United States Patent 12,397,048 (BUNYAVIRALES VACCINE) - sequence listing, part 14

SEQ ID NO: 15186 - RNA, 5100 nt, synthetic construct
  misc_feature 1..5100: note = derived and/or modified CDS sequence (opt11) from CCHFV(UCCR4432)__KY484047.1__GP
  source 1..5100: mol_type = other RNA
atgttctgcctgcgcctcgtgctgctgatcaacttggccctgtgccagctgctcgagggcaacgacggggtcaccagcgccgacgagatcaactccaacaccacgcagaccagcctcggcttacctaccatcctcaactccaccacgcccgcacctgggcccagcatcgacgctaccatggaggcggtgcctggaaccacgaactccgtgctggagacgcaggtcaccatggacagcgggtccggcgagctgagcactgacccgaccacgacccgggaggccaccacccccatcacggccgcgaccgtgtccgcccaggagaccaagacccacatgacgcagaaccccggcaccaccgtggaccctgacaccactactagcaacaccaccacttccatcgagccgatcaccaccccgcccaccagcccgacgccccaggccaccccaacgccctcctacagcgaaacccccacgctcccgaacacccatcatctgtcccgcagcctgctctccgccgtaggcaccgaggcgggccagacagcccccgccacccctacggccgaggtggccctggcgcccgggggcagctccaccgccgagtcaaacaccatcagcatcccggcccaggacaccacgatatccggggtaagcaagcaggataatcccaccaccaccggcatctcgcctgaggcccagacgatgcagagccagcaagccgtcgcgcccgtgaccacccctgccacggctatctccgccccgacgagccccaccaacagatccaaacgcgagagcaaggtgcagatcattctgaccttcccccagggcctcaagaagtactactccaaaatcctgaagttcctgcatctcacccaggaggaggacagcgaggggctgctcgagtggtgcacgcgggtcctccagcaggtctgcgacgacacctacttcaacgagcgcatcaaggagttcttcataacaggcaaggggtacttcaacgacgtcctgcagttcaagctgcacgacaccccggccacgaccgtccccgcgctcgcggcctccagcaccgcgatgcccttccggtcctactacgccaagggctctctgaccctggactccggctacttcagcgcgaagtgctacccacgcgccagtaacagcggaatgcaactcatcaacgtgacgcagcaccccatgaagatagcaaacacccccggacccaagatatccaacctgaagaccatcaactgcatcaacctgaaggtgagcaccgacaaggagcacagcgagttggaaatcaatgtcctgatcccccaggtggccgtgaacctgtccaactgcttcgtcagcattaagtcccacgtgtgcgactacagcctcgacacggacggggccatccggctgcccaaggtggcccacaacggcgtcttcatgccagggacctacaagatcgtgatcgacaagaagaataagctgaacgaccgctgcgccctcatcaccaactgcgtcatcaagggccgggaggtgaggaagggccagtccaccctgcggcagtataagacggagatccgcatcggccagaccatcgccggcagccggcgcctgctcgccgagggggtgtccaacgattgcgtcagccggacccagctgatcaagaccgaggtggcggagatccatgaggactcgtacggcgggcccggcgagaagatcaccatctgcaacggcagcaccatcgttgaccagcgccttgggtccgagctcggctgctataccatcaaccgggtgaaaacatacaagctgtgcgagaacagcgccaccgagaaggggtgcgagatcgactccgtgccggtcaagtgcaagcagggcttctgcctgaaggtcacgcaggaggggcgcggccacgtgaaacttagccggggcaccgagatcgtgctcgacgtctgcgacacctcctgcgagctgatgatcccgaaggggaccggcgacatcctggtcgactgctcagggggccagcagcacttcctccaggacaacctgattgatctgggctgccccaacgtgcccctcttagggaagatggccatctacatctgccgcatgtccaaccatccgaagactacaatggccttcctgttctggttcagcttcggctacgtcattacgtgcatcgtctgcaaggtcttgttctaccttctgatcgtcataggtacactcagcaagaagctgaagcagtacagggagctaaagccccagacctgcatcgtgtgcgaatccacccccgtgaacgccatcgacgcggagatgcacgagctcaactgcaactacaacatctgcccgtactgcgccagccggctgacctccgacggcctggtccgacacgtgaaccagtgcccgaaacggaaggagaaagtcgaagagaccgagctctacctgaacttggagcgcatcccttggctcgtccggcgcctgctgcaggtcagcgagtctacgggtatggccctcaagcggagctgctggatgactaccctgctgatcctcctggtggtgtccctgagccccgtgcagtccgcccccgtgggtcagggcaaggccgtcgaggtgtaccgcgtgcgggagagctacacctccatctgcctcttcgtcctggggagtgtgctgttcgcggtgtcctggctcatcaagggcctgatcgacgggatcggcaacagcttcttcccggggctgtccgtctgtaagacgtgcagcatcggctccatcaacggcttcgagatcgagagtcacaagtgctactgctccctcttctgctgcccctactgccgggcgtgctcgagcgacaagatcacccaccggatgcacctgaacgtgtgcaagaagcgcaaggccggatccaacgtgatgctggccgtttgcaagcggatgtgcttcaaggcgaccgtggaggccagcaacaccgccctcctgatccgcggcataatcaactccactttcgtgatctgcgtactgatcctcgtgatctgcgtggtaagcacctccgccgtcgacatggagaacctgccagccgggatctgggagcgtgaggaggacctgaccaacttctgccaccaggagtgccaggtgactgagacggaatgcctctgcccctacgaggcgttaatcctgcgcaagccgctctacctggacagcatcgcgaagggcatgaagtccctgctgaacagcaccaatcttgagacctccctgagcatcgaggccccctggggcgccatcaacgtccagtccaccttcaagcccacggtgagcgccgcgaacattgccctctcctggagctccgtggagcaccgaggcaacaagatcctggtcagcggccgctccgagagcatcatgaagctggaggagcggacggggatctcctggagccttggcgtggaggacgccagcgaatccaaaacgctgaccgtcagcgtgatggacctgtcccagatgtacagccccgtgtttgagtacctctccggggaccgccaggtcgaggagtggcccaaggcgacgtgcaccggcgactgccaggagcgctgcgggtgcaccagcagcacgtgcctgcacaaggagtggccccacagccggaactggcgatgcaaccccacctggtgttggggcgtgggcaccgggtgcacgtgctgcggcctggacgtgcgggacctattcaccgactacatgatggtcaaatggaaggtggagtacgtgaagaccgaggccatcatgtgcgtcgagctgacctcccaagagcgccagtgcagcctcatcgaggcggggacccgattcaacttgggcccggtgaccatcaccctgtccgagccccgcaacatccagcagcggctgcccagcgagatcgtgacgctccaccccaagatcgaggagggctttttcgacctgatgcacgtccagaaggtgctgtccgccagcaccgtatgcaagctccagtcctgcacccacggggtccctggtgacctccaggtgtaccacgtggggaacctgttaaagggcgacaaagtcaacgggcatagtatccacaaaatcgagtcccacttcaacaccagctggatgagctgggacggatgcgacctggattacttctgcaacatgggcgactggcccagctgcacgtacaccggggttacccagcacaatcgcgccgccttcatcaacatgctgaacatcgagaccgactacacaaagacctttcatttccacagcaagcgggtaaccgcgcacggggacacgccgcagctcgacctgaaggcccgccccacctacggggccggcgaggtcaccgtgctggtggaggtcgccgacctcgagttacacaccaagaagatcgaggtgtccgggctgaagttcgccagcctcacgtgctccgggtgctatgcgtgcagcagtggcatcagctgcaaggttagaatccacgtcaacgagccggacgagttcaccgtgcacgtaaagtccagcgaccccgacgtcgtagccgccgggtccagcctgatggccaggaagatagagttcggcgcggactccaccttcaaggcgttcagctccatgcccaaaaatagcctgtgcttctacatcgtggagcgagactactgctccagctgcaccaacgacgacacccagaagtgcgtcgacacgaagttggagcacccccagagcatcctgattgaacacaaggggaccatcatcggcaagcagaacgacacgtgcagcaccaagacctcctgttggctggagagcgtgaagtcctttttctacgggctgaagaatatgctgggcggcatcttcggaaacgtgttcctgggcatcttcctcttcctggccccgttcgccctgttaatcttcttcttctttttcgggtggcgcctgctgttctgcctgaagtgctgccgccgcacgcggggcctcctgaagtacaaacagctgaaggacgaggaggaggccggctacaagaagatcatcgagcgtctaaacgacaagaaggggaagtcccggctgttcgacggcgagcgcctggccgaccgtaagatcgcggagctgttcagcaccaagacccacatcgggtaa

SEQ ID NO: 15187 - RNA, 5100 nt, synthetic construct; identical to SEQ ID NO: 11901
  misc_feature 1..5100: note = derived and/or modified CDS sequence (opt11) from CCHFV(Nakiwogo)__KX013484.1__GP
  source 1..5100: mol_type = other RNA

SEQ ID NO: 15188 - RNA, 5100 nt, synthetic construct
  misc_feature 1..5100: note = derived and/or modified CDS sequence (opt11) from CCHFV(UG3010)__AY900143.1__GP
  source 1..5100: mol_type = other RNA
atgttctgcctgcgcctcgtgctgctgattaacctcgccttgtgccagctgctcgagggcaacgacggggtcacctctgccgacgagatcaactccaacaccacgcaaaccagcttaggcttacccactatcctcaactccaccacaccggcgcccgggcccagcatcgacgccaccatggaggccgtgcccggcaccactaattctgtgttagagacgcaggtcaccatggacagcgggtccggcgagctgagcaccgacccgaccacgacccgggaggccactacccccatcacggccgcgaccgtgtccgcccaggagaccaagacccacatgacgcagaacccaggcacaaccgtggaccccgacaccacgaccagcaacaccaccacgtccatcgagccgatcaccactccgcccacctctcccacgccccaggccacccccacccccagctactcggagacacctaccctgccgaacacccaccacttgtcccgcagcctgctctccgccgtcggcaccgaagctggtcagaccgcccccgccacgcccacggctgaggtggccctggcgcccgggggcagcagtaccgccgagagcaacaccataagcatcccggcccaggacaccacgatctccggcgtgagcaagcaggacaatcccaccacaaccggcatctcccccgaggcccagacgatgcagagccagcaggccgtcgcgcccgtgacgaccccggccaccgcaatctcagcccccacgtcacccactaaccggtcaaagcgcgagagcaaggtacagatcatcctgactttcccccagggactcaagaagtactactccaagatcttaaagttcctgcacttaacccaagaggaggacagcgaggggttgctggagtggtgcacgcgtgtactccagcaggtctgcgacgacacctacttcaatgagcgcatcaaagagttcttcatcaccggcaagggttactttaacgacgtgctgcagttcaagctgcatgacaccccagccacaaccgtccccgcgctcgccgcctccagcaccgccatccccttccggtcctactacgccaagggcagcctgaccctggacagcggctactttagcgcgaagtgctacccccgcgcctcgaacagcggaatgcagctcattaacgtgacgcagcaccccatgaagattgcgaacacccccggccccaagatctccaatctaaagaccataaattgcatcaacctgaaagtgagcacggacaaggagcattctgaactcgaaatcaacgtcctgattccccaggtggccgtaaacctgtccaactgctttgtcagcatcaagtctcacgtatgcgactatagccttgacacagacggggcgatccggctgccgaaggtggcgcacaacggcgtcttcatgcccgggacttacaagatagttatagacaagaagaacaaactgaacgaccgctgcgccctcatcaccaattgcgtcatcaagggccgggaggtgcgtaagggccagtcaaccctgcgacagtataaaacggaaatccgcatcgggcagaccattgccggtagccgccgcctactcgccgagggggtatccaacgactgcgtcagtcgcacccagctgatcaaaacagaggtggcggagatccacgaggactcctacggcgggccgggcgagaaaatcacgatctgcaacggcagtaccatcgttgaccaacgcttggggtctgagctcggctgctacaccatcaaccgggtgaagacctacaaactgtgcgagaacagcgccactgagaaagggtgcgagattgactcggtgccggtgaaatgcaagcagggcttttgccttaaggtcacgcaggaagggagaggccatgtgaaactcagccggggcaccgagatagtgctggacgtctgtgacacctcctgcgagctgatgattccgaaggggaccggcgacatcctggtggactgcagcgggggccagcagcatttcctccaagacaacctgatcgacctgggttgccccaacgtgcctctgttagggaagatggcaatctacatctgccgcatgtccaaccaccctaaaaccaccatggcattcctgttctggttcagcttcggatacgtcatcacgtgcatcgtgtgcaaggtcttgttctacttgctgatcgtcatcgggaccctctctaagaagctgaagcagtaccgcgagctgaagccacagacctgtatcgtctgcgagtccacccccgtgaacgccatcgatgcggagatgcacgagttaaactgtaactacaacatctgcccttactgtgccagccggctgacctccgacggcctggtccgccatgtgaaccagtgcccgaagcgtaaagagaaggtggaggagacagagctgtacctgaatctggagcgcattccctggctcgtacggcgcctcctgcaggtaagcgagtccactgggatggccctcaagcggagctgctggatgaccaccctgctgatcctcctggttgtgtccctgagccccgtccagtccgcccccgtaggacagggcaaagccgtcgaagtgtaccgcgttcgggaaagctatacctccatctgcctattcgtcctgggttctgtgctgttcgcggtctcctggctcattaagggactgatcgacgggatcggcaactcgttcttccctgggctgtccgtttgcaagacgtgcagcataggctccatcaacggcttcgagatcgagagccacaagtgctactgttccctcttctgttgcccctactgtcgcgcctgctcgagcgacaagatcacccaccggatgcacctgaacgtgtgcaagaagcgcaaggcggggtccaacgtgatgctggccgtctgcaagcggatgtgtttcaaggctaccgtggaggccagcaacaccgccttactgatccgcggcatcatcaactccacgttcgtgatctgcgtcctgatcttagtgatctgcgtggtcagtacctccgccgtggacatggagaacctgcccgcggggatatgggagcgggaggaagacctgaccaacttttgccatcaggagtgccaggtgaccgagacggagtgcctctgcccctatgaggcgctgatcctgcgcaaaccgctctacctggacagcattgccaagggcatgaagtccctgctgaacagcaccaacttggagacctccctgagcatcgaggccccttggggcgccatcaacgtccagtccactttcaagcccacggtgagcgccgcgaacatcgccctctcttggagctccgtggagcaccggggtaataagatcctggtcagcggccgctccgagagcataatgaagctggaggagcgaactgggatctcctggagcctcggcgtagaggacgccagcgagtccaagacattaaccgtcagcgtgatggacctatcccagatgtacagcccggtgtttgagtacctaagcggggaccgtcaggtcgaggaatggcccaaggctacgtgcactggcgactgccaggaaagatgcgggtgcaccagcagcacgtgcctgcacaaggagtggccccacagccggaactggcgatgcaaccccacctggtgctggggcgtgggcaccgggtgcacgtgctgcgggcttgacgtgcgggacctcttcaccgactacatgatggtcaagtggaaggtggagtacgttaagaccgaggccatcatgtgcgtcgagctgacctcccaggagcgacagtgcagcctgatcgaggcggggacccggtttaacctcggcccggtgaccatcaccctgtccgagcctcgcaacatccagcagcggctgcccagcgaaatcgttacactccaccccaaaatcgaggagggcttcttcgacctgatgcacgttcagaaggtgctgtccgccagcaccgtgtgcaagctccagtcctgcacccacggggtcccgggcgacctccaggtgtaccacgtggggaacctgctcaagggcgacaaggtaaacggtcacagcattcacaagatcgagtcccactttaacacctcatggatgtcctgggacggatgcgacctggactacttctgcaacatgggcgactggcctagctgcacgtacaccggggtcacccagcacaacagagccgcctttattaacatgctgaacatagagaccgattacacgaagaccttccacttccacagcaaacgggtgaccgcgcacggcgacacgcctcagttggacttgaaggcgcgccctacttacggggccggcgaagtcaccgtgctggtcgaggtcgctgacctcgagctgcacaccaagaagatcgaggtgtccggtctgaagttcgccagcctcacgtgctctggctgctacgcgtgctctagcggcatcagctgcaaggtgcggatccacgtcaacgagccggacgagttcaccgtgcacgtaaagtctagcgaccccgacgtcgtggccgccgggagcagcctgatggcccgcaaaatcgagttcggcgccgactccaccttcaaggcgttcagctccatgcccaagaacagcctgtgcttctacatcgtggaacgggactactgctccagctgcaccaacgacgacacccaaaagtgcgtcgacacgaaactcgagcacccccaatccatcctgatcgagcataaggggactatcatcggcaagcagaacgacacgtgcagcaccaagacttcctgctggctggagtctgtgaagtccttcttctacgggctcaagaacatgctgggcggcatcttcggaaacgtgttcctgggcatcttcctcttcttggccccgtttgcactgctcatcttcttcttcttcttcgggtggcgcctactgttctgcttaaaatgctgcagacgcacccggggcctcctgaagtacaaacagcttaaggacgaagaggaggccggctataagaagatcatcgagcgactgaacgacaagaagggcaagagccggctattcgacggggaacgcctcgccgaccggaagatcgccgagctgttcagcaccaagacgcacatcgggtga

SEQ ID NO: 15189 - RNA, 5100 nt, synthetic construct
  misc_feature 1..5100: note = derived and/or modified CDS sequence (opt11) from CCHFV(Semunya)__DQ094832.1__GP
  source 1..5100: mol_type = other RNA
atgttctgcctgaaactcgtgctgctgatcaacctcgccctgtgccagttattggagggtaacgatcgcgtgaccagtgccgacgggataaactccaacaccacgcagaccaacctgggcattagtaccatcttgaactccaccacccccgcgccagggcccagcactgacaccaccatggagacggtgcccagcaccgccgatagcatgctcgagacccaggtgaccacggactccggctcgggggagccctccacagagccgactaccacgggcgaggccacctcctccaccaccgccgccacggtcagcatgcaggagacaaagacccacatgacacagaacacgcggtccaccgcggaccccgacaccacgacgcccaataccaccacctcggtggagcccacgaccatcccgcccacctcccctatccttcaggccacccccacgccgggccacggcaaggcccccaccctgcccaacacccaccacctcagccgctccttgctgagcgccgtgtccaccgaggcgggtcagaccacgcccgccaccagcaccaccgaagcggccagcgccccgtcttcgtccagcacggcagaaaataacaccatgttccagcccgcgcaggacaccaccacgtctggagtcagcgagcagtataaccccaccaccaccggcatcagccccaaggcccagacaatgcaggcccagcaagccatagtgccggtgaccacccccgtcaccacgaccttcacccccatcaaccccaccaaccggagcaagcgcgagtccaaagtgcagatcatcctaacgttccctcaggggctgaagaagtactatagcaaaatcctgaagctcctgcatttgacccaggaagaagactccgagggcctcctggaatggtgcacccgggtactccagcaggtctgcgacgacacctacttcaacgagcgcatcgaggagttcttcatcacgggtaagggctacttcaacgacgtgttgcagttcaaactgcacgacacccccaccactacggtgcccgcgctggccgcatcatccaccgcaatgcccttccggagctactacgccaagggatccctcaccctggactccgggtacttctcagcgaagtgctatccgagggccagcaactccgggatgcaactgataaatgtcacccagcaccccatgaagatcgccaacacgcccggaccgaagaccagcaacctcaaaaccatgaactgcatcaacctgaaggttagcaccgacaaggagcacagcgagctggagatcaacgtactcatcccccaggtggccgtgaacctgagcaactgcttagtgtccatcaagagccacgtctgcgattactccctcgacacggacggggccatccggctgcccaaggtggcctacaacggcgtattcatgcctgggacatacaagatcgtcatagacaagaagaacagactgaacgaccggtgcgcactcatcaccaattgcgtaatcaaaggccgcgaggtccgtaaggggcagagcaccctgcgccagtataagaccgagatccggattggccaaacactgatgggctcccgccggctcctggccgagggggtgtcaaacgactgcgtgtcccgcacccagctgatcaagacggaggtcgccgagatccacgaagacagctacggcgggccgggcgagaagatcactatctgcaatgggtccacgatcgttgaccagcgacttggcagcgagctgggctgctacaccatcaaccgcgtgaagacctacaagctgtgcgagaactccgcgaccgagaaaggatgcgagatcgacagcgtccccgtcaagtgcaagcagggcttctgcctcaaggtgacgcaggaggggcggggccacgtaaagctatcccgggggaccgagatcgtgctggacgtgtgcgacaccagctgcgagctcatgatccccaagggcaccggcgacatcctcgtcgactgctccggtggccagcagcacttcctgcaggacaacctgatcgacctcgggtgccccaacgtgcctctactgggcaagatggccatctacatctgccgcatgagcaaccaccccaagacgaccatggccttcctcttctggttcagcttcggctacgttatcacctgtgtcgtgtgtaaggtgctgttctacttactcatcgtcatcgggaccctgggcaagaagctgaagcagtaccgggagttgaagccccagacgtgcatcgtgtgcgaatccatccccgtgaacgcgatcgacgccgagatgcacgagctgaactgcaactacaacatctgcccgtattgcgcgagccgcctgacctccgacgggctcgtccgccacgtgacccagtgcccgaagcgcaaggagaaggtggaagagaccgagttgtacctaaacctcgaacggatcccctggctggtacgccggttgctccaggtcagcgagtccacgggcatggccctgaagcgatcgtgttggatgaccaccctgctcatcctgcttgtggtctccctcagccccgtgcaatccgctccggtagggcaggaaaaggccatcgaggtgtaccaggtacgggaaagctacaccagcatctgcctgttcgttctgggcagcgtcctcttcgccgtgtcctggttagtcaagggactgatcgacggcatcggcaacagcttcttcccggggctatccgtctgcaagacgtgctcgatcggttccattaacgggttcgagatcgagtcacacaagtgctactgctccctgttctgctgcccctactgccgcgcatgcagcagcgacaagatcacccataggatgcacctgaatatctgcaaacgccggaaggtcggctccaacgtgatgctcgccgtctgcaagcgcatgtgcttcaaggccaccgtggaagcaagcaactccgccttactgatccggagcatcatcaactccaccttcgtgatctgcgtcctcatcctggtgatctgtgtggtcagcacatccgcggtggacatggagaacctgcccgccggcatctgggagagagaggaggacctcaccaacttctgccaccaggagtgtcaggtgaccgagacagagtgcctgtgcccgtacgaggcactgatcttgcggaagcccctgttcctggacagcatcgcgaaggggaagaagtccctcctgaacagcactaacctggagacctccctcagcatcgaggctccctggggcgcgatcaacgtgcagtccaccttcaagccgaccgtgagcgccgccaacatcgccctgtcctggagctcggtggagcaccgcgggaacaagatcctcgtctccggccggtccgagagcatcatgaagctcgaggagcgcacggggatcagctggtccctgggggtggaggacgcgagcgagtctaagaccctgacggtcagcgtgatggacctctctcagatgtacagcccggtgttcgagtacctgtccggcgaccgccaggtagaagaatggcccaaagccacctgtaccggggactgtcccgagcggtgtggctgcacgagctccacctgtctacacaaggagtggccgcacagccgcaactggcggtgcaatcccacctggtgctggggcgtggggaccggatgcacgtgctgcggcttagacgtgcgcgacctgttcacggactacatgatggtcaagtggaaggtggagtacgtgaagaccgaggccatcatgtgcgtcgagctgacctcccaagagcggcagtgcagcttaatcgaggccggcacgcgcttcaacctggggcccgtgaccataaccctgtccgagccccggaacgtgcagcagcgcctgccgagcgagatcgtcaccctgcaccccaaaatcgaggagggcttcttcgacctgatgcacgtacaaaaggtgctgttctgcaaatactccctgcaggccaccagctgcacccacggggtccccggcgacctccaggtgtaccacgtgggcaacctcctcaaaggggataaggtcaacggccactccatccacaagatcgagagccactttaacacctcctggatgagctgggacgggtgcgacctggactatttctgcaacatgggcgactggcccagctgcacctacacgggggtgacccagcacaaccgcgcggccttcgtgaacatgctcaacatagagaccgactacaccaagacgtttcatttccactccaagcgcgtaaccgcacacggcgacaccccgcagctggatttaaaagcccgtcccacctacggcgccggagaggtgacggtgctcgtggaggtggcggacctggagctgcatacgaagaagatcgaagtaagcggcctcaagttcgctagtctgacatgcagcgggtgctatgcctgctcctctggcatctcttgcaaggtccgaatccacgtgaatgagcccgacgagtttaccgtacacgttaagagcaacgaccccgacgtggtggcagccggctccagcctgatggcccggaagatagagttcggcgccgactccacgttcaaggcattcagctccatgccgaagaatagcctctgcttctacatcgtcgagcgggactactgcagtagctgcaccgacgacgacacccagaagtgtgtaaacataaagctggagcacccccagtccatcttaatcgagcacaagggcaccatcatcgggaagcagaacgacacgtgcccaaccaaaaccagctgttggctcgagtccgtcaagagcttcttctacggcttgaagaacatgctcgggggcatcttcgggaacgtgttccttggcattttcttattcctggcccccttcgctctcctgattctgttctttttcttcggctggcggctgctgttctgcctgaagtgctgccgccgaactcgcggactgctcaagtacaagcagctgaaagacgaagaggaggccggttacaagaagatcatcgagaggctgaatgacaagaagggcaagagccgcctcttcgacggggagaggctggccgaccgcaagatagccaagctgttctccactaagacccacataggctga

SEQ ID NO: 15190 - RNA, 5094 nt, synthetic construct
  misc_feature 1..5094: note = derived and/or modified CDS sequence (opt11) from CCHFV(79121)__AB069673.1__GP
  source 1..5094: mol_type = other RNA
atgctgttccactttaagttcatgctcctgatcaacttcatcctatgccacctcctgtggggcgggggcggggttacaggcggtgtagagaccaacagctccagcactcaagccatccaaaccccaccggttacctccaacagcaccacgcccggccccagcaccgacaccgccacagagacggcgagctccatgaccaccagcacccccgacactcaggtgaccaccgacaacggctccggggagccgagcaccgaccccctgacgactaacgaggccaccccgcccctctccgtcacgacagcccagaccaccgagacaaagaagcatacgaccctggacccatccacctcgaccaaccccgatgcgactaccccctcgatcaccatcctgtccgccagcaatacctcactccccatcagctccgtgcatgcaagcccgagccccagcagctccgaggagcccacgccccagaacgctcaccacctgagccgctccctgctcagcgccgtgtccaccgagaccggccagatcgcaagcgcggccaccgccgccaaggagatcacgaccaagaatagcccgcccaccgcagggaacgacaccatggtcaccagcgcgcccaacggcaacatccggaatacgcccgagcaggctaatccgaccgccccggaggcctcacccaagatccaaacaacccagaatcagcagactgtgaccccagaggccaccccgatcaccacgatcaccgcgctgacagacctgaccaaccgcagcaagcgggattccaaggttcagaagatcctcacgttcagccaggggctgaagaaatactactcaaagatcctgaaactcctgcagctgacccaggaggaggactcggaaggcctcctggagtggtgcacccgcgtcctggagcaggcgtgcgacgacgactacttcaataagcggatcgaggagttcttcatcaccggcaaggggtacttcaacgacgttctccagttccgcctgcacgacgccctgtccaacacggagcccgcacagaccaccagccccacggccgtgcctttcaagtcctactacgcgaagggcagcttaacgttcgacagcgggtatttctccgcccggtgttacccgcgcgcatcaaactccggcctacagctgataaacgtcacccagcaccccgtgaagatcgccaacactcccgggccgaagctcagcaacctgaagaccatcaactgcatcaacctgaaggtgtccactgacaaggagcatagcgagctcgaggtcaacgtcctgttgccccaggtggccgtaaacctctcgaactgccacgtgagcatcaagtcccacgtgtgcgattacagcttggacaccgacggggcgatcaagctgccccgggtcgcccacaacggcgtgttcatccccgggacctacaaaatcgtgatcgataagaagaacaacctcaacgaccgctgcaccctgatcacgaactgcgtcatcaagggccgggaggtgcgcaagggtcagtccgccctgcgccagtacaagaccgagatccgcatcggccagaccttcaccggcagccgtcgcctcctggcggaagggggctccagcgactgcatctcccggacgcagctggtcaagaccgaggtggcggagatccacgaggacagctacggcgggcctggagagaagatcaccatctgcaacggctccaccatcgtggaccagggcctcgggagcgaactgggctgctacacgatcaaccgcgttcggagctacaagctgtgtgaaaactcggccagcgggaagtcctgcgagatcgacagcatccccgtgaagtgcaagcagggcttttgcctcaaaattacccaggaagggcgaggccacgtgaaactttccagaggcaccgagatcgttctagacgtgtgcgatagcagctgtgagctcatgatccccaaggggacgggcgacatcctagtggactgcagcgggggccagcagcacttcctgcagaacaatctgatcgacctcggatgccccaacgtccctctgctggggaaaatggccatctatgtttgccgcatgtccaaccaccccaaaaccacgatggcattcctcttctggttcagcttcgggtatgtaattacctgcatcgcctgccgtgtcctgttctatctgctaatcgcgatcgggaccgtgggaaagaaactgaagcagtaccgggagctgaagccccagacctgcatcgtgtgtgagtccgtccccgtgaacgcaatcgacgccgagatgcacgagctcaactgcagctacaacatctgcccgtactgcgcctcccgcctgagcacggacgggttaatcagacacgttacccaatgccccaagcgccgtgagaaggtcgaagagaccgagttatttttgaacttggagcgcatcccctggctcgttcggaagctgctccaggtgtccgagagcaccggcatggccctcaagcgctcgtgttggatgatcacgctgctgatcctgctgctggtcagcatctcccccgtgcagagcgcgccggttggcaaggagcgggccatagagacctaccaggcccgcgagacttacaccgggatctgcctcttcgtcctgggctcagtgctgttcgcggtatcctggctcacgaaggccctgatcgacgggatagggaacagcttctcccccggactgagcgtctgcaagacctgctccattggcagcatcaacggcttcgagatcgagtcccacaagtgctactgctccctcttctgttgcccctactgccgggcgtgctcctcggacaagaacacgcaccgaatgcacctgaacgtgtgcaagaaacggaagatgggatcaaacgtgatgctcgccgtctgcaaacgcatgtgcttccgggccactattgaggccagcaacaaggcgctcctgattcgctccatcatcaatagcacgttcgtgatctgcatactgatcctcaccatctgtgtggtctccacgagcgccgtggacatggagaacctaccagccggcatctgggagaaggaggaggacctcaccaatttctgccaccaggaatgccaggtgacggagaccgagtgcctctgcccgtacgaagccatggtcctgcgaaagcccctgtttttggactcgaccgccaaggggatgaaaagcctgctgaactccaccagcctcgagacgagcctctccatcgaggcgccctggggcgccatcaacgtgcagagtaccttcaagcccaccgtgtccgccgccaacatagccctgagctggtccagcgtcgagcaccgcgggaacaagatcctcgtgtccggccggtcagagtccatcatgaaactggaggaacgcaccggggtgagctggaacctgggggtcgaggacgcgtccgagagcaagacgctcaccgtgtccgtgatggacctttcgcagatgtactccccggtcttcgagtacctcagcggcgaccgccaggtggaagagtggcccaaggctacctgcaccggagactgccctgaacggtgcggctgcacctccagcacctgtctccacaaggagtggccgcactccaggaactggcggtgcaaccccacctggtgctggggcgtggggaccggctgcacgtgctgcgggctggatgtcaaagacttcttcaccgactacatgctggtgaagtggaaggtggagtacatcaaaaccgaggccatcgtctgcgtggagctcaccagccaggagcgccagtgcagcctgatcgaggccggcacccggttcaacctcgggcccgtcacgatcaccctctctgagccgcgcaacgtacagcagcgcttaccgcccgagatcgtgaccctgcaccccaagatcgaggagggctttttcgacctaatgcacgtacaaaagatcctgagcgccagcacagtgtgcaagctgcagtcttgcacacacggcgtgcccggcgactttcaaatatatcacgtcggcaacctcctgcgtggggacaaggtaaatggccactccatccacaagatcgagccgcacttcaataccagctggatgtcctgggacgggtgcgacctggattacttctgcaatatgggcgattggcccagctgcacctacactggcgtaacccagcacaaccgtgccgccttcatcaacatgctcaacatcgagaccgactatacaaagaccttccacttccactccaagcgcgtcacagcgcacggtgatacgccccagctggatctgaaggcgcgtcccgcgtatggagcaggggaggtgaccgtcctcgtcgaggtggctgacctggagctgcacaccaagaacctagaggtgagcggcctgaagatcgcttccctgacctgcagcgggtgctacgcctgttcctcgggcatctcctgcaaggtccgcatccacgtgaacgagccggacgagttcaccgtacacgtccggagctcggaccccgacgtggtggcggcaggcagctccctaatggcccgcaagatagagttcggcgccgacagcacattcaaggccttcagctccatgcccaaggatagcctgtgcttctacatagtggagaaggattactgctctagctgcaccgacgacgacacgcagaagtgcgtaaacacgaaactggatcacccccagtccatccttatcgagcacaaaggcaccatcatcgggaagcaaaacgacacgtgcagcacgaaaacctcctgttggctggagagcgtgaagggcttcttctacgggctgaagaacatgttatccggcatcttcggcaacgtcttcctgggaatcttcctgttcctcgcgccgttcgttctgctgatattctttttcttcttcggctggcggctcctgttttgcctgaagtgctgccgccgaacccgcgggttactcaagtacaagcacctaaaggatgaggaggaagccggctacaagaagatcatcgagcggctgaacggcaagaagggtaagtcccagctgttcgacggcgagcgcctcgcggaccggaaaatagcggaattattctccaccaagatccacatcgggtga

SEQ ID NO: 15191 - RNA, 5094 nt, synthetic construct
  misc_feature 1..5094: note = derived and/or modified CDS sequence (opt11) from CCHFV(7001)__AB069670.1__GP
  source 1..5094: mol_type = other RNA
atgctgttccacttcaaattcatgctcctgatcaacttcatcctgtgccacctcctgtggggtgggggcggggtgaccggcggggtcgagaccaacagctcctcgacgcaggccatccagacgccgccggtgacctccaacagcaccacccccggcccctccaccgacacagccaccgagacggcgagctccatgaccaccagcacccccgacacgcaggtcaccaccgacaacggctccggggagccgagcaccgaccccctgacgaccaacgaggccaccccgcccctctccgtcaccacggcccagaccaccgagaccaagaagcacacgaccctggatcccagcacctccaccaatcccgacgccacgacccccagcatcaccatcctgtccgccagtaacacatccctccccatcagctccgtgcacgcgagcccgagcccctccagctccgaggagcccacgccccagaacgcccaccacctgagccgctccctgctcagcgccgtgtccaccgagaccggccagatcgccagcgcggccaccgccgccaaggagatcacgaccaagaactccccgcccaccgccgggaacgacaccatggtcacgagcgcgcccaacggcaacatacgcaacacgcccgagcaggccaacccgaccgcccccgaggcctcccccaagatccagactacccagaatcagcaaacggtgacccccgaggccaccccgatcaccacgatcaccgcgctgaccgacctgaccaaccgcagcaagcgggactccaaggtacagataatcctcacgttcagccaggggctgaagaagtactactccaagatcctgaagctcctgcagctgacccaggaggaggacagcgagggcctcctggagtggtgcacccgcgtcctggagcaggcctgcgacgacgactacttcaacaagcggatcgaggagttctttatcaccggcaaagggtacttcaacgacgtgctccagttccgcctgcacgacgccctgtccaacacggagcccgcccagaccaccagccccaccgccgtgccctttaagtcctactacgcgaagggcagcctcacgttcgacagcgggtacttctcagcccggtgctacccacgtgccagcaactccggcctgcagctgatcaacgtaacccagcaccccgtgaagatcgccaacacccccggcccgaagctcagcaacctgaagaccatcaactgcatcaacctgaaggtgtccacggacaaggaacacagcgagctcgaagtcaacgtgctgctgccccaggtggccgtcaacctctccaactgccacgtgagcatcaagtcccacgtgtgcgactacagtctggacaccgacggtgcaatcaagctgccccgggtcgcccacaacggcgtgttcatccccgggacctacaagatcgtgatcgacaagaagaacaacttgaacgaccgctgtaccctgatcacgaactgcgtcatcaagggccgggaggtgcgcaaggggcagtccgccctgcggcagtacaagaccgagatccgcatcggccagaccttcaccggcagccggcgtctcctggccgagggcgggtccagcgactgcatctcccggacgcagctggtcaagaccgaggtggcggagatccacgaggacagctacgggggcccgggggagaagatcaccatctgcaacggctccaccatcgtggaccagcgcctcggcagcgagctggggtgctacacgatcaaccgggtgcgtagctacaagctgtgcgagaactccgccagcgggaagtcctgcgagatcgacagcatccccgtgaaatgcaagcaggggttttgcctcaagatcacccaggagggccgggggcacgtgaagctgtcccgcggcaccgagatagtcctggacgtgtgcgacagctcctgcgagctgatgatccccaagggcaccggggacatcctcgtggactgcagcggcgggcagcaacacttcctgcagaacaacctgatcgacctcgggtgcccgaacgtcccgctgctgggcaagatggccatctacgtgtgccgcatgtcaaaccaccccaaaaccacgatggccttcctcttctggttcagcttcgggtacgtgatcacgtgcatcgcctgccgggtactgttctacctgctcatcgcgatcggcaccgtggggaagaagctcaagcagtaccgcgaactgaagccccagacttgcatcgtgtgcgagtccgtccccgtgaacgccatcgacgccgagatgcacgagctcaactgtagctacaacatctgcccgtactgcgccagtcggctgagcaccgacggcctgatccgccacgtgacccagtgccccaagcggcgcgagaaggtcgaggagaccgagctgttcctcaacctggagcggatcccctggctcgtgcgcaagctgctgcaggtctccgaaagcaccgggatggccctcaagcggtcctgctggatgatcacgctgctgatcctcctgctggtgagcatctcccctgtccagagcgcgccggtgggcaaggagcgcgccatcgagacctaccaggcccgggagacctacaccggcatctgcctcttcgtcctgggaagcgtgctgttcgccgtctcctggctcactaaggccctgatcgacggcatcgggaacagcttcttccccggcctgtccgtctgcaagacctgcagcatcggatccatcaacggcttcgagatcgagagccacaagtgctactgctcgcttttctgctgcccatattgccgcgcgtgcagctccgacaagaacacccaccggatgcacctgaacgtgtgcaagaagcgcaagatgggcagcaacgtgatgcttgccgtctgcaagcggatgtgcttccgcgccaccatcgaggcctccaacaaggcgctcctgatccggagcatcatcaactccacgttcgtgatctgcattctgatcctcaccatctgcgtagtcagcacctccgccgtggacatggagaaccttcccgccgggatctgggagaaggaggaggacctgaccaacttctgccaccaggaatgccaagtgacggagaccgaatgcctctgcccgtacgaggccatggtcctgcgcaagcccctcttcctcgacaacattgctaagggcatgaagtccctgctaaacagcacctcactcgagacctccctgagcatcgaggcgccgtggggcgccatcaacgtgcagagcacgttcaaacccaccgtgtccgccgccaacatcgccctgagctggtccagcgtcgagcaccgggggaacaagatcctcgtgtccgggcgcagcgagtccatcatgaagctggaggagcgcaccggcgtgagctggaacctgggcgtcgaagacgcgtccgagagcaagaccctcacggtgtccgtgatggacctgagccagatgtactccccggtcttcgagtatctgagcggggacaggcaagtggaggagtggcccaaggcgacctgcaccggcgactgccccgagcggtgcggctgcacctccagcacgtgcctccacaaggagtggccgcactcccggaactggcgctgcaaccccacctggtgctggggcgtggggaccggctgcacgtgctgcggcctggacgtcaaagacttcttcaccgactacatgctggtgaagtggaaggtggagtacattaagaccgaagccatcgtctgcgtggagctcaccagccaggagagacagtgctccctgatcgaggccgggacccgcttcaacctgggccccgtcaccatcacgctcagcgagccccggaatgtgcagcagcgcctgccgcccgagatcgtgaccctgcaccccaagatcgaggaggggttctttgacctcatgcacgtccagaagatcctgagcgcctccaccgtgtgtaagctgcagtcatgcacccacggcgtgcccggcgacttccaggtctaccacgttgggaacctcctgcggggcgacaaggtgaacgggcactccatccacaagattgagccgcacttcaacactagctggatgtcctgggacggctgcgacctggactacttctgcaacatgggagactggcccagctgcacctacaccggcgtcacccagcacaaccgcgccgccttcatcaacatgctcaacattgagacggactacaccaagaccttccacttccactccaagagggtgaccgcccacggcgacacgccccagctggacctgaaagcccgccccgcgtacggggccggggaagtgaccgtcctcgtggaggtggccgacctggagctgcacaccaagaagctcgaggtcagcgggctgaagatcgcctccttgacctgcagcggctgttacgcctgctccagcgggatctcctgcaaagttcggatccacgtgaacgagccggacgagttcacggtccatgtgcgcagctccgaccccgacgtggtcgcagccggtagctcgctcatggcccggaagatcgagttcggcgccgacagcaccttcaaggccttctccagcatgcccaaggacagcctgtgcttctacatcgtggagaaggactactgttccagctgcactgacgacgacacccagaagtgcgtgaacacgaagctggaccacccccagtccatcctcatcgaacacaaggggaccatcatcggcaagcagaacgacacgtgcagcaccaagacctcctgctggctggagagcgtcaaggggttcttctacggcctgaagaacatgctctccgggatattcggcaacgtgttcctgggcatcttcctgttcctcgcgccgttcgtgttgctgatattcttcttcttcttcgggtggcgcctcctgttctgcctgaagtgctgccggcgcacccggggcctgctcaagtacaagcacctgaaggacgaggaggaggccgggtacaagaagatcatcgagcgcctgaacggcaagaagggcaagagccagctgttcgacggggagcggctcgccgaccgcaagatcgccgagctgttttccaccaagatccatatcggctga

SEQ ID NO: 15192 - RNA, 5094 nt, synthetic construct; identical to SEQ ID NO: 11906
  misc_feature 1..5094: note = derived and/or modified CDS sequence (opt11) from CCHFV(YL16070)__KY354081.1__GP
  source 1..5094: mol_type = other RNA

SEQ ID NO: 15193 - RNA, 5094 nt, synthetic construct; identical to SEQ ID NO: 11907
  misc_feature 1..5094: note = derived and/or modified CDS sequence (opt11) from CCHFV(YL04057)__FJ562094.1__GP
  source 1..5094: mol_type = other RNA

SEQ ID NO: 15194 - RNA, 5094 nt, synthetic construct
  misc_feature 1..5094: note = derived and/or modified CDS sequence (opt11) from CCHFV(79121M18)__GU477493.1__GP
  source 1..5094: mol_type = other RNA
atgctgttccacttcaagttcatgctcctgatcaacttcatcctgtgccacctcctgtggggcgggggcggggtgaccggcggggtcgagaccaacagctccagcacgcaggccatccagacgcccccggtgacctccaacagcaccacgcccggcccctccactgacaccgccaccgagacggcgagctccatgaccaccagcacccccgacacccaggtgacaaccgacaacggctccggggagccgagcaccgaccctctgacgaccaacgaggccaccccgcccctctccgtcaccacggcccagaccaccgagaccaagaagcacacgaccctggaccccagcacatccaccaaccccgacgcaacgacccccagcatcacaatactgtccgccagcaacacctcccttcccatcagctccgtgcacgcgagcccgagcccctccagcagcgaggagcccacgccccagaacgcccaccacctgagccgctccctgcttagcgccgtgtccaccgagaccggccagatcgccagcgcggccaccgccgccaaggagatcacgaccaagaacagtccgcccaccgccggcaacgacaccatggtcaccagcgcgcccaacggcaacatccgcaacacgcccgagcaggccaacccgaccgcccccgaggcctcccccaagatccagaccacccagaaccagcagacggtgacccccgaggcgaccccgatcaccacgattaccgcgctgactgacctgaccaaccgcagcaagcgggactccaaggtgcagaagatcttaacgttctcgcaggggctgaagaagtactactccaagatcctgaagttgctgcagctgacccaggaggaggacagcgagggcctcctggagtggtgcaccagggtcctggagcaggcttgcgacgacgactacttcaacaagcggatcgaggagttcttcatcaccggcaaggggtacttcaacgacgtgctccagttccgcctgcacgacgccctgtccaacacggagcctgcccagaccaccagccccaccgccgtgcccttcaagtcctactacgccaagggcagcctcacgttcgacagcgggtacttctccgcccggtgctacccgcgcgccagcaactccggcctgcagctgatcaacgtcacccagcaccctgtgaagatcgccaacaccccaggcccgaagctcagcaacctgaagacaatcaactgcatcaacctgaaggtgtccacggacaaggagcacagcgagctcgaggtcaacgtgctgctgccccaggtggccgtcaacctctccaattgccacgtgagcatcaaatcccacgtgtgcgactactcgttggacaccgacggggcgatcaagctgccccgggtggcccacaacggcgtgttcatccccgggacctacaagatcgtgatcgacaagaagaacaacctcaacgaccgctgcaccctgatcacgaactgcgtcatcaagggacgggaggtgcgcaaggggcagtccgccctgcggcagtacaagaccgagatccgcatcggccagactttcaccggcagccgccgcctcctggccgaagggggctccagcgactgcatctcccggacgcagctggtcaagaccgaggtggcggagatccacgaggatagctacgggggcccgggggagaagatcaccatctgcaacggctccaccattgtggaccagggcctcgggagcgagctgggctgctacacgatcaaccgcgtccggagctacaagctgtgcgagaactccgcctctgggaagtcctgcgagatcgacagcatccccgtgaagtgcaagcagggcttctgcctcaagatcacccaggaggggcgcggccacgtcaagctgagtcggggcaccgagatcgtgctggacgtgtgcgacagctcctgcgagctgatgatccccaaggggaccggcgacatcctcgtggactgcagcgggggccagcagcatttcctgcagaacaacctgatcgacctcggctgccccaacgtcccgctgctggggaagatggccatctacgtttgccgcatgtccaaccaccccaagaccacgatggccttcctcttctggttcagcttcggctacgtgattacctgcatcgcctgccgagtcctgttctacctgctcatcgcgatcgggacagtgggcaagaagctgaagcagtaccgggagctgaagccccaaacctgcatcgtgtgcgagagcgtccccgtgaacgcaatcgacgccgagatgcacgagctcaactgcagctacaacatctgcccgtactgcgcctcccgcctgagcacggacgggctgatccggcacgtgacacagtgccccaagcgccgggagaaggtcgaggagaccgaactcttcctaaacctggagcgcatcccctggctcgtgcgtaagctgctccaggtgtccgagagcaccggcatggccctgaagcgctcctgctggatgatcacgctgctgatcctcctgctggtctcaatctcccccgtgcagagcgcgccggtgggcaaggagcgggccatcgagacataccaggcccgcgagacctacaccgggatttgcctcttcgtgctgggcagcgtgctgttcgccgtgtcctggctcacgaaggccctgatcgacgggatcggcaatagcttctccccggggctgagcgtctgcaagacctgctccattggcagcatcaacggcttcgagatcgagtcccacaagtgctactgcagcctcttctgctgcccctactgccgggcgtgctccagtgacaagaacacccaccgcatgcacctgaacgtgtgcaagaagcggaagatgggttccaacgtgatgctggccgtctgcaagcgcatgtgcttccgggccaccattgaggccagcaacaaggcgctcctgatccgctccatcatcaacagcacgttcgtgatatgcatcctgatcctcaccatctgcgtggtctccaccagcgccgtggacatggagaacctgcccgccggcatctgggagaaggaggaggacctgaccaacttctgccaccaggagtgccaggtgacggagaccgagtgcctctgcccgtacgaggccatggtcctgcggaagcccctgttcctcgattccaccgccaaggggatgaaaagcctgctgaactccaccagcctcgagacgagcttatccatagaggcgccctggggcgccatcaacgtgcagagcaccttcaagcccacagtgtccgccgccaacatcgccctgagctggtccagcgtcgagcaccgcgggaacaagatcctcgtgtccggccgaagcgagtccatcatgaagctggaggagcgcaccggcgtgagctggaacctgggcgtcgaggacgcgtccgagagcaagacgctcaccgtgtccgtgatggacctgagccagatgtactccccggtcttcgagtacctgagcggcgaccgccaggtggaggagtggcccaaggcaacctgcaccggggactgccccgaacggtgcggctgcacgtcctccacctgtctccacaaggagtggccgcacagccgcaactggcggtgcaaccctacctggtgctggggcgtggggaccggctgcacgtgctgcgggctggatgtcaaggacttcttcaccgactacatgctggtgaagtggaaggtggagtacatcaagacagaggccatcgtctgcgtggagctcaccagccaggagcgccagtgcagcctgatagaggccggcacccgcttcaacctggggcccgtcacgatcaccttatccgagccccgcaacgtgcagcagcggctgccgcccgagatcgtgacgctgcaccccaagatcgaggagggcttctttgacctcatgcacgtccagaagatcctgagcgcctccaccgtgtgcaagctgcagagctgcacgcacggcgtgcccggggacttccagatctaccacgttggcaacctcctgcgcggggacaaggtaaacggccactccatccacaagatcgagccgcacttcaacaccagctggatgtcctgggacgggtgcgacctggactacttctgcaatatgggagactggcccagctgcacctacaccggcgtgacgcagcacaaccgggccgccttcatcaacatgctcaacatcgagaccgactataccaagaccttccacttccactccaagcgcgtcacggcccacggggacacgccccagctggatctgaaggccagacccgcgtacggcgccggggaggtaaccgtgctcgtcgaggtggccgacctggagctgcacaccaagaagctcgaggtgagcggcctgaagatcgcctccctgacctgctcggggtgctacgcctgctccagcggcatctcctgcaaggtccgcatccacgtgaacgagccggacgagttcaccgtacacgtccggagctccgaccccgacgtggtggcggccggcagctccctcatggcccgcaagatcgagttcggggccgacagcaccttcaaggccttcagctccatgcccaaggacagcttatgcttctacatcgtcgagaaggactactgctccagctgcaccgacgacgacacgcagaagtgcgtgaacaccaagctggatcacccccagtccatcctcatcgagcacaagggcaccatcatcgggaagcagaacgatacctgcagcacgaagacctcctgctggctggagagcgtgaagggcttcttctacgggctgaagaacatgctctccggcatcttcggcaacgtcttcctggggatcttcctgttcctcgcgccgttcgtgctgctgatcttcttcttcttcttcggctggcggctcttgttctgcctgaagtgctgccgccgcacccgcgggctgctcaagtacaagcacctgaaggacgaggaggaggccggctacaagaagatcatcgagcggctgaacggcaagaagggtaagagccaactcttcgacggggagcgtctggccgaccggaagatcgccgagctgttctccaccaaaatccacatcggctaa

SEQ ID NO: 15195 - RNA, 5088 nt, synthetic construct
  misc_feature 1..5088: note = derived and/or modified CDS sequence (opt11) from CCHFV(ArD39554)__DQ211628.1__GP
  source 1..5088: mol_type = other RNA
atgctgtgccatatcaagcacatcctcctgttctgcatcatcctgtatcaccagcagtggaacactggagccagcaacacaacgatctcccccaccaccaacaagagccacacggacatatcacaccagccgacgtcaatcaccgccgcgtccagccccgggtcccccgccaccaccgcgcccccggagcgtagcgtgaccccctcacacacacccaccaccagcgtctccgaggccggtagcggggagccgccggccgccacgcccgcctccgccaccgcccaaagccccgaacccgcgtccgccgcccagccgagccccaccatccccaagcccacgacgccggacccgacctccgaggcgctcagcacccccgccacttcccggccccaggagccgtctacgcaccccagcccccgctccagcccctccaagccggtggagacccagagcacccggcacacggcgcgcgagctgctgagtgtgacgggcaccgaagccgagcagctcatcacccagaccatccacacgacaaaggaggccaccaaggccaccagcccccagcccacggcctccaatcccgacccgaccctggcgaccaccagccggtccatcaacagcatcaaccccaaagggcccgagagcacgcgcgccaccccgcagtcgacctcgcccacccccgagtcatccaccatccagacgcagatcctgcccatcatcaccacccctggaaccctcgaggccatcatccaccccacgaaccggagcaagcgcaacttgggcaccgagatcatcctgaccctcccgcaggggttaaagaaatactactccaaggtcctgaagctcatgcacctgacccgggaagaggacagcgagggcctgttggagtggtgcacgcgcatactggggcagacctgcgacgacgactacttccaaaaacgtatcaccgagttcttcatcaccggcgtggggtacttcaacgaggtgctgctgttcaaagaaacgaccgatgcccccaccctggccccgacacataagggcgcgccgcccacggaacccttcaagtcctactacgccaagggattcatcaccatggacagcgggtacttctcagcaaagtgctactcccgcgccagcaactccggcctgcagctcatcaatgtcaccatgcacagctccaagatgcccatcacccccgggcccaagtacagcaacctgaagaacataaactgcattaaccttaaggtgtccacggacaaagagcataacgaggtggagatcaacgtcctcctcccccaagtggccgtgaacctgagctcctgtcacgtcctcgtgagaagccacgtgtgcgactactccctggacgcggacggcatgatcaagctgccgcagatcactcacgagggcaccttcatccccgggacatacaagatcatcatcgacaagaagaacaagcagaacgaccgctgcacgctcatcaccaactgtgtcatcaagggccgggaggtgcgcaaggggcagagcgccttgcggcagtacaagaccgagatccgcgtgggccaggcctcaagcgggacccggcgcctgctctccgagagcaacaacaacgactgcgtctcccggacgcagctgatcaagaccgagaacgcagagatccacggcgacgactacggtgggcccggcgagaagatcacaatctgcaacgggagcaccatcgtggagcagcgcctgggctccgagctcgggtgctacacgatcaaccgcatcaagtccttcaaactgtgcgaaaactctgcgtccggcaagggctgcgagatcgactcgacccccgtaaagtgcaagcaggggttttgcctgaagatcacccaggagggacgggggcacgtcaagctctcccgcggtagcgagatcatactggacgtgtgcgactccagctgcgagatgatgatcccgaaggggtccggcgacatcctggtggattgcagcggcggacagcaacacttcctccaggacaacctggtcgacctgggctgccctaacgtgcccctcctggggaagatggccatctacatctgccggatgtccaaccaccccaagaccacgatggccttcctgttctggtttagcttcggctacgtcatcacgtgcatcttctgcaaggtgatcttctacgtgctaatcatcataggcacgctcgggaagcgcatcaagcagtaccgggagctgaagccgcagacctgcaccatctgcgaggccaccccggtaaacgcaatcgacgctgagatgcacgacctgaactgctcctacaacatctgtccctactgcgccagcaggctcacctccgagggcctggtgcggcacgtgacccagtgtccgaagcgcaaggagaagattgaggagaccgagctgtacctcaacctggagcggatcccctggttcgtacgcaagctgcttcaggtgagcgagtccacgggggtggccctgaagcggagctcctggctggtcaccctcctagtgctgctcaccgtgagcctgagccccgtccaatccgccccgatcggacaggagcgcaccgtggtaacgtaccaagtccgggagagctacaccgggatgtgcctgttcatcctcggctccgtgttattcgccatcagttggctgaccaagggcctagtggactccgtcgggaatatcttcttcccaggcctgagcgtgtgcaagacctgctccatcgggagcatcaacggctttgagatcgagtcccacaagtgctactgtagcctgttctgctgcccctactgccgctactgctccgcggaccgcggggcccaccagagccacctctcggtctgcaagaagagaaagacggggagcaacgtcatgctggccgtgtgcaagcggatgtgcttccgcgccaccctgaaggtgtccagcgaggccctcattatccggtccatcatcaacaccaccttcgtcgtgtgcatcctgatcctggtcgtctgcgtggtgagcacgtcggcggtcgagatggagaacctccccgcaggcacctgggagaaggaggaagaccttacaaacttttgccatcaggagtgccaggtgaccgagacggagtgtctgtgcccttacgaggcctttgtgctcaggaagccgctgttcctggactctacagccaagagcatgaagtcactcttaaacagcacctccctggaaacctccctctccatcgaggcgccctggggcgcaatcaacgtccagagcacgttcaagcccacggcttccaccgccaacatcgccttaagctggtcctccgtagagcaccgcgggaacaagatcctggtgactgggagatccgaaagcatcatgaagctcgaggagaggacgggtatctcctggaatctgggcgtcgaggacgcgagtgagtccaagaccctgaccgtgagcgtgatggacctctcccagatgtacagcaccgtctttgaatacctatccggcgatcgccaggtggaggagtggcccaaggccacgtgcacaggcgactgcccggagcggtgcgggtgcaccagcagtacgtgtctgcacaaggcctggccccactcccggaactggcgctgcaatcccacctggtgctggggcgtggggaccggctgcacgtgctgcgggctcgacgtcaagaatctgttcaccgactacatgctgatcaagtggaaggtggagttcatcaagaccgaggccatcgtgtgtgtcgagctcacaagccaggaacggcagtgctccttgatcgaggccggcacccgcttcaacctgggccccgtgaccatcaccctcagcgagccgcggaacatccagcagaagctgcctcccgagctggtgacgctccacccccgcgtagaggagggattcttcgacttgatgcacgtacaaaaggtgctgtccgcgtcgaccgtctgcaagctccagtcctgcacccacggcgtgcccggtgacctgcaggtataccacgtgggcaacctgctcaagggcgacaagatcaatggcaattcgttccacaagatcgagcccaacctgaacacctcctggatgagctgggacggctgcgacctggactactactgcaacatgggggactggcccagttgcacgtacaccggcgtgacccagcacaaccacgccgccttcgtcaacctcctgaacatcgaaaccgactacacgaagaacttccatttccacagcaagcgggtgacggcccacggggagacgccccagctggacctcaaagcccgcccgaagtacggcgcgggagaggtgaccgtcctggtggaggtggccgacatggagctgcacaccaagaagatcgagatctccgggctcaagtttgcctcgctgacctgcaccggctgctacgcctgctccagcgggatctcctgcaaggtacggctgcacgtggacgagcccgacgagctcaccgtgcacgttaagagcgacgaccccgacgtggtcgcggcctccagcagcctgatggccaggaagatcgagttcggcaccgactccaccttcaaggccttctcctccatgcccaaggacaagctgtgcttctacatcgtcgaacgggactactgcagctcctgcagcaaggaagacacccagaagtgcgtgaacgcgaagctcgagcagccgcagtccatcctgatcgagcacaagggtaccatcattggcaaacaaaacgacacgtgcaccgtgaaggcgagctgctggttggagtccgtcaagagcttcttctacggcctcaaaaacatgctcgggggcatcttcgggaatgtgatcctgggcatcatcatgttcctcgcccccttcgccctgctgctcctgttcttcctgttcgggtggcgcatcctgttctgcctgcggtgctgccgcagaacccgcggcctgttcaagtacaagcacatcaaggacgacgaggaatccggctacaagcggatcatcgagcgcctcaacaacaagaaggggaagaacaagctgttcgacggcgagcgcctggccgacaagaagatcgctgagcttttcagcaccaagacgcacatcgggtga

SEQ ID NO: 15196 - RNA, 5088 nt, synthetic construct
  misc_feature 1..5088: note = derived and/or modified CDS sequence (opt11) from CCHFV(AP92)__DQ211625.1__GP
  source 1..5088: mol_type = other RNA
atgcccgaccacttcatcctgttgctgctgatgtacaccgtgttccaccagcacccgcaggacgtcagcgccaacgtgcatctcgttaatccctccaacagcaccacgggtgcctccaccgctttcaacccagtccacaacgccaccaccgacggacagaagcagagcacgtcaaccaccaccatggcgcgccccagcaccgtgacccagatcacaaccgcccaggccatggaggtggacggctccggggaaagcacgaccctgccggcggtcacccccacgcccgccgagacgaccacccacgccaaccagaagtccgccagcaccatgggcacgctgaccacctccctcgaggacacagccttaatgacgctgaccgggcgtagcatcctcacctcccagagccagaccggctccttcgaccgcacgagcaagccccagaccccgcggtctacaaaccaacccctgcgcaagctgctctctgctgtgtccaccgaggccgcgccccagacgagccccaccgctgtgaccgcagaccagacggaggccagcacgtccccgcaggtcaccaccgacaccagcccctccacacctacgcaggtcactagctccgccggaagttccagctccaacaccagcaaccactccaagaccacgccccagctgaccagctccgggagcgaggctcagcagacccagccgaccacaatgcccaacaccactgccttagtgactccgacagcacacatcagccccactaaccggagcaaacgcaactccgaggtcgagatcatcctcaccctgccgcagggcctgaagaaatactacagcaagatactcaagttactacacctcaccctggaggaggactccgagggcctgcttgagtggtgcacgcgtacactgaagcaagcctgcgacgacggctacttccaggagcgcatcaaggagttcttcctgaccggggagggctatttcaacgaggtgctcctgttccgaagccccagccagctgggcaccacggggtctcccctcgccagtccacccaccgcagagccctttaagtccttctacgcgaagggcttcctaatcatggacagcgggtacttctccgcgaagtgctaccccaaggccagcaactccggtctgcagctcatcaacatcacccagcattccatcaaggtggtcaacactcccggcccgaagtactcgaacctgaagacggtaaactgcatcaacctgaaggtcagcaccgacaaggaccactctgagctcgaggtcaatgtgttgctgccgcaagttgccgtcaacatatcgaactgccacgtgctcattaaatcccacgtctgcgactacagcctggacaccgacgggatgatccgcctgccccaggtcacccacgagggcacgttcatcccgggcacgtacaagatagtgatcgacaagaagaacaagttgaatgaccggtgcactatgaccacgaactgcgtcatcaagggcaaggaggtgcgcaaggggcagtcaaccctgcggcaataccgcacagagatacgggttggccaaatgagctccggcacccgccggctgctcagcgagggcggggacgggggctgcatcagccgcacgcagctgataaagaccgagaccgccgaggtccacggggacgactacggcggtcccggagaaaagatcaccatctgcaacggctccaccatagtggaccagcggctggggagcgagctcggctgctacacgataaaccgcatcaagtccttcaagctgtgcgagaactcggcacagggtaagaactgtgagatcgactcggcgcccgtgcagtgccggcagggctactgtctgaagataagccaggagggccgcgggcacgtgaagctgtccagaggcagcgagatcgtactcgacgtgtgcgacacgtcttgtgagatcatgatccccaaggggaccggcgacatactggtcgactgcagcggcggtcagcagcactttctgcagtccaacctcgtcgacctgggctgcccgaacatccccctgctcgggaagatggccatctacatctgccggatgagcaatcaccccaaaaccacgatggcgttcctgttctggttctcgtttggctacgtgatcacgtgcatcctgtgcaagaccctcttttatatcctgatcatcatcgggaccctggggaagaaactcaaacagtaccgcgagctgaagccccagacctgcaccatctgcgagagcgttccggtgaacgccattgacgcggagatgcacgacttaaattgctcctacaacatatgcccctactgcgctagcagactcacctccgaggggctgacccgccacgtgaaccagtgccccaagcggaaagagaaggtagaggagacggagctgtacctcaacctggagcgcatcccctggatcgttcggaagctgctccaggtgtccgagtccaccggggtcgccttgaagcgctctagctggatgatcgtactgctcatcctgctgatcgtgtccatgagcccggtccagtcagcccccatcagccaggagcgcacagtggccttataccagtcccgcgaggactatatgggcatctgcctggtgattatggggagcgtcctgctagcggtgtccctgctggtgcggggcctcatcgacagcatctcctcaaccttcttcccggggctatccgtctgccgaacgtgccacatcggcagcatcaatggcttcgagatagagtcccataagtgctactgcgggctgctctgctgcccctactgccgggcctgcagcaccgaccaggacgcccaccagttccacctatccgtgtgcaagaagcgcaaggccgggagcaacgttatgctggccgtctgcaagcggatgtgcttcaaggcgatcatcgaggcgtccaacaaggttctcttcatccgcaacgtgataaacaccacattcgtggtgtgcatcctggtgatggtcgcctgcatcgcaagcagcgccgcggtggaaatggagaacctgccggccgggacgtgggagcgggaggaggagctcaccaacttctgccaccaagagtgccaggtgaccgagaccgagtgcctgtgcccctacgagagcttcatcctgcgcaagcccctcttcctggacagcattgccaagggcgtcaagaacttgctcaactccacgagcctggagacatccctgagcattgaggccccctggggcgcgatcaacgcccagtccacctataagccgaccgccagctccgcaaatatcgccctcacctggagcagtgtggagcaccggggtaacaagatcctggtgagcggtcgctccgagagcatcatgaagttggaggagcgcactgggatctcctggaacctcggcgttgaggacgcgagcgagtcccgcactttgaccataagcgttatggacctgtcccagatgtacagccccgtgttcgagtacctttccggggatcgccaggtcgaggaatggccgaaggccacgtgcacgggcaactgcccggagcggtgcgggtgcaccagctccacgtgcctgtacaaggaatggccgcacagccgcaattggcgatgcaaccccacctggtgctggggcgtgggcaccgggtgcacgtgctgcggcctggacgtgaaggaactcttcaccgaccacatgctagtcaaatggaaggtggagtatatcaagaccgaggcaatagtatgcgtcgaactgacctcacaggagcgccagtgctcccttatagaagccgggacccggttctcgctcggtcccgtcaccattaccctgtccgagccgcgcaacattcagcagaagctcccgcccgagctgatcacgctgcacccaaagatcgaagacgggtacttcgacctgatgcacgtccagaaggtgatgtctgcctccaccgtgtgcaagctgcagagctgcacccacggcgtgcccggcgacctgcagatctaccacgtggggaacttgctgaagggcgaccgggtgaacggccacttaatccacaaggtcgagccccacctcaacacctcttggatgagctgggacggctgcgacctggactatttctgcaacatgggcgattggccctcctgcacgtacactggggtcacccagcacaaccacgctgccttcgccaacctgctcaacatcgagactgactacacaaagaccttccacttccacagcaagcgggtgacggcccatggcgatacgccccaactggacctgaaagcacggccgcgctacggcgccggggagatcaccgtactcgtggaggtggccgacatggaactgcacaccaagaaggtcgaggtgaccgggctgaagttcgcctccctgacctgcagcggctgctacgcctgctctagcggaatttcctgcaaggtacgtatccacgtcgacgagcccgacgagctcaccgtacacgtcaaaagctctgaccccgacatcgtagcggccagcagctccctgatggcccgcaagatcgagttcggggtggacagcaccttcaaggccttctcttcaatgccaaaggattccctctgcttctacatcgtggaacgggactactgcaacagctgtaagaatgaagagacccagcgctgcgtgaacgcgaagctggagcagccgcaatccatcctgatcgagcacaccggcacgatcatcgggaagcagaacgacacgtgtggcagtcggacctcctgctggctcgacagcttcaagtcctttttctacgggctgaagtctatgcttagcggcatcttcggcaacgtgtttcttgggatcttcctgttcctagcgcccttcgcccttctcttgttcttctttttcttcggctggaggatcttattttgcttcaaatgctgtaggcgcacccggggcctcttcaagtaccgccacattaaagacgatgaggaggtagggtacaagaaaataatcgagcgcctgaacaacaaaaagggcaagcaccggctgctcgacggggagcgcctggctgaccggaagatcgcagagctgttcagcactaagacccacatcgggtga

SEQ ID NO: 15197 - RNA, 5085 nt, synthetic construct
  misc_feature 1..5085: note = derived and/or modified CDS sequence (opt11) from CCHFV(UCCR4413)__KY484038.1__GP
  source 1..5085: mol_type = other RNA
atgctgcgctacatcctctacgccctgctggccagcgcgatcctccaccagcacctgtacaaggtgggcgccgacacccagaagcccaccgtccggacaaacaccacccacaagatctccccgaccgccacagccaaccgcaccacctacgagcaggccacccccagcacgacccccaagtccagcaccaagcccaccacccacatcgcgaccgcccacctggccgagtccgacgggagcggcgagaccaccctcctgctgccgacgaccgcctcccagtacaccaccgaggggcagacaagcctcgagcccaccgcggaggagaccggctccaacaccatccccagcgacacgacctccaccagccccatcaccgagaacagcgagagcactgacacccagatgaacgtgtccgacagctccagctccccgctggccacccagggggcccggagccccgcccgcaacctgctaagcgtgccctccgtcgagcccggccagcagaccacgccgaagcagcccaccaccaagggcaccgtgacgcccaccaccccgcagccgaccaccagctcccccacgcccgcccccaccagcgcgacgctgtccaccaacagctcctctatctccacgccggtgcagaccagcagccccctgcagcccatggccccctcccacgagacccagcacgctctctacaccacgtccactgagagcaccctgcgcaccctgtccgccgagcgcatccacccgaccaaccggagccgccggaactccgaggtcgagatcatcctcaccctgccccaggggctgaagaagtactactcccgcctcctgaagctgctccatctgaccatggaggaggacaccgagggcctgcaggagtggtgcgtgcgggtgctcgggcagacgtgcgacgactcctacttccacaagcgcctggccgagttcttcatcaccggcaccgggttcttcaacgaggtcctcctcttccggagcccgagcacccccacgaccatcaaaccgtcccccaccggcagccccactgtggagccgttccgctcctactacgcgaagggcagtctgacgatcgactccgggtacttcagcgccaagtgctacccccgaacctccaactctggcctacagctcatcaacctgacccagcactctgtggagatcgccaacacccccgggcccaagcacagctccctgaagacgattaactgcatcaacatcaaggccagcaccgacaaggagcacaacgaggtcgagatcaacgtgctcctgccccaggtcgccatcaacctgtccaactgccacgtcagcatcagatcccacgtgtgcgactacagcctcgacaccgacggcaaaatccggctgccccagatctcccacgagggcacctttatccccgggacgtacaagattatcatcgacaagaagaacaagctgaacgaccgctgcagcctcatcaccagctgcgtgatcaagggccgggagctgcgcaaggggcagtccaccctgcggcagtacaagaccgagatcaagatcggccagacgagttcagggagccgccgcctcctgtccgagtcttccgcgagcggctgcatctctcggacccagatgatcaagagcgagaccgccgagatccacgacgacatctacggcgggcccggcgagaagctgaccatctgcaacgggaccacggtcgtggaccagcgcctcggctccgagctggggtgctacaccatcaaccggatcaaaacctacaagctgtgcgagaacagcgtgaaggagaagacctgcgagatcgacagtgtcccggtgaagtgccgccagggcctgtgcctcaagatcacgcaggagggccgggggcacgtgaagctgagccgcggctccgagatcgtcctggacatctgcgacagctcctgcgagctcatgatccccaaggggaccggcgacatcctggtggactgcagcgggggccagcaacacttcctgcaggacaacctcgtcgacctgggctgccccaacatccccctgctcgggaaggtggccatctacatctgccggatgtccaaccacccgaagaccaccatggccttcttattctggttcagcttcggctacgtaatcacgtgcatcctgtgcaagatcctcttctacctgctgatcatcacggggacccttggcaagaagctgaagcagtaccgcgagctgaagccccagacctgcacgatctgcgagagcacccccgtcaacgccatcgacgcggagatgcacgacctcaactgctcctacaacatctgcccctactgcgccagtcggctgacctccgacggcttaatccgccatgtgaacctgtgcccgaagcggaaagagaaggtggaggagaccgagctgtacctgaacctcgagcgcatcccctggttcgtccggaagctgctccaggtgagcgagtccacgggggtggccctgaagcgcagctcctggctactgatcctcgtcatcctgctgaccgtgagcatgtcccccgtgcagagcgcccccatcaaccagcagcgggcggtcgaggcctaccaggcccgcgagggctacaccgggatctgcctcttcatcctggggtccgtgctgttcatgaccagctggctaacgaaggggctgatcgactccatcggcgacagcttcttcccgggcctgttcgtgtgcaagacctgctccatcgggagcatcaatggcttcgagatcgagtcccaccggtgctactgcagcctcctgtgctgcccctactgccggacctgctccgccgacaaagacagccaccagctgcacctcagcatctgcaagaagaagaaggccgggtccaacgtcatgctggcggtgtgcaagcggatgtgcttcaaggctaccatcgaggccagcaaccgcgtgctgctcatccgctccatcatcaacacgaccttcatcatctgcatgctgatcctggtcgtgtgcgtgatcagcaccagtgccgtcgagatggaggacctccccgccggcacctgggagcgggaggaggatctgacgaacttctgccaccaggagtgccaggtgaccgagaccgagtgcctgtgcccctacgaggcgttcgtgctccgcaagccgctgttcctgtcttccatcgtcaaggggaagaagaacctccttaacagcgcctcactggagaccagcctcagtatcgaggccccctggggcgctatcaacgcccagagcacgttcaagcccaccatatccaccgcgaacatcgccctgagctggtcctcagtggagcaccggggcaacaaggtgctggtgtccgggcgcagcgagtccatcatgaagctcgaggagcggactggcatcagctggaacctcggggtggaggacgccagcgagtcccgcatgctgacggtgagcgtcatggacctctcccagatgtacctgccggtgttcgagtacctgagcggcgaccgccaggtggaggagtggcccaaggcgacctgcaccggggactgccccgagcgctgcggctgtacctccagcacgtgcctccacaaggagtggccccactcccggaactggcgctgcaacccgacctggtgctggggagttgggaccggctgcacgtgctgcgggctagacgtgaaggacctgttcaccgactacatgttcgtgaagtggaaggtcgagtacatcaagaccgaggccatcgtgtgcgtggagctcacctcccaggagcggcagtgctccctgatcgaggccggaacccgcttcaacctggggcccgtcaccatcacgctcagcgagccccggaacatccagcagaagctgccctccgagatcgtgaccctgcaccctaagatcgaggagggctttttcgacctcatgcacgtgcagaaggttctgtcagcctccaccgtgtgcaaacttcagtcttgcacccacggcgtggccggggacctccaggtctatcacgtgggcaacctgctgaagggggacaagatcaacggccactccatccacaagatcgagccccacctcaacacgagctggatgtcctgggacggctgcgacctggactactactgcaacatgggggactggcccagctgcacctacaccggcgtgacccaacacaaccatgccgcgttcgtcaacctgctcaacatcgagacggactacaccaagtccttccacttccacagcaagcgcgtgaccgcccatggggacacgccccagctggacctgaaggcccggccgatgtacggcgccggggagatcaccgtgctcgtcgaggtggccgacatggagctgcacagcaagaacatcgagatctccggcctgaagttcgcgagcctgacctgctccggctgctacgcctgcagctccgggatcagctgcaaggtccgcatccacgtggacgagcccgacgagctggccgtgcatgtcaagtccgacgacctggacgtggtcgccgccagctccagcctcatggcgcggaagatcgagttcggcaccgacagtaccttcaaggccttcagctccatgccgaaggagtctctctgcttctacatcgtcgagcgcgacttctgcaagtcctgcgccgccgaggacacgcagaagtgcgtgaaggcgaaactggagcagccccagagcatcctgatcgaacataaggggaccatcatcggcaagcagaacgacacgtgctccaccaagaccagctgctggctcgagtccttcaagagctttttctacgggctgaagaacatgctgagcggcgtgttcggctccgccatcatggggatcctcctgttcctggccccgttcattctcctgatactgttcttcttcttcggctggcggatcctcttctgtctgcgctgctgccggcgcacccgcgggctgttcaaatacaagcacatcaaggacgacgaggaggccggctacaagaagatcatcgagaagctcaataacaagaagggcgggaccagcaagttgctggacggcgagcggctcgccgaccgcaagatcgcggagctgttctccactaaagctcacatcgggtga

SEQ ID NO: 15198 - RNA, 5076 nt, synthetic construct
  misc_feature 1..5076: note = derived and/or modified CDS sequence (opt11) from CCHFV(SCT ex Afghanistan)__KC344856.1__GP
  source 1..5076: mol_type = other RNA
atgcatcatgcctaccagatcatgtacaccctgttggtgtgcgccatcttgtgcccccagccgtggagcctggagggcacccacgtccccctcaacgggacgaagcataacgggaccgggatcaccgcggcccccggcgggtcccaggggcccaccagcccggcctccacggccgtgtcgctgacccccgaccctttcaccaccgagcccacggcctccgcggtggaactggagagctccggcgaggggcacaccagcctctccgtcactacccagggcctgacgagcccggagaccacccccgggctccccaccgtgacggacaccggcgtgtccagcacctccatcttcgggatcggcatccgcgtcgccggcgacacccccacgagcaccacccacaccgggctcccgtcctcaccctccatgcccagcacggcccaaggcccccaccacgccgtgcgggggctgctgtccgtgagcagcacccgccccggcgaggcgtctaccatcactgtccccggcgaggccgggacggaggccaacagctccagctccgccatcagcaagaagcccgccccctccccgaccgcggaagccatcaccgaggccaacaacagctccaacccccgacagcctgaactttcaacccagcccgccatcccgggcctggtgacgtccagcgcccaaccaattctgctccagtccgccacctctaccgccgcccaggacatctacccctcccccaccaaccgtagcaagcgcaaccttgagatggagatcatcctgacactctcccaggggctgaagaagtactacggcaagattctgcgcatcctcgacctgaccctggaggaggacaccgaaggcttgctggagtggtgcaagcggaaccttggcctgacctgcaacgacaatttcttccaggagcgcatcgaggagttcttccttaccggcgaagggcacttcaacgaggtgctgcagttcaagacgccgagcaccctctcccccaccgagcccacccacacccggaccccaaccgtcaagccctttaagagctacttcgcgcgcggcttcctgagcatcgactccggctacttctctgccaagtgctattccaagaccagcaactccggcctgcagctcatcaacatcacccagcacccggcgcggatcgccgacacccccggacctaagataacaaatctgaaggctatcaactgcatcaacctgaaggccagcgtgttcaaggagcaccgcgagatcgagatcaacgtgctcctaccacaggttgccgtgaacctgtctaactgccacgtgttgattaaaagccacgtctgcgactactccctggacatcgacggcgcggtgcggctgccccacgtgcaccacaagggcaccttcatccccgggacgtacaagatcgtaatcgacaagcgcaacaagcaaaacgaccggtgtaccctcgtaaccaactgcgtgatcaagggcaaggagatccgcaaggggcagagcgccctgcggcagtaccgcaccgagatccggatcggtaaggcctccgcaggaagccgccggctgctctccgaggagagcggcgacgactgcatctcccgcacgcagctgctgcgtaccgaaacagcggaggtccataacgacaactacggcgggccgggcgataagatcactatatgtaacgggagcacgatcgtcgaccaacggttaggctccgaactgggctgttacaccatcaaccgcgtcaagtcattcaagctgtgtgagaacagcgccaccggaaagtcctgcaagatcgacagcacccccgtcaagtgccgacagggcttctgcctgaagattacgcaggaggggcgcggtcacgtgaagctctcacgggggagcgaggtcgtgttggacgcctgcgactcctcatgcgagatcatgatccccaagggcaccggcgacatcctggttgactgctccggcggccagcagcacttcctcaaggacaacctgatcgacctggggtgccccaacatcccgctcctgggcaagatggccatatacatctgccgcatgagcaaccatcccaagaccaccatggccttcttgttctggttctcctttgggtacgtcatcacgtgcatcttctgcaaggtgatcttctacctcctgatcgttgtcggcaccctgggcaagaagtttaagcagtacagggagctcaagcctcaaacctgcaccatctgcgagacgacccccaccaacgcgatcgacgccgagatgcacgacctgaattgctcctacaacatctgcccgtactgcgcctcccgcctgaccagtgacgggctcgcgcggcatgtaacgcagtgccccaagcgcaaggagaaggtggaggagaccgagctgtacctgaacctcgagcggatcccctggatcgtccgcaagctgctccaggtgtccgagagcaccggcgtggcactcaagagatccagctggctgatcgtcctgctcgtgctgctgaccgtctccctcagccccgtccagtccgcaccgatcgggcacggcaagaccatcgagacgtaccagacccgcgaagggtacatcagcgtatgcctgttcgtccttggcggcatccttttcgtcgtttcatgcctgatcaaggggctggtggactccgtcggcaatagcttcttccccggactcagcatctgcaagacctgtagcatcggctccgtaaacgggttcgagatcgagagccacaagtgctactgctccctgctgtgctgcccctactgccggcactgctccaccgaccgcgagatccaccagctccacctgagtatctgcaagaagcggcgcacgggcggcaacgtgatgctcgctgtctgcaagcgaatgtgcttccgcgccacaatggaggtgtcgaacaaggtcctcttcatccgcaacatcataaacaccactttcgtgatctgcatcctgatcctggccgtgtgtgtggtctccacgagtgccgtggagatggagtccctccccgcggggacctgggagcgggaggaggacctgaccaacttctgccaccaggagtgccaggtgaccgagacagagtgcctgtgcccatacgaggccctcgtgctgcgcaagcccctgttcctcaactctatcgtgaagggcatgaagaacttactgaactctaccaatctcgagaccagcctgtccatcgaggccccctggggcgccatcaacgtgcagagtaccttcaagccgacggtgtcgaccgcgaacatagccctgagctggagctccgtggagcaccgggggaacaagatcctcgtgagcggccgctccgagagcatcatgaagctggaggagcggaccgggatctcctgggacctgggcgtcgaagacgccagcgagtcaaagagcctaaccgtttccgtgatggatctgagccagatgtactcaccagttttcgagtacctgagcggggaccgtcaggtggaagagtggcccaaggccacgtgcaccggcgactgtcccgagcggtgcggttgcacctccagcacgtgcctccacaaggagtggcctcactcccgcaactggcggtgcaatcccacctggtgctggggcgtgggcaccgggtgcacgtgctgcggcctggacgtcaaggacctgttcaccgactacatgttcgttaagtggaaggtggagtatatcaagaccgaggctatcgtctgcgtcgagcttaccagccaggagcgacagtgctccctgatcgaagcggggaccaggttcaacctgggccccgtcaccattaccctcagcgagccccgcaacatccaacagaaactgccgcccgagatcatcaccctgcacccccggatcgaggaggggtttttcgacctcatgcacgtgcagaaggtgctgtccgcctcgaccgtctgcaagctgcagagctgcacccacggcgtgcccggcgacctccaggtgtaccacattgggaacctgctgaagggcgacaagctcaacgggcacatgatccacaaaatcgagccgcacttcaacacgtcctggatgagctgggacggatgtgacctggactactactgcaacatgggggactggccctcctgcacctacaccggcgttacccagcataaccacgccgccttcgtgaacttgctcaacatcgagacggattacacgaagaatttccacttccacagcaaacgcgtgaccgcccacggcgacacgccgcagctggacctgaaggcgcggcccacctacggggccggcgagatcaccgtcttagtggaggtggccgacatggagctgcacacaaagaagatcgacatctccgggctgaagttcgcgagcctgacctgcgcaggctgctacgcgtgttccagcggcataagctgcaaggtccgcatccacgttgacgagccggacgagctcaccgtgcacgtcaagagcgaggaccccgacatcgtggccgcatccacgagcctcatcgcccggaagctcgagctggggaccgattccaccttcaaggcgttcagcgccatgcccaagacctccctctgcttttacatcgttgagcgtgaatactgcaagagctgctccaaagaagacacgcagaagtgcgtcaacaccaagctcgagcacccccagggcatcctgatcgagcacaaggggaccatcatcggcaagcagaacgacacgtgcaccgccaaggccgggtgctggctggagagcgtgaaatccttcttctacggactcaagaacatgctgagcggaatcttcggcaacgtcttcatcggcatcttcctgttcctggcccccttcgtcctgcttatcctgttcttcatgttcgggtggcggctcctgttctgtttcaagtgctgccgccggacccgcggcctgttcaagtatcgccacctcaaggaggacgaggagagcgggtaccggcgcatcatcgagcggttaaacaataagaaaggaaagaacaagctgctcgacggcgagcgcctggcggaccggcgcatcgccgaactgttcagcaccaagacccacatcgggtga

SEQ ID NO: 15199 - RNA, 5070 nt, synthetic construct
  misc_feature 1..5070: note = derived and/or modified CDS sequence (opt11) from CCHFV(SPU 431/85)__KJ682812.1__GP
  source 1..5070: mol_type = other RNA
atgcccgtgaacatcatgtacacgcccctggtctgtgctgtcatctgcctccagctttggaacttaggcgggaccctcgtgagcactaaccgcacccagcacaacgagaccgggacggttgcaacccccgaggggacactgcggccccgcctgcccgtgtccacggccctcccgactaagagcgaccgtccgtccgtggggcccgccgccagctccagcgggctagagggctctggcgaacccaacaccagcccctccatcaccaccaaggggctgaccccgcccgagaccacccccgccctccccaccgccactgacaccgacgccagctccaccggagtcgtggacgtgagcacccagatgaccaaagacatccccatgtcaaccgcctacaccaaccctccgagcaccccgtccgcccctagcacgccccaagggacgcaccacaccgcccgcgggctgctgtccgtcgcgagcacaaagtccgaggaggtgagcatgagcacctcccccgctaagacttctaccgagacctccagccctccgcccgccacctccgagacgcccactccctcacccaccacccaggttcccacgggcaacaataaccccaacacctcccggcagcccacccccagcgcccagcccgccatgagcaacccggcgaccagcccagcccagccgaacttgagtcagagcgcgccgcccaccgcggaccaaggcgtccacccctcacccacgaacagaagcaagcggaacttagagatcgagatcatcctgaccctctcccagggcctgcgcaagtattacgggaagatcctgaagctcctggacctgaccctcgaggaggacaccgagggcctgctggagtggtgcaaacggaacttggggctgacgtgcgacgacaacttcttccagaagcgcatcgaggagttcttcctgaccggcgaaggctactttaacgaggtgctccagttcaaggtgcccagcactctttccagcacggagcccacgcacacccggccgcccaccgtcgagcccttcaagtcctattttgccaaagggttcctaagcatgaacagcggctacttctccgcgaaatgctacccgaggacctctaactccgggctccagctgatcaacgtgacgaagcacagcgccaagatcgccgacacccccggcccaaagatcaccaacctaaagaccatcaactgcatcaacctccgggcctccgtgttcaaggagcacagggaggtcgagatcaatgtgctgttaccccaggttgccgtcaatctcagcaactgccacgcccagatcaagtcccacgtctgcgactatagcctagccaccgacgggatggtgagactgccgcacatccaccatgagggcaccttcatccccggcacttacaagatcgttatcgataagaagaacaagcagaacgaccgctgcaccctcgtgacgaactgcgtcatcaaggggcgggaggtgcgcaagggccagtctgccctgcggcagtacaagaccgagatccgcatcggcaaggcctcctccggcagccggcgcctgctctccgaggagagcgacggggactgtatctcccgcacccagctgctccggaccgagacgaccgagatccattccgacaactacggcggccccggggacaaaatcaccatctgcaacggctccaccatagtcgaccagcgcctcgggagcgaactgggctgttacacgatcaacagagtcaagagcttcaagctgtgtgagaactccgccaccggcaagtcctgcgagatcgactccacccccgtgaagtgccgccagggtttctgcttgaagatcacccaggagggccgggggcacgttaagctcagccgcggctccgagatcgtcctggacgcatgcgactctaactgcgagattatgatcccgaaggggacgggcgacatcttagtggactgctccggcgggcagcagcactttctcaaggacaacctgatagacctgggctgtcccaacatccccctcctgggtaagatggccatctacatctgccggatgagcaaccaccccaagaccaccatggcattcctgttctggttctccttcggctacgtgatcacgtgcatcctctgcaaggtcatcttctacctgctgatcgttgccgggacggtgggcaagaagttcaagcagtatcgcgagctccgtccgcagacctgcaccatttgcgaaaccatccccgtcaacgcgatcgacgccgagatgcacgacctcaattgcagctataacatctgtccctactgtgcctcccgccttaccagcgacggcctcgcccggcacgtgatgcagtgcccgaagcgcaaagaaaaagtggaggagacggagctgtacctgaacttagagcggatcccctgggtcgtgcgcaaacttctccaggtttccgagagcaccggggtcgctctcaagcgctccagctggctgaccgtgctgctcgtgctgctgatcgtctccctctcgcccgtgcagtccgcgcccatcggccacgggaagacaatcgagacgtatcaggcccgcgagggctacaccagcttctgcctgttcatcttggggagcatcctcttcgttgtcagttgcctggtgaagggccttatcgatagcgttggcaactcgttcttcccggggctcagcatctgcaagacctgctccatcggatcaatcaacgggttcgagatcgagagccacaagtgttactgcagcctgttctgctgcccctattgccggcactgcccagccgaccgcgagatccacaagctgcacctctccatctgcaagaaacggaagaccggcagcaacgtcatgttggcagtctgcaagcgcatgtgtttccgcgccacgatcgaggtgtccaaccgggcgctgctcatccgcaatatcattaacaccaccttcgtcgtgtgtatcttgaccttggccgtgtgcgtcgtgagcacgtccgccgtggagatggagagtctccccgccgggacctgggagaaggaagaggacctgaccaacttctgccaccaggagtgccaagtcaccgagacagaatgcctctgcccgtacgaggccctcgtcctgcggaagcccctgttcctagactcgatcgtcaagggccgaaagaatttactgaacagcacatccctcgagacctcactgtccatcgaggcgccctggggcgcaataaacgtacagagcaccttcaagcccacggtgtcggccgcgaacatcgcgctgtcctggagctccgtcgagcaccgggggaacaaaatcctcgtctctggccgctccgagagcattatgaagctggaggagcggaccgggatctcctgggatctgggcgtggaggacgccagcgagtccaagctcctgaccgtgagcgtcatggacctgtcccagatgtacagcccggtgttcgagtacctctctggggaccgccaggtggaggaatggcccaaggcgacctgcacgggcgactgtcccgagcggtgtggttgcactagcagcacgtgcttacacaaggagtggccccatagccgcaactggcggtgcaacccgacctggtgctggggtgtgggtaccgggtgcacatgctgcggcctggacgtgaaggacctcttcactgactacatgttcgtgaagtggaaggtcgagtacatcaagaccgaggccatcgtgtgcgtcgagctgacgagccaagagcggcaatgcagcctgatcgaggccggtacccggttcaacttagggcccgtgaccatcaccctgtccgaaccccgcaacatccagcagaagttacccccggagatcatcacgctccacccccggatcgaggagggcttctttgatctcatgcacgttcagcgcgtcttaagcgcaagcacagtgtgcaagctccaaagctgcacccacggagtgcccggcgacctgcaggtctaccacatagggaacctgttgaagggcgacaaggtaaacggacacctgatccataagattgaaccccactttaacacaagctggatgtcatgggacgggtgcgacctggactactactgcaacatgggcgactggccgagttgtacctacacgggggtgacgcagcataaccacgccgcctttgtaaatctcctgaacattgagaccgactacaccaagaacttccacttccactcaaagcgagttacggcccacggcgacacgccccaactggacctcaaggcacgccccacctacggggctggcgaggtgacagtcctggtggaggtggccgacatggagctgcacacgaagaaaatcgagatcagcggcctcaagttcgcctccctgacctgcaccgggtgttatgcctgcagctccggcatcagctgcaaggtcaagatccacgtggacgagcccgacgaattaacagtgcacgtcaagtccgaggacccggacatcgtggcagctgggagctccctcatggcccggaagctggagttcggggccgatagcacgttcaaggccttctcggcgatgcccaagaccagcctgtgcttctatatcgtggagcgcgagtactgcaagtcctgcagccgcgaggacacccgcaagtgcgtgaacaccaagctcgaccgaccccaatccatactgatcgagcacaagggtactataataggtaagcagaacaacacgtgcacggccaaagccagctgttggttagagagcgttaagagtttcttttacggcctcaagaacatgctgagcgggatcttcggcaacgtcttcatcggaatcttcctgttcatcgctccgttcgtcctcctgatcctgttcttcatgttcggctggcggatcctgttctgtttcaagtgctgccgcagaacccgcggcctcttcaagtaccggcacctgaaagacgatgaggaaacagggtacagaaagatcatcgagagactgaataacaagaagggcaagaacaagctcctggacggggaacgcctggccgatcggaaaatcgcagagctgttctccaccaagagccatatcggctaa

SEQ ID NO: 15200 - RNA, 5070 nt, synthetic construct
  misc_feature 1..5070: note = derived and/or modified CDS sequence (opt11) from CCHFV(SPU 556/87)__KJ682811.1__GP
  source 1..5070: mol_type = other RNA
atgaccgtgaacaccgtctgcacgcccctggtgtgcgccgtgttctgcctccagctgtggaacctgggcgggaccctcgtcccgaccaaccgcacccagcacaacaagacgggcaccatggccacccccgaggggaccctgggcccccggctgcccgtgagcacggctctcccgaccaaatccgaccgccccagcgtggggcccgccgcgccctcgagcggcctggagggctcgggggagccgaacacctctccctccatcacgacgaagggcttggccctccccgagaccacccccgccccacccaccgcgacggacaccgacgccagctccaccggggttgtgaacgtgagcacccagatgaccaaggacatccccatgtccaccgcctataccaacccgcccagcaccccctccgcccctagcacgccccagggtacccaccacacggcgcgtgggctgctgtccgtcgccagcaccaagtcggaggaggtgagcatgtccacgagcccgggcaaaaccagcaccgagacctccagcccacccccagccacgtccgagacccccgcccctagccccaccacgcaggcccccacgggcaacaacaaccccaacacctcccgccagcccacccccagcgcgcagcccgccatgtctaaccctaccaccagccccgcccagcccaacctcctgcagaacgcccctcccacggccgaccagggggtgcaccccggccccaccaatcggagtaagcgcaacctggagatggagatcatcctcaccctgagccaggggctgcggaagtactacggcaagatcctcaagttcctggatctgacccttgaggaggacacggagggcctcctggagtggtgcaagcgcaacctcgggctaacctgtgacgataactttttccagaagcggatagaagagttctttctgaccggcgaagggtactttaacgaggtcctccagttcaaggtgccgtccaccctgagctccacggagcccacccataccggcagtccgaccgtggagcccttcaagtcctacttcgcaaaggggttccttagcatgaactccggctacttcagtgccaagtgctacccgaggacgtccaacagcggcctccagctgattaatgtcacaaagcacagcgccaagatcgccgacacccccgggcccaagatcaccaacctgaagactatcaactgcatcaacctccgtgcatccgtgttcaaggagcaccgcgaggtggagatcaacgtcctgttaccccaggtggcggtgaaccttagcaactgccatgcccagatcaaatcccacgtctgcgactacagcctggccaccgacggcatggtgagactgccgcggatccaccacgaggggaccttcatcccaggcacctacaagatcgtgatcgacaagaagaacaagcagaacgaccggtgcacgctcgtgaccaactgcgtgatcaaggggcgagaggtacggaagggccagtccgccctgcgccagtacaaaaccgagatccggataggcaaagcgtcttccggtagccgccggctgctctccgaggagtctgacggtgactgcatctcacgcacccagctgctgcgcacggagaccgcggagatacattcggacaactacgggggtcccggtgataaaataactatctgcaacggctccaccatcgtggaccagcgtctcggaagcgagctggggtgctatacgatcaaccgtgtgaagtccttcaagctgtgtgagaacagcgccaccggcaagtcctgcgagatcgacagcacccccgtcaagtgccggcaggggttctgcctcaagatcactcaggagggccgcggccacgtgaagctgagccgggggtccgagatcgtgctggacgcctgcgacagctcctgcgagatcatgatcccgaaaggtacgggggatatccttgtcgactgctcgggcgggcagcagcacttcctcaaggacaatctgatcgacttagggtgccccaacatccccctcctgggccgcatggccatctacatctgcaggatgtccaaccaccccaagactaccatggcgtttctgttctggttcagcttcgggtacgtcatcacgtgcatcctatgcaaggtgatcttctacctgctgatcgtcgcaggcaccgtggggaagaagttcaagcagtaccgcgagctccggccgcagacctgcactatctgcgagaccacgcccgtgaacgccatcgacgccgagatgcacgacctgaactgctcctacaacatctgcccctactgcgctagcagactgacgtccgacggcctcgcgaggcacgtcatgcagtgcccgaagcgcaaggagaagatcgaggaaaccgagctgtacctgaacctcgagcggatcccctgggtggtgcgcaagctgctgcaagtcagcgagtccaccggggtagccctcaagcggtctagttggctgaccgtgctgcttgtcctgctcatcgtgagcctctcccccgtgcagagcgcccccatcggccacggcaagacaatcgagacctatcaggcccgcgaggggtacacctccttctgcctgttcatcctgggcagcatactcttcatcgtctcctgcctggtgaaggggctcatcgatagcgtgggcaacagcttcttccctgggctctctatctgcaagacctgcagcatcggctccgtcaatggcttcgaaatcgagagtcacaagtgctactgctccctgttctgctgcccctactgccgccattgcagcgccgaccgtgagatccacaagctgcatctctccatctgcaagaaacggaagacggggagtaacgtgatgagtgcggtgtgcaagcgcatgtgcttccgcgccactatcgaggtctccaatcgggccctgctgatccgctccatcatcaacaccaccttcgccgtgtgcatcctgacgctggccgtgtgcgtcgtgagcaccagcgcggtggagatggagtccctgcccgccggcacctgggagagagaggaggacctcaccaacttctgccaccaagagtgccaggtcacggaaaccgagtgcctgtgcccctacgaggccctggtgctccgcaagccgctgttcctggactccatcgtgaaggggaagaagaacctcctgaacagcacgtccctagagaccagcctctcgatcgaggccccctggggcgcgatcaacgtccagagcacgttcaagcccaccgtgagcgccgccaacatcgccctgtcctggagctccgtggagcaccgagggaacaagatccttgtcagcggccgctccgaaagcatcatgaagctcgaggagcggaccggtatctcctgggacctgggggtggaggacgccagcgagtccaagctcctcaccgtgagcgtcatggacctgtcccagatgtacagccccgtatttgagtacctgtccggcgaccgccaggtagaggagtggccgaaggcgacgtgcaccggggactgccccgagagatgcggctgcaccagctccacgtgcctccacaaggagtggccccacagccgcaactggcggtgcaaccccacctggtgctggggcgtcgggaccggctgcacgtgctgcgggctggacgtaaaggacctattcaccgactacatgttcgtgaagtggaaggtcgagtacattaaaacagaggccatcgtgtgcgtggagctgacctcccaggagcgccagtgcagcctgatcgaggccggaacccggttcaacctggggccggtaaccatcacgctctccgagccccgcaacatccagcagaagctgccgcccgagatcatcaccctgcacccccggatcgaggagggcttctttgacctcatgcacgtgcagaaggtcctgagcgccagcaccgtgtgtaagctgcagtcctgcacccacggcgtgcccggggaccttcaggtctaccacatcggcaacctgctgaagggggacaaggtgaacggccacctcatccacaagatcgagccccacttcaacaccagctggatgagttgggacgggtgcgacctggactactactgcaacatgggtgattggcccagctgtacgtacactggcgtgacccagcacaaccacgccgcgttcgtcaacctgctcaacatcgagacggactacacgaagaacttccacttccactcgaagcgcgtgaccgcccatggggacaccccgcagctggacttaaaggcccggcccacctacggcgccggggaggttacggtcctcgtggaggtggccgacatggagcttcacaccaagaagatcgagatcagcggcctgaagttcgcgtccctcagctgcaccgggtgctacgcctgctccagcggcatctcctgcaaggtgcgaatccacgtggacgagcccgacgagctgaccgtgcacgtgaagtccgaggaccccgacatcgtggccgccggctccagcctgatggctcggaaactcgagttcggggcggactccacgttcaaggccttctctgccatgccgaagacctccctgtgcttctacatcgtggagcgcgagtactgcaagagctgctccagggaggacacccagaagtgcgtcaataccaagttagaacgcccccagagcatcctcatcgagcacaagggaacgatcatagggaagcagaacgacacgtgcaccgccaaggcgagctgctggctggagtccgtcaagagcttcttctacggcctgaagtcgatgctcagcggcatcttcgggaatgtgttcatcggcatcttcctgtttatcgccccctttgtgctgctcatcctgttcttcatgttcgggtggcgcatcctcttctgtttcaagtgttgccggcgcacccggggactgttcaagtaccgccacctcaaggacgacgaggagaccgggtaccggaagatcatcgagaggctgaacaacaagaagggcaagaacaagctgctcgacggcgagcgtctggccgaccgcaagatcgccgagctttttagcaccaagagccacatcgggtga

SEQ ID NO: 15201 - RNA, 5070 nt, synthetic construct
  misc_feature 1..5070: note = derived and/or modified CDS sequence (opt11) from CCHFV(SPU 18/88)__KJ682810.1__GP
  source 1..5070: mol_type = other RNA
atgcccttcaacatcatgtacaccccactgctctgcgccatcctgtgcctgcagctctggagcctggagggcatctacgggctgtccaataagacccagcacaacgatacgagcaccatcaaggtgcccgaggagtcccagaagaccagcctccccgccaacaccgcgtccccaatcacgagcgacccgtccagcgccacttccaccgccctggccagcggccccgaggggtccggcgacaccagcacgtcccccagcgtcaccacccaggggcccaccctgctcgagacgactccggagccccacaccaccatcgacatcgacgagtccagcacggccatcgcggacatttccacccagaccgtgaaggacatccccacccccacgacccacaccagcctgccgagcacccccagcgcccccacgatcccgcaggaggcccaccacaccgcccgcggcctgctcagcgtgacctccaccaagccgggcgagacgagcacccccacctcccccggggaggcgagcaccgaggccagtagcccccagccgacgatctccgagaccccgagcccgccgcccaccacccaagcccccacggagatcaacaacccaaacacctcccggcagcccatgcccagcacccagcccgccgcccccaactccgtcacccctcccgtgcagcccaccttcagccagtccgacgtgagcacggtcgcgcaggacatccacccctccccgaccaaccgcagcaagcggaacctggagatggagatcatcttaaccttatcccagggcttaaagaagtactacgggaaggtgctgaagctcctggatctgaccctcgaggaggacacggagggcctgttggagtggtgcaagcgcaacctcgggctgacctgcgacgacaacttcttccagaaacggatagaggagttcttcctgaccggcgagggccacttcaacgaggtgctccagttcaagacccccagcacgctgtcccccaccgagcccgcccgcgtcgagagcccgacggtggagcccttcaagagctacttcgccaaggggttcctgtcaatggacagcggctacttctccgccaagtgctaccccaagagctccaacagcgggctccagctgatcaacgtgacccagcactccatccggatcacggacactcccggcccgaagatcaccagcctgaaaaccatcaactgcatcaacctcaaggccctggtcttcaaggagcaccgcgagatcgagatcaacgtgctgctcccccaggtggcggtcaacctgtccaactgccacgtgctgatcaagagccacgcctgcgactactccctcgacatcgacggccccgtgcggctgccccggatccaccacgaggggacgttcatcccgggcacgtataagattgtcatcgacaagaagaacaagcagaacgaccggtgcaccctggtgaccaactgcgtgatcaaggggcgcgagatccggaagggccagagcgtcctccgccagtaccggacggagatcaagatcgggaaggcctccagcggctcccgccggctgctgagcgaggagtccaacgacgactgcctcagccgcacccagctgctgcggaccgagaacgccgagatccacagcgacaactacggcgggcccggcgacaagatcacgatctgcaacgggtccacgatcgtggaccagcgcctcggcagcgagctggggtgctacaccatcaaccgggtgaagtccttcaagctgtgcgagaacagcgccaccggcaagtcctgcgagatcgacagcacccccgtccgctgccgtcagggcttctgcctaaagatcacgcaggaggggcggggccacgtcaagctgtcccgcgggagcgaggtcgtgctggatgcgtgcgactccagctgcgagatcatgatccccaagggcaccggggacatcctggtggactgctccggcggccagcagcactttctcaaggacaaccttgtcgacctggggtgcccgaacatccccctcctgggcaagatggccatctacatctgccggatgagcaaccaccccaagacgaccatggggttcctgttctggttctccttcggctacgtgatcacgtgcatcctctgcaaggtgatcttctatctgctgatcgtcgtgggcaccctcgggaagaagttcaagcagtaccgcgagctgaagccccagacctgcaccatctgcgagacgaacccggttaacgccatcgacgccgagatgcatgacctgaactgcagctataacatatgcccctattgcgcctcccgactcaccagcgacggtctagcgagacacgtcatgcaatgccccaagcggaaggagaagatcgaggagaccgagctgtacctcaacctggagcgcatcccgtgggtggtgcggaagttactccaggtctccgagtccaccggggttgccctgaagcgctccagctggctggtgatcctcctggtactgctcaccgtgagcctgtcccccgtgcagagcgctcccatctcccacggcgagactgtcgaggtgtaccagaccagagaggggtacacctctatctgcctgttcgtgctcggctccatcctgttcctggtcagctgcctcatgaagggtctggtggactccgtggggaacagcttcagtcccggcctgagcatctgcaagacctgctccatcgggagcatcaacggcttcgagatcgagtcccacaagtgctactgcagcctcttctgttgcccgtactgccgccactgctccgccgacatcgagatccacaagctgcacctgagcatttgcaagaagcggaagactggatccaacgtcatgctcgcggtgtgcaagcgcatgtgcttccgggccacggtggaggtcagcaacaaggccctgctgatccgcaacatcatcaacaccaccttcgtggtgtgcatcctcatccttgccgtctgcgtggtgtctacgagcgccgtggagatggagaacctgcccgcgggcacctgggagaaggaggaggacctcaccaacttctgccaccaggagtgccaggtgaccgagacggagtgcctgtgcccctacgaggccctggtgctccggaagcccctgttcctggacagcatcgtcaagggcaagaagaacctcctgaactccaccagcctggagacctctctcagcatcgaggccccgtggggcgccatcaacgtccagtccaccttcaagccaacggtgagcgccgcgaacatcgccctgtcctggtcctccgtcgagcaccgcgggaacaagatcctggtgagcgggagatccgagagcatcatgaagctcgaggagcgcaccggcatctcctgggacctgggggtggaggacgccagcgagtccaagctgctcaccgtcagcgtgatggacctgtcccagatgtacagccccgtgttcgagtacctgtccggcgaccgccaggtcgaggagtggcccaaagcgacctgcacgggcgactgcccggagcggtgcggatgcaccagcagcacctgtctccacaaggagtggccccactcccgcaactggcggtgcaaccccacctggtgctggggcgtggggaccggctgcacgtgctgcgggctggacgtgaaggacctgttcaccgactacatgttcgtcaagtggaaggtggactatatcaagaccgaggccatcgtgtgcgtggagctcaccagccaggagcgccagtgctccctgatcgaagccggcacccggttcaacctgggccccgtgaccatcaccctctctgagccgcgcaacatccagcaaaagctgccgcccgagatcgtcacgctgcatccccggatcgaggaggggttcttcgacctcatgcacatccagaaggtgctatccgcaagcaccgtgtgcaagctgcagtcctgcacccacggcgtccccggggacctccagatctaccacatcggcaacctgctgaagggagacaaggtcaacgggcacctcatccacaagatcgagccccactttaacaccagctggatgtcctgggatggctgcgacctggactactactgcaacatgggagactggcccagctgctcctacacgggcgtgacgcagcacaaccacgccgccttcgtcaacatgctgaacatcgagaccgactacaccaagaacttccacttccacagcaagcgcgtgaccgcgcacggggacaccccgcagctcgacctgaaggcccggcccacctacggcgccggcgagatcaccgtgctggtcgaggtggccgacatggagctccacaccaagaagatcgagatctccgggctgaagttcgccagcctcacgtgcaccggctgctacgcgtgcagtagcgggatatcctgcaaggtgcgcatccacgtcgacgagcccgacgagctcacagtgcacgtcaagagcgaggaccccgacatcgtggccgcctccagcagcctgatggcccggaagctggagttcggcaccgactccacgttcaaggccttcagcgcgatgcccaagacctccctctgcttctacatcgtggagcgcgagtactgcaagagctgctccaaggaggacacccagaagtgcgtgaacaccaagctggagcagccgcagagcatcctgatcgagcacaaggggacgatcatcggcaagcagaacgacacgtgcaccggcaaggcagggtgctggctcgagtccattaagagcttcttctacggcctgaagaacatgctgtccgggatcttcggcaacgtcttcatcgggatcttcctgttcctcgcccccttcatcatgctgatcctgttcttcatgttcggctggcggatcttattctgcttcaagtgctgccgccggacccgcggcctgttcaagtaccggcacctgaaggacgacgaggagatcgggtaccgcaagatcatcgagcggctcaagaacaagaagggcaagaacaagctgctggacggggagcgcctcgccgaccggaagatcgccgagctgttcagcaccaagacccacatcggctga

SEQ ID NO: 15202 - RNA, 5070 nt, synthetic construct; identical to SEQ ID NO: 11916
  misc_feature 1..5070: note = derived and/or modified CDS sequence (opt11) from CCHFV(SPU 497/88)__KJ682808.1__GP
  source 1..5070: mol_type = other RNA

SEQ ID NO: 15203 - RNA, 5070 nt, synthetic construct
  misc_feature 1..5070: note = derived and/or modified CDS sequence (opt11) from CCHFV(SPU 130/89)__KJ682807.1__GP
  source 1..5070: mol_type = other RNA
atgcccttcaacatcatgtacaccccgctcctctgcgccatcctatgcctgcagctctggagcttggagggcatctacgggttgtccaacaaaacacaacacaacgataatagcaccaccaaggcaccagaggagtcccacaagacgagcctccccgcgaacaccgcctcacccatcacgagcgacccgccctccactactagcaccacctccgccagcggccccgaggggtccggcgacaccagcacctccccacccgtgaccacgcaggggcccgccagccccgagaccacgcccgagccacacaccacgatagacattgacaagtctagcaccgctatcgcggacatctccacccagaccgtaaaggacatccccacgccaaccacccacaccagcctgccctccacgctcagcgccccgaccattccccaagaggcccaccacaccgcacgcggattgctgagcgtgacccggcacaagcccggcgaggcatcaaagccaacgtcgccgggggaggcctccactgaggccagctcctcacaaccaaccatttccgagactcccagccctccgccgaccacccaagcccccaccgagatcaacaaccccaacacctcccgtcagccgatgccctcaacgcagcccgccgcaccgtccagcgtcacacaccccgcccagcccaccccctcccagagcgacgtccccaccgccgcccaggacatccacccctcccccaccaatcggagcaaacgcaaccttgagatggagatcatcctcacactatcccaggggctgaagaaatactacgggaaggtgctcaagctcctggatctcaccttggaggaggacaccgagggcttactcgaatggtgtaagaggaacctggggctgacctgcgacgacaacttcttccaaaaacgcatcgaagagttcttcctcacgggcgagggacacttcaacgaagtactgcaattcaagaccccctcgaccctgagtccgaccgagcccgccagggtcgagagccccacggtggagcccttcaagagctacttcgctaaggggttcctctccatggacagcggctacttttccgctaagtgctaccccaagagctccaacagcgggttgcagctgatcaacgttacccagcacctcatccgcatcaccgacacccccggccccaagatcaccaacctaaagaccatcaattgcataaacctgaaggctctcgtcttcaaggagcaccgggagatcgagataaatgtgctgctgcctcaggtggccgtcaacctctccaactgccacgtgctgatcaagagccacgtttgcgactactccctggacatagacggcccggttaggctccccagcatccaccacgaggggaccttcatccccggcacctacaagatcgtgatcgacaagaagaacaagcagaacgaccggtgcactttggtgaccaattgcgttatcaaggggcgcgagatcagaaaaggccagtccgttctgcgccagtatcggaccgagattaagatcgggaaagctagctccggcagccgccggttgctgtctgaggagcccaactacgattgtctgagccgcacacagctcctgcggacggaaaacgcggagatccattccgacaactacggcgggcctggcgacaagattaccatatgcaacggtagcaccattgtggaccagcgcctgggatccgagctcggatgctataccatcaaccgcgtcaagtcgttcaagctctgcgagaactctgcgacgggcaaatcctgtgagattgacagcaccccagtgcggtgccgccagggcttctgccttaagataacccaggagggtcggggacacgtgaaactttcccgcggtagcgaggtcgtgctcgatgcttgcgactccagctgcgagattatgatacccaagggcacaggggacatactggtcgattgctccggcggccaacagcacttcctgaaggacaacctcgtggacctggggtgccccaacattccgctgctcggcaagatggctatctacatctgtaggatgagcaaccaccccaagacgaccatggccttcctgttctggttctccttcggatatgtgatcacgtgcatactgtgcaaagtcatcttctacttattgatcgttgtgggcaccctgggaaagaaattcaagcagtacagagaactcaagccccagacctgcaccatctgcgaaacgaacccagtcaacgcgatcgacgcggagatgcacgacctgaactgcagctacaacatttgcccctactgcgccagccggcttacctccgacggtctcgcacgccacgtgatgcaatgccccaagcggaaggagaaaatcgaggagacggagctgtatctgaacctcgaacgcattccctgggtcgtccggaagctgttacaggtgtccgagagcaccggcgtggcgcttaaacggtcctcttggctggtcgtgctgctcgtgttacttaccgtctccctcagcccggtgcagagcgcccctatctcccacggggagacggtggaggtctaccagacccgggagggctacacgagcatctgcctgttcgtgctagggtcaatattattcctggtgagctgcctgatgaagggtctcgtcgattccgttggaaacagctttttcccggggctgtccatctgcaagacctgctcgatcggctccatcaacgggttcgagatcgaaagccacaagtgctactgctccctgttctgctgcccctattgccgccactgcagcgcagacatcgagatccacaagctccacctgtccatctgcaagaagcgtaaaaccggctctaacgttatgctggccgtctgtaagcgcatgtgctttcgggccaccgtggaggtttcaaacaaggcgctcttgatccgcaacattatcaacacgaccttcgtagtttgcatcctgatcctcgcagtgtgcgtcgtgagcacctcggcggtggagatggagaacctgcccgcaggcacctgggagaaagaggaggacctgacgaacttctgccaccaggagtgccaggtaaccgagaccgaatgtctctgcccctatgaggccttggtgcttcggaagccacttagcctggacagtatcgtgaagggcatgaagaacctgctcaacagcaccagcttagaaacgagtctgagcatcgaggcgccctggggcgctatcaacgtgcagtccacctttaaaccaaccgtgagtgccgccaacatcgcactctcctggagttccgtggaacacagggggaacaagatcttagtcagcggacggtccgagagcatcatgaagctggaagaacgcactggaatatcctgggacctaggcgttgaggacgcgagcgagtccaagctgctaacggtgtccgtgatggacctgtcccagatgtacagcccggtgttcgagtatctgtccggggatcgccaggtggaggaatggccgaaggccacatgcaccggcgactgcccggagcggtgtggctgcaccagcagcacgtgccttcacaaggagtggccgcattctcgaaactggcggtgcaaccccacctggtgctggggcgtagggaccgggtgcacgtgctgcggcctagacgtgaaggacctattcaccgattacatgttcgtgaagtggaaggtcgactacatcaagaccgaggccatcgtgtgcgtggagctgaccagccaggagcggcagtgctccctcatagaggccggcaccagattcaatctgggccccgtcacgatcacccttagcgagcccagaaatattcagcagaaactcccgcccgagatagtcaccctgcacccccggatcgaggaaggattcttcgatctgatgcatatccagaaggtgctctccgcaagcacagtgtgcaagctgcagtcctgcactcacggggtgcccggcgacctgcagatctaccatatcgggaacctcctgaagggcgacaaggtcaatggacacctgatccacaagatcgagccgcacttcaacaccagctggatgtcatgggacggctgcgacttggactactactgcaacatgggcgactggcccagctgctcctataccggggtaacccagcacaaccatgccgccttcgttaacatgctgaacattgagactgactataccaagaacttccacttccactccaagcgcgtcaccgcccacggcgacacccctcagctggacctcaaggcccggcccacctacggggcgggcgagatcaccgtgctggtagaggtcgccgacatggagctccataccaagaaagtggagatctccggcctaaagtttgccagcctgacttgcaccgggtgctacgcctgctccagcgggatctcctgtaaagttcgcatccacgtcgatgagccagacgagcttacggtgcacgtcaagagcgaggatccagatatcgtggccgcctcgagctccctcatggcccggaagctggagttcgggacagacagcaccttcaaggccttctccgccatgcccaagacctccctgtgcttctatatcgttgagcgcgagcactgcaagagctgctccaaagaggacacgcaacggtgcgtgaacactaagctcgaacagcctcagagcatcctgatcgagcacaaggggaccatcatcgggaagcagaacgacacgtgcacagccaaggcgtcctgctggctggagagcatcaagtccttcttctatggcttaaagaacatgctgagcggcatcttcgggaacgtcttcatcggcgtgtttctgttcctggcccccttcatcatcctcatactattcttcatgttcgggtggaggatcctgttctgcttcaagtgctgccggaggacgaggggtctcctgaagtaccgccacctgaaggacgacgaggagatcggctaccggaagatcatcgagcgcctcaacaataagaagggcaaaaacaagctactggacggcgagcggctcgccgaccgaaagatcgccgagctgttttccaccaaaacccacatcggatga

SEQ ID NO: 15204 - RNA, 5070 nt, synthetic construct
  misc_feature 1..5070: note = derived and/or modified CDS sequence (opt11) from CCHFV(SPU 383/87)__KJ682806.1__GP
  source 1..5070: mol_type = other RNA
atgcccttcaatatcatgtacacgcccctactctgcgccattctgtgcctgcaattatggtccctggagggtatctacgggctgtccaaccgcacccagcataatgacacctccaccatcaaggtgcccgaggagtcccagaaaaccagcctccccgccaataccgcgtctcccattaccagcgaccctccctccaccaccagcaccgcctccgccagcggccccgaggggtccggggacacctcaaccagcccacccgtcacgacccaagggcccaccccgcccgagactactcccgaaccgcacaccaccatcgacatcgacaagtcctccaccgccatcgccgacatcagcactcaaacggtgaaggacatccccacgcccaccacccacacctccttgccgagcacgctgtccgcgcccactatcccccaggaggcccaccacactgcccgaggcctgctgagcatcactagcacgaaacccggcgaggcatcgaccccgattagccccggggaggcctccaccgaggcctctagcccgcaacccaccattagcgagacgccgagcccgccgcccaccgcgcaagcccccaccgagattaacagccccaacacctcccgccagccaatgccctcgacgcagcccgccgcgcccaactccgtgacccaccccgcccagccgaccccctctcaatcggacgtcccaacagccgcgcaggacatacatccaaacccgatcaaccggagcaagcgcaacctggagatggagatcatcttgactctctcgcagggcctgaagaagtactacgggaaggtgctcaagctgctagatctcacgctggaggaggacacagaaggcctgctcgagagctgcaagcggaacctgggattgacctgcgacgacaacttcttccaaaagcgcatcgaggagttctttctcactggcgagggccacttcaacgaggtcctgcagttcaagacgcccagcaccctgagccccaccgaaccagcccgggtagagtccccgaccgtggagcccttcaagtcgtacttcgccaaggggttcctaagcatggactccggatacttcagcgccaaatgctactccaaaagctccaatagcgggctgcagctgatcaacgtcacgcagcacctcatccgcatcaccgacacccccggcccgaagatcaccaacctgaagacaatcaactgcatcaatctgaaggccctcgtcttcaaggagcaccgggagatcgaaatcaacgtgctgttgccccaggtcgccgtcaacctctcaaactgccacgtactcatcaagagccacgtgtgcgattactccctggacatcgacggccccgtccgccttccccgcatccaccacgagggtaccttcatccccggcacctataagatcgtgatcgataaaaacaacaagcagaacgaccgctgtacgctggtgacgaactgcgtcatcaaagggcgggagatccgcaaaggccaaagcgtgctgaggcaataccgcaccgaaatcaagatcgggaaggcctccagcggctcccggcgcctcctgagcgaggagtccaatgacgactgcctgagccggacccaactcctgaggaccgagaacgcggagatccacagcgacaactacggagggccgggcgacaagatcacgatttgcaacgggagcaccatcgtggaccagcgtctgggctcggagttggggtgctacacaatcaacagggtcaagtccttcaagctgtgcgagaatagcgccaccggcaagtcttgcgaaattgacagcacgcccgtacgctgccggcaggggttctgcttgaagatcacccaggaggggaggggtcacgtgaagttgtcccgggggagcgaagtcgtgctcgacgcctgcgactccagctgcgagataatgatccccaaggggaccggagacatcctggtcgactgctccggcggccagcagcacttcctgaaggacaacttagtggacctggggtgccccaacatccccctgctcggcaagatggccatctacatctgccgcatgagcaaccatcccaaaaccacgatggcattcttgttctggttctctttcgggtacgtgataacgtgcatcctgtgcaaggtaatcttctacctcctggttgtggtcggcaccctgggcaaaaagttcaagcaataccgcgagctcaagccccagacctgcacgatctgcgagaccaacccggtgaatgcaatcgacgctgaaatgcacgacctgaactgcagctataacatatgcccctactgtgcctcccgcctgaccagtgatgggctagcccggcacgtgatccagtgccctaaacgcaaggagaagatcgaggaaaccgagctctacctgaacctcgagcggatcccctgggtcgtgcgcaagctcctccaggtgtccgaaagcacgggagttgcattgaagcggtcctcttggctagttatactactcgtgctgttgactgtttccctcagccctgtgcagagcgcccccatctctcatggtgagaccgtggaggtttaccagacccgcgagggctacacaagcatctgtctatttgtgctggggtctatcctcttcttggtcagttgtctgatgaaaggcctcgtagactccgtgggcaacagcttcttccccgggctgtccatatgcaaaacgtgcagcatcggctccatcaacggcttcgagatcgagagccacaagtgctactgctccctattctgctgtccctattgccggcactgctcagccgacatcgagatacaccgactccacctgtccatctgtaaaaagcggaagaccggatctaacgtgatgctggccgtctgcaagcgcatgtgctttcgggctaccgtggaggtttccaacaaagcactcctgattcgcaacatcatcaatacgacgtttgtcgtctgcatactgatcctcgccgtgtgcgtcgtgtcgacctcagccgtggaaatggaaaatctgccggccgggacctgggagaaggaggaagacctgaccaatttctgccaccaagagtgtcaggtcacggagaccgaatgcctctgcccctacgaggccctcgtgcttaggaagcccctcttcctagacagcatcgtgaagggaatgaagaacctgctcaacagtacgagcctggaaaccagcctatccatcgaggcgccctggggcgccataaacgtccagagcaccttcaagccgaccgtttccgccgccaacatcgccctcagctggtccagcgtggagcatcgcgggaacaagatcctggtctccggccgcagcgagtccatcatgaagctggaggagcggaccgggatcagctgggacctcggtgtggaggacgcgtccgagagcaagctgctaaccgtgtccgtaatggacctcagccagatgtactcccccgtgttcgaatacctgagtggggaccgccaggtagaggaatggcccaaggcgacgtgcaccggcgactgccccgagcggtgcggctgcacctcgtccacatgcctgcacaaggagtggccgcacagccgcaactggaggtgcaacccaacctggtgctggggcgtaggcacgggctgcacgtgctgcggcctcgacgtgaaggacctattcaccgactacatgttcgtgaagtggaaagtcgattacatcaaaacggaagccatcgtgtgcgtggaacttaccagccaggagcgccagtgcagcctcatcgaggcaggaacccggttcaacctgggcccagtcaccatcacgctgtcagagccccgtaatatacagcagaagctaccgcccgagatcgtgaccctgcacccccggatcgaggaaggcttcttcgacctgatgcacatccagaaggtcctcagcgcgtccaccgtgtgcaaactgcagagctgcacccatggggttcccggcgacctgcagatatatcacatcggtaacctcctgaagggcgacaaggtcaacggccacctgatccacaaaatcgagccgcacttcaacacgagctggatgagctgggacggctgcgatctcgactactactgcaacatgggcgactggccctcctgctcttatactggcgtcacccagcacaaccacgccgccttcgtgaacatgctaaacatcgagacggattacacaaagaacttccacttccactccaagcgcgtaaccgcccacggcgacacgccccaactggacctcaaggcccggcccacctatggcgcgggcgagatcacagtgctggtggaggtcgccgacatggagctccacacgaagaagatcgagatcagcggcctgaagttcgcctccctgacctgtactgggtgctacgcctgcagctccggcatcagctgcaaggtgagaatccacgtggatgagccggacgagctgaccgtccatgttaagtccgaggaccccgacattgtggccgcgagctccagccttatggcccggaagctggagttcggtacggactccaccttcaaggccttcagcgccatgccaaaaactagcctgtgcttctacatcgtcgagcgcgagtactgcaagtcctgcagcaaggaggacacccagaaatgtgttaacacgaagctcgaacagcctcagtccatcctgatcgaacacaagggaaccatcttcgggaagcaaaacgatacgtgcacggccaaggcgagttgttggctggagtccgtgaagtccttcttttacgggctcaagaacatgctgtccggcatttttgggaacgtcttcatcggcgttttcctgtttcttgcccccttcatcatgttaatcctgtttttcatgttcgggtggcggattctcttctgcttcaagtgctgccggcgtacgcgcggcctcttcaagtaccgacacctgaaggacgacgaggagataggataccgcaagatcatcgagcgtctgaacaacaagaagggtaagaacaagctcctcgacggcgagcgcctggctgaccgtaagatcgccgagctgttcagcacgaagacccacatcgggtga

SEQ ID NO: 15205 - RNA, 5070 nt, synthetic construct
  misc_feature 1..5070: note = derived and/or modified CDS sequence (opt11) from CCHFV(SPU 44/08)__KJ682805.1__GP
  source 1..5070: mol_type = other RNA
atgcccttcaacatcatgtacacacccctcttgtgcgccatcctgtgcctgcagctctggagcttagagggcatctacggactgtccaacaacacccagcacaacgataccagcaccattaaggtgcccgaggagtcccagaagacctccctccccgccaacaccgcgtcccccatcacgagcgacccgccgcccacaacccccaccgcctccgccagcggcccggaggggtccggcgacacgagcacctccccgcccgtcaccacccaggggcccacgccgcccgagaccacgcccgagccccacacaacgatagacatcgacaagagctccaccgcaatcgccgacatcagcacccagaccgtgaaaaacatccccacgcccaccgcgcacacctccctgcctagcaccctgtccgcgcccacgatgccgcaggaggcccaccacaccgcccgcggcttgctgagcgttacctccaccaagcccggtgaggcgagcacgcccacctcgcccggggaggcctccaccgaggccagctccccgcagcccaccatccgggaaacgccaagcccgccgcctacgacccagacccccacggagatcaacaaccccaacacctcccgccaacccatgcccagcacgcaacccgccgccccgtccagcgtcactcaccctgcgcagcccaccccctcccaaagcgacgtgccgacggccgcccaagacattcacccatcccccaccaaccggagtaagcgcaacctggagatggagatcattctcaccctatcccagggcctgaagaagtactacgggaaagtgctcaagctgctcgacctcaccctggaggaggacacggagggcctgctcgagtggtgcaaacggaacctggggctgacctgcgacgacaatttcttccagaagcgcatcgaggagttcttcctcaccggcgagggccacttcaacgaggtcctgcagtttaagacccccagcacgctgtccccgaccgagcccgcccgggtggagagccctaccgtggagccattcaagtcctacttcgccaagggtttcctcctgatggacagcggctacttctccgcgaagtgctacccaaagagcagcaactccgggctgcagctaatcaacgttacccagcaccttatccgcatcacggacacccccggccccaagatcaccaacctgaaaaccatcaactgcatcaacctcaaggctctagtgttcaaggagcaccgggagatcgagatcaacgtgctgctcccccaagtcgccgtgaacctgtcaaactgccacgtgcttatcaagtcccacgtctgcgactacagcatagacatcgacggccctgtgcgcctcccccgtattcaccacgaggggacgttcatccctggcacctacaagattgtgattgacaagaagaacaagcaaaacgaccgctgcactctggtcaccaactgcgtgataaaggggcgggagatccgcaagggccagtccgtgctgcggcagtaccgcacggagattaagatcgggaaggccagctccggtagccggcgcctcctgagcgaggagagcaatgacgactgcctgtcccggacccagctcctgcgcaccgagaacgccgagatccacagcgacaactacggcgggcccggtgacaagatcaccatctgcaacgggtctacgatcgtcgaccagcggctgggtagcgagctggggtgctacaccatcaaccgcgtgaagtccttcaaactgtgcgagaacagcgcgaccggcaagtcctgcgagatcgacagcactccggtgcgctgccgccagggcttctgcctgaagatcacgcaagagggccgcggccacgtcaagctgagccgggggtccgaggtggtcctcgacgcctgcgacagctcctgcgagataatgatccccaagggcaccggggacatcctggtggactgcagcggcggccagcaacacttcttgaaggacaacctcgtggacctggggtgccccaacatccccctgctcggcaaaatggccatctacatttgccgcatgtccaaccaccccaagaccacaatggccttcctgttctggttcagcttcgggtacgtcatcacgtgtatcctgtgcaaggccatcttctacctcctgatcgtggtgggcaccctgggcaagaagttcaagcagtacagggaattaaagccacagacctgcaccatctgcgaaacgaaccccgtcaacgcgatcgacgccgagatgcacgacctgaactgctcatacaacatctgcccgtactgcgccagccgactgacctccgacgggctcgcccggcacgtgatgcagtgccccaaacgcaaagagaagatcgaggagaccgagctgtacctgaacctcgagcggatcccctgggtggtcaggaagctgctccaggtgagcgagtccaccggcgtggcgcttaagcggagctcctggctggtcatcctgctcgtgctgctgaccgtgagcctctcccccgtccagtccgccccgatcagccacggggagacggtggaggtgtaccagacccgcgagggctacaccagtatctgcttgttcgtcctggggtccattctcttcctcgtaagctgcctaatgcggggcctcgtggacagcgtcagtaacagtttcttccccggcctgtccatctgcaagacctgcagcatcggttccatcaacggcttcgagatcgagagccacaagtgctactgctccctgttctgctgcccctactgccgccactgctccgccgacatcgagatacacaagctccacctgtccatctgcaagaagcggaagaccgggtcaaacgtgatgcttgccgtatgcaagcgcatgtgcttccgggccaccgtcgaggtgtccaacaaggcactcctgatccgcaacatcatcaataccaccttcgtggtctgcatcctgatcctagccgtgtgtgttgtcagcacgtccgccgtggagatggagaacctgcccgccggcacctgggagaaggaggaggacctgaccaacttctgccaccaggagtgccaggtgaccgagacggagtgcctctgcccgtacgaggccctggtcctgcggaagcccctcttcctggacagcatcgtgaaggggatgaagaacctgctcaactccaccagcctggagacctccctgagcatcgaggcgccctggggcgctatcaacgtgcagtccaccttcaagccgacggtaagcgccgccaacatcgccctctcgtggtccagcgtggagcaccgcggcaacaaaatcctggtatccgggcgcagcgaatccatcatgaagctggaggagcggacgggcattagctgggacctcggggtcgaggacgcgtccgagtcaaagctgctgaccgtgtccgtgatggacctcagccagatgtactccccggtcttcgaatacctgagcggcgacaggcaagtggaggagtggcccaaggcgacctgcacgggggactgccccgagcggtgcggctgcacctccagcacgtgcctgcacaaggagtggccgcactcccgcaactggcgatgcaatccaacctggtgctggggcgtgggaacaggatgcacgtgctgcgggctcgatgtcaaggaccttttcaccgactacatgttcgtgaagtggaaggtggattatatcaagaccgaggccatcgtctgcgtggaactgacgagccaggagcgccagtgctccctcatagaggccggcacccggttcaatctggggcccgtaaccatcaccctaagcgagccccgcaacatccagcagaagctgcccccggagatcgtcacgctgcacccccggatcgaggagggcttcttcgatttgatgcacatccagaaggtactctccgccagcaccgtctgcaagctgcagagctgcacccacggcgtgcccggggacctgcagatctaccacatcggcaatctcctgaagggggacaaggtgaacggccacctgatccacaagatcgagccccacttcaacacctcctggatgagctgggacggctgcgacctcgactactactgcaacatgggggactggccgtcctgcagctacacgggcgtcacccagcacaaccacgccgccttcgttaacatgctgaacatcgagaccgattacacgaagaacttccacttccactccaagcgcgtgaccgcccacggggacacgcctcagctggacctcaaggcccggcccacctacggcgcgggggagattaccgtcctggttgaggtggcggacatggagctgcacactaagaagatcgaaatcagcggcctcaagttcgcctccctgacgtgcaccggctgctacgcctgcagctccgggatcagctgcaaggtccgcatacatgtggacgagccggacgagctgacagtgcacgtcaagtccgaggaccccgacattgtggccgcgagctccagcctcatggcccggaagctggagttcggcaccgactccactttcaaggccttcagcgccatgcccaaaacctccttgtgcttctacatcgtggagcgcgagtattgcaagagctgcagtaaggaggacacgcaaaagtgcgtcaataccaagctcgagcagccccagagcattctgatcgagcacaaagggacgatcatcggcaagcagaacgacacttgcaccgctaaagcgagctgctggctcgagtccattaagagcttcttctacgggctcaagaacatgctgagcggcatcttcggcaacgtgttcatcgggatctttctgttcctggccccgttcatcatgctcatcctgttcttcatgtttggctggcggatcctgttttgcttcaagtgctgccgccggacccgcggcctattcaagtaccggcacctgaaggacgacgaggaaattgggtaccgcaagatcatagagcggcttaacaacaagaaagggaagaacaagctccttgacggcgagcgcctggccgaccgcaagatcgccgagcttttctctaccaagactcacattgggtga

SEQ ID NO: 15206 - RNA, 5070 nt, synthetic construct
  misc_feature 1..5070: note = derived and/or modified CDS sequence (opt11) from CCHFV(Matin)__AF467769.2__GP
  source 1..5070: mol_type = other RNA
atgagcttcaacatcatgtacaccctgctgctgtgcgccatcctgtgctcccagctgtggagctccgaggggatccacgggctgagcaacgagacccagcacggcaacgcctccaccataaaggcccccgaggtaagccaggggctgggcctccccgtctcgaccgcgccgcccatcaccagcgacccgcccagcatcaccagcgccgcctccgtgagcgggcccgaaggctccggcgacaccaacacctccccgcccgtgaccacccaggggctgaccctgcccgagaccaccctcgagctgctgaccaccaccaacacgggcgcctccagcaccgtcatcgtggacgtgtccacccagaccgtcaaggacacccccgtgagcaccgcccacaccagcccgcccgggacccccagcgcccccaccacgccccagggcacgcaccacaccgcccgcgggctcctgagcgtgacctccaccaagagcgaggaggcctctacccagaccaaccccaagaagaccagcatggagaccaattccccgggcccagcgacgagtgagaccccgtcccccagccccaccacccaggcccccacggagaacaacaaccccaacacgccccggcagccgacgccacccacccaacccgccaccccgtcccccgtcacgagccccgccctgctcgcctcgagccagggcgacacctccaccgcggtgcaggacgtgcacccgagccccaccaaccgctccaagcggaacctggagatggaaatcatcctaacgctcagccaagggctgaagaagtactacggcaagatcctgaagctcctggacctgaccctcgaggaggacaccgaggggctgctggagtggtgcaagcgcaacctcggcctggtctgcgacgactccttcttccagaagcggatcgaggagtttttcttgaccggcgaggggcacttcaacgaagtgctccaattcaagacgcccagcacattatcccccaccgagccggcccgcgccggcagccccaccgtggagcccttcaagagctacttcgcacgggggctgctctccatggacagcggctacttctccgctaagtgctacccccgcgcgagcaactccgggctgcagctgatcaacatcactcagcacagcgcccggatcaccgacaccccgggccccaagatcaccaacctcaagacgatcaactgcataaacctgaaggcctccaccttcaaggagcaccgcgagatcgagatcaacgtcctgctcccccaggtggcggtgaacctgagctcctgccacgtcctgatcaagagccacgtttgcgactactccctcgacatcgacggccccgtgcggctgccgcgcatccaccacgaggggaccttcatccccggcacctacaagatcgtcatcgacaagaagaacaagcagaacgaccggtgcaccatcgtcaccaactgcgtgatcaaggggcgggagatccggaagggacagagcgtcctgcgccagtacaagacagagatcaagatagggaaagcctctagcggctcccggcgcctcctgagcgaggagtccggcgacgactgcatcagccggacccaactgctccgcacggagaccgcggagatccacagcgactcctacgggggccccggggacaagatcaccatctgcaacggcagcaccgtggtcgaccagcggctggggtccgagctgggctgctacacgatcaaccgcgtgaagtccttcaagctgtgcgagaacagcgccaccggcaagagctgtgagatcgactccacccccgtgaagtgccgccaggggttctgcctcaagatcacccaggagggccgggggcacgtcaagctgagccgcggctccgaggtggtgctggacgcctgcgacagctcctgcgagatcatgataccgaaagggacgggggacatcctcgtcgactgcagcggcgggcagcagcacttcctgaaggacaacctcatcgacctcggctgccccaacatcccactgcttgggaagatggccatctacatatgccggatgtccaaccaccccaagaccaccatggtattcctcttctggttcagcttcggctacgtcatcacgtgcatcctgtgtaaggtcatcttctacctgctcatcgtggtgggcacgctggggaagaagttcaagcagtaccgggagctgaagccgcagacctgtaccatctgcgagaccacccccgtcaacgcaatcgacgcggagatgcacgacctcaactgttcctacaacatctgcccctactgcgccagccggctgacgtccgacggcctggcccgccacgtgatgcagtgccccaagcggaaggagaagatcgaggagaccgagctctacctgaacctggagcgcatcccgtgggtggtccggaagctcttacaggtgagcgagtccaccggggtggccctgaagcgcagcagctggctcgtcgtgctgctggtgctcctgaccgtctccctgagccccgtgcagtccgcgcccatcggccacgggaagacggtggagacctaccagatccgggagggctacaccagcgtctgcctctttgtgctgggctccatcctgttcatcgtgagctgcctcatgaagggcctggtagactccgacggcaacagcttcttcccggggctgtccatctgcaagacctgcagcatcggctccatcaacgggttcgagatcgagagccacaagtgctactgctccctcttctgctgcccctactgccgccactgcagcacggaccgggagatccacaaactgcacctgtccatctgcaagaagcgcaagaccggcagcaacgtgatgctcgccgtctgcaaacggatgtgtttccgcgccaccgtcgaggtgtccaacaaggccctgctgatccggagcatcatcaataccacgttcgtggtatgcatcctcatcttggccgtttgcgtggtctccaccagcgcggtggagatggagagcctgcccgccggcacctgggagcgtgaggaggacctcatcaacttctgccaccaggagtgccaggtgaccgagacggagtgcctgtgcccctacgaggccctggtcctcagaaagccgctgttcctggactccatcatcaaggggatgaagaacctcctgaacagcacctccctggagaccagcctctcgatcgaggctccctggggcgccatcaacgtgcagagcaccttcaagcccacgatgtccgcggccaacatcgccctgagctggtccagcgtggagcaccgggggaacaagatcctggtctcaggccgcagcgagtccatcatgaagctcgaggaacggaccggtatcagctgggacctaggcgtggaggacgcctccgagagcaagctgctcaccgtgtccgtgatggacctgagccagatgtactcccccgtgttcgagtatctgtctggcgaccgccaggtggaggagtggccgaaggcgacctgcacgggggactgccccgagcggtgcggctgcaccagcagcacgtgcctccacaaggagtggccccacagccgcaactggcggtgcaatcccacctggtgctggggcgtgggcaccggctgcacgtgctgcgggctggacgtgaaggacctgttcaccgactacatgttcgtgaagtggaaggtcgaatacatcaagaccgaggtgatcgtctgcgtggagctcacgtcccaggagcggcagtgcagcctcatcgaggccggcacccggttcaacctggggccggtgaccatcaccctctccgagccccgcaacatccagcagaagctgccgcccgagatcgtcacgctgcacccgcggatcgaggagggcttcttcgacctcatgcacgtgcagaaggtgctgagcgcgtccaccgtctgcaaactccagagctgcacccatggggtgcccggagacctccaggtgtaccacatcggcaacctgctgaagggggacaaggtcaacggccacctcatccacaagatcgagccccacttcaacacctcctggatgagctgggacgggtgcgacctggactactactgcaacatgggcgactggccatcctgctcctatacgggggtgacgcagcacaaccacgccgccttcgtgaacatgctgtccatcgagaccgactacaccaagaacttccacttccacagcaagcgcgtcaccgcgcacggcgatacgccgcagctcgacctgaaggccagacccacctatggcgccggggagatcaccgtgctggtggaggtcgccgacatggagctccacaccaagaagatcgagatctccggcctgaagttcgccagcctgacgtgtaccggatgctacgcgtgctccagcgggatctcctgcaaggtgcgcatccacgtggatgagcccgacgagctcaccgtccacgtcaagtccgaggaccccgacatcgtggccgccagctccagcctgatggcccggaagctggagttcgggacggactccacgttcaaggccttcagcgcgatgccgaagacctccctctgcttctacatcgtagagcgcgagtactgcaagagctgctccaaagaggacacccagaagtgcgttaacaccaaactggaacagccccagagcatcctgatcgagcacaagggcacgataatcggcaagcagaacgacacgtgcaccgccaaggcctcctgctggctcgagagcgtgaagtccttcttctacgggctgaagaacatgctgagcggcatcttcgggaacgtcttcatcggcatcttcctgttcctcgccccttttgccctgctgatcctcttcttcatgttcggctggcggatcctgttctgtttcaagtgctgccgccggacccgcgggctgttcaagtaccggcacctcaaggacgacgaggagacgggctaccgcaagatcatcgagcggctgaacaacaagaaggggaagaacaagctgctcgacggagagcgcttagcggaccgcaagatcgccgagctgttctccaccaagacccacgtggggtga

SEQ ID NO: 15207 - RNA, 5070 nt, synthetic construct
  misc_feature 1..5070: note = derived and/or modified CDS sequence (opt11) from CCHFV(TADJ/HU8966)__AY179962.1__GP
  source 1..5070: mol_type = other RNA
atgcccgtgagcatcatgcacatgctgcttatgtgtgccgtactgtgcctgcagctctacggcctaggaggcaccctgcgctccaacaacggtaccgagcacaacaagacgaacgtgctcaccaccccgggcgacaaactctcgcccgaaccgcccgtgtccaccgccctgcccgttaccccagacagctccaccgtgacccccaccacgcccgcgagcgggctcgagggctcgggcgaggtctacaccagtccgcccatcaccaccaagggcctcagtcccagcgaggcgacgtccgagcccccggcgaccaccggcatggggatctcctccgcgagcggggtcgacttttccacccaggcagcgcgggacacgagcaccctgaccgtgctcacctccccgcccaacagccccaacacgccgcccacctcccaagacacccaccaccccgtccgcagcctgctgagcgtcacaagccctcggcccgaggagacgaccgccccctccaagtccgggaaggagtctcccgcggccaactccagccaccccgtgacctcccgcccgagttcacccctgatcaccgtacggggcccaacggagaactcctcccacaacaccactggccagctggagtccatgacgcaatccacgaccctggtccccatggcgagcccgacccagaccgtgctctcacagagcgtgacatccatcgccgtgcaggatgcgcacccgagttccaccaatcgcagcaagcggaacctggaaatggagatcatcctgaccctcccacaggggctgaagaagtactacggcaaggtgctgcgcctgctgcaactaaccctggaggaagacaccgaggggctgctggaatggtgtaagcggaatctcggcctggactgcgacgacacgttcttccagaagcggatcgaggagtttttcatcaccggcgaggggcacttcaacgaggtgctgcagtttcggaccccgggcaccctcagcacgaccgagtccacccacgccggaagccccaccgcggaacccttcaaatcctacttcgcgaagggcttccttagcatcgactccggatacttctccgccaagtgttactcccgcactagcaactccggcctgcgcctcattaacgtcacccgccacagcacccggatcgccgacacccccggccccaagattactaacctgaagaccatctcatgcatcaacctgcgcgcctctatcttcaaggagcaccgggaggtggagattaacgtgctcctgccccaggtcgccgtgaacctgtccaactgccatgtggcgatcaagagccacgtctgcgactactccctggacgtggatggcaccgtccgactgccccacatccaccacggcggtaccttcatccccggcacgtacaagatagtgatcgacaagaaaaacaagctgaacgaccgttgcaccctctttaccaactgcgtgatcaagggtcgcgaggtccggaagggccagagcatcttgcgccagtataagaccgaaatccgcatcggcaaggcctccacggggagtcggcgcctactcagcgaggagtcgggcgacgactgcataagccggacccagctcctgcgcaccgagaccgccgagatccatggggacgactacggcgggccgggggacaagatcacgatttgtaacgggtccaccatcgtggaccaacggctgggcagcgagctcggctgctacaccatcaaccgcgtgaagtctttcaagctgtgcgagaacagcgccaccgggaagaattgcgagatcgactccgtcccagtcaagtgcagacagggctactgcctgaagatcacacaggagggccgcgggcacgtgaaactcagccggggctccgaggtcgtgctggacgcctgcgactctagttgtgaggtgatgatccccaaggggaccggcgacatcagcgttgactgctccgggggccagcagcacttcctcaaggataaccttattgacctgggttgccccaagataccgttactcgggaagatggcgatctatatttgccgcatgagcaaccaccccaagaccaccatggcattcctgttctggttctcctttggctacgtgatcacccggatcctgtgcaaggccatcttctacctactgatcatcgtggggaccttaggcaagcgcttcaaacagtaccgggagctcaagccacaaacctgcactatctgcgagacgacccccgccaacgccatcgacgcggaaatgcacgacctgaactgcagctacaatatctgcccgtactgcgcctctaggctgaccagcgacgggctagcccggcacgtcacccagtgccccaagcgcaaggagcgggtggaggagaccgagctgtacttgaacctcgagcgaatcccctggatcgtgcggaagctgctacaggtctccgaaagcacgggcgtggcactcaaacggtcttcctggctgatcgtactactcgtcctgttcaccgtaagcctgagtcccgtgcagagcgctccgatcgggtacgggaacacgatcgagacgtaccaggcccgcgaggagtacacgtccatctgcctcttcgtcctgggcagcatcctgttcatcgtctcctgtctcatgaaggggctggtggacagcatcggaaacatctttttcccagggctgaccatctgcaagacctgttccatcggcagcatcaacggctttgagatcgagtcccacaagtgctactgcagcctcctctgttgtccctactgccgccactgctccgccgaccgtgagatccaccagctgcatctcagcatctgcaagaagcgaaagacggggtccaacgtcatgctggccgtgtgtaaacgcatgtgcttccgggccacgatggaggtgagcaacaaggcgttgctaatccgctccatcatcaacactaccttcgtcgtgtgcatcttgatcttggccgtgtgcatcgtttccacctccgcagtggaaatggagagcctccccgccggcacatgggaacgtgaagaggacctgaccaacttctgccaccaggagtgtcaggtgaccgagaccgaatgcctctgcccgtacgaggccctcgtcctgcgccggcccctattcctcgactctatcgtgaaggggatgaagaaccccctgaactccacgagcctggagacttccctgtccatcgaagccccttggggcgccataaatgtgcagagtacctacaagcccaccgtcagcactgcaaacatcgccctgtcctggagctccatcgagcaccgagggaacaacatcctggtgagcggccggtccgagagcatcatgaaactcgaggagcgcaccggcatctccggggacctgggcgtggaagacgcgagcgagtccaagctgctcaccgtcagcgtgatggacctttcccaaatgtacagccccgtgttcgagtacctatctggtgaccggcaggtcgaggaatggccgaaggcgacctgcacgggcgactgtccggagcgctgcggctgcacatctagcacgtgcctccacaaggagtggccccactcccggaactggcggtgcaaccctacctggtgctggggcgtgggaaccgggtgcacttgctgtggcctggacgtgaaagacctgttcatcgactacatgttcgtcaagtggaaggtggactacatcaagaccgaagccatcgtgtgcgtcgagctcaccagccaagagcggcagtgctccctggtggaagctgggacccgcttcaatttaggccccgtcaccatcactctcagcgagccgcggaacatacagcagaagctgccgcccgaaatcataaccctgcatccccgcatcgaggaaggctttttcgacctcatgcacgtgcagaaggtgctttccgccagcacggtctgcaagctgcagtcctgcacccacggggtgcccggtgacctccaggtgtaccatatcgggaacctcctcaagggcgacaaggagaacggccaccttatccacaagatcgagccccacttcaacaccagttggatgtcctgggacggctgcgacctggactactactgcaacatgggcgactggcccagctgcacctacactggggtaacccagcacaatcacgcgtccttcgtgaacctgctcaacatcgagaccgactacaccaagtcgtttcacttccactccaaacgggtgaccgcccacggcgacacgccccagctggacctgaaggcgcgcccgacgtacggggcgggcgagatcaccgtcctcgtggaggtggcagacatggagctgcataccaagaagatcgagataacgggtctgaaattcgcgagcctgacatgcaccggctgctacgcctgctccagcggcatctcctgcaaggtccgcatccacgtggatgagcccgacgagttaaccgtgcatgtcaagagcgacgacccggatgtggtggccgcctctagcagcctgatggcccggaagctggagttcgggacggactccaccttcaaggcgttcagcgccatgcccaagacctcgctgtgtttctacatcgtcgaacgcgagtaccgcaagtcctgctccaaggaggacacacagaagtgcgtaaatacgaagctggagcagccgcagagcatcttaatcgagcacaagggcacaatcatcgggaagcagaacaacacgtgcaccgccaaagcaagctgctggctggagagcgtgaagtccttcttttacggcctgaagaacatgctgagcggcatcttcgggaacgtcttcgttggcatcttcctcttcctggccccatttatcctgctcatcctgtttttcatgttcgggtggcggatcttatcctgcttcaagtgctgccgccgcacccgaggcctcctgaaacaccgccacttgaaggacgacgaggagaccgggtaccggagaatcatcgagcggctcaacaacaagaagggcaagaacaaactgttggacggtgagcgcctcgcggaccgccgcattgctgaactgttcagcaccaagacccacatagggtga

SEQ ID NO: 15208 - RNA, 5070 nt, synthetic construct
  misc_feature 1..5070: note = derived and/or modified CDS sequence (opt11) from CCHFV(88166)__AB069675.1__GP
  source 1..5070: mol_type = other RNA
atgagcttctccgtgatgtacacgcccttgctctgcgccgtcctgtgcctgcagctctggagtctggagggctcgcacgggctgagtaacaaaacgcagcactccaacaccagcaccaccaaggccccggaggtgtcccaggagctcggcctgcccgtgagcaccgtctccacgatcaccagcgacccgccctccatcaccagcgcggtctccgtgagcgggtccgagggtagcggtgacacgaacacgtcccccagcgtcaccacacaaggccccaccctgcccgagacgaccctcgagcccctgaccaccacggacaccgacgcctccagcaccgtggtggtcgacgtgagcacccagacggtgaaagacaccccgatatccaccacctacacgtccctgccctccacaccctctgagcccaccaccccgcagggcacacaccacaccgcccgcgggctcctgtccgtcaccagcaccaagccggaggaagcatccacgcaggccaaccccggcaaaatcagcatggagacgaacagcccccggctggcgatcagcgagaccccgtccttcagccccaccacccaggcacccaccgaaaattccaaccccatcacgagcaagcagctcatgctgtccgcccagccggtgacccccaaccccatgactagccccgtgcagccggccctgtcccagagcgacacttccaccgcgatccaggacatccaccccagccccaccgggcgcagcaagcgtaatctcgagatggagatcatactgactctgtcccagggcctcaagaagtactacgggaagatcctgaagctgctcgacctgacgcttgaggaggacaccgagggcctcttagagtggtgcaagcgcaacctgggcctcgtctgcgacgacaacttcttccagaagcggatcgaggagttcttcctgaccgggaagggccacttcaacgaggtgctgcaattcaagacccccagcacgctctccccgaccgggcccgcccgcaccggcagccccaccgtggagccgttcaagtcctacttcgcgaagggcttcctgagcatggactccggatacttcagcgccaagtgctacccacgggcctccaactctggcctgcaactcatcaacgtcacgcagcactccacccgcatcaccgacacccccgggcccaagatcaccaacctgaagaccatcaactgcatcaacctgaaggcgtcagtattcaaagagcaccgggagatcgaaatcaacgtgctccttccgcaggtcgccgtaaacctgtccagttgccatgtgctcatcaagtcccacgtgtgcgactacagcttagacatcgacggccccgtgcgcctgccccggatccaccatgaggggaccttcatccccggcacctacaaaatagttatcgacaagaaaaataagcagaacgaccgctgtacgctcgtgaccaactgcgtgatcaagggtcgggagatccgcaaggggcagtccgtcctgcggcagtaccgcaccgagattaagatcggtaaggccagctcagggtcccggcgcctgctcagcgaggagtccggcgacgactgcatcagccggacccaactgctgcgcacggagaccgccgagatccactccgacaactacgggggcccgggcgataagatcaccatctgcaacgggagcaccgtggtggaccaacggttaggctccgaactcgggtgctacacgatcaaccgcgtcaagagcttcaagctgtgcgagaactccgccaccggaaagtcgtgcgagatcgactcaacccccgtgaaatgccggcaggggttctgcctcaagatcacccaggagggccggggccacgtgaagctcagccgcgggtccgaggtcgtgctggacgcgtgcgactcgtcctgcgagatcatgatccccaagggcacgggggacatcctggttgattgcagcggtggccagcagcacttcctcaaggacaacctgatcgacctggggtgcccaaacatcccgctcctgggcaaaatggccatctacatctgccggatgtccaaccaccctaagactaccatgggcttcctgttctggttcagcttcggctacgtagtgacctgcattctgtgcaaggtgatcttctacctactgatcgtcgtggggacgctcggcaagaagttcaagcagtaccgtgagttgaagccccagacctgcaccatctgcgaaaccacccccgtgaacgccatcgacgccgagatgcacgaccttaactgctcctacaacatctgcccctactgcgccagccggctcacgagcgacggcctggcgcgccacgtcatgcagtgccccaagcggaaggagaagatcgaggagaccgagctgtacctcaacctggagcgcatcccctgggtggtgcggaagctgctccaggtgtccgagagcacaggtgtggccttaaagcgctctagctggctggtggtcctccttgtgctgctcaccgtatccctgagccccgtccagtccgccccgatcggccacgggaagaccgtggaaacctaccagacccgggagggctacaccagcatctgcttgttcgtgctcgggtccatcctgtttatcgtcagctgcctgatgaagggcctcgtggactccgtgggcaacagcttcttccccgggctgtccatctgcaagacgtgcagcatcggctccgtcaacgggttcgagatcgagagtcacaagtgctactgctccctgttctgctgcccctactgccgccactgcagcgccgaccgggagatccatcgcctccacctgtccatctgcaagaagcggaagacctggagcaacgtgatgctggccgtgtgcaagcgcatgtgcttccgggcgaccgtcgaggtgagcaacaaggccctcctgatccgtaacatcatcaacaccacgttcgtgctgtgcatccttatcctggccgtctgcgtggtgtccaccagcgccgtcgagatggagtccctgcccgcgggcacctgggagcgggaggaagacctcaccaacttctgtcaccaggagtgtcaggtgacggagacagagtgcctgtgcccttacgaggccttggtgctccgcaagccactgtttagtgactcaatcgtcaagggaatgaagaatctgctcaacagcacctccctggagaccagtctgtccatcgaggctccctggggcgcgatcaacgtgcagagcacgttcaagccgaccatgtccgccgcgaatatcgccctcagctggtcttccgtggagcaccgcggcaacaagatcctggtctctgggcgtagcgagtccatcatgaagctggaggagcgcacgggcataagctggaacctcggggtggaggatgcctccgagagcaagctcctgaccgtgagcgtcatggacttatcgcagatgtacagccccgtgttcgagtacctctccggcgaccggcaggttgaggagtggcccaaggccacgtgcaccggggactgccccgagcgctgcggctgcaccagctccacatgcctgcacaaggagtggccgcacagccggaactggcgctgcaaccccacctggtgctggggcgtggggaccggctgcacgtgctgcgggctcgacgtaaaggacctgttcaccgactacatgttcataaaatggaaggtcgagtacatcaaaaccgaggccatcgtttgcgtggagctgacatcccaggagcggcagtgcaccctcatcgaggcgggcacccgcttcaacctgggccccgtcacgatcacgcttagcgagccccggaacatccagcagaagctcccgcccgagatcgtgaccctgcacccccgcattgaggaggggttcttcgacctgatgcacgttcagaaggttctctccgccagcaccgtgtgcaagctccagagctgcacccacggcgtgcccggggacctccaggtctaccacatcggcaacctcctgaagggggacaaggtgaacggccacctgatccacaagatcgagccgcatttcaatacaagctggatgtcctgggacggctgcgacctcgactactactgcaacatgggggactggcccagctgtacctacaccggcgtgacccagcacaaccacgccgctttcgtcaacatgctgaacatcgagacggactacactaagaacttccacttccactccaaacgggtgaccgcccacggggacacgccccagctggacctcaaggcgcgccccacctacggagccggggagataaccgtgctggtcgaggtggcagacatggaactgcacaccaagaagattgagatcagcgggctcaagttcgccagcctgacctgcacgggctgctacgcgtgcagctccgggatcagctgcaaggttcggatccacgtcgacgagcccgacgagctgaccgtgcacgtgaagtccgaggaccccgacctcgtcgcggcttccagctcccttatggcccgcaaactggagttcggcaccgacagcaccttcaaggccttctctgcgatgcccaagacaagcctctgcttctacatagtggagcgggagtactgcaaatcctgcagcaaggaggacacccagaagtgcgtgaacaccaagctggagcagccgcagtccatcctgatcgagcacaaggggaccatcatcggcaagcagaacaacacttgcaccgccaaggccagctgctggctggagtctgtcaagagcttcttctacgggctcaagaacatgctgtccggcatattcggcaatgtgttcatcggggtgttcctgtttttcgccccgttcatcctcctgatcctgttcttcatgtttggctggcgcatcctcttctgcttcaagtgctgccggcgcacccgagggctgttcaagtaccgccacctgaaggacgacgaggaaaccggctaccggaagatcatcgagcgcctcaacaacaagaagggcaagaacaagctgctggacggggagcgcctcgctgaccggaagatcgcggagctgttcagcacgaaaacccacatcggctga

SEQ ID NO: 15209 - RNA, 5070 nt, synthetic construct
  misc_feature 1..5070: note = derived and/or modified CDS sequence (opt11) from CCHFV(8402)__AB069674.1__GP
  source 1..5070: mol_type = other RNA
atgagcttcagtgtgatgtacacgcccctgctctgcgccgtcctgtgcctgcagctctggagcctggagggctcccacgggctgagcaacaagacccagcactccaacaccagcaccaccaaggccccggaggtgtcccaggagctcggccttcccgtgagcaccgtctccacgatcaccagcgacccgccctccatcaccagcgcggtgtccgtgagcgggtccgagggcagcggggacaccaacacgtccccgagcgtcaccacccagggcccgaccctgcccgagacgaccctcgagcccctgaccaccacggacaccgacgcctccagcaccgtggtggtcgacgtgagcacccagacggtgaaggacaccccgatctccaccacctacacgagcctgccctccaccccgagcgagcctaccacgccccagggcacccatcacaccgcccgcgggctgctgtccgtcactagcaccaagcccgaggaggcctccacgcaggccaacccgggcaagatcagcatggagaccaatgggccccggctggcgatcagcgagaccccgagcttctcccccaccacgcaggcccccaccgagaactctaaccccatcacctccaagcagctcatgctgagcgcccagccggtgacccccaaccccatgacctcacccgtgcagccggccctgtcgcagtccgacacgagcaccgcgatccaggacgtccacccaagccccaccggccgcagcaagcgtaaccttgagatggagatcatcctgaccctgagccaggggttaaagaagtactacgggaagatcctgaagctgctcgacctgacgctggaggaggacaccgagggcctcctggaatggtgcaagcgcaacctggggctcgtgtgcgacgacaacttcttccagaagcggatcgaggagttcttcctgaccggcaaggggcacttcaacgaggtgctgcagttcaagaccccctccacgctcagcccgactggccccgcccgcaccggctcccccaccgtcgagccgttcaagagctacttcgcaaaggggttcctgtccatggacagcggctacttctccgctaagtgttacccccgggccagcaactccgggttgcagctcatcaacgtgacgcagcacagcacccgcatcaccgacactcccggccccaagatcacgaacctgaagaccatcaactgcatcaacctgaaggcgtccgtgttcaaggagcaccgggagatcgagatcaacgtcctcctgccccaggtggccgtgaacctctcttcctgccacgtactcatcaagagccacgtgtgcgactactccctggacatcgacgggcccgtccgcctgccccggatccaccacgagggcaccttcatccccgggacctacaagatcgtgatcgacaagaagaacaagcagaacgaccgctgcacgctcgtgaccaactgcgtcatcaaggggcgggagatccggaagggccagagcgttctgcgtcagtaccgcaccgagatcaagatcggtaaggcctccagcggcagccggcgcctgctctccgaggagagcggggacgactgcatctcccggacccagctgctgcgtacggagaccgccgagatccacaacgacaactacggcggcccgggggacaagatcaccatctgcaacggcagcacagtggtcgaccagcggttggggtccgagctcggctgctacacgatcaaccgtgtcaagagcttcaagctgtgcgagaactccgccaccggcaagagctgcgagatcgactccacccccgtgaagtgccgccaggggttctgcctgaagatcacccaggagggccgggggcacgtcaagctcagccgcggctccgaggtggtactggacgcgtgcgacagctcctgcgagatcatgatccccaagggcacgggcgacatcctggtcgactgcagcggcgggcagcagcacttcctcaaggacaaccttatcgacctgggctgccccaacatcccgctcctggggaagatggccatctacatctgccggatgtccaaccaccccaagaccacgatggccttcctgttctggttcagcttcggctacgtggtgacctgcatcctctgcaaggtcatcttctacctgctgatcgtggtggggacgcttggcaagaagtttaagcaataccgcgagctgaagccccagacgtgcaccatctgcgagaccacccccgtcaacgccatcgacgccgagatgcacgacctgaactgctcctacaacatctgcccgtactgcgccagccggctcacttccgacgggctggcccgccacgttatgcagtgtcccaagcggaaggagaagatcgaggagaccgagctgtacctcaacctggagcgcatcccctgggtggtccggaagctgctccaggtgagcgagagcaccggggtggccctgaagcgctccagctggctggtcgttctcctggtgctgctcaccgtctccctgagccccgtgcagtccgccccgatcggccacgggaagacagtggagacctaccagacccgggagggctacaccagcatctgcctgtttgtcctcgggtccatcctgttcatcgtgagctgcctgatgaagggcctcgtggactccgtcggcaacagcttcttccccgggctgtctatatgcaagacgtgcagcatcggctccgttaatgggttcgagatcgagagccacaagtgctactgctccctgttctgctgcccctattgccgccactgcagcgccgaccgggagatccaccgcctccacctgtccatctgcaagaagcggaagaccggcagcaacgtgatgctggcggtctgcaagcgcatgtgcttccgggccaccgtggaagtgtccaacaaggccctccttatccgcaacatcatcaacacaacgttcgtcctgtgcatcctcatcctggccgtgtgcgtggtcagcacctccgcggtggagatggaatccctgcccgccgggacctgggagcgggaggaggacctcacaaacttctgccaccaggagtgccaggtgacggagaccgagtgcctttgcccgtacgaggccctagtcctccgcaagcccctgttcagcgactccatcgtgaagggcatgaagaacctgctcaacagcacctccctggagaccagcctgtccattgaggccccctggggcgccatcaacgttcagtcgacattcaagccgaccgtctccgcggccaacatcgccttaagctggtccagcgtggagcaccgcgggaacaagatcctggtgtccggccggagcgagtccatcatgaagctggaggagcgcaccgggatcagctgggacctcggcgtcgaggacgcctccgagtcgaagctgctgaccgtgtccgtcatggacctcagccagatgtacagcccggtgttcgagtacctgtccggggaccgccaggtggaggagtggcccaaggccacgtgcaccggcgattgccccgagcggtgcggctgcaccagctccacgtgcctgcacaaggagtggccgcacagccggaactggcgctgcaaccccacttggtgctggggcgtcgggaccggatgcacgtgctgcggcctcgacgtgaaggacctgttcaccgactacatgttcatcaagtggaaggttgagtacatcaagaccgaggcgatcgtctgcgtggagctgacctcccaggagcggcagtgcacactcatagaggccggcacccgcttcaacctggggcccgtgacgatcaccctgagcgagccccggaatatccagcaaaagctcccgcccgagatcgtcaccctgcacccccgtatcgaggagggcttcttcgaccttatgcacgtgcagaaagtgctctccgccagcaccgtctgcaaactgcagtcctgcacccacggggtgcccggcgacctccaggtgtaccacatcgggaacctcctgaagggcgacaaggtcaacggccacctgatccacaagattgagccgcacttcaacacgagctggatgtcctgggacgggtgcgacctcgactactactgcaacatgggcgattggcccagctgcacctacaccggggtgacccagcacaaccacgccgccttcgtgaacatgctgaacatcgagacggactacaccaagaacttccacttccactccaagcgggtcaccgcgcacggcgacacgccccagctggacctcaaggcccgccccacctacggggcaggcgagatcaccgtgctggtggaggtcgccgacatggagctgcacaccaagaagatcgagatcagcggcctcaagttcgcgtccctgacctgcacgggctgctacgcctgcagctccggcatcagctgcaaggtgcggatccacgtggacgagccggacgagctgaccgtccacgtgaagagtgaggaccccgacatcgtggccgccagcagctccctcatggcccgcaagctggagttcgggactgacagtacctttaaggcgttctccgccatgcccaagacgagcctgtgcttctacatcgtcgagcgggagtactgcaagtcctgcagcaaggaggacacccagaagtgcgtgaacaccaagctcgagcagccccagagtatcctgatcgagcacaagggcaccataatcgggaagcagagcaacacgtgcaccgccaaggcctcctgctggctggagagcgttaaatccttcttctacggcctgaagaacatgttaagcggcatcttcgggaacgtcttcatcggcgtgttcctgttcttcgccccgttcatcctcctcatcctgttcttcatgttcgggtggcgcatcctgttctgcttcaagtgctgccggcgcacccggggcctcttcaagtaccgccacctgaaggacgacgaggagaccggataccgaaagatcatcgaacgcctgaacaacaagaaagggaagaacaagctcctagacggcgaacgcctggcggaccggaagatcgccgagctgttctccacgaagacccacatcgggtga

SEQ ID NO: 15210 - RNA, 5070 nt, synthetic construct
  misc_feature 1..5070: note = derived and/or modified CDS sequence (opt11) from CCHFV(7803)__AB069672.1__GP
  source 1..5070: mol_type = other RNA
atgcccgtttccatcatgcacatctcactgatgtgcgccgtcctatgcctccaactgtacggcttgggggagacccacggcagctccaacgagaccgaacataataagacgaacgtggtgaccacgcccggcgactcgcagtcccccgagccgctggtcagcaccacgctgcccgtcaccctcgactccagcaccgtgaccccgacgaccccggcctccgagcccgagggtagcggggaggtctacacctccccgccaatcaccacggagggcctgtctcccagtgaagcgacctccgagctgcccgtgacgacaggaattgggatctccagcgcctccgacgttgacagctcgacccaagccgccggcgacacctcgacccccacagtccgcacgagcccgccaaactcccccagcacgccccctacctcccaggacacccaccaccccatgcggaacctcctctctgtgacgtccctcaaaagcgaggagacctccgcccccagcaagtccgggaaggagtctccggcggcctccagcccgcaccccgttgcctcccgcccgcccacccaccccatcaccgcccagggcccaacggaaaacaacagccacaacaccaccgggcagctcgagtctgtcactcagagcgcgaccctgggccccatggcctcacccacccagaccgtgctgagtcagaacgtgacctccatcgccatccaggacacgcacccgtcgcccaccaaccggagcaagcgcaacctcgagatggagatcatcctgaccctcccccagggcctcaagaagtactacggtaaggtcctgagactgctccagctgaccctggaggaagacactgagggcctcctggaatggtgtaagcgcaacctggggctcgattgcgacgatacgttctttcagaagcggatcgaagagttcttcatcaccggggagggccattttaacgaggtgctgcagttccgcaccccgggaacactttccacgaccgagagcacccacgccgaatccccgaccgccgagcccttcaagtcatatttcgcgaagggcttcctctccatcgacagcggctacttttccgccaagtgctacagccggacgtctgacagcggcctgcagcttatcaacgtgaccaggcacagtactcggatcgccgacaccccagggcccaagatcacgaacctcaagactatcagctgcatcaacctgaaggcctccgtcttcaaagagcaccgcgaggtggaaatcaacgtcctgttaccccaggtcgccgtgaacctgagcaactgccatgtgacaatcaagtcccacgtctgtgactacagcctggacatcgacggcacagtgcggctcccccatatccaccatgagggcacgttcatcccagggacctacaagatcgtcatcgacaagaagaacaagctgaacgaccgctgcacactgtttaccaactgcgtaatcaagggccgggaggtgcggaaggggcagtccgtcctccggcagtacaagacggaaatccgcatcggaaaggctagcaccgggtcccggcgtctgctgtccgaggagagcggtgacgactgcatctcccggacccagctcctgcgcaccgagacggccgagatccacggcgacaactacgggggcccgggggacaagatcaccatctgcaacggctcgaccatcgtggaccagcgcctggggtccgaaatgggctgctacacaataaaccgggtgaagtccttcaagctgtgcgaaaactccgccacgggcaagagctgcgagatcgactccatccccgttaaatgccgccaggggtactgcctgaagatcacccaggagggccggggtcatgttaagctgagccgcggcagcgaggttatccttgacgcctgcgactcgtcctgcgaggtaatgatcccgaagggcaccggggacatcctcgtggactgcagcggcggtcagcagcacttcctgaaggataacctgatagacctcggctgcccctctatcccgctgctggggaagatggcgatctacatctgccggatgagcaaccaccccaagaccacgatggcgttcctcttttggttctccttcggctacgtgatcacgtgcatcctgtgcaaggccatcttctacctcctcatcatcgtcggcaccctggggaagagattcaagcagtaccgagagcttaagccccagacctgcacgatctgcgagaccacccccgctaacgctatcgacgccgagatgcacgacctcaactgctcgtacaacatctgcccgtactgcgcaagccgtctgaccagcgacggcctggcccggcacgtcacccagtgccctaagcgcaaggagaaggtggaggagacggagttatacctaaacctggagcggatcccctgggtcgtgcgcaagttgctccaggtaagcgaatctaccggggtagcccttaagaggtcctcctggttaatcgtgctgctggtcctcttcgccatcagcctgtccccggtgcagtcagccccgatctcccacggcaagaccatcgagacgtaccaagctcgcgaggagtacacgagcatatgcctgttcgtgctcgggtccatcctgttcatcgtgagctgcctgatgaagggcctcgtcgattccatcggcaacatcttcttccccgggctgagcatctgcaagacctgttccatcggcagcatcaacgggttcgagatcgagtcccacaaatgctactgctcgctgctctgctgcccctactgccggcactgctccgccgaccgcgagattcaccaactgcacctgtctatctgcaagaagcggaagacaggatccaacgtgatgctcgccgcctgcaagcgcatgtgcttccgggccaccatggaagtgagcaacaaggccctgctgatccgcagcatcattaacacgaccttcgtcgtatatatcctcattctggcagtgtgcgtcgtgagcacctccgccgtggagatggagtccctgcccgccgggacttgggagcgcgaggaggacctcacgaacttctgccaccaggagtgccaggtcaccgagaccgagtgcctgtgcccgtacgaggcgcttgtgctccgacgccccctgttcctcgacagcatcgtgcggggcatgaaaaaccccctcaattccaccagcctggagacctccctgagcatcgaggccccgtggggcgccatcaacgtccagtccacatacaagcccaccgtgagcaccgccaacatcgctctctcctggagctctgtggagcatcgcggaaacaagatcctggtcagcggccggtccgagagcatcatgaagttggaggagcggacggggatctcctgggacctcggcgtggaggacgccagcgagtccaagctgttaaccgtgagcgtcatggacctcagccagatgtacagccccgtgttcgagtacctgagcggtgaccgccaggtggaggagtggcccaaggcgacatgcaccggcgattgcccggaacggtgcgggtgcacgacttcgacgtgtctgcacaaggagtggccccacagccggaactggcgctgcaaccccacgtggtgctggggcgtcggtaccgggtgcacttgctgcggcttggacgtgaaggacctgttcaccgactacatgatcgtgaagtggaaggtcgagtacatcaagaccagagggatagtgtgtgtggagctgacctcccaggagcgccagtgcagcctcatcgaggccgggacccggttcaacctgggctccgtcaccatcaccctgagcgagccacgcaacatccagcaaaaactaccgcccgagatcattaccctgcaccctaggatcgaggagggattctttgacctgatgcacgtgcagaaggtcctctccgccagcaccgtgtgtaagctgcagtcatgcacccacggcgtgcccggggacctgcaggtctaccatgtgggcaacctccttaagggcgacaaggtgaacggtcacctgatccacaagatcgagccccacctcaacacgagctggatgtcctgggacggctgcgacctagattattactgcaacatgggggactggcccagctgcacatacacgggcgtcacccagcacaaccacgcgtccttcgtgaacttgctcaatatcgagaccgactacaccaagagcttccatttccattctaagcgcgtcacggcccacggggacacgccacagctggacttgaaggcccggcccacctacggcgccggcgaaatcaccgtcctcgtggaggtggccgacatggagttcactccgaaaaagatcgagatcagcgggctgaaattcgcgtcccttacctgcacaggctgctacgcttgcagctcagggatctcctgcaaggtccgcatccacgtggatgaacccgacgaactcaccgtgcacgtcaagagcgacgaccccgacgtcgtggccgccagtagctccctgatggcacgcaagctggagttcggcacggacagtaccttcaaggcgttctccgccatgcccaagaccagtttgtgcttctacatcgtggaaagagagtactgcaagtcctgcagcaaggaggacacccagaagtgcgtgaacactaagctggagcagccgcaatccattctgatcgagcacaaggggacgatcattggcaagcagaacaacacgtgcaccgccaaggccagctgctggctagagtccgtcaagagtttcttctacggcctgaaaaatatgctgtccgggatcttcggcaacttcttcatggggatcttcctcttcctggcgcccttcatcttgctcatcctcttctttatgttcggctggcgcattctgttctgcttcaagtgctgccgccgaacccggggcctgtttaagtaccgccacctcaaagacgacgaggagaccgggtaccggcgcatcatagagcgtctgaataataagaagggaaagaacaagctgctcgacggggagcgcctggcggaccggcgcatcgccgagcttttcagcaccaagacccacatcggctga

SEQ ID NO: 15211 - RNA, 5070 nt, synthetic construct
  misc_feature 1..5070: note = derived and/or modified CDS sequence (opt11) from CCHFV(75024)__AB069671.1__GP
  source 1..5070: mol_type = other RNA
atgcccgtgagcatcatgcacatcagcctgatgtgcgccgtgctctgccttcaactgtacgggctcggggagactcacgggtcttccaacgagaccgagcacaacaagaccaacgtggtgaccaccccgggtgacagccagtcccccgagcccctggtcagcaccaccctgcccgtgaccctcgactctagcaccgtgaccccgaccactcccgcctccggccccgaggggagcggcgaggtctacactagcccgcccatcaccaccgaaggcctgagcccctccgaggccaccagcgagctgcccgccaccaccgggatcggcatctccagcgcctccgatgtggacagctcaacccaggccgccggggacaccagcaccccaaccgtgcgcacgagcccgcccaactccagctccaccccacccaccagccaggacacacaccacccgatgcgcaacctcctgtccgtcacgagcttaaagcccgaggagacctcagcgcccagcaagagtgggaaggagagcccagccgcctcctcaccgcaccccgtggcgtcccggcctcccaccccgcccaccacggcgcaggggcccatcgagaacaacagccacaacaccaccggccagctcgaatccgtgacccagtcggccacgctgggacccatggcctccccgacccagacagtcctgagccagaacgtgacctccatcgccatccaggacacccaccccagccccaccaaccggagcaagcgcaacctcgaaatggagatcatcctgaccttgccgcaggggctcaagaagtactacggcaaggtgctgcggctgctccagctcaccctggaggaggacaccgaggggctcctggagtggtgcaagcgcaacttaggtctcgactgcgacgacacgttcttccagaagcggattgaggagttcttcatcaccggcgaggggcacttcaacgaggtcctgcagttccgaacccccggcacactgagcacgaccgagagcactcacgccgagagccccaccgcggagcccttcaagagctacttcgccaaggggttcctctccatcgactccggctacttttcggccaaatgctacagccggacgtccaacagcgggctgcagctgatcaacgtcacccgccactccacccgaattgccgacaccccgggccccaagatcacgaacttaaagaccatcagctgcatcaacctgaaggcgtctgttttcaaggagcaccgggaggtcgagatcaacgtgctgctcccacaggtggcggtcaacctgagcaactgccacgtgaccatcaagtcccacgtgtgcgactactccctggacatcgacggcaccgtccggctccctcacatccaccacgaggggacgttcattccgggcacctacaagatcgtgatcgacaagaagaacaaacttaacgaccgctgtaccctgtttaccaactgcgtcatcaagggccgggaggtgcgcaaggggcagtccgtgctccggcagtacaagacggagatcaggatcgggaaggccagcacaggcagccggcgcctgctgtccgaggagagcggcgatgactgcatctcccggacccagctcctgcgaaccgagacggccgagattcacggggacaactacggcgggcccggcgacaagatcaccatctgcaacgggtcgaccatcgtcgaccagcgcctgggctccgagatgggctgctacaccatcaaccgggtcaagagcttcaagctctgcgagaactccgcgaccgggaagtcctgcgagatcgactccatcccagtgaagtgccgccagggctattgcctgaagatcacccaggaggggcggggccacgtgaaactgagccgtggcagtgaagtggtgctggacgcctgcgacagctcctgcgaggtcatgatccccaaggggaccggcgacatcctcgtggactgcagcgggggccagcagcacttcttaaaggacaacctgatagacttagggtgcccctccatccccctgctgggcaagatggcgatctacatctgccggatgtcaaaccaccccaagaccacgatggccttcctcttttggttctccttcggctacgtgataacctgcatcctgtgcaaggccatcttctacctgctcatcatcgtggggaccctgggcaagcgcttcaagcagtatcgggagctgaagccccaaacctgcacgatctgcgagaccacccccgccaacgccatcgacgcggagatgcacgacctcaactgcagctacaacatctgtccctactgcgcctcccgcctgaccagcgacgggctcgcccggcacgtgacccagtgccccaagcgcaaggagaaggtagaggagacggagctctacctgaacttggagaggatcccctgggtcgtgcgcaagctcctccaggtgagcgagtccaccggcgtcgccctgaagcggagctcctggctcatcgtgctcctggtcctgttcgcgatcagcctgtcccctgtccagagcgcaccaatcgggcacggtaagacaatcgagacctatcaagcccgggaggagtatacctccatctgcctgttcgtgctcggctctatcctgttcatcgtgtcctgcctgatgaaggggctcgtggactcgatcggtaacatctttttccccgggctgtccatctgcaagacctgcagcatcggctccatcaacgggttcgagatcgagagccataagtgctactgctccctgctttgttgcccctactgccggcactgcagcgccgaccgcgagatccaccagctgcacctgtccatctgcaagaagcggaagaccggcagcaacgttatgctcgccgtgtgcaagcgcatgtgcttccgggcgaccatggaggtctccaacaaagccctgctgatccgcagcatcatcaacacgactttcgtggtgtgcatcctcatcctggccgtctgcgtggtgagcacgtccgccgtcgagatggagagcctgccggccggcacctgggagcgagaggaagacctcacgaacttctgccaccaggagtgccaggtgaccgagacagagtgcttatgcccctacgaggcgctggtgctccggcgacccctcttcctggactccatcgtgcgggggatgaagaaccagctcaacagcacctccctcgagacgagcctgagtatagaggccccgtggggcgccatcaacgtgcagagcacctataagcctaccgtgtccaccgcaaacatcgccctcagttggtccagcgtcgagcaccgcgggaacaagatcctggtatccggccggagcgagtccatcatgaagctggaggagcgcacggggatcagctgggacctcggcgtggaggacgcgtccgagtccaagctgctgaccgtctccgtgatggatctcagccagatgtacagccccgtgttcgagtacttgtccggggaccggcaggtcgaggagtggcccaaggcgacctgcaccggggactgcccggagcgctgtggctgcacgacctccacgtgcttacacaaggagtggccccactcccggaactggcgctgcaaccccacttggtgctggggcgtggggaccggttgcacgtgctgcgggctcgacgtgaaagacctcttcaccgattacatgattgtcaagtggaaggtggaatacatcaagaccgaggccatcgtgtgcgtcgagctgacgagccaggagcggcagtgctccctcatcgaggccggcacccgcttcaacctggggagcgtgaccatcaccctgtccgagccccggaacatccagcagaagctcccgcctgagataatcaccctgcacccccgcatcgaggagggcttcttcgacctgatgcacgtccagaaggtgctcagcgcgtccaccgtgtgcaagctgcagagctgtacccacggggtccccggcgacctccaggtgtaccacgtgggcaacctcctgaagggggacaaggtcaacggccacttgatccacaagatcgagccgcacctcaacacctcctggatgagctgggacgggtgcgacctggactactactgcaacatgggcgactggcccagctgcacctacacgggggtgactcagcacaaccacgcctcattcgtaaacctgctcaacatcgaaaccgactacaccaagtcctttcacttccacagcaagcgagttacggcccacggcgatacgccccagctggacctgaaggcccgccccacttacggcgccggggagatcaccgtgctcgtggaggtcgcggacatggagttcacgccaaagaagatcgagatctccggcctgaagttcgccagcctgacctgcaccgggtgctacgcctgctcctcaggcatcagctgcaaggtgcgtatccacgtggacgaacccgacgagctcaccgtccacgtgaagtccgacgacccagacgtggtcgccgccagctcctccctcatggcgcgcaagctggagttcgggacggactcaaccttcaaggctttcagcgccatgcccaagacatccctctgcttctacatcgtggagcgggagtactgcaagagctgctccaaggaggacacccagaagtgcgtgaatacgaagctggagcagccgcagagcattctgatcgagcacaagggcactatcatcggcaagcagaacaacacgtgcaccgccaaggcctcctgctggctcgagagcgtcaagtcgttcttctacgggctgaagaacatgctgagcggcatcttcgggaacctctttatgggcatcttcctgtttctggcgcccttcatcctgctcatcctgttcttcatgttcggttggcgcatcctgttctgctttaagtgctgccggcgcacgcgcggcctcttcaagtaccggcatctgaaggacgacgaggagaccggctaccgccggatcatcgaaaggctgaataacaagaaggggaagaacaagctcctggacggcgagcggctggccgaccgacggatcgccgaactcttctccaccaaaacccacatcgggtga

SEQ ID NO: 15212 - RNA, 5070 nt, synthetic construct
  misc_feature 1..5070: note = derived and/or modified CDS sequence (opt11) from CCHFV(66019)__AB069669.1__GP
  source 1..5070: mol_type = other RNA
atgcccgccaatatcatgtatacgctcctcgtctgcgcggtattatgcccgcaactttggtcactggaaggcacacatgtcccccacaacgaaacaaaacataacggcaccgggataacagctgcccccggcgaaagccagggcccgatgagcccagcgtccacagccgtaccgcttacccctgagccacccaacacgaagccggcagcttcggcctcagaactcgagagctccggagaaggccacaccagccttttagcgacgacacaaggtttaacatccccagaagcaacccccgaattaccgaccaccaccgacacgggagtctcgtccacctctgttgtcgacattggcacgcagatggccaaagacacccccacctccactgcccacacaagcctccccagtaacccgtccgccccttccacagcgcagggaacgcaccacacaatccgaggactcctctccgtcacctcaaccaagccagaggaggcgagtacacccaccgacccagggaaagccggggcagagaccggatccccacgccccgcaatcagccgcaagcccaccctgtcccccacggccgaagcccccacggaaattaacaactcctccacccctaaacagccagaacctagcatccaacctgctaccccatccctggttatctcgccggcccagcccgcgttcccgcaatcggccacttccaccgctgcacaagacatctactccagtcccaccaaccgaagcaaacgcaacctcaagatggaaatcatcctcacattaagccaaggacttaaaaagtattacggtaaaatacaaaagaccctcggcttgaccctggaagaagacaccgaaggcctactagaatggtgcaaacgaaacctcgggctaacctgcgacgacaacttcttccaaaaacgcatagaagagttctttctaaccggtgaaggatatttcaatgaagtactccaattcaaaaccccctcaacacccgggtcaactgaaccaacccataccgaagcacccacggtaaaacccttcaaatcctacttcgcccgcggattcctcacaatcgacagcggctatttcagcgccaaatgttactccagaaccagcaattctggactgcagctaataaacgtcacgcagcacccagcccgcatcgccgacacccccggacccaagataacaaatctcaaaaccatcaactgcatcaacctcaaagcctccgttttcaaggaacaccgagaaatcgaaatcaatgttctcctcccacaagtcgccgtcaacctcagtaactgccacgtacttataaaatcgcacgtttgtgactactcactcgacatagacggaacaatcagactcccgcgcatttaccacgagggcaccttcatccctggaacatacaaaattgtgatcgacaaacgagacaaacaaaacgatcgatgtaccttagtaacaaactgtgtaattaaaggtcgtgaagtgagacgcggccagtccgcattgcggcagtatcgcacagaaatacggatcggaaaagcctcagccggatcacgacgcctcctctcagaggaatccggcgacgactgtatctcgcggacccagttactccgcaccgaaacagccgaggtacacggagacaattacggcggacccggagataagatcacaatctgcaacggttccaccatcgtcgatcaacgcctcgggagcgagttagggtgttatacaattaacagggtcaagtcgttcaaactgtgcgagaactccggcactggcaagagctgcaagatcgacaacacccccgttaaatgtcgccaaggcttctgcctcaaaataacccaagaagggcgcgggcatgtcaagctatctcgcggatccgaagtagtccttgacgcgtgtgactctagctgcgaaatcatgatccccaagggaaccggagacatactcgtcgactgttcaggaggacagcaacacttcctaaaagataacctcgtagatctcggctgtcccaacatacccttactcggcaaaatggcaatctatatctgcaggatgtcaaatcacccgaaaacgaccatggccttcctattctggttcagcttcggctacgttataacatgtatcttctgcaaaataatattctacctactgatagtggtgggcacactaggtaagaaatttaaacagtaccgagaactgaaacctcaaacatgcaccatctgtgaaacaacccccaccaacgcaatcgatgcagaaatgcacgacctcaaatgcagctataatatatgcccttactgtgccagcagactaacctcagacggactcgcacgacacgtgacgcaatgccccaaacgaaaagaaaaggtcgaggaaacagagctatacctcaatctagagcgtatcccgtggatcgtccggaaactcttacaagtatcagaatcaacgggcgtcgccttaaaacgttcttcgtggctcatagtactcctggtcctcctcacagtgtcactgtctccggtacaatccgcacccataggacacgggaaaacaatcgaggcttaccagacacgagaaggttacacctcagtctgcctcttcatgctgggaggaatactattcgtagtctcctgcctaatgaaagggttagtagattccgtctctaatagcttcttcccaggactctcaatttgtaaaacctgttctataggctcagtaaacggcttcgaaatagaatctcacaaatgttactgcagtctcctatgctgcctatactgcagacactgctccgccgacagagaaatacaccaactccacctctccatctgcaagaaacgacgcgcaggaggaaacgtcatgttagccgtgtgcaaaagaatgtgccttagagcaacgatggaagtaagcaataaagtcctcttcattcgctccataattaacacgacttttgtcatatgtatcctagtgcttgcggtatgtatcgtgtcaacctcagcagtcgaaatggaatcgctccccgcaggtacgtgggaacgagaggaagacttaacaaatttctgccatcaggaatgtcaggtaacggaaacagaatgcctatgcccttacgaagccctcgtccttcgaaaacccctcttctccgacagcatcgtcaagggaatgaaaaatctgctaaattcgacgtcactggaaacttctctgtccatcgaggcaccatggggagccataaatgtccaatccacattcaagcccacagtaagcaccgccaacatcgcactttcgtggtccagcgtggaacaccgcggaaacaagatcttggtctcaggccgatccgaatcaattatgaaactcgaggagagaaccggcatctcgtgggacttaggcgtagaagacgcttcagagtccaaactccttacagtgtcggtcatggacttgtcccaaatgtactccccagtcttcgaatacctcagcggagacagacaagtagaagagtggcccaaagcaacctgcaccggaaattgcccggaccgctgcggatgcacatcatccacgtgtctacacaaagaatggccccacagccggaactggaggtgcaacccgacatggtgctggggtgtaggaacggggtgtacttgctgcggcctagatgtcaaagacttattcactgactacatgttcgttaagtggaaagtagagtacataaaaacagaggcaatagtatgcgtcgaactcaactcacaggaacgtcaatgctcgctcatcgaagccggcaccagattcaatctaggccccgtcactatcacgctgtcagagccacgaaacattcaacaaaaacttccgagcgaaatcatcaccctccaccctcgtatcgaagaaggcttcttcgatctcatgcatgtgcaaaaagtgctcagtgcctccaccgtctgcaaactccagtcatgcacgcacggagttcctggtgacctccaaatctatcacatcggtaacctgctcaagggcgatcgcgttaacgggcatctaattcacaaaatcgaaccccacttcaacacatcttggatgtcgtgggacgggtgcgatctcgactactattgcaacatgggagactggccctcctgtacgtacaccggcgtcacgcaacacaatcacgccgcgttcgtcaacctgctcaatatagaaaccgactacaccaaaaatttccatttccactcaaagcgagttacagcacacggcgacacgccccagctcgacctaaaagcacgccccacatacggggcaggagaaatcacagtcctggtagaagtagccgacatggaactgcacacaaagaaaatcgcaattagcggcctcaaattcgccagcctgacctgcacaggctgctatgcatgcagctcaggcatctcttgcaaagtgagaatacacgtggacgaacccgacgaactcacagtacacgttaaatccgaggaccccgacatcgttgcagcctcctcatccctcatggcccgcaaacttgagttcggcaccgacagcactttcaaggccttctccgccatgcccaagacttctctctgcttctacatagtcgaacgagaatattgcgaatcctgctcaaaagaagacacgcaaaaatgtgtaaacacaaaactcgagcaaccacaatcaatcctcatcgaacacaagggaaccataatcggcaaacagaacgatacctgcactgcaaaggcgtcgtgttggctagagtcagtaaaatcattcttttacggcctcaaaaatatgttatcggggatattcgggaacgtcttcatcggaatcttcctcttcctggctcccttcattctcctaatactcttcttcatgttcggatggcgcatactcttctgtttcaaatgctgtcgacgcactcgcggccttttcaaatatcgatatctaaaggacgacgaagagtccggctaccgacgaatcatcgagcgcctaaacaataagaagggtaagaataaactcctcgacggagaacggcttgcagatcgacggatcgctgaactattctcaacaaaaactcatatcggctaa

SEQ ID NO: 15213 - RNA, 5070 nt, synthetic construct
  misc_feature 1..5070: note = derived and/or modified CDS sequence (opt11) from CCHFV(BA8402)__AF350449.1__GP
  source 1..5070: mol_type = other RNA
atgagcttctccgtgatgtatacgcccctgctctgcgccgtcctgtgccttcagctctggagccttgagggctcccacggtctgagcaacaagacccagcactcgaacaccagtacaaccaaggccccggaagtgtcccaggagctcggcctgcccgtgtccaccgtctccacgatcaccagcgagccgccctccatcaccagcgcggtgtccgtgtctgggtccgagggtagcggggacaccaacacgtcccccagcgtcaccacccaaggccccaccctgcccgaaacgaccctcgaacccctcacgaccacggacaccgatgcttctagcaccgttgtggtagacgtgagcacacagacggtgaaggacacccccatctccaccacctacacgagcctgccctccacccccagtgagcccaccacgcctcagggtacgcaccacactgcccgagggctcctgtccgtcaccagcacaaagcctgaggaggcgagcccccaagccaaccctgggaagatcagcatggaaacgaacgggcctcggctggcgatctccgagacccctagcttcagccccacgacccaggcccccacggagaatagcaacccgatcacctccaagcagttaatgctgagcgcccaacccgtgacccctaaccccatgacctccccggtgcagcccgccctgagccagtccgacaccagcaccgcgatccaggacgtccacccctccccgacaggacgcagcaagcggaacctcgagatggagatcatcctgaccctgagccaggggctcaagaagtactacggcaagatcctgaagctgctcgacctgaccctggaggaggacacggagggtttactggagtggtgcaagcgcaacctggggctcgtatgcgatgacaacttcttccagaagcggatcgaggagttcttcctgaccggaaaagggcacttcaacgaggtgctgcagttcaaaaccccgtccaccctcagccccacgggccccgcaaggaccggctccccaaccgtggagccctttaagagctacttcgccaaggggttcctgtccatggacagcgggtacttttccgccaagtgctacccccgggccagcaatagcgggctgcagctcatcaacgtcacccagcacagcacccgaatcaccgacacccccggcccgaagataaccaacctgaagacgatcaactgcatcaacctgaaggcttccgtgttcaaggaacaccgggagatcgagatcaacgtcctcctgccccaggtggccgtgaacctgagctcctgccacgtcctcataaagtctcacgtgtgcgactactcgctagacatcgatgggcccgtccgcctgccacggatccaccacgagggcaccttcatccctggcacctataagatcgttatcgacaagaagaacaagcagaatgaccgctgcactcttgtaacgaactgcgtcatcaaggggagagagatccgcaagggccagagcgttctgcggcagtaccgcaccgagatcaagatcgggaaagcctccagcggctcacggcgcctgctctccgaggagagcggggacgactgcatttcccggacccagcttctgcgcacggagacggccgagatccacaacgacaactacggcggccccggggacaagatcaccatctgtaacgggtctaccgtggtcgaccagcggctgggatccgagctcggctgttacaccatcaatcgcgtgaacagcttcaacctctgcgagaacacggccaccgggaaaagctgcgagatcgatagcacccccgtgaagtgccgtcagggcttctgcctgaagatcactcaggagggccgggggcacgtcaagctcagccgcggcagcgaagtcgtgctggacgcgtgcgagtcctcctgcgagatcatgatccccaaggggacgggggacatcttggtcgactgctccggcgggcagcagcacttcctcaaggacaacctgattgacctgggctgtccgaacatccctctactggggaagatggcgatctatatctgccggatgagcaaccacccaaaaaccaccatggccttccttttctggttttccttcggctacgtggtgacctgcatcctctgcaaggtcatcttctacctcctgatcgttgtgggcacgctcgggaaaaagttcaagcagtaccgcgagctgaagccccagacctgcaccatctgcgagaccaccccggtcaatgccatcgacgcggagatgcacgacctgaactgcagctacaacatctgcccctactgcgcgtcccggcccacgtcggacgggctcgcccgccacgtgatgcagtgccctaaacggaaggagaagatcgaggaaaccgctctgtacctgaacctcgagcgcattccgtgggtggtccgaaagctgctacaggtgtccgagagcaccggggtggccctcaagcgcagctcctggctggtcgtgctcctcgtgctgctgaccgtcagcctctcccccgtgcagtctgctcccatcggtcacgggaagactgtcgagacctaccagacccgggagggctacacctcgatctgcctgttcgtcttaggtagcatactctttatcgtgagctgcctcatgaagggtctcgtggacagcgttggcaactccttcttcccggggctcagcatttgcaaaacgtgctccatcgggagcgtaaacgggttcgaaatcgagtcccacaagtgctactgcagcctgttctgctgcccgtactgccgtcactgctccgcagacagggagatccaccgactgcacctcagcatctgtaagaagcggaagaccggctctaacgtgatgctggccgtctgcaagcgcatgtgcttccgggccaccgtggaggtgagcaacaaagccctgctaatacgcaacatcatcaacaccacgttcgtcctgtgcatcttaatcctcgctgtatgcgtggtctccaccagcgccgttgagatggagagcctgcccgccggaacctgggagcgggaggaggacctgaccaacttctgccatcaggaatgccaggtgacggagaccgagtgcttgtgcccctatgaggccctggtcttacgaaagcccctcttctccgactctatagtgaaggggatgaagaacctgctgaactccaccagcttggagacttccctgagcatcgaggctccctggggcgcgataaacgtgcagtccacgttcaagcccaccgtcagcgccgccaacatcgctcttagctggtcatccgtggagcacagggggaataaaatcttggtgtcaggccggtccgagagtatcatgaagctggaggagcgcaccgggatcagttgggacctgggcgtcgaggacgcctcagagtccaaactcctgaccgtgagcgtaatggacctgtcccagatgtacagccccgtgttcgagtacctcagcggggaccgccaggtggaggaatggcctaaggcgacgtgcaccggcgactgtcccgagcgatgcggctgtacttccagcacgtgcctgcacaaggagtggccccactcccggaactggcgctgcaaccccacctggtgctggggcgtcgggaccgggtgcacgtgctgcggcctggacgtaaaggacctctttaccgactacatgttcatcaaatggaaggtggagtacattaagaccgaggccatcgtctgtgtcgagctgaccagccaggagcggcagtgcactctgatcgaggcaggcacccggttcaacctagggccggttacgatcaccttatccgagccccggaacatccagcagaagctgccgcccgagatcgtcaccttacacccccgcatcgaggagggcttcttcgaccttatgcacgtgcagaaggtgctgtccgcctccaccgtctgcaagctccagagctgcacccacggggtgcccggagacctccaggtataccacatcgggaacctgctgaaaggcgacaaggtcaacggccacctgatccacaagatcgagccacacttcaacacgtcctggatgagctgggacgggtgcgacctgcactactactgcaacatgggcgactggccctcgtgcacctacacgggcgtgacccaacacaaccacgccgcgttcgtgaatatgctcaacatcgagacggactacaccaagaacttccacttccacagcaagcgggtcaccgcccacggcgacaccccgcagctggacctgaaggctcgacccacgtacggggccggcgaaatcaccgtgcttgtcgaggtcgcggatatggagctgcacaccaagaagatcgagatctccggcctgaagttcgcaagcctgacttgtaccgggtgctacgcctgctccagcggcatctcctgcaaggtgcggatccacgtcgacgagcccgacgagctgaccgtccacgtcaagagcgaagaccccgatatcgtggccgcatcctcgagcctgatggcgcgaaagctcgagtttgggaccgacagcaccttcaaggccttcagcgccatgccgaagacatccctatgcttctacatcgtggagagggagtactgcgagagctgctccaaggaggacacccagaagtgcgtgaacaccaagctcgagcagccccaatcgatcctcatcgaacataagggcaccataatcgggaagcaatccaatacgtgcaccgccaaggcaagctgctggctggagtccgtcaagagcttcttttacggcctgaaaaacatgttatccggcatattcgggaacgtgttcatcggcgtcttcctcttcttcgcgcccttcatcctgctaatactcttcttcatgtttgggtggcgcatcctattctgctttaagtgctgccggcgcacccggggcctgtttaagtaccggcacttgaaggacgacgaggagaccggctatcggaagatcatcgaacgcctgaacaacaagaagggaaagaacaagctgctcgacggcgagcgcctggctgaccggaaaatcgccgagcttttcagcacgaaaacccacatcgggtaa

SEQ ID NO: 15214 - RNA, 5070 nt, synthetic construct
  misc_feature 1..5070: note = derived and/or modified CDS sequence (opt11) from CCHFV(BA66019)__AF350448.1__GP
  source 1..5070: mol_type = other RNA
atgcccgccaacatcatgtataccttactcgtgtgcgccgtcctgtgcccgcagctgtggagcctcgaggggacccacgttccccacaacgagacgaagcacaacgggaccggcatcaccgcggcccccggggagtcccagggccccatgagcccggcctccaccgccgtgcccctgacgcccgagcctccgaacaccaagcccgccgcgagcgcctccgagctggagtcatccggggagggccataccagcctcctggccaccacgcagggcctgacctcccccgaggccacacccgagctcccgaccacgaccgacaccggagtcagctccaccagcgtggtggacatcggcacccagatggccaaggacacccccacctccaccgcccacacgagcttaccctccaaccccagcgccccgtccaccgcccaggggacccaccacaccatccgcggcctgcttagcgtcacgtccactaagcccgaggaggccagcacccccaccgaccccgggaaggcgggcgccgagacgggcagcccgcggcccgccatctcccgcaagcccaccctgagccccaccgcagaggccccgaccgagatcaacaactccagcacgcccaagcagcccgagccctccatccagcctgcgacccccagcctggtgatctcccccgctcagccggccttcccccaaagcgccacctccaccgccgcgcaggacatctacagctcccccacgaaccggagcaagcgcaacctcaagatggagatcatcctgaccctgtcccaggggctcaagaagtactacggcaagatacaaaagaccctggggctgaccctcgaggaggacaccgagggcctgctggagtggtgcaagcggaacctcggcctgacgtgcgacgacaacttctttcagaagcgcatcgaggagttcttcttgaccggggagggctacttcaacgaggtgctccagttcaagaccccgagcaccccggggtcaacggagcccacccacgccgaggcccctaccgtcaagcccttcaagagctacttcgcgcggggcttcctgaccatcaactccgggtacttcagcgccaagtgctattcctggacgagcaacagcggcctgcagttgatcaacgtgacccagcacccggcgcgcatcgccgacacccccggtcccaagatcaccaacctgaagacgatcaactgcatcaacctgaaggcctccgtgtttaaagagcaccgggagatcgagatcaacgtcctcctgccccaggtggccgtgaacttaagcaactgccacgtcctcatcaagtcccacgtatgcgactacagcctggacatcgacgggaccatccgcctgccgcggatctaccacgagggcaccttcatccccgggacatacaagatcgtaattgacaaacgcgacaagcagaacgaccggtgcacgctcgtcaccaactgcgtgatcaaaggccgcgaggtgcgaaaggggcagtccgcgctgcgccagtaccggaccgagatccggatcggcaaggccagcgccggctcccggcgcctgctcagcgaggagtccggggacgactgcatcagcagaacccagctgctgcgcacggagaccgccgaggtccacggcgacaactacgggggccccggggacaagatcaccatctgcaacggctccaccatcgtggaccagcgcctcggcagcgagctgggatgctacacgatcaaccgggtgaagtccttcaagctgtgtgagaacagcggcaccgggaagtcctgcaagatcgacaagcaccccgtcaagtgccgccagggcttctgcctcaagatcacccaggagggccgggggcacgtgaagttaagccgcggctccgaggtcgtgctggacgcctgcgacagcagctgcgagatcatgatcccgaaggggaccggagacatcctggtggattgctccgggggccagcagcacttcctcaaggacaacttggtcgacctgggctgccccaacatccccctcctggggaagatggcgatctacatctgccggatgagcaaccaccccaagacgaccatggccttcctgttctggttcagtttcggctacgtgatcacgtgcatcttctgcaagatcatcttctacctcctgatcgtggtcgggaccctgggcaagaagttcaagcagtaccgcgagctcaagccgcagacctgcaccatctgcgagaccacccccacgaacgccatcgacgccgagatgcacgatctgaagtgcagctacaacatctgcccctactgcgcctcccggctgaccagtgacgggctcgcgcgccacgtgacccagtgccccaagcggaaggagaaggtggaagagaccgagctgtacctgaacctcgagcgcatcccgtggatcgtccggaagctgctccaggtgtccgagagcaccggcgtggccctgaagcgctccagctggctgatcgttctgctcgtgctgctgacggtgtccctcagccccgtccagtccgcccccatcggccacgggaagaccatcgaggcctatcagacccgggagggctacaccagcgtgtgcctgttcatgctcgggggcatcctgtttgtggtatcctgcctgatgaaggggctggtggactctgtgtccaacagcttcttcccgggcctcagtatctgcaagacgtgcagcatcggctcggtcaacgggttcgagatcgaatcccataagtgctactgcagcctgctgtgctgcctctactgccgccactgcagtgccgaccgggagatccaccagctgcacctgagcatctgcaaaaagcgccgggcgggcggtaacgtgatgctcgccgtgtgcaagcgcatgtgcctgcgggccaccatggaggtctccaacaaggtgctgttcatccgcagcataatcaacaccaccttcgtgatctgcatcctcgtcctggccgtgtgcatcgtgtccacgagcgcggtcgagatggagtccctgcccgccggcacctgggagcgcgaggaggacctcaccaacttctgccaccaggagtgccaggtgaccgagacggagtgcctgtgcccctacgaggccctggtgctccggaagcccctgttcagcgactccatcgtcaagggcatgaagaacctgctcaacagcacctccctggagaccagcctgagcatcgaggcgccgtggggcgccatcaacgtgcagagcacctttaagcccacggtgtccaccgcgaacatcgcccttagctggtccagcgtcgagcaccgcggcaacaagatcctggtgagcgggcggtccgagagcatcatgaagctggaggagcgcaccggcatctcctgggacctcggggtggaggacgccagcgagtccaagctgctgaccgtcagcgtgatggatctctcccagatgtactcgcccgtgttcgagtacctgtccggcgaccggcaggtcgaggagtggcccaaggccacgtgcactggcgactgcccagaccgctgcgggtgcaccagctccacctgtctgcacaaggagtggccccacagccggaattggcgctgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgaactcccaggagcggcagtgcagcctcatcgaggcgggcacccgcttcaacctggggcccgtgaccatcaccctgtcggaaccgcggaacatccagcagaagctcccgcccgagatcatcacgctgcacccccgcatcgaggaggggttcttcgacctgatgcacgtgcagaaggtcctcagcgcctccaccgtgtgcaagctgcagagctgcacccacggcgtccccggggacctgcagatctaccacattggcaacctcttgaagggggaccgggtgaacggccacctgatccacaagatcgagccccacttcaacacctcctggatgagctgggacggctgcgacctcgactactactgcaatatgggagactggcccagttgtacgtacaccggcgtgacccagcacaaccacgccgccttcgtcaacctgctgaacatcgagactgactacaccaagaacttccacttccactccaagcgcgtgacggcccacggggacactccccagctcgacctgaaggcgcggccgacctacggcgccggggagatcaccgtgctggtcgaggtggccgacatggagctccacaccaagaagatcgccatcagcgggctgaagttcgcgtccctgacctgcaccggctgctacgcctgcagctccgggatcagctgcaaggtgcgcatccacgtcgacgagccggacgagctcaccgtgcacgtgaagtccgaggaccccgacatcgtcgccgccagctccagcctgatggcccggaagctggagttcggcacagactccaccttcaaggcgttcagcgccatgcccaaaacctccctctgcttctacatcgtggagcgcgagtactgcgagagctgctccaaggaggacacccagaagtgcgtgaacacgaagctggagcagccgcagagcatccttatcgagcacaaggggaccatcatcggcaagcagaacgacacgtgcaccgccaaggcctcctgctggctcgagagcgtcaagtccttcttctacggcctgaagaacatgctgagcgggatctttggcaacgtgttcatcgggatcttcctcttcttggcccctttcatcctcctgatcctcttcttcatgtttggctggcggatcctgttctgcttcaagtgctgccgccgcacccgcggactgttcaagtaccgctacctcaaggacgacgaggagagcggctaccgtcgcatcatcgagcggctgaacaacaagaaaggcaagaacaagctgctggacggggagcggctggcggaccggcgcatcgccgagctgttcagtaccaagacccacatcggctga

SEQ ID NO: 15215 - RNA, 5070 nt, synthetic construct
  misc_feature 1..5070: note = derived and/or modified CDS sequence (opt11) from CCHFV(BA88166)__AF338470.1__GP
  source 1..5070: mol_type = other RNA
atgagcttctccgtgatgtacacgcccctgctctgcgccgtactgtgcctgcagctctggtccctggagggctcccacgggcttagcaacaaaacccagcactcaaacacctccaccaccaaggccccggaggtgtcccaggagctcggcctgccggtgagcaccgtctccaccatcaccagcgacccgccctcgatcacctccgcagtgagtgtgagcggatccgaaggcagcggggacacaaacacgtcccccagcgttaccacccagggccccaccctgcccgaaacaaccctagagcccctaaccactacggacacggatgcctccagcaccgtggtggtcgacgtgagcacccagactgtgaaggataccccgatctcaaccacctacacgagcctgccgtccaccccgagcgagcccaccaccccgcagggaacgcaccacaccgcccgcgggctgctgtccgtcacctcgaccaaacccgaggaggcctccacgcaggccaacccgggcaagatcagcatggagactaatagcccccgtctggcgatcagcgagacgccgtccttctcgcccacgacgcaagcacccaccgaaaacagtaaccccatcaccagcaagcagctcatgttgagtgcccagcccgtgacccccaaccccatgaccagtccggtgcagcccgccctgtcccagagcgacacgtctaccgcgatccaagatatccaccctagccccactgggcgctctaagcggaacctggagatggaaataatcctgaccctgtcacagggcctcaagaagtactacgggaagatcttgaagctgttagacctgacactagaagaggacaccgagggactcctggagtggtgcaagaggaatctgggcctggtctgtgacgacaatttctttcagaagcgcatcgaggagtttttcttgaccggcaagggccacttcaacgaagtgctgcaattcaaaaccccctctacgttatccccgacagggcccgcccgcaccggcagcccgaccgtggagccgttcaagagttattttgccaagggcttcctaagcatggattccgggtacttttccgccaaatgctatccccgggcgtccaacagcggcctgcagctcattaacgtcacacagcacagtacccgcattaccgatacacccgggcccaagataacgaaccttaagaccattaactgcatcaacctgaaggcgtctgtattcaaggaacaccgggagatcgaaatcaacgtgctcctgccgcaagtcgccgtgaacttgtctagctgtcacgtgctcatcaagagtcacgtgtgcgactacagcctggacatcgatggccccgtacgcctgccccggatccaccacgaggggaccttcatccccggcacctacaagatcgtcatcgacaagaagaacaagcagaacgaccgctgcacgctcgtgaccaactgtgtgatcaagggccgggagatccgcaagggtcagtccgtcctgcggcaataccgcaccgagatcaagatcggcaaggccagcagcgggagccgtcgcctgctcagcgaggagtccggcgacgactgcatcagccggacccagctgctgcgcaccgagaccgccgagatccactccgacaactatgggggcccgggggacaagatcaccatatgcaacgggtcaaccgtggtggaccagcggctgggctccgagctcggctgctacactattaaccgcgtaaagagcttcaagctgtgcgagaactccgccactggaaagagctgcgaaatcgatagcaccccggtgaaatgccgccaaggtttctgcctgaagatcacccaggagggtcggggccacgtgaagctcagccgcggctccgaggtcgtgctggacgcgtgcgacagctcctgcgagatcatgatccccaagggcactggtgacatcctagtggactgcagcggcggccagcaacacttcctcaaggacaacctaatcgaccttgggtgcccaaacatccctctcctggggaagatggccatttacatatgccggatgtcaaatcaccccaaaaccaccatgggcttcctgttctggttcagctttgggtacgtcgttacctgcatactgtgcaaaggaatcttctacctgctcatcgtggtcggtactctcggcaagaagtttaagcaataccgcgagctaaaaccgcagacctgcaccatatgcgagaccacccccgtgaatgccatcgacgccgagatgcatgacctcaactgctcctataatatctgcccgtactgcgcgagccggctcacgagcgatgggttggcacgccacgtaatgcagtgccccaagcggaaggagaagatcgaggagaccgagctctacctcaaccttgaacgcataccctgggtcgtgcgcaagctgctacaggtgtccgagtcgaccggcgtcgccctgaagcgctccagctggttggtggtgctcctggtcctgctcaccgtgtccctgtctccagtgcagtccgccccaatcgggcacggcaaaacggtcgaaacctatcagacccgggaagggtacaccagcatctgcctgttcgtgctcggctccatcctgttcatcgttagctgtctgatgaagggcctcgtcgactcggtggggaacagcttcttccccggcctgtccatatgcaaaacatgcagcatcgggtcagtgaacggcttcgagatcgagagccataaatgctattgttccctgttctgctgtccctactgccgccactgctcagcagaccgcgagatccatcgcctccacctgtccatctgcaagaagcggaagacctggagcaacgtcatgctggccgtgtgtaagcgcatgtgcttcagggcgaccgtggaggtcagcaacaaggccctcctgatccgcaatattatcaacaccaccttcgtgctgtgcatcctcatcctagcagtgtgcgtggtgtcaacgagcgccgtggagatggaatctctgcccgcggggacctgggagcgggaggaagatctcaccaacttctgccaccaagaatgtcaggtcacggagacagagtgcctgtgcccgtacgaagccctggtcctccgcaagcccctttacctggacagcatcgtgaaaggcatgaagaatttacttaactccacgagcctggagacctccctcagcatcgaggcgccctggggcgccatcaacgtccagtccacgtttaagccgactatgagtgctgcgaacatagccctgtcctggagctccgtggagcaccgcggtaacaagatcctggtaagcggccggagtgagagcataatgaaattggaggaacgaaccgggataagttggaacctgggcgtcgaggacgccagcgaatccaagctgctcacggtcagcgtgatggacctgagccagatgtactcgccggtattcgagtaccttagcggggaccgccaggtggaggagtggcccaaggccacgtgcaccggcgactgccccgagcggtgcggttgtaccagtagtacgtgcctccacaaggagtggccgcactcacggaactggcgctgcaaccccacctggtgctggggcgtcggcaccggctgcacgtgttgtggcctagacgtgaaagacctgttcacggactacatgttcatcaagtggaaggtggagtacatcaaaaccgaggccatcgtatgcgtggagctcaccagccaggaacggcagtgtaccctgatagaggcgggcacccgcttcaacctgggtcccgttatcatcacgctctccgagccccggaatatccagcaaaagctgccgcccgaaatagtcaccctgcacccccgaatagaggaaggcttcttcgacctcatgcacgtccagaaagtgctgagcgcctccactgtctgcaagctgcagagctgcacccatggagtgccaggcgatctccaggtgtaccacatcgggaatttactgaagggcgacaaagtgaacggccatctcatccacaagatcgagccgcacttcaacacatcctggatgagctgggacgggtgcgacctggactactactgcaacatgggtgactggccctcctgcacgtataccggggtcacccaacacaaccatgccgccttcgtgaacatgctgaacatcgagaccgactacacgaaaaactttcacttccacagcaagagagtcaccgcccacggcgacacgccccagctcgacctgaaggcgcgccctacttacggggccggagagatcaccgtgttagtggaggtagccgacatggagctccacaccaaaaagatagagatctccggcctgaagttcgcctcgctgacctgcacgggctgctacgcgtgctccagtggcatctcttgcaaggtgcggatccacgttgacgaaccggacgaactcacggtccacgtgaagagtgaagacccagacatcgtggctgctagctccagcctgatggcccgcaagttagagttcgggaccgactccaccttcaaagcctttagcgcgatgcccaagacctccctgtgcttctacatcgtcgagcgtgagtactgcaagagctgctccaaggaggacactcaaaagtgcgtgaacaccaagctggagcagcctcagagcatcttaatcgagcacaaaggcactatcatcgggaagcagaacaatacctgcaccgccaaggcctcctgctggctcgaaagcgtgaagtccttcttctacgggctcaagaacatgctgagcggaatcttcggaaacgtattcatcggcgtgttcctgttcttcgcccccttcatcctccttattctgttcttcatgttcggctggcgcatcctgttctgctttaagtgctgccggcgcacacggggcttgttcaagtaccgccacctgaaagacgacgaggagaccggctaccggaagatcatcgagcgcctcaacaacaagaaggggaagaacaaattactggatggcgagcgtctcgccgacaggaagatcgcggagctgttctccaccaagacgcatatagggtga

SEQ ID NO: 15216 - RNA, 5070 nt, synthetic construct
  misc_feature 1..5070: note = derived and/or modified CDS sequence (opt11) from CCHFV(UCCR4459)__KY484032.1__GP
  source 1..5070: mol_type = other RNA
atgagcttctccatcatgtacacgcccttactctgcgccgtgctgtgcctgcagctatggtcgctggagggctcccacgggctgagcaacaagactcagcactccaacaccagcactaccaaggccccggaggtctcacaggagttcggcctacccgtaagcaccgtgtccacgatcaccagcgacccgccctccatcaccagcgcggtctccgtgagcggatccgagggctcgggggacaccaacacgtcccccagcgtgaccacccagggccttaccctacctgagacgacgctcgagctgctgacgacgacggacaccgacgcctcctcaacagtcgtggtggacgtcagcacccagactgttaaggatacccccatctccaccacacacacgagcctcccctccacaccatctgccaccaccacgccacagggcacccaccacaccgcccgcgggctgctgtccgtgacaagcacgaagcccgagggggcctccacccaggcgaaccccgagaaaatcagcatggagaccaactccccgcggctcgccatcagcgaaaccccctccttctctcccacgacccaggcccccaccgaaaactccaacccgataactagcaagcagctgatcttctccgcccagcccgtcaccccaaaccccgtcactccgcccgtgcaaccggcgctcagccagtccgatacctccaccgccatccaagacatccacccttccccgacgagccgcagcaagcggaacctcgaaatggagatcatcctgaccctgtcccaggggctcaagaagtactacggcaagatcctgaagctgctcgacctgacgctggaggaggacactgaagggctcctggagtggtgcaagcgcaacctgggcctcgtctgcgatgacgacttcttccagaagcggatcgaggagttcttcctgaccggcgaagggcactttaatgaggtgctgcagttcaagacacccagcactctgtcccccaccggccccgcacgtacagggagcccgacggtggagcccttcaagtcctacttcgccaagggcttcctgagtatggactccggctacttcagcgccaagtgctacccccgggcgtccaactccgggctacagctcatcaacgtcacccagcactccactcgcatcaccgacacgccgggccccaaggtgaccaacttgaagaccattaactgcatcaacctgaaagccagcgtgttcaaagagcacagggagatcgagatcaacgtcctccttccccaggtggccgtgaacctttccagctgccacgtgctcatcaagtcccacgtgtgcgactacagcctcgacatcgacgggcccgtccgcttgccacggatccaccacgagggcaccttcatacccgggacgtacaagctggtgatcgacaagaagaacaagcagaacgaccgctgcacacttatcaccaattgcgtgatcaaaggccgagagatccgcaaaggccagtcagttttgcggcagtacaggacagagatcaagattgggaaggccagcagcggctcccggcgcttactgagcgaggagtccggggatgactgtatcagccggacgcagctgtcccgcaccgagaccgccgagatccacagcgacaactacggcgggcccggagataagatcacaatctgcaacggatccaccatcgtagaccagcggctagggtctgagctcggctgctataccatcaaccgcgtgaaatctttcaagttgtgcgagaactcggcgaccgggaaatcctgcgaaatcgactcaacccccatcaaatgcaggcagggcttctgtctgaagatcacgcaggaggggcgggggcacgtcaaactatcccgcggcagcgaggtggtgttagatgcctgcgactccagctgcgagatcatgattccgaaggggaccggcgacatcctggtcgactgctccgggggccagcagcacttcctcaaagacaatctgatagacctgggctgccccaacatcccgctcctggggaaaatggccatctatatctgccggatgagcaaccaccccaaaaccaccatggccttcctgttttggttctccttcggctacgttatcacgtgcatcctctgtaaggtgattttctatctgctgatcgtcgtggggaccctcggcaagaagttcaagcagtaccgcgagctgaagccgcagacttgcacaatctgcgagacaacgcccgtgaacgctatcgacgcggagatgcacgatctgaattgcagctacaacatctgcccctactgcgccagccggcttacctccgatgggctggcccgccatgtaatgcagtgcccaaagcgaaaggagaaggtggaggagaccgagctgtacctcaacctggagcgcatcccgtgggtggtccggaagctgctccaggtgagcgagtccacgggcgtggccctgaaacgcagctcctggctggttgtgctcctggtgctgcttacggtcagcctgtcccctgtgcaaagcgccccaatcggccacgggaagaccgtggagacctatcagacccgggaaggctacacgtccatctgcctgttcgtcctcgggagcatccttttcatcgtgtcctgcctgatgaagggcctcgtggacagcgtaggaaactccttcttccccgggctgagcatctgcaagacctgctcaatcggcagcatcaatgggttcgagatcgagtcccacaagtgctactgctcgctgttctgctgcccgtactgccggcattgctccgcagaccgggagatccacaaactccacctgagcatctgcaagaagcgcaagaccggcagcaacgtgatgttagccgtgtgcaagcggatgtgcttccgcgccaccgtcgaggtgtccaacaaggccctcctgatccggaacatcatcaacacgacgttcgtggtctgcatcctgatccttgcggtctgcgtggtcagcacctccgccgtggagatggaaagcctgcccgccgggacctgggagcgcgaggaggacctgacaaacttctgccaccaggagtgccaagtgaccgagaccgaatgcctctgcccctacgaggccctggtcctgcggaagcccctcttctccgacagcatcgtgaagggcatgaagaacctgctgaactcaaccagcctcgagacgtccctgagcatcgaggccccctggggcgcaatcaacgtgcaaagtaccttcaaacccaccgtcagcgccgccaacatagcgctgagctggagctccgtggagcatagaggtaataagatcctcgtgagcggccgctccgagagcatcatgaaactggaggaacggaccgggatatcctgggacttgggcgtagaagatgcctccgagagcaagctcttaaccgtatccatcatggacctgagccagatgtactcccccgtgttcgagtacctcagcggggacaggcaggtcgaagaatggccgaaggcgacctgcaccggcgactgtcccgagcggtgcgggtgcacctcctcaacttgcctgcacaaggaatggccccattcccgcaactggcggtgcaaccccacctggtgctggggcgtgggcaccgggtgcacgtgctgcggcctggacgtcaaggacctcttcaccgactacatgttcgtcaagtggaaggtggagtacatcaagacagaggccatcgtctgcgtggagctgaccagccaggagcgtcagtgctccctgattgaggccgggacccggttcaacctcggccccgtgacaattacactgagcgagccccgcaacatccagcagaagctgccgccggagatcgtcaccctccacccccggattgaggagggcttcttcgaccttatgcacgtgaagaaagtgctgtccgccagcacggtatgcaagctccagagttgtacccacggggtgcccggcgacctccaggtgtaccacatcgggaacctgctcaagggcgacaaagtcaacgggcacctgatccacaagatcgagccccacttcaatacgagctggatgagttgggacggctgcgacctggactactactgcaacatgggcgactggcccagctgctcttacaccggggtgacccagcacaatcacgccgcgttcgtgaacatgctcaacatcgaaaccgactacacgaaaatctttcacttccacagcaagcgcgtcaccgcccacggcgacaccccgcagctggacctgaaggcccggccaacctacggagccggcgaaattacggtgcttgtggaagtcgctgacatggagctgcacacgaagaagatcgagatctccgggctgaagttcgccagcctgacttgcaccggatgctacgcctgcagctccggcatcagctgcaaggtacgcatccacgtggacgagcccgacgagctgacggtccacgtgaagtccgaggaccccgacatcgtggccgccagttccagcctgatggcacggaagctcgagttcgggaccgacagcaccttcaaggccttctctgccatgcctaagaccagcctgtgcttttacatcgtcgagcgcgagtactgcaagtcatgctctaaggaggacacgcagaagtgcgtgaacaccaagctggagcagccccagagcatcctcatcgagcacaagggcaccatcatcgggaagcaaaacgacacatgcacgtccaaggccggctgctggctggagagcgtgaagtccttcttttacgggctgaaaaacatgctgagcggcatcttcggcaacgtcttcatcgggatcttcctcttcctggccccctttatcctgctaatcctgtttttcatgttcggctggcggatcctgttctgcttcaagtgctgccgccggacccgcggcttattcaagtaccggcacctgaaggacgacgaggagaccggctaccgcaagatcatcgagcggctgaacaataagaagggcaagaacaagctcctagacggggagcgcttggcggaccgcaagatcgccgagctgttcagtaccaagactcacatcggctga

SEQ ID NO: 15217 - RNA, 5070 nt, synthetic construct
  misc_feature 1..5070: note = derived and/or modified CDS sequence (opt11) from CCHFV(K168_125)__KX013460.1__GP
  source 1..5070: mol_type = other RNA
atgcccataagcaccatgcacatcagcctgatgtgcgccgtgctctgcttacagctgtacggcctcgggggcacccacggcctgcacaacggcacggagcacaacaagaccaacgccgtcaccacgtcatccaacagccagtccagcgagtccccggcgcgcacggccccgcccgtgacccccgactcgcccaccgtcactcccacgaccccagcctccgccccggaggggagcggcgaggcccactccagcccgcccaacaacaccgagggcccctccctgccggaaagcacctccgagccgcccgcggccacgagcaccgggatcccctccgctagcgacgtcaacagtagcacccaggccgcccgggacacgagcacgcccaccgtgcgcacctccccgcccaacagcccctccaccccgccaacgccccaggagacccaccaccccgtgcggaacctcctgagcgtcacctcccacaagcccgaggagaccagcgccccgtccgagagcggtaaagagtcccccgccgccaacagcccccaccccgtggcctccaggccgcccacacccagcaccacggcgcaggggccgaccgagaacaacaactacaacacgaccggccagctggagtccctcacccagagcaccacgctggggcccatgacctccctgacccagaccgacctcccccagtcggtgacgtccatcgccgtccaggacacccacccctctccgaccaaccggtccaagcgcaacctggagatggagatcatactcaccctcccccagggcctgaagaagtattacggcaaggtgctacggctcctgcagctgaccctcgaggaggatacagaagggctgctggagtggtgcaagcgcaacctaggcctggactgcgacgacaccttcttccagaagcggatcgaagagtttttcatcaccggggagggccacttcaacgaggtgctgcagtttcgcacccccggcaccctcagcaccaccgaaagcacccacgccgggctgcccacggccgaaccgttcaagtcctacttcgccaagggcttcctgagcatcgactccggttacttcagcgcgaagtgctactcccggaccagcaattccggcctccagctgattaacgtcacccgccacagcacccggatcgccgacacgcccgggctgaagatcaccaacctcaaaaccatcagttgcatcaacctgaaggcgtcggtattcaaggagcaccgcgaggttgagatcaacgtcctgctcccccaagttgccgtgaacctgtccaactgccacgtcaccatcaaaagccacgtgtgcgactactccctggacatcgacggcacggtgcggctcccccacatccaccacgacggcaccttcattccgggtacctacaagatagtcatagaccgcaaaaataagctgaacgaccggtgtaccctgttcacgaactgcgtgatcaagggccgcgaggtccggaaggggcagagcgtcctccgccagtacaagacagagatccggatcggcaaggcctccaccgggagccgccgcctgctgtccgatgagagcggggacgactgcatcagccggacccagctcctgcgcacggagaccgcggagatccacggggacaactatgggggccccggggacaagatcaccatctgcaacggctccaccatagttgaccagcggctgggcagcgagctcggctgctacacgatcaaccgcgtcaagtccttcaagctgtgcgagaacagcgccaccggcaagtcctgtgaggtggacagcatccccgtgaagtgccggcaggggtactgtctaaagatcacccaggagggccgagggcatgtcaagctgtccaggggctcggaagtggtgttggacgcctgcgactccagctgcgaggtaatgatccccaagggcaccggggacatcctggtggactgctctggcgggcagcagcacttcctgaaggacaacctcatcgacctgggctgcccaaaggttcccctgctggggaagatggccatctacatctgccgcatgagcaaccatcccaaaacgaccatggccttcctgttctggttcagcttcggctacgtcatcacgtgcatcgtgtgtaaggcgatcttctacctgcttatcatcgtgggcaccctggggaagcggttcaagcagtaccgcgagctgaaaccccagacctgcacaatatgcgaaacgaccccgacgaacgccatcgacgccgagatgcacgacctcaactgtagctacaacatctgcccttactgcgcctcccggctgacgagcgatggactggcgcgccacgtcactcactgccccaagcggaaggagaaagtggaggagaccgaactctacctgaacctggagcgcatcccctgggtggtccggaagctcctccaggtgtcggagagcaccggggtggccctgaagcgctccagctggctgatcgtcctgttagtcctcttcgccgtatcattatcaccagtgcagagcgcccccatcggccacggcaagacgatagagacctatcaggtgcgggaggagtacacctccatctgcctgttcgtgctcgggagtatcctgttcatcgtctcgtgcctcatgaagggcctcgtgaacagcgtggggaacatcttcttccccggcctgtccatatgcaagacctgtagcatcgggtccatcaacggcttcgagatcgagagccacaagtgctactgcagcctgctctgctgcccgtactgcagacactgctcggccgacagggagatccaccagctgcacctgtcgatctgcaagaagcgcaagacggggagcaacgtcatgctcgcggtgtgcaagcgcatgtgtttccgggccaccgtggaggtctccaacaaggccctgagcatccgctccatcatcaacaccaccttcgtggtttgcatcctgatcctcgcggtctgcgtggtgagcacttctgccgtcgagatggagagcctgcccgcgggcacctgggagcgggaagaggaccttaccaacttctgccaccaggagtgccaggtgaccgagactgagtgtctctgtccatacgaggccctggtactgcggaggcccctcttcctggactcaatcgtcaagggcaagaagaacttactcaactccaccagcctggagacgtccctgagcatcgaagccccgtggggcgccatcaacgtgcaatccacctacaagcccacggtgagcgccgcgaacatcgccctatcctggagctccgtcgagcaccgcgggaacaagatcttagtgagcggtcgctccgagagcatcatgaagctggaggagcgcaccggcatctcctgggacctcggggtggaggacgccagcgagtccaagctgctgaccgtcagcgtgatggatctctcccagatgtatagccccgtgttcgagtacctgtccggcgatcggcaggtcgaggagtggcccaaggcgacctgtacgggtgactgcccggagcgctgcgggtgcaccagctccacttgcctgcataaggaatggccacacagccggaactggcgctgcaatcccacctggtgctggggcgttgggaccggctgcacgtgttgcggcctcgacgtgaaggacctgttcaccgactacatgttcgtcaagtggaaggtggagtacatcaagaccgaagccattgtctgcgtagagctgactagccaggagcggcaatgctccctcatcgaagccgggacccgcttcaacttgggccccgtgaccatcaccctgagcgagccgcggaacatccagcagaagctccctcccgagataatcacgctgcacccccgcatcgaggaggggttcttcgacttgatgcacgtgcaaaaggtgctctccgccagcaccgtgtgcaagctgcagtcctgcacccatggcgtgcccggggacctccaggtgtaccatatcggcaacctgctgaaaggcgacaaggtgaacgggcacctgatccacaagatcgagccccacttcaacaccagctggatgtcctgggatggatgcgacctcgactactactgcaacatgggggactggcccagctgcacctatacgggcgtcacccagcataaccacgcctccttcatcaacctgctgaatatcgagaccgactataccaagtcattccacttccactccaagcgggtgacggcccacggggacacgccccagctcgacctgaaggcgcgcccgaactacggcgccggcgagatcaccgtgctggtcgaggtggccgacatggaactgcacaccaagaagatcgagatcagcgggctgaagttcgcctccctgacctgcaccggctgttacgcctgctcgtccgggatcagctgcaaggtgcggatccacgtggacgagcccgacgagctcaccgtgcacgtaaagtccgacgaccccgacgtcgtggcggccagcagctccctgatggcccgcaagctggagttcggcaccgacagcacattcaaggccttctccgccatgcccaagaccagcttatgcttctacatcgtcgagcgggagtattgcaagtcctgcagcaaggaggacacccagaagtgcgtcaacaccaagctggagcacccgcagtccatcctaatcgagcacaagggaacgatcatcggtaaacagaacaatacgtgcaccgcgaagaccagctgctggctcgagtccgtcaagagcttcttctatggcctaaagaacatgctctccgggatcttcggcaacgtgttcgtggggatcttccttttcctggctccgttcatcctgctgattctcttcttcatgttcggctggcgcatcctgttctgcttcaagtgctgccgccgaactcgcggcctgttccggtacaagcacctcgaggacgacgaggagaccggttaccgacggatcatcgagcgcctgaataacaagaagggcaaaaacaagctgctcgacggggagcggctcgccgatcgccggatcgccgagctgttcagcaccaagacccacatcggttga

SEQ ID NO: 15218 - RNA, 5070 nt, synthetic construct
  misc_feature 1..5070: note = derived and/or modified CDS sequence (opt11) from CCHFV(K168_40)__KX013457.1__GP
  source 1..5070: mol_type = other RNA
atgcccatcagtactatgcacatctccctgatgtgcgcagtgctctgccttcagctatacggcctcggaggcacccatggcctgcacaacggcaccgagcacaacaagaccaacgccgtgaccaccagctccaacagccagtcgtccgagtctccggcccgcacggccccgccagtgaccccggactcgcccaccgtgacaccaactacgcctgccagtgctcccgaggggagcggcgaggcccactccagcccgcccaacaacacagagggcccctccctgcccgagagcacctccgagccgccagcggccaccagtaccggcatcccctccgccagcgatgtgaactctagcactcaggccgcgcgggacacatccacacctaccgtgcgcactagccctcccaacagcccgtccaccccgcccacgccccaagagacccaccacccggttcggaacctcctgtcagtcacgtcgcacaagccagaggagacgtccgcaccatctgagtccggcaaagagtccccggccgcaaattcaccacatcccgtggcctccaggccacccacgccctcgacaaccgcgcaagggccgacagaaaataacaactacaatacgaccggccaactggagtccctaacccagagcaccacgcttgggccgatgaccagtttaacccaaaccgacctcccacagtccgtcacgagtatagccgtccaggatacccaccccagcccaacaaacagatccaagcgcaacctggagatggaaatcatcctgaccctcccacagggccttaagaagtactacggcaaggtgttgcggctcttacaactgacccttgaggaagacacggaggggctgctggagtggtgcaagagaaatctcgggctggactgcgacgacaccttctttcaaaaacggatagaagaatttttcatcaccggcgaaggccatttcaacgaggtgctgcagttccgcaccccaggcaccctgagcactaccgagagcacccacgcgggactgccgactgccgagccttttaagtcctactttgctaagggcttcctgagcatagactccgggtacttctctgccaagtgctactcccggaccagcaactccggtctccagctgataaatgtgaccagacacagcaccagaatcgcagacacgcccgggcccaagatcacaaatcttaaaaccatctcctgcatcaatctcaaggccagcgtttttaaggagcaccgagaggtggagatcaatgtcctgctcccccaggtcgccgtgaacctctcgaactgccacgtcacgatcaagtcacatgtgtgcgactactctttggacatcgatggcacggtgcggctgccgcacatccaccacgacggcaccttcatccctgggacgtacaagatcgtaatcgaccgcaagaacaagctcaacgacaggtgtaccctgttcacgaattgcgttataaagggtcgggaggtgcggaagggccagagcgtcctgcgccagtacaagaccgagattcggataggcaaggcctccaccggaagcaggagactcctttccgacgagagcggcgacgattgcattagccggacccagctgctccgcaccgagaccgcggagatccacggcgacaactacgggggcccgggggacaagatcacgatctgcaacggctccaccatagtggatcaacggcttgggagcgagctcggatgctacacgatcaaccgcgttaaatcattcaagctctgcgagaatagcgctaccggcaagtcgtgcgaggtcgacagcatccccgtgaaatgccggcagggctactgcctgaaaattacacaggagggacgcggccacgtcaagctgtcccgtggcagcgaggtggtgctggatgcctgcgactccagctgtgaggtcatgatccccaagggaaccggggacatccttgtggactgctccggagggcagcaacacttcctcaaggacaacctgatcgaccttggctgccccaagatccccctgctagggaagatggcaatatatatctgccgtatgagtaatcaccccaagacgacgatggcattcctcttttggtttagtttcggctatgtgattacatgcattgtctgcaaggcaatcttctaccttctcatcatcgtgggcacgctcgggaagcggttcaaacagtaccgcgaactgaagccgcaaacctgcaccatctgcgagacgaccccaacgaacgccatcgacgccgagatgcacgacctgaactgctcatacaacatctgcccatactgcgcctctagactcacgagcgatggactggcgaggcacgtgacgcattgccccaaacgtaaagagaaggtcgaggagaccgagctttatctcaatcttgagcgcatcccgtgggtagttcggaagctgctccaagtctccgagtcgacaggggtggcgctgaagaggagtagttggctcatcgtgctcctggtcctgttcgccgtgagcctctcccccgtgcagagcgcacccatcggccacgggaagacgatcgagacctatcaggtccgggaggagtacacctcaatttgcctgttcgtgctgggaagcatcctttttatcgtgtcgtgtctgatgaagggcttagtcaactcagttggtaacattttcttcccggggctctccatctgcaaaacatgcagcatcgggtccataaacggtttcgagatcgagtcgcacaagtgttactgctccctgctgtgctgcccctactgtcgccactgcagcgccgaccgggagatccaccaactccacctctccatctgtaagaagaggaaaacggggagcaatgtgatgctggctgtatgcaagcgaatgtgcttccgtgctaccgtggaggtgtccaacaaggcgcttagtatacgctccataatcaacaccacctttgtcgtgtgcatcctaatcctggccgtgtgtgtcgtgagcacgtctgccgtggagatggaaagtctcccagcgggcacatgggagagagaagaggacctgaccaatttttgtcaccaggagtgccaggtcaccgagacggaatgcctgtgcccctacgaggcacttgtgctgcgtcggccgctattcttggacggtatcgttaaggggatgaagaacctactgaactcgacctccctcgagaccagcctgtctatcgaggccccctggggcgcgatcaacgtgcagagcacctacaaacccacggtgtccgcggcgaacatcgccctgtcctggtccagcgtggagcaccgcgggaacaaaatcttagtctcgggacggtccgagagcatcatgaagctagaggaaaggaccgggatctcctgggaccttggggtggaggacgcctccgagagcaagctcctgacagtgtccgtgatggaccttagccagatgtattcccctgtattcgagtacctcagcggcgaccgtcaggtggaggagtggcccaaggcgacctgcacgggggattgccctgagcggtgcggatgcacctcctccacgtgcctacacaaggaatggccacacagtcggaattggcgctgcaacccgacctggtgctggggcgtcgggaccgggtgtacgtgctgcgggctcgacgtgaaggacctcttcaccgactatatgtttgtgaagtggaaggtagagtacattaagaccgaggccatcgtctgcgtcgagctgacgagccaggagagacagtgtagcctgatcgaggccggtacccgatttaacctcgggccggtgaccatcaccctgtccgagcccagaaacatacagcaaaagctcccgccggaaatcataacgctccatccaagaattgaggagggcttcttcgatctgatgcacgtgcagaaagttctgagcgcctccacggtctgcaaactccagagctgcactcatggggtgcccggcgacctacaggtctaccacatcggcaacctgttgaagggcgacaaggtgaacgggcatctgatccacaagatagagccccacttcaacacctcctggatgagctgggacgggtgcgacctggactactactgcaatatgggcgactggccatcctgcacctacacgggggtaacccaacacaaccacgcctcatttattaatctcctgaacatagaaaccgattataccaaatcgtttcacttccatagcaagcgcgtcacggcccacggcgacaccccgcagctcgacctaaaggcgcgccccaactacggcgccggagagatcactgttctggtggaggtcgcagacatggagctgcacaccaagaagatagagatttccggcctcaaattcgccagcctcacgtgcaccgggtgctacgcctgctcaagtggtatctcatgcaaggtgcggatccacgtagacgagcccgacgagctgaccgtccatgtcaaatcagacgaccctgacgtggtggcggcctcatccagcctcatggccaggaagctggagttcggtaccgattccacctttaaagccttcagcgccatgccaaaaacgagtctgtgcttctatatcgtggagcgggagtactgtaagagctgctccaaggaggatactcagaaatgcgtgaacaccaagctcgagcacccccagtcaatcttgattgagcacaagggcaccataatcggcaagcaaaacaacacgtgtaccgcgaaaacctcctgctggttagagtccgtgaaatcattcttctacggtttgaagaacatgctgagcggcatttttgggaacgtattcgtaggcatcttcctgtttctggcccccttcatcctcctaatccttttcttcatgttcggctggcgcatccttttctgtttcaagtgttgccgccgcacccgcgggctattccggtacaagcatttggaagacgacgaagaaacaggctataggcggatcatcgaacgcttgaataacaaaaaggggaaaaacaagctgctcgacggagagcggctcgctgaccgccggatagccgagctgttctcaaccaaaacccacattggctga

SEQ ID NO: 15219 - RNA, 5070 nt, synthetic construct; identical to SEQ ID NO: 11933
  misc_feature 1..5070: note = derived and/or modified CDS sequence (opt11) from CCHFV(K128_76)__KX013454.1__GP
  source 1..5070: mol_type = other RNA

SEQ ID NO: 15220 - RNA, 5070 nt, synthetic construct
  misc_feature 1..5070: note = derived and/or modified CDS sequence (opt11) from CCHFV(Hodzha)__KX013448.1__GP
  source 1..5070: mol_type = other RNA
atgcccgtgagcattatgcacatcctgctcatgtgcgccgtcctgtgcctgcagcagtacggcctcggggagacccaccgcccgaataacggcaccgagcacaacaagacgaacgtgctgaccacaccatccgacaagctgagccccgagccgccggtgtcaaccgccctcagcgtcacgcccgactcgagcaccgtgacccccacaacacccgtctccgggctggagggcagcggggaggtctacacctccccgcccgtgacaacgaagggcctgagcccctccaaggcgacgagcgagctccccgccaccaccggcatcgacacctccagcgcctccgacgtggacagctccacccaggccgcccgggacactagcaccttaaccgtccggacgtccccgcccagcagcccctccacgcccccgaccagccaggacacctaccacctggtgcggaacctcctgagtgtcaccagtccccgccccgaggagaccaccgcgccctccaagtcggggaaggagtccccggtcgccaacagcccccaccccgtgacctcccggccctcttccccgcccatcaccgtgcagggccccaccgagaacagctcccacaacaccaccgggcagctggagagcatggcccagtccacgaccctcgtccccatggccagcccgactcagaccgttctctcacagagcgtgacgtccctggcggtccaggacgcccaccccagccccaccaaccgcagcaaacggaacctcgagatggagatcatcctaaccctgccccagggcctcaagaagtactacgggaaggtgctacgcctgttacagttaaccctagaggaggacaccgagggcctcctggaatggtgcaagcggaacctgggcctcgactgcgacgacacattcttccagaagcgcatcgaggagttcttcatcaccggcgagggccacttcaacgaggtgctgcaattcaagaccccctccaccctgtccacgaccgagtccacccacgccgtcagccccaccgccgagcccttcaaatcctacttcgcaaaggggttcctcagcatcgactccggctacttcagcgcgaagtgctactcgaagacgagcaactccggcctacagttgatcaacgtgacccggcacagcacccgcatcgccgacaccccggggcccaagatcacgaacctgaagaccatctcctgcatcaacctgaaggcctcagtattcaaggagcaccgcgaggtcgagatcaacgtgctgctcccccaggtcgccgtgaacctgtccaactgccatgtgaccatcaagagccacgtctgcgactactccctggacgtcgacgggaccgtgcgcctcccccacatccaccacgggggcacgttcatcccggggacatacaagatcgtgattgacaagaagaacaagctgaacgaccggtgcaccctgtacaccaactgcgtgatcaagggccgcgaggtgcggaagggccagagcatcctccgccagtacaagacggagatccggatcgggaaggccagcaccggctcgcgccggctgttatctgaggagtccggggacgactgcatcagccgcacccagctcttgaggaccgagacggcggagatccacggcgacgactacgggggccccggcgacaagatcaccatctgcaacgggtccacaatcgtcgaccagcggctgggcagcgagctgggttgttacacgatcaaccgcgtgaagtccttcaaactctgcgagaatagcgccacgggcaagtcctgcgagatcgatagcacccccgtgaagtgccggcaggggtactgcctgaagatcacccaggagggccgcggccacgtcaagctgtcccgggggagcgaggtggtgctcgacgcctgcgacagcagctgtgaagtaatgatccccaagggcaccggggacatcctggtggactgctccggcggccagcaacactttctgaaggacaacctcatcgacctggggtgcccgcgcatccccctgctcggcaagatggccatctatatctgccggatgagcaaccaccccgagacgaccatggccttcttattctggttctccttcgggtacgtgatcacgtgcattctgtgcaaggcgatcttctatctcctgatcatcgtcggcaccctggggaagcgcttcaagcagtaccgggaactcaagccccagacctgcaccatctgcgagaccaccccggccaacgccatcgacgccgagatgcacgacctgaactgcagctacaacatctgcccctattgcgcttcccgcctgacctccgacggcctcgcgcggcacgtgacgcagtgccccaagcgcaaggagaaggtagaggagaccgagctgtacctgaacctcgagcggatcccctggatcgtccgcaagctgttgcaagtgagcgagtccaccggcgtggccctgaagcggagctcctggcttatcgtcctgctcgtgctgtttgccgtgagtctgtccccggtccagagcgcccccatagggcacggcaagaccatcgagacgtaccaggcgcgcgaggagtacactagcatctgcctcttcgtgctggggagcatcctgttcatcgtgtcctgccttatgaagggcctggtcgatagcatcgggaacattttcttccccggcttgacaatctgcaaaacctgcagcatcggcagcatcaacgggttcgagatcgagtcccacaagtgctactgcagcctcttgtgctgcccctattgccgtcactgcccggccgacagagagatccatcagctgcacctctccatctgcaagaagcggaagacgggcagcaacgtgatgctggccgtctgcaagcgcatgtgcttccgagccaccatggaggtctccaacaaggccttactcatccgcagcatcatcaacaccaccttcgtggtgtgcatcctgatcctggccgtctgcgtggtgtccacgagcgcagtcgagatggagagcctccccgccgggacttgggagcgcgaggaggacctgactaacttctgccaccaggaatgccaggtgaccgagacggaatgcctgtgcccctacgaggccctcgtgctgagacgcccactgttcctcgactccatcgtcaagggcaagaagaacctgctgaacagcacctccctagagaccagcctgtccatcgaggccccctggggcgcgatcaacgtgcaaagcacatacaagcccaccgtgtccaccgccaacatcgccctgagctggtcctcggtcgagcaccgggggaacaagatcttagtgtccggcagaagcgagtccatcatgaagctggaggagcggaccgggatcagctgggacctcggcgtggaggacgcgtccgagagcaagctcctgaccgtctccgtgatggacctgtctcagatgtactcccccgtgttcgagtacctcagcggggaccgccaggtcgaggagtggcctaaggcaacgtgcaccggcgattgcagcgagcgttgcgggtgcacctccagcacgtgtctgcataaggagtggccccactcacgcaactggcgatgcaaccccacctggtgctggggcgtgggaaccgggtgcacgtgctgtggcctggacgtcaaggacctattcaccgactatatgttcgtgaagtggaaggtggattacattaagaccgaggcgatcgtctgcgtggagctgaccagccaggagcgccagtgctccctagtggaggccgggacccggttcaacctcggccccgttaccatcacgctgagcgagccgcgcaacatccagcagaagctgccgcccgagatcatcaccctccacccccggatcgaggagggtttcttcgacctgatgcacgtgcagaaggtgctgtccgcaagcacagtctgcaagctccagtcctgcacccacggggtccctggcgacctccaggtgtaccacatcgggaacctgctgaagggtgacaaggttaacggacacctgatccacaagatcgagccccacttcaacaccagctggatgtcctgggatggctgcgatctggactactactgcaacatgggcgactggcccagctgcacatacacgggggtgacacagcacaaccacgcctccttcgtgaacctcctgaacatcgagaccgactacaccaagagcttccatttccactccaaacgcgtcaccgcgcacggagacacgccccagctggacctcaaagcccgcccgacctacggggccggcgagatcaccgttctagttgaggtcgccgacatggagctgcacactaaaaagatagagatcacggggctaaagttcgccagcctgacttgcacgggctgttacgcgtgctcgagcggaatctcctgcaaggtgcgcatccacgtggacgagcccgacgagctgaccgtccacgtcaagagcgacgaccccgacgtggttgccgccagctctagcctcatggcccggaagctggagttcgggaccgactccaccttcaaggccttcagcgcgatgcccaagacgtccctgtgcttctacatagtggagcgcgagtactgcaagagctgctccaaggaggacacccagaagtgcgtgaacacaaagctcgagcagccgcagagcatcctgatcgagcaaaagggcaccatcatagggaagcagaacaacacgtgtaccgccaaggcctcctgctggctggagtcggtcaagtccttcttctacggcctgaagaacatgttaagcgggatcttcggcaacgtgttcgtgggcattttcctgttcctggcccccttcatcctcctcatcctgttctttatgttcgggtggcggatcctcttctgcttcaagtgctgccgccggacccggggcctgttcaagtacaagcacctgaaggacgacgaggagaccgggtaccggcggatcatcgagcgtctaaacaacaagaagggcaagaacaagctgctggacggcgagcggttggccgaccgccggatcgccgagcttttctccacgaaaacgcacattgggtga

SEQ ID NO: 15221 - RNA, 5070 nt, synthetic construct
  misc_feature 1..5070: note = derived and/or modified CDS sequence (opt11) from CCHFV(Hy13)__AY900145.1__GP
  source 1..5070: mol_type = other RNA
atgagcttctccatcatgtacactcccctgctctgtgcagtgctgtgcctgcagctctggagcctggagggctcccacgggctgagtaacaagacccagcattccaacaccagcaccaccaaggcgccggaggtgtcgcaagagttcggcctccccgtgagcaccgtgtccacgatcaccagcgacccgccctccatcaccagcgcggtgagcgtgagcgggtccgagggcagcggcgacaccaacacgtcccccagcgtgaccacccagggcctgaccctgcccgagacgaccctcgagctgctgacgaccacggataccgacgcctccagcaccgtcgtggtggacgtgagcacccagacggtgaaggacacccccatttccacgacccatacgagccttccttccaccccgagcgccaccaccacgccccaaggcacccaccacaccgcgcgggggctgctgagcgtgaccagcacgaagcccgagggcgcctccacccaggccaaccctgagaagatcagcatggagaccaactccccgcggctcgccatcagcgagaccccctcgttcagcccaacgacccaggcccccaccgagaactccaatccgatcacgagcaagcagctgatcttctccgcccagcccgtcacccccaaccccgtcacgccgcccgtgcaacccgcgctctcacaaagcgatacgagcaccgccatccaggacatccacccctccccgaccagccgaagcaagcggaacctcgagatggagatcatcctgacgctgtcccaggggttgaagaagtactacggcaagatcctgaagctgctcgacctgacactggaggaggacactgaggggttgctagagtggtgcaagcgcaacctgggcctcgtctgcgacgccgacttcttccagaagaggatcgaggagttcttcctgaccggcgaggggcacttcaacgaagtgctgcagtttaagactcccagcaccctctcccccaccggccctgcccgcaccgggagcccgacggtggagcccttcaagtcctactttgccaagggtttcctgagcatggactccggctacttcagcgcgaagtgctacccccgggcctccaacagcgggctgcagctcatcaacgtgacccagcactccacccgcatcaccgacacgccgggccccaaggtgaccaatctgaagaccatcaactgcatcaacctgaaggcctcggtgttcaaggaacaccgagagatcgagatcaacgttctcctgccccaagtggccgtgaacctgtcatcgtgccacgtcctcataaagtcccacgtgtgcgactactctctggacatcgacgggcccgtcaggttaccgcggatccaccatgagggcaccttcattcccgggacgtacaagctcgtgatcgacaagaaaaacaagcagaacgacagatgcacactgatcaccaactgcgtgatcaagggcagggagatccgcaagggccagtccgtcctgcggcagtaccgtaccgagatcaagatcgggaaggccagctcgggctcccggcgcctcctgagcgaggagtctggggacgactgcatcagccggacgcagctgtcccgcacggaaacagcggagatccacagcgacaactacggcgggcccggcgacaagatcaccatctgcaacggctccacgatcgtagaccagcggctggggagcgagctcggctgttacaccatcaaccgcgtgaagtccttcaagctgtgcgagaacagcgccaccgggaagtcctgtgagatcgacagcaccccgatcaagtgccgccagggcttctgcctgaagatcacgcaggaggggcggggccacgtcaagttgtcccgcggcagcgaggttgtgctggatgcctgcgactccagctgtgagatcatgatcccgaaggggaccggcgacatcctggtcgactgctccgggggtcagcagcacttcctcaaggacaacctgatcgacctgggctgccccaacatccctctccttggaaagatggccatctacatctgccggatgagcaaccaccccaaaaccaccatggccttcctgttctggttctccttcggctacgtgataacatgcatcctctgcaaggtgatcttctacctgttgatcgtcgtgggtaccctgggcaagaagttcaagcagtaccgcgagctgaagccgcagacctgcaccatctgcgagaccacgcccgtgaacgcgatcgacgccgagatgcacgacctgaactgcagctacaacatctgcccctattgcgccagccggctcacctccgacgggctggcccgccacgtcatgcagtgccccaagcgcaaggagaaggtagaggagaccgagctgtacctcaacctggagcgcatcccgtgggtggtccggaagctgctccaggtgagcgagagtaccggcgtggccctgaagcgtagctcctggctggtcgtgctcctggtgctgctcaccgtcagcctgtcccccgttcagagcgcgcccatcggtcatgggaagaccgtggagacgtaccagacccgggagggctacacgagcatctgcctgttcgtcctcgggagcatcctgttcattgtgtcctgcctgatgaagggcttagtggacagcgtcgggaactccttcttccccggcagctccatctgcaaaacctgcagtatcggctccatcaacgggtttgagatcgagagccacaagtgctactgctcactgttctgctgcccgtactgccgccactgcagcgccgacagagaaatccacaagctgcacctctcgatctgcaagaaacgcaaaaccggctccaacgtgatgctggccgtgtgcaagcggatgtgctttcgcgccaccgtcgaggtgagcaacaaggcgttactcatccggaacatcatcaacacgaccttcgtggtctgcatcctgatcctggccgtgtgcgtggtctcgaccagcgccgtggagatggagtcactccccgccgggacctgggagcgcgaggaggacctgacgaacttctgccaccaggagtgccaggccacggagactgagtgcctgtgcccctacgaggcgctcgtcctgcggaagcccctgttcagcgactccatcgtcaagggcatgaaaaacctcctgaacagcacctccctggagaccagcctctccatcgaggccccgtggggcgccatcaacgtgcagagcaccttcaaacccaccgtatccgccgccaacatcgccctgagctggtcctcggtcgagcaccgcgggaacaagatcctggtgtccgggcggagcgagtccatcatgaagctcgaggagcggaccgggatcagctgggacctgggggtggaggacgccagcgagtccaagctactaacggtcagcataatggacctgtcccagatgtacagccctgtgttcgagtacctgtccggggaccgccaggtggaggagtggccgaaggcgacctgcaccggcgactgccccgagcggtgcgggtgcactagctccacgtgcctccataaggagtggccccacagccgcaactggcggtgcaaccccacctggtgctggggcgtcggcaccgggtgcacatgctgcggcctggacgtgaaggacctgttcaccgaccacatgttcgtcaagtggaaggtggaatacataaaaaccgaggccatcgtgtgcgtcgagctcacctcccaggagcgccagtgcagcctgatcgaggcggggacccggttcaacctcggccccgtgacgatcaccctctccgagccccgcaacatccagcagaagctgccgcccgagatcgtgaccctgcacccccggatcgaggagggcttcttcgacctcatgcacgtcaagaaggtattgagcgcctccaccgtttgcaagctgcagagctgcacccacggcgtcccgggcgacctccaggtgtaccatatcgggaatctgctgaagggcgacaaagtgaacgggcacctcatccacaagatcgagccccacttcaacacgtcctggatgtcttgggacggttgcgacctggactactactgcaacatgggcgactggccgtcctgcagctacaccggggtcacccagcataaccacgccgccttcgtgaacatgctgaacatcgagacggactacacgaagatcttccatttccattccaagcgcgtgaccgcccacggcgacaccccgcagctcgacctgaaagcgcggcccacctacggcgccggcgagatcacggtcctggtggaggtggccgacatggagctccacaccaagaagatcgagatcagcgggctgaagttcgcctccctgacctgcaccggctgctacgcctgctcctctgggataagttgcaaagtccgtatccacgtggacgagcccgacgagttgacggtacacgttaagagcgaggaccccgacatcgtggcagcctccagctccctgatggcccggaagctggagttcgggaccgacagcacgttcaaggccttctccgccatgcctaagacaagcctctgcttctacatcgtggagcgcgagtactgtaagtcctgcagcaaggaggacacgcagaagtgcgtcaacaccaagctggagcagccccagtccatcctgatcgagcacaaaggcaccatcatcgggaagcagaacgacacttgcaccagcaaggcgggctgctggctagagtccgtcaagagctttttctacgggctgaagaacatgctgtccggcatcttcggtaacgtgttcatcgggatcttcctgttcctcgcccctttcatcctgctgatcctcttcttcatgttcggctggcggatactgttctgcttcaagtgctgccgccgcacccgcggtctgttcaagtaccggcacctcaaagacgacgaagagaccggctaccgcaagatcatcgagcggcttaacaacaagaagggcaaaaacaaacttctcgacggggaacgcctggccgacagaaagatcgccgagttgttctccaccaagacgcacatcggctag

SEQ ID NO: 15222 - RNA, 5070 nt, synthetic construct
  misc_feature 1..5070: note = derived and/or modified CDS sequence (opt11) from CCHFV(SPU415/85)__DQ211635.1__GP
  source 1..5070: mol_type = other RNA
atgcccgtgaacatcatgtacaccccgctggtctgcgccgtgatctgtctccaactatggaacctgggcgggaccctcgtgttcatcaaccgtactcagcacaacgagaccggcacggtcgccaccccagaggggacgcttcggccacgcctgccagtgagcactgcgcttccgaccaagtccgaccggccctcggtgggtccagccgcctccagcagtgggttagagggctcaggcgaacccaacacctcgccgagcatcacgactaaggggctgaccccacccgagacgacgcccgccctcccgacagccaccgacaccgacgcgtcctctacgggcgtggtggacgtgtccacccaaatgactaaagacatacccatgagtacggcctacacgaacccgccttccacgcccagcgcaccaagtactccccaggggacacaccacacagcgcgcgggctactgagcgtcgcctcaaccaagagcgaggaggtgtccatgagcacctcccccgccaaaacctccacggagacctcttcccctccacccgccaccagcgaaacccccacgccgagccccacgacccaggtgcccactgggaacaacaaccccaatacgagtcggcagccgacgcctagtgctcaacccgccatgtcgaacccggcgacctcccccgcacagcccaatctctcacagtccgctccacccaccgccgaccagggggtccatcccagccccaccaaccgatccaagcggaacctcgaaatcgagattatactgacgctcagccaaggcttgcgcaaatattacgggaagatcctcaaactcctggacctaacactcgaggaggataccgagggactattagagtggtgcaagcggaacctcggcctgacctgcgatgacaatttcttccagaagcgcatcgaggagtttttcctgacaggcgaggggtacttcaacgaggtattgcagttcaaggtgccctccaccctgagctctacagagcccacacacacgcggccccctaccgttgaaccttttaagtcatacttcgccaaagggttcctctccatgaactccggctacttcagcgcgaagtgttatccacgaacctcaaattccgggctccagctgatcaacgtaaccaaacactccgccaaaatcgctgacactcccggccccaagatcactaacctgaagaccataaactgtatcaacttgagggccagcgtgttcaaagaacaccgcgaggtcgagatcaacgtgctcctgccccaggtcgctgttaacctctccaattgccacgcgcagatcaagtctcacgtatgcgactactcgttagccactgacgggatggtgcgtctgccccatatccatcatgagggcacgttcatccccggtacctacaagatcgtcatagataagaaaaacaagcagaatgaccgttgcactttggtgaccaattgcgtcatcaagggccgagaggtgcgcaaaggtcagtcagccctaagacagtataagacggaaatccgcattgggaaggcctccagtgggtcccggcgcctgctgtccgaagagtccgacggggactgcattagccgcacgcagctgctacgtaccgagactacggagatccacagcgacaactacggtggccccggtgacaagatcaccatctgtaatggcagcacaatcgtggaccaacgcctcgggtccgagctgggctgctacaccattaatcgcgtcaagagtttcaagttatgcgagaacagcgccacggggaaaagctgcgaaatcgacagcacccccgtaaagtgccgccagggcttctgtctgaaaatcacccaggaagggcgggggcacgtgaagctgtcacgcggcagcgagatcgtcctcgacgcgtgcgactccaactgcgagatcatgatcccgaagggaaccggggacatccttgtggactgcagcggcgggcaacagcatttcctgaaggacaacctcatcgacctggggtgccccaatatccctctcctgggtaagatggcaatttacatctgcagaatgtccaaccaccccaagacaaccatggccttcctgttttggttcagctttggctacgtgatcacttgcatcctctgcaaggtcatcttctacctgctgatcgtcgccggcaccgtggggaagaagttcaaacagtaccgagagctccggcctcagacgtgcaccatttgcgagaccatccccgtcaacgcgatcgacgccgagatgcacgatctcaactgctcatacaacatctgcccttactgcgccagccggctgacctccgacggactcgcccggcacgtgatgcagtgcccaaagcgcaaagagaaggtggaggaaacggagttatacctcaacctcgagcggataccctgggtcgtgcgcaaactgctccaggtgagcgaatccacgggggtcgccttgaaacggagctcctggttaacagttctactcgtccttttgatcgtaagcctctcccccgtacagagcgcgcccattgggcacgggaagaccatagagacctaccaagctcgagagggctacacgtccttctgcctattcatcctcggaagcatactctttgtcgtaagctgcctggtgaagggcctgatcgactccgtgggcaatagcttcttcccgggcctctccatctgcaagacctgctcaatcggcagtatcaatgggttcgagatcgagtctcataaatgctactgctctctattttgctgtccctactgccggcactgcagcgccgatcgcgagatccataagctgcacctctccatatgcaaaaagagaaagaccggctccaatgtcatgctggccgtttgcaagaggatgtgcttccgcgccaccattgaggtgagcaaccgggcgctcctaatccgcaacatcatcaacacgaccttcgtagtgtgcatcctgactctggcagtgtgcgtcgtaagcacttcggccgtggagatggaaagcctccccgccgggacgtgggagaaggaggaggatctgaccaacttctgtcaccaggagtgccaggtcacggaaaccgaatgcctatgcccctacgaggcactcgtgcttcggaaaccgctgttcctcgactccatcgtgaagggcatgaagaatctgctgaatagcacgtccttagagaccagtctgtcgatcgaggcgccctggggcgccataaacgtgcagagtactttcaagcccactgtgtcagccgcaaacattgcactgtcctggagctccgtggagcaccgcgggaacaaaatattggtcagcggacggtcggagagtatcatgaagttggaggagcgcactggaatctcctgggacctgggcgtggaggacgcaagcgagtccaaactcctgacggtgagcgtcatggacctgagccagatgtacagccccgttttcgagtacctctccggagaccgtcaggtggaggaatggccgaaggctacctgcacgggcgactgccccgagcgctgcggctgcacgagctcaacctgcctacacaaggaatggccgcactcccggaactggcgatgtaacccaacctggtgctggggcgttgggaccgggtgcacatgctgcggcctagatgttaaggatctcttcaccgactacatgttcgtaaagtggaaagtcgagtacatcaagacggaggccatcgtgtgcgtcgaactcacatctcaggagcggcaatgcagccttatcgaggccggcacgcgcttcaatcttgggcctgtgaccatcacactgtccgaaccccggaacatccaacagaaactgccacccgagattataaccctccacccccgcatcgaggaaggcttcttcgatctgatgcacgtgcagcgtgtcctgagcgcaagcacggtgtgcaagttgcagtcgtgtacccacggagtgcctggcgatctgcaggtctaccacatcggcaatctgctcaaaggcgacaaggtgaacgggcacctaatacacaagatcgaaccacatttcaacacgagctggatgtcctgggacgggtgcgatctggactactattgcaacatgggagattggccctcttgcacctacaccggggtgacgcagcataaccatgctgccttcgtcaacctattaaatatcgagaccgactacaccaagaatttccactttcactccaagcgcgtgacagcgcacggagatacgccccagctcgacctcaaggcccgacccacctatggagccggcgaggtgacggtcctagtcgaggtggcagacatggagctacacaccaagaagatagaaataagcggcctcaaatttgcctccctgacatgcaccggatgctacgcttgcagctccggcatctcttgcaaggtaaaaatacacgtggacgagcccgacgagctgaccgtccacgtaaaatccgaggaccccgacatagtggccgcgggcagctcccttatggcccgcaaattggagttcggcgccgactcaactttcaaggccttcagcgcgatgccgaagacaagtctgtgcttctacatcgtggagcgggaatattgtaagtcttgtagccgtgaggacaccagaaagtgcgtcaacaccaaactcgaccgtccccagtccatcctgatcgagcataagggcaccatcatcggcaagcagaacaatacctgcaccgccaaggcatcttgctggctggagagcgtgaagtccttcttttacggcttaaagaacatgttgagcgggatcttcggaaacgtgttcatcgggatcttcctgttcatcgcacccttcgtgctcctcatcctgttcttcatgttcggctggcgcatactgttctgcttcaagtgctgcaggcggacccggggcctcttcaaataccgccacctgaaggacgacgaagaaacggggtaccggaagatcatcgagcgcctgaacaacaagaagggcaagaacaagttactggacggcgagcgtctggcggaccgtaaaatagcggagctgttctcgacgaagagtcacataggctaa

SEQ ID NO: 15223 - RNA, 5070 nt, synthetic construct
  misc_feature 1..5070: note = derived and/or modified CDS sequence (opt11) from CCHFV(SPU97/85)__DQ211633.1__GP
  source 1..5070: mol_type = other RNA
atgaccgtgaacaccgtctgcacgcccctcgtctgcgccgtgttctgcctccagctatggaacctgggcgggaccctcgtcccaaccaaccgcacccagcacaataaaaccggcaccatggccacccccgaggggaccctgggcccccggctgcccgtgagcacggcactgccgaccaagtctgaccgccccagcgtgggccctgccgccccctcctcaggcctggagggctcaggggagccgaacaccagcccctccataaccacgaagggacttgccctcccggagactacccccgcaccgcccaccgcgacggatacggacgctagctccaccggagtcgtgaacgtgagcacccagatgactaaggacatccccatgtccaccgcctacaccaatccgcccagcaccccctccgcccccagcacgccccagggcacccatcacactgcgagagggctcctgtccgttgcgagcaccaagtccgaggaggtgagcatgtcgacgagcccgggcaaaacaagcacggagacctccagcccacccccagccacctccgagacccccgccccgtcccccaccacccaggcccccacgggtaacaacaacccaaacacatctcgccaacccacccccagcgctcaaccagccatgtccaaccccaccaccagtcccgcgcagcccaatctcctgcaaaacgccccgcccacggccgaccagggggtgcaccccggtcccaccaaccggtccaagcgcaacctggagatggaaatcatcctcaccctgagccagggcctgcggaagtactacggaaagatcctcaagttcttggacctgaccttggaggaggacacggaaggtctgctggagtggtgcaaacgcaacctcgggctaacgtgcgacgataactttttccagaagcggatcgaggagttcttcctgaccggcgaggggtatttcaacgaggtcctccagtttaaggtcccgtcaaccctgagctcaacggagcccacgcacaccggcagcccaaccgtggagccgttcaagtcctactttgcaaaggggttcctgagcatgaactccggctattttagcgcgaagtgctacccgagaacgtccaacagcggcctccagctgatcaatgttactaagcacagcgccaagatagccgacacacccgggcctaagatcaccaacctgaagacgatcaactgcatcaacctccgagcttccgtgttcaaggagcatagggaggtggagatcaacgtgctgttgccccaggtggccgtgaacctctcaaactgccacgcccagatcaagtcccacgtctgcgactacagcctggccaccgacggcatggtgcggctgccgcgcattcaccatgaggggaccttcatccccggcacttacaagatcgttatcgacaagaaaaacaaacagaacgatcgttgcacgctcgtcaccaactgtgtgatcaaaggtcgagaggtccggaagggccagtcggcactgcgccagtacaagaccgagatccggatcggcaaagccagctccgggagccgccggctgctctccgaggaaagcgacggcgactgcatctcccgcacccagctgttgcgcactgagaccgcggaaatccacagcgacaactacgggggcccaggggacaagatcaccatctgtaacgggtccaccatcgtggaccagcggctcggcagcgagctggggtgctacacgattaaccgcgtgaagtccttcaaactttgcgagaacagcgccaccggtaaatcctgcgagatcgactctacccccgtcaagtgccggcaggggttttgcctcaagatcactcaggagggacgcggccacgtgaagctgagccgggggagcgaaattgtgctagacgcatgcgacagctcctgtgagatcatgatccccaagggaacaggggacatcctagtagactgcagcggcggccaacagcacttcctcaaggacaacctaatcgacctgggctgccccaacatccccttgctgggccgcatggccatctacatatgccggatgtccaaccaccccaagaccaccatggcgtttctgttctggttcagcttcggttacgtgatcacgtgcatcttatgtaaagtgatattttacctgctgatcgtcgccgggaccgtcgggaagaagttcaaacagtaccgcgagctccggccacagacctgcaccatctgcgagaccacccccgttaacgccattgacgccgagatgcacgacctgaactgctcctacaacatctgtccctattgcgcctctcgcctgacgtccgacgggctcgcgcggcacgtcatgcagtgcccgaagcgcaaggagaagatcgaggagactgagctgtacctgaatcttgaacggatcccctgggtcgtccgcaagctgctgcaggtctccgagtccaccggtgtggccctgaaacggagctcttggctgaccgtgctgctcgtcctgctgattgtgagcctctcccccgtgcagtccgcccccatcggacacggcaagacgatcgagacataccaggcccgcgaggggtatacctcgttctgcctgttcatcctaggtagcatcctcttcatcgtctcctgcctggtgaaagggctgattgactccgtgggcaacagctttttcccgggcctctccatttgcaagacctgcagtatcggctctgttaacggcttcgagatcgagtcacacaagtgctactgttcactgttctgttgcccatactgccggcactgctccgccgatcgcgagatacataaactgcacttatctatctgcaagaagcggaagacagggagcaacgtgatgctagcggtatgcaagcgcatgtgcttccgcgcgaccatcgaggtctccaaccgggccctgctcatccgctctatcatcaacaccaccttcgccgtgtgcatcctgacgctagcagtgtgcgtagtgtccaccagcgcagtggagatggagtccctccccgccggcacctgggagcgggaggaggacctgaccaacttttgccaccaagagtgccaagtcacggagaccgagtgtctgtgcccgtacgaggccctcgtgcttcgcaagccgctgttcctcgacagcatcgtgaaggggaagaagaacctgctgaactccaccagcctcgaaacaagtctgagcatcgaggccccctggggcgcgataaacgtccagtcaactttcaagcccaccgtctctgccgccaacatcgccctgagctggtcttccgtggagcaccgcgggaacaagatcctcgtgtccggccgcagcgagtccatcatgaagctggaggagcgaacaggaatatcatgggacctgggggtcgaggacgcttccgagagcaagctcctgacagtatccgtgatggacctgagccagatgtactcccccgtgttcgagtacctcagcggggaccgccaggtggaggagtggccgaaagcgacgtgcaccggcgattgcccagagcgatgcggctgcaccagttcgacgtgcctgcataaggagtggccccactcccgaaactggcggtgcaaccccacctggtgctggggcgtcgggaccggctgtacgtgctgcgggctggacgtgaaagacctctttaccgactacatgtttgtgaagtggaaggtcgagtacatcaagaccgaggccatcgtgtgcgtggaactcaccagccaggagcgccagtgctccctgatcgaggctggcacccggttcaacctcggaccggtgaccataactctgagcgagccccgaaacatacagcagaagttgccgcccgagatcattacgctccacccccggattgaggaaggctttttcgacctgatgcacgtgcagaaggtcttatccgctagcacagtctgcaagctccagagctgtacccacggcgtgcccggtgatctgcaagtgtatcacataggcaacctgctcaagggtgacaaggtaaacggacacctgatccataagattgagccccacttcaacaccagttggatgagttgggacgggtgcgacctggactactactgcaacatgggcgactggccgtcgtgcacgtacaccggcgtcacccagcacaaccacgccgcgttcgtcaatctcctgaacattgagactgactatacgaagaacttccacttccactctaagagggtgaccgcgcacggggacaccccacagctggacctcaaggcccgtcccacctacggagccggggaggtgacggtcctggttgaggtggctgatatggagcttcacaccaagaagatcgagatttccggcctcaagttcgctagcctgtcctgcaccgggtgctacgcctgctcatcggggatcagctgcaaggtccgcattcacgtggatgagcccgacgaattaacggtgcacgtaaagtcagaggaccccgacatcgtggccgccggcagcagtctcatggcccggaagctggagttcggggccgactccacgttcaaggccttctccgctatgccgaagaccagcttatgcttttacatcgttgaacgcgagtactgcaagtcttgctcccgggaggacacccagaagtgcgtcaacaccaagttggagcgaccccagtcaatcctgatcgagcacaagggtacgatcatcggaaagcagaacgacacgtgcaccgccaaggcgagctgctggttggagagtgtgaagtcattcttctatggcctcaagtcaatgctgtccggcatcttcgggaatgtgttcataggcatttttctgttcatcgccccattcgttctcctaatcctgttctttatgttcgggtggcgaatcctattctgtttcaagtgctgccggcgcacccgggggctattcaagtaccgccacctgaaggatgacgaagagaccgggtaccggaaaatcatagagcgcctgaacaacaaaaagggcaagaacaagctcttggacggcgaacgtttggctgaccgcaagatcgccgagctgttcagcaccaagtcccacattgggtaa

SEQ ID NO: 15224 - RNA, 5070 nt, synthetic construct
  misc_feature 1..5070: note = derived and/or modified CDS sequence (opt11) from CCHFV(C-68031)__DQ211629.1__GP
  source 1..5070: mol_type = other RNA
atgagcttctctatcatgtacacgcccctgctctgtgccgtgctgtgtcttcagctttggagcctggagggctcccacgggctgagcaacaaaacccagcattccaacaccagcaccaccaaggccccggaggtcagtcaggagttcggactccccgtgagcaccgtatccacgataaccagcgacccgccctccataaccagcgcggtctccgtgagtggatccgaaggcagcggggacaccaacacgtcccccagcgtgaccacccagggcctgaccctgcccgagacgacacttgagctgctgaccaccacggacaccgacgcctcctccaccgtagtggtggacgtgagcacccagacggtgaaggacacccccatctccaccacccacacgagcctcccctccaccccgagcgccccaaccacgccccagggcacccaccacaccgcccgcgggctactgtccgtgacgagcaccaagcccgagggcgcctccacgcaggcgaacccggagaagatcagcatggagaccaacagcccccggctcgccataagcgagaccccctcgttcagccccaccacgcaggccccgaccgagaactccaaccccatcaccagcaagcagctgatcctgtcggctcagccggtcacccccaacccggtgacccctcccgtgcagcccgccctctcacagtccgacacgagcaccgccatccaggacatccatccctcccccactagccgaagcaagcggaacctggagatggagatcatcctgaccctctcccaggggctgaagaagtactacggcaagatcctgaagctgctggacctgacgctcgaggaggacaccgagggactgctggagtggtgcaagcgcaacctcggcctggtctgcgacgacgatttcttccagaagcggatcgaggagttcttccttaccggtgagggtcacttcaacgaggtgctccagttcaagaccccatctacgctgtctcccaccggaccggcacgcaccgggagtcccaccgtggagccctttaagtcctatttcgccaagggcttcctgtcgatggactccggctacttcagcgccaagtgctacccgcgggcgtccaacagcgggctccagctgatcaacgtcacgcagcactccacacgtatcactgacacccccggcccaaaggtgacgaacctgaagaccatcaactgcatcaatctcaaggccagcgtgttcaaggagcaccgggagatcgagatcaacgtcctgctaccccaagtagccgtgaatctctcctcatgccacgtcctgatcaagtcccacgtctgcgactacagcctggacatagatggcccggtccgcctccctcggattcaccacgaaggcacgttcatacccgggacctacaagctggtgatcgacaagaagaacaagcagaatgatcgctgcacgctgatcaccaactgtgtgatcaagggccgggagatccgcaagggccagtccgtcctacggcagtacaggaccgagatcaaaatcggcaaggccagcagcggctcccggcgcctattaagcgaggagtccggggacgactgtatcagccggacccagctgtcccgcacggaaaccgccgagatccacagcgacaactacggcgggcccggcgacaagatcaccatctgcaacggctccaccatcgtggaccagcggctcgggagcgagctgggctgctacacgatcaaccgcgtgaagtccttcaagctgtgcgagaacagtgcgaccgggaagtcatgcgagatcgacagcaccccgatcaaatgccgccagggcttctgcctcaagatcacccaggaggggcggggccacgtcaagctgagtcgtggcagcgaagtggtgctggatgcctgcgactccagctgcgagatcatgatccccaaggggacaggcgacatcttagtcgactgctccggcggccagcagcacttcctgaaagacaacttgatcgacctcggctgccccaacatccctctgctggggaagatggccatatacatctgccggatgtcaaatcacccgaagaccaccatggccttcctcttctggttctccttcggctatgtgatcacgtgcatcttgtgcaaggtgatcttctacctgctcatcgtcgtggggaccctgggcaagaagttcaagcagtaccgcgagctgaagccccaaacctgcaccatctgcgagactacccccgtgaacgccatcgacgcggaaatgcacgacctcaactgcagctacaacatctgtccctactgcgccagccggctgacgtccgacgggctggcccgccacgtcatgcagtgcccgaagcggaaggagaaggtggaggagaccgagctctacctgaatctggagcgcataccctgggttgtccggaagctcctccaagtgagcgagtccacgggcgtggccctgaagcgcagctcctggctcgtcgtgctgcttgtgctcctgaccgtcagcctgagtccagtgcagagcgcgcccatcggccacgggaagacggttgagacctaccagacccgggagggctacacctccatatgcctcttcgtcctggggagcatcctgttcatcgtctcctgcctcatgaagggcctggtagacagcgtcgggaactccttcttcccgggcctgagcatctgcaagacgtgctccatcggcagcatcaacgggttcgagaccgagtcccacaagtgctactgcagcctcttctgctgcccctactgccgccactgctccgcggaccgggagatccacaagctgcacctgtctatctgcaagaagcgcaagaccggcagcaacgtgatgctcgccgtgtgcaagagaatgtgcttccgcgccaccgtggaggtgtccaacaaggccctgctgatccggaacatcatcaacactaccttcgtggtgtgcatcttgatcctggcggtatgcgtggtcagcacctcggccgtggagatggagtccctgcccgccgggacctgggaacgcgaggaggacctcacgaacttttgccaccaggagtgccaggtgaccgagactgagtgcctgtgcccctacgaggccctggtcctccggaagccgctgttctccgacagcatcgtgaaggggatgaagaacctgcttaattccaccagcctggagacgagtctgagcatcgaggcaccctggggcgcgataaacgtgcaaagtaccttcaagcccaccgtctcagccgccaacatcgccctctcctggagctccgtggagcaccgcgggaacaaaatcctggtaagcggccgctccgagagcatcatgaagctggaggagcggaccgggatctcctgggatctcggcgtcgaggacgctagcgagagcaagttactgacggtgtccataatggacctcagccagatgtattccccggtgttcgagtacctgtcaggggaccgccaggtcgaggagtggcccaaggcgacctgtaccggcgactgccccgagcggtgtgggtgcacctccagtacgtgcctgcacaaggagtggccccactcccgcaattggcggtgcaacccgacctggtgctggggcgtgggcaccgggtgcacgtgctgcggccttgacgtcaaggacttgttcaccgattacatgttcgtgaagtggaaggtggagtacatcaagaccgaggccatcgtctgcgtggagctgacaagccaggagcgccagtgctccctcatcgaggccgggacccgtttcaatcttggccccgtgacgatcaccctgagcgagccccgcaacatccagcagaagctgcccccggagatcgtcaccttacacccccgtattgaggagggcttcttcgacttaatgcacgtgaagaaggtgctctccgcctctaccgtctgcaagctgcagtcatgcacccacggggtgcctggcgacctccaggtgtaccacatcgggaacctgctgaagggcgacaaggtcaacgggcacctgattcacaaaatcgagccccacttcaacacgagctggatgtcttgggacggctgcgacctcgactactactgcaacatgggcgactggccgagctgctcctacaccggggtgacccagcacaaccacgccgcgttcgtgaacatgctgaacattgagaccgactacacgaagatctttcactttcacagcaagcgcgtcactgcccacggcgacacgccccagctggacctcaaggcccggccgacctacggggccggcgagatcaccgtactggtggaggttgctgacatggaactgcataccaagaagatcgagatatccggtctcaagttcgccagcctgacctgcaccggctgctacgcctgcagctccggcatcagctgcaaggtgcgcatccatgtagacgagcccgacgagctgactgtccacgtgaagtcggaggacccggacatcgtggccgcctcatcctccctaatggctcgaaagctggagttcgggaccgactccaccttcaaggccttcagcgcaatgcccaagacctccctgtgcttctacatagtcgagcgcgagtactgcaagagctgctccaaggaggacacgcagaagtgcgtgaacaccaagctcgagcaaccccagagcatcctgatcgagcacaagggcaccattatcgggaagcagaacgacacgtgcacctccaaggccggctgctggctggagtcagtgaagtccttcttctacgggctgaagaacatgctcagcggaatcttcggcaacgtcttcatcgggatcttcctgttcctggccccctttatactcctgatcctcttcttcatgttcggctggcggatcctcttctgcttcaagtgctgccgccggacccgtgggctgttcaagtacagacacttgaaggacgacgaagagaccggctaccgcaagatcatcgaaaggttaaacaacaagaagggtaagaacaaactgctggacggggagcgcctcgccgaccgcaaaatcgccgagctgttctccaccaagacacatatcggctga

SEQ ID NO: 15225 - RNA, 5070 nt, synthetic construct
  misc_feature 1..5070: note = derived and/or modified CDS sequence (opt11) from CCHFV(Baghdad 12)__AJ538197.2__GP
  source 1..5070: mol_type = other RNA
atgcccgtctcaataatgcacatcagcctcatctacgccgtcctctgtcttcaactctatggactgggcgaaactcacggcagcagcagcggtaccgaacacaaccgcacaaacgttgtagccactccaggcggcagtcaatcaccggagccactcgtcagcacaaccttgccggtcaccctagactcttcaacagtaaccccagccacccaggcctcaggtcctgaaggtagcggagaggtatacacctctccgcccaccactaccgaaggtctctccccctccgatgccacatccgaactacccacgacaactggcataggaatatcaagttcaagcgacgtcaattcatcgacacaagcagccggtgatacctcgactcccacagcccgcacttcgctaccagactcaccgtcaacaccacccacgtcccaagatacgcatcaccccatgcgaaacctgctttcagtgacctcgctcaaaccagaagaaacacccgccccctcgaaaagcggcaaagaatcccctgctgcaagttcgcctcatccagtcgcatcacgcccacccactcccagcactacagcccaaggccccaccgagaataactcacgcaacacaactgtccaactaaaatccgttacccaatcagctaccttgggaccaatggcttcccccacgcagaccgtcctattacagtcagtcacaagcatcgcgatccaggatacgcatccgagccccactaatagatcccgccggaacctggaaatggaaatcattctcaccctcccccaggggctaaagaaatactacggcaaagttctccgattactccagctcacacttgaagaagacacagagggcctactagaatggtgtaagcgcaaccttggactagactgcgacgacacattcttccaaaaacgaatcgaagaatttttcataaccggagagggtcacttcaacgaggtcctacagttcaggacccccggaacacttagcaccacagaatcaacccacgccggcagtcccacagtcgaaccctttaaatcatactttgcaaaaggatttctactcattgatagcggttatttcagcgctaagtgctacagccgcacctccaactcaggtctacaactaatcaacgtcactcggcactcaaccaaaatcgccgacacccccgggcccaaaataacaaacctaaagacgatatcttgcataaatctgaaggcatccatcttcaaagaacatagagagatcgaaatcaacgtcctgttgccacaagtcgctgtaaacttgagcaactgccacgtaacgatcaagagccacgtctgcgattactccctaaacatagacggcaccgtcaaattaccacacatacaccacgaaggaatattcattcctggcacttataaaatcgtaatagacaagaaaaataaattaaacgaccgctgtaccctatttactaactgcgtcatcaaaggacgggaagtacgaaaaggtcagtccgtattaagacaatacaaaaccgagataagaatcggtaaagcctcgaccggttcacgccgactactaagcgaagaatcgggagacgattgcatctcccggactcgactactccgcaccgaaacggccgaaatacacggcgactcttacggaggaccaggcgataaaataacaatatgcaacggctcaacaatagtagaccaacgattgggttcagagatgggatgctacacgatcaaccgggtgaaatccttcaaactgtgcgagaactcagcaaccggaaaatcttgcaaaatcgacagcatacccgttaaatgccgccagggttactgtcttaagattacacaagagggccggggccacgttaagttgagccgcgggtccgaagtagtactcgacgcctgcgattcatcctgtgaggtaatgataccaaaagggactggggacatactcgtagactgcagcggtgggcaacaacacttcctgaaagacaacctaattgacctcgggtgtccgaacatcccgctgctggggaaaatggcaatatatatctgcagaatgtccaaccaccccaaaactaccatggccttcctcttctggttcagcttcgggtacgtaattacctgcattctttgcaaagctatattttacctcctaatcatagtcggaacactaggcaagcgcttcaaacagtacagagaattaaagccccaaacatgtactatctgcgaaacgacgccggtcaacgccatcgacgctgaaatgcacgatctcaactgctcgtacaacatctgcccatactgcgcctccagactgacgagcgacggcctcgcgcgccacgtaacccaatgccccaagcgaaaagagaaagtcgaggaaactgaactctacctcaacctcgagcgcatcccgtgggtcgtccgcaaactcctgcaagtgtcagagtcgaccggagtcgcactaaaaagaagctcttggctaatcgtacttctggtactactagccgtatcatccagcccagtacaaagtgctcccataggttacggcaaaaccatagaaacctaccaagctagggaagggtacacatcaatctgcctattcgtcctcggctcaatcctttttatcgtaagttgcctaaccaagggtctagtcgacagcataggcaacatcttcttcccggggctatctatttgcaaaacctgctccatcggctcaataaacggtttcgaggttgagtcacacaaatgctactgcagtctcctatgctgcccatattgccgccactgctccgcggaccgggaaatacaccagctacacctatccatatgcaaaaagagaaaaacaggttcaagcgtcatgttagctgtctgcaaaaggatgtgctttagggccacgatggaagtatcaaacaaagcactactgatacgatccataatcaacactacatttgtagtatgcatacttaccctcgccgtatgcgtcgtatccacaagcgcagtggaaatggaatcactccccgctggcacgtgggaaagagaagaagacctcaccaacttttgccatcaagaatgccaagttaccgaaacagaatgcctctgtccatacgaagcactcgtgctgcgcaaaccactcttcctcgactcgatcgtcaaaggcaccaaaaacctgctcaacagcacatccctcgaaacgtccctctccatagaagctccgtggggcgccatcaacgtacaatcgacctacaaaccaacagtcagcacggcgaacatcgctctatcgtggtcaagcgtcgaacacagggggaacaagatcttggtttcggggcgctcggaaagcattatgaaactagaagaacgcacgggcatctcctgggacctgggggtcgaggacgcctcggagtcaaagctcctcaccgtcagcgtaatggacctatcacagatgtactccccagtgttcgagtacctgagtggtgatcggcaagtcgaagagtggcccaaagccacgtgcacaggtgactgtcctgagcgatgtggatgcacaacctccacatgcctacacaaagaatggccgcattcacgcaactggcgctgcaatccaacatggtgttggggagtaggcacagggtgcacctgttgcggcctcgatgtaaaagacctattcactgactacatgtttgtcaaatggaaagtagaatatataaaaacggacgctatagtttgcgtcgaactaacgagccaagaacgccaatgcagcttaatagaagccggtacccgcttcaacttaggctcggtcaccataacactatccgaacctagaaacatacaacaaaagctcccacccgaaataataaccctgcacccacgaatcgaagagggcttcttcgacctcatgcacgtccaaaaagtattaagcgcatccacagtatgtaaactacaaagttgtacacatggagtgccaggtgacctacaggtctaccacatcggaaaccttctcaagggcgacaaggtaaacggccacctaatacacaagatagagccacactttaacactagctggatgtcgtgggacggatgcgatcttgattactattgcaatatgggcgactggccctcgtgcacctacacgggcgtcacccaacacaatcatgcatcattcgtaaatctcctcaacatcgagaccgattacacgaaatcattccacttccacagcaaacgcgtcacagcccacggggacacgccccagctagacctcaaggtccgacccacctacggagcgggcgaaatcactgttctagtagaagtagccgacatggaactgcacacgaagaaaatagagatatccgggctcaaatttgccagccttacctgcaccgggtgctacgcctgcagtagcgggatctcctgcaaggtgagaatacacgtcgacgaaccagacgaactaacagtacatgttaaatcggatgaccccgacgtcgttgcagcaagcagctctctaatggctcgaaaactagaatttggcaccgactccacattcaaagccttcagtgctatgcccaaaacatcactatgcttctacattgtcgagcgagaatactgcaaatcctgctctaaggaagatacacaaaagtgcgtcaacacaaaacttgagcaaccccaaagtatcctaatcgaacacaaagggacgatcatcggcaaacaaaataacacatgcacggccaaaacatcctgctggctcgaaagtgttaagtccttcttctacggcctcaaaaatatgctttcgggtatattcggcaacttcttcatgggaatcttccttttcctggccccctttatcctcctaatcctcttcttcatgttcggctggagaatactcttctgctttaagtgttgccggagaacccgcggcctcttcaagtaccgccacctcaaagacgacgaagaaacagggtacagacggatcatagagagactgaacaacaagaaaggcaaaaacaaactcctagacggcgaacgactggccgaccgacgcatagcggaactcttctcaacgaaaacacacatcggctaa

SEQ ID NO: 15226 - RNA, 5070 nt, synthetic construct
  misc_feature 1..5070: note = derived and/or modified CDS sequence (opt11) from CCHFV(Hodzha)__AY223476.1__GP
  source 1..5070: mol_type = other RNA
atgcccgtgtccatcatgcacatcctgctcatgtgcgcagtcctgtgcctgcagcagtacggcctcggggagacccaccgcccgaacaacggcaccgagcacaacaagacgaacgtgctgaccacccccggggacaagctgtcccccgagctccccgtgagcacggccctgtccgtcacgccggacagctccaccgtgacccccaccacgcccgtgagcggcctggaggggtccggcgacgtctatacctccccgcccgtgaccaccaagggcctctcccccagcaaggcgacgtccgagctgcccgccagctccgggatcgacaccagctccgccagcgacgtggactccagcacccaggccgcccgggacacctccacgctgaccgtccgcaccagcccgcccagctcccccagcaccccgcccacgtcccaggacacctatcacctcgtgcggaacctgttgagcgtgacctccccctggcccgaggagaccacggcgcccagcaagtccggcaaggagagccccgtagccaactcgccgcatcccgtgaccagccgcccctccagcccgcccatcaccgtacaggggcccacagagaactcgagccacaacacgaccggtcagctcgagtccatggcccagagcaccaccctggtcccaatggcctcccccacgcagaccgtgctgagccagtccgtgacctctctcgccgtccaggacgcccacccgagccctaccaaccggtccaagcgcaatctggagatggtaatcatcctgacgctcccccagggactgaagaagtactacggcaaggtactgcggctcctgcagctgaccctcgaggaggacaccgagggcctgctggagtggtgcaaacgcaacctcgggctggactgcgacgacaccttcttccagaagcggatcgaggagttcttcatcaccggcgagggtcacttcaacgaggtcctgcagttcaagacgccgagcaccctctccaccacagagagcacgcacgccgtgtcccccactgccgagcccttcaagagctactttgccaagggcttcctgtccatcgacagcggctacttttccgcgaagtgctacagcaagacctcaaacagcgggctgcagctcatcaacgtgacccgacacagtacgcggatcgccgacacccccggcccgaaaatcaccaacctgaagactatctcgtgcatcaacctgaaggcctccgtcttcaaggagcaccgcgaggtggagatcaacgtcctcctgccccaggtggccgtgaatctcagcaactgccacgtaacgatcaagtcccacgtgtgcgactacagcctcgacgtggacgggaccgtccggctgccccacatccaccacggcgggaccttcatccccggcacctacaagatcgtgatcgacaagaagaacaagctcaacgacaggtgcacgctctacaccaactgcgtgatcaagggcagggaggtccgcaaggggcagagcatcctgcgccagtacaagaccgaaatccgcatcggcaaggcctccactgggagccggcgcctgctctccgaggagagcggcgacgactgcatctcccggacgcagctgctgcgcaccgagaccgcggagatccacggggacgactacggcggcccgggggacaagatcaccatctgcaacggcagcacgatcgtcgaccagcgcctggggtccgagctcggttgctacaccatcaaccgggtcaagagcttcaagctgtgcaagaactccgccaccggcaagagctgcgagatcgactccactcccgtgaagtgcaggcaggggtactgcctgaaaatcacgcaggagggccgggggcacgtgaagctcagtcgcggctccgaggtagtcctggacgcctgcgacagctcctgcgaggtgatgatccccaaagggaccggcgacatcctggtggactgcagcggcgggcagcagcacttcctcaaggacaacctgatcgacctgggctgcccccggatcccgctcctggggaagatggccatctacatatgccgaatgtccaaccaccccaagaccaccatggccttcctgttctggtttagcttcggctacgtcatcacgtgcatcctctgcaaggcaatattctacctgctgatcatcgtggggaccctcggcaagcggttcaagcagtaccgcgagctgaagccccagacctgcaccatctgcgaaacgacccccgccaacgccatcgacgccgagatgcacgacctgaactgcagttacaacatctgcccgtactgcgcaagccggctcaccagcgacggcctggcgcgccacgtgacccagtgccccaagcggaaggagaaggtcgaggagaccgagctgtacctaaaccttgagcgcatcccctggatcgtgcggaagctgctccaggtgtccgagagcacgggggtcgccctgaagcgctccagctggctgatcgtgcttctggtgctgttcgccgtctccttgagccccgtgcagtccgccccgatcggccacgggaagaccatcgaaacctaccaggcgagagaggactacaccagcatttgcctgttcgtgctgggctccatcctcttcatcgtcagctgcctgatgaaggggctggtggactccatcggcaacatcttcttccccggcctcacgatctgcaagacctgcagcatcgggtccatcaacggcttcgaaatcgagagccacaagtgctactgctccctactgtgctgcccctactgccgccactgcagcgccgaccgggagatccaccagttacacctgtccatctgcaagaagcgcaagaccggaagcaatgtgatgctggccgtctgcaagcggatgtgcttccgcgccaccatggaggtgtccaacaaggccctcctgatccgcagcatcatcaacacgaccttcgtggtctgcatcctgatcctcgcggtgtgcgtggtcagcacctccgccgtggagatggagagtctgcccgccggcacctgggagcgggaggaggaccttacgaacttctgccaccaggagtgccaggtgaccgaaaccgagtgcctctgcccgtacgaggccctggtcctgcgccggcccctcttcctggactccatcgtgaaggggaccaagaacctgctcaacagcacgtccctggagaccagcctgtcaatagaggccccctggggcgcgatcaacgtgcagagcacctacaagccgaccgtctccacggccaacatcgccctcagctggtcgagcgtggagcaccgcggcaacaagatcctggtgtccgggcggagcgagtccatcatgaagctggaggagcgcaccggcatcagctgggacctcggggtcgaggacgcctccgagagcaagctgctgaccgtgtccgtgatggacctcagccagatgtacagccccgtcttcgagtacctgtccggcgaccgccaggtggaggagtggcccaaggcgacctgcacgggggactgccccgagcggtgcggctgcaccagcagcacgtgcctgcacaaggagtggccgcactcccggaactggcgctgcaaccccacctggtgctggggcgtcgggaccggctgtacctgctgcgggctcgacgtcaaggacctgttcaccgactacatgttcgtgaagtggaaggtcgactacatcaagaccgaggccatcgtgtgcgtcgagctgacctcccaggagcggcagtgcagcctcgtcgaggccggcacccgcttcaacctgggccccgtgaccattaccctgtccgagccccggaacatccaacaaaagctcccgcccgagatcatcacgctgcacccccgcatcgaggaggggttcttcgacctgatgcacgtgcagaaggtcctcagcgcctccactgtttgcaagctgcagagctgcacccacggggtgcccggggacctgcaggtctaccacatcggcaacctcctgaagggggacaaggtgaacggccacctgatccacaagatcgagccgcatttcaacacctcctggatgagctgggacggctgcgacctcgactactactgcaacatgggggactggccctcctgcacctacacgggcgtgacccagcacaaccacgccagcttcgtcaacctgctgaacatcgagaccgactataccaagtccttccacttccacagcaagcgggtgacagcgcatggagacacgccccagctcgacctgaaggcccgccccacctacggggccggggagatcaccgtgctggtcgaggtggccgacatggagctccacaccaagaagatcgagatcaccggccttaagttcgcctccctgacttgcaccggctgctacgcgtgcagctccgggatcagctgcaaggtgcggatccacgtcgacgagccggacgagctcacggtgcacgtcaagtcagacgaccccgacgtggtggccgcttccagctccctgatggcccgcaagctggagtttggcaccgacagcaccttcaaggccttctccgcgatgcccaagaccagcctctgcttctacatcgtggagcgggagtactgcaagtcctgctctaaggaggacacgcagaagtgcgtcaacaccaagctggagcagccccagtccatcctgatcgagcgcaaggggaccatcatcggtaagcagaacaacacgtgcaccgccaaggccagctgctggctggagtccgtcaagagcttcttctacgggttgaagaacatgctgtccggcatcttcggcaacgtgttcgtggggatcttcttattcctcgccccgttcatcctgctgatcctcttcttcatgttcggctggcggatcttgttctgcttcaagtgctgccgccgcaccagagggctgttcaagtacaagcacctcaaggacgacgaggagaccggctaccgccggatcatcgagcgcctgaacaataagaagggcaagaacaagctgctcgacggggagcggctggccgaccgccggatcgcggagctgttctcaaccaagacgcacattggctga

SEQ ID NO: 15227 - RNA, 5067 nt, synthetic construct
  misc_feature 1..5067: note = derived and/or modified CDS sequence (opt11) from CCHFV(Kosovo/9553/2001)__AY675511.1__GP
  source 1..5067: mol_type = other RNA
atgcccatcaacatcatgcacaccctgctcgtgtgcttcatcctgtacctgcagctcctgggcctagggggagcccacgggcaaagcaacgccaccgagcacaacggcacgaacaccaccaccgcgccggggacgtcccaaagccccaagccgcccgcctccaccacccccagccatgcccccgagtcctctaccattaagctcacgacccccacctccgagactgagggcagcggggagacgacgcccccgacctccaccacgcaggggagcccgcccctggaaaccacccccgagcgctccactacgaccgccaccagcacctccggaacggacaacatgaacagcacgacccagatgaccgacaacacccccaccctgacggcctccaccagcccctccagctcccccagcacgcccagcaccagccaggggctccactacccggtccggagcctgctctctgtgtcttcccccaagaccgtgaccacgccgacccccatgagcccgggcgagatgtccagcgagacctcaagccagcactccgcgatgagccgcacccccacgccccacaccgccacccaggtctccaccgagaacgccaaccggagcacctcccgccagtctgagtccagcgcccagcccgcgacgcagtccccggttaccagccccgcccagagcatcctcctgatgtccgccacccccaccacaatccagaacatccaccccagtcctaccaaccggtccaagcgcaacctggagatggagatcatcctgaccctgagccaggggctgaagaagtactacggcaagatcctgaagctgctgcacctcaccctggaggaggacacggagggcctccttgagtggtgcaagagaaacctggggtccaactgcgacgacgacttcttccagaagcgcatcgaggagtttttcattaccggcgaggggtacttcaacgaggtgctgcagttcaaaaccctcagcaccccctcccccacagagccgtcgcacgcccgactgcccaccgccgagcccttcaagtcctacttcgcgaagggcttcctgagcatcgactccggctacttcagcgccaagtgctacccccgttcctcaacgtccggtttacagctgatcaacgtcacccagcacccggcccggatcgccgagacgcccggccccaagattacgagcctgaagaccataaactgcatcaacctccgcgcatccgtgttcaaggagcaccgcgaggtggagatcaacgtcctgctgcctcagatcgcggtgaatctcagcaattgccacgtggtcatcaactctcacgtgtgcgactactccctggacaccgacgggccggtgcgcctgccccggatctaccacgagggcacgttcatgcccgggacctataagatcgtcatcgaccgcaagaacaagctcaacgaccgctgcaccctcgtgaccaactgcgtgatcaagggccgcgaggtccggaaggggcagagcgtgctgaggcagtacaagacggagatcaaaatcggtaaggcccccacaggctcccggaaactcctgagcgaggagcctggcgacgactgcatctccagaactcagctgctccgcaccgagacggccgagatccacgacgacaactacggcgggcccggcgacaagatcacgatctgcaacggcagcaccatcgtcgaccagcgactgggttccgagctgggttgctacaccatcaaccgcgtcaagagcttcaagctctgcgagaactccgccacgggtaagacctgcgagatcgacagcaccccagtgaagtgccggcagggcttctgcctgaagatcacccaggaggggcgcggccacgtgaagctgtcccggggctcagaggttgtgctggacgcctgcgacagtagctgcgaggtcatgatccccaaggggaccggcgacatcctcgtggactgctccgggggccagcagcacttcttaaaagacaacctgatcgacctcggctgcccgcacatccccctgctggggaagatggctatctacatcgcccgcatgagcaaccaccctaagacgaccatggccttcctcttctggttctccttaggctatgtcattacctgcatcctttgtaaggccctcttttacagccttatcatcatcgggactcttggcaagaagatcaagcagtaccgggagctcaagccccagacgtgcaccatctgcgagaccgccccggtcaacgcgatcgacgccgaaatgcacgacctgaactgctcctacaacatctgcccttactgcgccagccgccttaccagcgacgggctcgcccggcacgtaaagcagtgccccaagagaaaggaaaaggtggaggagacggagctgtacctcaacctcgagagaatcccctgggtcgtgcgcaagctgctgcaggtatcagagagcaccggcgtcgcgctcaagcggtccagctggctgatcgtgctgcttgtattactgactgtctccctcagcccagtgcagtccgccccggtgggccacgggaagaccatcgagacgtaccagacccgcgagggcttcaccagcatatgcctgttcatgctggggtccatcctcttcatcgttagctgcctggtgaagggcctggtggactccgtcagcgactccttctttcccgggctcagcgtgtgcaagacctgctcgatcggctccataaacggcttcgagatcgagtcccacaagtgctactgcagcctgttctgttgcccgtactgccggcactgctccgctgaccgcgagatccaccagctgcacctcagcatctgcaagaagcggaagacggggagcaacgtgatgctggctgtctgcaagcgcatgtgcttccgggccaccatcgaggcgtcccgccgcgccctgctcatccggagcatcatcaacaccaccttcgtgatctgcatcctgacgctgaccatctgcgtggcttccaccagcgccgtcgagatggagaccctccccgcagcgacgtgggagcgcgaggaggacctgaccaacttctgccaccaggagtgccaggtgcccgagaccgagtgcctgtgcccctacgaggccctcgtgctgcggaagccgctgttcctcgactccatcgtcaagggcatgaagaacctgctcaacagcacctccctcgagacgagcctgtccatcgaggccccctggggcgccatcaatgtgcaaagcacattcaagcccaccgtgtccaccgccaacatcgcgctgagctggtccagcgtcgagcaccgcgggaacaagatcctcgtgacggggcggtccgagagcatcatgaagctggaggagcgcaccggcgtgtcctgggatctgggagtcgaggacgccagcgagtccaaactcctgaccgtgagcatcatggacctgagccagatgtactccccagtattcgagtacctcagcggggaccggcaggttgaggagtggcctaaggcgacctgcacgggcgactgccccgagcgctgtgggtgcacctcgtccacctgtctgcacaaggagtggccccacagccggaactggcgctgcaaccccacctggtgctggggcgtagggaccggctgcacgtgctgcggcgtggacgtaaaggacctgttcaccgaccacatgttcgtgaagtggaaggtggaatacatcaagaccgaggccattgtctgcgtggagctcaccagccaggagcggcagtgctcattgatcgaggccggtacgcgcttcaacctcggccctgtgaccatcaccctcagcgagccccggaacatccagcagaaacttccacccgagatcatcaccctgcacccgaagatcgaggagggcttcttcgaccttatgcacgtacagaaggtgctgtccgccagcacggtgtgcaagctgcaatcctgcacccacggcatccccggggacctccaggtctaccacatcgggaacctgctgaagggcgacagagtgaacggccacctcatccacaagatcgaaccccacttcaacaccagctggatgtcgtgggacggctgcgatctggactactactgcaacatgggggactggcccagctgcacctacacgggcgtgacccagcacaaccatgcagctttcgtcaacctgctcaacatcgagaccgactacaccaagacgttccactttcattccaagcgcgtgaccgcgcacggcgacacaccgcagctggacctgaaggcgcgccccacctacggggcaggcgagatcacggtcctcgtggaggtggccgacatggagctgcacaccaagaaggtcgagatcagcgggctgaagttcgcctccctcgcctgcaccggctgctacgcgtgcagctccggtatcagctgtaaggtgcggatccacgtggacgagcccgacgagctgaccgtccacgtcaagagctccgaccccgacgtggtggccgccagcacttccctgatggcccgcaagctcgagttcgggaccgacagcaccttcaaggccttctccgcgatgcctaagaccagcctatgcttctacatcgtggagaaagagtactgcaagtcctgcagcgaggacgacacgaagaagtgcgtggacaccaagctggagcagccccagtccatcctcatcgagcaccgtggcacgatcatcgggaagcccaacgacacctgtcctgctaagacgagctgctggctggagtccgtcaagagcttcttctacggtcttaagaatatgctcgggtccgtgttcggcaacttcttcatcgggatcctgttgttcctggcaccgttcttcttatggatgttgagcttcatgttcggctggaagatcctgttctgcttcaaatgttgccgccggacccgcggcctgttcaagtaccgccacctgaaggacgacgaggagaccgggtaccggagaatcatcgagcggctgaacaacaagaagggtaagaaccgtctcctggacggggagcggctggcagaccgcaagatcgcggaactcttctccaccaagacgcacatcggttga

SEQ ID NO: 15228 - RNA, 5067 nt, synthetic construct
  misc_feature 1..5067: note = derived and/or modified CDS sequence (opt11) from CCHFV(200406546-Turkey)__KR864902.1__GP
  source 1..5067: mol_type = other RNA
atgcccaccaacatcacccacaccctactggtgtgcttcatcctgtacctgcagcttctgggtcgcgggggcgcacacgggcagagcaatgccaccgagcacaacggcacgaacaccaccaccgcgcccgggaccagccagtcgcataagcccctggtgagcaccaccccgccccacacgctcgagtcaagcaccatcaaacacaccacccccaccagcgagactgagggcagcggcgagaccaccccgccgcctaataccacccaggggccctccccgcccgaggctacccccgagcggcccgccaccaccgcaacctccaccccctcgacggacaacacgaactccaccacccagatgaacgataacaatcccacgagcaccatatccacgagcccctccagctcccccagcacgccgcccacgccgcagggcatccaccaccccgcacgctccctgcttagcgtgagctctctcaagaccgcgacgacccccacgcccaccagtcccggggagatttccagcgagacatccagccagcactccgcgatgagccggaccccgaccctgcacacaaccacccaggtgtctactgagagcacgaaccactcaacaccccgccagtcagagtccagcgcccagcccactaccccctctcccatgacgagccctgcccagtcgatcctgcccatgagcgcggccccgaccgccatccagaatatccacccatcccccaccaaccggtcgaagcgcaacctcgaggttgagatcatcctcaccctgagccagggcttaaagaagtactatgggaagattctgaaactgctacacctgaccctggaggaggacaccgagggcctactggagtggtgcaagcggaacctgggctccagctgcgacgacgacttctttcagaagcgcattgaggagttcttcgtaacaggagagggctactttaatgaggttctccaattcaaaactctgtccacgcttagccccaccgaaccgtcccacgccaagctccccaccgtcgagccattcaagagctacttcgccaagggattcctgtccatcgacagtggctacttctccgcgaaatgttatccccggagctccaccagcggcctgcagctcatcaacgtgacgcaacatccggcccgcatcgccgagacccccgggcccaagacaacctccctgaagacgatcaactgcatcaacctgcgggccagcgtgtttaaggagcatcgcgagattgagatcaacgtcctactgcctcagatcgccgtgaacctgtccaactgccacgcggtgatcaagtcgcacgtctgcgactattcactcgacaccgacggcccagtgcggctgccccacatctatcacgaggggaccttcatccctggcacctacaagatcgtgatagacaagaagaacaaactgaacgaccgctgcatccttgtcacgaactgcgtgatcaaagggcgggaggtgcgcaagggccagtctgtactgcggcagtacaaaacagagatcaagataggcaaggccagcaccgggtcccgcaagctgctcagcgaggagcctggcgacgactgcatctcccggacccagttgctgcgcacagagaccgccgagatccacgacgacaactatgggggcccgggagacaagattaccatctgcaacggcagcacgatcgtggatcagcggctcggctccgagctggggtgctacacgatcaaccgcgtcaagagcttcaagctgtgcgagaactccgctaccgggaagacatgcgagatcgacagcacccccgtcaagtgccgccagggtttctgcctcaaaatcacccaggaaggccggggacacgtaaagctgtccaggggcagcgaagtggtcctggacgtgtgcgacagtagctgcgaggtcatgatcccaaaggggacgggtgacatcctggtggactgctcaggcgggcaacagcactttctcaaggataacctgatcgacttggggtgcccccacgtgccgctcctgggccggatggccatctacatatgccgcatgtcgaaccacccccggaccaccatggcgttccttttctggttctccttcggttacgtcatcacgtgtatcttctgcaaggcccttttctacagcctgatcatcatcggcacgctcgggaagaaattcaagcaataccgcgagctcaaaccccagacctgcaccatatgcgagactgccccagtgaacgcaatcgacgccgagatgcacgacctgaactgctcctacaacatctgcccgtattgcgcgagccggctgacgtccgacggcctcgcacgccacgtgccccagtgccccaagcggaaggagaaggtcgaggagaccgagctgtacctgaacctcgaacgcataccgtggatcgtgcggaagctgctccaagtgagcgaatcgaccggggtcgcacttaagcgcagtagctggctgatcgtgctgctcgtactcctgaccgtctccctcagtcccgtgcaatccgctcccgtgggccacggcaagaccatcgagacctaccagacccgggaggggttcacgagcatctgcctgttcatgctgggctccattctcttcattgtcagctgcctggtgaaggggctggtggactcagtctctgactcctttttccccggcctcagcgtttgcaagacatgttcgatagggagcatcaacggcttcgagatcgagtcccacaagtgctactgttctctgttctgctgcccgtactgccgccactgctccgcagaccgtgagatccaccagctgcacctcagcatctgcaagaaacgcaaaacggggtcaaacgtaatgctggcagtctgcaaacggatgtgcttccgcgccaccatcgaagctagccggcgcgccctgctcatccggagcataataaacaccacgttcgtgatctgcatcctgaccctgaccatctgtgtggtctccaccagcgcggtggagatggagaacctcccagcagggacgtgggagcgggaggaagacctgaccaacttctgccaccaggagtgccaggtgacggagaccgagtgcctgtgcccatacgaggcgctcgtgctgcgcaagcccctgttcctcgactccatcgtgaagggcatgaagaacctgctgaacagcacctccctcgaaaccagcctgtccatcgaggccccgtggggcgccatcaatgtgcagagtactttcaagcccaccgtctccacggcgaatatcgctctgagctggtccagtatcgagcaccggggcaacaagatcctcgtgaccgggaggtccgagagcatcatgaagctggaggagcggaccggcgtgtcctgggaccttggcgtggaggacgctagcgaatccaagctcctgaccgtgagcatcatggacctgtcccaaatgtatagccccgtgttcgagtacctcagcggggaccgccaagtcgaggagtggcccaaggccacgtgcaccggcgactgcccggaacggtgcgggtgtacctcctccacgtgcctgcacaaggagtggccccactcccgcaattggcggtgcaaccccacctggtgttggggagtggggaccggctgcacgtgctgcggcgtggacgtcaaggacctgttcactgaccacatgttcgtgaagtggaaggtggagtacatcaagaccgaggccatcgtgtgcgtggaactcacgagccaggagcgccagtgctctctgatcgaggcggggacccggttcaacctgggtcccgtgactatcaccctcagcgagccgcgcaacatccagcagaagctgccgcccgagatcatcacgctgcaccccaaggtcgaggaggggttcttcgacctcatgcacgtgcagaaggtgctgtctgccagcaccgtctgcaagctgcagtcttgcacccacgggatcccgggcgacctccaggtgtaccatatcgggaacctcctgaagggggaccgggtgaacgggcacctcatccacaagatagagccccatttcaacaccagctggatgtcctgggacggctgtgatctagactactactgcaacatgggagactggccatcgtgcacgtacaccggcgtcacccagcacaatcacgccgcgttcgtgaacctactcaacatcgagacagactacacgaagactttccatttccactccaagcgtgtcaccgcgcacggcgacacgccccagctggacctgaaggcccggccgacttacggggccggcgaaatcaccgtgctcgtagaggtcgcagacatggagctgcacaccaagaaggtggagatcagcgggctgaagttcgccagtctcgcgtgcaccggctgttacgcctgcagctccgggatcagctgcaaggtgcgcatccacgtcgacgagccagacgagttgacggtacacgtgaagtccagcgatcccgacgtcgtggccgcctcaacctccctgacagcccggaagctcgagttcggtaccgactcaacgttcaaggcgttctccgccatgcccaagaccagcctgtgcttctacatcgtggagaaggagtactgcaagtcctgcaacgaagacgacacacaaaagtgcgtggacaccaagctggagcagccgcagagcatccttattgaacacaagggcacgatcatcggaaagcagaacgacacgtgcactgccaaggcctcctgctggttggaaagcgtgaagtccttcttctacggcttgaagaacatgctcgggagcgtgttcggcaacttctttatcgggattctgttatttctcgcccccttcgtgctgcttgttctattcttcatgttcggctggaagatcctcttctgcttcaagtgctgcaggcggacccgcggcctgtttaagtaccggcacctgaaggacgatgaggagacggggtacaagcgcataatcgagcgcctcaacaacaagaagggcaagaaccggctgctggacggggagcgcctcgcggaccggaaaatcgccgaactcttcagtaccaaaacccacataggctaa

SEQ ID NO: 15229 - RNA, 5067 nt, synthetic construct
  misc_feature 1..5067: note = derived and/or modified CDS sequence (opt11) from CCHFV(Haskovo-V46/13)__KR092379.1__GP
  source 1..5067: mol_type = other RNA
atgcccaccaacatcatgcacaccctgctcgtgtgcttcatcctctacctccagctcctgggcctcgggggcgcccacgggcagagcaacacgaccgagcacaacggcaccaacaacaccacggccccggggacctcccagagccccaagccccacatgtccaccacgcccccgcacgcgcccgagagctccaccatcaagccgaccacccccaccagcgagacggagggctccggcgagaccaccccgcccagcaacaccacgcagggcccctccccgcccgagaccaccagcgagcgccccgccaccacggccatctcaaccagctccaccgacaacatgaaccccaccagccagatgaccgacaacacccccacctccaccgtcagcatctccccgagctccagccccagcacgccctccacgccgcagggcatgcaccacccggcccggagcctgctgtccgtgagctcccccaaaaccgccaccacccccacccccaccagcccggtggaggtcgggtccgagaccagctcccagcacagcgcgatgtccagcacgcccactccccacaccgccacccaggtgtccaccgagaacaccaaccacagcacgccccgccagtccgagccgagcgcccagcaaaccaccccctcccccatgccgagccccgcgcagtcgaccctgctcatgagcgcggcacccaccgccgtgcagaatacccaccccagcccgaccaaccggtccaagcgcaacctggagatggagatcatcctgacgctcagccagggcctgaagaagtactacgggaagattctgaagctcctgcatctgaccctcgaggaggataccgagggcctgctggagtggtgtaagcggaacctcggctccaactgcgacgacgacttcttccagaagcgcatcgaggagttcttcatgaccggggagggctacttcaacgaggtcctgcagttcaagaccctgagtaccctctcccccatggagcccagccacgccgagctgcccaccgccgaacctttcaagtcctacttcgcgaaggggtttctgagcatcgactccggctacttcagcgccaaatgctacccccggtccagcacctccggcctccagctgatcaacgtgacgcagcaccccgcccgcatcgccgagacccccgggccgaagaccaccagcctgaaggccatcaactgcatcaacctccgggcgtccgtgttcaaggagcaccgcgagatcgagatcaacgtcctgctgccccagatcgccgtgaacctcagcaactgtcacgtggtaatcaactcccacgtgtgcgactacagcctggacacggacggccccgtgcggctgccccacatctaccacgaggggaccttcatcccgggcacctacaagatcgtcatcgacaagaagaacaagctcaacgaccgctgcaccctggtgacgaactgcgttatcaaggggcgggaggtccgcaagggccagagcgtgctgcggcagtacaagaccgagatcaagatcggcaaggcctccaccggcagccgcaagctcctgtccgaggagttaggcgatgactgcatcagccggactcagctcctgcgcacggagaccgccgagatccatgacgacaactacgggggccccggggataagatcaccatatgcaacggctccaccattgtggaccagcggctgggcagtgagctcgggtgttacacgatcaaccgcggcaagtccttcaagctgtgcgagaacagcgccactgggaagacctgcgagatcgactccacccccgtaaagtgccggcagggcttctgcctgaagatcacgcaggagggtcgcggccacgtgaaactaagccgcggctccgaggtggtcctggacgcgtgcgacagctcctgcgaggtgatgatccccaaggggaccggcgacatcctggtcgactgcagcgggggccagcaacacttcctgaaggacaacctcatcgacctgggctgcccgcatatccccctgctcgggaagatggccatctacatctgccggatgagcaaccacccccgcaccaccatggccttcctgttctggttcagcttcggctacgtgatcacgtgcatcttctgcaaggccctgttctactccctcatcatcatcgggactctcggcaaaaagatcaagcagtaccgggagctgaagccccagacctgcaccatctgcgagaccacgccggtaaacgctatcgacgcggagatgcacgacctcaactgcagctacaacatctgtccctactgcgcctcccgcctgaccagtgacgggctggcccggcacgtcacccagtgccccaagcgcaaggagaaggtggaggagaccgagctctacctgaacctggagcggatcccgtggatcgtgcgcaagttactgcaggtcagcgaatccacgggtgtggccctgaagcggagctcctggttgatcgtgctgctggtcctcctgcccgtgagcctgtcccccgtgcagagcgcacccgtcggccacgggaagaccatcgagacctaccagacccgcgagggcttcacgtccatctgcctcttcatgctggggagcatcctgttcatcgtgtcctgcctcgtgaagggccttgtcgactctgtgggggacagtttcttcccgggcctgagcgtgtgcaagacctgctccatcggcagcatcaacgggttcgagatcgagtcccacaagtgctactgctctctcttctgctgcccctactgccggcactgttccgcagaccgcgaaatccaccagctgcacctgagcatttgcaagaagcggaagaccggctccaacgttatgctcgccgtgtgcaagcgcatgtgcttccgggccaccatcgaggccagccgccgggcgctgctgatccgcagcatcataaacacgaccttcgccatgtgcatcctcaccctgaccatatgcgtggtcagtacgagcgccgttgaaatggagaacctgcctgccgggacctgggagcgggaggaggacctcactaacttctgccaccaggagtgccaggtgaccgagacggagtgcctgtgcccctacgaggccctggtcctccgcaagccgctgttcctggactccatcgtgaagggcatgaagaacctcctgaacagcacctccctggagaccagcctcagtatcgaggcgccctggggcgccatcaacgttcagagcacctttaagcccacggtctccaccgccaacatcgccctgagctggtccagcgtggaacaccgcgggaacaagatcctggtgaccggccggtccgagagcatcatgaagctcgaggagcgcaccggggtctcctgggacctgggcgtggaggacgctagcgagtccaagctgctcacggtgagcatcatggacttatcccagatgtacagccccgtcttcgagtacctgagcggggaccgccaggtggaggagtggccgaaggcgacctgcaccggcgactgccccgagcggtgcgggtgcacctccagcacgtgcctccacaaggaatggccccactcccggaactggcgttgcaaccccacctggtgttggggcgtgggcaccgggtgcacgtgctgcggcgtagacgtgaaggacctgttcaccgaccacatgttcgtgaagtggaaagtcgagtacatcaagaccgaggccatcgtgtgcgtggagctgaccagccaggagcggcagtgctccctcatcgaggccgggacccgcttcaacctgggcccggtcaccatcacgctgagcgagcctcggaacatccagcagaagctcccgcccgagatcatcaccctacaccccaagatcgaggaaggcttcttcgacctgatgcacgtgcagaaggtgctctccgccagcacggtctgcaagctgcagtcctgtacccacgggatccccggcgacctccaggtgtaccacatcgggaacctgctgaagggcgaccgcgtgaacgggcacctgatccacaagatcgagccccacttcaacacgagctggatgtcctgggacggctgcgacctcgactactactgcaacatgggcgactggcccagctgcacctacaccggggtcactcagcacaaccacgcggccttcgtgaacctgctgaacatcgaaacggactacaccaagaccttccactttcacagcaagcgggtgaccgcccacggcgacacgccgcagctcgacctgaaggcccgccccacctacggggccggcgagatcaccgtccttgtggaggtcgcggacatggagctccacaccaagaaggtggagatcagcgggctgaagttcgcctccctgacgtgcaccggctgctacgcctgcagctccggcatcagctgtaaggtgcggatccacgtcgacgagccggacgagctcaccgtgcacgtgaaatccagcgaccccgacgtcgtggccgccgggaccagcctgatggcgcgcaagctggagttcggcacggactccacctttaaggccttcagcgccatgccgaagacctccctctgcttctacatcgtggagcgggagtactgcaagtcctgctccgaggacgacacccagaagtgcgtcgacacgaagctggagcagccccagagcatcctgatcgagcacaaggggaccatcatcggcaagcagaacgacacgtgcaccgcccgcgcctcctgctggctcgagagcgtgaagtccttcttctacgggctgaagaacatgctgggcagcgtgttcggcaacttcctcatcgggattctgctgttcctcgcgcccttcgtcctgctggtgctgttcttcatgttcggctggaagatcctattctgcttcaagtgctgccggcgcacccgcgggctgttcaagtaccgccacctgaaggacgacgaagagaccggctaccggcgcatcatcgagcgcctcaactccaagaaaggcaagaaccggttactggatggggagcgactcgccgaccggaagatcgccgagctgttcagcaccaagacccacatcggctga

SEQ ID NO: 15230 - RNA, 5067 nt, synthetic construct
  misc_feature 1..5067: note = derived and/or modified CDS sequence (opt11) from CCHFV(VLG/TI29414)__AY179961.1__GP
  source 1..5067: mol_type = other RNA
atgcccaccaacataatgcacaccctgctcgtgtgtttcatcctgtacctgcagcttctgggactcgggggcgcccacatacagagcaatgccacggaacacaacgggaccaacaccaccacggcgccgtccaccagccagtcacccaagcccttggtcagcaccgcgcccccgcacgcgctggaatcctcgacgatcaagcccacgacccccgtatccgagacagagggctctggaggcaccacgcccccgcccaataccacccagggcccctcgccgcccgaggccacacccgagcgccccgccacgaccgccaccagcaccccctccaccgacaacaccaactcaaccacccatgtgacggacaacaatcccacctccaccatcagcacctcccccagttcaagcccctccacgcccagcaccccgcaggggatccaccatcccgcccggaacctgctcagcgtctccagccccaagaccgccaccactcccaccccgacctcccccggcgacatcagctccgagaccagctccctgcacagcgctatgtcccgcacgagcaccctgtacactgcgacccaggtgagcaccgagaatgccaaccacagcgcgccccggcagtctgagagctccgcccagcagaccaccacatcccccatgacctccccggcccagcccatcctcgtgatgagcgccgcccccacggccattcagaacatccacccatcccccacaaaccgcagcaagcggaacctggagatggagatcatcctgaccctcagccaggggctgaagaagtactacggcaaaatcctgaagctgctgcaccttaccctcgaagaggacactgaggggctgctggagtggtgcaagcgttccctcggaagtaactgcgacgacgacttcttccagaagcggatcgaggagttcttcatgaccggcgaggggtacttcaacgaggtcctgcagttcaagaccctgtccaccctcagccccacggagccctcccatgcccgcccacccaccgtggagcctttcaagtcttacttcgcaaagggctttctgtctatcgacagcgggtacttctccgcgaagtgctacccccggctgagcacctccgggctccagctgatcaatgtaacccaacacccggcccgcattgccgagacgcccggccccaagaccaccagcctcaagactatcaactgcatcaacctccgggccagtgtattcaaagaacatcgcgagatcgagataaacgtgctgcttccccagattgccgtgaacctctccaattgccacgtcgtgatcaactcccacgtgtgcgactatagcctggacactgacgggccggtccggctgccccacatctaccacgagggcaccttcatcccagggacctacaagatcgtgatagacaagaagaacaagctcaatgaccgctgcaccttagtgacgaactgcgtcatcaaggggcgggaggtgagaaaggggcagagcgtgctgcggcaatacaagaccgagatcaagatcggcaaagcgtctaccggcagccgcaaactcctttccgaggagcccggagacgactgcatctcccggacccagctgctccgcgccgagccggccgagattcatgacgacaactacggcggaccaggcgacaagatcacgatctgcaacgggagtaccatcgtcgaccaacggctgggcagcgagttgggctgctacaccatcaaccgcgtcaagagcttcaaactttgtgagaacagcgccaccgggaagacctgtgagatagactccacccctgtgaagtgtcgccagggcttttgcttgaagatcacccaggaggggcggggccacgtgaagctgagccgcggatccgaggtggtactggacgcctgcgactcttcctgcgaggtgatgatccccaagggcaccggcgacatcctcgtggactgcagcggaggccagcagcacttcttaaaggacaaccttatcgacttggggtgcccgcacatccccctgctgggcaagatggcgatctacatctgccggatgtccaaccacccccgaacgaccatggccttcctcttctggttctccttcggctacgtcatcacgtgcatcttctgtaaggccctgttttactccctgatcatcatagggactctcggcaagaagatcaaacagtacagggaactgaagccccaaacctgtaccatctgcgagaccgccccggtgaacgcgatcgacgcagagatgcacgacctaaactgcagctacaacatctgcccctactgcgcctctcgcctcaccagcgacgggctggcccggcacgtgcctcagtgcccgaagaggaaggagaaggtcgaggagaccgagctgtatctaaaccttgagcggatcccctggaatgtacgcaagctgctccaggtgtcggagagcacgggggtcgccctgaagcgtagctcctggctgatcgttctcctggtcctgttaaccgttagcctgtcccccgtgcaaagcgcgcccgtagggcatggcaagaccatcgagacctaccagacgcgcgagggcttcacctccatctgcctgttcatgctcgggagcatcctgttcctggtctcctgccttgtgaagggactggtggacagcgtctcggacagcttcttccccgggctgtccgtctgcaagacctgcagcatcggctccatcaacgggttcgagattgagtcgcacaagtgctactgctccctcttctgctgcccgtactgccggcactgcagcgccgaccgcgagatccatcagctgcacctgtccatctgcaagaaacggaaaatgggcagcaatgtgatgctcgccgtctgcaaacgcatgtgctttcgggccaccatcgaggccagtcgccgagcgctgctgatccgcagcatcatcaacacaaccttcgtgatctgcatcctcaccctgaccatctgcgtggtcagcacgtccgcggtggagatggagaacctgccgagcggcacctgggagcgtgaagaggacctcaccaatttttgccaccaggaatgccaggtgaccgagactgagtgtctgtgtccctacgaggccctggttctccggaaaccgctattcctggactcaatcgtgaaggggatgaagaacttactgaacagtaccaaccttgagacctccctcagcatcgaggccccctggggcgccatcaatgtgcagtccaccttcaaacccaccgtcagtaccgcgaacatcgctctgtcctggtcctccgtggaacaccgcgggaacaagatcctggtgaccggccgaagcgagtcaattatgaaacttgaggaacgcaccggggtcagctgggatctgggcgtggaggacgcctcagagagcaagctgctcacggtgtccatcatggacctcagccagatgtactcccccgtcttcgagtacctgagcggcgaccgccaggtggaggagtggccgaaggcgacctgcaccggggactgccccgagcggtgtggctgcaccagctccacgtgcctgcacaaggagtggccccatagtcgtaactggcgctgcaaccccacctggtgctgggaagtggggaccggatgcacgtgctgtgggtggaacgtcaaggacctgttcaccgaccacatgtttgtaaagtggaaggtggagtacatcaagaccgaggccatcgtctgcgtggagttaacatcccaggagcggcagtgcagcctcatcgaggccggcacccgcttcaacctgggccctgttaccatcacgctatccgagcccaggaatatccagcagaagctcccgcccgaaatcatcaccctgcatcccaaagtcgaggagggatttttcgacctgatgcacgtgcagaaggtgttatctgcctccaccgtctgcaaactgcagtcttgcacccacggcatccccggagaccttcaagtgtaccacatcggaaacctcctgaagggcgaccgcgtgaacgggcacttgatccacaagatcgagccccacttcaacacatcctggatgagctgggacgggtgcgacctagactactactgcaacatgggggactggccctcctgcacgtacaccggcatgacacagcataatcacgccgcattcgtcaatctgcttaacatcgagacggactacaccaagaccttccacttccacagcaaacgggtgactgcgcacggggatacgccgcagctagacctgaaggcccgacccacctacggcgccggcgagataaccgtcctcgtggaagtggccgacatggaactccacaccaagaaggttgagatttccgggctgaagttcgccagcctggcttgcacgggctgctacgcctgctccagcgggatctcctgcaaagtgcggatccacgtggacgagcccgatgaactcactgtgcacgtcaagagcaacgaccccgacgtgatcgccgcttccaccagcctgatggcaagaaagctggagttcggcaccgacagcacgtttaaagcgttctccgccatgccgaaaaccagcctctgcttttacattgccgaacgggaatactgcaagtcctgtagcgaggaggacacccagaagtgcgtggacaccaaacttgagcagccccagtcgatattaatcgagcacaaggggacgatcatcggcaagcaaaacgacacgtgcaccgccaaggcgagctgctggctcgagtccgtcaagagctttttctacggactgaaaaatatgctggggtccgtgttcggcaatttcttcatcggaatcctcctgtttctggcaccctttgtgctgctcgtgctgttcttcatgttcggctggaagatcctgttctgcttcaagtgctgccgccggacgcgcgggctcctgaagtaccggctgttgaaggacgacgaggaaaccggctaccgccgcataatagagcggctgaacaacaagaagggcaagaaccgcctgctcgatggggagcggctggccgaccgcaagatcgcagagctgttcagcaccaaaacccacatcggctag

SEQ ID NO: 15231 - RNA, 5067 nt, synthetic construct
  misc_feature 1..5067: note = derived and/or modified CDS sequence (opt11) from CCHFV(UCCR4405)__KY484029.1__GP
  source 1..5067: mol_type = other RNA
atgcccatcaatatcatgcacgcacttctcgtgtgcttcattctttacctccaactcagcggcctcggcggagctcaccggcagtccaacgcaacagagcacaatggcaccaacaccactacggccccgggaacctcccaatcccctaaaccgcccgtctcaacaactctaccccacacgcccgaggcaagcacaatcaaactaaccacccccacctcagaaactgagggatcgggcgaaacaacccctccgcccaacaccacacaagggttgccactacccggcaccacccctgaaagatcggctaccactgcaacctccacgtcctccactgacgacatgaacagtaccacccaaatgaccgacaatacccccaccagcaccgtctcaattggactgtcgtcgtccccctcaatgccgtccacatcgcagggcatccactatccagtccgaagcctactcagcgttagctccccaaaaaccgcgacaacccccacccctatgtcccccggcgaagtctcgcccgagacatccagccagcactcagcaatgtcacgaatcccaacgctttacaccgctacacaagtgtcgaccgaaaacaccaaccgttcaatcccccgccagtcagagagctccgtccaaccggccacccagagcccgatcacctctcccgcacaaaccatactcttaatgagcgcagcccccactgctatccaagatatgcaccccagccccaaaaaccgctcaaaaagaaacctcgaggtcgaaataatcctaacattgtcccaaggattgaagaaatactatggcaaaattctcaagctcctccacctcaccttagaggaagataccgaaggactcctagaatggtgcaaacgcaacctagggagcaactgcgacgacgacttcttccaaaaacgcatcgaggagttctttattaccggcgaagggtacttcaacgaagtgctgcagttcaaaacaccctctacactgagcccaaccgaaccttcacatgtacgcctcccaaccgccgaacccttcaaatcctacttcgccaaggggttcctatctatcgactctgggtatttctccgcgaagtgttacccgcgctcctccacctcaggcctccaactcataaacgtcacccaacaccccgcccgcatcgctgaaaccccaggcccaaaaaccacctccctgaaaactattaactgcataaatctacgcgcatccgtcttcaaagaacacagggaagtagaaattaacgttctcctaccgcaaatagccgtaaaccttagcaactgccacgtagtaataaattcacacgtgtgcgattacagtctcgacaccgacggacccgtccgcttacccagaatacaccacgagggagctttcatacccgggacctacaagatcgttatcgataagaaaaacaaactcaacgatcgctgctccctcgttacaaattgcgtcatcaaaggacgcgaggtaagaaagggacaatcagtcttacggcagtataagaccgagataaaaatagggaaggcctcaacaggtagccggaaacttctatccgaggaaccgggcgacgactgtatctcgagaacccaactcctaaagactgaaaccgcggaaatccacgacgacaactatggaggccccggcgacaaaatcacaatttgcaacggatctaccatcgtagaccaacgcctcggaagcgagctaggatgttacactataaaccgagtcaagtcctttaaactttgcgaaaactcagcaactggcaaaacatgtgaaatcgattccacccccgtaaagtgccgacaaggattttgcctaaaaataacacaagagggacgcggccacgtcaaactatcacgtggctccgaggtcgtcctagacgcctgcgattcatcctgcgaagtcatgatcccaaaaggcacaggcgacattctagttgactgcagcggcggtcaacaacacttcctaaaggacaacctcatagacctcggctgcccccacatccccctcctaggcaaaatggcaatatacatatgccgcatgagtaaccacccaagaaccaccatggcatttctcttctggttcagtttcggctatgtcattacttgcatattttgcaaagctctcttctatagcctgataatcattggcacactcgggaagaaaataaaacaatatcgagaattaaaacctcaaacgtgtactatttgcgaaacggcacccgtaaacgccatagacgccgaaatgcacgacctgaaatgctcatacaacatctgtccctattgcgcaagccgcctcacttcagatgggttagcccgccacgtaacccagtgccctaaaaggaaagaaaaagtagaggaaacagaactctacctcaacttagaacgtatcccgtggatcgtcaggaaactcctgcaagtcagcgagtcgaccggtgtagcactcaagagaagcagctggcttatcgtacttctcgtactccttaccgtaagcctctcacccgtacagtcggcaccggtcggccacggcaaaacaattgaaacataccaaactcgtgaaggcttcacctcaatctgcctcttcatgctcgggagcatccttttcatagtttcttgcttggtcaaaggcctcgtggattccgtctccgattctttcttccccggcttaagcgtctgcaaaacttgttctatcggttctatcaacgggttcgagatcgaatcacacaagtgctactgttcccttttctgctgtccctactgtcgccactactcggccgacagagaaatccaccagctccacctctcaatctgcaagaaacgcaaaacgggaagcaacgtgatgctggccgtctgcaaacgcatgtgttttaaggccaccattgaggcgtcgcgccgcgcactcctcatcagaagcataataaacactactttcgtcatctgcatactcatactcgcaatctgcgtcgtctccacgtccgctgtcgagatggagaacctcccagccggtacatgggaaagagaagaagacctcacgaacttctgccaccaggaatgtcaagttacagaaaccgagtgcctctgcccctatgaagccctagttctacgcaagcccctcttcttagacagcacagtaaagggcatgaagaacctcctaaactctacttccctcgagacttccctaagcatagaggcaccttggggtgccataaatgtccaatccactttcaaacccacagtctcaacggccaacatagcactgtcgtggtcatccgtagaacatcgcggcaacaaaattctagtcaccgggaggtccgagagcatcatgaagctcgaagaaagaaccggcgttagttgggacctcggcgtcgaggacgcctcagaatcaaaactcctcacagtctcgataatggatctctcccaaatgtactcccccgtcttcgagtatctgtccggggaccgacaagtcgaagaatggcccaaagccacatgcactggcgactgtcccgaacgctgtggatgcactagctccacatgcctccacaaggagtggccccattcacgtaactggcggtgcaacccgacctggtgctggggcgttggcacaggttgtacctgctgcggcgtcgacgtaaaagaccttttcactgaccacatgttcgtaaaatggaaggttgaatatattaaaacggaggcaattgtttgcgtggaactcacttcacaagaacgtcagtgtagcctgatcgaagccggtacacgtttcaacttaggaccagtaaccataacccttagcgagccacgtaacattcagcaaaaactacctcccgaaatcataactctgcaccccaaaatagaagagggctttttcgacctcatgcacgttcaaaaggtcctctcggcctctacagtctgcaagttacaaagttgtacccacggtatcccgggggacctccaaatataccacataggcaatcttcttaagggcgaccgcgtcaacggccacctaatccacaaaatagaaccccatttcaacacctcctggatgtcatgggatggctgcgacctagactactactgcaacatgggcaactggccatcgtgcacctacacgggcgtaacgcaacacaaccacgcggccttcgtcaacttattaaatatcgaaacggactatactaagacctttcacttccacagcaaaagagtaacggcacacggcgacaccccacaactagacttaaaagcccggcccacctacggcgcgggcgagataaccgttctcgttgaagtcgccgatatggaactacacaccaagaaagttgagatatccggcctgaaattcgcgtccctcgtttgcacaggctgctacgcctgcagctcgggaatcagctgcaaagtcagaatccacgtcgatgagccagacgagctaactgtgcacgttaaaagcagcgaccctgacgttgtcgccgcctcaacctccctaatggcacgaaaacttgaatttggcactgactcgatattcaaagcattctcggccatgcctaaaacctccctctgtttctacattgttgaacgcgaatactgcaaatcctgttccgaagatgacaccaaaaagtgcgttgacacaaaactagaacaaccccagtcgatcctcatcgagcacaaagggacaataataggaaaacaaaacgatacctgcaccgcaaaagcaagctgctggctagaaagcgtcaaatccttcttttacggactcaaaaacatgttaggaagcgtcttcggaaactttttcgtcggcatcctactgtttcttgcaccattcgtgcttctagtcctattcttcatgttcggctggaaaatcctcttctgctttaagtgctgccgtcgcacccgcggcttattcaaataccgccatctcaaagacgacgaagaaactggctaccgacgcataatagaacggttaaatagcaagaaaggtaaaaaccgtcttcttgacggcgaacgcctcgccgaccgcaaaatagcagaactcttttctacaaaaactcacataggctag

SEQ ID NO: 15232 - RNA, 5067 nt, synthetic construct
  misc_feature 1..5067: note = derived and/or modified CDS sequence (opt11) from CCHFV(Ast133)__KX056060.1__GP
  source 1..5067: mol_type = other RNA
atgccgatcaacataaagcacaccctgctcgtctgcttcatcctgtacttacagttaagcggccttgggggcgcccacgggcagagtaacgccaccgagcacaacggcacgaacacaaccaccgttccggggacgagccaatcccccaagcctcccgcgagcacaaccccgccccacacgccagagtcctctacggtgaagctgaccacccccacctccgagacggaaggcagcggcgagacaaccccgccgcccaataccacccaggggctccccctgcccggcactacccccgagcgctccgccaccacggccacgagcacctccagcaccgacaacatgaactccacaacccaggtcacagacaacacccccacgtcgaccgtctccatcagcccgtccagctcaccgtccatgcctagcacctcccaggggatccaccaccccgtgcggagcctgctctccgtgtcctcccccaagactgtcacgaccccgacccccatgagtcccggggagatgtcccccgagaccagctcccagcacttcgccatgagtcgaatcccgacgctgtacaccgccacccaggtgtccaccgagaacaccgatcggagcacgccccgccagtccgagagctcagtgcaaccggcgacacagagccccatcacctccccggcccagaccatcctgctcatgtccgcggcccccaaggcgatccaggatatgcaccccagcccgacgaatcggtcaaagcgcaacctggaggtcgagataattctgacactcagccaggggctgaagaagtactacggtaagatactgaaattgctgcatctcacccttgaagaagacaccgagggcctgctggagtggtgcaagcggaacctaggctccaactgcgacgacgacttcttccagaagcgcatcgaggagttcttcatcacgggcgaggggtacttcaatgaggtgttacagttcaagactctgagcacgctctcccccaccgagcccagccacgtccgcctgccaacggccgagcccttcaaatcctatttcgccaaaggcttcctgagtatcgactctggctacttctccgcaaagtgctacccgcggtctagcacctccggtctccagttaatcaacgtcacccagcaccccgcccggatagcggagacccccggcccgaagacgacctcactgaagaccattaactgtatcaatctacgggcctccgtgttcaaggagcacagggaggtagagatcaatgtgttgctgccccaaatagccgtgaacctgagcaactgccacgtggtcataaactcccatgtgtgcgactactccctcgacaccgacgggcccgtacgcttacccagaatccatcacgagggcacgttcataccggggacctataagattgtcatagaccgcaaaaacaagctcaacgatcggtgctccctagttaccaattgcgtaatcaaaggacgcgaggtacggaaaggccagagcgtgctacggcagtacaagaccgaaatcaagattgggaaggcctccacgggctcccggaaattactgtcggaggagcccgacgacgactgcatttcccgcacccagctcctcaagaccgagaccgccgagatccacgacgacaactacgggggccccggggacaagatcaccatctgtaacggcagcaccatagtcgaccagcggctgggctcggagttagggtgctacaccatcaaccgggtaaagagctttaagctctgcgagaactccgcgaccggcaagacatgcgagatcgacagcacacccgtgaaatgcaggcaagggttttgcctgaaaattactcaggagggcagagggcacgtgaagctgtcccgcggcagcgaggtggtgttggacgcctgcgactccagctgcgagatcatgatcccgaagggcaccggggacatcctcgtcgactgctccggcgggcagcaacacttcttgaaagacaatctgatcgacctcggctgcccccacatccccctgctggggaagatggcaatttacatctgtcggatgtctaaccacccccgaacgaccatggcctttctattctggttctctttcgggtacgtgattacctgcatcttctgcaaggccctgttctacctcctcatcatcatcggcaccttggggaagaagataaagcagtaccgggagttaaagcctcagacctgcacgatatgtgagaccgcgcccgtgaacgccatcgacgccgagatgcacgacctaaactgctcttacaacatatgcccttactgcgcctcccgcctgaccagcgatggcctggcccgccacgtcacccagtgccccaaaagaaaggaaaaggtggaagagacggagctttacctgaacctggaacgtatcccgtggatcgtacgcaaattgttgcaggtcagtgagtcaaccggggtggccctgaagcggtccagctggctcattgtgctgctggttctactgaccgttagcctgtcccccgtacaaagcgcccccgtgggacacggcaagacaatcgagacgtaccagacccgcgaggggttcacctccatctgcctcttcatgctgggcagcatactgttcatcgtgtcctgcctcgtgaaggggctggttgacagcgtgtccgatagctttttcccggggctgtcggtgtgcaagacctgcagcatcgggtccatcaacggcttcgagatcgagtcgcacaagtgctactgctccttattctgctgcccctactgtcggcactgcagcgcagatcgcgagatccaccagctgcacctgtccatctgcaagaagcggaaaacgggcagcaacgtaatgctcgccgtgtgcaagcgaatgtgctttaaggcgactatagaggcctcccggcgcgccctgcttatccggagcatcatcaatacgaccttcgtgatgtgcatcctcacgctggccatctgcgtcgtgagcacatccgccgtggagatggaagacctgcccgctgggacctgggagcgggaagaagacctaaccaacttctgccaccaggagtgccaggtcacggagaccgagtgcctgtgcccctacgaggccctcgtgctccgcaagccgctgttcagcgactccatcgtgaagggcatgaagaacctgctaaacagcacctccctggagaccagcctgtccattgaggccccctggggcgccatcaacgtgcagagcacatttaagcccaccgtatccaccgcgaacatcgcgctcagctggtcctcagtggagcacagagggaacaagattcttgttaccgggcgcagcgagagcatcatgaagctggaggaacgaacgggcgtgtcgtgggacctcggcgtggaggacgccagcgagtccaagctgctgaccgtcagcataatggacctgtcccagatgtacagccccgtgtttgagtacttaagcggggaccggcaagtggaggagtggcctaaggctacctgcaccggagactgtcccgagcggtgcgggtgcacttcgagcacctgtctgcacaaagagtggccccactcgcgcaactggcggtgcaaccccacttggtgctggggcgtcgggacgggctgcacgtgctgtggcgtggacgtgaaagacctcttcaccgaccatatgtttatcaagtggaaagtcgagtacataaagacagaggccatcgtgtgcgtggaactgacaagccaggagcgccagtgttccctgatcgaggccgggacacggttcaacctgggccctgtcacgatcaccctgagcgagccccggaacatccagcagaaactgccacccgaaatcatcaccctccacccgaagatagaggaggggtttttcgacctgatgcacgtgcagaaggttttatccgccagtaccgtctgcaagctccagtcctgcacgcacggcatccccggcgacctgcagatctatcacattgggaacctgctcaagggggatcgggtgaacggtcacctgatccacaagatcgagccacatttcaatacaagctggatgtcatgggacggctgcgacctggactattactgtaacatgggggactggcccagctgcacctacaccggcgtcacccaacacaaccatgctgctttcgtgaacctcctgaacatcgagaccgactataccaagaccttccacttccacagcaagcgcgtgacagcccacggcgacaccccgcaactggacctcaaagcgcggcccacctacggggccggcgagattaccgtcctcgtggaggtggccgacatggagctacacacgaagaaggtagagatcagcgggttaaagttcgcctcccttacatgcaccgggtgctacgcttgcagctccgggatctcatgcaaggtaagaatacacgtggacgagcccgacgagctgaccgtccatgtgaagtccagcgaccccgacgtagtcgcggccagcacgtccctcatggcccggaagctggagttcggcaccgacagtacctttaaggccttctccgccatgccgaagaccagcttatgtttctacatcgttgagcgcgaatactgcaagagctgtagcgaggacgacacgaagaagtgcgtggataccaagctcgagcagccccagtccatcctgatcgagcacaaaggcaccattatcgggaagcagaacgatacctgcacggcaaaagccagctgctggctggagtccgtaaagagctttttctacggcttaaagaatatgctggggtccgtgttcggcagcttcttcgtggggatactgttgttcctggccccattcgtcctgcttgttctcttcttcatgttcgggtggaagatactgttctgcttcaagtgctgccggcgcacccggggcctgtttaagtaccgccacctcaaggacgacgaggagaccgggtaccgcaggatcatcgagcggctgaactcgaagaagggcaagaaccggctgctcgacggggagcgcctggcagaccgcaagatcgccgaactgtttagctccaagacacacatcgggtga

SEQ ID NO: 15233 - RNA, 5067 nt, synthetic construct
  misc_feature 1..5067: note = derived and/or modified CDS sequence (opt11) from CCHFV(Ast137)__KX056057.1__GP
  source 1..5067: mol_type = other RNA
atgcccattaacatcatgcacacacttctcgtgtgcttcatcctgtacctgcaactcagtggcctcgggggcgcccacgggcagtccaacgctaccgaacataacggcacgaataccaccaccgtcccgggaacgagccagtcccccaagccacccgcgagcaccaccctgccccacaccccagagtccagcacagtgaagctaaccacccccacgtcggagacggagggcagcggagagaccacgcccccgcccaacaccacccaggggctgcccccgcccggcaccacccccgagcggcccgccaccacggccaccagtactagctccaccgacaacatgaacagcacgacccaggtgaccgacaatacacccacgtccaccgtcagcatctcccccagctccagcccctccatgcccagcaccagccaagggatccactaccctgtgcggtcgctgctctcagtgtccagcccgaagaccgtcacgactcccaccccgatgagtcccggcgaaatgagcccggagacctccagccagcactccgccatgagccgcatccccacgttatacaccgccgcccaggtctccaccgagaacaccaaccggagcacgccccgccagtccgagagcagtgcccagcccgccacccaaagcccgaccaccttcccggcccagacaatccttctcatgtccgcggcacccaaggccatccaggacatgcacccgagccccacgaatcggtccaagcgcaacctggaggtggagatcatcctgaccctcagccaggggctgaagaaatactatggcaagatccttaaactcctgcacctgaccctcgaggaggacaccgaaggcctgctggagtggtgcaagcggaatctcgggagcaactgcgacgacgacttcttccagaagcgcatcgaggagttcttcatcacgggcgaggggtactttaacgaggtcctgcaattcaagaccctgtccaccctcagcccgaccgagccctcgcacgtgcggctgccgacggccgaaccctttaagagctacttcgccaaaggcttcttatccatagacagcggctacttctccgcaaagtgttaccctagaagctccaccagcgggctccagctgatcaacgtaacgcagcacccggcccggatcgccgagaccccgggccccaagacgacctccctcaagaccatcaactgtatcaacctccgcgccagcgtcttcaaggagcaccgggaggtcgagatcaacgtgctgctgccccagatcgccgtcaacctctcgaactgtcacgtggtgatcaacagccacgtctgcgactacagtctggacaccgacgggcccgtgaggctgccccggatccaccacgaaggcacattcatacccgggacctacaagatcgtgatcgacaagaagaacaagctcaacgatcgctgcagcctggttaccaactgcgtgatcaaaggccgggaggtgcgcaaaggccagagtgtcttgcggcagtacaagacagagatcaagatcgggaaggcgagcacgggcagccgcaaactcctgagcgaggaacctggggacgactgcatctctcggacccaactgctcaagacggagaccgctgagatccacgatgacaactacggtgggccaggggacaagatcacgatctgcaacgggtccaccatcgtggaccagcgcctcgggagcgagctgggctgctacaccataaacagagtcaagtccttcaagctgtgtgagaactcagccaccggtaagacgtgtgagatcgactccacaccggtgaagtgccggcagggcttttgcctgaaaatcacccaggaagggcgcggccacgtgaagctgagccggggctccgaggtggtgctggacgcctgcgacagctcctgcgagattatgattccaaaaggcaccggagatatcctggttgactgctctgggggtcagcaacacttcctgaaggacaacctgatcgatctcggctgccctcacatccccctgctggggaagatggccatccacatctgccgcatgtccaaccacccgcggaccaccatggcgttcctcttctggttcagcttcggctatgttataacctgcatcttctgcaaggccctgttctactccctgatcatcatcggtaccctcggcaagaagatcaagcagtaccgcgaactgaaaccccagacctgcaccatctgcgagaccgcccccgtgaacgccatcgatgccgagatgcacgatctgaactgcagctacaacatctgcccgtattgtgcgtcccggctcaccagcgacggcctggcccgccacgtgactcagtgcccgaagcggaaggagaaagtcgaggagactgagctgtacctcaacctggaacgcatcccctggatcgttcggaagttactccaggtgtccgagagcacgggcgtcgccctgaagcgaagctcctggctcatcgtgctcctggtgctgctcaccgtcagtctatcccccgtgcagagcgcgccggtgggccatgggaagaccatcgagacgtaccagacccgggagggattcaccaacatatgcctgttcatgctcgggtccatcctgtttatcgtctcttacttagtaaaaggcttagtggactcagttagcgactcgttcttccctggcctgagcgtctgcaagacctgctccatcggcagcatcaacggcttcgagatcgagtcccacaagtgctactgcagcctcttctgttgcccctattgccgccactgctccgcagaccgggagatccaccaattacacctggggatctgcaaaaagcgcaaaacgggcagcaacgtgatgctagccgtctgcaagcggatgtgcttcaaggccactatcgaggcctccagacgcgcgctcctaatccgcagcatcatcaacaccaccttcgtgatctgcatcctgacgctagcaatctgcgtggtgtccaccagcgccgtggagatggagaacctgcccgccgggacctgggagcgagaggaggacctgaccaacttctgccatcaggagtgccaagtgacggagaccgagtgcctctgcccgtacgaggccctggtcctgcggaagccccttttcctcgatagcatcgtcaagggcaccaagaacctgctcaactccaccagcctggaaacgtctcttagcattgaggccccatggggagcgatcaacgtgcagtccaccttcaagcccactgtcagcacagccaacatcgccctctcctggagctccgttgagcaccgcgggaacaagatcctggtgaccggccggagcgagtcaatcatgaagctggaggagcgcacgggggtcagctgggacctcggagtggaggacgccagtgagagcaagctgctgacagtgtccatcatggatctcagccagatgtactccccggtcttcgagtacctgagcggggaccgccaggtggaggagtggcccaaggcgacgtgcaccggcgactgccccgagaggtgcgggtgcacctcctccacgtgcctgcacaaagagtggccacactcgcggaactggcgctgcaacccgacctggtgctggggcgtcgggaccgggtgcacgtgctgtggcgtcgacgtgaaggacctttttaccgaccacatgttcatcaagtggaaggtggagtacatcaagaccgaagccattgtctgcgtggagctgacctcccaggagcggcagtgcagccttatcgaggccgggacccgcttcaacctcggtcccgtgaccatcaccctgtccgagccccgcaacatccagcagaagctacccccggagatcatcaccctgcaccccaagatcgaggaaggcttctttgacctgatgcatgtccaaaaggtgctgtccgcctccacggtctgcaagctccagagctgcacccacggtatccccggcgacctgcagatctaccacatcgggaatctgctcaagggcgacaggctgaacgggcacctaatacacaagatcgagccccacttcaacacctcatggatgagctgggacggctgcgacctagactactactgcaacatgggcgactggccgtcgtgcacctacactggggtgacacaacacaaccacgccgcgttcgtgaatctgctgaacatcgagactgattacaccaaaacgtttcacttccacagcaagcgggtcaccgcccacggcgacacgccccagcttgacctgaaggccagacccacctatggggccggcgagatcaccgtgcttgtagaagtcgccgacatggagctacacaccaagaaggtggaggtgtcggggctgaaattcgccagcctggcctgcaccggctgctatgcctgctccagcggtatctcctgcaaggtgcgaatccacgtggacgagcccgatgagctcaccgttcatgtcaagagcagcgacccggacgttgtggccgccagcacgtccctgatggcgcgcaagctggagttcgggacagacagcacttttaaggccttcagcgccatgccaaagacctccctctgcttctacatcgtcgagcgggagtactgcaagagctgctccgaggacgacacgaagaagtgcgtggacaccaagctggagcagccccagagcatcttaatagagcacaagggaaccatcatcggtaagcagaacgatacctgcaccgcgaaggcctcgtgctggctcgagtctgtgaagtcctttttctacggtttaaagaatatgctggggagcgtcttcggcaatttcttcgtgggcatcctcctgttcctggcgccattcgtgttgctcgtcttgttcttcatcttcgggtggaagatcctgttctgctttaagtgctgccgtagaacccgcggcctcttcaaataccggcacctgaaggacgacgaggagaccgggtaccgcaagataatcgagcgcctgaactccaagaagggcaagaaccggctcctggacggcgagcgcctggccgaccggaaaatcgccgagttgttcagcaccaagacgcatatcgggtga

SEQ ID NO: 15234 - RNA, 5067 nt, synthetic construct
  misc_feature 1..5067: note = derived and/or modified CDS sequence (opt11) from CCHFV(Ast149)__KX056054.1__GP
  source 1..5067: mol_type = other RNA
atgccgatcaacataatgcacacattgctagtctgctttatcctctacctgcagctatcaggcctgggcggcgcacacgggcagtccaacgccactgagcacaacgggacgaacaccaccaccgcgccggggacatcccaaagtcccaagccgccggcgtcaacaaccccgccgcatacccccgagtcctctacggtcaagctgactaccccaacttccgagacggaggggagcggagagacgacgcccccgcccaacaccacgcaagggctacctccgcccggcaccacccccgagaggcctgcaaccacggccacatccaccagcagtaccgacaacatgaacagcacgacccaggtgaccgacaataccccgacgtccactgttagcacctctccctcaagcagcccgagcatgccgagcaccagccagggaatccactaccctgttagaagcctgttgtccgtttcctcacccaaaacggtcaccacccccacccccatgagtcctggggaaatgagccccgaaacgtcgagccagcactccgccatgagccggatccccaccctctacacggcggcccaagtatccactgaaaacgccaaccggtcgacaccacggcaatccgagtcttcggcccaacctgcgactcagagccctacgaccttccccgcgcagaccatcctgctgatgtccgccgcgccgaaggcaattcaagacatgcatccctcacccactaaccgaagtaaaagaaacctagaagtggagataattctgaccctgagccaggggctcaaaaagtattacggcaagatcctgaagctgctgcacctaacactggaggaagacaccgagggcctcctagagtggtgtaagcggaatctcgggagtaattgcgatgatgacttcttccagaagcgcatcgaggagttcttcattacgggcgagggctacttcaacgaggtgttacagttcaagaccctatcaaccctctcccccacagagccgtcccatgtccggctcccaacggctgagcccttcaagtcctacttcgcgaaaggctttctgtctatcgacagtggatacttctctgctaaatgctacccccgcagctccacctcggggttgcagctaattaacgttacccaacacccggcaagaatagccgagaccccagggcctaagacaacgtccctgaagacgatcaactgtatcaaccttcgcgcgagcgtgttcaaagaacaccgggaagtagaaataaacgtcctcttaccgcagatcgccgtgaacctgtccaactgccacgtcgtgatttatagccatgtgtgcgattattccctcgacaccgatgggccagtgagattaccacggatccaccacgagggcacgttcattcctgggacctataagatagtgatcgacaagaaaaacaaacttaacgacagatgcagcctcgtaaccaactgtgtcatcaaggggcgcgaagttcgcaaggggcagagcgttctacggcagtacaaaacagaaatcaaaattgggaaggccagcaccggcagtcgcaagctgctcagcgaagaacccggtgatgattgcatcagtcgcacgcagctccttaaaaccgagaccgccgagattcacgacgacaattacggcggaccgggcgataagatcacaatctgcaacgggtccaccatcgtggatcagcgcctcggttctgaactgggctgctacacaataaaccgcgtgaaatccttcaagttgtgcgagaacagcgccaccgggaagacttgcgagatcgattccacccccgtaaagtgccggcaaggattctgtcttaagataacccaggagggccgcggccacgtcaagctgtcgagaggctccgaggtagtcctcgacgcctgtgacagctcctgcgaaatcatgatccccaaggggaccggcgacatactggtggactgcagcgggggccagcaacacttcctcaaggacaacctgatcgacttgggatgcccccacatccctctcctggggaagatggctatctacatttgtcgaatgtccaaccaccccagaacgaccatggccttcctgttctggtttagcttcgggtacgtgattacctgtattttctgcaaggccctgttttactctcttataatcatcgggacgctgggcaagaagattaaacagtaccgcgagctcaaaccccagacgtgcacgatctgcgagactgctcctgtcaacgcgattgacgccgaaatgcacgacctaaactgctcatacaacatttgcccgtactgtgcgtctcggctgactagcgacgggctcgcccgccacgtgactcagtgtcccaaacgcaaagaaaaggtggaggagacggagctgtatttaaacctagaacgcatcccatggatcgttagaaaactgctccaggtgtccgagagtaccggcgtggccctcaagcgcagttcctggctcatcgtcctgcttgtgttgctaacggtaagcctctccccagtccaaagcgcaccggtcggccacgggaagaccatagagacgtatcaaacccgggagggctttacaaatatatgtctgttcatgctgggctccatactattcatcgtgagctgcctggtgaaaggcttagtcgactccgtaagcgactcctttttccccggcttatcggtctgcaagacatgttccatcggcagcataaatggtttcgagatcgagtcacacaaatgttactgcagcttattctgctgcccctactgccgccactgcagtgccgaccgggaaatccaccagctgcacctgggaatatgcaagaagcgcaaaacgggaagtaacgtcatgctagcagtatgcaagagaatgtgcttcaaagcaaccatcgaggcctcccggcgcgcactgccgatcagatccataattaacacgactttcgtcatctgcatcctcacgttagcgatctgcgtagtgagcacgagcgctgtggaaatggagaaccttcccgcggggacctgggaacgcgaggaggacctcactaacttctgtcaccaggaatgccaagtaactgaaaccgagtgcttgtgcccgtacgaggccctggtgcttcgtaagccccttttcctggacagcatagtgaagggcatgaaaaaccttctaaattcaaccagcttagagaccagtctcagcatagaggcaccgtggggcgccatcaatgtgcagtcaacgttcaaaccaaccgtgagcaccgccaatatcgccctgtcctggagctccgtagagcatcgcgggaacaagatattagtgactggaaggagcgagtctatcatgaaactagaggaaaggacgggagtgtcttgggacctcggcgtagaggatgcgtctgagagcaaactgcttaccgtgtccatcatggacctgagtcagatgtactcccccgtttttgagtacctctccggagatcggcaggtcgaagagtggccaaaagcaacctgcaccggggactgcccggaacgttgcgggtgtacgagttcgacctgcttgcacaaggagtggccccacagccgcaactggcgctgcaaccccacttggtgctggggcgtggggaccgggtgcacatgctgcggcgtggacgtgaaggatctcttcacagaccacatgttcataaagtggaaggtggaatacattaagaccgaagccatagtttgcgtggagctgacctctcaggagcgtcagtgcagcctcatcgaggccggaactcgcttcaacctggggcccgtgacgatcaccctgtccgagccccgcaacatccaacagaagttacccccggagatcatcacccttcatcccaaaatagaggagggcttcttcgatctgatgcatgtgcagaaggtcctcagcgcatccacggtgtgtaaactgcaaagctgcacgcacgggataccgggagacttacaaatttatcacatcggtaacttgctcaagggcgaccgcctgaatgggcaccttatccacaagatcgaaccccacttcaataccagctggatgagctgggacggctgcgacctggactactattgtaacatgggcgactggccctcatgcacgtacacgggggtgacccaacacaaccacgccgccttcgtgaacctgctcaatatcgagaccgactacaccaagacattccacttccacagcaaacgcgtgacggcacacggtgacacgccccagctggacttgaaggccaggccgacctacggggcgggggagatcaccgtcctcgtcgaagtggccgatatggagctccacacgaagaaagtcgaggtatccggactcaagtttgctagcctcgcctgtacggggtgctacgcctgctcctcgggcatctcctgcaaggttcgaatacacgtcgacgaacccgacgagctgacggttcacgttaagagctccgatcccgacgtggtggcggcatcgacctccctgatggcccgcaagctcgagttcgggacggactcgaccttcaaggccttcagcgcaatgcccaaaacatcactgtgcttttacatagttgagcgcgagtactgcaagagctgctctgaggatgacacgaagaagtgtgtcgatacgaagctggagcagccgcagagcattctcattgaacacaagggcaccatcattggtaagcagaacgacacgtgcactgcgaaggcctcctgctggcttgagagtgtgaaatccttcttttacggcctgaaaaacatgctcggcagcgtgttcggcaacttcttcgttggcattttattgtttctcgcccccttcgtgctgcttgccctgttctttatctttggttggaaaatcctcttctgcttcaagtgctgccgacgtacgcgcggcctgttcaagtatcgccacctgaaggacgacgaagagaccggataccgcaaaatcatcgagaggctcaattctaaaaagggcaagaaccggttattagatggagagcgactcgctgaccgtaagatcgccgaactgtttagcaccaaaacccatataggttag

SEQ ID NO: 15235 - RNA, 5067 nt, synthetic construct
  misc_feature 1..5067: note = derived and/or modified CDS sequence (opt11) from CCHFV(Ast199)__KX056051.1__GP
  source 1..5067: mol_type = other RNA
atgcccatcaacataatgcacaccctgctcgtgtgcttcatcctgtacctgcagctcagcggactagggggcgcccacgtccagtccaacgccaccgagcataatggcacgaacacgaccaccgtgccgggcacgagccaatcccccaagccgcccgcgagcaccacactgccccacaccccggagtccagcacggtgaaactgaccaccccaacgtccgagacggaggggtctggggagacaacgcccccgccgaacaccacccagggcctgcccccacccggtaccaccccagagaggcccgccaccacggccactaccacctccagcacggacaacatgaactccacgacccaggtaaccgacaatacgcccaccagcaccgtgtccatcagcccttccagcaatccctccatgcctagcacctcccaagggatccactaccccgtgcggagcctgctcagcgtctcaagcccgaagacagtgaccactcccacccccatgtcccccggggagatgagcccggagacgtccagccagcacagcgcgatgagccgtatccccaccctgtacacggccgcccaggtgtccacggagaacaccaaccggagcacgccccgccagtccgagagctccgcccagcccgccacccagagcccgaccaccttccccgcccagacgatccctttaatgtccgcggccccgaaagccatccaggacatgcatcccagccccaccaaccggtccaagcgcaacttagaggtagagatcatcctgaccctgagccagggcctcaaaaagtactacgggaagatcttaaagctgctccacctgactctggaggaagacacagagggtcttctcgagtggtgcaagcggaacttaggctccaattgcgacgacgatttcttccagaagcgcatcgaggagttcttcatcaccggggaaggctacttcaacgaggtgctccagttcaagacaccgagcaccctgtcgccgacggagccatcccacgtgcggctgcccaccgccgagccattcaagagctacttcgccaagggcttcctctccatcgacagcggctatttctccgcgaagtgctacccgcgctcgtccaccagcggcctgcaactgatcaacgtcacacagcaccccgcccggatcgctgagacgcccgggcccaaaaccaccagtctcaagaccatcaactgcatcaacctgcgcgccagcgtgttcaaggagcaccgggaggtggagatcaacgtcctgctaccgcagatcgctgtgaacctgtcaaactgccacgtcgtgatcaacagccacgtgtgtgactactccctggacactgacggccccgtgcgcctcccccggatccatcacgaggggaccttcatccccggcacctacaagatagtaatcgacaagaagaacaaactgaacgaccgctgcagcctggtgaccaactgcgtgataaaaggccgggaggtccgtaagggccagtccgtgttgcggcagtacaagacggaaatcaagatcggcaaggcctccaccgggtccaggaagctgctgagcgaggagccgggagacgactgcatcagcagaacccagctcctcaagaccgagacggcggagatccacgacgacaactacgggggcccaggcgacaaaataaccatctgcaacggctccaccatcgtcgaccagcgcctgggcagcgagcttgggtgctacaccatcaaccgcgtcaagtccttcaagctgtgtgagaacagcgcgacgggcaagacttgcgagatcgactcgacccccgtgaagtgccggcagggattctgcctgaagattacccaggagggccgcggacacgtcaaactcagccgggggtccgaggtggttttagacgcctgtgactcttcctgcgagatcatgatacccaagggcacaggagacatcctggtcgactgcagcggcgggcagcagcacttcctgaaggacaacttaatcgacctgggctgcccgcacatccctttactcgggaaaatggccatctacatctgccgcatgtccaaccacccccggaccaccatggcgttcttattttggttcagcttcgggtacgtgatcacgtgcatcttctgcaaggccttgttctactccctgattattattggcacactggggaagaaaatcaaacagtatcgcgaactgaagccccagacctgtacaatttgcgagaccgctccggtgaacgcgatcgacgccgagatgcacgacctcaactgcagctacaacatatgcccctactgcgcgtcccggctgaccagcgacggtctggcccgccatgtcacgcagtgcccaaagcggaaggagaaagtggaggaaactgagctctacctgaatctggagcgcatcccgtggatcgtgaggaaactcctgcaggtctccgagtctaccggggtggccctgaagcgctgctcctggctcatcgtgctgctggtcctcctgaccgtgagcctgagccccgtgcagtccgcccccgtaggccacggtaagacgatcgagacctatcagacccgggaggggttcaccaacatctgtctcttcatgctgggcagcatcctgttcatcgtgtcctgcctcgtgaaggggctggtcgactctgtgtccgacagcttcttccccggcctgtccgtgtgcaagacgtgcagcatcgggtccatcaacggcttcgagatcgagagccacaagtgctactgctccctcttctgctgcccgtactgccgccactgcagcgcggaccgggagatccaccaactgcacctgggcatctgcaaaaagcgcaaaaccggctccaacgtcatgttggccgtgtgcaaacggatgtgctttaaggccacgatcgaggccagccgccgagcgctgctgatccgctccatcatcaacacaacgttcgtgatctgcatcctcaccctggcaatctgcgtcgtgagcacctccgcggtggagatggagaacctgcccgccggcacatgggagcgcgaggaagacctcacgaatttctgccaccaggagtgccaggtaactgagacggagtgcctgtgtccctacgaggccctagtgctccgcaaaccccttttcctggacagcatagtgaagggaatgaagaacttactcaactccaccagcctggagacgtcactctccatcgaggccccgtggggagcgatcaacgtccagagcaccttcaagcccactgtgagcaccgccaacatagccctatcatggtcctctgtagagcaccgcggtaacaagatcttagtgacgggccggtccgagagcatcatgaaactcgaggagcgcaccggcgtgtcctgggaccttggtgtggaggacgcaagcgagtccaagctgcttaccgtcagcatcatggatctgtcccagatgtacagcccagtgtttgagtacctgtccggggaccgtcaagtggaggagtggcccaaggccacgtgcaccggagactgcccggagcggtgcggctgcaccagctccacgtgcctccacaaggagtggccccacagtcggaactggcgctgcaaccccacctggtgctggggcgtcggcaccggctgcacgtgctgcggggtggacgtgaaggacctgtttacggaccacatgttcatcaagtggaaggtcgaatacatcaagaccgaggcgatcgtgtgcgtggaactgacctcacaggagcggcagtgcagcctcatcgaggccggcacccgcttcaacctggggccggttaccatcaccctcagcgagccacggaacatccagcagaaactcccgcccgagatcatcaccctgcacccaaagatcgaagagggcttcttcgacctgatgcacgtccagaaggtgctctccgccagcacggtgtgcaagctgcagtcctgtacccacggcattcccggtgacttacagatctaccacataggcaacctcctgaagggggaccgtctgaacggccacctcatacacaagatcgagccccacttcaacaccagctggatgtcctgggacggttgtgacctggactattactgcaacatgggcgactggcccagctgcacctacacgggtgtcacccagcacaatcacgccgcgttcgtaaacctgctcaacatcgagaccgactacaccaagacgttccactttcactccaagcgggtgaccgcccacggggacacgccccagttggacttaaaggcccgccccacctacggcgctggtgagatcaccgtgctcgtcgaagtggccgacatggagctgcacaccaagaaggtggaggtatcgggcctgaagttcgcgtcactcgcctgtaccgggtgctatgcctgctcgtccggcatcagctgcaaggtgcggatccacgtggacgagcccgacgagctgaccgtccatgtgaaatccagcgaccccgacgtggtcgccgcctcgacgagcctgatggctcgcaagctcgagttcggcaccgactccacgttcaaggcgttctctgccatgccaaagaccagtctgtgcttctacatcgtggagagagagtactgcaagagctgcagcgaggacgacaccaagaagtgcgtggacactaagctggagcagccgcagagcatactcatcgagcacaagggcaccatcatcggcaagcagaacgacacctgtaccgccaaggccagctgctggctggaatccgtcaaatcgttcttttacgggctgaagaacatgctcggctcggtctttgggaacttcttcgtgggcatcctgctgtttctcgcgcctttcgtcctgctggtgctgttcttcatattcggctggaagatcctcttctgctttaagtgctgccgccggacccgagggctgttcaagtatcggcacctgaaagatgacgaggagaccggctatcgcaagatcatcgagcgcctcaacagcaaaaaggggaaaaatcgattgctggacggcgagcgcttagccgatcggaagatcgccgagctgttctctaccaagacgcacatcggctga

SEQ ID NO: 15236 - RNA, 5067 nt, synthetic construct
  misc_feature 1..5067: note = derived and/or modified CDS sequence (opt11) from CCHFV(Saf)__KX013487.1__GP
  source 1..5067: mol_type = other RNA
atgcctaccaacatcatgcataccctgctagtgtgcttcatactgtatctgcagcttctgggcctcgggggcgcccacgggcaaagcaacgctacggagcacaatggcaccaacaccaccacggctccgtccacgagtcagtcccccaaaccgctggtctctaccgcgccaccgcatgccctcgagtccagcaccatcaagcctacaacccccgcctccgagaccgaggggagcggcgagaccacgcccccaccgaataccacccagggaccctccccgcccgagactactcccgagcgacccgccaccaccgcgaccagcacgccctccacagacaacacgaacagcaccacgcatgtgaccgacaacaacccgacttcgaccatcagcacatccccctctagtagcccgtcaacgcccagcaccccgcaggggattcatcaccctgcccggaacctcctaagcgtgtccagcccgaagactgccacaaccccgacccccacctcccccggcgagatcagctccgagacgagctccctgcatagcgccatgtcccgcactagcaccctgtacacggcgacccaggtctccacagagaacgctaatcacagcgcgccccgccagtccgagagctccgcgcaaccaacaaccacgagcccgatgacctcccccgcccaaagtatcctcgtgatgagtgccgcccctacggcgatacagaacatccacccgagccccaccaacagatccaagcggaacctagagatggagatcatcctgaccctatcacaggggctgaagaagtactacggcaagatccttaagctcctgcaccttacgctcgaggaggacaccgaggggctgttagagtggtgcaaacgcaacctcggctccaactgcgacgacgacttcttccaaaagcggatagaggagttcttcatgaccggggaggggtacttcaatgaggtgctgcagttcaagacactgtccacgctcagccccaccgagccctcccacgctcggccgcctaccgtcgaacccttcaaaagctacttcgccaagggcttcctgtccattgatagcgggtacttttccgctaaatgctaccccaggagctcgactagcggccttcagctcatcaacgtgacgcagcacccggcaagaatcgctgaaacccccggccccaaaaccaccagcttgaagacgattaactgcatcaacctgagagccagcgtgttcaaagagcaccgggagatcgagattaacgttctcctgccccaaatcgcagttaacctctccaactgtcacgtggtcatcaactcccacgtgtgcgactactccctggacaccgacggtccggtccggctgccccacatccaccacgagggcacgttcatccctgggacctacaagatcgttatcgacaaagaaaacaagctgaacgaccgctgcacgctcgtgaccaattgtgtcatcaaaggcagggaggtgaggaagggccagagcgtgctacggcagtacaagaccgagatcaagatcggcaaggcgagcaccgggtcccgcaagctgctcagcgaggagcccggggacgattgtatctcccggacccagttactgaggaccgagaccgccgagatccacgacgacaactatggcgggcctggcgataagattacaatctgcaacgggtccacgatcgtggaccagcggctcggctcagaactgggctgctataccataaatcgagttaagagcttcaaactgtgtgagaactccgccaccggaaaaacctgcgaaatagacagcacgcccgtgaagtgccgccagggcttctgcctcaagatcacacaggaggggcggggccacgtgaaactgtcccgcgggagcgaggtcgtgctggacgcctgcgactccagctgtgaggtcatgatccccaaaggcaccggcgacattctggtggactgctccggcggtcagcagcactacctcaaggacaatctgatcgacctggggtgcccccatatcccgctcttgggcaagatggccatctacatctgtcggatgtcgaaccacccccgcaccacaatggcattcctgttctggttcagtttcggctacgtgatcacgtgcatcttctgcaaggccctcttctacagcctgatcatcatcggcacgctgggcaagaaaatcaagcagtaccgcgagttaaagccccagacctgcaccatctgcgaaacggcccccgtcaacgccatagacgcagagatgcatgacttgaactgctcttataacatctgcccgtactgcgcctcccgcttaacctccgacggtctagcccgtcacgtgccgcagtgccccaagcgcaaggaaaaggtggaggagacagagctatacttaaacctcgagcgcatcccgtggatcgtccgcaaattactccaggtgagcgagtcgacaggtgtggccttaaagcggtcctcctggctaatcgtcctgctcgtgttgctaacggtttcgctgtcacccgtccagtccgcccccgtggggcatggcaaaacaattgagacgtaccaaacgcgcgaggggttcactagcatctgccttttcatgttggggtccatactcttcttggtgagctgtctggtcaagggcctagtggattcggtgagcgactcctttttccccggtctgagcgtatgcaaaacatgctccatcggcagcattaacgggtttgagatcgaatctcacaagtgctattgctcactcttctgctgtccgtactgcaggcactgttccgcggaccgagagatccaccaacttcacctgtcaatctgcaagaagcggaagaccggctctaacgtgatgctggccgtgtgcaagcgcatgtgcttccgggccacgattgaggccagccgcagagccctcttgattcgcagcatcatcaacacgaccttcgtcatctgcatcctaaccctgactatctgcgtggtgtccacgagcgcggtagagatggagaaccttccctccggaacctgggagcgcgaagaggacctgaccaacttctgccaccaagagtgccaagttaccgaaacggagtgcttgtgcccctacgaggccctggtattacggaagcccctcttttcagactccatcgtcaaggggatgaagaacctgctgaatagcacatccctcgagaccagcttgtccatcgaggccccgtggggcgccatcaacgtgcagtcaacattcaagcccacggtgtcgaccgccaacatagcactgagctggagctcagttgagcaccgcgggaataagatcctcgtgaccgggcggtccgagtccataatgaaactggaggagcgcactggggtgtcctgggacctgggcgtcgaggacgctagcgagtctaagctcctgaccgtgtcgatcatggacttaagccagatgtactctcccgtgttcgagtacctcagcggcgaccggcaggtagaagaatggcccaaggcgacctgcaccggcgactgcccggagcgctgtggctgcacctccagcacctgtcttcataaggagtggccccactcccggaactggcgctgcaacccaacatggtgctggggcgtggggaccgggtgcacgtgttgcggcgtggacgtcaaggaccttttcaccgaccatatgttcgtgaaatggaaagtggagtacatcaagaccgaggcaatcgtctgcgtggagctcactagccaggagcggcagtgcagcctgatcgaggcaggcacccgctttaacctggggccggtcacaatcacgctatctgaaccacgtaatatccagcagaagctgccacccgagatcatcaccttgcaccccaaggtcgaggaggggttcttcgatctcatgcacgtgcagaaggtactgtccgccagcactgtctgcaagctgcagtcctgcacgcacgggatccccggcgacttacaggtgtaccatataggaaacctgctgaagggggaccgggtgaacggccatctcatacataagattgagccccacttcaacacgagctggatgtcctgggacggatgtgacctggactattactgcaacatgggcgactggcccagctgtacatataccggcgtcacccaacacaaccacgccgccttcgttaacctgctcaacatcgagacggattatatgaagaccttccacttccattctaaacgggtcaccgcccacggtgacacgccccagctggacctgaaagcgcgcccgacctacggcgccggggaaatcaccgtgctcgtggaggtcgccgacatggagttgcacaccaagaaggtggagatctcaggcctaaagttcgtgtccctcgcatgcacagggtgctacgcctgcagctccggcattagctgcaaggtccggatacatgtggacgaacccgatgagctgactgtacacgtcaagagcagtgacccagacgtggtggcggcgagcacctccctcatggccagaaagctcgagttcgggaccgacagcacgttcaaggctttttccgctatgcccaagacgtcactgtgtttttacatcgtcgaaagggagtactgtaagtcctgcagcgaagaggacacccagaagtgcgtggatactaaactggaacagccgcaatccatattaatcgagcacaagggtaccattatcggcaaacagaacgacacgtgcaccgcaaaagccagctgctggctggagtccgtcaaaagtttcttttatgggctgaagaacatgctgggatccgtatttgggaacttcttcattggcatactgctgttcctcgcccccttcgtgctgctggtgctgttcttcatgttcggctggaagattctcttctgcttcaagtgctgccgccgaacccgcggcctgctgaagtaccggcacctcaaggacgacgaggaaaccggctaccgccgcataatcgaacggctaaacaacaaaaagggcaagaaccgcttactcgacggtgagcggcttgccgaccgcaagattgcggagctgttcagcacgaagacccacattgggtga

SEQ ID NO: 15237 - RNA, 5067 nt, synthetic construct
  misc_feature 1..5067: note = derived and/or modified CDS sequence (opt11) from CCHFV(Min)__KX013481.1__GP
  source 1..5067: mol_type = other RNA
atgccgactaacatcatgcacacgctgctcgtgtgcttcatcctgtacctgcagctcctgggccttgggggcgcccacggacaaagcaacgccacggagcacaacggcaccaacaccaccacggcgccgtccaccagccagtcccccaagcccctcgtcagcaccgcgcccccgcacgccctggagtccagcaccattaagcccacgacccccgcctccgagaccgaggggagcggcgagaccacgcccccgcccaacaccacccagggcccctccccgcccgagaccacgcccgagcgccccgccaccaccgccaccagcacgccctccaccgacaacaccaacagcaccacgcacgtgaccgacaacaacccgacctccaccatctctacgtcgcccagctccagcccctccacccccagcaccccgcaggggatccaccaccccgcccgtaacctgttgagcgtgtccagcctgaagacggccacgacccccacccccacctccccgggcgagatcagctccgagacgagctccctgcacagcgccatgtcccgcaccagcaccctctacaccgcgacccaggtctccacggagaacgcaaaccatagcgcgccccggcagtccgaaagctccgcccagcccaccaccaccagccccatgacgtccccggcccaaagcatcctggtaatgtccgccgcccccatcgccatccagaacatccaccccagcccgaccaaccgctcaaaacggaacctggagatggagataatcctcaccctgtcccaggggctgaagaagtactacggcaagatcctcaagctgctgcacctcaccctggaggaggacacggaggggctgctcgagtggtgcaagcgcaaccttggcagcaactgcgacgacgacttcttccagaagcggatcgaggagttcttcatgaccggcgaggggtacttcaacgaggtgctgcagttcaagaccctctccaccctgagccctacggagccatcccacgcccggcccccgaccgtcgagcccttcaagagctacttcgccaagggcttcctgtccatcgacagcgggtacttctccgcgaagtgttacccccgcagctccaccagcggcctgcagctgatcaacgtgacccagcaccccgcccgcatcgccgagacgccgggccccaagaccaccagtcttaagaccatcaactgcatcaacctccgggccagcgtcttcaaggagcaccgcgagatcgagatcaacgtcctgctgccccagatcgccgtgaacctctccaactgccacgtggtaataaacagccacgtgtgcgactattccctggacacggacgggcccgtgcggctgccgcacatctaccacgagggcaccttcatccccgggacctacaagatcgtcatcgacaagaagaacaagctcaacgaccgctgcaccctggtgacgaactgcgtgattaagggccgggaggtccgcaaggggcagagcgtgctgcggcagtacaagaccgagatcaagatcggcaaggcgagcaccggctctcgcaagctcttgagcgaggagcccggggacgactgcatctcccggacccagctgctccgcacggagaccgccgagatccacgacgacaactacggcgggcccggcgacaagatcacgatctgcaacgggagcaccattgtggaccagcggctgggctccgagctgggctgctacacgatcaaccgcgtcaagagcttcaagctctgcgagaactccgccaccggcaagacctgcgagatcgacagcaccccggtcaagtgccgccagggcttctgcctgaagatcacgcaggaggggcggggccatgtgaagctgtcccgcgggagcgaggtcgtgctggacgcctgcgactccagctgcgaggtcatgatccccaagggcaccggcgacatcctcgtggactgctccgggggccagcagcacttcctgaaggacaacctgatcgacctcgggtgcccccacatccccctgctgggcaagatggccatctacatctgccggatgagcaaccacccgcgcaccaccatggcgttcctcttctggttttctttcggctacgtgataacctgcatcttctgcaaggccctgttctatagcctcatcatcatcggcacgctcggcaagaagatcaagcagtatcgggagctgaaaccccagacctgcaccatctgcgagaccgcccccgtcaacgccatcgacgcggagatgcacgacctgaactgctcctacaacatttgcccctactgcgccagccgcctcacgtccgacgggctggcacggcacgtgccgcagtgccccaagcgcaaggagaaagtggaggagaccgagctgtacctcaacctggagcggatcccctggatcgtccgcaagctgctccaggtgagcgagagcaccggcgtggccctgaagcggtccagctggctgatcgtcctcctggtgctgctcaccgtgtccctgagcccggtccagtccgcccccgtggggcacggcaagacgatagagacctaccagacccgcgagggtttcaccagcatctgcctgttcatgctcgggtccatcctgtttctggtgagctgcctcgtcaagggcctggtggactccgtgtctgactccttcttccccgggctgagcgtctgcaagacgtgcaccatcggctccatcaacgggtttgagatcgagagccacaagtgctactgctccctcttctgctgtccctactgccggcactgcagcgcggaccgcgagatccaccagctgcacctgtccatctgcaagaagcggaagaccggcagcaacgtgatgctcgccgtgtgcaagcgcatgtgcttcagagccaccatcgaggcgtcccgccgggccctgctgatccgcagcatcatcaacacgaccttcgtcatctgtatcctcaccctgaccatctgcgtggtgagcacatccgcggtcgagatggagaacctgccgagcggcacctgggaacgcgaggaggacctaaccaacttctgccaccaggagtgccaggtgaccgagacggagtgcctgtgcccctacgaggccctggtgttgcggaagcccctgttcctggactccatcgtcaaggggaccaaaaacctcctgaacagcaccagcctggagaccagcctctccatcgaggccccctggggcgccatcaacgtgcagagcacgttcaagccgaccgtgtccaccgccaacatcgcgctgagctggtccagcgtcgagcaccgtgggaacaagatcctggtgaccggccggtccgagtcgatcatgaagctcgaggagcgcacgggggtgtcctgggacctgggggtcgaggatgccagcgagtccaagctgctcaccgtgagcatcatggacctgtcccagatgtacagccccgtgttcgagtacctgtctggcgaccgtcaggtcgaggagtggcccaaggcgacctgcaccggggactgccccgagcgctgcgggtgcacctccagcacgtgcctccacaaggagtggccgcactcccggaactggcgctgcaaccccacctggtgctggggcgtggggaccgggtgtacctgctgcggtgtggacgtcaaggatctgttcaccgaccacatgttcgtgaagtggaaggtcgagtacatcaagaccgaggccatagtctgcgtggagctgaccagccaggagcggcagtgctccctcatcgaggccggcacccgcttcaacctggggccagtgacgatcaccctgagcgagccccggaacatccagcagaagctcccgcccgagattatcacgctgcaccccaaggtcgaggagggcttcttcgacctgatgcacgtgcagaaggtgctctcagcctctaccgtctgcaagctgcagtcctgcacgcacgggatccccggcgacctgcaggtttaccacatcggcaacctcctgaagggtgacagaatcaacggccacctgatccacaagatcgagccgcacttcaacaccagctggatgtcttgggacgggtgcgacctcgactattactgcaacatgggcgactggcccagctgcacctacaccggggtgacgcagcacaaccacgccgccttcgtcaacctgctcaacatcgagaccgactacaccaagaccttccatttccactccaagcgggtgacggcacacggcgacacgccccagctcgaccttaaagcgcgccccacctacggtgccggggagatcaccgtcctggtggaggtggccgacatggagctccacaccaagaaggtcgagatcagcggcctgaagttcgcctccctggcctgcaccgggtgctacgcgtgcagctccggcatcagctgcaaggtgcggatccacgtagacgagccggacgagctcaccgtccacgtgaagtccagcgaccccgacgtggtcgccgccagcacctccctgatggcccgcaagctggagttcgggacggacagcaccttcaaggccttctccgcgatgcccaagaccagcctctgcttctacatcgtggaacgggagtactgcaagtcctgcagcgaggaggacacccagaagtgtgtggacacgaagctggagcaaccccagtccatcctgatcgaacacaagggcaccatcatcggcaagcagaacgatacctgcaccgccaaagccagctgttggctcgagtccgtcaagagcttcttctacgggctgaagaacatgctgggctccgtgttcggcaactttttcatcggcatcctcctgttcctggccccgttcgtgctgctcgtcctgttcttcatgttcgggtggaagatcctgttctgcttcaagtgctgccgccggacgcgcggcctcctgaagtaccggcacctgaaggacgacgaggagaccggctaccggcgcatcatcgaacggctcaacaacaagaaggggaagaaccgcctgctggacggcgagcggctcgcggaccgcaagatcgccgaactgttcagcaccaagacccacatcgggtga

SEQ ID NO: 15238 - RNA, 5067 nt, synthetic construct
  misc_feature 1..5067: note = derived and/or modified CDS sequence (opt11) from CCHFV(Mamon)__KX013478.1__GP
  source 1..5067: mol_type = other RNA
atgccgacaaacataatgcacaccctgctcgtgtgcttcattttatacctgcaactgctgggcctcgggggcgcccacgggcaaagcaacacgaccgagcacaacggcaccaacaccacgaccgcgccctccacgagccagtccccgaagcctctggtcagcaccgcgcccccgcacgccctagagtccagcacgatcaagcccacaaccccagcttccgagaccgaggggagtggcgagaccacgcccccacccaacatcacccagggcccctccccgcccgagactactccggagcgccccgcaaccaccgccaccagcacgccctccaccgacaacaccaactccacgacgcacgtcaccgacaacaacccaacctccaccatcagcacgtcccccagctccagcccttccacccccagtaccccacaggggatccaccaccccgcgcgcaacttgctcagcgtgtcctcacccaaaaccgctacgacccccaccccgacctcccccggcgagatttcttcgaagacgagctccctgcacagcgccatgtcccgcaccagcaccctgtacaccgccacacaagtctccacggagaatgcgaaccacagcgcgccccgccagtcggaatcctccgcccaacccaccaccaccagcccaatgacgtcgcccgcccagagcatcctcgtgatgtccgccgcgcccaccgccatccagaacatccacccgagcccaaccaaccgcagcaagcggaacctggagatggagatcatcctgaccctctcccaagggttgaagaagtactacggcaagattctgaagctcctgcacctgacgcttgaggaggacaccgagggactgctggaatggtgcaagcgcaacctcggcagcaactgcgacgacgacttcttccagaagcggatcgaggagttcttcatgaccggcgaggggtacttcaacgaggtgctgcagttcaagacactgtccacgctcagccccaccgagccctcgcacgcccgcccacccaccgtcgagcccttcaagagctacttcgccaagggcttcctgtccatagacagcgggtacttctccgccaagtgctacccccggagctcaaccagcggcctgcagctgatcaacgtgacgcagcaccctgctcgcatcgccgagacccccgggcccaagaccacctctctgaagacgatcaactgtatcaacttacgagccagcgtgttcaaggagcaccgcgagatcgagatcaacgtcctcctgccccagatcgccgtgaatctgtccaactgtcacgttgtcatcaacagccatgtgtgcgactacagcctcgacaccgacgggcctgtgcggctgccccacatctaccacgagggcaccttcattcccgggacctacaagatcgtcatcgacaagaagaacaagctgaacgacaggtgcacgctcgttaccaactgcgtgataaagggccgggaggtacgcaaggggcaaagcgtgctgcggcagtacaagaccgagatcaagatcggcaaggccagcaccggctctcgcaagctgctcagcgaggagccgggagatgactgcatttcccggacgcagctgctccgcacagagaccgccgagatccacgacgacaattacggcgggccgggcgacaaaatcaccatctgcaacgggagcacgatcgtagatcagcggctcggctccgagctgggctgctacaccatcaaccgcgtcaagagctttaagctatgcgaaaacagcgctaccggcaagacctgcgagatcgatagcacgcctgtaaagtgccgccagggcttttgcctcaagatcacccaggaggggaggggccacgtgaagctgtcccgcgggagcgaggtcgtgtcagacgcctgcgacagctcctgcgaagttatgatccctaaaggcaccggcgacatcctggttgattgcagcggtggacagcagcacttcctaaaggataacctcatagacctgggctgcccccacatcccactgctcggcaagatggccatctacatctgcagaatgtccaaccacccccgcaccaccgtggccttccttttctggttcagcttcggctacgtgataacgtgcatcttttgcaaggcgctgttctacagtcttatcatcatcgggacactgggcaagaagatcaagcagtaccgggagctaaagccccagacctgcaccatctgcgagacggcccccgtgaacgcgatagacgccgaaatgcacgacctcaactgcagctacaacatctgtccgtattgcgcgtcccgcctgaccagcgacgggctggcccggcacgtgccccagtgccccaagcgcaaggagaaggtcgaggagacggagctctacctgaacctggagcggatcccgtggatcgtgcgcaaacttctccaggtgtccgagtccaccggggtcgctctgaagcgttcgagctggctgatcgtactgctggtgcttctgacggtctcgctgtcccccgtccagagcgcccccgtggggcacggcaagaccatcgagacttatcagacccgcgaaggcttcacgtccatttgcctcttcatgctggggagcatcctgttcctcgtcagctgcctggtaaagggcctagtagacagcgtgtccgacagctttttccccgggctctccgtgtgcaagacctgcagcatcggctctatcaacgggttcgaaatcgagagccacaagtgctactgctccctgttctgctgtccctattgccggcactgcagcgccgaccgcgagatccaccagctgcacctctccatctgcaagaagcggaagaccggctcaaacgtgatgttagccgtctgcaagcgcatgtgtttcagagccaccatagaggccagccgtcgggccctactcatacgctccatcatcaacactaccttcgtgatctgcatcctgaccctaaccatctgcgtggtgagcacgtccgccgtggagatggagaatctcccaagcggaacctgggaacgcgaggaggacctgaccaacttctgccaccaggagtgccaggtgacggagacggagtgtctgtgcccctacgaggcgttggtcttgcggaagcccctgtttctcgactccatagtgaaggggatgaagaacctgctgaacagcacctccttggagaccagcctgtccatcgaggccccatggggcgccatcaacgtgcaaagcaccttcaagcccacggtctccactgctaatatcgccctaagctggtccagcgtggagcaccgcgggaacaagatattagttaccggccggtccgagtcaatcatgaaattagaggagcgcaccggggtctcatgggacctgggcgtcgaagacgccagcgagtccaagctcctgacggtcagcatcatggatctgagccagatgtacagtccagtcttcgagtacctcagcggcgacagacaggtggaggaatggcccaaagctacctgcaccggggactgcccggagcggtgcggctgcacctccagcacgtgcctgcacaaggagtggccccattcccggaattggcgctgcaaccccacctggtgctggggcgtggggaccgggtgcacgtgctgcggcgtcgacgtgaaggacctgtttaccgaccacatgttcgtgaaatggaaagtcgagtacataaagaccgaggccatcgtgtgcgtggagctcaccagccaggagcggcagtgctcgctgatagaggcagggacacgattcaacctagggcccgtaaccatcacgctcagcgagccgcggaacatccagcagaagctgccgcccgagattatcactcttcaccccaaggtggaggagggcttctttgacctcatgcacgtccagaaggtcctgtccgccagcacagtgtgcaaactgcagtcctgcacccacgggatacccggggacctccaggtgtatcacataggcaacctgctgaagggggatcgcgtcaacggccacctcatccacaagattgaaccccacttcaacacgagctggatgtcctgggacgggtgtgacctcgactactactgcaacatgggcgactggccaagttgtacgtacaccggggtgacccagcacaaccacgccgccttcgtcaacctgctgaatatcgaaacggactacaccaagaccttccacttccactccaagcgggtgaccgcccacggcgacacgccacagttagatctgaaggcccgcccgacgtacggcgcgggggagatcaccgtgctcgtcgaggtggccgatatggagctgcacaccaagaaggtggagatcagcggcctgaaattcgcctccctcgcctgcacggggtgctacgcctgcagctccggcatcagctgcaaggtccggatccacgtggacgagcccgacgagctgacagtgcacgttaagtcttccgaccccgacgtggtggcggccagcacctccctaatggcccgcaagctcgagttcgggaccgacagcacgttcaaggccttttccgccatgcccaagaccagcctgtgcttctacatcgtcgagcgggagtactgcaaatcatgtagcgaggaggatacgcagaagtgcgtggacaccaagctggagcagccgcagtccatactcatcgagcacaagggcacgataatcggaaaacagaacgacacgtgtaccgcgaaaaccagctgctggctggagagtgtcaagagcttcttctacgggctgaaaaacatgctcggctctgtgttcgggaacttctttatcggaatattgctctttctcgccccctttgtgctgctagtgctgttcttcatgttcgggtggaagatcctcttttgtttcaagtgctgcaggcggacacgcggcctgctgaaatacagacacctcaaggacgacgaagagactggctaccgccgcatcattgagcggctgaacaacaagaagggaaagaatcgccttttagacggcgagcgactggccgacagaaagattgccgagctgttcagcaccaagacccacatagggtga

SEQ ID NO: 15239 - RNA, 5067 nt, synthetic construct
  misc_feature 1..5067: note = derived and/or modified CDS sequence (opt11) from CCHFV(K340_6)__KX013475.1__GP
  source 1..5067: mol_type = other RNA
atgcccatcaacatcatgcacaccctgctcgtctgcttcatcttgtacctgcagttaagcggcttagggggcgctcacgtccaatccaacgcgactgagcataacgggacgaacaccaccactgcgccgggcactagccagtcccccaagccgcccgccagcaccactctgccacacacccccgagtccagcaccgttaagcccacgacccccacctccgaaactgaggggagcggcgagaccaccccgccgcctaataccacccagggcctcccgcccaccggtaccacgcctgagcgcagcgcaacgaccgccaccagcacctcctccacggacaatatgaactccaccacccaggtgaccgacagcacgcccacttccacggtcagcacctcccccagctcctcgagttccatgcccagcacgtcccagggcatccaccatcccgtacgaagcctgctgtccgtgagctcccccaagaccgtcaccacccccacgccgatgagcccgggggagatgtcccctgagaccagctcccagcacagcgccatgtcccgtgtgcccaccctctataccgcgactcaggtgagcacggagaacaccgaccggtccacccctcgacagagcgagtccagcgtccagccagccacccagtcacctattactagcccagcccagacgatcctgctgatgagcgccgcgccgaaggccatccaggacatgcacccctcccccaccaatcggagcaaacgcaatctggaggtggagatcatcctgaccctgagtcagggcctcaagaagtactacgggaagatcctgaagctgctccacctgacactggaggaggacacggagggcctgttagagtggtgcaaacggaacctgggcagcaactgcgacgacgacttcttccagaagcgcatcgaggagtttttcatcaccggggagggctacttcaacgaggttctccagttcaaaaccctgtccacgctgagcccgacggagccctcccacgttcggctccccaccgccgagcccttcaagagctacttcgccaaggggttcctgtctatcgacagcggctacttctccgccaaatgctacccgcgctcatccaccagcggcctccagctcatcaacgtgacacagcaccccgcgcggatcgcagagacccctgggcccaagaccacctccctaaagaccatcaactgcatcaacctgcgtgcctcagtgtttaaggagcaccgggaggtcgagatcaacgtgctcctgccacagattgccgtgaacctgtccaactgccacgtcgtgatcaacagccacgtgtgcgactactcactcgataccgacggccccgtcagactgccccggatccaccacgagggaaccttcattcccggcacttacaagatagttatagaccgcaagaacaagttgaatgaccggtgctccctcgtgacaaactgtgtcatcaaggggcgcgaggtacggaagggccagagcgtcctgcgccagtacaagaccgagataaagatcggcaaggcctccaccgggagccggaaactgctctccgaggagcctggcgacgattgcattagccgcacacagctgctgaagacggaaaccgcggagatccacgacgacaactacgggggccccggggacaagatcaccatttgcaacggctccaccatcgtggaccagcgcctcggctctgagctggggtgctacacaatcaaccgggtgaagtccttcaagctgtgcgagaacagcaccacaggcaagacctgcgagatcgactccacgccagtcaagtgccgccaggggttctgcctcaagatcacccaggagggcagggggcacgttaagctcagccgcggctcagaggtggtcctggatgcctgcgacagctcctgcgagatcatgatccccaaaggcaccggggacatcctggtggattgcagcggcgggcagcagcacttcctcaaggacaatctgatcgacctaggctgcccgcacatcccacccctcggtaagatggccatctacatctgcaggatgtccaaccacccacgcaccaccatggcctttctgttctggttcagcttcgggtacgtgatcacgtgcatcttctgcaaggctctgttctactccttaatcataatcggcaccctggggaagaagataaagcagtaccgggagctgaagccccagacctgcacgatctgcgagacggcgccggtcaacgcgatcgatgccgagatgcacgacctcaactgcagctacaatatctgtccctattgcgccagccgcttaacctccgacggcctggcccggcacgttacccagtgcccaaagcgcaaagagaaagtggaggagaccgaactctacctgaacctggagcggatcccgtggatcgtccgcaagctcctccaggtgagcgagtccacgggggtggccctgaagcggagctcctggctgatagtcttgctggtgctcctaaccgtgagcctgtcccccgtccagagcgcccccgtgggccacggcaagacaatcgaaacttaccagacgcgcgaaggattcacctccatctgcctcttcatgttaggctctatccttttcatcgtgagttgcctagtcaaggggcttgtggacagcgtgtccgatagctttttcccaggcctgtcggtctgcaaaacatgcagcatcgggtccatcaacggcttcgagatcgagagccacaagtgctactgctctctcttctgctgcccctactgccggcattgtagcgccgaccgcgagatccaccagctgcacctgagcatttgcaagaagcggaaaaccggctccaacgtcatgctcgccgtatgcaagcgcatgtgcttcaaggcgacgatcgaggccagccggcgtgcccttctgatccgatccatcatcaacactaccttcgtcatgtgcatcctcaccctggccatctgcgtagtcagcacttcggccgtcgagatggaggacctacccgctggtacctgggagcgggaggaggacctcaccaacttctgccaccaagagtgccaggtgaccgagacggagtgcctttgcccgtatgaggccctggtactccgcaagccgctgtctctggacagcatcgtcaagggcatgaagaacctcctgaactcaacctccctggagacgtctctttccatcgaggccccatggggcgccatcaacgtgcagagcaccttcaagcccacggtgtccaccgccaacatcgcgctgagctggtctagcgtcgaacacagggggaacaagatcctggtgaccggtcgctccgagagcatcatgaagctcgaggagcggaccggcgtgtcctgggatttaggcgtcgaggacgcctcggaaagcaagctgctcacggtgtccatcatggacctgagccagatgtactcccccgtgttcgagtaccttagcggggaccgtcaggtagaggagtggccgaaggcgacctgcaccggcgactgccccgagcgctgcgggtgcacctccagcacgtgcctccacaaggagtggccccactcccgcaactggcggtgtaaccccacctggtgctggggcgtggggactggctgcacgtgctgcggcgtggacgtcaaggacctgttcaccgaccacatgttcatcaagtggaaggttgagtatatcaagacggaggccattgtgtgcgtcgagctcactagccaagagcgccagtgctccctcatcgaagccgggacccggttcaacctcggcccggtgaccatcaccctgagcgagccccgtaacatccagcagaaacttcctcccgagatcatcaccttacacccaaagatcgaggagggcttcttcgacctgatgcacgtgcagaaggtcctctccgccagcaccgtgtgcaagctgcagtcgtgcacccacggcatccccggcgacctgcagatctaccacatcgggaacctcctgaagggcgaccgtgtcaacgggcacctgatccacaagatcgagccccacttcaacacgagctggatgtcctgggacggctgcgacctcgactactactgcaacatgggtgactggccgagctgcacctacaccggtgtcacccagcacaaccacgcggcctttgtgaacctgctgaacatagagacggactacaccaagaccttccacttccactccaagcgcgtaaccgcacacggcgacacgccgcagctagacctgaaggcgaggcccacttacggggccggcgagataaccgtgctggttgaggtcaccgacatggagctccacacgaagaaggtggagatctccggcctgaagttcgcctccctgacctgcacgggatgttatgcctgcagcagcgggatatcctgcaaagtgcgcatccacgtcgacgagcccgacgagctaaccgtgcacgtcaagagctccgatcccgacgtggtggccgcgagcacgtccctgatggcccggaagctggagtttggcaccgacagcacgttcaaggccttctccgccatgcctaaaacctcactctgcttctatatcgtggagcgcgagtactgcaagagctgcagcgaggacgacacgaagaagtgcgtcgacaccaagctggaacagccccagtccatcctcatagagcacaagggcaccatcatagggaagcagaacgacacgtgcaccgccaaggcttcatgctggctcgagtccgtcaagagcttcttctacggcctcaagaacatgctggggtccgtgttcggctctttcttcgtggggatcctcctgttcctggcccccttcgtgctccttgttcttttcttcatgttcggctggaagatcctgttctgcttcaagtgctgccggcgcacaagaggcctcttcaagtaccgccacttcaaggacgacgaggaaaccggctaccgccggatcatcgagcgccttaactccaaaaagggaaagaaccggttactcgacggggagcgcctggccgatcggaagatcgccgagctgttcagcaccaagacacacatcggttga

SEQ ID NO: 15240 - RNA, 5067 nt, synthetic construct
  misc_feature 1..5067: note = derived and/or modified CDS sequence (opt11) from CCHFV(K323_27)__KX013472.1__GP
  source 1..5067: mol_type = other RNA
atgcccataaacatcatgcacacgctgctcgtgtgcttcatcttatacctgcagctcagcggcctcgggggcgcccacgggcagtccaacgccaccgagcacaacggcacgaacaccaccaccgtcccggggacttcccagtctcccaagccacccgcgagcaccaccctgccccacacccccgaatccagcacggtgaagctcaccacccccacttccgagacggaaggcagcggcgagaccacgcccccgcccaacaccacacagggactgcccctgcccggcaccaccccggagcgctccgccaccacggccaccagcacctccagcaccgacaacatgaactccactacccaggtgacagacaacacccccacgagcactgtctccattagcccctccagctcccccagcatgcccagcacctcccaggggatccaccaccccgtgcggagcctcctgtccgtgagctcccccaagaccgtcacgacccccaccccgatgagccccggcgagatgtcgcccgagaccagctcccagcacagcgccatgagccgcatccccacgctgtacaccgccacccaggtgagcaccgagaacaccgaccggtccacgccacgccagagcgagtcctccgtgcagcccgcgacacagtcccccatcacgagccccgcccagaccatcctcctgatgtccgcggccccgaaggcgatccaggacatgcatccgagccctacgaaccggtccaagcgcaacttggaggtcgaaatcatcctgaccctgtcacaggggctgaagaagtactatggaaagattctcaagctgctgcacctcaccctggaggaggataccgagggcttgctcgaatggtgcaagcggaacctggggagcaactgcgacgacgacttcttccagaagcgcatcgaggagttcttcatcacgggcgaggggtatttcaacgaggtgctgcagttcaagaccctctccaccctgagcccgaccgagagctcgcacgtgcggctgcccacggcagagcccttcaagtcctacttcgccaagggcttcctaagcatcgactccggttacttcagcgccaagtgctacccccgctccagcacctccggcctgcagctgattaacgtcacgcagcacccggcccggatcgcggagactcccggccccaagacgaccagcctcaagaccatcaactgcatcaacctgcgcgcgtccgtgttcaaggagcaccgggaggtggaaatcaacgtgctgctcccccaaatcgcggtgaacctgagcaactgccacgtggtcatctccagccacgtgtgcgactactctctcgacaccgacggaccggtgcgcctcccccggatccaccacgagggcaccttcatccccgggacctacaagatcgtcatcgaccgcaaggacaagctgaatgaccggtgctcgctggtgaccaactgcgtaatcaagggacgcgaggtccggaaggggcagtccgtgctccgccagtacaagaccgagatcaagatagggaaggcctctacgggcagccggaaacttctgtccgaggagccaggggacgactgcatcagccgcacccagctcctgaagaccgaaaccgccgagatccacgacgacaattatggcggtccgggcgacaagatcacgatctgcaacggctccaccatcgtggaccagcgcctcgggagcgagctcggctgctacaccatcaaccgggtgaagtccttcaagctgtgcgagaatagcgcgactgggaagacgtgcgagatagactccacccccgtgaagtgccgccagggcttctgcctgaagatcacgcaggaggggcggggacacgtcaaacttagcaggggctcggaggtggtccttgacgcctgcgacagctcctgcgagatcatgatccccaagggcaccggcgacatcctggtcgactgctccgggggccagcagcacttcctgaaggacaacctcatcgacctggggtgtccccacatcccgctgctcgggaagatggccatttatatctgccggatgtccaaccacccccgcacgaccatggccttcctgttctggttcagcttcggctacgtgatcacgtgcatattctgcaaggcactgttctacctcctgattataatcgggaccctggggaagaagatcaagcagtaccgggagctcaagccccaaacctgcaccatctgcgagaccgcgcccgtgaacgccatcgacgccgaaatgcacgacctgaactgctcctacaacatctgcccgtactgcgcctcccgcctgaccagcgatgggctggcccggcacgtcactcagtgtcccaagcgcaaggagaaggtggaggagacggagctgtacctgaacctcgaacggatcccctggatcgtgcgcaagctgctgcaggtctccgagagcaccggcgtggcgctcaagcggtccagctggctgactgtgctcttggtcctgctgaccgtgtccctcagccctgtgcagtccgccccggtcggccacgggaacacgatcgagacttaccagaccagagagggctttaccagcatctgcctgttcatgttggggtcaatcctcttcatcgtgagctgcttggtgaagggcctggtcgactccgtgagcgactccttcttccccgggctcagcgtgtgcaagacgtgctccatcggctctatcaacggctttgagatcgagtcccacaagtgctactgcagcctgttctgctgtccccactgccggcaccgctccgcagaccgggagatacaccagctgcacctcagcatctgcaagaagcgcaagacggggagcaacgtcatgctggcagtatgcaagcgaatgtgcccgaaagcgaccatcgaggcctcccgtcgtgcccttcccatccggagcatcataaacacaacgcttgtcatgtgtatcttgaccctggccatctgcgtcgtgtccaccagcgccgttgagatggaagacctccccgcgggcacctgggagcgcgaggaggacctgacgaacttctgccaccaggagtgccaggtcaccgagaccgagtgcctgtgtccatacgaggccctggtgttacggaagccgctgttcctcgactccatcgccaaggggatgaagaatctgctgaacagcaccagtctcgagacgagcctgtccatcgaggcgccctggggtgccatcaacgtgcagagcaccttcaagccaacagtctccaccgcgaacatcgcgctgtcttggtccagcgtggagcaccgcgggaacaagatcttagtaacgggccggtccgagtccatcatgaagctcgaggaacgcaccggcgtctcctgggacctgggggtggaggacgcatctgagagtaagctcctaaccgtgagcatcatggacctgagccagatgtactcccccgtcttcgagtacctcagcggcgaccgccaggttgaggagtggccgaaggcgacctgcacgggggactgcccagagcggtgcggctgcacctccagcacgtgcctgcacaaggagtggccccactcccggaactggcgctgcaacccaacctggtgctggggcgtagggaccggctgcacgtgctgcggggtcgacgtgaaggacctgttcaccgaccacatgttcatcaagtggaaggtggagtacatcaagactgaggcaatcgtctgcgtggagctcaccggccaggagagacagtgcagcctcatcgaggccgggacccgctttaacttaggcccggtgaccatcacactctccgagccccgtaacatccagcaaaagctgccgccggagatcataaccctgcaccccaagatcgaggaaggcttcttcgacctgatgcacgtccagaaggtgctgagcgcgtccaccgtgtgcaagctgcagagctgcacccacggaatccccggcgacctccagatctaccacattgggaacctgctgaagggagaccgcgtcaacgggcacctcatccacaagatcgagccccacttcaacacatcctggatgagctgggacggttgcgacctggactactactgtaacatgggcgactggccctcctgcacctacacgggtgtgacccagcacaaccacgccgcctttgtcaacctgctcaacatcgagaccgactataccaagacgttccacttccacagcaagcgggtgaccgcgcacggcgataccccgcagctggacctgaaggcccgccctacctacggggccggcgagatcacggtgctcgtcgaggtggccgacatggagctgcacaccaagaaggtggagatctccgggctgaagtttgccagcctgacctgcaccggctgttatgcgtgctccagcggcatctcctgcaaggtccggatccacgtggacgagcctgacgagctgacggtgcacgtaaagagcagcgaccccgacgtggtggccgcctccaccagcctgatggcccgcaagctcgagttcgggaccgactccactttcaaagccttcagcgcgatgccgaagacgtccctgtgcttctacatcgtcgaacgggagtactgcaagagctgctccgaggacgacactaagaagtgtgtggacacaaagctggagcagccacagagcattctcatcgagcacaagggcaccatcatcgggaagcagaacgacacgtgcaccgccaaggcgtcctgctggctggagtccgtgaagtccttcttctacggcctgaaaaacatgctcgggagcgtctttggctccttcttcgtgggtatcctgctgttcttagcccccttcgtgctcctggtactgttcttcatgttcgggtggaagatcctcttctgcttcaagtgctgccgccgaacgagaggcctgttcaagtaccgccacctgaacgacgacgaggagaccggttacaggcgcatcatcgagcggctcaacagcaagaagggcaagaaccgcctcctggacggcgagcggctcgcagatcgcaagatcgcggagctgttcagtacgaagacccacatcgggtga

SEQ ID NO: 15241 - RNA, 5067 nt, synthetic construct
  misc_feature 1..5067: note = derived and/or modified CDS sequence (opt11) from CCHFV(K315_14)__KX013469.1__GP
  source 1..5067: mol_type = other RNA
atgcccttcaacataatgcacaccctgctcgtgtgcttcatcctgtacctgcagctgtcaggcctgggcggcgcccacggtcaatccaacgagaccgagcacaacggcacgaacactacgacggttccggggactagccaatcccccaaaccacccgccagcaccaccctgcagcacactccggagtccagcacggtcaagctgaccacccccacctccgagacggagggcagcggcgaaaccaccccgccgcccaatacgacgcaggggctgccccctcccggcaccacccccgagcgctcagcgaccacggccacctccacctccagcaccgacaacatgaactccacgacacaggtgaccgacaatacccccacaagcaccgtctccataagcccctccagctcccccagcatgcccagtacctcccaggggatccactaccccatccggtctctgctcagcgtgagctcgcccaagaccgtgacgacccccactccgatcagccccggtgaaatgtcccccgagaccagctcccagcacagcgccatgtcccgcatccctacgctgtacaccgccacccaggtcagcaccgagaacaccaaccggtccacgccgcgccagagcgagtccagcgtgcaacccgccacccagtcccccatcaccagccccgcacagaccatcctcctgatgtccgccgccccgaaggccatccaggatatgcacccctcgcccacgaaccggagcaagcgcaacctggaggtggagatcatcctaaccctatcccaggggctgaagaagtactacggcaagatactgaagctcctgcacctgaccctcgaggaggacactgagggactgctggagtggtgcaagcggaacttagggagcaactgcgacgacgacttcttccagaagcgcatcgaggagttcttcatcacgggcgaagggtatttcaacgaggttttgcagttcaaaacattgtcgaccctcagcccgaccgagcccagccacgtccggctacccacggcggagcccttcaagtcatacttcgccaagggcttcctatcaatcgacagcggctacttctccgccaagtgctacccccgcagctccactagcgggctccagctcatcaacgtgacccagcaccccgccagaatcgcagagacccccggccccaagacaacctccctgaagaccatcaactgcatcaatttacgcgcgagcgtgttcaaggagcaccgggaggtggagatcaacgtgctgctgccgcagatcgccgtcaacctctccaactgccacgtggtgatcaacagccacgtctgcgactactcactggataccgacgggcctgtgcgcctgccccggatccatcacgagggcaccttcattcctgggacctacaaaatcgtcatcgacaaaaagaacaagctcaacgaccgttgcagcctggttacgaactgcgtgatcaagggccgagaggtgcgcaagggccagagcgtcctaaggcagtacaaaaccgagatccgcatcggcaaggcctccacggggagccggaagctcctgtccgaggagccgggggacgactgcatcagccgcacccagctgctgaagaccgagaccgccgagatccacgacgacaactatggcgggcccggcgacaagatcaccatctgcaacggctccacggtggtcgaccagcgcctggggagcgagctgggctgctacacaatcaaccgggtgaagagtttcaagctctgtaagaacagcgccaccgggaagacatgcgagatcgactccacccctgttaagtgccggcagggcttctgcctgaagatcacccaagaggggaggggccacgtcaagctgagccgtggctccgaggtagtgctggacgtctgcgacagctcctgcgagatcatgatcccgaaagggaccggcgacatcttagtggactgcagcgggggccagcagcacttcctcaaggacaacctgatcgacctcggctgcccgcatatccccctgttagggaagatggcgatctacatctgccggatgtccaaccacccacgcacgaccatggccttcctcttctggttcagcttcggctacgtgataacctgcatcttctgcaaagctctgttctattccctaatcatcatcgggacactcgggaagaagatcaagcaataccgggagttaaagccccagacctgcacgatctgcgagacagccccggtaaatgccatcgacgctgagatgcacgacctgaactgctcgtacaacatctgtccctactgcgccagccgcttgaccagcgaggggctggcgcggcacgtgacccagtgcccgaagcgcaaggaaaaggtggaggagacggagttgtacctcaacctggaacggatcccctggatcgtgcgcaagttgctccaggtgagcgagtccaccggcgtggccctgaagcggagctcctggctgatcgtcctcctggtgctgttaaccgtcagcctgtcccccgtccagagcgccccagtgggccacggtaagaccatcgagacgtaccaaacccgcgaaggcttcacgtccatctgcctgttcatgctgggaagcattctgttcatcgtgtcctgcctggtaaagggcctcgtgtacagcgtatccgacagcttcttcccagggctttccgtttgtaagacctgctcaataggctccatcaacggcttcgagatcgaaagccataagtgctactgttccctgttctgctgcccgtactgccggcactgcagcgcggaccgagaaatccaccagctccacctgtccatctgcaagaagcggaagacgggtagcaacgtgatgctggccgtgtgcaagaggatgtgcttcaaagccaccatcgaggccagccggagagctctcctgatccgcagtatcatcaacaccaccttcgtgatctgcatcctgacgctcgccatctgcgtagtgagtacctccgcggtcgagatggaggacctgccagccgggacctgggagcgggaggaggacctgaccaacttctgccaccaggagtgccaggtgacggagaccgaatgcctatgcccctacgaggcactggtgctgcgcaagcccctcttcctggacagcatcgtcaaggggatgaagaaactgctgaacagcaccagcctggagacatccctgagcattgaggcaccgtggggagccatcaatgtgcagtccacctttaagcccactgtaagcaccgccaacatcgctctctcctggagctccgtcgagcaccgggggaataagatcctggtaacgggccgtagcgagagcatcatgaagctggaggaacggacgggcgtgagctgggacctcggggtcgaggacgcctccgagtcgaagctgctgaccgtgtcaatcatggacctaagccagatgtatagccctgtgtttgaatacttgtccggcgaccgccaggtcgaggagtggcccaaggcgacttgtaccggggactgcccggagcggtgtggctgtacgagcagtacctgtctgcacaaggagtggccccactcccgcaattggagatgcaatcccacttggtgctggggtgtgggcaccggctgcacgtgttgcggggtggacgtcaaggacctcttcaccgaccacatgtttatcaagtggaaggtggagtacatcaagaccgaggccatcgtttgcgtcgagctcacctcccaggagcgccagtgctcgctgatcgaggccggcacccggtttaacctcgggcccgtgacgatcaccctgtccgagccgcgcaacatccagcagaagctgccgcccgagatcatcaccctccaccctaagatcgaggaagggttcttcgacctgatgcacgtgcagaaggttttgagcgccagcaccgtgtgcaagctccagagctgtacacacggcattccgggggacctgcagatctaccacatcggcaacctgctcaagggggatcgggtgaacggccacctgatccataagatcgagccccacttcaacaccagctggatgagctgggacgggtgtgacctagactactactgtaacatgggcgactggcccagctgcacttataccggcgtgacgcagcacaaccacgccgcattcgtgaacctcctgaacatcgagacagactacaccaagaccttccactttcactctaagcgcgtcacggctcacggtgataccccgcagctggacctcaaggccaggccgacatacggcgcaggggagatcaccgtgctggttgaggtcgcagacatggagctgcacacgaagaaagtggagattagtggcttgaagttcgccagcttaacctgcactggatgctacgcctgtagtagcggcatctcctgcaaggtgcgcatccatgtcgacgagcccgatgagcttacggtgcacgtgaagtccagcgatcccgacgtcgtcgctgccagtacgagcctcatggcgcggaaactggagttcggcactgattccaccttcaaggccttcagcgccatgccaaagacctccctgtgcttctacatcgtggagcgcgagtactgcaagagctgcagcgaggacgacacgaagaagtgcgtcgacacaaagctcgagcagccgcagagtattctgatcgagcacaaggggaccatcatcggtaaacaaaacgatacctgtacggccaaggcctcctgctggctcgagagcgtgaagtcctttttctacgggctcaaaaatatgctgggcagtgtgtttgggtcctttttcgttggcatccttctcttcctggctcctttcgtgctgctggtcctcttcttcatgttcggctggaagatcctattctgcttcaaatgctgcaggcgcacccgggggctgttcaagtatcgccaccttaaggacgacgaggaaacaggctatcgccgaattattgagcgactgaacagcaagaaggggaaaaaccgccttctcgacggcgagcgccttgctgaccgaaagatcgccgagctgttctccaccaagacgcacatcggctga

SEQ ID NO: 15242 - RNA, 5067 nt, synthetic construct
  misc_feature 1..5067: note = derived and/or modified CDS sequence (opt11) from CCHFV(K229_243)__KX013466.1__GP
  source 1..5067: mol_type = other RNA
atgcccacaaacatcatgcacaccctgctcgtttgcttcatcctgtacctgcagctcctgggcctcggcggggcccaggggcagagcaacgccaccgagcacaacgagaccaacaccaccaccgccccctccaccagccagtcccccaagccgccggtgagcaccaccccgccgcacgcactcgagtccagcacgatcaagcccaccacccccgcccgcgagaccgaggggtccggggagaccacgccgccgcccaacaccacccagggccccagcccgcccgaggccacccccgagcggcccgccaccaccgcgacctccacgcccagcaccgacaacaccaactccaccacgcacgtgaccgacaacaaccccacaagcaccatctccacgagcccctccagctcccccagcacccccttcacgccccagggcatccaccaccccgcccgcaatctgctgtccgtaagcagccccaagaccgcgacgacaccgacccccaccagccccagagagctcagctccgagacgagctccttacacagcgccatctcccgcaccagcaccctgtacaccgcgacccaggtgtccacggagaacgccaaccactcagcgccccggcagtccgaaagctctgcccagccgaccaccaccagccccatgacttcccccgcccagagcatcctcgtgatgtccgccgccccgaccgccatccagaacatccaccccagccccaccaaccgctccaagcggaacctggagatggagatcatcctgaccctcagccaggggctgaagaagtactacggcaagatcctgaagctcctgcacctgacgctcgaggaggacaccgaagggctgctggagtggtgcaagcgcaacctcggcagcaactgcgacgacgacttcttccagaagcggatcgaggagttcttcatgacaggtgagggctacttcaacgaagtgcttcagttcaagaccctgtccacgctcagccccaccgagccgtcccacgcccggccgcccgccgtcgagcccttcaagagctacttcgcgaagggcttcctgagcatcgactcgggttacttctccgccaagtgctacccgcggagctccacaagcggcctgcagctcatcaatgtgacccagcaccccgcccggatcgcagagacgcccgggcccaagaccacctccctgaagaccatcaactgtatcaacctgcgggccagcgtgtttaaggagcaccgcgagatcgagatcaacgtcctcctgcctcagatcgcggtgaacctgtcaaactgccacgtggtcatcaacagccacgtgtgcgactactcccttgacacggacggccccgtgcggctaccccacatctaccacgagggcaccttcatccccgggacctacaagatcgttatcgacaagaagaacaagctgaacgaccgctgcaccctcgtgacgaactgcgttatcaagggccgggaggtccgcaaggggcagagcgtgctgcggcagtacaagaccgagatcaagatcggcaaggcctcaaccgggagccgcaagctgctcagcgaggagccgggcgacgactgcatctcccggacccagctgctgcgcacggagaccgccgagatccacgacgacaactacggcgggcccggcgacaaaatcaccatttgcaatgggagcaccatcgtggaccagcgcctcggctccgagctgggatgctacacgatcaaccgggtcaagagcttcaagctgtgcgagaactccgcaaccggcaagacctgcgagatcgacagcacccccgtgaagtgccgccagggcttctgcctcaagatcacgcaggaggggcggggccacgtgaagctgtcccgcgggagcgaggtcgtgctggacgcctgcgactccagctgtgaggtcatgatccccaagggcaccggggacatcctggtggactgctccggcggccagcagcacttcctcaaggacaacctgatcgacctggggtgcccgcacatccccctcctgggcaagatggcgatctacatctgcaggatgagtaaccacccccgcacgaccatggccttcctgttctggttctccttcgggtatgtgattacctgcatcttctgtaaggccctcttctacagcctgatcatcatcggcacgctgggtaagaagatcaagcagtaccgggagctcaagccccagacctgcacaatctgcgagaccgccccggtcaacgcgatcgacgccgagatgcacgacctgaactgctcctacaacatctgcccctactgcgccagccgcctgacgtccgacgggctcgcccggcacgtgccccagtgcccgaagcgcaaggagaaggtggaggagaccgagctgtacctgaatctcgagcggatcccctggatcgtgcgcaagctgctccaggtgagcgagtccaccggcgtggccctcaagcggagcagctggctgatcgtcttgctcgtgctgctcaccgtctccctctcgcccgtccagtccgcgcccgtggggcacggcaagacgatcgagacctaccagacccgcgaggggttcaccagcatctgtttgttcatgctgggctccatcctcttcctggtgagctgcctggtcaagggcctcgtggactccgttagcgactccttcttcccggggctgagcgtctgcaagacgtgctccatcggtagcatcaacgggttcgagatcgagtcccacaagtgctactgcagcctgttctgctgcccctactgccggcactgctccgccgatcgcgagatccaccagctccacctgagcatctgcaagaagcggaagaccggctccaacgtgatgctggccgtgtgcaagcgcatgtgcttccgggcgaccatcgaggccagccgccgcgcgctcctgatccggtccatcatcaacaccaccttcgtcatctgcatcctgaccctcaccatctgcgtggtgagcaccagcgccgtcgagatggagaacctgcccgccgggacgtgggagcgcgaggaggacctgaccaacttctgccaccaggagtgccaggtgaccgagaccgagtgcctctgcccctacgaggccctggtgctgcggaagcccctgttcctggactccatcgtcaagggcatgaagaacctgctcaacagcacgtccctggagaccagcctgtccatcgaggccccctggggcgcgatcaacgtgcagtctaccttcaagcccaccgtgtccacggccaacatcgccctcagctggtccagcgtcgagcaccgcgggaacaagatcctggtgaccggccggtccgagagcatcatgaagctggaggagcgcaccggggtgtcctgggacctcggcgtcgaggacgccagcgagtccaagttgctgaccgtgagcatcatggacctctcccagatgtacagccccgtgttcgagtacctgtccggggaccggcaggtcgaggagtggccgaaggcgacgtgcaccggcgactgccccgagcgctgcggctgcacgagctccacgtgcctgcacaaggagtggccccactcccggaactggcgctgcaaccccacatggtgctggggcgtgggcaccgggtgcacgtgctgcggcgtggacgtcaaagacctcttcaccgaccacatgttcgtaaagtggaaggtggagtacatcaagaccgaggccatcgtctgcgtggagctgacgagccaggagcggcagtgctccctgatcgaggccgggacccgcttcaacctcggcccggtgaccatcaccctgagcgagccccggaacatccagcagaagctgccgcccgagataattacgctccacccgaaggtagaggagggcttcttcgacctgatgcacgtgcaaaaggtgctgtccgccagcaccgtctgcaagctccagtcctgcacccacgggatccccggtgacctccaagtctaccatatagggaacctgctcaagggcgaccgcgtgaacggccatctgatccacaagatcgagccccacttcaacaccagctggatgtcgtgggacgggtgcgacctggactactactgtaacatgggcgactggcccagctgcacgtacaccggggtcacccagcacaaccacgccgcgttcgtgaacctcctgaacatagaaaccgactacacgaagaccttccacttccactccaagcgggtcaccgcccacggcgacaccccgcagctggacctcaaggcccgccccacgtacggggccggcgagatcaccgtgctggtggaggtcgccgacatggagctgcacaccaagaaggtggagatcagcggcctcaagttcgcgtcactggcctgcaccgggtgctacgcctgcagctccggcatcagctgcaaggtgcggatccacgtcgacgagcccgacgagctgacggtgcacgtgaagtcctctgaccctgacgtcgtggccgcctccaccagcctcatggcgcgcaagctggagttcggcaccgatagcaccttcaaggccttctccgccatgccgaagacgagcctgtgcttctatatagtggagaaggagtactgcaagtcctgcagcgaggaggacactcagaagtgcgtcgacaccaagctcgagcagccccagtccatcctgattgagcacaagggcaccatcatcgggaagcagaacgatacgtgcaccgccaaggcgagctgctggctggagtccgtcaagagctttttctacggcctcaagaacatgctaggctccgtgttcgggaacttcttcatcggcatcctccttttcctaacccccttcgtcctgctggtcctgttcttcatgttcgggtggaagatcctgttctgcttcaagtgctgccggcgcacccggggcctgctcaagtaccgccacctgaaggacgacgaggagacggggtaccgccggatcatcgagcgcctgaacaacaagaagggcaagaaccggctcctggacggcgagcgccttgccgaccggaagatcgccgagctgttcagcaccaagacccacatcgggtga

SEQ ID NO: 15243 - RNA, 5067 nt, synthetic construct
  misc_feature 1..5067: note = derived and/or modified CDS sequence (opt11) from CCHFV(K229_194)__KX013463.1__GP
  source 1..5067: mol_type = other RNA
atgcccatcaacatcatgcacaccctgctcgtgtgcttcatcctgtacctacagctcagcggcctcggcggggcccacgggcagtccaacgccaccgagcacaacgggacgaacaccaccaccgtcccgggcacgagccagtcccccaagccgcccgcgagcaccaccctgccccacacccccgagtccagcactgtgaagctgaccacccccacttccgagacggagggctcaggcgagaccacgcccccgcccaacacgacccagggcctgcccccgcccggtaccacccccgagcgccccgccaccacggccacctccaccagctccaccgataatatgaactcaacgacccaggtgaccgacaatacccccattagtacggtcagcatctccccgagctccagcccttccatgcccagcaccagccaagggatccactaccccgtgcggtccctactcagcgtgtccagcccgaagaccgtcaccacccccacccccatgtcccccggcgagatgagcccggagacctccagccagcactccgccatgagccgcatccccaccctgtacacggccacccaggtgtccaccgagaacaccaaccggagcacgccccgccagtccgagtcgtccgcgcagcccgccacccaatcaccgaccacctccccgacccaaacgatcctgctcatgagcgccgcccccaaggcgatccaagacatgcacccgtcccccaccaaccggagcaagcgcaacctggaagtggagatcattctgaccctcagtcaggggctgaagaagtactacggcaagatcctgaagctcctgcacctgaccctcgaggaggacacggagggcctgctggagtggtgcaagcggaacctaggctccaactgcgacgacgacttcttccagaagcgcatagaggagttcttcatcaccggcgaggggtacttcaacgaggtcctgcagttcaagacactgaacaccctcagccccacggagccctcacatgtgcggctgccgaccgccgagcccttcaagtcgtacttcgccaaggggttcctgtccgtggacagcggctacttctccgccaagtgctacccccgcagctccaccagcgggctccagttgataaacgtcactcagcaccctgcccggatcgcggagaccccgggtcccaaaaccacctccctgaagaccatcaattgcatcaacctccgcgccagcgtattcaaggagcaccgggaggtcgagatcaacgtcctgctgccccagatcgccgtgaacctctccaactgccacgtggtcattaacagccacgtgtgcgactactccctggacacggacgggcccgtgcgcctgccgcggatccaccacgagggcaccttcatccccggtacctacaagatcgtcatcgacaagaaaaacaagctcaacgaccgctgcagcctggtgaccaactgcgtgataaagggtcgggaggtccgcaagggccagtccgtgctgcggcagtacaagacggaaattaagatcgggaaagccagcaccggctcacgcaagctcctgtccgaggagcccggagacgactgcatcagccggacccagcttctcaagaccgaaacggccgaaatccacgatgacaactacggcgggcccggcgataagatcaccatctgcaacggttccaccattgtcgaccagcgcctggggagcgagctgggctgctacaccatcaaccgcgtgaagtccttcaagctctgcgagaacagcgcgacggggaagacatgcgagatcgactccacccccgtaaagtgcaggcagggcttctgcctgaagatcacccaagaggggcgcgggcacgtaaagctgagccggggctccgaggtggtgctggacgcctgcgacagctcctgcgagatcatgatccccaaggggacgggcgatatcctcgtcgactgctctgggggccagcagcacttcctgaagggcaacctgatcgacctcgggtgcccccacatccccctgctgggcaaaatggccatctacatctgccgcatgagtaaccacccgcggaccaccatggcattcttattttggttcagcttcgggtacgttatcacgtgcatcttctgcaaggccctgttctactccctgatcatcatcggcaccctcgggaagaagatcaagcagtaccgcgagctgaagccccaaacctgcaccatctgcgagacagcgccagtgaacgccatcgacgccgagatgcacgacctaaactgcagctacaacatctgcccctactgtgcttcccggctcaccagcgacggcctggcccgccacgtcacgcagtgcccgaaacggaaggagaaggtggaagagaccgagctgtatctcaacctggagcgcatcccctggatcgtgcggaagctgctccaggtctccgagtcaacaggcgtggcgctgaagcggtcttcctggttaatcgtgctcctggtcctgctcaccgtgtcgctgtcccccgtgcagagcgccccggtggggcacggcaagacgatcgaaacctaccagacgcgcgaggggttcaccaacatctgcctgttcatgctcggctccatcctgttcattgtgtcctgcctggtgaaggggctcgtcgactccgttagcgactctttcttccccggtctgagcgtgtgcaagacgtgctccatcggcagcatcaacgggttcgagatcgagtcccacaagtgctactgcagcctgttctgctgcccctactgccgccactgctccgccgaccgggagatccaccagctccacctgggcatctgcaagaagcgcaagaccgggtcgaacgtcatgctggccgtatgcaagcggatgtgtttcaaggcgaccatcgaggcctcccgtcgggccctcctgatccgaagtatcataaacaccacgttcgtaatctgcatcctgaccctcgccatctgcgtcgtgtccaccagcgccgtggagatggagaacctgcccgcgggcacctgggagcgcgaggaggatctgacgagcttctgccaccaggagtgccaggtcaccgagaccgagtgcctctgcccgtacgaggccctggtcctgcggaagcccctcttcctggactccatagtgaaggggaagaagaacctgttaaacagcacctccctggagacgagcctgtccatcgaggccccctggggcgccattaacgtccagagcaccttcaagcccaccgtgtccaccgctaacatcgcgctcagctggtccagcgtggagcatcgcggcaacaagatcctggtcacggggcggagcgagagcatcatgaagctggaggagcgaaccggcgtgtcctgggacctcggggtggaggacgccagcgagtccaagctgctgaccgtcagcatcatggacctctcccagatgtacagcccggtgttcgagtacctgtccggcgaccgccaggtggaggagtggcccaaggcaacctgcacgggggattgtcccgagcggtgcggatgcaccagctccacgtgtctgcacaaggagtggccccatagccggaactggcgctgcaacccgacctggtgctggggcgtcgggaccggctgcacgtgctgcggagtcgacgtgaaggacttattcaccgaccacatgttcatcaagtggaaggtcgagtacatcaagaccgaggccatcgtgtgcgtggagcttaccagccaagagcggcagtgctccctgatcgaggccggcacccgcttcaacctgggccccgtaaccatcaccctgagcgagccccggaacatccagcagaaactgcccccggagatcatcaccctccaccccaagatcgaggaggggttcttcgacctgatgcacgtgcagaaggtgctgtctgccagtacggtctgcaagctccagtcctgcacccacggcatacccggggatctgcagatctaccacatcggcaacctgctcaaaggagaccgcctgaacggccacctgatccacaagatcgaaccccactttaacacctcctggatgtcctgggacggctgcgacctcgactactactgcaacatgggggactggccgtcgtgcacatacacgggcgtgacccagcacaaccacgcagccttcgtcaacctcctgaacatagagaccgactacaccaagaccttccatttccactccaagcgggtgaccgcccatggtgacacgccccagctcgacctgaaggcccgccccacctacggcgccggcgagatcaccgtgctggtcgaagtggccgacatggagctccacacaaagaaggtggagatcagcggcctaaagttcgcctccctggcctgcaccggctgctactcatgctccagcgggatctcctgcaaagtccggatccacgtggacgagcccgacgagctcaccgtgcacgtcaagagctccgacccggacgtggtggcggccagcacgagcctgatggcccgcaaactggagttcggcacggactccaccttcaaggccttcagcgccatgcctaaaacctccttatgtttctacatcgtcgagcgggagtattgcaagagctgctccgaggacgacactaagaagtgcgtggataccaagctggagcagccccagagcattctaatcgagcacaagggtaccatcatcggcaagcagaacgacacgtgcaccgcgaaggcatcctgctggctcgagagcgtgaaatccttcttctacggtttgaagaacatgttaggcagcgtcttcggcaacttcttcgtagggatcctcctgttcctggcccctttcgtgctgctcgtcttgttcttcatgtttggctggaaaatcctgttttgcttcaagtgttgccgccggacccgcggcctcttcaaataccggcatctgaaggacgacgaggagaccgggtatcgcaagatcatcgagcgcttaaattccaagaagggcaagaaccggctcctggacggagagcggctggccgaccggaagatcgccgaactgttcagcacgaagacgcatatcggctaa

SEQ ID NO: 15244 - RNA, 5067 nt, synthetic construct; identical to SEQ ID NO: 11958
  misc_feature 1..5067: note = derived and/or modified CDS sequence (opt11) from CCHFV(Gaib)__KX013445.1__GP
  source 1..5067: mol_type = other RNA

SEQ ID NO: 15245 - RNA, 5067 nt, synthetic construct
  misc_feature 1..5067: note = derived and/or modified CDS sequence (opt11) from CCHFV(Kosova Hoti)__EU037902.1__GP
  source 1..5067: mol_type = other RNA
atgcccatcaacatcatgcataccctgctcgtgtgcttcatcctgtacctgcagctcctgggcctcgggggcgcccacggacagagcaacgccaccgagcacaatggcacgaacaccaccaccgccccggggacgtctcagagccccaagccgcccgcttccaccacacccagccacgcccccgagccctccaccatcaagctgacgacccccaccagcgagacggagggatccggcgagacgacgccccctaccaataccacccaggactctccgcccctggagaccacccccgagcgctccgccaccacggcaaccagcacctcggggacagacaacatgaacagtacgacccagatgaccgacaacacccccacgtccactgtcagcacctccctgagctccagcccctccacccccagcacttcacaggggatgcaccacccggtgcggagcctccttagcgtgtccagccccaagaccgctacgacccccacgccaatgtccccgggagagatgagctccgagacgtcgtctcaacactccgccatgtcccgcacccccacgccccataccgccacccaggtttctaccgagaacgcgaaccggtccaccagccgccagtccgagagctccgctcagccagccactcagagcccggtcacgtcccccgcccagagcatcctactaatgagcgccacccccactaccatccagaacatccacccctcccccacgaaccggagtaagaggaacctggaaatggagatcatcctaaccctctcccagggcctgaagaagtattacggtaagatcctgaagctcctccacctgaccctcgaggaggacaccgagggcctgctcgagtggtgcaagcggaacctcggcagcaactgcgacgacgacttcttccagaagcgcatcgaggagtttttcataacgggggagggctacttcaacgaagtactgcagttcaagaccctgtcaacccccagctccaccgagcccagccatgcccggttacccacggcggagcccttcaagtcctatttcgccaaggggttcctgagcatcgactcgggctactttagcgccaaatgttacccccgctccagcacctccggcctgcagcttatcaacgtcacccagcaccccgcccggatcgccgagaccccggggcccaaaacgacaagcctgaaaaccatcaactgcatcaacctgcgcgcgtccgtgttcaaagagcaccgggaggtggagatcaacgtattactgccccagatcgccgtgaacctgagcaactgccacgtggtcatcaacagccacgtgtgcgactattccctcgacacagacggccccgtgcgactgccgagaatctaccacgaggggacgttcatgcccggcacctacaagatcgtaattgaccgcaaaaacaagctgaacgaccggtgtaccctggtgaccaactgcgtaatcaaagggagagaggtccggaagggccagagcgtcctgagacagtacaagactgagatcaagatcggcaaggccccgaccggctcccggaaactgctcagtgaggagcccggcgatgactgcatcagtcgcacccaactgctgcgcaccgagacggccgagatccacgacgacaactacgggggcccgggggacaaaatcactatatgcaacggcagcacgatcgtggaccagcggctcggcagcgaactggggtgctacacgatcaaccgcgtcaagagcttcaagctatgcgagaactccgccacgggcaagacctgtgagatcgacagcacccccgtgaagtgccggcaggggttctgcctcaagatcacccagaagggccgcggacacgtgaagctgtcccggggctcagaagtcgtactggacgcgtgcgactccaattgtgaagtcatgatccccaagggcacgggggacatcctggtggactgcagcggcgggcagcagcatttcctcaaggacaacctgattgatctgggctgcccccacatcccgctcctgggcaagatggccatctacatctgccgcatgtcgaaccaccccaagacgacgatggccttcctgttctggttcagcttcgggtacgtgattacctgcatcttctgcaaagcactcttctactccctgatcatcatcggcactctgggtaagaagatcaagcagtaccgggagctcaagccccagacatgcaccatctgcgagaccgcccccgttaacgcgatcgacgccgagatgcacgacctgaactgcagctacaacatatgcccgtattgcgcctcccgcctgacgagcgacggcctcgcacggcacgtgaagcagtgccccaagcgcaaagagaaggtggaggaaacggagctgtacctgaatctcgagcgcataccctgggtcgtgcgcaagctactgcaggtaagcgagagtaccggggtcgcattaaagcggagctcctggctgatcgtgctgctagtgctgctgaccgtctctctctcccccgtgcagagcgcgcccgtgggccacggcaaaaccatcgagacgtaccagacccgcgagggattcacctccatctgcctattcatgctgggtagcatcctcttcatcgtctcctgcctggtgaaggggctggtggacagcgtctccgacagcttcttccccggcctctccgtgtgcaagacctgctccatcgggtccatcaatggcttcgagatcgagtcccacaagtgttactgctccctgttctgctgcccctactgccgacactgtagcgccgaccgcgagatccatcagctgcacctgaacatctgcaagaagcggaagacggggtccaacgtgatgctggccgtctgcaagcgcatgtgcttcagagctaccatcgaagctagtcgccgcgccctgctcatccggtcgatcatcaacaccacctttgtgatctgcatcctgaccctaaccatctgcgtggtttccaccagcgccgtggagatggagaacctcccggccgggacctgggagcgcgaggaagacctgactaacttctgccaccaggagtgccaggtaaccgagaccgagtgtctgtgtccctacgaggcccttgtcctgcgcaagcccctgttcttagacagtatcgtgaaaggcatgaagaacctgctgaatagcacttccctcgaaaccagtctgtccatcgaagcgccgtggggtgccataaacgtgcagagcaccttcaagccgaccgtttccacagccaacatcgccctgagctggtcaagcgtggagcaccgcggcaacaagatcttggtgacggggagatccgaaagcatcatgaagctggaggagcgcaccggcatatcatgggacctgggcgtcgaagacgccagcgagtccaagctcttgaccgtatccatcatggacttatcacagatgtacagccccgtgttcgagtacctcagcggggaccgacaggtcgaggagtggcccaaagcgacctgcacgggcgactgtccccagaggtgcggttgcacctccagcacctgtctgcataaggagtggccgcactcacggaattggagatgcaaccccacctggtgctggggcgtggggaccggctgcacgtgctgcggcgtggacgtcaaggacctgttcaccgaccatatgttcgtgaaatggaaagtggagtacatcaagaccgaggccatcgtctgtgtggagctcaccagccaagagcggcagtgctccctgatagaggccgggacgcgcttcaacctcggccccgtgaccatcaccctcagcgagcctcggaacattcagcagaagctgccgcccgagatcatcactctgcaccccaagatcgaggaggggttcttcgacctcatgcacgtccagaaggtgctgtccgccagcacagtgtgcaagctgcagtcctgcacccacggcatccccggagacctccaggtctatcacattgggaacctgttaaagggcgaccgcgtgaacgggcacctcatccacaagatcgagccgcacttcaacaccagctggatgtcctgggacggctgcgacctggactactactgcaacatgggtgattggcccagctgcacctacacgggcgtgacccagcacaaccacgcggccttcgtcaacttgctaaacattgagacggactataccaagacgttccactttcactccaagcgggtgaccgcacacggcgacacaccccagctggacctgaaggccagacccacctacggagccggggagattacggtcttagtggaagtggcagacatggagctgcacaccaagaaggtggagatcagcgggttaaagttcgcctccctcgcttgcaccggctgctacgcctgcagctccgggatcagctgtaaggttcggatccacgtggacgagcccgacgaactgaccgtccacgttaagagcagcgaccccgatgtggtcgccgcgggcacctcactgatggcccggaagctcgagtttggcactgattccaccttcaaggctttttccgcaatgcccaagacctccctgtgtttctacattgtggagaaagagtactgcaagagctgctccgaggacgacacgaagaagtgcgtggacaccaagctggagcagccccagagcatcctcatcgagcaccgggggaccatcatcggtaagcaaaacgatacctgcacggccaaggcgtcctgctggctggaaagcgtcaagtcgttcttctacgggttaaagaacatgctaggcagcgtgttcgggaacttcttcatcggcatcctactgttcctcgcccccttcgtgctgctggtcctgttcttcatgttcggctggaagatcctcttctgcttcaagtgttgccgccggacccgcggcctgttcaagtaccgccacctgaaggacgacgaggagaccggctaccggcgcatcatcgagcggctaaataacaagaaggggaagaaccgtctactggacggcgagcggctcgccgaccgcaagatcgccgagctgttcagtaccaagacgcacatcggctga

SEQ ID NO: 15246 - RNA, 5067 nt, synthetic construct
  misc_feature 1..5067: note = derived and/or modified CDS sequence (opt11) from CCHFV(Turkey200310849)__DQ211636.1__GP
  source 1..5067: mol_type = other RNA
atgcccaccaacatcatgcataccctgctcgtgtgcttcatcctgtacctgcagctcctgtgcctgggcggggcgcacggccagctcaacacgaccgagcacaacggtaccaacaacaccacggcaccgggcgcgagccagtcccccaagccgcccatgagcaccaccccgccccacgcccccgagtccagcaccatcaagcccacgacccccatctccgaggcggaggggagcggcgagaccacctccacgcccaacaccacccagggcctgagctcccccgagaccacgagcgagcgccccgccaccaccgccatctccacgagctccacggacagcaccaacccgaccacccagatgacagacaacacccccaccctgaccgtctccacgagcccctccagctcccccagcacgccgagcacgccccaggggatctaccaccccgcgcggtccctcctgtcagtgtccagccccaagaccgtgaccaccccgacccccacttcccccggggagatgagctccgagacgagctcccagcacagcgccatgtccagaatccccaccccacataccgccacccgggtcagcaccgagaacacgaaccactccacgccccgccagtccgagtccagcgcccagcagaccaccccctcccccatgacaagcccggcgcagtccatcctgctcatgagcgccgcccccaccgccgtgcaggacatccaccccagcccgaccaaccggtccaagcgcaatctggagaccgagatcatcctgacgctcagccaggggctgaagaagtactacggcaaaatcctgaagttgctgcacctgaccctcgaggaggacaccgaggggctgctggagtggtgcaagcggaacctcggctccaactgcgacgacgacttcttccaaaagcgcatcgaggagttcttcatgaccggcgaggggtacttcaacgaggtgctgcagttcaagacgctgagcaccctctcccccaccgagccctcgcacgcacggctgccgaccgcggagccgttcaagtcctacttcgccaagggcttcctgagcatcgactccgggtacttcagcgctaaatgctacccccgctccagcgcctccggcctccagctgatcaacgtcacgcagcaccccgcccggatcgcggagacccccggcccgaagaccaccagcctgaagacgatcaactgcatcaacctgcgcgcctccgtgttcaaggagcaccgggagatcgagatcaacgtgctgctgccccagatcgccgtcaacctcagtaactgccacgtggtgatcaactcccacgtctgcgactacagcctggacaccgacgggcccgtgcgcctgcctcggatctaccatgagggcaccttcatcccggggacctacaagatcgtgatcgataagaagaacaagctcaacgaccgttgcacgctggtcaccaactgcgtgatcaagggccgggaggtgcgcaaggggcagtctgtcctgcggcagtacaagaccgagatcaagatcggcaaggcctccaccggcttccgcaagctcctgagcgaggagcccggggacgactgcatctcccggacgcagctgctccgcaccgagaccgccgagatccacgacgacaactacggcgggcccggcgacaagatcacaatctgcaacgggagcacgatcgtggaccagcgcctgggctccgagctgggctgctacacgatcaaccgcgtaaagagcttcaagctctgcgaaaattccgcgaccgggaagacctgcgaggtggacagcacgcccgtcaagtgccgccagggcttctgcctgaagatcacccaggaggggcggggccacgtgaagctgtcccgcgggagcgaggtcgtgctggacgcctgcgactccagctgcgaggtaatgatcccgaagggcaccggcgacatcctcgtggactgctccgggggacagcagcacttcctgaaggacaacctgatcgacctcgggtgtccccacatccccctgctgggcaagatggccatctacatctgccggatgtccaaccacccccgcaccaccatggcgttcctcttctggttctcgttcgggtacgtgatcacgtgcatcagctgtaaggccctgttctactccctgatcatcatcgggaccctcggcaagaagatcaagcagtaccgggagctgaagccgcagacctgcaccatctgcgagacggcgcccgtcaacgccatcgacgccgagatgcacgacctgaactgtagctacaacatctgcccctactgcgcctcccgcctgaccagcgacgggctggcgcggcacgtgacccagtgccccaagcgcaaggagaaggtggaggagaccgagctgtacctcaacctggagcggatcccgtggatcgtccgaaagctgctccaggtgagcgagtccacgggagtggccctgaagcggagctcctggctgatcgtcctcctggtgctgctcaccgtgagcctttcccccgtacagagcgcccccgtggggcacggtaagaccatcgagatctaccagacccgcgagggcttcgcttccatctgcctgttcatgctcgggagcatcctgttcatcgtgtcctgcctggtcaagggcctcgtggacagcgtgtccgacagcttcttcccggggctgtccgtctgtaagacgtgcagcatcggctccgtgaacgggttcgagatcgagagccacaagtgctactgctccctgttctgctgcccctactgccggcactgcagcgccgaccgcgagatccaccagctccacctgtccatctgcaagaagcggaagaccggcagcaacgtgatgctggctgtctgcaagcgcatgtgcttccgagccaccatcgaggccagtcgccgcgccctcttgatccggtccatcatcaacaccacgttcgtgatctgcatcctgaccctcaccatctgcgtggtcagcacctccgccgtggagatggagaacctgcccgcgggcacgtgggagcgcgaggaggacctgaccaacttctgccaccaggaatgccaggtgaccgagaccgagtgcctctgcccctacgaggccctggtcctgcggaagcccctcttcctggatagcatcgtgaagggtatgaagaacttactgaactccacgagcctggagacttccctgagcatcgaggccccgtggggcgccatcaacgtgcagtccaccttcaagcccgccgtcagcaccgcgaatatcgccctctcctggagctccgtggagcaccgcgggaacaagatcctggtgacgggacggagcgagtccatcatgaagctggaggagcgcaccggtgtcagctgggacctcggcgtggaggacgcctccgagagcaagctgctgacagtgtccatcatggacctcagccagatgtacagccccgtcttcgagtacctgtccggcgaccgccaggtggaggagtggccgaaggcgacctgcacgggggactgccccgagcggtgcggctgcaccagctcgacgtgtctgcacaaggagtggccccactcccggaactggcgctgcaacccaacctggtgctggggcgtggggaccgggtgtacctgctgcggggtcgacgtgaaggacctcttcaccgaccacatgttcgtgaagtggaaggtcgagtacatcaagaccgaggccatcgtgtgcgtggagctaacctcccaggagcggcagtgcagcctgatcgaggccggcacccgcttcaacctcgggccggtcaccatcaccctatccgagccccggaacatccagcagaagctgccgcccgagatcatcaccctccatcccaagatcgaggagggcttcttcgacctgatgcacgtccagaaggtgctgtctgcctccacagtctgcaagctccagagctgcacccacgggatccccggcgacctccaggtgtaccacatcggcaacctgctcaagggggaccgcgtgaacggccacctgatccacaagatcgagtcccacttcaacaccagctggatgtcctgggacggatgcgacctggactactactgcaacatgggcgactggcccagctgcacctacacgggggtaacccagcataaccacgccgccttcgtgaacctcctgaacatcgagaccgactacaccaagacgttccacttccactccaagcgggtcaccgcgcacggcgacacgccccagctggacctcaaggcccgcccgacctacggcgctggggagatcaccgtgctggtggaggtcgccgacatggagctgcacaccaagaaggtggagataagcggtctcaagttcgcctcccttgcgtgcaccgggtgctacgcctgcagctccggcatcagctgcaaggtgcggatccacgtcgacgagcccgacgagctgaccgtgcacgtcaagagctccgaccccgacgttgtggctgccagcacgtccctcatggccaggaagctcgagttcgggaccgacagcaccttcaaggcgttctccgccatgcccaagaccagcctgtgcttctacatagtggagcgggagtactgcaagtcctgcagcgaggacgacacgcagaagtgcgtcgacacccgcctcgagcagccgcagtcaatcctaatcgagcacaagggcaccatcatcggcaagcagaacgatacctgcaccgccaaggccagctgctggctggagtccgtcaagagcttcttctacgggctcaagaacatgctgggctccgttttcgggaacctattcatcggcatcctcctgttcctggcgcccttcgtgctgctcgtgctgttcttcatgttcggatggaagatcctgttctgcttcaagtgctgccggcgcacccgcggcctcttcaagtaccggcacctgaaggacgacgaggagaccggctaccgccggatcatcgaaaggttaaacagcaagaaggggaagaaccggctcctggacggcgaccgcctggccgaccggaagatcgcggagctgttctccaccaagactcacatcgggtga

SEQ ID NO: 15247 - RNA, 5067 nt, synthetic construct
  misc_feature 1..5067: note = derived and/or modified CDS sequence (opt11) from CCHFV(Kashmanov)__DQ211631.1__GP
  source 1..5067: mol_type = other RNA
atgcccaccaacatcatgcacacccttctcgtatgcttcatcctgtacctgcagctcctgggcctcggcggggcccacgggcagagcaacgccacggagcacaacgggaccaataccaccacggccccgagtacctctcagtctcccaagcccctggtcagcaccgcgcctccgcacgccctggagtccagcaccatcaagcccacgacccccgcctccgagaccgaggggagcggcgagaccacgcccccgcccaacaccacccagggcccctccccgcccgagaccacgcccgagagacccgccaccaccgccactagcacgccctccaccgacaacaccaacagcaccacgcacgtgaccgacaacaacccgacctccaccatcagcacgtcccccagctccagcccctccaccccctccaccccgcaggggatccaccaccctgcccggaacctcctgagcgtgtccagccccaagaccgccacgacccccaccccgacctcccccggcgagatcagctccgaggccagttctctgcacagcgcgatgtcacgcacgagcaccctgtacaccgccacccaggtttccaccgagaacgccaaccacagtgcgccccggcagtccgagagctccgcccagcccacgaccaccagcccgatgacctcccccgcccagagcatcctcgtgatgtccgcagcccccatcgccatccagaacatccacccgagccccacgaaccgcagcaagcggaacctggagatggagatcatcctgaccctctcccaggggctgaaaaagtactacgggaagatcctgaagctcctgcacctgaccctcgaggaggacaccgaggggctgctggagtggtgcaagcgcaacctcggcagcaactgcgacgacgacttcttccagaagcggatcgaggagttcttcatgacgggcgaggggtacttcaacgaggtgctgcagttcaagaccctgtccaccctctcgcccaccgagcccagccacgccggcccgcccacggtcgagcccttcaagagctatttcgcgaaggggttcctgtccatcgactcgggctacttctccgccaagtgttacccccgtagctccaccagcgggctgcagctcattaacgtgactcagcaccccgcccggatcgccgagacccctgggcccaagacgacctccttaaagaccatcaactgcatcaacctgcgcgccagcgtgttcaaggagcaccgggagattgagatcaacgtgctcctgccccagatcgcggttaacctgtcaaactgccatgtggtcataaacagccacgtatgcgattacagtctcgacaccgacggcccggtgcgcctgccccacatctaccacgagggtacgtttatccccggtacctataagatcgtcatcgacaaaaagaacaagctgaacgaccggtgcaccctcgtgaccaactgcgtgatcaaagggcgcgaggtccgaaagggccagagcgtgctgcgccagtacaagacggagatcaagatcggcaaggccagcaccgggtcccggaagctgttgagcgaggagcccggcgacgactgcatctcccgcacccagctgctgcggacggagacggccgagatccacgacgacaactacgggggcccgggggacaagatcaccatatgcaacggcagcaccatcgtggaccagcgcttaggttccgagctgggctgctacaccatcaaccgagtcaagagctttaagctctgcgagaacagtgccactgggaagacctgcgagatcgacagcacccccgtgaagtgtcgccagggcttctgcctcaagattacccaggagggtcgcgggcacgtgaagctgtcccggggctctgaggtcgtgctggacgcctgcgactcttcctgcgaagtcatgatccccaagggcacgggggacatcctggtagactgctccggcgggcagcagcacttcctcaaggacaacctgatcgacctgggctgcccccacatcccgctcctggggaagatggcgatctacatctgccgcatgagcaatcacccccggaccaccatggccttcctgttctggttctccttcgggtacgtaatcacgtgcatcttctgcaaggccctcttttacagcctgatcatcatcggcaccctcgggaaaaagatcaaacagtaccgcgagctcaagccccagacctgtacaatctgtgagaccgcccccgtcaacgcgatcgacgccgagatgcacgatctgaactgctcctacaacatctgcccgtactgcgccagccggctgacctcggacggcctcgcccgccacgtgccccagtgccccaagcggaaggagaaggtggaggagacggaactgtacctgaatctcgagcgcattccgtggatcgtccggaagctgttgcaagtgagcgagagcacaggggtggccctgaagcgctcctcatggctgatcgtcctgctagtgctgctcaccgtgtccctcagccccgtccagtccgcgcccgtgggccacggcaagaccatcgagacgtaccagacccgggaggggttcaccagcatctgcctgtttatgctgggttccatcctattcctggtgagctgccttgtaaaggggctcgtggattccgtgagcgacagtttcttccccggcctgagcgtctgcaagacctgcacgatcgggtccatcaacggcttcgagatcgagagtcacaagtgctactgctccctgttctgctgcccttactgccgccactgcagcgccgaccgggagatccaccagctccacctgtccatttgcaaaaagcgcaagaccggcagcaacgtcatgctggccgtgtgcaagcggatgtgcttccgcgcaactatcgaggcctcccggcgcgcgctcctgatccggagcatcatcaacaccacgttcgtcatctgcatcctgaccctcaccatctgcgtggtgagcacctccgccgtcgagatggagaacctgcccagcgggacgtgggagcgcgaggaggacctgactaacttctgccaccaggagtgtcaggtgaccgagaccgagtgcctctgcccctacgaggccctggtgctgcgcaagcccctcttcctggattcaatcgtcaagggtatgaagaacagcctgaactccacgagcctcgagacatccctgagcatagaggccccgtggggcgccatcaacgtgcagtccacctttaagccaaccgtgagcacggcgaacatcgccctgtcctggagctcggttgagcatcgggggaacaagatcctcgtgaccgggcgcagcgaatccatcatgaagctggaggagcggaccggcgtgagctgggacctgggcgtggaggacgcctccgagagcaagctcctgactgtatccattatggacctgagccagatgtacagccccgtgttcgagtacctctccggggaccgccaggtcgaggaatggcccaaagccacgtgcaccggcgactgcccggagcgctgcgggtgcaccagctccacgtgcctgcacaaagagtggccccacagccgcaactggcggtgcaacccgacgtggtgctggggcgtggggactggctgcacgtgctgcggcgtggacgtcaaggacctgttcaccgaccacatgttcgtgaagtggaaggtggagtacatcaagaccgaggcgatcgtatgcgtggagctcacctcccaggagcgccagtgcagcctgatcgaggccgggacccggttcaacctgggccccgtcaccatcaccctctccgagccgcgcaacatccagcagaagctgccgcctgagatcatcacgctgcaccccaaggtcgaggaggggttcttcgatctcatgcacgtgcagaaggtgctgagcgcctccaccgtctgcaagctacagtcatgcacccacggcatccccggcgacctccaggtgtaccacatcgggaacctgctgaagggcgaccggatcaacgggcacctcatccacaaaatcgagccccacttcaacacctcctggatgagctgggacgggtgcgacctggactattactgcaacatgggagactggccctcctgcacgtacaccggcgtgacccagcacaaccacgccgccttcgtcaacctgctcaacatcgagaccgactacacgaaaaccttccacttccatagcaaacgggtgaccgcgcacggcgacacgccccagctggaccttaaggcccggccgacctacggggcaggcgagatcaccgtcctcgtagaggtggccgacatggagctgcacactaagaaggtcgagatctccgggctaaaattcgcgagcctcgcgtgcaccggctgctacgcctgctccagcgggatctcctgcaaggtacgcatacacgtggacgagcccgacgagctgacggtccacgtcaagagcagcgaccccgacgttgtggccgcatccaccagcctgatggccagaaagctcgagttcggcaccgacagtaccttcaaggcgttcagcgccatgcccaagacgtccctgtgcttctacatcgtggagcgcgagtactgcaaaagctgctccgaggaggacacccagaagtgcgtggacaccaagctggagcagccgcagagcatcctcatagagcacaagggcactatcatcgggaagcagaacgacacgtgcaccgccaaggccagttgctggctagagagcgtcaagtccttcttctacggcctgaagaacatgctcggcagcgtgttcggtaacttcttcatagggatcctactgtttctcgcgccctttgtgctgctcgtcctgttcttcatgttcggctggaagatcctcttctgtttcaagtgctgccggcgcacccggggcctgctgaagtaccgccacctcaaggacgacgaggagaccgggtaccggagaatcattgagcgcctgaacaacaaaaagggcaagaaccggctgctcgacggggagcgcctggccgaccggaagatcgccgagctgttctccacgaagacccacataggctga

SEQ ID NO: 15248 - RNA, 5067 nt, synthetic construct
  misc_feature 1..5067: note = derived and/or modified CDS sequence (opt11) from CCHFV(Drosdov)__DQ211630.1__GP
  source 1..5067: mol_type = other RNA
atgcccatcaacatcatgcacgcgctgctcgtgtgcttcatcctgtacctgcagctcagcggcctcgggggcgcccaccgccagtccaacgctaccgagcacaacgggaccaacacgaccaccgccccgggcaccagccagtcccctaagccacctgtcagcactaccctgccacacaccccggaggcctccaccattaagctgacgacccccaccagcgagaccgaggggtccggcgagacaacgcccccgcccaataccacccagggcctgcccctgcccgggaccaccccggaacggagcgccaccaccgctacgtccaccagctctaccgacgatatgaacagcaccacgcagatgaccgacaacacccccacctccacggtgagcatcggactctccagctcccccagcatgccctccaccagccaggggatccactacccggtgcgcagcttgctgtccgtcagctcccccaagaccgcgaccacgcccacccccatgagcccgggcgaggtgtcccccgagaccagctcccagcacagcgccatgagtcggatccccactctctacacagccacccaggtgagcacagagaacaccaaccgctccatcccccggcagagcgagtccagcgtccagccggccacccagtcccccatcacgagccccgcacagaccatcctgctgatgtccgccgctcccaccgccatacaagacatgcacccgagccccaagaaccgctccaagcggaacctcgaggtggagatcatcctgaccctgtcgcaggggttgaagaagtactacggcaagatcctgaagctgctccatctgacgctggaggaggacaccgagggcctcctggagtggtgcaagcgcaacctggggagcaactgcgacgacgacttcttccagaagcggattgaggagttcttcatcaccggcgaggggtacttcaacgaggtgttacaattcaaaaccccctccacgctgagcccgaccgagccctcccacgtccgcctgcccaccgccgagccctttaagagctacttcgcgaagggcttcctctccatcgactcaggctacttctctgccaagtgctacccgagaagctccaccagcgggctgcagctgatcaacgtgacacagcaccccgcccgcatcgccgagacccccggccctaaaaccacctccctcaagacgatcaactgcatcaacctgcgggccagcgttttcaaggagcaccgcgaggtcgagatcaacgtactgctcccgcagatagcggtgaacctgtcgaactgccacgtcgtgatcaacagccacgtgtgcgactactccctggacaccgacggacccgtacggctcccccgcatccaccacgagggcgccttcatccccgggacctacaagatagtgatcgacaagaagaacaagctgaacgaccggtgcagcctggtcacgaactgcgttatcaagggccgcgaggtgcggaagggccagtccgtcctccgccagtacaagacagagatcaagatcgggaaggccagcaccggcagccggaagctgctgtccgaggagccgggggacgactgcatcagccgcacccagctcctaaagaccgagactgccgagatccacgacgacaactacggcgggcccggcgacaagatcaccatctgtaacggctccaccatagtcgaccagcgcctggggagcgagctcggctgctacaccatcaaccgcgtgaagtccttcaaactgtgcgagaacagcgccacggggaagacctgcgagatcgacagtacccccgtcaagtgccgccagggcttctgccttaaaatcacccaggagggtcggggccacgtaaagttaagccgcggctccgaggtggtcctcgacgcgtgtgatagctcttgcgaggtgatgatccccaaggggacgggcgacatcctcgtggactgcagcgggggtcagcagcacttcctgaaggataacctaatcgacctgggctgcccgcacatccccctcctcggcaagatggccatctatatctgccggatgtccaaccacccccgcaccaccatggccttcttattttggttcagcttcggttacgtcatcacgtgcatcttctgcaaggccctgttctactccctcatcatcatcggtaccctggggaagaagatcaagcaatatcgggagcttaagccccagacttgcaccatttgcgagaccgccccggtgaacgcgatcgacgccgagatgcacgacctcaagtgcagctacaacatctgcccctactgcgcctcccgcttaacaagcgacgggttggcccggcacgtgacccagtgccccaagcgcaaggagaaggtcgaggagaccgagctctatctgaacctggagcggatcccctggatcgtgcgcaaactcctccaggtgtctgaatcgaccggcgtcgcgctgaagcggagctcctggctcatcgtgctgctggtgttactgaccgtcagcctctccccggtccagagcgcccccgtggggcacgggaagacgatcgagacctaccagacccgcgagggcttcacctccatttgcctattcatgctggggtcgatcctgttcatcgtctcatgcctcgtcaagggcctggtggacagcgtctccgatagcttcttccccgggctgtccgtgtgcaagacgtgtagcatcgggtccatcaacggcttcgagatagagagtcacaagtgctactgctccctcttctgctgcccgtattgtaggcactacagcgccgacagggagatccaccagctgcacctttccatctgcaagaagcggaagaccgggagcaatgtgatgctcgccgtatgcaagcgcatgtgcttcaaggccaccatcgaggcgtcccggcgcgccctgctgatccgcagcatcattaacaccacgttcgtgatctgcatcctcatcctggccatctgcgtggtgagcacctccgccgttgaaatggagaacctgcccgccggcacgtgggagcgggaggaggacctcaccaacttctgccaccaagagtgccaggtcacggagaccgagtgcctgtgtccctacgaggcgctggtcctccgcaagcccctgttcctggacagcacggtgaaggggatgaagaacctcctgaactccacaagcctggagacatcgctcagcatcgaggccccgtggggcgccatcaacgtgcagtccacgttcaagcccaccgtcagtaccgccaacatcgcactgtcctggagctccgtggagcaccgggggaacaagatcctggtgacgggacgcagcgagtccattatgaagctcgaagagaggaccggcgtcagctgggacctcggggtggaggacgcgtccgaaagcaagctgctcaccgtatccatcatggacctgagccagatgtactcccccgtcttcgagtacctgagcggcgaccgccaggtggaagagtggcccaaggcgacgtgcacgggagactgcccggagcggtgcggctgtaccagcagcacgtgcctccataaggagtggccccactcccggaactggcggtgcaaccccacgtggtgctggggcgtggggaccggctgcacttgctgcggggtcgacgtgaaggatctgttcaccgaccatatgttcgtcaagtggaaagtcgagtacatgaagaccgaggccatcgtgtgcgtggagttaacctcccaggaacggcagtgcagccttattgaggccgggacccggttcaacctggggcctgtcaccatcaccctgtccgagccacgcaacatccagcagaagctcccgcctgagatcattaccctgcaccccaagatcgaggagggcttcttcgacctgatgcacgtgcagaaggtgctcagcgcctccacggtctgcaagttgcagagttgcacccacggcatccccggggacctgcagatctaccacatcggtaacctcctgaagggggaccgggtcaacggccacctgatccacaagatcgagccccacttcaacacctcctggatgagctgggacgggtgcgacctggactactactgcaacatgggcaactggccctcctgcacctacacgggcgtcacccagcacaaccacgccgccttcgtgaacctgctgaacatcgagaccgactacaccaagacgttccacttccacagcaaacgcgtgaccgcccacggggacacgccccagctcgacctgaaggcccggccgacctatggcgcgggtgaaatcaccgtcctggtggaggtggccgacatggagctccacaccaagaaggttgagatctccggcctgaagttcgccagcctggtgtgcaccgggtgctacgcctgctccagcggcatctcctgcaaggtgcgcatccacgtcgacgagcccgatgagttgaccgtgcacgttaagagctccgaccccgacgtggtggccgcgtcaacgagcctgatggcccggaaactggagttcggcaccgactccatcttcaaggccttcagcgccatgcccaagacctccctctgcttttacatcgtggagcgcgagtactgcaagtcttgctccgaggacgacaccaagaagtgcgtcgacacgaagctggagcagccgcagagcatcctgatcgagcacaaggggaccatcatcggcaagcagaacgacacctgtaccgccaaggcgagctgttggctcgagagcgtgaagtccttcttttacggactgaagaacatgctgggcagcgtgttcgggaactttttcgtaggcatcctcctgttcctggcccccttcgtgctgctcgtgctgttctttatgttcggctggaagatcctgttctgcttcaagtgctgcagacgcacccggggcctcttcaagtaccgccacctgaaggacgacgaggagactgggtaccgccggatcatcgagcgccttaattccaaaaaggggaagaaccggctcctggatggagaacgcctggccgaccgtaaaatcgccgagctgttcagcaccaagacccacatcggctga

SEQ ID NO: 15249 - RNA, 5067 nt, synthetic construct
  misc_feature 1..5067: note = derived and/or modified CDS sequence (opt11) from CCHFV(1231-CR/TI-2015)__KU161585.1__GP
  source 1..5067: mol_type = other RNA
atgcccatcaatatcatgcacaccctgcttgtgtgcttcatcctgtacttgcagctcctgggcctcgggggcgctcacgagcagagcaacgcaaccgaccacaaccgcacgaacaccataaccgcgccgtcgaccagccagaaccccaaacctcccgcctccacgaccccgccccacacccccgagagctccaccatcaagctcatcacgagcaccggggaggccgagggctccggagagaccacgcccccgctgaacaccactcagggccccttcccgcccgagaccaccagcgagcaccccgcctccacggccaccaacaccagctccaccaacagcatgaactccacgacccagatgaccgacaagaccctaacgagcaccgtctccaccagcctctccatctctccatcaacccccagcactagccagggcatccactaccccatccggtccctgctgagcgtgtccagcccgcgcactgcggccacccccacccccatgtccacgcgggagatgagctcggaaaccaacagccagcactccgccgtgtctcggacacctaccttccacactgccacccaggtctcaactgaaaacgacaaccggagcaccccgaggcagtcggagagctccgcgcagcccgccacccagagtcccatgacgtcccccgcccagagcatcctcctggtatccgccgccccgaccactatccagaacattcatcccagccccaccaaccggtccaagcgcaacctggagatggagataatcctcacgctgccccaggggctaaagaagtactacggcaagatcctcaagctgttacacctgaccctggaggaggacaccgaggggctgctcgagtggtgcaagcggaacctgggcagtaactgcgacgacgagttcttccagaagcgcatcgaagagttcttcatcaccggggagggctacttcaacgaagtgctacagtttaagacgctctcgaccctgtccccgatggagcccagccacgcgcggcccccgacagccgagcccttcaagtcctacttcgccaagggcttcctgagcatcgattccggctacttcagcgctaagtgttacccacgctccagctccagcggcctccagctgatcaacatcacccagcatcccgcccggatcgcggagacgccggggcccaagaccacctccctgaagaccatcaactgcatcaacttacgcgcctcagtcttcaaggagcacagggaggtggagatcaacgtgctgctgccgcagatcgcggtcaacctctcgaactgccacgtggtaatcaacagccacgtctgcgactactccctggacacggacggccccgtgcgccttccgcggatctaccacgagggcaccttcatccctgggacctacaagatcgtgatcgacaagaagaacaagctcaacgaccgctgcaccctggtcacgaactgcgtgaccaagggtcgggaggtgaggaaggggcaaagcgtcctgcggcagtacaagaccgagatcaagatcggaaaggccagcaccggctcccgcaagctcctgagcgaggagcccggcgacgactgcatctcccgcacgcagctgctccggaccgagaccgccgagatccacgacgacaactacggcgggcccggcgacaagatcaccatatgcaacgggagcacgatcgtggaccaacgcttgggctccgagctggggtgctacaccatcaaccgggtaaagagcttcaagctctgcgagaactccgcgacgggcaagacttgcgagatcgacagcacgcctgtgaagtgccgccagggcttctgcctgaagatcacccaggaggggcggggccacgtcaagctgtcccgcgggagcgaagtggtcctggacgcctgcgactcctcgtgtgaggtgatgattcccaagggaaccggggacatcctcgtcgattgctccggcggccagcagcacttcctgaaggacaacctgatagatctcgggtgcccgcacattcccctgctgggaaagatggccatatacatctgccggatgagcaaccacccccgcaccacgatggcgttcctcttctggttctccttcggttacgtgataacctgcatcttctgtaaggccctgttctatagcctgatcatcatcggcaccctcggcaagaagatcaagcagtatcgggagctgaagccccagacctgcaccatctgcgagacggcgcccgtaaacgccatcgacgccgagatgcacgacctgaactgctcctacaacatctgcccctactgcgccagccgcctgacttccgacgggctggcacggcacgtaacccagtgcccgaagcgcaaagagaaggtggaggagaccgagctgtacctcaacttggagcggatcccctggatcgtccgcaagctactccaggtctccgagagcacgggcgtggccctgaagcggtccagctggctgatcgtgttactggtcctgctcaccgtgtccctaagccccgtgcagtccgcccccgtcgggcatggcaagaccatcgagacctaccagacgcgcgaggggttcacgagcatatgcctgttcatgctcggctccatcctattcatcgtgagctgcctggtcaagggcctcgtcgagtccgtgagcgactccttcttcccggggctgagtgtgtgccggacctgctccatcggaagcatcaacgggttcgaaatcgagtcccataagtgctactgcagcctgttctgctgcccctactgccgtcactgctccgccgaccgggagatccaccaactccacctgagcatctgtaagaagcgcaaaaccggctccaacgtcatgctggccgtgtgtaagcgcatgtgcttccgggcgacgatggaggccagccgccgggcgctcctgatccgcagcatcatcaacaccaccttcgtgatctgcatcctgaccctcacgatctgcgtcgtatccaccagcgccgtggagatggagaacctgcccgccgggacctgggagcgggaggaggacctgaccaacttctgccaccaggagtgccaggtcacggagaccgagtgcctctgcccgtacgaggcgctagtgctgcgtaagcccttattcctggactccatcgtgaagggcatgaagaacctgttaaacagcacctccctggagacgagcctgtccatcgaggccccttggggcgcaatcaacgtccagtcaaccttcaagcccaccgtgtccacggccaacatcgccctcagctggtccagcgtggaacacagagggaacaagatcctggtcaccggccgctccgagagcatcatgaagctggaggagaggacgggggtgtcctgggacctcggcgtggaggacgcgagcgagtccaagctgctgacagtcagcatcatggacctctcccagatgtacagcccggtgttcgagtacctgagcggggaccgccaggtggaagagtggcccaaggcgacctgcaccggtgactgcccggagcggtgcggctgcacgtccagcacttgcctgcataaggagtggccccactcccgcaactggcggtgcaacccgacctggtgctggggcgtcgggaccgggtgcacgtgctgcggcgtggacgtgaaggacctcttcaccgaccacatgtttgtcaagtggaaggtggagtatatcaagaccgaggccatcgtctgcgtcgagctgaccagccaggagcgccaatgctccctgatcgaagccgggacccggttcaacctcggccccgtgacgatcaccctgagcgaaccccgcaacatccagcagaagctacccccggagatcatcacgctccaccccaagatcgaggagggcttcttcgacctgatgcacgtgcagaaggtcctgtccgccagtaccgtgtgcaagctccagtcctgcacgcatgggatccctggcgacctccaggtgtaccacatcgggaacctgttgaagggcgaccgggtcaacggccacctgatccacaagattgagccccacttcaacaccagctggatgtcctgggacgggtgcgacctggactactactgcaacatgggcgactggccgagctgtacatacacaggggttacgcaacacaaccacgccgccttcgtgaacttactgaacatcgagaccgactacaccaagaccttccacttccactccaagcgcgtaacggcccacggcgacaccccgcagctggacctcaaggcccggcccacctacggggcaggcgagatcacagtgttggtcgaggtggccgacatggagctgcacacaaagaaggtggaaatctctggcctcaagttcgcctcactggcctgcaccggatgctacgcctgttcctccggcatcagctgcaaggtccgcatccacgtggacgagcccgacgagctgaccgtgcacgtcaagtcgagcgacccggacgtggtggcggctagcacctcgctcatggcccggaagctggagttcgggacggactcaacgttcaaggccttctccgccatgcccaaaaccagcctgtgcttctacatagtcgagcgcgagtactgcaagtcctgcagcgaggacgacaccaagaagtgcgtggacacgaagctcgagcagccccagtccatcctgatcgagcacaagggaaccatcatcgggaagcagaacgacacatgcaccgccaaagccagctgctggctggagtccgtcaagagcttcttctacggcctcaagaacatgctgggctccgtgttcgggaactttttcatcggcatcctgctgttcctggccccctttgtgctgctggtgctgttcttcatgttcgggtggaagatcctgttctgctttaagtgttgccgccggacgcgcggcctgttcaagtaccggcatttgaaggacgacgaagagaccgggtaccgccggatcatagagaggctgaacaacaagaagggcaagaaccggctcctcgacggcgagcgcctggccgaccggaagatcgcggagctgttcagcaccaagacccacatcgggtga

SEQ ID NO: 15250 - RNA, 5067 nt, synthetic construct
  misc_feature 1..5067: note = derived and/or modified CDS sequence (opt11) from CCHFV(1-CR/HU-2015)__KU161584.1__GP
  source 1..5067: mol_type = other RNA
atgcccatcaacatcatgcacaccctgctcgtgtgcttcatcctgtacctgcagctcctgggcctcggtggcgcccacgagcagagcaacgccaccgaccacaaccgcacgaacaccatcaccgcgccgtccaccagccagaaccccaagccacccgcctccacgaccccgccccacactcccgagagctccaccatcaagctgatcacgagcaccggggaggcggagggctccggtgagacaaccccgcccctgaacacgacccagggccccttcccgcccgagaccaccagcgagcaccccgcctccacggccaccaacaccagctccaccaacagcatgaactccacgacccagatgaccgacaacacgttaacgagcaccgtctccaccagcctctccatcagcccctccacccccagcaccagccagggcatccactaccccgtgcggtccctgctgagcgtgtccagccccaagaccgcggccacccccacccccatgtccacgcgcgagatgagctccgagaccagctcgcagcacagcgcaatgtcccggacccccaccttccacacggccacccaggtcagtaccgaaaacgcgaaccgctccaccccgcggcagagcgagtccagcgcccagcccgccacccagtcccccatgacgagccccgcccagtccatcttcctcgtgagcgccgcgccgaccaccatccagaacatccaccccagccccaccaaccgttccaagcggaacctggagatggagatcatcctgacgctcccccaggggctgaagaagtactacggcaagatcttaaagctcctgcacctgaccctcgaggaggacaccgaggggctgctggagtggtgcaagcgcaacctcggcagcaactgcgacgacgagttcttccagaagcggatcgaggagttcttcatcaccggggagggctacttcaacgaggtgctgcagttcaagacgctgtccaccctcagcccgaccgagccctcccacgcccggcccccgaccgccgagcccttcaagagctacttcgcgaaaggcttcctgtccatcgacagcgggtacttctccgccaaatgctacccccgcagctccacgagcggcctgcaactcatcaacatcacccagcaccccgctcgcattgcagagactccggggcccaagaccacgtcgctgaagaccatcaactgcatcaacctgcgggctagcgtcttcaaggagcaccgcgaggtggagatcaacgtgttactgccccagatcgccgtcaacctgtccaactgccacgtggtgatcaacagccacgtctgcgactactccctcgacaccgacggccccgtgcggctgccgcgcatctaccacgagggcaccttcatccccgggacgtacaagatcgtgattgacaagaagaacaagctgaacgaccggtgcaccctcgtcaccaactgtgtgatcaagggccgcgaggtgcggaaggggcagagcgtcttacgccagtacaagaccgagatcaagatcggcaaggccagcacggggtcccggaagctgctcagcgaggagcctggcgacgactgcatctcccgcacccagctgctgcgcaccgagaccgcggagatccacgacgacaactacggcgggcccggcgacaagatcacgatctgcaacgggagcaccatcgtggaccagcggctcggctccgagctggggtgctacaccatcaaccgcgtcaagagcttcaagctgtgcgagaactccgccaccggtaagacgtgcgagatcgacagcaccccggtgaagtgccggcaaggcttctgcctcaagatcacccaggaggggcgcggccacgtgaagttatcccgggggagcgaggtggtcctggacgcctgcgactccagctgcgaggtgatgatcccaaagggcaccggggacatcctggtcgactgctccggaggccagcagcacttcctcaaggacaacctgatcgaccttgggtgcccccacatccccctcctgggcaagatggccatctacatctgccgcatgagcaaccacccgcggacgaccatggccttcctgttctggttctccttcgggtacgtgatcacgtgcatcttctgcaaagccctcttctacagcctgatcatcatcggcaccctgggcaagaagatcaagcagtaccgcgagctcaagccccagacctgcaccatctgcgagaccgcccccgtgaacgccatcgacgccgagatgcacgacctgaactgttcctacaatatctgcccctattgcgcgagccggctgacctccgacgggctcgcccgccacgtcacccagtgcccgaagcggaaggagaaggtcgaggaaacggagctgtaccttaacctcgagcgtatcccctggatcgtgcggaagctgctgcaggtcagcgagtcaaccggcgtggccctcaagcgctccagctggctgatcgtgctgctcgtcctgctgaccgtgtccctcagccccgtgcagtccgcacccgtcgggcacggcaagaccatcgagacgtaccagacgcgcgagggattcaccagcatctgcctgttcatgctggggtccatactcttcatcgtgagctgccttgtgaagggcctggtcgactccgtgagcgactcgttcttcccggggctcagcgtgtgccggacctgctccatcggcagcataaacgggttcgagatcgagtcccacaagtgctactgcagcctgttctgctgtccctactgccggcactgctccgccgaccgcgagatccaccagctgcacctctcgatctgcaagaagcggaagacgggctccaacgtcatgctggcggtgtgcaagcgcatgtgcttccgcgccaccatggaggcctctcggcgcgccctgctcatccgcagcatcatcaataccaccttcgtgatctgcatcctgacgctgaccatctgcgttgtgtccaccagcgccgtggagatggagaacctccccgcggggacctgggagcgcgaggaggacctgacgaacttctgccaccaggagtgccaggtcaccgagaccgagtgcctgtgcccctacgaggccctcgtgctgcggaagcccctgttcctcgactccatcgtgaagggcatgaagaacctgctgaactcaacctccctcgagacgagcctgtccatcgaggccccctggggcgccatcaacgtccagagcaccttcaagcccaccgtgtccaccgccaacatcgcgttaagctggtccagcgtggagcaccgcgggaacaagatcctcgtcacgggccggtccgagagcatcatgaagctggaggagcgcaccggtgtgtcctgggacctgggcgtggaagacgccagcgagtccaagctcctgaccgtcagcatcatggacctttcccagatgtacagcccggtgttcgagtacctcagcggggaccgccaggtggaggagtggcccaaggcgacctgcacgggcgactgccccgagcgctgcggctgcacctcctccacgtgcctgcacaaagagtggccccacagccggaactggcgctgcaatccgacctggtgctggggcgtagggaccgggtgcacgtgctgcggcgtggacgtgaaggatctgttcaccgaccatatgttcgtcaagtggaaggtggaatacatcaagaccgaggccatcgtgtgcgtcgagctcaccagccaggagcggcagtgctccctgatcgaggccgggacccgcttcaacctgggccccgtgaccatcaccctcagcgagccccggaacatccagcagaagctgcccccggagatcatcaccctgcacccaaagatcgaggagggcttcttcgacctcatgcacgtgcagaaggtcctgtccgccagcacggtgtgcaagctgcagtcctgcacccacgggatccccggtgacctccaggtgtaccacatcgggaacctgctgaagggcgaccgcgtcaacggccacctcatccacaaaatcgagccccacttcaacaccagctggatgtcctgggatgggtgcgacctggactactactgtaacatgggcgactggccgagctgcacatacacgggggtgacccagcacaaccacgccgctttcgtgaacctgctcaacatcgagaccgactataccaagacgttccacttccattcgaagcgggtcaccgcccacggcgacacgccccagctggacctgaaggcgcgccccacctacggggccggcgagatcaccgtgctcgtcgaggtggccgacatggagctgcacaccaagaaggtggagattagcggcctgaagttcgcctccctcgcctgcaccgggtgctacgcgtgcagctccggcatctcctgcaaggtccgtatccacgtggacgagcccgacgagctgaccgtgcacgtgaagtccagcgacccggacgtggtggccgccagcacgtccctaatggcccgcaagctcgagttcgggaccgatagcaccttcaaggccttctccgcgatgcccaagacctcgctgtgcttctacatcgtcgaacgggagtactgcaaatcctgcagcgaggacgacacgaagaaatgcgtggacacgaagctggagcagccccagtccatcctcatcgagcacaagggcaccatcatcgggaagcagaacgacacatgcaccgccaaggccagctgctggctagagagtgtcaagagcttcttctacggcctgaagaacatgctcggctccgtgttcgggaacttcttcatcggcatcctgctgttcctcgcccccttcgtgctgctggtgctgttcttcatgttcgggtggaagatcctcttctgcttcaagtgctgccgccgcacccggggccttttcaagtaccgccacctgaaggacgacgaggagaccgggtaccggcgaatcatcgagcggctcaacaacaagaagggcaagaaccgcctgctggacggcgagcggctcgcggaccgcaagatcgccgagctgttcagcaccaagactcacatcgggtaa

SEQ ID NO: 15251 - RNA, 5067 nt, synthetic construct
  misc_feature 1..5067: note = derived and/or modified CDS sequence (opt11) from CCHFV(V42/81)__GU477490.1__GP
  source 1..5067: mol_type = other RNA
atgcccaccaataccatgcacacgctgctcgtgtgcttcatcctgtacttacagctcctgggcctcgggggcgcccatgtccaaccgaacgccaccgaacacaaccgcaccaacaccacgaccgcgcccgggaccagccactccctcaagcccctggtgagcaccacgccccctcaggcccccgagtccagcaccatcaaacccaccacccccacgtccgagaccgagggcagcggggaggccaccccgttatccaacaccatccaggcccctagctcccccgagactaccagcgagcggcccgccaccgcggtgatctccaccagcggcacggactccaccaacagcaccacccagacgaccgacaacaacccgaccaccacggtcgggacctcccccagctccagcccctccacccccagcaccccgcaggggatccaccaccacgcccgcagcctcctgtccgtaacgagccccgagaccgtgactacccccaagcccacgtcgccccgggagatgagctccgaaaccagcaaccagcactccgccatgagccgcacccccacccaccacactgtcacccaggtgtctaccgagaacaccagccactccacgccccggcagcccgagagctccgcccaaccgacgagctccagccccatgacctcccccgcgcagagcaccctgctcatgtccgccgcccccaccgccgtgcagagcatccacccgagccccacgaaccgctccaagcggaacctggagaccgagatcatcctgaccctcagccagggcctgaagaagtattacgggaagatcctgaagctgctgcacctgaccctcgaggaggacacggagggcctgctggagtggtgcaagcgcaacctcgggtctaactgcgacgacgacttcttccagaagcggatcgaggagttcttcatgacgggcgagggctacttcaacgaggtcctgcagttcaaaacccccagcaccgtgtccccgacggagcccagccacgcccgcctgcccaccgcggagccattcaagtcctacttcgccaaggggttcctcagcatcgattccggctacttcagcgccaagtgctactcccggagctccaccagcgggctgcagctgatcaacgtgacccagcatccggcccgcatcgccgagacgcccggccccaagaccacctccctcaagaccatcaactgtatcaacctgcgggcgagcgtcttcaaggagaaccgcgagatcgagatttccgtgctgctcccccagattgccgtgaacctgagcaactgccacgtcgtaatcaacagccatgtgtgcgactactccctggacacggacggcccggtccggctcccccgcatcaatcacgaggggaccttcatccccggcacctacaagatagtgatcgacaagaagaacaagctgaacgaccggtgcaccctggtgacgaactgcgtcatcaaggggcgcgaggtgcggaagggccagagcgtgctccgccagtacaagaccgagatcaagatcgggaaggccagcaccggcagccggaagctgctgtccaaggagcccggcgacgactgcatcagccgcacccagctcatgcgcacggagaccgccgagatacacgacgacaactacggcggccccggggacaagatcaccatatgcaacggctccaccatcgtcgaccagcggctggggagcgagctgggctgttacacgatcaaccgcgtgaagtccttcaagctctgcgagaacagcgccaccggcaaggcgtgcgaggtcgactccactcccgtgaagtgccggcaggggttctgcctgaagatcacccaggagggccgtgggcacgtgaagctgagccggggctccgaggtcgtgctcgacgcctgtgacagctcctgcgaggtgatgatccccaaggggaccggcgacattctggtcgactgcagcggcggtcagcagcacttcctgaaggacaacctgatcgacctcgagtgcccccatatcccgctgctgggcaagctcgccatctacatctgccgcatgtccaaccacccccggacgaccatggccttcttgttctggttcgggttcggttacgtgatcacgtgcatcctgtgtaaggccttgttctacagcctaatcatcatcggcaccctgggcaagaagatcaagcagtaccgcgagctcaagccccagacctgcaccatatgcgagaccgcgcccgtgaacgccatcgacgccgagatgcacgacctgaactgctcctacaacatctgcccgtactgcgccagccggctgacgagcgacggcctcgcgcgccacgtcacgcagtgccccaagcggaaggaaaaggtggaggagaccgagctgtacctgaacctcgagcgcatcccctggatcgtgcggaagctgctgcaggtctccgagagcaccggggtggtgctcaagcgctccagctggctgatcgtcctgctcgtgctgctgaccgtgtccctcagccccgtccagtccgccccggtgggccacgggaagacgatcgagacctaccagacccgggagggcttcaccagcatctgcctgttcatgctgggctccatcctcttcatcgtgagctgcatcgttaaggggctggtggactccgtgagcgactccttcttccccggcctgagcgtctgcaagacgtgctccatcagctccatcaacgggttcgagatcgagtcgcacaagtgctactgctccctcttctgctgcccctattgccgccactgctctgcagaccgggagatccaccagctccacctgagcatctgtcgcaagcggcgcaccggctccaacgtgatgctcgccgtgtgcaagcgcatgtgcttccgggccaccattgaggtcagccgccgggcgctgctgatccgctccatcatcaacaccacgttcgtgatctgcatactcaccctgaccatctgcgtggtgagcacctccgccgtggagatggagaacctgccggccgggacgtgggagcgggaggaggacctcaccaacttctgccaccaagagtgccaggtgacggagaccgagtgcctgtgcccctacgaggccctggtcctccgcaagcccctgtttctggatagcatcgtgaagggcaagaagaacctcctgaactccacgagcctggaaacctccctcagcatcgaggccccctggggcgcgatcaacatccagtccacgttcaagccaaccgtcagcgccgccaacatcgccctgtcctggagctccgtcgagcacagggggaacaagatcctggtgagcggccgctccgagagcatcatgaagctcgaggagcggacgggggtgtcctggaacctgggcgtcgaggacgccagcgagagcaagctactcaccgtgtccatcatggacctgagccagatgtactcccccgtgttcgagtacctgagcggggaccgccaggtcgaggagtggcccaaggcgacctgcaccggcgactgccccgagcggtgcggctgcacgtccagcacgtgcctccacaaggagtggccgcactcccgcaactggcggtgcaaccccacctggtgctggggcgtggggaccgggtgcacgtgctgcggcgtggacgtcaaggacctttttatcgaccacatgttcgtcaagtggaaggtggagtacatcaagacggaggccatcgtctgcgtggaactgaccagccaggagcgccagtgctccctgatcgaggccgggacccggttcaacctgggccccgtgaccatcaccctgtctgagcctcgcaacatccagcagaagctcccgcccgagatcatcaccctgcaccccaagatcgaggagggcttcttcgacctgatgcacgtccagaaggtgctcagcgccagcaccgtatgcaagctgcagtcctgcacccatgggatccccggcgacctccaggtctaccacatcgggaacctgctgaagggcgaccgggtgaacggccacctgatccataagatcgagccgcacttcaacacgagctggatgtcctgggacggctgcgacctcgactactactgcaacatgggcgactggcccagctgcacctacaccggggtcacccaacacaaccacgcggccttcgtgaacctgcttaacatcgagacggactacaccaagaccttccacttccactccaagcgcgtgaccgcccacggcgagacgccccaactcgacctgaaggcccggcccgcctacggggcgggcgagatcaccgtgctggtggaggtggccgacatggagctccacaccaagaaggtcgagatcagcggcctgaagttcgcctccctggcctgcacagggtgctacgcctgcagcagcggcatctcctgcaaggtgcgcatccacgtggacgagccggacgagttaacagtccacgtcaagagcaacgaccccgacgtggtagcggcctccaccagtctgatggcccggaagctggagtccgggaccgacagcaccttcaaggccttctccgccatgcccaaaacgagcctctgcttctacatcgtggagcgcgagtactgcaagtcctgcagcgaggacgacacccagaaatgcgtggagaccaagctggagcagccccagtccatcctgatcgagcacaagggcacaatcatcgggaagcagaacgacacgtgcaccgcgaaggccagctgctggctcgagtccgtcaagagcttcttctacggcctgaagaacatgctgggctccgtgttcgggaacttcttcatcgggatcctcctgttcctggccccgttcgtgctcctggtcctgttctttatgttcgggtggaagatcctgttctgcttcaagtgctgccgccggacccgcggactcttcaagtaccggcacctgaaggaggacgaagagaccggttaccgccggatcatcgagcgcctgaacagcaagaagggcaagaaccggctcctggacggcgagcgcctggccgaccggaagatcgcggagctgttctccacgaagacccacatcgggtga

SEQ ID NO: 15252 - RNA, 5067 nt, synthetic construct
  misc_feature 1..5067: note = derived and/or modified CDS sequence (opt11) from CCHFV(ROS/HUVLV-100)__DQ206448.1__GP
  source 1..5067: mol_type = other RNA
atgcccaccaatataatgcacaccctgcttgtgtgttttatcctgtacctgcagctcctgggcctcgggggagcccaccgacagagcaacgctacggagcacaacgggactaataccaccacggcgccgtccaccagccagtccccgaagcccctggtcagcaccgcgcccccgcacgccctggagtccagcaccatcaagcccactacgcctgtgtcagagactgagggcagcggagagaccacgcccccgcccaacaccacccagggcccctccccgcccgaggccacccccgaaaggcccacgaccaccgccacgagcacgccctccaccgataacaccaacagcaccacgcacgtgaccgacaacaatccgacctcaaccatcagcacgtcccccagctctagcccctccacccccagcaccccgcagggtatccaccaccccgcccgcaacctgctcagcgtcagcagcccaaagacggccacgacgcccaccccgacctcccccggggagatcagctccgagacgagctccttacatagcgctatgtcccggaccagcaccctgtacacggccacccaagtttccacggagaacgcgaatcactctgcgcctcgtcagagtgagagctccgcccaacagaccaccaccagccccatgacgtccccggcccagagcatactcgtcatgtccgccgcacctaccgccatccagaacatccacccaagcccgacgaaccggagcaaacgcaacttggagatggagatcattctcaccctgtcccagggcctgaagaaatactacgggaagatcctgaagctccttcacctcacgctcgaggaggacaccgagggcctcctggagtggtgcaaacggaaccttgggtccaactgcgatgacgacttcttccagaagcgcattgaggagttcttcatgactggcgaaggctactttaacgaggtcctgcaattcaagaccctttccacgctcagccccaccgagccatcccacgcccgtccgccgaccgtggagccgttcaagagctacttcgccaagggattcctttccatcgactcaggctacttctctgcgaaatgctacccccgcctgagcacgtccgggctacagctgattaacgtgacgcaacacccggcgcgtatcgctgaaacccctggccccaagaccaccagcctgaagacgatcaactgcataaacctccgagcctccgtcttcaaggagcaccgggagatcgagatcaacgtgctgctgccgcagatcgccgtgaacctcagcaattgccacgtcgtgatcaactctcacgtgtgtgactacagcctagacaccgacggccctgtccgcctaccgcacatctaccacgaggggaccttcatccccggcacctacaagatcgtaatcgacaaaaagaacaagctcaacgaccggtgcacgctagtgaccaactgcgtcatcaaggggagagaggtgcggaagggccagtccgtgctgcgccagtataagaccgagatcaagatcgggaaagctagcaccggcagccggaagctcctgtccgaggaacccggcgacgattgcatcagccgcacgcagctgctccggaccgagaccgcggagatccacgacgataactatggtggcccaggggataagattaccatctgcaacgggtccacgatcgtcgaccagcgcctggggagcgagctgggctgttacaccatcaaccgcgtgaagtccttcaagttgtgtgagaacagcgccacgggcaagacctgcgaaatcgactccacgccggtgaagtgccggcaggggttctgcctgaagatcacccaagagggccgagggcacgtcaagttgagccggggctccgaggtggtcctggacgcctgcgacagctcctgcgaggtgatgatccccaaggggaccggcgacatactcgtggactgcagcggcgggcagcagcactttttgaaggacaacctgatcgacctcggttgcccccacatccccctgctggggaaaatggctatctacatctgccgtatgtccaatcacccgcggaccacgatggccttcctcttctggttcagcttcggctacgtcatcacgtgcatcttctgcaaggcgctgttctactcgctgatcatcatcggtaccctcggaaagaagatcaagcagtaccgcgagctgaagccacagacctgcaccatctgcgagaccgcgcccgtgaacgccatagacgccgagatgcacgacctgaactgcagctacaacatctgcccctactgcgcgagtcgattgaccagcgacgggctggccaggcacgtcccgcagtgcccgaagcggaaggagaaggtcgaggaaaccgagctgtacctcaacctggagcgcatcccctggatcgtgcggaagctgctccaggtgtccgagagcaccggggtcgccctgaagcgaagttcctggctgatcgtcctattagtcctgcttactgtcagcctgtctccggtgcagagcgcccccgtgggccacgggaagaccatcgagacctaccagacccgggagggcttcacgtccatctgcctcttcatgctcggcagcatcctgttcctagtcagctgcctcgtgaaggggctggtggacagcgtttccgacagtttcttccccggcttatctgtgtgcaagacctgctccatagggtccatcaacggcttcgagatcgagagccacaagtgctactgttccctcttctgctgcccctactgcaggcattgcagcgccgaccgggagatccatcaactgcacctttccatctgcaaaaagcgcaaaaccggaagcaacgtgatgctcgcggtatgcaagcggatgtgcttccgtgccaccatcgaggcctcccggcgcgccctgctgatccgcagcattatcaacactaccttcgtgatctgcatcctcaccttaaccatctgcgtcgtttcgacgtccgccgtggaaatggagaacctcccgagcggcacctgggaacgggaggaggacctcaccaacttctgccaccaagagtgccaggtgaccgagactgaatgcctgtgcccctacgaggcgctggtcctccgcaagcccctgttcctggactccatcgtgaagggcatgaaaaacctcctaaactctacgtccctggagaccagcctctcgatcgaggccccctggggcgcgatcaacgtgcagtctaccttcaagccgacggtctccaccgccaacatcgccctgagctggtccagcgtggagcaccggggcaacaagatcctggtcaccgggcgcagcgaaagcatcatgaagttggaggagcggaccggcgtctcctgggacctgggagtggaggacgccagtgagtccaaacttctcaccgtgagcatcatggacctcagccagatgtacagccccgtcttcgaatacctcagcggcgatcgccaggtggaggaatggcccaaggcgacctgcaccggcgactgccccgaaaggtgcgggtgcacctccagcacgtgcctccacaaggagtggccgcactccaggaactggcgttgcaaccccacctggtgctggggagtggggacagggtgcacatgctgtggagtagacgtgaaggacctgttcaccgaccacatgttcgtgaagtggaaggtcgagtacatcaagaccgaggccatcgtgtgcgtggagttaaccagccaggagcgccaatgctccctcatcgaggccggaacacgtttcaacctgggccccgtcaccatcacgctgagcgagccccgcaacattcagcagaagctcccgcccgagatcatcaccctgcaccccaaggttgaggaagggttcttcgacctgatgcatgtgcagaaggtcctctccgcaagcaccgtgtgcaagctgcagtcctgcacacacggcatccccggggacttgcaggtataccacatcggcaacctgctgaagggcgaccgggtcaacgggcacctgatccacaagatcgagccgcacttcaacactagctggatgtcctgggacggttgcgacctcgattactactgcaacatgggggactggcccagctgcacctacacgggggtgacccagcacaaccacgccgcctttgtgaacttactgaacatcgaaacggactataccaagaccttccacttccactccaagcgcgtgaccgcccacggggacactccccaacttgacctgaaggcccgtcccacctacggcgcaggcgagatcaccgtgttggtcgaggtggccgatatggagctgcacaccaagaaggtagagatcagcgggttaaagtttgccagtctggcctgcacgggttgctatgcatgcagctccgggattagctgcaaggtccgcatccacgtcgacgagcccgacgaactcaccgtgcacgtcaagtcctcggatcccgacgtggttgcggcgagcacctctctcatggcccggaagctggagttcggcaccgacagcacgttcaaggccttctcggctatgcccaaaaccagcctttgcttttacattgtcgaaagagagtactgcaagtcctgcagcgaggaggacacgcagaagtgcgtggacaccaagctggagcaaccccagtcaatcctgatcgaacacaaggggacgatcatcggcaagcagaacgacacgtgcaccgcgaaggcaagctgctggctcgagtccgttaagagcttcttttacgggctgaagaatatgctggggtccgtgtttggcaacttcttcattgggattctcctgtttctggccccgttcgtactgctcgtgttgttcttcatgttcggctggaagatcctgttctgcttcaagtgctgccggaggacccggggactcctgaagtaccggctgctcaaggacgacgaggagaccggttaccgccggatcatcgagcgcctgaacaacaagaagggcaagaatcggctgctcgacggagagcgcctggccgatcggaagatcgcggagctgttcagcaccaagactcacatcggctga

SEQ ID NO: 15253 - RNA, 5067 nt, synthetic construct
  misc_feature 1..5067: note = derived and/or modified CDS sequence (opt11) from CCHFV(5180-R-2011)__KR814874.1__GP
  source 1..5067: mol_type = other RNA
atgcccaccaacatcatgcacactctgctcgtgtgcttcatcctgtatcttcagctcctgggcctcgggggagctcacagacagagcaacgccacggagcacaacgggaccaacaccactacggcgccgtccaccagccagtcccccaagccgcctgtaagcacagccccgccctacgccccagagtctagcaccatcaaaccaacgactcccgcctcggagaccgagggcagtggggagaccacacccccacccaacaccacccaaggcccctctcctcctgaggccacccccgagcggcccgcaacgaccgccaccagcaccccctccacggacaacaccaacagcaccacccacgcgacggacaacaaccccacctccactatcagcacctccccatcgagcagcccgtccacgccgagcacgccccagggcatccaccatcctgcccgcaaccttttatcagtgtcctctccgaagaccgcgaccacccccacccccacctcccccggggacatcagctccgagaccagctccctgcacagcgctatgtcacggacaccgaccctccacaccgccacccaggccagcacagagaacgccaaccactccgcgcccaggcagagcgaatccagcgcgcaacaaacaaccacctcccccatgaccagcccggcccagcccatccttgtgatgtccgcagctcccacggcaatccagaacatccaccccagcccgacgaaccgctcaaagcgcaacctggagatggagatcatcctcacactgagccagggcctgaagaaatactacgggaagatcctcaagctgctgcatctcaccctggaggaggacacggagggcctgctcgagtggtgcaagaggaacttggggagcaactgcgacgacgacttcttccagaagcgcatcgaggagttcttcatgaccggcgagggctacttcaacgaagtgctgcaattcaagaccctcagcacccttagccccacggagccctcccacgcccggcccccgaccgtggagcccttcaagagctacttcgccaagggattcttatccatcgacagcggctacttttccgcaaagtgctacccgcgcctcagcacctccgggctgcagctgatcaacgtcacccagcaccccgcccggatcgcggagacccccggccccaagaccacctcactcaaaaccattaactgcatcaacctgcgcgcctccgtcttcaaggagcaccgggagatcgagatcaacgtgctgctcccccagatcgccgtgaacctgagcaactgccatgtcgtgatcaactcccacgtgtgcgactacagcctggacacggacggcccggtccgcttgccgcacatctaccacgaggggaccttcatccccggcacgtacaagatcgtgatcgacaagaagaacaagctgaatgaccggtgcaccctggtgacgaactgcgtcattaaggggcgcgagatccggaagggtcagtccgtgctccgccagtacaagaccgagatcaagataggcaaggccagcaccggctccagaaagctgctgtcagaggaacccggcgacgactgcatcagccgcacccagcttctgcggacggagaccgcagagatccacgacgacaactacgggggccccggcgacaagatcacgatctgtaacggcagtaccatcgtagaccaacgactggggagcgagctcggctgctacactatcaaccgcgtcaagtccttcaagctatgcgagaacagcgcgactggcaagacctgcgagatcgactccaccccggtgaagtgccggcaggggttctgcctgaagatcacgcaggaaggcagagggcacgtaaaattaagccggggcagtgaggtggtgctggacgcctgcgataccagctgcgaagtgatgatacccaaggggactggagacatcttagtcgactgctccggcgggcaacagcactttctgaaggacaatctcatcgacctgggctgcccacacatccccctattggggaaaatggccatctacatttgcagaatgagcaaccaccccagaaccaccatggccttcctattttggttttccttcggctacgtgatcacgtgcatcttttgcaaggcgctgttctacagcctcatcatcatcgggaccctggggaagaagatcaagcagtatcgtgagttaaagccccagacctgcaccatctgcgagacggcccccgtcaacgctatcgacgccgagatgcacgacctcaactgctcctacaacatctgcccatactgcgcaagccggctgactagcgacggcctggcgcgccacgtgccccagtgccccaagcggaaggagaaggttgaggagaccgagctctacctgaacctggagcgcattccatggatcgtccggaagctccttcaggtgagtgagtccaccggggtggctttaaagaggtcctcctggctcatcgtcctgctggtgcttctgacggtgagccttagccctgtccagtcagcccccgtgggccacggaaagaccatcgaaacctatcagacccgggagggcttcacaagcgtttgtctcttcatgctgggctcgatcctgtttctcgtcagctgcctggtgaaagggctggtggactctgtaagcgactccttcttccccggcctcagcgtgtgcaagacctgctcgatcggtagcatcaacggcttcgagatcgagtcccacaagtgctactgcagcctgttctgctgcccctactgccgccactgctcggccgaccgggagattcaccagctgcacctcagcatctgcaagaagcgcaagatggggtccaatgtaatgttggccgtctgtaagcggatgtgcttccgcgcgaccatcgaggccagccgtcgcgccctgcttatacgctccattataaacaccacgttcgtgatttgcatcctgaccctgaccatctgcgtggtaagcacctccgccgtggagatggagaacctcccatcaggcacgtgggaacgggaggaggacctgaccaacttctgccaccaggagtgccaggttaccgagaccgagtgcctgtgcccctacgaggccctcgtcctgcgcaaacccctgttcctcgactcaatcgtgaagggcatgaagaacctgttaaactcgacgagcttagaaacctccctgagcatagaggcgccctggggcgccatcaatgtgcagtccaccttcaagccgaccgtcagcacggccaacatcgccttatcatggtcatccgtggagcaccgggggaataagatccttgtgaccgggcgcagtgagagtatcatgaagttggaggaacggacaggcgtcagctgggatctgggggtcgaggacgcgtccgagagcaagctcctaaccgtgtccatcatggacctcagccagatgtactcccccgtcttcgagtacctcagcggcgaccgccaggtagaggagtggcccaaggccacgtgcaccggcgactgccccgagcggtgcgggtgcacctcctccacgtgtctccacaaggagtggccgcatagcaggaactggcggtgcaaccctacctggtgttggggcgtgggtactggctgcacgtgctgcggggtcgacgtgaaggacctgttcaccgaccacatgttcgtgaagtggaaggtcgagtacattaagaccgaggcgattgtgtgcgtggagctcaccagtcaggagcgccagtgcagcctgatcgaggccggcacccggttcaacctgggccccgtcaccatcacgctctccgagccccgcaacatccaacagaagctaccgcccgagatcatcacgctccaccctaaggtggaagaggggttcttcgatctcatgcacgtgcagaaggtcctgagcgcctccacggtgtgtaagctgcaaagctgtacgcacggcatccccggggacctccaggtgtaccacatcggcaacctgctgaagggcgaccgggtgaacggtcacctcatccacaagattgaaccgcacttcaacacgtcctggatgagctgggacggctgcgacttggactactactgcaacatgggggactggcccagctgcacgtacaccggtgtgacccagcacaaccatgcggcctttgttaacctgctcaacattgagaccgactacacgaagaccttccactttcacagcaagcgagtcaccgcccacggcgacacgcctcagctggatctgaaggcccgacccacctacggtgccggcgagatcaccgtgctcgtcgaagtggcggatatggagctgcacaccaagaaggttgagatctccgggctgaagttcgccagcctcgcctgcaccggctgctacgcctgctccagtgggatttcctgcaaggtccgcatccatgtggatgagccggacgagctgacggtgcacgtcaagagcaacgaccctgacgtggtggccgcgtccaccagtctgatggctcggaagctcgagttcggcaccgactccaccttcaaggccttcagcgccatgcccaagacgagcttatgcttctacattgtggagcgcgaatactgcaagtcctgctcagaggaggacacacagaagtgcgtagacaccaagctggagcagccgcagagtatcctcatcgagcacaaggggactataatcggcaagcaaaacgatacctgcacagcgaaggcaagctgctggctggagtccgttaagagcttcttctacggcttaaagaacatgctcgggtccgtgttcggcaacttcttcatcgggatcctgctgttccttgcccccttcgtgctgttagtgctgtttttcatgttcgggtggaagatcctcttctgctttaagtgttgccggcgcacccgggggctgctgaagtaccgcttgctgaaggacgacgaggagaccggctatcgccggatcatcgagcgcctgaacaacaagaagggcaaaaaccgtctcttggacggggagaggctggccgaccggaagatcgcagaattgttttcaacgaaaacccacatcggctga

SEQ ID NO: 15254 - RNA, 5067 nt, synthetic construct
  misc_feature 1..5067: note = derived and/or modified CDS sequence (opt11) from CCHFV(5170-R-2011)__KR814873.1__GP
  source 1..5067: mol_type = other RNA
atgccctttaacatcatgcacaccctgctcgtgtgcttcatactatacctgcagctttcgggcctcgggggcgcccacgggcagtccaacgagactgagcataacggcacgaacaccaccacagtaccggggacgagccagtcccccaagccccctgcctcgacgaccctgcagcacacgccggagtcctcgacggtgaagctcaccacccccaccagtgagacggagggaagtggcgagaccaccccgcccccgaacaccacgcagggcctgcccccgcccggcaccacaccagagcgctccgcgacgacggccaccagcacctccagcaccgacaacatgaacagtacgacccaggtgaccgacaacacccctacgagcaccgtctccatcagcccctcctcttcccccagcatgccgagcacttcccaggggatccactacccaatccggtcactgctctccgtgagctcccccaaaacagtgacaacgcccactccgatcagccccggcgagatgtcccccgagaccagctcccagcacagcgccatgtcccgcatcccaacgctgtacaccgccacccaggtcagcaccgagaataccaaccggtccactccgcgccagagcgagtcctcggtgcagcccgccacccagtcccccatcacctcgcctgcgcagaccatcctgctcatgtccgctgccccaaaggccatacaggacatgcatccctcacccacgaaccggagcaagcgcaacctggaggtcgagatcatcctgaccctctcccaggggcttaagaagtactacggcaagatcctgaagttgctgcacctgactctcgaggaggacaccgaggggctgctcgagtggtgcaagcggaatctcgggagcaactgcgacgacgacttcttccagaagcgcatcgaagagttcttcatcacgggcgaggggtacttcaatgaggtcctgcagttcaagaccctgtccaccttgagcccgaccgagctgtcccacgtgcggctgcccacggcggagcccttcaaatcctacttcgccaagggcttcctctccatcgatagtggctatttctccgccaagtgctacccccgcagctccaccagcgggctgcagcttatcaacgtgacccaacacccggctcggatcgccgagacccctggtcccaagacgacctccttaaaaacaatcaactgcatcaacctgcgtgccagtgtcttcaaggagcaccgggaagtggagatcaacgtgctgctcccacaaatcgcggtcaacctgtccaactgccacgtggtgatcaacagccacgtctgcgactactccctggataccgacggccccgtgcgcctcccccggatccaccacgagggcacgttcattcccgggacctacaagatcgttatcgataagaagaacaagctgaacgaccgctgtagcctggtgaccaactgcgtcataaagggcagggaggtgcgcaagggccaaagtgtcctccggcagtacaaaaccgagatcaagatcgggaaggcttccacaggcagccgcaagctgctgagcgaggagcccggtgacgactgcatcagccggacccagctcttaaagaccgagaccgctgagatccacgacgacaactacggcgggccgggcgacaagataacgatctgcaacggctccaccatcgtggaccagcgcctgggaagcgagctaggctgctacaccatcaatcgcgtcaagtcctttaagctgtgcgagaacagcgccaccgggaagacgtgcgagatcgactccacccccgtgaagtgccggcagggcttctgcctgaagatcacccaggaggggagaggccacgtgaagctgagccggggctccgaggtcgtgctcgacgtgtgcgacagctcctgcgagatcatgatccccaaggggaccggcgacatcctggtcgactgcagcgggggccagcagcacttcctgaaggacaacctcatcgacctgggctgcccccacatcccgctgctcgggaagatggctatctacatctgcagaatgtccaaccacccacggacgacgatggccttcttattctggttcagctttggctacgtgataacctgcatcttctgcaaggccctgttctactccctcatcatcatcgggactttagggaagaagatcaagcagtacagagagctaaagccccagacctgcacgatctgcgagacagcacccgtgaatgccatcgacgcggagatgcacgacctcaactgcagctacaacatctgcccgtattgcgcatcccggctgaccagcgaggggctagcccgccacgtcacccaatgccccaagcggaaggagaaggtggaagagacggagctctacctgaacctggagcgcatcccatggattgttcgtaagctcctccaggtgagcgagtcgaccggtgtggccctgaagcgctcaagttggctgatcgtgctcttagtcctcctcaccgtgagcttatcccccgtgcagagcgctccggtcggccatgggaagaccatcgagacgtaccagacccgggagggcttcacctccatctgcctcttcatgttagggagcatcctgttcatagtgtcctgtctcgtgaagggcctggtcgacagcgtgtccgacagcttctttcccgggctgtccgtgtgcaagacctgcagcatcggctcaatcaacggtttcgagatagagagccacaagtgttactgctccctcttctgctgcccctactgccgccactgcagcgcggaccgggaaattcaccagctgcacctgtccatctgcaagaaacgcaagactggaagcaacgtcatgctcgccgtgtgcaaacggatgtgcttcaaggccacgatcgaggccagccgccgggcgctgctgatccgctctatcatcaacaccaccttcgtgatctgcatcctcacgctcgccatctgcgtcgtgagtacctccgcagtggaaatggaggacctgccggcaggcacctgggagagagaggaggacctcaccaacttctgccaccaggagtgccaggtcacggagaccgaatgcctgtgcccctacgaggctctggtgttacggaagcccctgttcctggacagcatcgtgaaggggatgaagaacctgctgaactccaccagcctcgagacctccctctcaatcgaggcgccctggggagccataaacgtccagagcacgttcaagccgaccgtgagcaccgcgaacatcgccctgtcctggagctccgtagaacaccgcgggaacaagatcctggtcacgggtcggagcgagtccatcatgaaacttgaggagcgcacgggcgtgtcatgggacttaggggtggaggacgcctccgagagcaagctgctcaccgtatccatcatggacctgagccagatgtattcccccgtgtttgagtatctgtccggcgaccgccaggtggaggagtggcccaaggctacctgcaccggggactgccccgagcggtgcggctgtacgagctccacctgtctccacaaggagtggccgcacagccggaattggcgctgcaaccccacctggtgctggggtgtcggcaccggctgcacgtgctgcggggtagacgtgaaggacctgttcactgatcacatgttcatcaagtggaaggtcgagtacatcaagaccgaagcaatcgtgtgcgtagagctgacctcccaggagcggcagtgctctctcatcgaggccggcacccgcttcaacctggggcccgtcacgatcaccctgtccgagccccggaacatccagcagaagctgccacccgagatcatcactctgcaccccaagatcgaggaaggcttcttcgatctgatgcacgtgcagaaggttctctcagcctccaccgtctgcaagctgcagtcctgcacgcatggcatccccggagacctgcagatctaccacatcggcaacctcctgaagggggaccgcgtcaatggccacctgatccacaagatcgagccgcacttcaacacctcctggatgagctgggacgggtgcgacctagactactactgcaacatgggcgactggccctcctgcacctataccggcgtcacgcaacacaatcatgccgccttcgtgaacctgttaaacattgagaccgactataccaagacctttcatttccacagcaagcgggttacggcccacggggacacgccccagctggacctcaaggcacgccccacctacggcgccggggagattaccgtcctggtggaagtcgcggacatggaactccacaccaagaaggtcgagatctccggcctgaagttcgccagcctgacctgcaccggatgctacgcctgctccagcggtatttcctgcaaggttcgcatccacgtggacgaaccggacgagctcaccgtccacgtaaagagctccgaccccgacgtggtcgccgcctccacgagcctgatggcgcgaaagttggagttcggcaccgactccaccttcaaggcctttagcgcaatgcccaagacctcgttatgcttctacattgtggagcgggagtactgcaagtcgtgctccgaggacgacacgaaaaagtgcgtggataccaagctggagcagccccaaagcatcctgatcgaacataaggggaccatcatcggcaagcagaacgatacctgcacagccaaagcgagctgctggctcgaatcggtcaagtctttcttctacgggctgaagaacatgttgggcagcgtgtttgggtccttcttcgtaggaatcctcctgtttctggcgccgtttgtcctgctcgtgctgttctttatgttcggctggaagatcctgttctgcttcaaatgctgccgccggacccgcgggctgttcaagtaccggcacctgaaggacgacgaggagacgggctaccgccgcataattgagaggctgaactctaagaaagggaagaaccgcttactggacggcgagcggctggccgaccgcaagatcgccgagttattctccaccaaaacgcatataggatga

SEQ ID NO: 15255 - RNA, 5067 nt, synthetic construct
  misc_feature 1..5067: note = derived and/or modified CDS sequence (opt11) from CCHFV(4701-ST-2009)__KR814872.1__GP
  source 1..5067: mol_type = other RNA
atgccgataaacatcatgcacaccctgctcgtgtgcttcatcctgtacctgcagctcagcggactcgggggagcccacgggcagtccaacgccaccgagcacaacggcacgaacaccaccaccgcgccagggactagccaatcccccaagccgcccgcaagcaccaccctcccgcacacccccgagtccagcacggtcaagctcacgacccccacgagtgaaacggagggttctggcgagaccactcccccgcccaacaccacccagggcctgcctctgaccggcaccacccccgagcgctccgccacgaccgccacgagcacctccagcacggacaacatgaactccaccacccaggtgactgacaacacgccgaccagcaccgtctccatatcaccctccagctccagcagcatgccctccactccgcaggggactcaccacccggtccggagcctcctgtccgtaagctcccccaagacggtgaccaccccgacgcccatgagcccgggggagatgtcacctgagacgagctcccagcacagcgccatgtcccgcgtccccaccctgtataccgcgacccaggtgagcacggagaataccgatcggtccacgccccgccagagcgagtccagcgtgcagccggcaacccagtcccccatcaccagccccgcccagactatcctcctgatgtccgccgcgcctaaggcaatccaggacatgcatccgagcccgaccaaccggtccaagcgcaacctagaagtcgagatcatactaaccctgtcccagggtctgaagaaatactacggcaaaatcctcaagttgctgcacctcactctagaggaggacacggagggcctgctcgagtggtgcaagcggaacctgggaagcaactgcgacgacgacttctttcagaagcgaatcgaggagtttttcatcacaggcgaggggtactttaacgaggtgctacagtttaagaccctctccacgcttagcccaactgaaccgagccacgtgcggctgcctaccgccgagccgttcaagagctacttcgccaaaggcttcctatccatcgacagcggctacttctccgccaagtgctaccctcgcagctcaaccagcgggctgcaactgatcaacgtaacgcaacacccggcgcggatcgccgagacccccggccccaagaccacctccctcaagaccatcaactgtatcaacttgcgcgccagtgtctttaaagagcacagagaggtggaaatcaacgtcctgctcccccagatcgccgtaaacctgtcgaactgccacgtggtcatcaattcgcacgtgtgcgactactccctggacaccgacgggccggtgcgcctcccccggatccaccacgagggaaccttcatccccgggacctacaagatcgtcatcgaccgaaagaacaaactgaatgaccggtgcagtctggtgactaactgcgtgatcaagggccgagaggttcggaagggccagagcgtgctccgccagtacaagaccgagatcaagatcggtaaagcctccaccggcagccggaagctgctgtccgaggagcccggggacgactgcatcagccgtacccagctattgaagaccgagaccgcggagatccacgacgacaactacggcggtccgggcgataagattacaatctgcaacgggtccaccgtcgtggaccagcgcctggggagcgaattaggctgctacacgatcaaccgggtgaagtccttcaagctgtgcgagaacagcgccacagggaagacctgcgaaatcgactccacccccgtcaagtgccgccagggattctgcctgaaaatcacgcaggaagggcggggccacgtgaaactgagccggggctccgaggtcgtcctcgacgcctgtgacagctcctgcgagatcatgatcccgaaggggaccggcgacatcctggtggattgcagcgggggccagcagcacttcctgaaagacaacctcatcgacttgggctgcccccacatcccgctgcttgggaagatggccatatacatctgccggatgtccaatcacccccgcaccaccatggcctttctcttctggttcagcttcggctacgtgatcacgtgcatcttctgtaaggctttgttctacagccttattataatcgggaccctgggcaagaagatcaagcagtaccgggaattgaaaccccagacctgcaccatttgcgagaccgcccccgtcaacgccattgacgccgagatgcacgacctcaactgctcatacaatatatgcccgtactgcgcatcacgtctgacgagcgacgggctggcgcgtcacgtgacccagtgccccaagcgcaaagagaaggtggaggagaccgagctctacctgaaccttgagcggatcccctggatcgtccgcaaactcctccaggtgagcgagtccaccggcgtcgccctgaagcggagctcgtggctgatcgtccttctggtgctcctgactgtgtccctgtcccccgtccagagcgcccctgtgggccacggtaaaaccatcgagacctaccagacccgcgaggggttcacgtccatctgtctcttcatgctagggagcatcctgttcatcgtgtcatgtttagtcaagggcctggtggacagcgtgtctgacagcttcttccccgggctatccgtttgcaagacgtgtagcatcggctccattaacggcttcgagatcgaatcacataagtgctactgctccctcttctgctgcccctactgccggcactgcagcgccgaccgcgagatccaccagctgcacctgtccatttgtaagaagcggaagaccgggagcaacgtgatgctcgcggtgtgcaagcgaatgtgcttcaaagccaccatcgaagccagccgtcgcgccttgctgatccgctctatcatcaacacgaccttcgtcatgtgcatcttaaccctggccatctgcgtggtgagcacctccgcggtcgagatggaggacctgccggccggcacgtgggagcgggaggaggatctcaccaacttctgccaccaggaatgccaggtgaccgaaacggaatgcctgtgcccctacgaggccctcgtgcttcgcaagcccctgtttttagatagtatcgtcaaggggatgaagaacctcctgaactccacgagcctggagacctccctcagcatcgaggccccctggggcgccatcaacgtgcagtccaccttcaagccgaccgtttccacggcgaacattgccctgtcctggagcagtgtcgagcacagagggaacaagatcctggtgaccggccgcagcgaatccatcatgaagctcgaggaacggaccggcgtgagctgggacctgggggtcgaagacgcctctgagagcaagctgcttaccgtgtccatcatggacctgtcgcagatgtactcacccgtgttcgagtacctgtccggcgaccgccaagtcgaggagtggcccaaggccacgtgcaccggggattgccctgagcggtgcggctgcacaagctccacatgcctccacaaggagtggccgcacagccgcaactggcggtgtaaccccacctggtgctggggcgtagggaccgggtgcacgtgctgcggggttgacgtcaaggatctgttcaccgaccacatgttcataaagtggaaggtggagtacataaagaccgaggctatcgtctgcgtcgagctgacctcccaggagcgccagtgcagcctcatcgaggcgggcacccgattcaatctcgggcccgtgaccatcacgctgtccgagccccgtaacattcagcagaagctcccgcccgagatcatcactctgcaccccaagatcgaggagggcttcttcgacctgatgcacgtgcagaaggtcctctcggcctccaccgtgtgtaagctgcagagctgtacccacggcatccccggggacctgcagatctaccacatcggcaacctcctgaagggagaccgggtcaacggccacctgatacacaagatcgagccacactttaacacctcctggatgagctgggatgggtgtgacctcgactactactgcaatatgggcgactggccctcctgcacgtacaccggcgtgacccagcacaatcacgccgccttcgtaaacctgctcaacatcgagaccgactacacgaaaaccttccactttcacagcaagcgcgtaaccgcgcatggggacacgccccagcttgacttaaaggcccggcccacgtacggcgccggggagataaccgtgctggtggaggtcgccgacatggagctgcacactaagaaggtggagatctccggcctgaagttcgcctccctgacctgcacggggtgttacgcttgctccagcgggatcagctgcaaggtccgcatccacgttgacgagccggatgagctaaccgtgcatgtcaagagcagcgaccccgacgtggtggccgcctccactagcctgatggcccggaagctggagttcggcaccgactccacgttcaaagcatttagcgcgatgcctaagacctccctctgcttctacattgtggaacgcgagtattgcaagtcctgctccgaagatgacaccaagaagtgcgtcgacaccaagctggagcagccccagagcatcctgatcgagcacaaggggactatcatcggcaagcagaacgacacatgcaccgcaaaagcctcctgctggctcgagagcgtaaagtccttcttctacgggttgaaaaacatgctgggcagcgtgttcggtggattcttcgtcggaatccttctgttcctggccccgttcgtactgctcgtgctgttcttcatgttcggttggaagatcctgttctgtttcaagtgctgccggcgcacccggggcctcttcaagtaccgccacctgaaggacgacgaagagaccgggtaccgccgcatcatcgaacgcctaaatagcaagaagggcaagaaccggctcctggacggcgagcgcctcgccgaccgcaagatcgcggagttattcagcaccaaaacccacatcgggtga

SEQ ID NO: 15256 - RNA, 5067 nt, synthetic construct
  misc_feature 1..5067: note = derived and/or modified CDS sequence (opt11) from CCHFV(4574-ST-2008)__KR814870.1__GP
  source 1..5067: mol_type = other RNA
atgcccaccaacatcatgcacaccctgctcgtgtgcttcatcctgtacctgcagctcctgggacccgggggcgcccacggccagcccaatgccacggagcacaaccgcaccaacaccaccacggcgcctagcacctcccagagcccaaagccgcccgtctccaccgccccaccccacgccctggagagcccgaccatcaagtccacgacccccacctcggagaccgagggttccggcgagactacaagccctcccaacaccacccagggcccgtccctcccagaaactacccccaaacgccccgccacgactgccacgagcaccccgtccaccgacaacaccaacagcacgacccacgtgaccgacaacaacccaacctccactatcagcacctcccccagctccagcccctccacgccgagcacgccccgcggcatccaccaccccgcgcggaacctgctgagcgtatccagccccaagaccgccaccaccccgacccccacctcccccggggagataagctccgagacatcctccctccacagcgccatgtcccgcacctccaccctgtataccgccacacaagcgtcaaccgaaaatgcaaaccacagcgcgccccggcaatccgagtcgcccgcccagcccacgaccacgtccctgatgaccagccccgcccagtccatcctcgtcatgagcgccgccccgaccgccattcagaatatccacccctcccccaccaaccgctcaaagcggaacctggagatggagatcatcctaacgctcagccagggccttaagaaatactacgggaagatcctgaaactcctgcacctgaccctcgaggaggacaccgagggcctgctggagtggtgcaagcgcaacctcgggtccaactgcgaggacgacttcttccagaagcggatcgaggagttcttcatgaccggcgagggctatttcaacgaggtgctgcagttcaaaactcttagcaccctctccccgactgagccgagccatgccaggccgcccaccgtggaacccttcaagtcctacttcgccaaggggttcctgagtatcgactcgggctacttcagcgctaagtgctacccgcggtccagcacgtccggtctccagctcatcaacgtcacccagcacccagcccgcatcgccgagacccccggccccaagaccacgagcctgaagaccatcaactgcatcaacctgcgggcctccgtgttcaaggagcaccgcgaaatcgaaataaatgtcctcctgccgcagatcgccgtaaatttaagcaactgccacgtggtgattaactcacacgtctgcgactacagcctcgacactgacggcccagtgcggctgccccacatctaccacgaggggaccttcatcccaggcacctacaagatagtgatcgacaagaaaaataaactaaacgaccgctgcaccctcgtgaccaactgcgtgatcaagggacgggaggtgaggaagggccagtccgtcctgcggcagtataagactgagatcaagatcgggaaggtcagcacgggcagccgtaagctactcagcgaggagtccggtgacgactgcatctcccggacccagctgttacgcacagagaccgcggagatccacgacgacaactacggtggcccgggtgacaaaatcacgatctgcaacggcagcaccatcgtggaccagcgcctcgggtccgaactgggctgctacaccatcaatcgggtcaagagtttcaaactttgcgagaactccgctaccggcaaaacgtgtgagatcgactctacccccgtgaagtgtcgccaggggttctgcctcaagatcacccaggaaggccgagggcacgtgaagctgtcccgcggcagcgaggtcgtgcttgatgcctgcgactctagctgcgaagtcatgatccctaaggggaccggcgacatactggtggactgctccggcgggcagcaacactttctcaaggacaacttaatcgacctgggatgcccccacatccccctcctggggaagatggccatctacatttgccggatgagcaaccaccccaggaccacgatggccttcctgttttggttctccttcggctacgtgattacctgcctgttctgcaaggctctgttctacagcctgatcatcataggcaccctcgggaagaagatcaaacagtaccgggagctgcgcccccagacctgcacgatatgcgagaccgcccccgtaaacgcgatcgacgccgagatgcacgacctgaactgctcctacaacatctgcccgtactgcgcgagccggctcacctctgacggcctggcccgccacgtaccccagtgccccaagcggaaggagaaggtggaagagaccgagttgtacctcaatttggagcgcatcccgtggatcgtccggaagctgctccaagtgagcgaaagcacgggagtagccctgaagcgctccagctggctgatcgtcctcctggtgctgctcaccgtgtccctgagccccgtccagtccgcccccgtgggccacgggaagaccatcgagacctaccagacccgggagggcttcaccagcatttgtctgttcatgctcggctccatcctattcctcgtgagctgcctcgtcaaggggttggtggactccgtgagcgactcgttcttccccggactgagcgtctgcaagacctgttccatcgggagcatcaacggcttcgagatcgagtcccacaagtgttactgcagcctcctgtgctgcccgtactgtcgccactgctcggccgaccgggagatccaccagctgcatctcagcatctgcaagaagcggaagaccgggtccaatgtgatgctggcggtgtgcaagcggatgtgctttcgtgccacgatcgaggccagccgccgggccctgctcatccgctccattatcaacaccaccttcgtcatctgcatcctgacgctgacgatctgcgtggtgtctacctcagcagtcgagatggagaacttgccgtcaggcacatgggagaaggaggaagacctgaccaacttttgccaccaggagtgtcaggtgacggagaccgagtgtctgtgtccctatgaagcgctcgtgctgcggaagcccctgttcttggactcaatagtcaaggggatgaaaaacctgctgaatagtaccagcctagagacctcccttagcattgaggccccatggggagccatcaacgtgcagtccactttcaagcccaccgtgagcaccgccaacatcgccctgtcctggagctccgtcgagcaccgcggcaacaagatcctcgtgaccgggcggtcagaatcgatcatgaagctggaggagcgcacgggcgtgagctgggacctgggggtcgaggacgcgtccgagagcaagctcctgactgtgtccatcatggacctgtcacagatgtacagccccgtgttcgagtacctctccggcgatcggcaggtcgaggagtggcccaaggccacctgtaccggcgactgccctgagcgctgcgggtgcacaagctccacctgtcttcacaaggagtggccccacagcagaaactggcgctgcaaccccacctggtgctggggtgtggggactggctgtacctgctgcggggtggacgtcaaggacctgttcacggaccacatgtttgtgaagtggaaggtcgagtacatcaagaccgaggccatcgtctgtgtggagctcacctcccaggagcggcagtgctcccttatcgaggcgggaacccgcttcaacctgggccccgtgacgataaccctctccgaaccgcggaacatccagcagaagctgccacctgagatcatcaccctgcacccaaaggtcgaggaagggtttttcgacctcatgcacgtgcagaaggtactgagcgcgtcaaccgtctgcaagctgcagagctgcacccacggcatcccgggggacctccaagtataccatataggcaatctgctgaaaggcgatcgcgtgaacgggcacttaatacacaaaatcgagcctcatttcaacacatcctggatgagttgggacggctgcgacctggattactactgcaacatgggggactggccctcctgcacctacaccggcgtcacgcagcacaaccacgccgcgttcgtgaatctgctcaacatcgagacagactacaccaagaccttccacttccacagcaagcgagtcacagcccacggggacactccccagctggacctgaaggcccgtccgacctacggggcgggcgagatcaccgtgctagtggaggtcgccgacatggagttacacacgaaaaaggtggagatctccgggctcaagttcgccagcctcgcgtgcaccgggtgctacgcttgctcatcggggatttcctgcaaggtgcgcatccacgtcgacgagcctgacgagcttaccgtgcatgtgaagagttctgaccctgacgtcgtggcagcctccaccagcttaatggcccgcaaactcgagttcggcaccgactccaccttcaaggccttcagcgccatgcccaagacctccctgtgcttttacattgtggaacgggaatactgcaagtcttgctccgaggaggacacccagaagtgtgtcgacacgaagctggagcagccgcagagcatcctcatagagcacaaggggacaatcatcggcaagcagaacgacacttgcacggcgaaggcctcctgctggctggagagcgtgaagtccttcttctacggcctcaagaacatgttggggagcgtcttcggcaacttcttcatcgggatactgctgttccttgctcccttcgtcctcctggtgctgttcttcatgttcggctggaagatactcttctgcttcaagtgctgccgccgagctcgtgggctgctgaagtaccgccacctcaaggatgatgaggagaccggctaccggaagatcatcgagcgcctgaacaacaagaagggcaagaaccggctgctcgatggggaacgcctggcagaccggaagatcgccgagctgttctccaccaagacccacatcggctga

SEQ ID NO: 15257 - RNA, 5067 nt, synthetic construct
  misc_feature 1..5067: note = derived and/or modified CDS sequence (opt11) from CCHFV(4495-ST-2008)__KR814869.1__GP
  source 1..5067: mol_type = other RNA
atgcccaccaacatcatgcacaccctgctcgtgtgcttcatcctgtacctgcagctcctgggacccgggggagcccacgggcagcctaacgccacggagcacaatcgcacaaacaccaccacggcgcctagcacctcccagagccccaagcctcccgtctccaccgccccgccccacgccctggagagcccgaccatcaagtccacgacccccaccagcgagacagagggctcaggggagacgacgccccctccgaacaccacccagggtccctctccgcccgagaccactcccgagcggcccgcaactactgccacgtccacccccagtaccgacaacactaactccacgacacacgtgaccgacaacaaccccaccagcacgatctctacaagcccgtcaagctcccccagcaccccctccacgcccagaggaatacaccaccctgcgagaaatctcctgagcgtgagctcccctaagactgccaccacccccacccccacgagcccgggggagatctcctcggagacctccagcctgcactccgcgatgagccgcacctccaccctttacaccgccacgcaggcgagcaccgagaacgccaaccactccacgccccggcagagcgaatcccccgcccagccgaccaccaccagcctgatgacctcgcccgcccagagcatcctggtcatgtccgccgcacccaccgccatccagaacatccaccccagcccgacgaacaggtccaaaaggaacttagagatggagatcatcctaactttatctcagggcttgaagaagtactacgggaagatcctgaaactgctgcacctgaccctggaggaggacaccgaaggcctcctggagtggtgtaagcgcaacctggggagcaactgcgacgacgacttctttcagaagcggatagaggagttcttcatgacgggtgagggctacttcaacgaggtgctccagttcaaaaccctgtccacgctgagccccaccgagccgtcccacgcccggcccccgacggtggagcccttcaagagctacttcgccaaggggttcctttccatcgacagcggttacttttccgccaagtgctacccccgcagcagcaccagcgggctgcagctgatcaatgtcacccagcaccccgctaggatcgcggagaccccgggccccaagacaacctccctcaagaccataaactgcatcaacctgcgggccagcgtattcaaggaacaccgcgagatcgagatcaacgtgttactcccccagatcgccgtcaatctgtccaactgccacgtggtgatcaacagccacgtctgcgactactccctggacaccgacggccccgtgagactcccgcatatctaccacgagggaactttcatccccggcacctacaagatagtcatcgacaagaagaacaagctgaacgaccgctgcacattagtcaccaactgcgtgattaaagggcgggaggtgcgcaagggccagagcgtactccgccagtacaaaactgagatcaaaatcgggaaggtctccaccgggagccgcaaactgctgtcggaggagtccggcgacgactgcatcagcagaacccaactcctgcgcactgagacggcagagatccacgacgacaactacggaggccccggagacaaaatcaccatctgcaacggctccaccatcgtggaccagcgcctggggagcgagctcggctgctacacaatcaatcgggtcaagtccttcaagctgtgcgagaactcggcgacgggcaaaacctgcgagatcgacagtacccccgtcaagtgccgccagggattctgcctgaagataacccaggagggccggggtcacgtgaaacttagccgcggttccgaggtcgtgctcgatgcctgcgactcttcctgtgaggtcatgatcccaaaggggaccggcgacatcctggtagactgctcgggcgggcagcagcacttcctgaaggacaacctcatagacctgggctgcccccacatacccctgctcggcaagatggccatctacatctgccggatgagtaaccaccccagaacgacgatggcgttcctgttctggttcagcttcggctacgtgataacctgcctgttctgcaaggccctcttttactccctaatcatcatcggcaccctggggaaaaagatcaagcaataccgggagctccgcccgcagacgtgtaccatctgcgagactgcgcccgtcaacgccatcgacgccgagatgcacgatctgaactgcagctacaacatatgtccctactgcgccagccggctgacctctgacggcctcgcgcgccacgtgccgcagtgccccaagcggaaggagaaggtcgaggagactgagctgtacctgaacctcgaacggatcccctggatcgtccggaagctgctccaggtgtccgagtcaaccggggtggccctgaagcgcagctcctggctgatcgtcctgctcgtgctgctgactgtcagcctctcccccgtccagagcgccccggtgggccacgggaagaccatcgagacctaccagacccgggagggcttcacctccatatgcctgttcatgctgggaagcatcctcttcctggtgtcctgcctcgtcaaagggctcgtggacagcgtgtccgattctttcttccccggcttgtccgtctgcaagacatgcagcattggttccataaacggcttcgagatcgagagccacaagtgttactgctccctgttatgctgcccctactgccgccactgcagcgccgatcgggagatccaccagctgcacctgtctatctgtaagaagcgcaagacggggagcaacgtgatgttagccgtgtgcaagcggatgtgtttccgcgcgaccatcgaggcgtcccgtagagccctgttgatccggagcatcatcaataccaccttcgtcatctgcatcctcacgctgaccatctgcgtggtgagcacctcagccgtcgagatggagaacctgcccagtggcacctgggagaaggaggaggacctcacgaacttctgccaccaggagtgccaggtgaccgagacggagtgcctgtgcccgtacgaggccctcgtgctccggaagcccctgttcctggacagtattgtcaaaggcatgaagaacctcctgaacagcaccagcctggagaccagcctctccatcgaggctccctggggcgcgatcaacgtgcagagcaccttcaagcccacagtgtccaccgccaacatcgcgctgagctggtcgagcgtcgagcatagggggaacaagatcctagtgacagggcggtccgagagcattatgaagctcgaggaacgcaccggcatctcctgggacctgggggtggaggatgccagcgagtccaagctgctcaccgtatcgatcatggacctgtcccagatgtactcaccggtgttcgagtaccttagcggcgaccgtcaagtggaggagtggcccaaggctacctgcactggcgactgtcccgagcgctgcgggtgcacctccagcacatgcctccacaaggagtggcctcactccagaaactggcgctgtaacccgacctggtgctggggcgtcgggaccggctgcacctgttgcggggtggacgtcaaggacctgttcaccgaccacatgttcgtgaagtggaaggtggagtacatcaagaccgaggccatagtgtgcgtcgagctgaccagccaggagcggcagtgctccttaatcgaggccggaacccgattcaacctggggcccgtgaccatcaccctgtcagagccgcggaacattcagcagaagctcccgccggagatcatcaccctccaccccaaggtggaggaggggttcttcgacctgatgcacgttcagaaggtgctctccgccagcacggtgtgcaagctgcagtcctgcacgcacggcatccccggggacctgcaggtctatcacataggcaacctcctgaaaggcgacagagtgaacgggcacctgatccacaagattgagccacacttcaacaccagctggatgtcctgggatggctgcgacttagactactattgcaatatgggggactggccgtcttgtacctacacgggcgtgacgcagcataaccacgcggccttcgtcaacctgctgaacatcgagaccgactacaccaagacgttccacttccactccaaacgggtgaccgcccacggtgacacgccccagctcgacctgaaggcaaggcccacctacggcgccggcgagatcaccgtactggtggaggtggcggacatggagctccacaccaagaaggtcgaaatcagcgggctgaagttcgcctccctggcctgcaccggctgctacgcatgcagctcggggatatcatgcaaggtgcggatccacgtggatgagcctgacgagctcaccgtccacgtgaagtccagcgacccggacgttgtagccgcgagcacctccctaatggccaggaagctggagttcggcaccgacagcacctttaaggccttctccgccatgcctaagaccagcctctgcttctacatcgtggagagggaatactgcaagtcctgtagcgaggaggacactcagcgctgcgtggataccaagctggaacagccccagtccatcctgatcgagcacaagggaaccatcattggcaagcaaaacgatacctgcacggccaaggcgagctgctggcttgagtccgtcaagagcttcttctatggcctgaagaacatgctggggtctgtgttcggtaatttcttcatcggtatcctcctgttcctggccccgttcgtgctgctcgtcttgttcttcatgttcggctggaagatcctgttctgtttcaagtgctgccgtcgcgctagagggctcctgaagtaccggcacttgaaggacgacgaagagaccggctaccgcaagatcatcgagcggctcaacaacaagaagggcaagaatcgcctgctggacggggagcggttggccgaccgcaagatcgctgagctgttcagcaccaaaacacacatcggctga

SEQ ID NO: 15258 - RNA, 5067 nt, synthetic construct
  misc_feature 1..5067: note = derived and/or modified CDS sequence (opt11) from CCHFV(3809-ST-2007)__KR814867.1__GP
  source 1..5067: mol_type = other RNA
atgcctactaatatcatgcatactctgctcgtgtgcttcatcttgtacctgcagctcctggggctcgggggcgcacaggggcagagcaacgccacggagcacaacgagaccaatacgaccacggcgccgtctacctctcagtcccccaagccgcccgtcagcacaacacccctgcacgcattagagtccagcaccataaagcccacaacccccgcccgcgagaccgaggggtccggggagactacgcccccacccaacaccacccagggccccagcccacctgaggccacccccgagcggcccgccacaaccgcgacttccgcacccagcacagacaacaccaattctaccacccacgtgactgacaacaacccgaccagcaccatctccaccagcccctcctcttcccccagcactccctttaccccgcagggcattcaccacccagctcgcaacctgctcagtgtgagtagccccaagaccgccaccacgccgacccctacaagtcccggggagctgagctccgagacgtcttccctgcacagcgcgatctccaggacgagcactctctatactgccacccaggtctccaccgagaatgccaaccactccgcacccaggcaatccgagagctcagcccagcccacgaccacctcccccatgacctccccggcccagagcatcctggtgatgtccgccgctcccacggccatccagaacatacatccgagccccaccaacaggtccaagcgcaatttagaaatggagatcattctcaccctgagccagggcctgaagaaatactacgggaagatcctgaagctcctgcacctcaccttggaggaggacacggagggcctgttggaatggtgcaagcgaaacctggggagcaactgcgacgacgacttcttccagaagcgcatcgaggagttcttcatgaccggcgagggctattttaacgaggtgctgcagttcaagaccttatccaccctgagccccacggagccctcccacgcccgtccgcccgcggtcgaaccattcaagagttattttgccaaggggttcttgtccatcgatagcggctatttctccgccaaatgctacccccgcagctctaccagcgggctccagctgatcaacgtgacccaacaccccgcccggatcgccgaaacccccggccccaaaacgacctctctgaagaccatcaactgcattaaccttcgcgcgagcgtgttcaaggagcaccgggagatagagatcaacgtgctactgccccagatcgccgtgaacctctccaactgccatgtggtcatcaactcgcatgtgtgtgactactccctagacaccgatggccctgtgcgcctaccccacatctaccacgagggaacgttcatccctggcacctacaagatcgtcatcgacaagaagaacaagctcaacgaccgctgcaccctggtgaccaactgtgtgatcaagggccgcgaggtccggaagggccagagcgtgctgcgccagtacaagacagagatcaagatagggaaagcatccaccggcagccggaagctcctgtctgaggagcccggtgacgactgcatctcccgcacgcagctgttgcggaccgaaacggccgagatccacgacgacaattatgggggccccggggacaagatcaccatctgcaacggctctaccatcgtggaccaacgactggggtccgaactgggttgctacaccatcaaccgcgtcaagagcttcaagctctgtgagaactctgccacgggcaagacctgcgagatcgacagcacccccgtgaagtgccggcaggggttctgcctgaaaatcacacaggaaggccgcgggcacgtgaagctgtcccggggtagcgaggtcgtgctggacgcgtgcgactccagttgcgaggtcatgatccccaaggggacgggcgatatattagtggactgctccggcgggcagcagcacttcctgaaggacaacttgatcgacttaggctgcccccacatcccgctgctggggaaaatggccatctacatttgccgcatgtctaaccacccacggaccaccatggccttcctcttctggttctccttcggctacgtgataacctgcatcttctgcaaggctctattctacagcctgatcatcatcggtactctcgggaagaagatcaagcagtaccgcgagctgaaaccccagacatgcaccatctgcgagaccgcccccgtcaacgctatcgacgccgagatgcacgacctgaattgtagttacaacatctgcccgtactgcgcaagccggctcacctccgacggtctggcccgccacgtcccacagtgccccaagcgtaaggagaaggtggaggagacggagctctacctcaacctggagagaatcccatggatcgtccgcaagctgctccaggtgagcgaatctaccggggtggcgctgaagcgcagcagctggctgatcgtcttattggtgttgttaaccgtgtccctgagccccgtccaatccgctccggtgggccacggaaaaacaatcgagacgtatcaaaccagggagggattcacttccatctgtctgttcatgctcggctccatcctctttctggtgagctgtttagtcaaggggctggtcgactccgtgagcgactccttcttccccggcctgagcgtctgcaagacatgctccatcgggtccgtgaacgggttcgagatcgagtcccacaagtgctactgcagcctcttctgctgtccatattgccgtcactgtagcgccgaccgggagatccaccagctgcacctgagcgtgtgcaagaagcgcaagaccggttccaacgttatgctcgcagtgtgcaaacggatgtgcttccgcgccaccatcgaagcgagcagacgcgccctgcttatccgctccatcatcaatacaaccttcgtgatctgtatcctcacgctgaccatctgcgtagtaagcacctcagccgtggagatggagaacctacccgcgggcacctgggagcgcgaggaggacctgacgaacttctgccaccaggagtgccaggtcaccgagacagagtgcctctgcccctacgaggccctggtgctccggaagcccctgttcctggacagcatcgtgaagggaatgaaaaacctcctgaactccacctccctggagacatcgctatccattgaggccccgtggggcgctataaacgtccagagcacctttaagcccaccgtctccaccgcgaacatcgccctgagctggtccagcgtggaacacagaggaaataagatcctggttacgggacgatccgagtcaatcatgaagctcgaagaacggactggcgtgtcctgggatttaggggtggaggatgcaagcgagagtaagctgctcacagtcagcatcatggacctgtcccagatgtacagccctgtgttcgagtacctgtccggcgaccgccaggtggaggagtggcccaaggcaacatgtaccggagattgcccggagcgttgcggttgcaccagctccacgtgcctccacaaggagtggccccacagccgcaactggcgctgcaaccccacctggtgctggggcgtcgggacgggctgcacgtgctgtggcgtggacgtgaaggatctgttcaccgaccacatgttcgtcaagtggaaagtggagtacatcaagaccgaggccatcgtgtgcgtcgagctgaccagccaggagagacaatgctccctcatcgaggccggcacacggttcaacctgggccccgtgaccataactctgtcggagcctcgcaatatccaacagaaactcccgccagagatcatcaccctgcaccccaaggtggaggaggggttcttcgacctgatgcacgtccagaaagtgctcagcgcctcaacggtgtgtaaactgcagtcctgcacccacggcatccccggggacctgcaggtatatcacattggcaatctcctgaagggcgaccgggtgaacgggcacctgatccacaaaatcgagccccactttaacaccagctggatgtcctgggacggctgcgacctcgactactattgcaacatgggagactggcccagttgcacctacacgggagttacacagcacaaccacgccgccttcgtcaacctgctgaacatagagacagactacacaaagacattccacttccattccaagcgtgtgaccgcccacggggacacgccacaactcgacctgaaggcccggcctacctacggcgccggcgagatcaccgtcctagtggaggtggcggacatggagctccacaccaagaaggtcgagatcagcgggctcaagttcgcctccctggcttgcaccggctgctacgcgtgcagctccgggatcagctgcaaggtgcgcatccacgtggatgagcccgacgaactcaccgtccacgtcaagagtagcgaccccgatgtggtcgcagcgtccacgagcctgatggcccggaagctggagttcggtaccgacagcaccttcaaggccttcagcgccatgcccaagaccagcctctgcttctacatcgtggaaaaggaatactgccgctcctgcagcgaggaggacacgcaaaagtgcgtggacacaaaactggagcagccgcagtccatcctgatcgagcacaaggggaccatcatcggtaagcagaacgacacgtgcaccgcaaaggccagctgctggctcgagtccgtaaagagcttcttctacggcctgaagaacatgctggggtccgttttcggcaacttcttcatcgggatcctcctgttcctgaccccattcgtgcttctggttctgttctttatgttcggctggaaaatcctgttctgcttcaagtgctgccgccgcacccgggggctcctaaagtacaggcacttaaaggacgacgaggaaaccggctaccgccggataatagagcgcctcaacaataagaagggcaagaaccggctgctggacggcgagcgactcgccgaccggaagatcgcggaactgttcagcacgaaaacccacatcggctga

SEQ ID NO: 15259 - RNA, 5067 nt, synthetic construct
  misc_feature 1..5067: note = derived and/or modified CDS sequence (opt11) from CCHFV(3756-ST-2007)__KR814866.1__GP
  source 1..5067: mol_type = other RNA
atgcctatcaacatcatgcataccttactcgtgtgcttcatcctgtacctgcagctcagcggcctgggtggcgcccacgggcaatccaacgccaccgagcacaaccgcacgaataccactaccgtcccgggaacgagccagtcccccaaaccgcccgcgagcaccaccctgccccacacccccgagtccagcactgtgaagctcacaacccccacctccgaaacggaggggagcggcgagactacccctccgcccaacaccactcagggactgcccctgcccgggaccaccccagagcggtctgccaccacggctaccagcacctccagcactgacaacatgaacacgaccacacaggtgaccgacaacacgcccacctccaccgtcagcatctccccctcctccagcccctccatgccgagtacttctcagggcatccactatccggtgcgctccctcctgagcgtgtcctctcccaagacggtcaccacccccaccccgatgtcacccggggagatgtctcccgagacgtctagccagcactccgccatgagccggatccccaccctttacaccgcaacccaggtaagtaccgagaacatcaaccgcagcacgccgcggcagtccgagagctccgttcagcccgcgacccagagccccatcacctcccctgcccagaccatcctcctgatgagcgccgccccgaaggcgatacaggacatgcacccctcccccacgaaccgcagcaagcggaacctggaggtcgagatcattctcaccctgagccagggcctgaagaagtactacgggaagatcctaaagctgctgcacctcaccctggaggaggacaccgaggggctgctcgaatggtgcaagcgcaacctgggctccaactgcgacgacgacttcttccagaagcggatcgaggagttcttcatcaccggcgagggctacttcaacgaggtgctgcagttcaagacactcagcaccctgtccccgaccgagcccagccacgtccgcctgcccaccgccgagcccttcaaatcctacttcgctaaggggttcctcagcatcgactctggctatttcagcgccaagtgctacccgcggtccagcacctcgggcctgcagctgatcaacgtcacccagcaccccgcccgcatcgcggagacccctgggcccaagacgaccagcctcaaaaccatcaactgcatcaaccttcgggcctccgtgttcaaggagcaccgcgaagtggagatcaacgtcctgctcccgcagattgccgtgaacctgtccaactgccacgtggtcatcaactcccacgtgtgcgactacagcctggacaccgacgggcccgtgcggctgccccgcatccaccacgaggggacgttcatccccggaacctacaagatcgtcatcgaccggaagaacaaactgaacgaccgatgctccctggtgactaactgcgtgatcaaggggcgggaggtccgaaagggccagagcgtgctccggcagtacaagaccgagatcaagatcggcaaggccagcacaggttcccgtaagctgctgagcgaggagccgggcgacgactgcatatcccgaacccagctcctgaaaaccgagaccgccgagatccacgacgacaactacgggggccccggggacaaaatcacgatctgcaacggcagcactatcgtcgaccaacggctgggctccgagctcgggtgctacaccatcaaccgcgttaagagcttcaagctgtgcgagaactccgctaccggtaagacgtgtgagatcgacagcacccccgtgaaatgccggcaggggttctgccttaagatcacccaggagggccgcggccacgtgaagctctcccggggttcggaggtggtgctagacgcctgcgactcctcatgcgagatcatgatccccaagggcaccggggacatcctggtcgactgctccggcgggcagcagcacttccttaaggacaacctcatcgacctgggctgcccacacatccccctgctcggtaagatggccatctacatctgccgtatgagcaaccacccccggactaccatggccttcctgttctggttttccttcgggtacgtgattacctgcatcttctgcaaagcccttttctacagtctaatcatcatcggcacgctgggaaagaagattaagcagtaccgcgagctcaagccccaaacatgtacgatctgcgaaaccgcgccggtcaacgctatcgacgctgagatgcacgacctcaactgttcgtataacatctgcccctactgcgccagccggctgacctccgacggcctggcccgtcacgtcacccagtgccccaaacggaaagagaaggttgaggaaacggagctctacctgaacctggagcgcatcccctggatcgtgcggaagctcttacaggtcagcgagtctactggagtagctcttaagcgctcctcttggttaatcgtgctgctggtcctcctgaccgtgtccctgtcgccggttcagtccgcccctgtcggccacggaaagaccatcgagacgtaccaaacccgggaggggtttacctcaatctgcttgttcatgctgggctccatcctgtttatcgtgagctgcctcgttaagggactggtcgactccgtgagcgactctttcttccccggcttaagcgtgtgcaagacttgctccatcgggtcgatcaacggattcgaaatcgagtcccacaagtgctactgcagcctcttctgctgcccgtactgccgtcactgctccgccgaccgcgagattcaccagctgcaccttagcatctgcaagaagcgcaagacgggctctaacgtcatgctcgccgtgtgcaagcggatgtgcttcaaggcgactatcgaggctagccgccgcgccttactgatccggagcatcattaacaccacctttgtgatctgcatcttgacgctggccatctgcgtcgtgtccacctctgccgtggagatggaagacctgcccgctgggacctgggagagggaggaggacctcaccaacttctgccatcaggagtgccaggtcacggagaccgagtgcctgtgcccctacgaggcgttagtgctccgcaagcccctgttcttggactccatcgtgaagggaatgaagaacctcctgaactctacctccctggagaccagcctctccatcgaggccccgtggggcgccatcaacgtccagagcacgttcaagcccaccgtgtccaccgccaacatcgcgctgagctggtccagcgtggagcaccgcgggaacaagatcctggtaaccggtcggtccgaaagcatcatgaagctcgaggagcgcacgggagtgtcctgggacctaggcgtagaggacgccagcgagtccaagctgctcaccgtcagcattatggacctgtcccagatgtacagcccagtgttcgagtatctgagcggggaccgccaggtggaggagtggcccaaggcaacctgcaccggcgactgcccggagcggtgcgggtgcacgtccagtacctgcctccacaaggagtggccccattcccggaactggcgctgcaaccccacatggtgctggggcgtcggaaccggctgcacgtgctgcggggtggacgtaaaggacctgttcacggaccacatgttcattaaatggaaggtcgagtacatcaagaccgaggccattgtgtgcgtggagctgaccagccaggagcgccagtgctccttaatcgaggcaggtacccgcttcaacctggggcccgtcacgatcaccctcagcgagccgcggaacatccagcagaagctccctcccgaaatcataacccttcaccccaaaatcgaagaggggttcttcgacctgatgcacgtgcaaaaggtcctctccgcaagcactgtctgcaaacttcaatcatgtacacacggcatcccgggcgacctgcaaatctaccacattgggaacctcctgaagggggaccgtgtgaacgggcacctgatccacaagatcgagccccacttcaacactagctggatgtcctgggacggctgcgacctcgactactactgcaacatgggggactggcccagctgcacctataccggcgtcactcagcacaaccacgctgccttcgtgaacctgctgaatatcgagaccgactacaccaagaccttccactttcactccaagcgggtgacggcccacggcgacactccccagctcgacctgaaggcgcgcccgacctacggggccggcgagatcaccgtcctggtggaggttgccgacatggagctccacacgaagaaggtcgagatcagcgggctgaagttcgcctcccttacctgcaccggctgctacgcttgcagctctgggataagctgcaaggtgcggatccacgtggacgagcccgacgagctcacagtccacgtgaagtccagcgaccccgacgtggtagcggccagcacgtccttgatggctcgcaagctggagttcggcaccgactctaccttcaaggccttctccgccatgcctaagaccagcctctgcttctacatcgtcgagcgggagtactgcaaatcctgtagcgaagacgacacgaagaagtgcgtggacaccaagctagaacagccgcagagcatcctgatcgagcataagggcaccatcatcgggaagcagaacgatacctgcacggcgaaggccagctgctggctcgagtccgtcaagagcttcttctacggcctgaagaacatgctggggtcagtgtttggcagcttcttcgtggggatccttctgttcctgaccccctttgtgttgttggtgctgttcttcatgttcggctggaagatcctgttctgcttcaagtgctgccgccggacccgtggccttttcaagtaccgccacctgaaggacgacgaagaaaccgggtaccggcgcatcatcgagcgattaaactccaaaaagggcaagaatcgcctcctcgacggggagcggctggccgaccgcaagatcgccgagcttttcagcactaagacccacattggctga

SEQ ID NO: 15260 - RNA, 5067 nt, synthetic construct
  misc_feature 1..5067: note = derived and/or modified CDS sequence (opt11) from CCHFV(81-R-2014)__KR814865.1__GP
  source 1..5067: mol_type = other RNA
atgcccaccaacatcatgcacacactgctcgtgtgcttcatcctgtatctgcagctcctgggcctaggaggggcccacgggcaatccaacgccacggagcacaacggcaccaacaccaccacggtcccctccaccagccagtcccccaagcccctcgtgagcaccacacccccgcacgcgctggagtcctccacgatcaagcccaccaccccaacctcggagacggaggggagcggcgagaccgcccctctgccgaacacgacccagggaccaccgccgcccgaaacgacccccgagcgtcccgctaccaccgtgacgtccacccccagcaccgacaacaccaactccacgatccacgtcaccgacaacaacccgacctcgaccatctccacgagcccctcctcgtcccccagcaccccctccaccccgcaggggattcaccaccccgcccggagcctcctgagcgtgtccagccccaagacggccacgacccctactccgacctcccccggcgagatcaacagcgagacgtccagcctgcactccgcgatgagccgcactcccaccctccacaccgccacccaggtgtccacggagaacgccaaccacagcgcaccccggcagtccgagagcagcgcccagccgaccaccaccagcctgatgacgtcgcccgcccagagcatcttgctcatgtccgccgcccccaccgccatccagaacacccacccgagccctaccaaccgctccaagcggaacctggagatggagatcatcctgacgcttagccaggggctgaagaagtactacggcaagattctaaagctgctgcacctgaccctcgaggaggacaccgaggggttgcttgagtggtgcaagcgcaacctcggcagcaactgcgacgacgacttcttccaaaagcggatcggcgagttcttcatgaccggggaaggctacttcaacgaggtcctgcagttcaagactctgtccaccctcagccctaccgagccgtcccacgcgcgcctgccgaccgtggagccgttcaagagctacttcgccaagggcttcttgtccatcgacagcggctacttcagtgccaagtgctacccccggagctccacgagtggcctccagctgatcaacgtgacccagcaccccgcacgcatcgccgagaccccggggcccaagaccacgtcgctgaagaccatcaactgcatcaacctccgggcgagcgtcttcaaggagcaccgcgaaatcgagatcaacgtgctgctgccccagattgctgtgaacctgtccaactgccacgtcgtgatcaacagccacgtgtgcgactactccctggacaccgacggccccgtccggctgccgcacatctaccacgaggggaccttcatccccggcacgtacaagatcgtgattgacaaaaagaacaagctcaacgaccgctgcaccctggtgactaactgcgtcattaaggggcgggaggtgcgcaagggccagtcggtgctgcggcagtacaagaccgagatcaagatcggcaaggcctccacggggagccgcaagctgctgagcgaggagcccggggacgactgcatctcccggacccagctgctccgcaccgagaccgccgagatccacgacgacaactacgggggccccggggacaagatcacgatctgcaacggcagcaccatcgtcgaccagcggctgggctccgagctggggtgctacaccatcaacagggtaaagagcttcaagctctgcgagaactccgccaccggtaagacgtgcgagatcgacagcaccccggtgaagtgtcgccaggggttctgcctcaagatcacccaggagggccgggggcacgtaaagctgtcccgcggcagcgaggtggtcctggacgcgtgcgactccagctgcgaggtgatgatccccaagggcaccggggacatcctcgtggactgctccggcgggcaacagcatttcctgaaggacaatctgatagacctcggctgcccccacatccccctgctgggcaagatggccatatacatctgccggatgagcaatcacccgcgcacaacgatggccttcctcttctggttctccttcgggtacgtcataacctgcatcttctgcaaggccctgttctacagcctgatcatcattggcaccctggggaagaagatcaagcagtaccgggagctgaagccccagacctgcacgatctgcgagaccgcccccgtgaacgcgattgacgccgagatgcacgacctgaactgctcctacaacatttgcccctactgcgcaagccgcctcacctccgacggcctggcacggcacgtgccgcagtgccccaagcgcaaagagaaggtcgaggagacggagttatacctcaatcttgagcggatcccctggatcgtgcgcaagctgctccaggtgagcgagtcaacgggggtcgcgctaaagcggagcagctggctgatcgtgctcctggtgctgctcaccgtctccctgtcaccggtgcagtccgcccccgtgggccacggcaagaccatcgagacctaccagacacgcgagggcttcaccagcatctgcctgttcatgctaggctccatcctcttcctcgtctcctgcctcgtgaaagggcttgtggactccgtcagcgactccttcttccccgggctaagcgtgtgcaagacctgctccattgggagcatcaacggcttcgagatcgagtctcataagtgctactgcagcttgttctgctgcccctactgccggcactgctccgccgaccgcgaaatccaccaactgcacctgagcatctgcaagaagcggaagaccggcagcaacgtcatgcttgccgtctgcaagcgcatgtgcttcagagccacgatcgaagcgagccgccgggccctgctgatccgcagcataatcaacaccacgtttgtaatctgcatcctcaccctgacgatatgcgtggtcagcaccagcgccgtggagatggagaaccttcccgccgggacctgggagcgcgaggaggacctcaccaacttctgccaccaggagtgccaggtgacggaaaccgagtgtctgtgtccctacgaggcactggtcctgcgcaagcccttattcctggactccatagtgaagggcatgaagaacctcctgaacagcacctccctggagaccagcctctccatcgaggcgccttggggagccatcaacgtgcagagcacgttcaagccgaccgtatccaccgctaatatcgccctgtcttggagcagcgtggagcaccgcggcaacaagatcttagtgaccgggcggtccgagagcatcatgaagctcgaggaacgcacgggtgtatcctgggacctgggcgtggaggacgccagcgagtccaagctgctcaccgtgagcatcatggacctgtcccaaatgtacagccccgtcttcgagtacctgtccggcgaccgccaagtggaggagtggcccaaggcaacgtgcactggcgactgccccgagcgctgcgggtgcaccagcagcacttgcctccacaaggagtggccgcactcccggaactggcgctgcaaccctacctggtgctggggcgtagggaccggctgtacctgctgcggcgtcgacgtgaaggacctgtttacggatcacatgttcgtaaagtggaaggtcgagtacatcaagaccgaggccatcgtgtgtgtggaactgaccagccaggagcgacagtgctccctcatcgaagccgggacccgcttcaatctgggccccgtaactatcaccttgagcgagccccggaacatccagcagaagctcccgcccgagatcatcaccctgcaccccaaggtcgaggagggcttcttcgatctgatgcacgtccagaaggtcctcagcgccagcaccgtgtgcaagctgcagtcctgcacgcacggcatccccggggacctacaggtgtaccacatcgggaacctgctgaagggcgaccgcatcaacgggcacctgatccacaaaatcgagccgcacttcaacacaagctggatgtcctgggacggctgcgacctcgactactattgcaacatgggggattggcccagctgcacctacaccggcgtcacgcagcacaaccacgcggccttcgtgaacctgctgaacatcgagaccgactacaccaagaccttccacttccattccaagcgggtcacggcccacggcgacacgccccagctcgacctgaaggcccgcccaacctacggggctggcgaaataaccgtgctggtagaggtcgcggacatggagctacacaccaagaaggttgagatcagcgggttaaagttcgcctcgctggcctgcaccggctgctacgcctgcagctccgggatcagctgcaaagtgcggatccacgtcgacgagccggacgagctcaccgtgcacgtgaagagtagcgacccggacgtcgtggccgcgtccaccagcctgatggcccgcaagctggagttcggcacggacagcaccttcaaggccttctccgccatgcctaagaccagcctctgcttctacatcgtggagcgggagtactgcaagtcctgcagcgaagaagacacccaaaagtgcgtcgacacgcgcctggagcagccccagtccatcctgatcgagcacaagggcaccatcatcgggaagcagaacgatacctgcaccgccaaggcgagctgctggctcgagtccgtgaagtcattcttctacggcctgaagaacatgctcgggtccgtgttcggcaacttcttcatcgggatcctactcttcctggcccccttcgtccttctcgtgttgttctttatgttcgggtggaagatcctgttctgcttcaagtgctgccggcgcacgcggggcctcctgaagtaccgccacctgaaggacgacgaggagaccgggtaccgccggatcatcgagcgcttgaacaacaagaagggcaagaaccgtctgctggacggggagcgcctcgccgatcgcaagatcgccgagctgttcagcaccaagacccacatcggctga

SEQ ID NO: 15261 - RNA, 5067 nt, synthetic construct
  misc_feature 1..5067: note = derived and/or modified CDS sequence (opt11) from CCHFV(75-ST-2010)__KR814864.1__GP
  source 1..5067: mol_type = other RNA
atgcccaccaacatcatgcacaccctgctcgtctgcttcatcctgtacctgcagctcctgggccccgggggcgcccacgggcagcccaacgccacggagcacaaccgcaccaacaccaccacggcccccagcacctcccagtcgcccaagccgcccgtctccaccgccccgccccacgccctggagagcccgaccatcaagtccacgacccccaccagcgagaccgagggctccggggagacgaccccgccgcccaacaccacccagggccccagcctccccgagacgacccccgagcggcccgccaccacggccacgtccacccccagcaccgacaacaccaactccacgacccacgtgaccgacaacaaccccaccagcacaatctccaccagcccctccagctcaccgagcacgccctccacgccccgcggcatccaccaccccgcgcggaacctgctgagcgttagctccccgaagaccgcaaccaccccaacccccacgagccccggggagatatccagcgagacatccagcctccactccgccatgagcaggacctccaccctgtacaccgccacgcaggcgagcacagagaacgccaaccactccgccccgcggcagagcgagagtccagcccagcccacgaccacgagcctgatgacctccccggcccagagcatcctcgtcatgtccgcggcccccactgccatccaaaacatccaccccagccccaccaaccgctccaagcggaacctggagatggagatcatcctgacgctcagccagggcctgaagaagtactacgggaagatcctgaagctcctgcacctgaccctcgaggaggacaccgagggcctgctggagtggtgcaagcgcaaccttgggagcaactgcgacgacgacttcttccagaagcggatcgaggagttcttcatgaccggcgagggctatttcaacgaggtgctgcagttcaagacgctgtccaccctcagcccgaccgagccctcccacgcccggcccccaaccgtggagccgttcaagagctacttcgccaaggggttcctgtccatcgacagcggctacttctccgcgaagtgttacccccgcagctccacgagcggtctacagctcatcaacgtcacccagcaccccgcccgcatcgccgagacccccggcccgaagaccacgtccctgaagaccatcaactgcatcaacctgcgggccagcgtgttcaaggagcaccgcgagatcgagatcaacgtgctcctgccccagatcgccgtcaacctgtccaactgccacgtggtgatcaacagccacgtctgcgactactccctcgacaccgacggacccgttcggctaccccacatctaccacgagggaaccttcatcccgggcacgtacaagatcgtgatcgacaagaagaacaagctgaacgaccgctgtaccctcgtcaccaactgcgtcatcaaggggcgggaggtgcggaagggccagtcagtcctgcggcagtacaagaccgagatcaagatcgggaaggtgtccacgggcagccgcaagctgctaagcgaagagtccggcgacgactgcatcagccgcacccagctgctgcgcaccgagaccgcggagatccacgacgacaactacgggggccccggggacaagatcacgatctgcaacggctccaccattgtggaccagcgcctcgggagcgagctgggctgctacaccatcaaccgagtcaagtccttcaagctgtgcgagaacagcgccaccggcaagacgtgcgagatcgactccacccccgtgaagtgccgccaggggttctgcttaaagatcacccaggagggccgggggcacgtgaagctgagtaggggctccgaggtcgtgctggacgcctgcgacagctcatgcgaggtcatgatccccaaggggaccggcgacatcctggtggactgcagcggcgggcagcagcacttcctcaaggacaacctgatcgacctgggctgcccgcacatccccctcctggggaagatggccatctacatctgccggatgtccaaccaccccaggaccacgatggccttcctgttctggttcagcttcggctacgtgattacctgcctcttctgcaaggcgctgttctactctctgatcatcatcggcaccctcgggaagaagatcaagcagtaccgggagctgcgcccccagacctgcacgatctgcgagaccgccccggtcaacgccatcgatgccgagatgcacgacctgaattgcagctacaacatctgcccctactgcgcatcccggctcaccagcgacggcctggcccgccacgtgccccagtgcccgaagcggaaagagaaggtggaggagaccgagctgtacctcaacctggagcgcatcccctggatcgtccggaagctgctccaggtttccgagagtacaggggtggccctgaagcgcagctcctggctgatcgtcctgctggtgctgctcaccgtcagcctgtcccccgtccagtccgcccccgtgggccacgggaaaaccatcgagacctaccagacgcgggagggcttcacctccatctgcctgttcatgctcggcagcatcctgttcctggtgtcctgcctcgtcaaggggctggtggacagcgtgtccgacagcttcttcccgggcctgtccgtctgcaagacctgcagcatagggtccatcaacggcttcgagatcgagagccacaagtgctactgctccctcctgtgttgcccctactgccgccactgcagcgccgaccgggagatccaccagctgcacctctccatctgcaagaagcgcaagaccgggagcaacgtgatgctggcggtgtgcaagcggatgtgcttccgcgccacgatcgaggcctcccgccgggccctgctcatccgcagcatcatcaacaccaccttcgtcatctgcatccttaccctaaccatctgcgtggtgagcacctccgccgtcgagatggaaaacctccccagcggcacctgggagaaggaggaggacctgaccaacttctgccaccaggagtgccaggtgacggaaaccgagtgcctgtgcccctacgaggcgctcgtgctgcggaagccgctgttcctcgactccatcgtcaagggcatgaagaacctgctgaacagcacctcgctcgagaccagcctgtccatcgaggccccctggggcgccatcaacgtgcagagcacgttcaaacccaccgtgtccaccgccaacatcgccctcagctggtcctccgtcgagcacagggggaacaagatcctcgtgaccgggcggtccgagagcatcatgaagctggaggagcgcacgggcgtgtcctgggacctgggggtcgaggacgcgtcagagagtaagctcctgaccgtgagcatcatggacctgtcccagatgtacagccccgtgttcgagtacctcagcggcgaccggcaggtagaggagtggccaaaggcgacctgcaccggcgattgcccggagcgctgcgggtgcacgtcctccacgtgcttgcacaaggagtggccccacagccggaactggcgctgcaaccccacctggtgctggggcgtggggaccggctgtacctgctgcggggtggacgtaaaggacctgttcaccgaccacatgttcgtgaagtggaaggtggagtacatcaagaccgaggccatcgtctgcgtggagctcaccagccaggagcggcagtgctctctgatcgaggccggtacccgcttcaacctgggcccggtgacgatcaccctcagcgagccccggaatatccagcagaagctgccgcccgagatcatcaccctgcatcccaaggtcgaggaggggttcttcgacctcatgcacgtgcagaaggtactgtccgccagcaccgtctgcaagctgcaatcctgcacacacggcatccccggggacctccaggtgtaccacatcggcaacctgctgaagggcgaccgcgtgaacgggcacctcatccacaagatcgagccccacttcaacaccagctggatgagttgggacggctgcgacctggactactattgcaacatgggggactggcccagctgcacctacaccggcgtcacgcaacacaaccacgccgccttcgtgaacctgctcaacatcgagacagactacaccaagaccttccacttccacagtaagcgggtcacggcccacggggacaccccgcagctggacctgaaggcccgccccacctacggcgcgggcgagatcaccgtgctcgtggaggtcgccgacatggagctgcacacgaagaaggtggagatcagcgggctgaagttcgcctccctcgcctgcaccggctgctatgcctgcagctccggaatcagctgtaaggtgcggatccacgtcgacgagcccgacgagctgaccgtgcacgtgaagtccagcgaccccgacgtcgtggcggccagcacctccctgatggcccgcaagctcgagttcggcacggacagcaccttcaaggccttctccgccatgcccaagaccagcctgtgcttctacatcgtggagcgggagtactgcaagtcctgcagcgaggaggacacccagaagtgcgtcgacacgaagctggagcagccccagtccatcctcattgagcacaaggggaccatcatcggcaagcagaacgatacctgcaccgctaaggccagctgctggctggagtccgtcaagagcttcttctatggcctgaagaacatgctcgggtccgtgttcggcaacttcttcatcgggatcctcctgttcctggcccccttcgtgctcctggtgctattcttcatgttcggctggaagatcctcttctgcttcaaatgctgtcgccgggcacgcgggctgctgaagtaccgccacctcaaggacgacgaggagacgggctaccggaagatcatcgagcgcctgaacaacaagaagggcaagaaccggctgctcgacggggagcgcctggcggaccggaagatcgccgagctgttctcaaccaaaacccacatcggctga

SEQ ID NO: 15262 - RNA, 5067 nt, synthetic construct
  misc_feature 1..5067: note = derived and/or modified CDS sequence (opt11) from CCHFV(75-R-2012)__KR814863.1__GP
  source 1..5067: mol_type = other RNA
atgcccaccaacatcatgcacacactgcttgtttgcttcattctgtacctgcagctcctgggcctcggcggggcccatcgtcagagcaacgccacagggcacaacgggaccaacaccaccaccgccccctccaccagccagtcccccaagcccctcgtgagcaccgcgcccccgcacgccctggagtccagcatcatcaagcacaccacgcccgtgagcgagaccgaggggtccggcgagaccacgccgccgcccaacaccacccagggcccaagccccctggagacaactcctgaacggcccgccaccaccgccaccagcacgccctccaccgacaacaccaacagcaccactcacgtgacggacaataatcccacctccaccatcagcacctcccccagctcgagcccgtccacgccgagcacgccccagggaatccaccacccagcccgcaacctcctaagcgtctccagcctgaaaacagccaccacgccgacccccacctcccccggcgaaatttccagcgaaaccagctccttacactccgccatgtccaggacatctaccctgtacaccgccacccaggtgtccaccgagaacgctaaccacagcgcgccaaggcagtccgagagctccgcccagcagaccaccaccagcccgatgacctcccccgcccagagcatcttagttatgtccgccgctcccaccgccatacagaacacccacccctcaccgaccaaccggagcaagcgcaacctcgagatggagataatcctgacactgtcgcaagggctcaagaagtattacggcaagatcctgaagttattacacctgacgctggaggaggacaccgaggggctcctggagtggtgcaagaggaatttgggcagcaactgcgatgacgacttcttccagaagcgcatagaggagttcttcatgaccggcgaagggtatttcaacgaggttctccagttcaagacccttagcacgcagagccccaccgagccctcacacgctcggcctcccaccgtggaacccttcaagtcatatttcgccaagggatttctttcgatcgacagcggctacttcagtgccaagtgctacccccgcttgagcacctccggcttacagctgatcaacgtgacgcaacacccggcgaggatcgccgagaccccgggtcccaaaaccacctcgctcaagacgatcaactgcatcaacctgcgcgcttcggtatttaaggaacaccgggagatcgagatcaatgtcctgctcccccagatcgctgtgaacttatctaactgccacgtcgtgatcaactcccacgtctgcgactacagcttggacaccgatggcccggtccgactcccccatatctaccacgaggggacctttatccccggaacctacaaaatcgtaatcgacaagaagaacaagctgaatgaccgatgcacgctggttactaactgtgtcatcaaggggcgcgaggtccgaaaggggcagtccgtcctccgccagtataagaccgagatcaagatcggcaaagcaagtaccggaagccgaaagctgctgtccgaggagccgggggacgactgcatttcacgaactcagctcctacggactgagactgcggagattcacgacgacaactacggtgggccgggggacaaaatcaccatctgcaatgggagcacgatagtcgaccagcgcctgggcagcgagctcggctgctacaccatcaaccgcgttaagtcgttcaagctgtgtgagaactcagccacagggaaaacctgcgagattgactctgcacccgtcaagtgccgacagggcttttgcctgaagatcacgcaggagggacgcggccacgttaagctgagccgggggtccgaggtagtactcgacgcctgcgatagctcctgcgaggtgatgatccccaagggcactggcgatatcctggtggattgcagcgggggccagcagcacttcctaaaggacaatctgattgacctgggttgcccccacatcccgctgctcggcaagatggccatctacatctgccgtatgtccaaccacccccggacgaccatggcgttcctattctggtttagcttcggctatgttatcacatgcatcttctgtaaggccctcttctattccctcatcattatcgggacgctaggtaaaaagataaagcagtaccgggagctgaagccccagacctgcaccatttgcgagaccgcccccgtgaacgccatcgacgcggagatgcacgacctaaactgctcatacaacatctgcccctactgcgcctcccggctgacgagcgacgggctcgccaggcacgtgccccagtgccctaagcggaaggagaaggtcgaagagaccgagctctacctcaacctggagcggattccctggatcgtgagaaagctcctccaggtgtccgaaagcaccggcgtcgccctgaagcgcagctcctggctcattgtgctgctggtgttgttgacggtcagcctgtccccggttcagagcgcccccgtggggcacggcaagacgatcgagacctaccagacccgggaaggcttcacctccatttgccttttcatgctcgggagcattctgtttctcgtaagttgcctggtgaagggtctcgtcaatagcgtctccgactccttcttcccggggctctccgtgtgcaagacgtgcagcatcggctccatcaacggattcgagattgagagccacaagtgttactgctccctgttttgctgcccttactgccgccactgcagcgcggaccgagagatccaccagctgcacctctctatctgcaagaaacgcaaaaccggcagcaacgtgatgctggcagtctgcaagcggatgtgcttccgcgccaccatcgaggcctcgcggcgcgccctcctcatccgcagcataattaacaccacgttcgtgatatgtatcctgaccctgactatttgcgtggtcagcacttccgcagtcgagatggagaacctcccctccggcacttgggagcgggaggaagatctgaccaacttctgccatcaagagtgtcaggtaaccgagaccgagtgcctgtgcccgtacgaggctctcgtcctgcgcaagcctctgttcctcgactccatcgtgaaggggatgaaaaacctgctgaactcgacgtcactggaaaccagcctgtccatcgaggccccgtggggcgccatcaacgtacagagcaccttcaaacccaccgtctccacggccaacatcgcgttgagttggtccagcgtggaacaccgtggcaacaagatcctcgtgaccggtcgctccgagagcatcatgaagctggaggaacggaccggggtctcctgggacctgggcgtagaggacgcctccgagtccaaactcctgaccgtgtcgatcatggacctgtcccaaatgtacagtcctgtcttcgagtacctctcgggcgaccgccaggtggaggaatggcccaaggccacgtgcacgggggactgcccggagcggtgcggctgcacctcctccacgtgcctgcacaaggaatggccccactcccgcaattggcggtgcaacccgacctggtgctggggcgtgggaaccgggtgcacatgttgcggcgtcgacgtgaaggacctatttaccgaccacatgttcgtgaaatggaaggtcgagtacatcaagaccgaggccatagtttgcgtggagctcacgagccaggaacgccagtgctcgctgatcgaggcggggactcgttttaacttaggacccgtcactataacactcagcgagccgcgtaacatccagcagaagctcccgcccgagatcatcacgctgcaccctaaagtggaggagggctttttcgacctaatgcatgtgcagaaggtcctctccgcctctaccgtgtgcaagctgcagtcctgcacccacggaatcccgggcgacctccaagtgtaccacatcggcaatctcctgaagggggaccgggtcaacggccatctcatccataagatcgaaccacacttcaataccagctggatgtcctgggatgggtgtgacctcgactactactgcaatatgggcgactggccgtcatgtacctatacaggggtgacccagcacaaccacgccgcgttcgtcaacctgttgaacatcgagactgattacacgaagacctttcacttccactcaaagcgagtgacggctcatggcgatacgccccagctggacctgaaggcgcggccgacctacggcgccggggagatcaccgtgctcgtcgaggttgccgatatggagctgcacaccaagaaagtagaaatcagcggcctgaagttcgcttccctcgcctgcacaggatgctacgcttgcagctccggcatcagctgcaaagtccgcatacatgtagacgagcccgacgagctgaccgtgcacgttaagtcgtcggatcccgacgtggtggccgcctcaacctccctgatggcccggaagctcgagttcgggaccgacagcaccttcaaggccttcagtgcgatgcccaagacgagcctgtgcttctacatcgtcgagcgcgagtactgcaagtcctgcagcgaggaggacacccaaaagtgcgtggacaccaagttagagcagccgcagtccatacttatagagcacaagggcaccatcatcggcaagcagaacgacacatgcaccgccaaggcaagctgctggcttgagtccgtaaagagcttcctgtacgggctcaaaaacatgctggggtccgtcttcgggaacttcttcatcggcatcctgctgttcctcgccccattcgtgctcctggtgctgttcttcatgttcggttggaagatcctcttctgcttcaagtgctgccgtcgcaccagaggcctcctcaagtaccgactgcttaaggacgacgaggagaccggctaccgccggatcattgaacgactcaacaacaagaaagggaagaaccgactgctggacggcgagcgcctcgcggaccggaagatcgctgagctgttcagtaccaagacacacattgggtga

SEQ ID NO: 15263 - RNA, 5067 nt, synthetic construct
  misc_feature 1..5067: note = derived and/or modified CDS sequence (opt11) from CCHFV(52-R-2014)__KR814862.1__GP
  source 1..5067: mol_type = other RNA
atgcccacaaacatcatgcacaccctgctcgtgtgcttcatcctgtacctgcagctcttgggcctgggaggtgcacaccggcagagcaacgccacggaacacaacgggaccaacaccaccacggcgccctccaccagccagtcccccaagccgcccgtcagcaccgctccgccccacgcccccgagtccagcaccatcaagcccacgacccccgcctccgaaaccgagggcagcggagagaccacgcctccgcccaacaccacccagggcccctccccgccagaggccacccccgaacggcccgcgacaaccgccacctccaccccctccaccgacaacaccaacagcaccacccacgccacggacaacaaccccacctccaccatcagtaccagtcccagctcgagcccgtccacgcccagcactcctcagggaatccaccacccggcaagaaacctgctgtcagtgtccagcccgaagaccgcgaccacccccaccccaacctcccccggggacataagctcggagaccagctccctgcacagtgccatgtcccggacgccgaccctccacaccgcgacgcaggcctcaaccgagaacgccaaccactccgcgccccgccagagcgagtccagcgcccagcagactaccacctcccccatgacctcccctgcccagcccatcctggtgatgtcagccgcccccacggcgatccagaacatccaccccagcccgaccaaccggtccaagaggaacctggagatggagatcatcctcaccctgagccagggactgaagaaatactacgggaagattctcaagctgctgcacctcaccctggaagaggacaccgagggcctgctcgagtggtgcaagcggaacctggggagcaactgcgacgacgacttctttcagaagcgcatcgaggagttcttcatgaccggggagggctactttaacgaggtcctgcagttcaaaaccctctccacactcagccccacggagccctcccacgcccggcccccgaccgtggagcccttcaagagctacttcgcaaagggtttcctgtccattgacagcggctacttttccgccaagtgctacccccgcctcagcaccagcgggctgcagctgataaacgtgactcagcaccccgcccggatcgcagagacgccgggacccaagaccaccagtctcaagaccatcaactgcatcaacctgcgcgcctccgtcttcaaggagcaccgggagatcgaaatcaacgtgctgctcccccagatagccgtgaacctgagcaactgccacgtcgtcatcaactcccacgtgtgcgactacagcctggacacggacggccccgtccgcctcccgcacatctatcacgaggggaccttcatccccggcacctacaagatcgtgatcgacaagaagaacaaactgaacgaccggtgcaccctggtaacgaactgcgtcatcaaggggcgcgaagtacgcaaggggcagtccgtgttacgccagtacaagaccgagatcaagatcgggaaggccagcaccggctcccggaagctgctgagcgaggagcccggcgacgactgcatcagccgcacccagctcctgcggacggagaccgccgaaatccacgatgacaactacgggggccccggggacaagatcaccatctgcaacggctccaccatagtagaccagcgcctcgggagcgagctcggctgctacacgatcaaccgcgtgaagtccttcaagttatgcgagaacagcgcaaccggcaagacctgcgagatcgactccaccccagtgaagtgccggcagggcttctgcctgaagatcacgcaggaaggccgcggccacgtcaagctcagccggggctctgaggtggtgctagacgcctgcgataccagctgcgaggtcatgatacccaaggggacgggcgacatcctggtggattgctccggcgggcagcagcactttctgaaggataatctcatcgacctgggctgcccccacgtccctctgctcgggaagatggccatctacatttgccgcatgagcaaccacccgcggaccaccatggccttcctgttctggttctccttcggctacgtgatcacgtgcatcttctgcaaggcgctattctattcactcataattatcggcaccctggggaagaagattaagcagtaccgcgagctaaagccccagacctgcaccatctgcgagacggcccccgtgaacgccatcgacgccgagatgcacgacttaaactgcagttacaacatctgcccgtactgtgccagccggctgacctccgacggcctggcgcgtcacgtcccccagtgccccaagcggaaggagaaggtggaagaaaccgaactgtacctgaacctggagcggataccctggatcgtgcggaagctacttcaggtctccgagtccaccggggtggccctgaaacgcagctcctggctcattgtgctgctggtcctcctaacggtgagcctgagccccgtgcagtccgcccccgtcggccacgggaagaccatcgagacctaccagacccgggaaggcttcacgagcgtgtgtctcttcatgctgggttccatcctgttcctcgtgagctgtctggtcaaggggctggtggattccgtgagcgactccttcttccccggcctcagcgtctgcaagacctgctccatcgggagcatcaacggcttcgagatcgagagtcacaagtgctactgcagcctgttctgctgcccctactgccgtcactgtagtgccgaccgggagatccaccagctgcacctcagcatctgcaagaaacgcaagatgggatcaaacgtgatgcttgccgtttgcaagcggatgtgcttccgcgcgaccatcgaggcgagccggcgcgccctgctcatccgctccatcatcaacaccacgttcgtcatctgcattctgaccctgaccatctgcgtggtgagcacctccgccgtcgagatggagaacctcccgagcggcacgtgggagcgggaggaggacctgaccaacttctgccaccaggagtgccaggtgaccgagaccgagtgcctgtgcccctacgaggccttggtgctgcgcaagcccctgttcctcgacagcatcgtcaaaggcatgaagaacctgctgaactccaccagcctcgagacctcactgagcatcgaggccccctggggcgccatcaacgttcagtccacctttaagccgaccgtgagcacggcgaacatcgccctgtcatggagctccgtagaacaccgggggaacaagatattggtaaccgggcgcagtgagtccatcatgaagctggaggagcgtaccggcgtgagctgggacctgggggtcgacgacgcgtccgagagcaagctcctgaccgtgtccatcatggacctgagccagatgtactcccccgttttcgagtacttatccggcgaccgccaggtcgaggagtggccgaaggcaacgtgcaccggcgactgccccgagcggtgcgggtgcacctcctccacgtgcttgcacaaggagtggccgcacagccgcaactggcggtgcaatcccacctggtgctggggcgtggggaccggctgcacgtgctgcggtgtggacgtcaaggacctgttcaccgatcacatgttcgtgaagtggaaggtggagtacatcaagaccgaggccatcgtatgcgtggagctcacaagccaggaacgccaatgcagcctgatcgaggccggtacacggttcaacctgggccccgtgaccattaccctctccgagccccgcaacatccagcaaaagctgcctcccgagatcataacgctgcaccccaaggtcgaggaggggttcttcgaccttatgcacgtacagaaggtgctgagcgcgtccaccgtctgcaaactgcagagctgcacacacggcatccccggagacctccaggtgtaccacatcggcaacctgctgaagggcgaccgggtgaacgggcacctcatccataagatcgagccgcactttaatacctcctggatgagctgggacggctgcgacctggactactactgcaacatgggggactggccctcctgcacgtacaccggcgtcacccagcacaaccacgcggccttcgtgaacctgctcaacatagagaccgactacacgaaaaccttccacttccacagcaagagagtcaccgcccatggggatacgccccagctggacttaaaggcccggcccacctacggcgccggcgagatcaccgtgttagtggaggtcgcggacatggagctgcacacgaagaaggtggagatctccgggctgaagttcgccagcctcgcctgcaccggctgctacgcctgctccagcggcatcagctgcaaggtgcgcatccacgtcgacgagcctgacgagctgacggtgcacgtaaagagcaacgaccccgacgtggtggccgcgtccaccagcctgatggcccgtaagctcgagttcggtaccgactccaccttcaaggccttcagcgctatgcccaagacgagcctgtgcttctacatcgtcgagcgcgagtattgcaagagttgctcagaagaggacacccagaagtgcgtcgacaccaagctggagcagccacagtccatcctcatcgagcacaaggggacaatcatcggcaagcaaaacgatacttgcaccgcgaaggccggttgctggctggagagcgtgaagtccttcttctacgggctgaagaacatgctcggcagcgtgttcgggaacttcttcatcggcatcctactgttcctcgccccgtttgtcctgctggtgctgttcttcatgttcggctggaagatcctcttctgcttcaagtgctgccggcgcacccggggcctgctgaagtaccgcctcctgaaagacgacgaggagaccggctaccgccggatcatagagcgcctaaacaacaagaaggggaagaaccggctcctggacggggagcgcttagccgaccggaagattgccgagctgttctccacgaagacccacatcggatga

SEQ ID NO: 15264 - RNA, 5067 nt, synthetic construct
  misc_feature 1..5067: note = derived and/or modified CDS sequence (opt11) from CCHFV(47-ST-2013)__KR814861.1__GP
  source 1..5067: mol_type = other RNA
atgcccatcaacatcatgcacaccctgctggcctgcttcatcctgtacctgcagctatccgggctcggcggagcccacgggcagtccaacgccaccgagcataacggtaccaataccaccaccgtgccggggacttcccagtcgcccaagccgccggccagtaccaccctgccgcacacccccgagagcagcacggtcaaactcaccacccccacctccgagaccgagggcagcggcgagacaacgcccccgcccaacaccacccaggggctgccaccgcccggcaccaccccggagcgctccgccaccaccgccacctccacctccagcaccgacaacatgaactccacgacgcagatgaccgggaacacccccacccccaccgtcaatatgagccctagtagttcccccagcatgccctccaccagccagggaatccactaccctgtccggagcctgctctccgtcccgagccccaagacagccaccacccccactccagttagccccggtgagatgagccccgagacctccagccagcattccgcaacgagccgcatccccaccctgtacaccgccacccaggtgtccaccgaaaatacaaaccggagcacgccccgccaaagtaagagttccgtgcagccggccacccagagccccatcacaccgccagctcagacgatcctgctcatgtccgcggccccaaaggccatccaggacatgcatcccagccccacgaatcggtccaagcgcaacctggaggttgagatcatcctgaccctcagccagggcctgaagaagtattacggcaagattctgaagctcctgcacctgacgctcgaggaggatacggaggggctcctggagtggtgcaagcggaacctcggctccaactgcgacgacgacttcttccagaagcgcatcgaggagttcttcatcaccggggagggctacttcaacgaagtgctgcagttcaaaaccctgagcaccctcagccccactgagccctcccacgtccggctgcccaccgccgagcccttcaagagctactacgccaagggcttcctgagcctggacagcggctacttctccgcgaagtgttacccgcggtcgtccactagcggcctgcagctaatcaacgtgacccagcaccccgcccggattgccgagacgcccgggcccaagaccacctccttaaagaccatcaactgcatcaacctgcgcgcctccgtttttaaagagcatcgggaggtcgagatcaacgtgctactcccgcagatcgccgtgaacctgagcaactgccacgtcgtgatcaacagccacgtgtgcgactaccccctggacacggacggccccgttcgcctcccccggatccaccacgaggggaccttcatcccgggcacctataagatcgtcatcgacaagaagaacaagctgaacgaccgctgctccctggtgaccaactgtgtcatcaagggacgtgaggtgcgcaaggggcagagcgtgctccggcagtacaagacggagataaagatcggcaaggcgtccaccgggagccgcaagctgctgtccgaggaacccggcgacgactgcatcagccggacccagctcctgaagaccgagacggccgagatccacgacgacaactacgggggtcccggcgacaagatcaccatctgcaacgggagcaccatcgtagaccagcgcctgggctccgagctcgggtgttacaccatcaaccgcgtgaaatccttcaagctctgcaaaaattcggccactggcaagacctgcgagatcgacagcacccccgtcaagtgccggcaggggttctgcctgaaaatcacccaggagggccgcggccacgtgaagttgtcccggggaagcgaggtggtcctcgacgcctgcgactcaagctgcgagatcatgatccctaagggcactggggacattctggtggattgctccggcggccagcagcacttcctgaaggacaacctcatcgacctggggtgtccccacatacccctgctcgggaagatggccatctacatttgtcgcatgagcaatcacccccggacaaccatggcgttcctgttctggttctccttcgggtatgttatcacgtgcatcttctgtaaggccctcttttacagcctcatcattatcggcactctggggaagaagatcaagcagtaccgcgagctcaagccgcagacgtgcactatctgcgagaccgcccccgtcaacgccatcgacgcagagatgcacgacctcaactgctcgtacaacatttgcccctactgcgcgagccggctaacgtccgacgggctggcccgccacgtcacgcagtgtccgaaacggaaggagaaagtggaagagaccgagctctatctgaacctggagcgcatcccctggattgtccggaaactcctccaggtgagcgaatccaccggcgtggccttaaagcgcagcagttggctcattgtcctgctggtgctcctaacggtgagcctaagccccgtccagtccgcccccgtgggacatggcaagaccatcgagacctaccagaccagagaggggttcaccagcatctgcctctttatgctgggctccatactgttcatcgtgagctgcctcgtcaaggggctggtggactccgtgagcgactccttcttcccgggcctgagcgtatgccgcacgtgctccatcggcagcatcaacgggttcgaaatcgagtcccacaagtgctactgcagcctcttctgctgcccctactgccggcattgctccgcggaccgtgagatccaccagctgcacctgagcatctgcaagaagcgcaaaaccggctccaacgtgatgctcgccgtgtgcaagaggatgtgcttcaaggccaccattgaggcctcccggcgcgccctgttcatccgctccatcattaacactacgttcgtgacctgcatcctgaccctcgcgatctgcgtggtgagcacctccgcggtcgagatggaggaccttcccgcagggacctgggagcgggaggaggacctaaccaacttctgtcaccaagagtgccaagtgacagagaccgaatgcctgtgcccctacgaagccctggtgctgcgtaagccgctgtttctggactctatcgtcaaggggatgaagaacctgctcaacagcacgtcactcgagaccagcctgtccatcgaggccccctggggcgcgataaacgtgcagtcgaccttcaagcccaccgtgtccaccgcgaacatcgctctaagctggtccagtgtcgaacaccggggcaacaagatcctggtgaccggccgctccgagtccataatgaagctggaggagcgaaccggggtgtcgtgggacctcggcgtcgaggacgccagcgaatccaagctgctgaccgtgagcatcatggacctctcccagatgtatagccccgtgttcgagtatctatccggggaccggcaggtcgaagagtggccgaaggctacatgcaccggcgagtgccccgaacggtgcgggtgtaccagcagcacgtgtttacacaaggaatggccccacagcagaaattggcggtgcaaccccacctggtgctggggcgtgggtaccggatgcacgtgctgcggcgtggacgtcaaggacctcttcaccgaccacatgttcatcaagtggaaggtggagtacatcaagaccgaggcgatcgtatgcgtcgaactgacgagccaggagcgccagtgctccttaatcgaggccgggactcggttcaacctcggcccggtgacaatcaccctgagcgagcccagaaacatccagcagaagctaccgcccgaaatcatcacgctccacccgaagatcgaggaaggcttcttcgatctgatgcacgtgcagaaggtcctgtccgccagcaccgtgtgcaagctccagtcctgcacccacgggatccccggagacctgcagatctaccatattgggaatctgctgaaaggcgaccgggtgaatgggcacctgattcacaagatcgagcctcacttcaacaccagctggatgagttgggacggctgcgacctggactactattgcaacatgggcgactggccctcatgcacgtacaccggggtcacccagcacaaccacgccgcgttcgtgaacctgctaaacatcgagaccgactacactaagaccttccattttcactccaagcgcgtcaccgcgcacggcgataccccgcagctggacctcaaggccagacctacttacggggccggcgagatcaccgtgcttgtggaggtagccgacatggagctgcacaccaagaaagtggaggtgagcggactcaagttcgcgtccctggcctgcacaggctgctacgcctgcagctccggcatcagctgcaaagtccgcatacacgttgacgagcccgacgagctgacggtgcacgttaagtctagcgaccccgacgtggtggccgcgtccaccagcctcatggcgcggaagctggagttcgggaccgactccaccttcaaggcattcagcgccatgccgaagaccagcctgtgcttctacatcgtcgagcgcgagtactgcaagtcctgctcggaagatgacacaaagaaatgtgtggacaccaagctcgagcagccccagtcaatcctgatcgagcacaagggcaccatcatcgggaagcagaacgacacgtgtacggccaaggcctcctgctggctggagtccgtcaagagcttcttttacggccttaagaacatgctggggtccgtcttcggcaatttctttgtgggcatcctcctgttcctggcgcccttcgtgctgctggtactcttcttcatgtttggatggaagatcctgttctgcttcaagtgttgcagacgcacccgaggcctgttcaagtaccgccacctcaaggacgacgaagagaccggatatcgccggatcatagagagactgaacagcaagaagggcaagaaccggctgctggacggcgagcgcctggccgaccgaaagatcgccgagctgttctccacgaaaacccacatcggttga

SEQ ID NO: 15265 - RNA, 5067 nt, synthetic construct
  misc_feature 1..5067: note = derived and/or modified CDS sequence (opt11) from CCHFV(46-ST-2012)__KR814860.1__GP
  source 1..5067: mol_type = other RNA
atgcccaccaacatcatgcacaccctgctcgtgtgcttcatcctgtaccttcagctcttgggccttggaggcgcccacgggcagagcaacgccacggagcacaacggcaccaacaccaccacggtcccgtccaccagccagtcccccaagcccctggtgagcaccacgcccccgcacgctctggagtccagcaccatcaagcccaccacccccacctccgagacggaggggagcggcgagaccgcgcccctgccgaacaccacccaggggcccccgccgcccgagaccacccccgagcgccccgccaccaccgtgacgtccacccccagcaccgataacacctccagcacgatccatgtcaccgacaacaaccccacctccaccatcagcacgtcccccagctccagcccctccacccccagcaccccgcagggaatccaccaccccgcccggagcctcctgtccgtgagcagccccaagacggccacgacccccaccccgaccagccccggcgagatcaactccgagaccagctccctgcacagcgccatgtcccgcacccccaccctccacaccgccacccaggtgagcacggagaacgccaaccattccgcgccccggcagagcgagtccagcgcccagccgaccaccacctccctgatgacgagccccgcccaatccatcctgctcatgagcgccgcccccaccgctatccagaacatccacccgtcccccaccaaccgcagcaagcggaacctggagatggagatcatcctgaccctcagccaggggctgaagaagtactacggcaagatcctgaagctcctgcacctgacgctcgaggaggacaccgaggggttactggagtggtgcaagcgcaacctcggctccaactgcgacgacgacttcttccagaagcggatcgaggagttcttcatgaccggcgaggggtacttcaacgaagtactgcagttcaagaccctgagcacgctctcccccaccgagcccagccacgcgcgcctgccgaccgtggagcccttcaagtcctacttcgccaagggcttcctgagcgtggactccgggtacttcagcgccaagtgctacccccggtccagcacctccggcctccagctgatcaacgtgacgcagcaccccgcccgcatcgcggagaccccgggccccaagaccacctcgctgaaaacgatcaactgcatcaacctccgggcgtcggtgttcaaggagcaccgagagatcgagatcaacgtgctgctgccccagatcgccgtcaacctcagcaactgccacgtggtgatcaactcacacgtctgcgactacagcctggacaccgacgggcccgtgcggctgccccacatctaccacgagggcaccttcatcccggggacctacaagatcgtgatcgacaaaaagaacaagctcaacgaccgctgcacgctggtcaccaactgcgtgatcaaaggccgggaggtgcgcaagggacagtcagtcctgcggcagtacaagaccgagatcaagatcggcaaggccagcaccggcagccgcaagctcctgtccgaggagcccggggacgactgcatcagccggacgcagctgctccgcaccgagaccgccgagatccacgacgacaactacggcgggcccggcgacaagatcaccatctgcaacgggtccactatcgtggaccagcgactgggcagcgagctaggctgctacaccatcaaccgcgtgaagtccttcaagctgtgcgagaacagcgctaccgggaagacctgcgagatcgactccacgccggtcaagtgccgccagggcttctgcctcaagatcacccaggaagggagaggccacgtgaagctgagccgcgggtccgaggtcgtgctggacgcgtgcgacagctcctgcgaggtcatgatcccgaaaggcaccggcgatatcctcgtcgactgcagcgggggccagcagcacttcctgaaggacaacctgatagacctcgggtgcccccacatccccctgttaggcaagatggccatctacatctgccggatgtccaaccacccgcgcaccaccatggccttcctcttctggttcagcttcggctacgtgatcacgtgcatcttctgcaaggccctgttctactccctgatcatcatcgggaccttaggcaagaagatcaagcagtaccgggagctgaagccccagacctgcaccatctgcgagacggcccccgtgaacgcgatcgacgccgagatgcacgacctgaactgcagctacaacatctgtccctactgcgcctcgcgcctcaccagcgacgggctagcccggcacgtcccgcagtgccccaagcgcaaagagaaggtggaggagaccgagttatacctcaacctggagcggatcccatggatcgtgcgcaagctgctccaggtctccgagagcaccggtgtggcgctgaagcggagctcttggctgatcgtgcttctggtcctgctcacggtgagcctcagccctgtgcagagcgcccccgtcgggcacggcaagaccatcgagacctatcagacccgcgagggcttcacgtccatctgcctgttcatgctcgggagcatcctgttcctggtgtcctgcctcgtgaagggcctggtcgacagcgtgtccgacagcttcttcccagggctgtccgtgtgcaagacctgcagcatcggctctatcaacgggttcgagatcgagagccacaagtgttactgttccctcttctgctgcccctactgccggcactgcagcgccgaccgcgagatccatcaactgcacctgtccatttgcaagaagcggaagaccgggagcaatgtcatgctcgccgtgtgcaagcgcatgtgcttccgggccaccatcgaggcgtcccgccgggccctgctgatccgcagcatcatcaacgccacgttcgtgatctgcatactcaccctgaccatctgcgtcgtgagcacctccgccgtggagatggagagcctgcctgccggcacgtgggagcgcgaggaggatctcaccaacttctgccaccaggagtgtcaggtcaccgagaccgagtgcctgtgcccctacgaggcgctggtgctacggaagcccctgttcctggactccatcgtgaaggggatgaagaacctcctgaacagcacgtccctggagaccagcctctccatcgaggccccctggggcgccatcaacgtccagagcaccttcaagccgaccgtgtccacggccaacatcgccctgagctggtccagcgtggagcaccgcgggaacaagatactggtcaccggccggtccgagagcatcatgaagctcgaggagcgcaccggggtgtcctgggacctgggcgtggaggacgcgagcgagtcaaagctgctcaccgtgagcatcatggacctgtcccagatgtacagcccggtgttcgagtacctgagcggcgaccgccaggtggaagagtggcccaaagccacgtgcacaggggactgccccgagcggtgcggctgcacctccagcacgtgcctccacaaggagtggccgcactcccggaactggcgctgcaacccgacctggtgctggggcgtcggcaccgggtgcacgtgctgcggcgtggacgtgaaggacctgttcaccgatcacatgttcgtcaagtggaaggttgagtacatcaagaccgaggccattgtgtgcgtcgagctgacaagccaggagcggcagtgctccctcatcgaggccggcacacgcttcaacctggggcccgtgaccatcaccctgagcgagccccggaacatccagcagaagttgccgcccgagatcatcacgctgcaccccaaggtggaggagggcttcttcgacctgatgcacgtccagaaggtgctctccgcgtcaaccgtgtgcaaactgcagtcatgcacccacgggatccccggcgacctgcaggtctaccacatcgggaacctcctgaagggggaccgcatcaacggccacctcatccacaagatcgagccgcacttcaacaccagctggatgtcctgggacgggtgcgacctcgactactactgcaacatgggcgactggcccagctgcacgtacaccggggtaacccagcacaaccacgccgccttcgtcaacctgctgaacatcgagaccgactacacgaagaccttccacttccattccaagcgggtgaccgcccacggcgacacgccccagctcgacctgaaggcccgccccacctacggcgcgggggagatcaccgtgctggtcgaggtggccgacatggagctgcacaccaagaaggtggagatcagcggccttaagttcgcctccctggcctgcacagggtgctacgcctgcagctccggcatcagctgcaaggtccggatccacgtggacgagccggacgagctcacagtgcacgtcaagtccagcgaccccgacgtggtggcggccagcacttccctgatggcccgcaagctggagttcgggaccgacagcaccttcaaggccttctccgccatgcccaagacgagcctctgtttctacatcgtcgagagggagtactgcaagtcctgcagcgaggaagacacccagaagtgcgtggacacccgcctggagcagccccagtccatcctgatcgagcacaagggcaccatcatcggaaagcagaacgacacgtgcaccgcgaaggccagctgctggctcgagtccgtcaagagcttcttctacgggctgaagaacatgctgggctccgttttcgggaacttcttcatcggcatcctcctgttcctggctccgttcgtgctgctcgtgctgttcttcatgttcgggtggaagatcctgttctgcttcaagtgctgccggcgcacccggggcctcctgaagtatcgccacctgaaggacgacgaggagactggctaccgccggatcatcgagaggctcaacaacaagaaggggaagaaccggctgctggacggcgagcgcctcgccgaccggaagatcgcggagctgtttagcacgaagacgcacatcgggtga

SEQ ID NO: 15266 - RNA, 5067 nt, synthetic construct
  misc_feature 1..5067: note = derived and/or modified CDS sequence (opt11) from CCHFV(44-ST-2010)__KR814859.1__GP
  source 1..5067: mol_type = other RNA
atgcccatcaacatcatgcataccctgctcgtgtgcttcatcctgtacctgcagctcagcggcctgggcggcgcccacgggcagtccaacgccaccgagcacaacggcacgaacacaactaccgtcccggggacgagccagtcccccaagccgcccgcgagcaccaccctgccccacacccccgagtcatccacggtgaagctcaccaccccaacaagcgagacggaggggagcggcgagaccacgcccccgcccaacaccacgcagggtctgcccccgcccggcaccacccccgagagacccgccacaacggcaacctccatgagctccaccgacaatatgaatagcaccacccaggtgaccgacaacacccccacctccacggtcagcatatccccgagctccagcccctccatgcctagcaccagccagggaatccactatcccgtacggtccctgctcagcgtgtccagcccgaagacagtcaccacgcccacccccatgtcccccggcgagatgagcccggaaacctccagccagcactccgccatgagccgcatccccaccttgtacacggccacccaggtgtccaccgagaacaccaaccggtccactccccgccagtccgagagctccgcgcagcccgccacccagagcccgaccacctcccccacccagacgatcctgttaatgagcgccgcacccaaggctatccaggacatgcacccgtcccccaccaaccggagcaagcgcaatctagaggtggagatcatcctgaccctcagccaggggctgaagaagtactacggtaagattctgaagctccttcacctgaccctcgaggaagatacggagggcctgctggagtggtgcaagcggaatctcgggtccaactgtgacgacgacttcttccagaagcgcatcgaagagttcttcatcaccggcgaggggtacttcaacgaggtcctgcagttcaagaccctgagcaccttatcccctacggagcccagccacgtgcggctgccgaccgccgagcccttcaagtcctactttgccaagggcttcctgagcatcgactccggctatttcagcgccaagtgctacccccgctccagcacctccgggctccagctgatcaacgtcacccagcaccccgccaggatcgcggagacgcctggcccaaagaccaccagcctgaagaccatcaactgcatcaacctccgcgcctccgtcttcaaggagcaccgggaggtggagatcaacgtgctgctgccgcagatcgccgtgaacctgagcaactgccatgtggtgatcaactcccacgtctgcgactacagcctggacacggacgggcccgtgcgcctgccgcggatccaccacgagggcaccttcatccccgggacatacaagatcgtgatcgacaagaaaaacaagctcaacgaccgctgctccttagtcaccaattgcgtgatcaaaggccgggaggtgcgtaagggtcagagcgtcctgcggcagtacaagacggagatcaagatcgggaaggccagcaccggctcccgcaagctcctgagcgaggagcccggggacgactgcatctcccggacccagctgctcaagactgagacggccgagatccatgacgacaactacggcggacccggagacaagatcaccatttgcaacggcagcacaatcgtggaccagcgcctgggctcggagctgggctgctacaccatcaaccgcgtcaagagcttcaagctctgcgagaactccgcgacggggaagacctgcgagatcgacagcaccccggtgaagtgccggcagggcttctgcctgaagatcacccaggaagggcgcggccacgtgaagctgtcccggggcagcgaggtcgtgctggacgcctgcgactccagctgcgagatcatgattcccaaggggacgggcgatatcctcgtggactgctccgggggccagcagcacttcctgaaagacaacctgatcgatctcggctgcccccacatccccctgctggggaagatggccatctacatctgccgcatgagcaaccacccccggaccaccatggccttcctcctgtggttcagcttcggctacgtcattacctgcatcttctgcaaggccctgttctacagcctcatcatcatcgggaccctgggcaagaagatcaagcagtaccgcgagctgaagccccagacgtgcaccatctgcgagaccgcgcccgtgaacgccatcgacgccgaaatgcacgacctcaactgctcctacaacatctgcccctattgcgccagccgactgacctccgacgggctggcccgccacgtgacgcaatgcccgaagcggaaggagaaggtagaggagaccgaactctacctgaacctggagcgcatcccctggatcgtgcggaagctcctccaggtgagcgagagcaccggcgtcgcgctgaagcggtccagctggctgatcgtgttgttggtgcttctgaccgtctccctgagccccgtgcagagtgccccggtaggccatggcaagacgatcgagacctatcagacccgggagggcttcaccaacatctgccttttcatgctagggagcatcctgttcatcgtcagctgcctcgtgaagggcctggtggacagcgtctccgacagcttcttcccgggtctgtccgtgtgcaagacgtgcagcttcggctccataaacggcttcgagatcgaaagccacaagtgctactgctccctcttctgctgcccctactgccgccattgctcagccgaccgggagatccaccagctgcacctggggatctgcaagaagcgcaagactggatccaacgtgatgctcgccgtttgcaagcggatgtgcttcaaggcgacgatcgaggcctcccgccgggccctgctgatccgctccatcattaacacaacgttcgttatctgtatcctgaccctggccatatgcgtggtcagcaccagcgcggtggagatggagaacctgcccgcggggacctgggagcgcgaggaggacctcacgaacttctgccaccaagagtgccaggtatccgaaacagagtgcctgtgcccgtacgaggctctggtcctccggaagcccttattcctggacagcatcgtaaaaggcatgaagaacctactgaactccaccagcctggagacttcccttagcatcgaggcgccctggggcgccattaacgtgcagtccacgttcaaaccgaccgtcagcaccgccaacatcgcactgtcctggagctccgtggagcaccgcgggaacaagatcctggtgaccggccggagcgagtccatcatgaagctcgaggagcgcacgggggtcagctgggacctgggcgtggaggacgcgtccgagagcaagttactcaccgtgtccatcatggatctgagccagatgtactccccggtcttcgagtacctgagcggggaccgccaggtggaggaatggcccaaggctacctgcaccggcgattgccccgagcggtgcgggtgcacgagctccacgtgcctccacaaagagtggccgcacagcaggaactggcgctgtaacccgacctggtgctggggcgtgggcaccgggtgcacctgttgcggcgtggacgtaaaggacctgttcactgaccacatgttcatcaagtggaaggtggagtacatcaagaccgaagccatcgtctgcgtggagctgacctcccaggagcggcagtgcagcctcattgaggctgggacccgcttcaacctgggccccgtgacgatcaccctctccgagccccggaacatccagcagaagctcccgccggagatcatcaccctgcaccccaagatcgaagaaggatttttcgacctgatgcacgtccagaaggtcctcagcgcatccaccgtgtgcaagctgcagagctgcacgcacgggatacccggcgacctgcagatttaccacatcgggaacctcctgaagggcgaccgcctgaacggccacctcatccacaagatcgagccgcacttcaacacctcttggatgagctgggacggctgcgacctggactactactgcaatatgggcgactggccgtcctgcacctataccggggtcacgcagcacaaccacgccgccttcgtgaacctgctcaacatcgagaccgactacaccaagaccttccacttccacagcaagcgggtcacggcccacggcgacacgccccagctggacctgaaggcgcgcccaacctacggggctggcgagatcaccgtgctcgtggaggtcgccgacatggagctgcacaccaagaaggtggagatctccggtctgaagttcgccagcctcgcctgcaccggctgctacgcgtgctccagcggcatctcctgcaaggtccggatccacgttgacgagcccgacgagctgaccgtgcacgtcaagagctccgacccggacgtggtggccgccagcaccagcctgatggcacgcaagttagagtttggaacggactccaccttcaaagccttctcagcgatgccgaagacctccctgtgcttctacatcgtggagcgggagtactgcaagagctgctctgaggatgacaccaagaagtgcgtcgacacgaagctggaccagcctcaaagcatcctcatcgagcataagggtaccatcatcgggaagcagaacgacacctgtaccgccaaggcctcctgctggctggagagcgtgaagtccttcttctacggcctgaagaacatgctcggatccgtgttcggcaacttcttcgtcggcatcctgctgttcctggcccccttcgtgctcctggtgctgttcttcatgtgtgggtggaagatcctcttctgcttcaagtgctgccgccggacgcgcggcctgttcaaataccggcacctgaaggacgatgaggagacggggtaccgccgcatcatagagcggctcaactccaagaagggcaagaaccgcctgctggacggcgagcggctcgctgaccgcaagatcgcggagctgttcagcacaaagtcccacattgggtga

SEQ ID NO: 15267 - RNA, 5067 nt, synthetic construct
  misc_feature 1..5067: note = derived and/or modified CDS sequence (opt11) from CCHFV(37-R-2013)__KR814858.1__GP
  source 1..5067: mol_type = other RNA
atgcccaccaacatcatgcacaccctgctcgtgtgtttcatcctgtaccttcagttactggggcttgggggagcccaccgccagagcaacgccacggagcacaacggaaccaacaccaccacggcgccctccaccagccagtcccccaagcctcccgtcagcaccgccccgccccacgcccccgagacctccaccatcaagcccaccaccccggcctccgagacggagggctccggtgagacgactcccccgcccaacaccacgcagggccccagcccacccgaggccacgcccgagcggccggcgacgaccgtgacatccacacccagcaccgacaacactaactccaccacgcacgccaccgacaacaaccccacgagcacgatctccacgagcccctcaagctccccgagcaccccatccacgccccagggcatccaccaccccgcccgcaacctcctgagcgtgtcctccccgaagaccgccaccactcccacccccaccagccccggggacatctccagcgagacgtccagcctgcactccgcgatgtctcggaccccgaccttacacacagcgacccaggcctccacggagaacgccaaccacagcgctccccgccagtccgagagctccgcgcagcagaccacaacctcccccatgacgtctccggcccagcccatccttgtcatgagcgccgcccccaccgccatccagaacatccacccctccccgaccaaccggagcaagaggaacctagagatggagatcatcctcaccctgtcccagggcctgaagaagtactacgggaagatcctcaagctgctgcacctcacgctggaggaagacaccgagggcctgctcgagtggtgcaagcggaacctggggagcaactgcgacgacgacttcttccagaaacgcatcgaggagttcttcatgaccggtgaggggtacttcaacgaggtgctgcagttcaagaccctcagcacgctgtcccccaccgaacccagccacgcgcggcccccgaccgtggagcccttcaagtcttactttgccaaggggttcctgagcatcgactccggatacttcagtgccaagtgctacccccgcctcacaacgtccgggctgcagctgatcaacgtcacccagcaccccgcccggatcgccgagaccccgggccccaaaaccacgagcctcaagaccatcaactgcatcaacctgcgcgcgtccgtgttcaaggaacaccgggagatcgagatcaacgtgctgctcccccagatcgccgtcaacctgagcaactgccacgtggtgattaattcccacgtctgcgactacagcctggacacagacggccccgtgcgcctcccgcacatctaccacgagggaaccttcatccccggcacgtacaagatcgtgatagacaagaagaataagctgaacgaccggtgtaccctggtcactaactgcgtgatcaaagggcgcgaggtgcggaagggccagtccgtcctccgccagtacaagaccgagatcaagatcgggaaggccagcacgggctcccggaagctgttaagcgaggagcccggcgacgactgcatctcccgcacccagctcctgcggaccgagaccgccgagatccacgacgacaactacgggggccccggggacaagatcacgatctgcaacggcagcaccatcgtggaccagcgccttggtagcgagctcggttgctacaccatcaaccgcgtgaagtccttcaagctgtgcgagaacagcgccaccggcaagacgtgcgagatcgactccaccccggttaagtgccggcaggggttctgtctgaagatcactcaggagggccgcgggcacgtgaagctcagcaggggctccgaggtggtcctcgacgcgtgcgacaccagctgcgaggtgatgatccccaaggggaccggcgacatcctggtcgactgctccggcgggcagcagcacttcctgaaggacaacttgatcgacctgggctgtccccatatccccctgctcgggaagatggccatctacatttgccgcatgagcaaccacccgcggacgactatggcctttttattctggttctccttcggatacgtgataacctgcatcttctgcaaggccctgttctacagcctcatcatcatcggtaccctggggaagaagatcaagcagtaccgggagctgaagccccagacatgcaccatctgcgagaccgcgcccgtgaacgccatcgacgccgaaatgcacgacctcaactgctcctacaacatctgcccgtactgcgccagccggctgacctccgacggcctggcacgccacgtcccccagtgccccaaacggaaggagaaggtggaggaaacggagctctacctgaacctggaacgcatcccctggatcgtgcggaagctcctgcaggtctccgagtccactggggtagcgctgaagagatcttcctggctcatcgtgctgctggtcctcctgaccgtcagcctgtccccggtgcagagcgcccccgtgggtcacgggaagaccatcgagacgtaccagacccgggagggcttcaccagcgtgtgcctcttcatgctgggctctatcctgttcctcgtgagctgcctggtcaagggcctggtggactccgtgagcgattccttcttccccggcctcagcgtctgcaaaacctgctccatcgggagcattaacggtttcgagattgagtcacacaagtgctactgcagcctgttctgctgcccctattgccgccactgcagcgccgaccgggagatccaccagctccacctcagcatctgcaagaaacgcaagatggggtccaacgtgatgctggccgtgtgcaagcggatgtgcttccgcgccacgatcgaggcgagcaggcgcgccctgttgatacgctccatcatcaacaccacgttcgtcatctgcatcctgaccctgacgatctgcgtggtgagcacgtccgccgtcgagatggagaacctcccgagcggcacctgggagcgggaggaggaccttaccaatttctgccaccaggagtgccaggtcacggagaccgagtgcctgtgcccctacgaggccctcgtgctgcgcaagcccttattcctcgactcgatcgtcaagggcatgaagaacctgctgaacagcaccagcctcgagacctccctgagcatcgaggccccctggggtgcgatcaacgtgcagtcgacgttcaagccaaccgtgtcaaccgccaacatcgccctgagctggagctctgtcgaacaccgggggaacaagatcctggtgaccgggcgcagcgagtccataatgaagttagaggagcggacgggcgtaagctgggacctgggcgtcgacgacgcatccgaaagcaaactcctgaccgtgtccatcatggatctgagccagatgtactccccagtgtttgagtacctcagcggcgaccgccaggtcgaagagtggcccaaggcgacctgcacaggcgactgccctgagcggtgcggttgcacatccagcacgtgcctgcacaaggagtggccgcactcccgcaactggcggtgcaaccccacctggtgctggggcgtggggaccggctgtacctgctgcggggtggacgtaaaggacttattcaccgaccacatgttcgtgaagtggaaggtggagtacatcaagaccgaggccatagtctgcgtggagctcaccagccaggagcgccagtgcagcctgatcgaggccggcacccggttcaacctgggacccgtgacgatcaccctctccgagccgcgcaacatccagcagaagctgccgcccgagatcatcaccctccaccccaaagtcgaagagggtttcttcgacttaatgcacgtgcagaaggtgctgtcagcctccaccgtctgcaagctgcagagctgcacgcacggcatcccaggggacctccaggtgtaccacattggcaacctactgaagggcgaccgggtgaacggccacctcatccacaagatcgagccacacttcaacacctcatggatgagctgggacggctgtgacctggactactactgtaacatgggggactggccctcctgcacctacaccggcgtcactcagcacaaccacgccgcgttcgtgaacctgctcaacatcgaaacagactacaccaagaccttccacttccacagcaagcgcgtcaccgcccacggggacacgccccagctggacctgaaggcccgtcccacctacggcgccggcgagataaccgttctcgtggaggtcgccgacatggagctgcacacgaagaaggtggagatctccgggctgaagttcgcgagcctcgcctgcaccggctgctacgcctgctccagcgggatctcctgcaaggtgcgcatccacgtcgacgagccggacgagctgaccgtgcatgtgaaaagcaacgaccccgacgtcgtggccgcctccaccagcctgatggcgcggaagctcgagttcggcacagactccacctttaaggcgttcagcgcgatgcccaaaacatccctgtgcttctacatcgtggaacgcgagtactgtaagagctgcagcgaggaggacacccagaagtgtgtcgacacgaagctggagcagccgcagtccatcctcatcgagcacaagggaaccatcattggcaagcagaacgtgacctgtaccgccaaggcgagctgctggctggagtccgtcaagagcttcttctacggcctgaagaacatgctcgggtccgtgttcggcaacttcttcatcggtatcctgctgttccttgcccccttcgtgctgcttgttctgttcttcatgttcggctggaagatcctcttctgcttcaagtgctgccgacgcacgcgggggctgctgaagtaccgcctcctgaaagacgacgaggagaccggctaccgccggatcattgagcgcctgaacaacaagaagggcaagaaccggctcctggacggggagcgcctggccgaccggaagatcgccgaactcttcagcaccaagacccacatcggctag

SEQ ID NO: 15268 - RNA, 5067 nt, synthetic construct
  misc_feature 1..5067: note = derived and/or modified CDS sequence (opt11) from CCHFV(36-ST-2014)__KR814857.1__GP
  source 1..5067: mol_type = other RNA
atgcccatcaacatcatgcacacactgctcgtgtgcttcatcctgtacctgcagcttagcggcttagggggcgcccacgggcagtccaacgccaccgagcacaatggcacgaacaccactaccgtcccggggacgagtcagtctcccaagccgcccgcgagcaccaccctcccccatacccccgaatccagcactgtgaagctcaccactcccacctccgagaccgagggctcgggcgaaacaacgcccccgcccaacaccacgcagggactgccccctcccggcaccacccccgagcgccccgccaccacggccacctccatgtcatccaccgacaacatgaacagcaccacccaggtgaccgacaacacacccacatccacggtcagcatctctccgtcgtccagcccttccatgccgagcaccagccaagggatccactaccccgtgcggtccctgctcagcgtgtcctcaccgaagaccgtcaccacgcccaccccaatgtcccccggcgaaatgagcccggagacttccagccagcactccgccatgtctcgcatccccaccctgtacacggccacccaggtgtccaccgagaacaccaaccggagcacgccccgccagtccgagagctccgcgcagcccgccacgcagagcccgaccaccagccctacccagacgatcttgctgatgagcgccgcacccaaggcgatccaagacatgcacccatcccccacaaaccgaagcaagcgcaacctggaggtggagataatcctgaccctcagccaggggctgaagaagtactacggcaagatcctgaaactcctgcatctgaccctcgaggaggacacggagggcctgctggagtggtgcaagcggaacctcggctccaactgcgacgacgacttcttccagaaacgcatcgaggagtttttcatcaccggcgaggggtacttcaacgaggtcctgcagttcaagaccctgagcaccctctcccccacggagccctctcacgtgcggctgccgaccgccgagcccttcaagtcgtacttcgccaagggcttcctgagcatcgactccggatactttagcgccaagtgctatccacgctcctcgacctccgggctacaactgatcaacgtgacccagcaccccgcccggatcgcggaaacgccgggccccaagaccaccagcctgaagaccatcaactgcatcaacctccgcgcctccgtgttcaaggagcaccgagaagtggagatcaatgtcctgctgccccagatcgccgtcaacctcagcaactgccacgtggtgattaactcccacgtctgcgactacagcctggacacggacgggcccgtgcggctgccgcggatccaccacgagggcaccttcattccaggcacctacaagatcgtgatcgacaagaagaacaagctcaatgaccgctgctccctggtgaccaactgtgtgatcaagggccgggaggtgcgcaagggccagagcgtcctgcggcagtacaagacggagatcaagatcgggaaggccagcaccggctcacgcaagctcctaagcgaggagcccggggacgactgcatctcccggacccagttactgaagaccgagacggccgagatccacgacgacaactacggcgggcccggcgacaagatcaccatctgcaacggaagcaccatcgtggaccagcgcctgggttccgagctgggctgttacaccatcaatcgagttaagagcttcaagctctgcgagaactccgcgacggggaagacctgcgagatcgacagcaccccggtgaagtgccggcagggcttctgcctgaagatcacccaggaagggcgcggccacgtgaagctgtcccggggcagcgaggtcgtgctggacgcctgcgactccagctgcgagatcatgatccccaaggggacgggagacatcctcgtggactgctccggtggccaacaacactttctgaaggacaacctgatcgacctcggctgcccccacatccccctgctggggaagatggctatctacatctgccgcatgagcaaccaccctcggaccacgatggccttcctcttctggttttccttcggctacgtcatcacatgcatcttctgcaaggccctgttctacagcctgatcatcatcggcaccctgggcaagaagatcaagcagtaccgcgagctgaagccccagacgtgcaccatctgtgagaccgcgccggttaacgccatcgacgccgagatgcacgacctgaactgctcctataacatctgcccctactgcgctagccggctcaccagtgacgggctcgcccgacacgtgacgcagtgcccgaagcggaaggagaaggtcgaggaaaccgagctgtacctcaacctggagcgcatcccctggattgtgcggaagctgctccaggtgagcgagagcaccggcgtcgcgctgaagcgctcctcgtggctgatcgtgctcctggtgctgctgactgtctccctgtcacccgtgcagtccgccccggtgggccacgggaagacgatcgagacctaccagacccgggagggcttcacgaacatctgcctgttcatgctagggagcatcctgttcatcgtctcctgcctggtgaagggcctcgtcgatagcgtctccgacagctttttccccgggctgtccgtatgcaagacgtgcagcatcggctccatcaacggcttcgagatcgagagccacaagtgctactgctccctgttctgctgcccctactgccgccactgcagcgccgatcgggagatccaccagctgcacctggggatatgcaagaagcggaagaccggatccaacgtgatgctggccgtctgcaaacggatgtgctttaaggcgaccatcgaggccagccgccgggccctcctgatccgttccataatcaacaccactttcgtaatctgcatcctgaccctcgccatctgcgtggtcagcaccagcgccgtggagatggagaacctgcccgcggggacctgggagcgcgaggaggacctgacgaacttctgccatcaggagtgccaggtgtccgagactgaatgtctctgtccgtacgaggccctggtcctccggaagccccttttcctggactctatcgtgaagggcatgaagaacctcctcaactccaccagcctggagacctccctgagcatcgaggccccctggggagccatcaacgtgcagtccacgttcaagcccaccgttagtaccgccaacatcgccctcagctggagctccgtggagcaccgcggcaacaagatcctggtaaccggccggagcgagtccatcatgaaactggaggagcgtactggggttagctgggacctcggcgttgaagacgcctccgagagcaagctgctgaccgtgtccatcatggacctcagccagatgtactcgcctgtcttcgagtatctgagcggggaccggcaggttgaggagtggcccaaggcaacctgcacgggcgactgccccgagcgctgcgggtgtacgagctccacttgcctgcacaaggagtggccccacagccggaactggcgctgcaacccgacctggtgctggggcgtgggcaccgggtgcacgtgctgcggcgtcgacgtgaaggacctcttcacggaccacatgttcatcaaatggaaggttgagtacatcaagaccgaggccatcgtctgcgtggaactgacctcccaggagcggcagtgcagcctgattgaggccgggacccgcttcaacctaggccccgtgacgatcaccctgtccgagccccggaacatccagcagaagctgcccccggagatcatcaccctccaccccaagatagaggagggcttcttcgacctgatgcacgtacagaaggtcctgagcgcctccaccgtgtgcaagctccagagctgcacgcacgggatccccggcgacctgcagatataccacatcgggaacctgctcaagggcgaccggctgaacgggcacctgatccacaagatcgagccccacttcaacacctcctggatgagctgggacgggtgcgacctcgactactactgcaacatgggtgactggccgtcgtgcacctacacaggggtcacgcagcacaaccacgccgccttcgtgaacttactgaacatcgagacagactacaccaagaccttccacttccacagcaagcgggtcacggcccacggcgacacgccccagctcgacctgaaagcccgccccacctacggggccggcgagataacggtgctggtggaggtcgccgacatggagctgcacacgaagaaggtggagatctccgggctgaagttcgccagcctggcctgcaccggctgctacgcgtgctccagcggcatctcctgcaaggtgcggatccatgtcgacgagcccgacgagctcaccgtccacgtcaagagcagtgacccggatgtggtggccgccagcaccagcctgatggcccgcaaacttgagttcgggacggactccaccttcaaggctttcagcgcgatgcccaagacgtccttgtgcttttacatcgtcgagcgggagtactgcaagagctgttccgaggacgataccaagaaatgcgtcgacaccaagctggaccaaccccagagcatcctgatcgagcacaagggcaccatcatagggaagcagaacgatacctgcaccgccaaagcctcctgctggctcgagagcgtgaagtcctttttctacggcctgaagaacatgctggggagcgtgttcggcaacttcttcgtcggcatcctcctgtttctggccccctttgtgctgctcgtgctgttctttatgtgcgggtggaagttcctgttctgcttcaagtgctgccgccggacgcgcggcctctttaagtaccggcatctgaaggacgacgaggagaccgggtaccgcagaatcatcgagcggctgaactccaagaagggcaagaaccgcctcctcgacggcgaacgtctggcagaccgcaagatcgcggaactcttcagcaccaagtcccacatcgggtga

SEQ ID NO: 15269 - RNA, 5067 nt, synthetic construct
  misc_feature 1..5067: note = derived and/or modified CDS sequence (opt11) from CCHFV(24-R-2012)__KR814856.1__GP
  source 1..5067: mol_type = other RNA
atgccgaccaacatcatgcacaccctgctcgtgtgcttcatcctgtaccttcagcttctcggcctcggaggcgcccatcgccagagcaacgccacggagcacaacggcaccaacaccaccacggctccgtccaccagccagtcccccaagccgcccgtaagtaccgccccgccccacgcccccgagtccagcaccatcaagcccacgacccccgcctccgaaaccgagggcagcggggagacaacgcccccgcccaacaccacccagggcccctctccgcccgaggccacccccgagcggacagcgaccaccgccaccagcacgccctccaccgacaacaccaacagcaccacgcatgccacggacaacaaccccacctccaccatcagcacgtcccccagttccagcccctccaccccgagcacgccccagggcatccaccaccccgcccgcaacctgctgtccgtgtccagccccaagaccgctaccaccccgacccccacctcccccggggacatcagctccgagacgagctccctgcatagcgccatgagtagaacccccacactccacaccgccacccaggccagcacggagaacgccaaccactccgcgccgcgccagagcgagtccagcgcccagcaaaccaccacctcccccatgacgtcgcccgcccaaccgatcctggtgatgtccgccgcccccaccgcgatccagaacatccaccctagccccaccaaccggtctaagcgcaacctggagatggagattatcctcaccctgagccagggcctgaagaagtactacgggaagatcctcaagctgctccacctcacgctggaggaggacaccgagggcctgctcgagtggtgcaagcggaacctgggcagcaactgtgatgacgacttcttccagaagaggatcgaggagttcttcatgaccggcgagggctacttcaacgaggtcctacagttcaagacgctcagtacgctgtcaccgaccgagccctcccacgcccggccgcccaccgtggagccgttcaagagctactttgccaagggtttcctgtcaatcgacagcggctacttctccgcgaagtgctacccccgcctctctacctccgggctgcagctgatcaacgtgacgcagcaccccgcccggatagcggagacccccggtccgaagaccacctcgctcaagacgatcaactgcatcaacctgcgcgcaagcgtcttcaaggaacaccgggagatcgagataaacgtgctgctcccccagatagccgtgaacctgagcaactgccacgtcgtgatcaactcccacgtgtgcgactacagcttggacaccgacggccccgttcgcctcccccacatctaccacgaggggaccttcatcccgggcacctacaaaatcgtgatcgacaagaagaacaagctgaacgaccggtgcacgctggtgaccaactgtgtcatcaaggggcgcgaggtgcggaagggccagagtgtgctccgccagtacaagaccgagatcaagattgggaaggccagcacgggctcccggaaactgctgagcgaggagcccggcgacgactgcatcagccgcacacagttactgagaaccgagaccgccgagatccacgacgacaactacgggggccccggggacaagatcaccatttgcaacggctccacgatcgtcgaccagcgcttggggtctgagctcggctgctataccatcaaccgggtcaagtccttcaagctgtgcgagaacagcgcgaccggcaagacctgcgagatcgactccacacccgtgaagtgccggcaggggttctgcctaaagatcacccaggagggcagggggcacgtcaagctcagcagaggctccgaggtggtgctggacgcctgcgacaccagttgtgaggtcatgatcccgaaggggaccggcgacatcctggtggactgcagcggcgggcagcaacatttcctgaaggacaacctcatcgacctgggctgcccccacatccccctgctcgggaagatggccatctacatctgccgcatgagcaaccacccccggaccacgatggcctttcttttctggttctccttcggctacgtcatcacgtgcatcttctgcaaagcgctgttctatagcctaatcatcatcggcaccctggggaaaaagatcaagcagtaccgcgagctgaagccgcagacctgcaccatctgcgagaccgcccccgtaaacgccatcgacgccgagatgcacgatctcaactgctcctacaacatctgcccctactgtgccagccggctcacctccgacggtctggcgcgacacgtgccgcagtgccccaagcggaaggagaaggtggaagagaccgagttgtacttaaacctggagcgcattccctggatagtgcggaagctcctccaggtgagcgagtcaacaggggttgccctgaagcggagctcctggctgatcgtgctgctggtcctcctgaccgtcagcctaagccccgtccagtccgccccggtgggccatggtaagaccatcgagacctaccagacgcgggagggcttcaccagcgtctgcctcttcatgttgggctccatcctgttcctcgtgagctgcctggtgaaggggctggtcgactccgtgagcgattccttcttcccgggcctcagcgtctgcaagacctgctccatcgggagcatcaacggcttcgagatcgagtcccacaagtgctactgcagcctgttctgctgcccctactgccgccattgctccgccgatcgggagatccaccagctgcatctctccatctgcaagaagcgcaagatgggttccaacgtcatgctcgccgtgtgcaagcggatgtgcttccgcgcgaccatagaggccagccggcgggccctgctcatacgctcaatcatcaacacgaccttcgtaatctgcatcctgaccctgaccatctgcgtcgtgagcacgtccgccgtcgagatggagaaccttcccagcggcacctgggagcgggaggaggacctgaccaacttctgccaccaggagtgccaggtcaccgagacggagtgcctatgcccgtacgaggccctcgtgctgcgcaagccccttttcctcgacagcatcgtgaagggcatgaagaacctgctgaactccacctcgctcgagacctccctgagcatcgaggcgccctggggcgccatcaacgtccagtccaccttcaagcccacggtgagcaccgccaatatcgccctgtcctggagctccgtggagcaccgggggaacaagatcctcgtcaccgggcgcagcgagtccatcatgaagctggaggagcggaccggcgtgagctgggacctgggtgtggaggatgcgtccgaatccaagctcctgacggtctccatcatggacctgagccagatgtactcccccgtgttcgagtacttaagcggcgaccgccaggtggaggaatggcccaaggcgacatgcacgggcgactgtcccgagcgctgcgggtgcacctcctccacgtgcctgcacaaggaatggccccactctcgcaattggcggtgcaatccgacgtggtgctggggagttgggacgggctgtacgtgctgtggggtcgacgtgaaggacctgttcaccgaccacatgttcgtcaagtggaaggtggagtacatcaagaccgaggccatcgtgtgcgtcgagctcaccagccaggagcgccaatgcagcctgatcgaggccggcaccaggttcaacctgggccccgtgacgatcacgctctccgaaccccgcaacatccagcagaagctgccccctgagatcatcaccctgcaccccaaggtggaggaggggttcttcgacctcatgcatgtccagaaggtgctgagcgcctccaccgtgtgcaagctgcagagctgcacccacgggatccccggggacctacaggtctaccacatcggcaacctgctgaaaggtgatcgggtgaacgggcacctcatccacaagatcgagccccatttcaacacgtcctggatgtcttgggacggctgtgacctggactactactgcaacatgggggactggccgtcctgcacctacaccggcgtcacccagcacaaccacgccgccttcgtcaacctgctcaatatcgagacggactacaccaagaccttccacttccatagcaagcgcgtgaccgcccacggtgacacgccccagctggatctgaaggcccggcccacctacggcgccggcgagatcaccgtcctcgtggaggtggcggacatggagctgcacaccaagaaggtcgagatctccgggctgaagttcgccagcctcgcctgcaccggctgctacgcctgctccagcgggatctcctgcaaggtgcgcatccacgtggacgagcccgacgagctgaccgtccacgtcaagagcaacgacccggacgtggtggccgcatccacctcactgatggcccggaaattggagttcggcaccgactccacgtttaaggccttctccgccatgcccaagaccagcctgtgcttctacatcgtggagcgcgagtactgcaagtcctgcagcgaggaggacacccagaagtgcgtggacacaaaacttgagcagccccagtccatcctcatcgagcacaaggggacgatcatcggcaagcagaacgacacgtgcaccgcgaaggccagctgctggttggagtccgtcaagagcttcttctacggcttgaagaacatgctcgggtccgtgttcggcaacttcttcatcgggatcctgctgttcctcgccccgttcgtgctgctggtcttgttcttcatgttcggctggaagatcttattctgcttcaagtgctgccggcgcacgcgggggctgctgaagtaccgcctcctcaaggacgacgaggagaccggctaccgccggatcatcgagcgcctgaacaataagaagggcaagaaccgtctcctggacggggaacgcctggccgaccggaagatcgccgagctgtttagcaccaagacccatatcggctga

SEQ ID NO: 15270 - RNA, 5064 nt, synthetic construct
  misc_feature 1..5064: note = derived and/or modified CDS sequence (opt11) from CCHFV(Oman-199809166)__KR864901.1__GP
  source 1..5064: mol_type = other RNA
atgccagtgaacaccatgcacaccctactcgtctacgccgtgttctgcctgcagctatggagcccgggcgggacgcgcgggctctccaacgagacacagcacaacgagaccgggatcaccagggcccccgaaggctcacaggggccctcgctgcccgtgagcactgcgagcccgatcatgtcggacccctccatcaccactctgagcgcctccaccagcggcctggagggaagtggggacacgaccccgcccgccatcactcagggccccaccctgcccgagaccacccccgagcccagcaccaccacgggtacgaacgccttctcgaccgccatcgcgaacgtcagcacacagacggttaaggacacaccgacccccaccgtgcagacgtccccgcccagcacccccgacgcctccaccatcccgcaaggcacccaccacacggcacgcggcttgctctctgtcaccgtgaccaagcccgaggaggtgcccacaccaacgggccctgaacaggcctccatcgaaaccaactctagccgacttgcgaccagcaagacccccagcccctccccgacggcccaggtaactacggagaatagcaaccccaacacctcgaggcagctggtgctctcaacccagcccgccactagcagccccgtgacctccccggcccagctgaacttcgtacagagcgccaccaccatcgccgtgcaagacgcccaccccagtcccacgaaccgatctaagcgcaacctggagatggaggtgatcctcaccctgtcccagggcctgcggaagtactatgggcgcatcctcaagctgctggacctcaccctggaggaggacaccgaaggcctgctcgaatggtgcaaacggaacctggggctgacatgcgacgacaacttcttccagaaacgcatcgaggagttctttctcaccggcgaagggcattttaacgaggtcctgcagttcaagaccccgagcacattgtcccccacggagagcgcatctgtgggtctccccactgtggaacccttcaagagctactttgccaagggctttctgtccatcgatagcggttactttagcgccaagtgctacccccgggcgtccaacagcggcctgcagttaatcaacgtcacccagcactcagcccgcatagccgacactcccgggcccaagatcacgaatctaaagaccatcaactgcatcaacctgaaggccctcgtgttcaaggagcaccgggagatcgagataaacgtgctactgccccaggtagccgtgaacctaagcaactgccacgtgcacatcaagtcccacgtatgtgactacagcctggacatcgacggcactgtgcgcctgccccggatccaccacgagggtaccttcatccccgggacgtacaagatcgtcatcgacaagaagaataagcagaacgaccgctgcaacctcgtgaccaactgcgtgatcaagggccgggaggtccgcaaggggcaatccgttttgcggcagtaccgaaccgagattcggataggcaaagcaagctccggatcccgccgcctgctctccgaggagagcggcgaggactgcatctcccggactcagctgctgcgcaccgagaccgccgagatccacggcgacaactacgggggccccggggataagatcaccatctgcaacggcagcaccatagtggaccagcggctcgggtccgagctgggctgctacacgataaatcgcgtcaaaagtttcaagctgtgcgagaactccgctaccggcaagagctgcgagatagataacacccccgttaagtgcaagcaggggttttgtctgaagatcacccaggagggccgggggcacgtgaagctcagccgcgactccgaggtggtgctggacgcctgtgactcttcctgcgagatcatgatcccgaagggcacgggcgacattttagtagactgttctgggggccaacaacacttcctcaaggataacctgatcgacctgggatgccccaacatccccctcctcggcaagatggcgatatacatctgccggatgtccaaccaccccaaaaccaccatggcgttcctgttctggttcagctttggctatgtcatcacgtgcattctgtgcaaggtgatcttctacttactgatagtggtcggaaccctgggcaagaagttcaagcagtatcgcgagctaaagccgcagacctgcaccatctgcgaaaccaccccggttaacgccattgacgccgagatgcacgacttgaactgctcgtataacatctgcccctactgcgccagccggctcacgtccgatgggcttgcgcgccacgtaatgcagtgccccaagcgaaaggagaagatcgaggagaccgagctgtacctcaaccttgaacgcatcccctgggtggtgcggaagctgctccaggtgagcgagtccaccggcgtcgcactgaagcgcagctcttggctgatcgtgctcctggtgcttctcaccgtcagtctgtcccctgtgcaatccgcccccatagggcacggcaaaacgatcgagacctaccaaacgagagaggggtacacctccatctgcttattcgtgctcggctctatcctgttcatcgtgtcccacttaatgaagggcttagtggatagcgtagggaacagcttctttcccggcctatccatctgcaagacgtgcagcattgggtccatcaacggctttgagatcgagagccacaagtgctactgctccctgttctgctgtccgtactgccgccactgcagcgccgacaaggagatacacaagctccacctgtccatctgcaagaagcgcaaggccgggagcaacgtcatgctggctgtgtgcaaacgcatgtgctttcgggccacaatggaggtatccaacaaggcactgcttatccgcagcgtcatcaacacgactttcgtggtatgcatcctgatcctagccgtctgcgtggtgtcgacgtcggccgtcgaaatggagtccctgcccgcgggaacctgggagcgcgaggaggaccttaccaacttctgccaccaggagtgtcaggtgaccgaaacggagtgcctctgcccctatgaggcactggtgcttcggaagcccctcttcctggatagcatcgccaaagggatgaagaacctgctcaactccaccagcctggagacctccctcagcatcgaggccccctggggcgccataaatgttcagtccaccttcaagcccacggtgtccaccgcgaacatcgccctcagctggagtagcgtggagcaccgcgggaataagatcctggtctccgggcggagcgagagtatcatgaagttggaggagcgcacaggcattagctgggacctgggggtggaggacgcctccgaaagcaagctactgaccgtgtccgtcatggacctcagccagatgtactcccccgtgttcgagtatctgagcggcgaccgtcaggtggaggagtggccgaaggctacgtgcacaggggactgccccgagcggtgcgggtgtacctcctccacgtgcctgcacaaggagtggccgcacagccggaactggcgctgtaaccccacatggtgctggggagtagggacagggtgcacgtgctgcggcttggacgtgaaggacctgttcaccgactacatgttcgtcaagtggaaagttgagtacataaagaccgaggcgatcgtttgcgtcgagttaacatctcaggagcggcaatgctccctcatcgaggctggtacacgattcaacctggggccggtgacgatcacgctttcggagccccggaacatccagcaaaagctccctcccgagatcgtgactctgcacccccgcatcgaggaggggttcttcgacctgatgcacgtccaaaaggtgttatcagccagcaccgtgtgcaaattgcagtcctgcacccatggcgtccccggggacctacaggtgtaccacattggcaacctgctcaagggcgacaaagtgaacgggcacctgatccataaggtcgagccccacttcaacacctcctggatgtcctgggacggatgtgacctcgactactattgcaatatgggggattggccctcctgcacgtacaccggcgtgacccagcacaaccacgccgccttcgtgaatctgttgaacatcgagaccgactacacgaagaatttccacttccacagcaagcgcgtcacagcgcacggggataccccgcagcttgaccttaaggccaggcccaattacggcgccggggagatcacggtgttagtggaggtcgccgacatggagctccacacgaagaagatcgagatctccgggctgaagttcgccagcttaacctgcaccggctgctacgcttgcagtagcgggatctcctgcaaggtgcggatacatgtggacgaaccagacgaactcaccgtccatgtaaagagcgaagatccagatatcgtggccgcctcctcaagcctgatggcccggaagctggagttcggcacggatagcaccttcaaggcgttctcagcgatgccgaagaccagcctgtgcttttacatcgtggagcgggagtactgcaagagttgcagcaaagaggacacccaaaagtgcgtgaacgccaagctggagcgcccccagtccatcctgatcgagcataagggcacaatcatcggcaagcagaacgatacctgcaccgccaaggccagctgctggctcgagagcgttaagtccttcttttacggcctgaagaatatgctgagcgggatcttcggcaacgtcttcatcgggatcttcctcttcctggctcccttcatattactgatactctttttcatgtttggatggcggatcctgttctgcttcaagtgctgccgccggaccaggggcctgtttaagtaccgccacctcaaagacgacgaggagaccgggtaccgaaagataatcgagcgtttgaacaacaagaagggcaagaacaagctgcttgacggggagcggttagccgaccgcaagatcgccgaactcttcagcacgaagacccacataggctga

SEQ ID NO: 15271 - RNA, 5064 nt, synthetic construct
  misc_feature 1..5064: note = derived and/or modified CDS sequence (opt11) from CCHFV(Oman_812956)__KY362518.1__GP
  source 1..5064: mol_type = other RNA
atgcccgtaaacaccatgcatactctgctcgtctatgccgtgttctgcctgcaactgtggagccccggcggaacccgcggcctctccaacgagacccagcacaacgagactgggatcacccgagcccccgagggcagccaggggccctccctgcccgtgagcacggcgtccccgatcatgtcagacccctccattaccaccctcagcgcctctaccagcggcctcgagggctccggggatacgaccccgcccgccatcacccagggaccgaccctgcccgagacgacccccgagcccagcacaaccacggggacgaacgcattctccaccgccatcgcgaacgtcagcactcagacggtgaaggacactccgacccccaccgtgcagacgtccccgccaagcacccccgacgcctccaccattccccagggcacccaccacacggcccgcgggctgctcagcgtcaccgtgaccaagcccgaggaggtgcccaccccgacgggccccgaacaggcatccatcgagaccaacagcccccggctggctacctcaaagaccccctccccgagccccacggcccaagtcactaccgagaactccaaccccaacacaagccgccagctggtgctctccacccagcccgccacgagctcaccggttaccagcccagcccagctgaacttcgtccagtccgcgaccaccattgcggtgcaggacgcccaccccagcccgacgaatcggtccaagcgcaacctggagatggaggtgatcctcactctgagccaggggctgcggaagtactacggccgcatcctcaagctgttggacctcaccttagaggaggacaccgagggcctgctcgagtggtgcaaacggaacctggggctgacgtgcgacgacaactttttccagaagcgcatcgaggagttcttcctcaccggcgaaggccatttcaatgaggtcttacaattcaaaacgccctccaccctaagcccgacggaatccgcgagcgtcgggttacctaccgtggaaccgttcaagtcctacttcgccaagggcttccttagcatcgactccgggtacttcagcgccaagtgttacccccgcgcgagcaattccggcctgcagttaataaacgttacccagcactcagcccgcattgccgacacgcccgggcccaagatcacgaacttaaagaccatcaactgcatcaacctgaaggccttagtgttcaaggagcaccgggagatcgagatcaacgtgctccttccgcaagtcgccgtaaacctctccaactgccacgtacatatcaagagccacgtctgcgactactccctggacatcgacggcactgtgagactgccccggattcaccacgagggcaccttcatccccgggacctacaaaatcgtcatcgataagaagaacaagcagaacgaccgctgtaacctcgtgaccaactgcgtgatcaagggccgggaggtccgcaaaggtcagagcgtgcttcggcagtatcgcaccgagatccggatcggcaaggcgtccagcgggtcccgccgcctgctcagcgaggagtcaggcgaggactgcataagcaggacacagctcctgcgcacggagaccgccgagatccacggcgacaattacgggggccctggggacaagatcaccatatgcaacggtagcaccatcgtggaccagagattaggttctgagctgggctgctatactataaaccgcgttaagtcgttcaagctgtgcgagaactcagccaccgggaagtcctgcgagatcgacaacaccccagtgaagtgcaagcaagggttctgtctgaagatcacccaggagggccgggggcacgtgaagctcagccgcgacagcgaggtcgtattagacgcctgcgacagtagctgcgagatcatgatccccaagggcacgggcgatatcctggtggactgttccggtggccaacagcactttctcaaggacaacctgatcgacctggggtgccccaacatccccctcctgggcaagatggcgatctacatctgccgaatgagcaaccacccgaagaccaccatggcatttctgttctggttctcgttcgggtacgtcataacgtgcatcctatgcaaggtgatcttctacctgctgatcgtggtcggcacgctcggcaagaagttcaagcagtaccgcgagctcaagccccagacctgcaccatctgcgagaccactcccgtgaacgccatcgacgcggagatgcacgacctgaactgctcatacaacatatgcccctactgcgcctcccggctcacgagcgacgggctggcgcgccacgtgatgcagtgcccgaagcgaaaggagaagatcgaggagaccgagctgtatctcaacctggagcgcatcccatgggtcgtgcggaagctgctccaggtgtccgaaagcaccggcgtcgccctgaagcgctccagctggctcatcgtgctcctagtgctgctcaccgtctccctgtcacccgtacaatctgcccccatcgggcacggcaagacgatcgagacctaccagacccgggaggggtacaccagcatctgccttttcgtgctcggctccatcctgttcatcgtaagccacctaatgaagggcctcgtagactccgtgggtaacagctttttcccgggcctgagcatctgcaagacgtgctccatagggagcataaacggcttcgagatcgagtcccacaagtgctattgcagcctgttctgctgcccctactgtcgccactgctccgccgacaaagagatccataagctccacctgagcatctgcaagaaacggaaagccgggtccaacgtcatgctggcggtgtgcaagcgcatgtgctttcgggccaccatggaggtgagcaacaaggcgctactgatccgctccgtcatcaacacaacctttgtggtatgcatcttgatcctcgccgtctgcgtggtgagcacgtccgccgtcgagatggagagcctgcccgcgggcacctgggagcgagaggaggaccttaccaacttctgccaccaggagtgtcaggtgaccgagacggagtgcctctgcccgtacgaggccctggtgctgcggaaacccctcttcttcgattccatagccaaaggcatgaagaacctgctgaacagcacctccctagagaccagcctgtccatcgaagccccctggggcgccataaacgtccagagcacctttaagcccacggtgtccactgcgaatatcgcactgagctggagctcagtggagcaccgtgggaataagatcctcgtcagcggccggtccgagagcatcatgaagctggaggagcgcaccggcatctcatgggatctgggcgtggaggacgccagcgagtccaagctcctgaccgtgagcgtcatggacctctcacagatgtatagcccggtgttcgagtacctctccggcgaccgacaggtggaggagtggcctaaagccacgtgcaccggcgattgccccgagcggtgtgggtgcacgagctccacgtgcttacacaaggaatggccccacagccgaaactggcgctgcaacccgacctggtgctggggcgtcgggaccgggtgcacgtgctgcgggttggacgtgaaggacctcttcaccgactacatgttcgtcaaatggaaggtggagtatatcaagaccgaggcgatcgtctgtgtcgagctgacctcccaggagcggcagtgctcactgatcgaggccgggacccggttcaacctgggccccgtgaccatcacgctgtcggaaccccggaacatacaacagaagctgcccccagagatcgtaaccctccacccccgcattgaggagggatttttcgaccttatgcacgtccaaaaggtcttaagcgcctcgaccgtgtgcaaacttcagagctgcacccacggcgtgcccggggacctccaggtgtaccacatcgggaaccttctgaagggcgacaaggtgaacgggcacctgattcacaaggtcgagccccacttcaacaccagctggatgtcctgggacggctgcgacctggattattactgcaacatgggcgattggccaagctgcacgtataccggtgtgacccagcacaaccacgcagccttcgtgaacctcctgaacattgagaccgactacacgaagaacttccacttccactccaagcgggtcaccgcgcatggggacacgccccagctggatttgaaagcccgacccaactacggcgccggcgagatcactgtgttggtagaggtagccgatatggagttgcacaccaagaaaatcgaaatcagcgggctcaagttcgcctccctgacctgcactggctgctacgcctgctcgtcggggatcagctgtaaggtgcggatccacgtggacgagcccgacgagctgaccgtgcacgtgaaatccgaggaccccgacatcgtggccgccagctccagcctcatggcccgcaagctggagtttggcacggattcaacctttaaggccttctcggcgatgcccaagacctccctgtgcttctacatcgtcgagcgggaatactgcaagagctgttcgaaggaggatacccagaagtgcgtgaacgccaagctcgaacgcccccagagcatcttgatcgagcacaaaggaacgatcatcgggaagcagaacgacacttgcaccgccaaggcctcctgctggctggagagcgtcaagagcttcttctacggcctcaagaacatgctgtccggtatctttggcaacgtgttcatcgggatctttctgttcttggcgccctttatcctccttatacttttcttcatgttcggctggcggatcctcttctgctttaagtgctgcagaagaacccgcggcctcttcaagtaccgccacctgaaggacgatgaggagaccgggtatcggaagatcatcgagcgcctcaacaacaagaagggcaagaacaagctgctagacggggagcgtctcgccgaccgcaagatcgccgagctgttcagcaccaagacccacatcggctga

SEQ ID NO: 15272 - RNA, 5064 nt, synthetic construct
  misc_feature 1..5064: note = derived and/or modified CDS sequence (opt11) from CCHFV(Oman)__DQ211632.1__GP
  source 1..5064: mol_type = other RNA
atgcccgtgaacacgatgcacacactcctggtctacgccgtcttctgcctgcagctgtggagcccgggcgggactcgcgggctctcaaacgagacccaacacaacgagaccgggatcaccagggcccctgagggcagccaggggccctccctccccgtgagtactgcgtccccgatcatgagcgacccaagtataacaacccccagcgcctccacctctggcttagagggttccggggacacgacgcccccggccataacccagggccccaccccgcctgagaccacccccgagcccagcaccaccaccgggaccaacgccttctccaccgccattgcgaacgtcagcacccagacggtgaaggacacccccactcccacagtgcagacgtccccgccgagtacccccgacgcatccaccataccccagggcacccaccacacggcccgcggtctcctgagcgtcaccgttaccaagccggaggaggtgcccacacccacgggcccggagcaggcctccatagagaccaactctcctcgccttgccaccagcaagaccccttcccccagcccgacggcacaggtcacaaccgagaactccaaccctaacaccagccgccagctcgtgctgtccacccagcctgccacgagctcccccgtaacctccccggcccaactgatcttcgtccagagtgccacaaccgtggcggtgcaagacgcccaccccagccccacgaaccggtcaaagcgcaacctcgagatggaggtcatcctgaccctaagccagggcctccgcaagtactacgggcgtatcctgaagctactagacctgaccctggaagaagacaccgagggtctcctggagtggtgcaagcggaacctggggctcacgtgcgacgacaacttcttccagaagcgcatcgaggagtttttcctgaccggcgagggccacttcaacgaggtgctgcagtttaagaccccgtccactctctcatctactgagagcgcttcggtggggctgccgaccgtcgagccctttaagtcgtacttcgctaaaggcttcctgtccatcgacagcgggtactttagcgctaagtgttacccccgggcgagcaacagcggcctccagctgatcaacgtgacccagcactccgcccgcatcgccgacactcctggtccgaagatcacgaacctgaagaccataaactgcatcaacttaaaagccctggtgttcaaggagcaccgggaaatcgagatcaacgtcctgctcccccaggtggccgtgaacctgagcaactgccatgtccacatcaagtcccacgtgtgcgactacagcctggacatcgatggcaccgtccgcctccccaggatccaccacgagggcaccttcatccccgggacgtacaagatcgtgatcgacaaaaagaacaagcagaacgaccgatgcaatctggtgacgaactgcgtcatcaagggccgggaggtgcgcaaaggccagtccgtcctgcggcagtacagaacagagatccggatcggcaaggcgagctcagggagccgtcgtctcttgtcagaggagagtggcgaggactgcatctcacggacccagctgctccgcacggagaccgccgagatccacggcgacaactacgggggccctggggacaagatcaccatctgcaacggctcgaccatcgttgaccagaggttagggtccgagctgggctgctacaccataaaccgcgtcaagagctttaaactctgcgagaacagcgccaccggcaagagctgcgagatcgacaacacccccgtgaagtgcaagcaggggttctgcctgaagatcactcaggaaggccgggggcacgtgaagttaagccgagacagtgaggtcgtgctggacgcctgtgacagctcctgcgagatcatgatccctaagggaacgggcgacatcctcgtcgactgcagcggcggccaacagcacttcctgaaagacaacctgatcgacctcgggtgccccaacatcccgcttctgggcaagatggctatctacatctgccggatgtccaaccatcccaagaccaccatggcgttcctcttctggttcagcttcgggtacgtgataacctgcatcctgtgcaaggtgatcttctacctgttaatcgtcgtgggcacattaggcaagaagttcaaacagtaccgcgagttgaaaccccagacatgcaccatctgcgagaccacccccgtgaacgccatcgacgctgagatgcacgacctgaactgctcctacaacatctgtccgtactgcgccagccgactgacgtccgatgggctggcgcgccatgtcatgcagtgccctaagcggaaggagaaaatcgaggagaccgaactttacctgaacctggagcgcatcccctgggtggtgcggaaactcctacaggtcagcgagtccaccggcgtggccctgaagcgcagctcctggctaatcgtgctgctcgtcctccttaccgtgagcctgtccccagttcagagcgccccgatcgggcacggcaagacgatcgagacctaccagacccgggaaggatacacctccatctgcctctttgtcctgggctcgatcctgtttatcgtgtcccacctcatgaagggcctggtggacagcgtcgggaacagtttcttccccggtcttagcatctgcaagacctgcagcatcgggtccatcaatggcttcgaaatcgagagccacaaatgcttctgctccctcttctgttgcccctactgccgccactgcagcgccgataaggagatccacaagttgcacctgtccatctgcaagaagcggaaggccggaagcaacgtgatgctcgccgtgtgcaagcgcatgtgcttccgagccaccatggaggtctccaacaaggccctgctgatccgtagcgtgatcaacaccaccttcgtggtctgcatcctgatcctggccgtgtgcgtggtctccacaagcgccgtggagatggagtccctgccggccggcacgtgggagcgcgaggaggacctcaccaatttctgccaccaggagtgccaggtgaccgagacggagtgcctgtgcccttacgaggccctggtcctcaggaagccattattcctggacagcatcgccaagggcatgaagaacctcctgaactccaccagcctggaaacctccctcagcatcgaggctccctggggcgccatcaacgtgcagtccaccttcaagccgacggtgagcaccgcgaacatagccctgagctggtccagcgtcgagcaccgcgggaacaagatcctggtgtccgggcggagcgagtccatcatgaaactcgaggagaggaccggcatcagctgggacctgggggtggaggacgcctccgagagcaagctgctcaccgtttcggtgatggacttgagccagatgtactcccccgtgttcgagtacctgagcggcgatcggcaagtcgaggagtggcccaaggccacgtgcaccggagactgccccgagcgctgcgggtgcacatcctccacgtgcctccataaggagtggccgcactcccggaactggcgctgcaatcccacctggtgctggggcgtgggtacaggctgcacttgctgcggcctggacgtcaaggacctgttcaccgactacatgttcgtgaagtggaaggtggagtatatcaagaccgaggcgatcgtgtgcgtggagctcaccagccaggagcggcagtgctccctgatcgaggctggtacccgcttcaacctgggccccgtgaccatcacgctcagcgaaccccggaacatccaacagaagctgcctcccgaaatcgtcaccttacacccccgcatcgaagagggattcttcgacctaatgcacgtccagaaggtgctgagtgccagcaccgtctgcaagttacagagctgcacccacggcgttcccggcgacctccaggtgtaccacatcggcaacctgttgaagggcgacaaggtaaacggacacctgatccacaaagtggagccgcacttcaacacctcctggatgtcttgggacggctgcgatctggactactactgcaacatgggtgactggccctcctgcacgtacaccggcgtgacccagcacaaccatgccgcgttcgtaaacctgttaaacatcgaaactgactacacgaagaacttccacttccacagcaaacgtgtgaccgcgcacggggacacgccccagctggatctgaaggcccgccccaactacggcgccggcgaggtgaccgtcctcgtggaggtggcggacatggagctgcataccaagaagatcgagatttccggactgaagttcgccagcctgacctgcaccggctgctatgcttgctccagcgggatttcctgcaaggtccggatccacgtggacgagccggacgagctcaccgtgcatgtcaagagcgaggatcccgacatcgtggccgcctccagctctctgatggcccgcaagctcgagttcggcacggacagcaccttcaaggccttctccgcgatgcccaagacgagcctgtgcttctacatcgtggagcgggagtactgcaagtcctgtagcaaggaggacacgcagaagtgcgtcaacgccaagctcgagcgcccacagtccatcttgattgagcataaagggacgatcattgggaaacaaaacgacacgtgcaccgctaaggccagctgctggctggagagcgtcaagtccttcttctacggcctgaagaacatgctcagcgggatcttcggcaacgtattcatcgggatcttcctgttcctggcgccgtttatcctgctcatcctgttcttcatgttcggctggcggatcctgttctgcttcaagtgctgccgcaggacccgtggcctcttcaagtaccgccacctgaaggacgatgaggagaccgggtaccggaagataatcgagcgcctgaacaacaaaaagggcaagaacaagctcctggatggggagcggctggccgaccgcaagatcgccgagctgttctccaccaagactcacatcggctga

SEQ ID NO: 15273 - RNA, 5064 nt, synthetic construct
  misc_feature 1..5064: note = derived and/or modified CDS sequence (opt11) from CCHFV(3820-ST-2007)__KR814868.1__GP
  source 1..5064: mol_type = other RNA
atgcccataaacatcatgcacaccctgctcgtgtgcttcatcctctacctgcagctcagcggcctgggaggcgcccacgggcagtccaacgccacggagcacaacggcacgaacaccaccaccgtcccggggacgagccagtccccaaagccgcccgcgagcaccaccctgccccacacccccgagtccagcacggtgaagctcaccacccccacttccgagacggaaggcagcggcgagacaacgcccccgaacaccacccagggcctgcccctgcccggcaccacacccgagcgctccgccaccacggccacgagcacatccagcaccgacaacatgaactccacgacccaggttaccgacaacaccccaacgtcaaccgtgtcaatcagcccctccagctccagcagcatgccctctaccagccaggggatccaccaccccgtgcggtccctgctgagcgtgtcctcaccgaagaccgtcacgacccccacccccatgtcccccggcgagatgagcccggagacatccagccagcactccgccatgagccgcgtgcccacgctgtacaccgccacccagatctccacggagaacaccgaccggtccacgccccgccagtccgagagctccgtgcagcccgcgacccagagcccgatcacgtcccctgcccaaaccatcctcctgatgagcgccgcccccaaagcgatccaggacatgcacccctcgccgactaaccggtccaagcgcaacctggaggtcgagatcatcctcaccctgagccaggggctgaagaagtactacggaaagatcctcaagctgctgcacctcacgctggaggaggacaccgagggactgctcgagtggtgcaaacggaatctggggtccaactgtgacgacgacttctttcagaagcgcatcgaggagttcttcatcacgggtgagggttacttcaacgaggtgctgcagtttaagacccttagcaccctgtctcccaccgagcccagccatgtgcggctgccgaccgccgaacccttcaagtcctactttgccaaaggcttcctcagcatcgactccggttactttagcgccaagtgctacccccgctccagcacctccgggctgcagctaatcaacgtcacccagcaccctgcccggatcgcggagaccccaggccccaagacgaccagcctcaagaccattaactgcatcaacctgcgcgcatccgtgttcaaggagcaccgggaggtggagatcaacgtcctgctcccccagatcgctgtgaatctgagcaactgccacgtggtcatcaactcccacgtgtgcgactacagcctggacaccgacgggcccgtgcgccttccgcggatccaccacgagggcacgtttatccccgggacctacaagatcgtcatcgaccgcaagaacaagctgaacgaccggtgcagcctcgtgaccaactgtgtgatcaaaggccgggaagtccggaagggccagtccgtcctccgccagtacaagactgagatcaagatcgggaagacgagcaccggctcccggaagctgctgtccgaggagccaggggacgactgcatatcccgcacccagctcctgaagaccgagacggccgagatccacgacgacaactacggcagccccggtgacaagatcaccatctgcaatggctccaccatcgtcgaccagcgcctgggcagcgaactcgggtgttacaccatcaaccgggtgaagtccttcaagctgtgcgagaatagtgccacgggcaagacctgcgagatcgactccacccccgtgaagtgtcgccaagggttctgcttgaaaataacccaggaaggtcgggggcacgtcaagctgagccggggcagcgaggtggtgctcgacgcgtgtgacagctcctgcgagatcatgatccccaagggcacgggggacatcctggtcgactgcagcggcggacagcagcacttcctgaaggacaacctcatcgacctgggctgtccccacatccccctgctcggtaagatggccatctacatctgccggatgagtaaccacccgcgcacaacgatggccttcctgttctggttcagtttcgggtacgtgataacctgcatcttctgcaaggccctgttctactccctcatcatcatcggcaccctggggaagaagatcaagcagtaccgggaactgaagccccagacgtgtaccatctgcgagaccgcccccgtaaacgcgatcgacgccgagatgcacgacctcaactgcagctacaacatctgcccctactgcgccagccgcctaacctccgatggactggcccggcacgtcacgcagtgcccgaagcgcaaggagaaggtggaggagactgagttatacctgaacctcgagcggatcccctggatcgtgcgcaagctgctgcaggtcagcgagtccaccggggtcgccctgaagcggtcttcctggctcatcgtactgctggtcctcctggcggtgagcctgtcccccgtccagagcgcacccgtcggccacgggaagaccatcgagacgtatcagacccgcgaggggttcacctccatctgcctcttcatgctgggcagcatcctgttcatcgtgtcctgccttgtgaaggggctggtcgacagcgtgtccgacagcttcttcccgggtctgtccgtgtgcaagacctgcagcatcgggtccatcaacggcttcgagatcgagagccacaagtgctactgctccctcttctgttgcccctactgccggcactgcagcgccgaccgtgagatccaccagctgcacctgagcatctgcaagaagcggaagacgggttccaacgtcatgctggccgtgtgcaagcgcatgtgcttcaaggcgaccatcgaggcctcccgtagggccctgctgatccgctccatcatcaacaccaccttcgtaatgtgcatcctcacgcttgccatctgcgtcgtgtcaacctccgccgttgagatggaggacttgcccgcggggacttgggagcgcgaggaggacctcaccaacttctgccaccaggagtgccaggtcacggagacagagtgcctgtgcccgtacgaggccctggtgctccgtaagcccctgttcctggacagcatcgtgaagggcatgaagaacctcctgaactccaccagcctggagacctccctcagcatcgaggccccctggggcgccatcaacgtccagtccacgttcaagcccaccgtgagcaccgccaacatcgcgctgtcctggagctccgtcgagcaccgggggaacaagatcctggtcaccggacgcagcgagtccatcatgaagctcgaggagcggacgggcgtgagctgggacctgggcgtggaagacgcctccgagagcaagctgctcaccgtcagcatcatggacctgtcccagatgtacagccctgtattcgagtacctgtccggggaccgccaagtggaggaatggcccaaggcaacctgcaccggagactgccccgagcgttgcgggtgcacgagctccacgtgcctccacaaggagtggccccacagccgcaactggcggtgcaacccgacctggtgctggggcgtcgggaccggctgtacctgctgcggcgtggacgtgaaggacctgttcactgatcacatgttcatcaagtggaaggtcgagtatatcaagaccgaggctatcgtgtgcgtcgagctgacctcccaggagcgccagtgcagcctcatcgaggcagggacccggttcaacctgggccccgtcacgatcaccctatccgagccgcgtaacatccagcaaaagctcccgcccgagatcatcaccctgcaccccaagatcgaggaggggttcttcgacctgatgcacgtgcagaaggtgctcagcgcttcaactgtctgcaagctgcagagctgcacgcatggcatccccggcgacctgcaaatctaccacatcgggaatctcctgaagggcgacagggtgaacgggcacttgatccacaagatcgagcctcacttcaacacctcctggatgagctgggacggctgcgacctcgactactactgcaacatgggtgactggccgtcctgcacctacaccggcgtcacgcagcataaccacgcagctttcgtgaacctgctgaacatcgagaccgactacaccaagaccttccatttccacagcaagcgcgtgacggcccatggcgacacgccccagctcgatctgaaggcgcggcccacctacggggccggcgagatcaccgtcctggtggaggttgcagacatggaactccacaccaaaaaggtcgagatttccgggctgaagttcgccagcctgacttgcaccggttgctacgcctgctccagcgggatcagctgcaaggtgcgcatccacgtggacgagcccgacgagctcaccgtccacgtgaagtccagcgacccggacgtggtcgcggcttccacgagcctgatggcccggaaacttgagttcggcaccgactccacctttaaggccttcagcgccatgcccaagacctccctctgcttctacatcgtggagcgcgagtactgcaagagctgctccgaggacgacacgaagaagtgcgtggacaccaagttggagcagccccagagcatcctgatcgagcacaagggcaccattatcgggaagcaaaacgatacctgcacggcgaaggcctcctgctggctcgagagcgtcaagtccttcttctacggccttaaaaacatgctggggagcgttttcgggtccttcttcgtggggatcctcctgttcctggcccccttcgtcctgctcgtgctgttcttcatgttcggctggaagatcctgttctgctttaagtgttgccggcgcacccgaggtctcttcaagtaccgccacctgaaggacgacgaggagaccgggtaccgcagaatcatcgagcgcctgaacagcaagaagggcaagaaccggctcctggatggggagcgcttggccgaccggaaaatagccgagttattttccaccaaaacacacatcggctga

SEQ ID NO: 15274 - RNA, 5058 nt, synthetic construct
  misc_feature 1..5058: note = derived and/or modified CDS sequence (opt11) from CCHFV(SR3)__AJ538199.1__GP
  source 1..5058: mol_type = other RNA
atgcatatctccttaatgtatgcagtgttctgcctccagctttgcggactggggaaaacgaacggcccccacaacgggaccgagcacaacaacacgcacgtcatgaccaccccggacgattcccagagccccgagccgcccgtgtccacggccttacccgtgacgcccgaccccagcaccgtcaccccctccaccccggctagcgggttggaggggtccggcgaagtgtatacgagctcccctatcaccactaaaggcctgagccttcccgaggccacctccgagcccccggcgacgaccagcgtagtcacttccagcgcctccgacaccgacagctccacgcaggccgcgggggacacccccacccctaccgttcgcacctcgctgccctcctcgccgagcaccccctccaccagccagggcacccactaccccgtgagatccttgctcagcgtcacgtccccgaagccggaggagacccccaccccctcaaaatccgggaaggacgacttagccaccaactcaccccaccccgccacgtcccgccctaccacgccacccaccacggcccagaagcccaccgagaacaactcgcacaacaccaccgagcagctggagtcattgacgcacctggcgaccctgggcctcatgatcagccccacccagaccgtgctgccccagtccgtgacgagcatcgccatccaggatatccacaattccccgacgaaccggagtaagcgcaacctggacatggagatcatcctcaccctgtcccaggggctgaagaaatactacggcaagatcttaaaactgctgcacctcaccctagaggaggacaccgagggcctgctcgagtggtgtaagcgtaatctggggctggactgcgacgacacgttcttccaaaagcgcatcgaggagtttttcatcaccggcgaggggcacttcaacgaggttctccagttccggacgctgggcacccttagcacgaccgagtccacacacgccggcagccccaccgtggaacccttcaagagctacttcgccaaggggttcctctccatcgacagcggctatttctccgccaagtgctacagccgcacgtcaaatagcggactgcaactgatcaacgtgacacgacactcaacaagaattgctgacacccccggtccgaaaataacaaacctcaaaaccatcaactgcatgaatctgaaggccagcgtctttaaggagcaccgcgaggttgagataaacgtactgctaccccaggtcgccgttaacctgtccaactgccacgtggccatcaagtcccacatctgcgactactcactggataccgacggggccatccggctcccccagatccaccacgagggcaccttcatcccaggcacttataaaatcgtcatcgacaagaagtcacgcctgaacgatcgctgcaccctgttcaccaactgcgtgatcaaggggcgggaggtgcgcaagggccagtccgtcctccgtcagtacaagaccgagatccgcatcgggcgggcgagcacgggatcccgccggctgctaagcgaggagtcaggagacgattgcatcagccgcacccagctcttgcgcacagagaccgctgaggttcatggggacaactacggcgggcccggcgacaagatcacgatctgcaatgggtcgacggtcgtcgaccagcggctgggctctgagctggggtgctacactatcaaccgcgtgcggtcattcaagctctgcgaaaattccgccaccggtaagagctgcgagatcgactccatccccgtcaagtgcaagcagggctactgcctgaagatcacgcaagaggggcgcggccatgtgaagctgtcgcgcggatccgaggtggtcctcgacgtgtgcgacagctcctgcgaagtgatgattcccaaaggcaccggcgacatcctagtcgactgtagtgggggccagcaacatttcctcaaagacaacctcgtggacctggggtgccccaagattccgctcctcggcaagatggccatctacatctgcagaatgtccaaccaccccaaaactaccatggccttcttattctggttcagtttcggatacgtgatcacgtgcatcctgtgcaaggcaatattctttctcctgatcatctttggcaccctgggtaagaggttcaagcagtaccgcgagctcaagccgcaaacctgcacgatctgcgagaccacgcccgtgaacgccatcgacgccgagatgcacgaccttaattgctcctacaacatttgcccttactgcgcaagtcggctaaccagcgacgggctggcccgccacgtcacccagtgcccccggcgcaaggagaaagtggaggaaaccgagttatacctgaacctcgagcggatcccctgggtcgttcgcaagctgctccaggtgagtgaatccactggtaccgtcctgaagcggagctcgtggctgatagtgcttctcgtgctgttcaccgtctccctgagccccgtgcagtccgccccgatcggacacggcaagaccatagagacgtaccgcgtgcgggaggagtacacgagcatctgcctcttcgtcctggggtccatcctgttcatcgtgagcttcctcatgaagggcctggtggacggcgtagggaacatattcttccccggactgtccgtgtgcaagacgtgttccatcgggagtatcaacggcttcgagatcgaaagccacaagtgctactgcagcctcttttgctgcccctactgtcgccactgctccgccgacggagagatccaccagctccacctgtccatctgcaagaagcggaagactggcagcaatgtgatgttggccgtctgcaaacgcatgtgcttccgcgccacgatggaggtgtccaacaaggcgctgttcatccggagcataatcaacaccaccttcgtaatgtgcatcctgaagggcgagttcgccgccgtgaaatcaatccatcccatcgagatggagagcctcccggccgggacctgggagagggaggaggatctgacaaacttttgccaccaagagtgccaggtgactgagaccgagtgcctgtgtccctacgaagccctcgttctgcggcgcccactgtttctagactccatcgttaaaggtatgaagaacctgctgaactccacctccctcgagacctcactgagcatcgaggcgccgtggggtgccataaacgtgcagtccacatacaagcccaccgtgagcaccgccaacatcgccctgtcttggagcagcgtcgaacaccgggggaacaaggtgctcgtgtcagggcgctccgaaagcataatgaaactggaggagagaacggggatctcctgggacctgggcgtcgaggacgcatcagagtccaagctcctgacagtgtctgtgatggacctttcccagatgtatagccccgtattcgagtacctctccggagaccgccaggtggaggagtggcctaaggcgacatgcaccggagattgcccggaacggtgcgggtgcacgagctcaacctgtctgcacaaggagtggccgcatagcaggaactggcggtgcaaccccacctggtgttggggcgtaggtaccgggtgcacgtgctgcggcctggacgtcaaggaccttttcaccgactacatgttcgtcaagtggaaggtggagtacatcaagaccgaggccatagtctgtgtagagctgaccagtcaggaacgacagtgcagcctgatcgaggccggtacccggttcaacctcggcagcgtcaccatcaccctgtccgagccccgcaacattcagcagaagctaccgcccgaaatcatcacactccaccccaagatcgaggagggtttcttcgacctgatgcacgttcagaaggtcctaagcgcttccacggtctgcaaactccaaagttgcacacacggcgtacccggcgatctgcaagtatatcacatcggtaacctgttaaagggcgaccgggtcaacgggcacctgattcataagatcgaacagcatttcaacacctcctggatgagctgggacggctgcgatcttgactactactgcaacatgggggactggccgtcctgcacgtacaccggtgtgactcagcacaaccacgctagcttcgtgaacctcctgaacatagagaccgactacactaagactttccacttccactccaagcgcgtcactgcgcatggcgacacgccccagctggacctcaaggcccggcccacatacggagccggcgagatcaccgtgttggtggaggtcgccgacatggagctgcacacgaagaagattgagatcagcggtctcaagttcgcgggtctgacctgtaccgggtgctacgcatgcagcagcggcatctcctgcaaggtaaggatccacgtggatgagcccgacgagctcacggtccacgtgaagtcagacgacccggacgtggtcgccgcctccagctccctcatggcccgtaagctggagttcggcacggacagcacctttaaggcgttctccgcaatgcctaagaccagcctttgcttctacatcgttgagcgcgaatactgcaagagctgcaacaaggaggatacccagaagtgcgtgaatacgaagctcgagcagccccaatccatcctgatcgaacacaaggggacaatcatcggcaagcagaacaatacctgcaccgcaaaggccagctgctggctggagtccgtcaagagtttcttctacgggctcaaaaacatgctgggcggcatcttcgggaacgtgttcatcggcatcttcacattcctgacccccttcatcttgctcatacttttcttcatgttcgggtggcggatcctgttctgcttcaagtgctgccgccgcactcggggcctcttcaagtaccgccatctgaaggatgacgaagagaccggctaccgaaagatcatcgagcgcctgaacaacaagaaggggaagaatcggctcctagacggcgagcgcctggccgaccggaaaatcgcggagctcttttccacgaagacccacatagggtga

SEQ ID NO: 15275 - RNA, 5055 nt, synthetic construct
  misc_feature 1..5055: note = derived and/or modified CDS sequence (opt11) from CCHFV(SPU 187/90)__KJ682814.1__GP
  source 1..5055: mol_type = other RNA
atgcatatcagcctcatgtacgcagtgctttgcctgcagttatgctccctcggtgagacccaccgctctcacaacgagatcgggcacaacaagaccgacgtcatgacgacgcccggcgataacctgtccagcgagcagccggtgtccaccgcactgagcatcacccccgacccctccacggtaactccaaccaccccggcgagcgggtccgagggctctggggaggtctacacgtcatcacccataaccaccgagtccctcagcctgcccgaaaccacgcccgagctgccggccaccaccggcatcgacagttcttctgccagcggcgttgactccagcacgcaggccgccgggggcacgagcgcgctcaccgtacggacctccctgcccaacagcccgtccacccccagcacaccgcaggacacctaccaccccgtccgcatcctgctctccgtgaccgggcccggcccggaggagaccagcacgccgtccgggagcggcaaggagtcgagcgccacctccagcctgcaccccatctccgaccggctaccgacgcccccggcgaccgcccagggccccaccgagaacaacagccacaacgcgaccgagcaccccaaacccctcacccagtccgccactccggggctgatgactagccccacccagatcgtgcacccccagtccgccaccagcatcaccgtccaggacacgtacccctccccgaagaaccgcagcaagcggaatctggagatggagatcatcctcaccctaagccagggcttgaagaagtactacgggaagatcctccgcctgctgcggttgaccctggaggaggacaccgagggcctgctcgagtggtgcaagcgcaaccttggcctggactgcgacgacaccttcttccaaaagcggattgaggagttcttcatcacgggggagggccacttcaacgaggtgctccaattcaagaccccggggaccctgtccaccacggagagcacccccgccgagctgccgaccgccgaacccttcaagtcctacttcgcgaagggcttcctaagcatcgactccggatactactccgccaagtgctactccggcaccagcaactccggcctacagctgatcaacattacgagacacagcacccggatcgtggacacccctgggcccaagatcaccaacctcaagacgatcaactgtatcaacctgaaggcctccatcttcaaagagcatcgcgaagtcgagatcaacgtgctgctaccgcagatcgccgtgaacctgagcaactgccatgtcgtgatcaagtcccacgtgtgcgactacagcctggacatcgatggcaccgtccggctcccccacatctatcacgagggggtattcatccccggcacctacaagatcgtgatcgacaagaagaacaagctgaacgaccgctgcaccctgttcacgaactgcgtcatcaaggggcgggaggtgcgtaagggccaatccgtcctccggcagtacaagaccgaaatccgcatcggcaaggcctccaccgggtcccgacgcctgcttagcgaggagcccagcgacgactgcatctcccggacccagctattgcgcacggagaccgcggagatccacggcgacaactacgggggcccgggggacaagatcaccatctgcaacggcagcaccatcgtcgaccagcgcctgggctccgagctggggtgctacacgataaaccgggtaaagagcttcaaactatgcgagaactccgccaccggcaagagctgcgagatcgactccgttcccgtgaagtgccgccaagggtactgcctgcggatcacccaggagggccgcggccacgtgaagttaagccgggggtccgaggtcgtgctcgacgcctgcgacaccagctgcgagatcatgatccccaagggcacgggggatatcctggtggactgctccggcgggcagcaacacttcctgaaagacaacctcatcgacctgggctgccccaagatcccgctgctcggcaagatggccatatacatctgccgcatgagcaatcaccccaagaccaccatggccttcctgttctggttctccttcggatatgtcattacgtgcatcctgtgcaaggcgatcttttatctcctgatcatcatcggcaccttaggtaagcggtttaagcagtaccgcgaactcaagccccaaacctgcaccatttgcgagaccacgcccgtgaacgccatcgacgccgagatgcacgacctgaactgcagctataacatctgcccgtactgcgcctcccgactgaccagcgacggcctcgcccgccatgtgacccagtgtcccaagcggaaggagaaggtggaggagaccgagctgtacttaaacctcgagcgcataccatgggtggtcaggaagctgcttcaggtctccgagagcacaggggtggccctcaagcgctccagctggctgatcgtgctgctagtcctgttcacggtgagcctgtcccccgtgcagagcgccccgatcgggcacgggaagaccatcgaggcctaccgcgcccgcgaggggtatacctccatctgcctcttcgtcctgggctctatcctgttcgtagtgtcctgcctcatgaaggggctggtcgactctgtgggcaactccttcttcccagggctgagcatctgcaagacctgctccataggttctatcaacggcttcgagatcgagtcccacaagtgctactgctctctcttctgctgcccctactgccggcactgctccgcagacaaggagatccacaagctgcacctgagcatttgcaagaagcgcaagacagggtccaacgtgatgctcgccgtatgcaagcggatgtgcttccgcgccaccatggaggtgagcaaccgagccctgttcatccgttccatcatcaacaccaccttcgtgctgtgcatcctcatcttagccgtctgcgtggtgagcacttccgcggtggagatggagaacctgcccgccggcacatgggagcgcgaggaggatctcaccaacttttgccatcaggagtgtcaggtgaccgagacggagtgcctgtgtccgtacgaggccctggtgctccggcgccccctgttcctggacagcatcgttaagggaatgaaaaacctcctgaacagcacctccctggaaacctcgctctccatcgaggccccctggggcgccataaacgtgcagagcacctacaagccgacggtttcgaccgcgaacatcgccctaagctggtccagcgtcgagcaccgggggaacaagatcctggtgtccggccgcagcgagtccatcatgaagctcgaggagcggaccggcatcagctgggacctgggggtggaggacgcctccgagagcaagctgctcaccgtctccgtgatggacctgagccagatgtactcccccgtgttcgagtacctgagcggcgaccgccaggtcgaggagtggcccaaggccacgtgcaccggggactgccccgagcggtgtggctgcacctcctcaacgtgcctccacaaggagtggccgcacagccgcaactggcggtgcaaccccacctggtgctggggcgtggggaccggctgcacgtgctgcgggctggacgtgaaagacctattcaccgactacatgttcgtcaagtggaaggtggaatacatcaagacagaggccatcgtgtgcgtcgagctcacctcccaagagcgccagtgcagcctgatcgaggcgggcaccaggttcaacctggggcccgtgaccatcacgctctccgagccccgcaacatccagcagaagctgccgcccgagatcatcaccctgcacccccggatagaggagggcttcttcgacctcatgcacgtgcagaaagtcctgagcgccagcaccgtgtgcaagctgcagagctgtactcacggcgtccccggggacctccaagtgtaccacatcggcaacctgctgaaaggggacaaggtgaacgggcacctcatccacaagatcgagccgcacttcaacacgtcctggatgtcttgggacgggtgcgacctggactactactgcaacatgggggactggccgtcatgtacctacaccggcgtaactcagcacaaccacgccagcttcgtgaacctgctcaacatcgagaccgactacaccaagaacttccacttccactctaagcgcgtgaccgcccatggggacacgccccagctggacctgaaggcgcggccaacctacggcgccggggagatcaccgtcctcgtggaggtggccgacatggagctgcacaccaagaagatcgagatcagcggcctgaagttcgcctctctgacgtgcacggggtgctacgcctgcagctccggcatcagctgcaaggtccgcatccacgtggacgagccggacgagctcacggtacacgtcaagtcagacgaccccgacgtggtggcggccagctccagcctgatggctcgtaagctcgagttcggcaccgacagcatcttcaaggcattctccgctatgcccaagacgagcctgtgcttctacatcgtcgaacgcgagcactgcaagtcctgcagcgaggaggacacgaagaagtgcgtgaacacgaagctggagcagcctcagtccatcctaatcgagcacaaggggaccatcatcggcaagcagaatagcacgtgcaccgcgaagacctcctgctggctcgagagcgtgaagtccttcttctatgggctgaagaacatgctgagcggcatcttcgggaacgtgttcatcgggatctttctcttcctggcaccgttcatcctgctcattctattcttcatgtttggctggcggatcctgttttgcttcaagtgctgccgccgcacccggggcctcttcaagtaccgacacctgaaggatgatgaggagaccgggtaccggcgcatcatcgagcggctgaacaacaagaaggggaagaacaagctcctggacggggagcgcctggccgaccggcgcatcgcagagctgttctccactaagacgcacatcggctga

SEQ ID NO: 15276 - RNA, 5055 nt, synthetic construct
  misc_feature 1..5055: note = derived and/or modified CDS sequence (opt11) from CCHFV(SPU 48/90)__KJ682813.1__GP
  source 1..5055: mol_type = other RNA
atgcatatcagcctgatgtacgcggtgctgtgtctgcagctgtgcggtttgggggaaacccaccgctcccacaacgagaccggacataataaaactgacgtcgccaccacccccggggacaacctgtcttccgagcagctagtgagcaccgcgctatccatcaccccggaccccagcaccgtgacccccaccacgtccgccagcggcctggaggggtccggcgaggtctacaccagctccctgataacgacggagagcctctccctgctggagacaacgcccaagctcccgaccaccacgggcatcgacacaagctctgccagcgacgtggactccagtacccaggccgccggggacacctccgcgctgacggtacggaccagccctcccagcaacccctccacccccagcacgcctcaggacacccaccaccccatgcgcaacctgctatccgtcaccagccccggcccggaggagacctctactcccagcggctccggcaaggagagccccgccacgagtagcccccatcctgtgtcgaacaggagccagaccccgcccgcaacggcccaggggcccaccgaggacaactcttacaacgcgacggagcaccccgagcacttaacccagagcgccacctccggcctgatgaccagccccacgcagatcgtgcacccccagtccgccacctccatcaccgtccaggacacatacccctccccaacgaaccgcagcaagcggaacctcgagatggagatcatcctgacgcttagccagggcctcaaaaagtactacgggaagatcctgcgcctgctccggctgacgctggaagaggacacggaaggcttacttgagtggtgcaagcgcaacctggggctcgattgtgacgacaccttcttccagaaacggatcgaggagttcttcatcacgggcgagggccattttaacgaggttttacagttcaagacaccagggaccctgtccaccacggagagcacccccgccgagcctccgacagccgagcccttcaagtcctacttcgcgaaggggttcctcagcatcgactccgggtactacagcgccaagtgctactccggcactagcaactcagggctgcagctgatcaacatcacgcgacactcgaccaaaatcgccgacacccccggcccgaagatcaccaacctcaagacgatcaattgcattaatctgaaggcctccatcttcaaggagcacagggaggtagagatcaacgtcctgctaccccaggtggcggtgaacctaagcaactgccacgtcgtgataaaatcccacgtctgcgactaccccctggatatcgacgggaccgtcagactgccgcacatctaccacgagggggtcttcattccgggcacctacaagattgtgatcgacaaaaagactaagctgaatgaccggtgcacgctgttcaccgactgcgtcattaagggccgcgaggtgcggaaaggccagagcgtgctccgccagtacaagaccgagattcggatcgggaagaccagcacggggagccgacggctgctgtccgaggagcccagcgacgactgcatcagtcgaacccagctcctgcgaaccgaaaccgcggagatccacggcgataactacggagggcccggggataagatcacgatatgcaatggctccaccatcgtagaccaacgcctggggtcggaactgggctgttacaccataaaccgagtgaaatcgttcaaactctgcgagaactctgccactgggaagtcttgtgtcatcgacagcgtccccgtgaagtgccggcagggatactgcctgagaatcacgcaggagggccgggggcacgttaaacttagccgcggcagcgaggtagtcctcgacgcctgcgacacctcctgtgagattatgatcccgaagggcaccggcgatatcctggtcgactgctcaggcggacaacagcactttctcaaggacaacctcatcgatctgggctgcccgaagattcccctgctcggcaagatggcgatctacatctgtaggatgtcgaaccaccccaccacgaccatggccttcctcttctggttttcattcggctacgttatcacgtgcatcctgtgtaaggccatcttttacctcctcatcatcattggcaccttaggaaagcgcttccggcagtatcgcgagctcaagccgcaaacctgtaccatatgcgagaccacccccgtgaacgccatagatgcggagatgcacgacctgaattgctcttacaatatatgcccgtactgcgctagccggctgacctccgatggcctagcccgccacgtcacgcagtgccccaaacggaaagagaaggtggaggaaacggaactgtacttaaacctcgagcgaatcccatgggtggtgcgtaagctgctccaggtgagcgagtccaccggggtggctttaaagagatcttcctggctcatcgtcctcctcgtgctgttcaccgtgagcctctcgcccgtccaatccgctcccatcggacacgggaagacgatcgaagcctaccgagcccgagagggctataccagcatctgcctttttgtgctggggtccatactgttcgtggtatcttgcctcatgaagcggttggtagactctgtggggaactcattcttccccggcctctccatctgcaagacctgcagcatttccagcatcaacggatttgagatcgagtcccacaagtgctactgcagccttttctgctgcccgtactgccgccactgctccgcggacaaggagatacataagctgcacctgtcgatttgcaagaagcggaagaccgggtccaacgtcatgctcgccgtgtgtaagagaatgtgtttccgcgccacgatggaagtcagcgaccgggccctgttcatccgctccatcatcaacaccaccttcgtcctgtgcatcctcatcctggccgtgtgcgtggtaagcacctcagcggtggagatggagaacctgcccgcagggacctgggaacgtgaggaggacctcaccaacttctgccaccaggagtgccaggtaaccgagaccgagtgcctgtgcccctacgaggccttagtcctccgcaagcccctgttccgggacagcatcgtgaagggcatgaagaacctgctcaacagcacgtcccttgagaccagcctctccatcgaggccccgtggggcgccatcaacgttcagtctacttacaagcccaccgtctccacggcgaacatcgccttaagctggtccagcgtggaacaccgcgggaacaagatcctggtgtcaggccggagcgagtccatcatgaaactggaggaacgcaccgggatcagctgggacctcggcgtggaagacgcgtccgagagcaagctgctgaccgtgtccgttatggacctcagccagatgtattccccagtgttcgaatacctgagcggtgaccgccaggtggaagagtggccgaaggcgacctgtacgggcgactgccccgagcggtgcggctgtacctcgagtacttgcctgcacaaggagtggccccactcgaggaactggcgctgcaaccctacctggtgctggggcgtagggacggggtgcacatgctgcggcctcgacgtcaaggatctgttcaccgactacatgttcgtgaagtggaaagtggagtacatcaagaccgaggccattgtttgtgttgagctaacttcccaagagagacaatgctcactcatcgaagccggcacccgctttaacctggggccggtgacgattacgctctccgagccccggaacattcagcagaagctcccacccgagatcatcaccctgcacccccgcatcgaggagggcttctttgacctgatgcacgtccagaaggtgctcagcgcctccacggtctgtaagctgcagagctgtacccatggggtgccgggcgacctccaggtgtaccacattggcaaccttctgaagggcgataaggtcaacggccacctcatccacaagatcgaaccccacttcaacacctcgtggatgagctgggacgggtgcgacttggactactactgcaacatgggcgactggccctcctgtacctatacaggggtgacgcagcacaatagggcctctttcgtgaacctgctaaacatcgagaccgactacaccaagaactttcacttccactcgaagcgcgtgacggcacatggcgacaccccgcagctcgacttaaaggcacggccgacctatggggccggcgagatcacagtgctagtggaggtagccgacatggagctccacaccaagaagatcgagatcagcggattaaagttcgcctccctgacctgcaccgggtgctacgcatgtagctcaggcatcagctgcaaggtgcgcatccacgtggacgagcccgacgaattgacagtccacgtcaagtcagacgaccccgatgtggttgcggccagctccagcctgatggcccgcaagctggagttcgggacggactccaccttcaaggccttctccgccatgccgaaaaccagcctctgcttctatatcgtggaaaaggagtactgcaaatcctgcagcgaggaagataccaagaagtgtgtgaacacgaaactggagcaaccccagtccatcctgatcgaacacaagggcaccatcatcgggaagcagaactccacgtgcaccgcgaaggtctcgtgctggctcgagagcgctaagtcattcttctacgggctgaaggacatgctgagcggcatcttcggtaatgtgttcatcggcatcttcctgttcctcgcccccttcatcctgctgatcctcttcttcatgttcggatggcgcatactgctctgcttcaagtgctgtcgccggacccgcggcctattcaagtaccggcacctgaaggacgacgaggagaccgggtaccgccggatcatagagcgcctgaataataagaaagggaagaacaagctcctggacggcgagcggctggccgaccgccgaatcgcggagctgtttagtaccaagacgcacatcggatga

SEQ ID NO: 15277 - RNA, 5055 nt, synthetic construct
  misc_feature 1..5055: note = derived and/or modified CDS sequence (opt11) from CCHFV(Sudan AB1-2009)__HQ378187.1__GP
  source 1..5055: mol_type = other RNA
atgcacatcagcctcatctacgccatcctctgcctgcagctgtgcggcctcggggagacccacggctcccacaacgagacccgccacaacaagacggacaccatcaccacccccggggataacctgagctccgagccgagcgtgtccacggctctgagcatcacccccgacccctccaccgtcacccccacgaccccggcgagcggactcgaggggtccggcgaggtgtacaccagcccgcccatcaccacgggctccctgcccctgcctgggaccacccccgagctccccgccaccacgggaaccgacaccagctccgccagcgacgtggactccagcacccagacggccgggggaaccttcacccttaccgtccggacgtccctgccccgcagcccgtccacccccagcacgccccaggacacccaccaccccgtccggaacctcctgagcgtgacctccccggggcccgacgagaccagcaccccctccggcaccggcaaggagagccccgccacgtccagcccgcaccccgtttccaatcgcccgcccaccccgcccgcgaccgcccaagggcccaccgagaacgacagccacaacgctacggagcaccccgagtccctgacccagagcgctaccaccggccccatgacctcccccacgcagatcgtccacccccagtctgcgaccccgatcaccgtgcaggacacccacccctcccccacgaaccggagcaagcgcaacttggagatggagatcatcctgaccctgtcacaggggctcaagaagtactacggcaagatcctgcggctgctccacctgaccctagaggaggacaccgagggcctcctggagtggtgcaagcgcaacctggggcttgactgcgatgacacgttcttccagaagcggatcgaggagttcttcatcaccggcgaggggcactttaacgaggtcctgcagttccgcacccccggcaccctgagcactaccgagtccaccccggccgggctccccaccgccgagcccttcaagagctacttcgccaagggcttcctgtccatcgacagcggctactacagcgccaagtgctacagcgggacgagcaattccggcctgcagctcatcaacatcacccggcacagcacccgcatcgtggacacccccgggccgaagatcacgaacctgaagaccattaactgcatcaacctgaaggcgtccatattcaaggagcaccgggaggtggagatcaacgtcctcctcccccaggtcgccgtgaacctaagcaactgccacgtcgtgatcaagtcccacgtgtgcgactactcgctcgacatagacggcgccgtccgcctgccccacatctaccacgagggggtgttcatccccggcacctacaagatcgtgatcgacaagaagaacaagttgaacgaccggtgcaccctcttcacgaactgcgtcatcaagggccgcgaggtgcggaaggggcagtccgtgctgcgccagtacaagaccgaagtccggatcggcaaggccagcacggggtcccgccggctgctcagcgaggagccgtccgacgactgcatcagccgcacccaactgctgcgcacggagaccgccgagatccacggcgacaactacgggggccccggcgacaagatcacgatctgcaacgggtctaccatcgtggaccagcggctcggcagcgagctggggtgctacacgatcaaccgcgtcaagtccttcaaactgtgcgagaacagcgcgaccggcaagaactgtgagatcgactccgttcccgtgaagtgccggcagggctactgcctgcgtatcacccaggaggggcggggccacgtcaagctctcccgcgggagcgaggtggtgctggacgcctgcgacacctcctgcgagatcatgatccccaagggcacgggggacatcctggtcgactgcagcggcggtcagcagcacttcctcaaggacaacctgatcgacctggggtgcccgaaaatccccctcctgggcaagatggccatctacatctgccggatgtccaaccaccccaagaccaccatggccttcctgttctggttcagcttcgggtatctcatcacgtgcatcctgtgcaaggccatcttctacctgctcatcatcatcgggacccttgggaagcgtctgaagcagtaccgggagctcaagccccagacctgcaccatctgcgagaccaccccggtgaacgcgatcgacgccgagatgcacgacctgaactgctcctacaacatctgcccctactgcgccagccgcctgacgtccgacggcctcgcccggcacgtgatccagtgccccaagcgcaaggaaaaggtcgaggagaccgagctgtacctgaacctcgagcggatcccctgggtggtgcggaagctgctgcaggtcagcgaatccactggcgtggccctcaagcggagctcctggctgatcgtgctgctcgtcctattcaccgtctctttgtcccccgtgcagagcgcgccaatcgggcagggcaagacgatcgaggcctaccgcgcccgggaggggtacacctccatctgcctcttcgtcctgggtagcatcctgttcatcgtgtcctgcctcatgaaggggctggtggacagcgtcggcaacagcttcttccccggcctgtccatctgcaagacctgcagcatttccagcatcaacgggttcgagatagagtcccacaagtgctactgcagcctcttctgctgcccgtactgccgccactgctccaccgacaaggagatccacaagctgcacctgagcatctgcaagaagcggaagacgggctccaacgtgatgttggccgtgtgcaagcgcatgtgcttccgcgcgaccatggaggtcagcaaccgggccctgttcatccgctccatcatcaacaccaccttcgtgctgtgcatcctcatcctggccgtatgcgtcgtaagcacgtccgccgtggagatggagaacctgcccgcggggacctgggagcgggaggaggacctcaccaacttctgccaccaggagtgccaggtcaccgagacggagtgcctgtgcccctacgaggcgctggtgctccgcaagcccctgttcctggacagcatcgccaagggaatgaagaacctcctgaactccaccagcctggaaacctccctcagcatcgaggccccgtggggcgccatcaacgtgcagtccacatacaaacccacggtcagcaccgccaacatcgctctgagctggtccagcgtggagcaccgggggaacaagatcctggtgtccggccgcagcgagtccatcatgaagctcgaggagcggaccgggatcagctgggacctgggcgtcgaggacgcctccgaaagcaagctgctcaccgtgtccgtgatggacctgtcccagatgtattcccccgtcttcgagtacctgagcggggaccgccaggtggaggagtggccgaaggctacgtgcaccggcgactgtccggagcggtgcggctgcacctccagcacgtgcctccacaaggagtggccccactcccgcaactggcgatgcaaccccacctggtgctggggcgtggggaccggatgcacgtgctgcggcctggacgttaaggacctgttcaccgactacatgttcgtgaagtggaaggtcgagtacatcaagaccgaggccatcgtctgcgtggagctcaccagccaggagcgccagtgctccctgatcgaggccgggacccggttcaacctgggacccgttaccatcaccctcagcgagccgcgcaacatccagcagaagctgccgcccgagatcattacgctgcacccccggatcgaggagggcttcttcgacctcatgcacgtccagaaggtgctgtcagcgagcaccgtttgcaagctgcagagttgcacccacggggtccccggcgacctacaagtgtaccacatcgggaacctgctgaagggcgacaaggtcaacggacacctcatccataagatcgagcctcacttcaacacctcctggatgagctgggacggctgcgacctggactactattgcaacatgggcgactggccctcctgcacgtacaccggagtgacccagcacaaccacgccagcttcgtgaacttactcaacatcgagaccgactacacgaagaacttccactttcactccaagcgcgtcaccgcccacggcgacacgccccagctggacctgaaggcccggccgacctacggggcgggcgagatcaccgtgctcgttgaggtggccgacatggagctgcacaccaagaagatcgagatctcagggctgaagttcgccagtcttacctgcaccggctgctacgcctgctcctccggcatctcttgcaaggtgcgcatccacgtggacgagcccgacgagctcacggtccacgtgaagtccgacgaccccgacgtggtcgccgcgagctccagcctgatggcccggaagctcgagttcgggaccgactccaccttcaaggccttcagcgccatgcccaagacctccctgtgcttctacattgtggaacgcgagcactgcaagagctgcaacgaggaggacacgaagaagtgcgtgaacaccaagctggagcaaccgcagtccatcctcatcgagcacaagggcaccatcatcgggaagcagaacagcacgtgcaccgcccgggcgagctgttggctggagtccgtcaagagcttcttctacggcctgaagaacatgctgtccgggatcttcgggaacgtgttcatgggcatcttcctcttcctggcccccttcatcctgctcatcctgttcttcatgttcgggtggcgtatcctgttctgtttcaagtgctgccgccggacccgcggcctcttcaagtaccggcacctgaaggacgacgaggagaccgggtaccgccggatcatcgagcgcctgaacaacaagaaaggcaagaacaagctcctggacggcgagcggctggccgaccgccggatcgccgagctgttcagcaccaagacgcacatcgggtga

SEQ ID NO: 15278 - RNA, 5055 nt, synthetic construct; identical to SEQ ID NO: 11992
  misc_feature 1..5055: note = derived and/or modified CDS sequence (opt11) from CCHFV(Sudan Al-Fulah 9-2008)__HQ378185.1__GP
  source 1..5055: mol_type = other RNA

SEQ ID NO: 15279 - RNA, 5055 nt, synthetic construct; identical to SEQ ID NO: 11993
  misc_feature 1..5055: note = derived and/or modified CDS sequence (opt11) from CCHFV(SPU4/81)__DQ157175.1__GP
  source 1..5055: mol_type = other RNA

SEQ ID NO: 15280 - RNA, 5055 nt, synthetic construct
  misc_feature 1..5055: note = derived and/or modified CDS sequence (opt11) from CCHFV(NIV 11703)__JN572086.1__GP
  source 1..5055: mol_type = other RNA
atgcacaccagcctgatctacgtggtcttgtgcctgcagctgtgctccctcggcaagacgcacgggagccacaacggcacggagcacaacaagacggacgtgatgaccacccccggggacaatcagtccccggagcccctggtgagcacggctctacccgtcacacccgacccgtccaccgtgacccccacggcccccgctagcggcctcgaggggagcggagaagtgtacaccagctcctcaatcaccacaaagggtctgagcctgcccaaggccaccagcgaactcctggcaaccaccgggatggtcacctccagcgcctccgacatcgacccgagcacacaggccgcgggcgacacccccacccccacagtgcgtacgagcctgcccaacagcccctccacccctagcaccagccaggacactcaccaccccgtgcggaatcttctgtccgtcacgagccccaagccggaggagacccccacgccctccaagagcgacaaggactcaagcgccaccaacagcccccacccggcggccagccgcctgtccacgccgcccaccaccgaccaggggcccaccgagaacaacaaccacaacagcacggagcaactcgagtccctgacgcggagcgcgaccagcagctccatggtgagcctgacccagacggtgctcccccagtccgccaccagcatcgccacccaggacacccacccctcccccaccaatcgcagcaaacgcaacctggagatggagatcatcctgactctcccccagggcctaaagaagtattacgggaagatcctgaagctccttcacctgactctcgaagaggataccgagggcctgctggagtggtgtaagcgcaatctcggcctggactgcgacgacaccttctttcagaagagaattgaggagttctttattacgggagagggtcacttcaacgaggtcctgcagttccgagccccgggtaccctctctaccaccgagccaacgcacgccggctcccccaccgcggaaccgtttaagagctacttcgcgaagggcttcctgtccatcgactctggatatttctccgccaagtgctacagccgaacctcaaacagcggcctgcagctcatcaacgtgacgcgccacagcacgcggatcgccgacacccccgggcccaagatcaccaacctgaagaccatcaactgcatcaacctgaaggccagcgtgttcaaagagcaccgcgaggttgagatcaacgtgctgctgccccaagtggcagtcaacctgtccaactgccacgtggccatcaagtctcacgtgtgcgactactcccttgacacggacggggccatccggttgccgcacatccactatgagggaacgttcatacctggtacctataagatcgtcattgacaagaagaacaagctgaacgacaggtgcactctcttcacgaactgcgtgatcaagggccgtgaggtgcggaaggggcagagcgtcctgcggcaatacaagaccgagatccgcatcggacgggccagtaccgggagcaggcggttactcagtgaggagagcggagacgattgcatcagccgcacccagctgctgcgcacggagacggccgaggtgcacggggacaactacggcggccccggggataagatcaccatctgtaatggcagtaccgtcgtggaccaacggctggggagcgagctcggctgctacacgatcaaccgcgtgaagtccttcaagctgtgcgagaacagcgccacagggaaatcctgcgagattgacagcatacccgtgaagtgccggcagggctactgcctgaagatcacacaggagggccgcgggcacgtgaagctctccaggggctctgaggtggtcctggacgcctgcgactccagctgcgaggttatgatcccgaaggggaccggcgacatcctggtggactgctcaggtgggcagcagcacttcctcaaggataacctgattgacctaggctgccccaagatccccctcctcgggaagatggccatctacatctgccgcatgagcaaccaccccaagacgaccatggcattcctgttctggttctcctttggctacgtgataacatgcatcttatgcaaagtgatcttctacctgctgatcatctttggcacccttggaaagcggttcaagcaatatcgcgagttaaagccgcagacctgcaccatctgcgagaccacccccgttaacgccatcgacgctgaaatgcacgacctgaactgctcgtacaacatctgcccctactgcgcctcccggttaactagcgacggcctggcccgtcacgtcacacagtgccccaagcggaaggagaaagtggaggagaccgagctgtacctcaacctggaacgcatcccctgggtggtcagaaagctgctccaggtgtccgagagcaccgggatcgccctcaagcgcagcagctggctgatcgtcctcctggtcctgttcactgtgagcatcacgcccgtgcagtccgcgcccatcggccacgggaagaccatcgaggcctatcgggcccgcgaggagtacacctcaatctgtctcttcgtcctaggctccgtgctgttcgtggtcagctgcctcatgaaggggctggtggacagtgtgggcaacatcttcttccccggcctgttcatatgcaagacctgcagcatcgggtccatcaacggcttcgagatcgagtcccacaaatgctactgctccttgttctgctgcccgtactgccggcactgcagcgccgaccgcgagatccaccagctgcacctgtccatttgcaagaagcggaagacggggagcaacgtcatgctggccgtgtgcaaaaggatgtgcttccgtaccaccatggaggtgtccaacaaggcgctattcgtccggagcatcatcaacaccaccttcgtggtttgcatcctgatcctcgccgtctgcgtggtgtccaccagcgccgtcgagatggaatcgctgcccgctggtacctgggagcgagaggaagacctgaccaacttctgccaccaggagtgccaggtgacggagaccgagtgcctctgcccgtacgaggccctggtgctgcggcgccccctattcttagatagcatcgtgaagggcatgaagaacttactaaactccaccagcttagagacatcactgtccatcgaggcgccgtggggcgccatcaacgtgcagagcacgtacaagcccacagtgtccgccgcgaatatcgccctcagctggtccagcgtcgagcaccggggaaacaagatcctggtgtccggccggagcgagtccatcatgaagctggaggagcgaaccggcatcagctgggacctcggggtcgaagacgcttccgagagcaagctgctgaccgtcagtgtgatggacctcagccaaatgtactctcccgtgttcgaatacctgagcggggaccgccaggtcgaggagtggccgaaggccacgtgcaccggggattgccccgagagatgcggctgcacttcaagcacgtgcctacacaaggagtggccccactcccgcaactggcggtgtaaccccacctggtgctggggcgtggggaccggctgtacatgctgcgggctcgacgtgaaggacctgttcaccgactacatgtttgtcaagtggaaggtggagtacatcaagacggaggccatcgtctgcgttgagctgaccagccaggaacgccagtgcagcctcatcgaggccggaacccggttcaacttgggctccgtgaccatcacactgagcgagcctcgcaacatccagcagaagctcccgcccgagatcatcacgttgcacccacggatcgaggaggggttcttcgacctgatgcacgtccagaaggttctctcagcgagcaccgtgtgcaagctgcagtcatgcacccacggcgtcccaggggatctccaagtgtaccacatcggaaatctcctgaagggagaccgcgtcaacggacacctgatccacaagatcgagcagcatcttaacacctcctggatgtcctgggacggctgtgacctcgactactactgcaatatgggggattggcccagctgcacttacaccggcgtcacccagcacaaccacgcatccttcgtgaacctgctcaacatcgagaccgactacacgaagaccttccacttccacagcaagcgggtgactgcccacggggatacgccgcaactggatttgaaggcccgccccacctacggcgcaggggaaatcaccgtcctagtggaggtggcggacatggagctgcacaccaagaagatcgagatctcaggcctgaagtttgcctccctcagctgcacgggctgttacgcctgcagctccgggatttcctgcaaggtccggatccacgtagacgagccggacgagctgacggtgcatgtcaagtccgacgaccccgacgtggtggcggccagcagttcgctgatggctcgcaagctcgagagtggcaccgactccaccttcaaggccttcagcgccatgcccaagacctccctgtgcttctacatcgtcgagcgggaatactgcaaggggtgcagcaaagaagacacgcagaagtgcgtgaatactaagctggagcagccccagtccatcctcatcgagcacaagggcaccatcatcgggaagcagaacaatacgtgcacagccaaggccagctgctggctggaatccgtgaagtccttcttctacggcctgaagaacatgctgtctggcatcttcgggaacgtcttcctcggcatcttcagcttcctggcgccgttcgtgctgctaatcctgtttttcatgtttgggtggcgcatcctgttctgtttcaagtgttgccgccggacccggggcctcttcaagtaccggcacctaaaggacgatgaggagaccggctaccgcaagatcatcgagcggttaaacaacaagaaagggaagaacaagctcctggacggcgaacgcctcgccgatcgaaagatcgctgagctgttctcgaccaagacccacatcgggtga

SEQ ID NO: 15281 - RNA, 5055 nt, synthetic construct
  misc_feature 1..5055: note = derived and/or modified CDS sequence (opt11) from CCHFV(NIV 112143)__JN572085.1__GP
  source 1..5055: mol_type = other RNA
atgcacaccagcctgatctacgtggttctctgcctgcagctttgctccctcggcaagacccacggaagccacaacggcacggagcacaacaagaccgacgtgatgaccacccccggagacaaccagtccccggagcccctggtaagcacggccctgcccgtcacccccgacccgtcaaccatcacccccacggcccccgcgagcggcctcgaggggtccggcgaggtgtacaccagctccagcatcaccaccaagggcctgtccctccccaaggccacgagcgaactcctggccaccaccgggatggttacctccagcgcctccgacatcgacccgagcacgcaggccgcgggcgacacccccacccctaccgtccgcacgagcctgcccaacagcccgtccacccccagcaccagccaggacacccaccaccccgtgcggaacctcctgtccgtgacgagccccaagccggaggagacccccaccccctccaagagcgacaaggactccagcgccaccaacagcccccacccggccgcctcccgcctgtccaccccgcccaccaccgaccaggggcccaccgagaacaacaaccacaacagcacggagcagctcgagtccctgactcgaagcgcaacctccagctccatggtgagcctgacccagacggtgctcccccagtccgccaccagcatcgcgacccaggacacccacccctcccccaccaaccgctcgaagcggaacctggagatggagatcatcctgacgctccctcagggcctgaagaagtactacgggaagatcctgaagctactgcacctgaccctcgaggaggacaccgagggcctgctggagtggtgcaagcgcaacctcggcctggactgcgacgacaccttcttccagaagcggatcgaggagtttttcatcacgggggagggccacttcaacgaagtgttgcagttccgcgccccggggaccctcagcaccaccgagcccacacatgccggctcccccaccgcggagccgttcaagagctacttcgccaagggcttcctgtccatcgacagcgggtacttctccgccaagtgctacagccggacatccaacagcggcctgcagctcatcaacgtcacccgccactccacgcggatcgccgacacccccgggcccaagatcaccaacctgaagaccatcaactgcatcaacctgaaggcgagcgtgttcaaggagcaccgcgaggtggagatcaacgtcctcctgccgcaggtcgcggtgaacctgtccaactgccacgtcgccatcaagagccacgtgtgcgactactccctcgacacggacggcgccatccggctgccgcacatccattacgaggggaccttcatccccggcacctacaagatcgtgatcgacaagaagaacaagctgaacgaccgctgcaccctcttcacgaactgcgtcatcaagggccgggaggtgcgcaaggggcagtcagtgctgcggcagtacaagaccgagatccgcatcggccgggcctctaccgggtcacgccggctgctctccgaggagagcggcgacgattgcatcagccgcacccagctgctgcgcacggagaccgccgaggtccacggggacaactacggcggccccggggacaagatcaccatctgcaacggctccaccgttgtcgaccagcggctggggagcgagctcggctgctacacgatcaaccgcgtgaagtccttcaaactttgcgagaacagcgcgaccgggaagtcctgcgaaattgacagcatccccgtgaagtgccggcagggctactgcctgaagataacccaggagggtcgcgggcacgtcaagctcagtcggggcagcgaggtggtgttggacgcctgcgactccagctgcgaggtcatgatcccgaaggggaccggcgatatcctggtggactgctccggtggccagcagcacttcctcaaggacaacctgatcgacctgggctgccccaagatccccctcctggggaagatggccatctacatctgccgcatgagcaaccaccccaagacgaccatggccttcctcttctggttctccttcggctacgtgatcacgtgcatcctctgcaaggtcatcttttacctgctgatcatcttcgggaccctcggcaagcggttcaagcagtaccgcgagctgaagccgcagacctgcaccatctgcgagaccacccccgtgaacgccatcgacgcggagatgcacgacctgaactgcagctacaacatctgcccctactgcgcctcccggctcaccagcgacggcctggcccgccacgtgacgcagtgccccaaacggaaggagaaggtcgaggagaccgagctgtacttgaacctggagcgcataccgtgggtggtgcggaagctgctccaggtctctgagagcaccgggatcgccctgaagcgctccagctggctgatcgtgctcctggtgctgttcaccgtcagcatcacgcccgtgcagtccgcgcccatcggccacgggaagaccatcgaggcctaccgggcccgcgaggagtacaccagcatctgcctcttcgtgctgggctccgtcctgttcgtggtgagctgcctcatgaaggggctggtcgactccgtgggtaacatcttcttccccggcctgttcatttgcaagacctgtagcatcgggtccatcaatggcttcgagatcgagagccacaagtgctactgctccctcttctgctgcccctactgccggcactgcagcgctgaccgcgagatacaccagctgcacctgtccatctgcaagaagcggaagacggggagcaacgtgatgctcgccgtctgcaagcgcatgtgcttccgcgcgaccatggaggtgtccaacaaggccctgttcgtgcggagcatcatcaacaccaccttcgtggtgtgtatcctgatcctcgccatctgcgtggtctccacgagcgccgtggagatggagtccctgcccgccggcacctgggagcgcgaagaggacctgaccaacttctgccaccaggagtgccaggtgaccgagacggagtgcctctgcccctacgaggcgctggtgctgcggcgcccccttttcctggacagcatagtgaaggggatgaagaacctgctcaactccaccagcctggagaccagcctgtccatcgaggccccgtggggcgccatcaacgtgcagagcacctacaagcccacggtctccgccgccaacatcgcgctcagctggtccagcgtggagcaccggggcaacaagatcctggtgtccgggcgcagcgagtccatcatgaagctggaggagcggaccggtatcagctgggacttaggggtcgaggacgcctccgagagcaagctactgaccgtgtccgtgatggacctcagccagatgtactcccccgtcttcgagtacctgagcggcgaccgccaggtggaggagtggccgaaggctacctgcacgggggactgccccgagcggtgcggctgcacctccagcacgtgcctgcacaaggaatggccccactcccgcaactggcggtgcaaccccacctggtgctggggcgtggggaccggctgcacgtgctgcgggctcgacgtcaaagacctgttcaccgactacatgttcgtgaagtggaaggtggagtacatcaagaccgaagccattgtctgcgtggagctgaccagccaggagcggcagtgcagcctcatcgaggccggcacccggttcaacctggggtccgtcaccatcaccctgagcgagccgcgcaacatccagcagaagctcccgcccgagatcatcacgctgcacccccggatcgaggaagggttcttcgacctgatgcacgtgcagaaggtgctttccgccagcaccgtctgcaagctgcagtcctgcacccacggcgtgcccggggacctccaggtgtaccacatcggcaacctcctgaagggggatcgcgtcaacggccacctgatccacaagatcgagcagcacctcaacaccagctggatgtcctgggacggctgtgacctggactactactgcaacatgggggactggcccagctgtacctacacgggcgtgacccagcacaaccacgcctccttcgttaacctcctcaacatcgagaccgactacacgaagaccttccacttccacagtaagcgggtaaccgcccacggggacacgccccagctggacctgaaggcccgccccacctacggcgcgggggagatcaccgtgctagtggaggtcgccgacatggagctgcacaccaagaagatcgagatctccggtctgaagttcgccagcctctcctgcaccggctgctatgcctgcagttccgggatcagctgcaaggtgcggattcacgtggacgagccggacgagctgaccgtccacgtgaagtccgacgaccccgacgtggtcgccgcgtcgtcctccctgatggcccgcaagctcgagttcggcacggacagcacattcaaggccttctccgccatgcccaagaccagcctgtgcttctacatcgtggaacgggagtactgcaaggggtgctccaaggaggacacccagaagtgcgtgaacacgaagctggagcagccccagagcatcctcatcgagcacaagggcaccattatcgggaagcagaacaacacgtgcaccgccaaggcgtcctgctggctggagagcgtcaagtccttcttctacggcctgaagaacatgctgagcggcatcttcgggaacgtgttcctcggcatcttttccttcctggccccgttcgtgctgctcatcctgttcttcatgttcgggtggcgcatcctgttctgcttcaagtgctgccgccggacccgcggcctcttcaagtaccggcacctgaaggacgacgaggagaccggctaccgcaagatcatcgagcgtctgaacaacaagaaggggaagaacaagctcctggacggcgagcgcctggccgaccggaagatcgccgagctgttcagcacaaagacccacatcgggtga

SEQ ID NO: 15282 - RNA, 5055 nt, synthetic construct
  misc_feature 1..5055: note = derived and/or modified CDS sequence (opt11) from CCHFV(NIVA 118594)__JN572084.1__GP
  source 1..5055: mol_type = other RNA
atgcacaccagcctcatctacgtggtcctctgtttgcagctgtgctccctcggcaagacccacgggagccacaacggtacggagcacaacaagaccgacgtgatgaccacccccggggataaccagtcgccggagccgctggtgagcacggccctgcccgtcacccccgatccgtccaccgtgacccccacggcccccgcgagcggcctcgaggggtccggcgaagtgtacaccagcagtagcataactaccaagggcctgtccctgcccaaggccacgagcgaactcctggccaccaccgggatggtcacaagcagcgcctccgacatcgacccgagcacgcaggccgcgggcgatacccccacgcccaccgtgcgcacgtccctgccaaatagcccgtccacccccagcacctcacaggacacccaccaccccgtgcgcaatctcctgtccgtcacgagccccaagccggaggaaacccccaccccctccaagagtgataaggactccagcgccaccaacagcccacacccggccgccagccgcctgtccacgccgcccaccaccgaccaggggcccaccgagaacaacaaccacaacagcacggagcagctcgagtcactgacccggtctgcgacctccagctccatggttagcctaacccagacggtgctcccccagtccgccaccagcatcgccacccaggacacccacccctcccccaccaaccgcagcaagcggaacctggagatggagatcatcctgacgctcccccagggactgaagaagtattacgggaagatcctgaagctcctgcacctgaccctcgaagaggataccgagggcctgttggagtggtgcaagcgcaacctcggcctggactgcgacgacacgttcttccagaagcggatcgaggagttcttcatcacgggggaaggtcacttcaacgaggtactgcagttccgcgccccggggaccttaagcaccaccgagcccacgcacgccggctcccccaccgcggagccgttcaaaagctacttcgccaagggcttcctgtccatcgactctgggtacttctccgccaagtgctacagccggacctccaactctggcctgcagctcatcaacgtgacccgccattccacgcggatcgccgacacaccaggacccaagatcaccaatctgaagaccatcaactgcatcaacctaaaggccagcgtgttcaaggagcaccgcgagttcgagatcaacgtcctcctgcctcaggtagcggtgaacctgtccaactgccacgtcgccatcaagagccacgtgtgcgactactccctcgacacggatggagccatccggctgccgcacatccactacgaggggacattcatccccggcacctacaagatcgtgatcgacaagaagaacaagctgaacgaccgctgcactcttttcacgaactgcgtcatcaagggccgggaggtgcgcaaggggcagagcgtgctacgacagtacaagaccgagatccggatcggccgggcctccaccgggagccgccggctgctctccgaggagtcgggcgacgactgcatctcacgcacccagctgctacgcaccgagaccgccgaggtgcacggggacaactacggcggccccggggacaagatcaccatatgcaacggctccaccgtcgtcgaccagcggttggggtccgagctcggctgctacacgatcaaccgcgtgaagtccttcaagctgtgcgagaacagcgcgaccgggaagtcctgcgagatcgacagcatccccgtgaagtgccggcaggggtactgcctcaagatcacccaggagggccgcggccacgtcaagctctcccggggcagcgaggtggtgctggatgcgtgcgactccagctgcgaggtcatgatccctaaggggaccggcgacatcctggtcgactgctccggcgggcagcagcacttcttgaaggataacctgatagacctgggctgtcccaagatacccctcctggggaagatggccatctacatctgccgcatgagcaaccaccccaagacgaccatggccttcctgttctggttcagtttcggctacgtcataacctgcatcctctgcaaggtcatcttctacctgctgatcatcttcgggaccctcggcaagcggttcaagcagtaccgcgagctgaagccgcagacctgcaccatctgcgagaccacccccgtgaacgccatcgacgccgagatgcacgatctcaactgcagctacaacatctgcccctactgcgcctcccggctcacaagcgacggcctggcccgccacgtgacgcagtgccccaagcggaaggagaaggtcgaggagaccgagctgtacctgaacctggagcgcatcccctgggtggtgcggaagctgctccaggtctccgagtccaccgggatcgctctgaagcgcagcagctggctgatcgtgctcctggtgctgttcactgtcagcatcacgcccgtgcagtccgcgcccatcggccacgggaagaccatcgaagcctacagagctcgcgaggagtacaccagcatctgcctcttcgtgctgggctccgtactgttcgtggtgagctgtctcatgaaggggctggtcgactccgtgggcaacatcttcttccccggcctgttcatctgcaagacctgcagcatcgggtccatcaatggcttcgagattgagagccacaagtgctactgctccctcttctgctgcccgtactgccgccactgcagcgccgaccgcgagatccatcagctgcacctgtccatctgcaagaagcggaagacggggtcaaacgttatgctcgccgtctgtaagcgcatgtgcttccgcaccaccatggaggtgtccaacaaggcgcttttcgtgcggtctatcatcaacaccacttttgtcgtgtgcatcctgatcctcgccgtgtgcgtcgtttctaccagcgccgtggagatggagtcactgcccgccgggacctgggagcgggaggaggacctgaccaacttctgccatcaggagtgccaggtcacggagaccgagtgcctctgcccctacgaggccctggtgctgcggcgccccctcttcctggacagcatcgtgaaggggatgaaaaacttgctcaactcgaccagcctggagacctcgctgagcatcgaggcgccgtggggcgccatcaacgtccagagcacctacaagcccaccgtctccgccgcaaacatcgccctcagctggtccagcgtcgagcaccggggcaacaagatcctggtatccgggcgcagcgaatccataatgaagctggaggagcggaccggcataagctgggacctcggggtggaggacgcatccgagagcaagctgctgaccgtatccgttatggacctcagccagatgtacagccccgtgttcgagtacttgagcggcgaccgccaggtggaggaatggcccaaagcaacgtgcaccggcgactgccccgagcggtgcggctgcacctcctctacctgcctgcacaaagagtggccacactccaggaactggcggtgcaaccccacctggtgctggggcgtcgggaccggctgcacgtgctgcgggctcgacgtgaaggatctgttcaccgattacatgttcgtgaagtggaaggtcgagtacatcaagaccgaggccatcgtgtgcgttgagctgaccagccaagagcgccagtgcagccttatcgaggccggcacccggttcaacctgggctcggtgaccatcaccctgtctgagccgcgcaacattcaacagaagctcccgccggagatcatcaccctacacccccggattgaggaggggttcttcgacctgatgcacgtccagaaagtcctctccgcgagcaccgtgtgcaagctgcagtcctgcacccacggcgtgcccggagacctgcaggtctaccacatcggcaacctcctgaagggggaccgcgtgaacggccacctgatccacaagatcgagcagcacttgaacaccagctggatgtcatgggacggctgcgacctggactactactgcaacatgggggactggcccagctgcacgtacaccggtgtgacccagcacaaccatgcctccttcgtcaatctgctcaacatcgagaccgactacacaaagaccttccactttcacagcaagcgggtgaccgcccatggtgacacgccccagctggacctgaaggcccgccccacctacggcgccggggagatcaccgtgctcgtagaggtggcggacatggagctgcacaccaagaagatcgagatctccggcctgaagttcgccagcctctcctgcaccggctgttatgcatgcagctccgggataagctgcaaggtgcggatccatgtcgacgagccggacgaactcacggtgcacgtgaagtccgacgaccccgacgtcgtcgccgccagctctagcctgatggcgcgcaagctcgagagcggcaccgattccaccttcaaggccttcagcgccatgcccaagacctccctgtgcttctacatcgtggagcgcgagtactgcaaggggtgcagcaaagaggacacgcaaaagtgcgtcaacaccaagctcgagcagccccagtccatcctcatcgagcacaaggggaccatcatcgggaagcagaacaacacgtgcaccgccaaggccagctgctggctggagtctgtgaagtcctttttctacggcctgaagaacatgctgtccggcatcttcgggaacgtgttcctcggcatcttcagcttcctggcgccgttcgtcctgctcatcctcttcttcatgttcgggtggaggatcctgttctgcttcaagtgctgtcgccgtacccgcggccttttcaagtaccggcacctgaaggacgacgaggaaaccggctaccgcaagatcatcgagcggctaaacaacaagaagggcaagaacaagttgcttgacggcgagcgcctggccgaccggaagatcgccgagctgttctccaccaagacgcacatcgggtga

SEQ ID NO: 15283 - RNA, 5055 nt, synthetic construct
  misc_feature 1..5055: note = derived and/or modified CDS sequence (opt11) from CCHFV(UCCR4448)__KY484042.1__GP
  source 1..5055: mol_type = other RNA
atgcacatctcgctaatgtatgccgtgctctgtctgcagctgtgcggcctaggggagacccacggctcccacaacgagaccgggcataacaagacggatgtcatgaccacccccggcgacaacctgagctctgagcagccggtgagcaccgctctaagtatcacgcccgaccccagcactgtgaccccaaccacacccgcgtccggactcgagggctcgggcgaggtatacacctccccgcccatcatcaccgagagcctatccctgcccgagaccacacccgagctcagcgccaccgccgggatcgacacctccagcgcctccgacgttgactcatccacccaagccgcgcgcggcacgagcgccctgaccgtgcgaacctccctgcccaacagccccagcaccccctccacgccccaggagacccaccacccggtccgcaacctcctgagcgtaaccagcccccggcccgaggagaccagcacgccgtcaggcagcggcaaggagtccagcgccacgtcggggccccatcccgtcagcaataagcccccaactccgcccgccaagacgcagggccccacggagaacaactcccacaacgcgaccgagcaccccgaacccctgactcagagtgccaccctcggcctcatgacctcccccacccagatcgtccacccccagagcgctacctccatcaccgtacaggacacgtacccgagccccacgaaccgttccaagcggaacctggagatggagatcatcttaaccctgtcacaggggctgaaaaagtactacggcaaaatcttaagactgttgcggctcaccttagaggaggataccgaaggcctgctcgagtggtgcaaacgcaaccttggcctggactgtgacgacacgttctttcaaaagcggatcgaggagttcttcatcaccggcgaagggcacttcaatgaggtgcttcagtttaagactcccgggacccttagcacgaccgaaagcaccccggccgagctgccaactgccgagcccttcaagagctacttcgcgaaggggttcctctccatagacagcggctattactccgccaagtgctacagcggcacgtccaacagcggcctgcagctgattaacatcacccgccactccgctcggatcgtcgataccccaggcccgaaggtcacaaacttgaagactatcaactgcatcaacctgaaggccagcattttcaaggagcaccgcgaggttgagatcaacgtcctgctcccccaggtggcggttaacctgtccaactgccatgtcatcatcaaatcccacgtatgtgactactccctggacatcgacgggaccgtgcggctccctcacatctaccacgagggcgtcttcatccccgggacctacaagattgtgattgataagaaagacaagctgaacgaccgctgcaccctgttcacggactgcgtgatcaagggccgtgaggtccgcaaggggcagagcgtcctccggcagtacaagaccgagatcagaatcggcaaagcgtccacagggagccggcgcctactgagtgaggagaccagcgatgactgcatctcccggacgcagctcttacggaccgagaccgctgagatccatggggacaattatggcgggccgggcgacaagataaccatctgtaacgggagcacgatcgtcgaccaacgcctgggctcagagctgggctgttacaccattaaccgagtgaagtcatttaaactctgcgagaacagcgccaccgggaagtcctgcgagatcgactctgtgcccgtcaaatgtcgccagggctactgcctgcggatcacccaggaggggcgcggccacgtgaagctgagtcggggcagcgaggtcgtcctcgacgcctgcgacacgtcttgtgagatcatgatccccaaggggaccggcgacatcctagtcgactgcagcgggggccaacagcacttcctgaaggacaatttgatcgatctggggtgccccaagatccctctactcggcaagatggcaatttacatctgccgcatgtcgaatcatcctaagaccacaatggccttcctgttctggttcagtttcggctacgtgatcacgtgtatactgtgcaaggccatcttttatctcctgattattatcgggacgctgggcaagcggttcaaacagtatcgcgagctcaagccccaaacctgcaccatctgcgagacgacacccgtcaacgccatcgatgcggagatgcacgacctgaattgctcctataacatctgcccgtactgcgccagccggctgacctccgacgggttggcgcgccacgtaacgcagtgtccaaagcggaaggagaaggtggaggagactgagctgtacctgaatctcgagcgcatcccatgggtcgtgagaaagctgcttcaggtgagcgagtccactggcgtcgctctaaagcgcagctcctggctgatagtgctactggtgctgttcaccatcagcctgagccctgtccaaagcgccccaatatcccacggcaagaccatcgaggcctaccgggcgcgcgaggggtacacctccatctgtctcttcgtgctgggctcaatcctgttcatagtatcttacttgatgaagggactggtagattccgtgggcaactccttcttccccgggctgagtatttgcaagacgtgctctaccagctccatcaacggtttcgagatcgagagccacaagtgctactgctctctcttctgctgcccttactgccggcactgcagcgccgacaaggagatacacaagttacacctgtccatctgtaagaagcgcaagaccgggagcaacgttatgctagctgtctgtaagcggatgtgtttccgcgccaccatggaggtgtccaaccgcgccctgttcatacggagcatcataaatacgacctttgtgctatgtatcctcatcctagcggtttgcgtggtgtccaccagcgctgtagagatggagaacctgccggccggcacctgggagcgcgaggaagacctcacgaatttctgccaccaggagtgtcaggtcaccgagaccgagtgcctatgcccgtacgaggccttggttttacgtaagcccctgtttctggactccattgtcaagggaatgaaaaacctcctgaatagcaccagcctggagacgtccctgagcatcgaggcaccctggggcgcgattaacgtacagtccacctacaagccgaccgtgtctaccgctaacatcgccctgtcttggtcatccgtcgagcaccgcgggaacaaaatcttagtgagtgggcgatccgagagcatcatgaaactcgaggagaaaacgggcatctcctgggacctgggggtggaggacgcctctgagtccaaattactcaccgtcagcgtgatggatctgtcccagatgtactcacccgtgttcgaatacctgtccggcgaccgccaggtagaggaatggcccaaggccacatgcaccggcgactgccccgaacggtgcgggtgcacgagctccacgtgcctccacaaagagtggccgcatagccgcaactggaggtgcaaccccacctggtgctggggcgtggggaccggctgtacctgctgcggcctcgacgtgaaggacctgttcaccgactatatgttcgtcaaatggaaggtggaatatatcaagaccgaggcgatcgtgtgcgtcgagctcacctcccaagagagacagtgctccctaatcgaagccgggactcggttcaacctgggccctgtgaccatcaccctctcagaaccgcgcaacatccagcagaagctgccgcccgagatcatcaccctccaccctcggatcgaggaggggttcttcgacctcatgcacgttcagaaggtcctgtcggccagtacggtatgcaagctgcagtcttgcacccacggcgttccaggggacctccaggtctaccacataggtaacctgctgaagggcgacaaagtgaacgggcacctcatccacaagatcgagccgcacttcaacaccagctggatgtcctgggacggctgcgacctggactactactgcaacatgggtgattggcccagctgtacctacaccggcgtcacgcagcacaaccacgcctcctttgtgaacctgctcaacatcgagacggactacaccaagaattttcatttccacagcaagcgggtgaccgcacatggggacacgccccagttggatctgaaggcacggcccacctacggcgccggcgagatcactgtgctcgtggaagttgccgacatggaactgcacacgaagaagatcgagatctccgggctgaaattcgcatccttgacttgcacaggatgttacgcgtgctccagcggcatctcctgcaaggtccgcatccacgtcgatgagccagatgagctgaccgtgcacgtcaagagcgatgacccggacgtggtggctgccagcagctccctgatggcccggaagctcgaatttgggaccgactcaacgttcaaggccttcagcgcgatgcccaagacctccctgtgtttctacatcgtcgagcgggagcactgcaagtcctgctccgaagaggacaccaagaaatgcgtcaacaccaagctggaacagccccaatccatcctcatcgagcataaggggacgatcatcggaaaacagaatagtacctgcaccgccaaagccagctgttggctcgagtccgtcaagagcttcttctacggtttgaagaacatgctgtccgggatctttggcaatgtgttcatcgggatcttcctcttcttggccccgttcattctgctcatcctgttctttatgttcggctggaagatcctgttctgcttcaagtgctgccggcgcactcggggactcttcaagtaccgccacctgaaggatgacgaggagacgggttaccgtcggatcatcgagcgccttaataacaagaagggcaagaacaagctgctggacggggagatcctggctgaccggcgcatcgcagagcttttctccaccaagacacacatcggctga

SEQ ID NO: 15284 - RNA, 5055 nt, synthetic construct
  misc_feature 1..5055: note = derived and/or modified CDS sequence (opt11) from CCHFV(UCCR4401)__KY484035.1__GP
  source 1..5055: mol_type = other RNA
atgcacatcagcctgatgtacgccatcctgtgcctgcagctttgcggcctcggggagactcacggctcccacaacgagacccgccacaacaagacggacaccatgaccacccccggggacaacccgagctccgagccgcccgtgagcacggccctgagtatcacccttgaccccagtaccgtcacccccacgacccccgcgtccggcctcgaggggagcggcgaggtatacacctccccgccaatcaccacgggcagcctgcccctgtccgagaccacccccgagctccccgtgaccacgggcaccgacaccctgagcgccggcgacgtcgacccctccacccagacggccgggggcaccagcgccccgaccgtgcggaccagcctgcccaactccccgtccacgcccagcaccccgcaggatacccaccaccccgtgcgcaacctcctcagtgtcactagcccagggcccgacgagacgagcaccccgtccggcaccggcaaggagagcagcgccacaagcagcccccaccccgtgtcaaaccggcccccgacgccgcccgcgaccgcccaggggcccaccgaaaacgactcccacaacagcaccgagcaccccgagtccctgacacagagcgccacccccggcctcatgacctcccccacccagatcgtgcacccccagagcgccacccccatcacggtccaggacacccacccctcccctaccaaccgcagcaagcggaacctaaagatggagatcatcctgaccctctcccaggggctgaagaagtactacggcaagatactgcgcctcctgcagctgacgctcgaggaggacaccgagggcctactggagtggtgcaagcggaacctcgggctcgactgtgatgacaccttcttccagaagcgcatcgaggagttcttcatcaccggcgaggggcacttcaacgaggtgctgcagttccggacgccaggcaccctcagcacaaccgagtccacacccgcggggctgcccaccgcggagcccttcaaaagctacttcgccaagggcttcctgtccatcgacagcggctactactctgccaagtgctattccgggaccagcaactccggcctccagctgatcaacatcacccgccacagcacgcggatcgtggacacgccggggcccaaaatcaccaacctgaagaccatcaactgcataaatctcaaggcctccatcttcaaggagcaccgagaggtcgagatcaacgtgcttctgccccaggtggcggtcaacctcagcaattgccacgtggtgatcaagtcccacgtctgcgactacagcctggacatcgacggcgccgtgcggctcccccacatctaccacgagggggtgttcatcccgggcacctacaagatcgtaatcgacaagaagaataagctcaacgaccgctgcacactgttcaccgactgcgtgatcaagggtcgggaggttcggaaagggcagtccgtcctgcggcagtacaagaccgagatccgcatcggcaaagcctctacggggtcccggcggctcctgagcgaggagccctccgacgactgcatcagccggacccaactgctccgaaccgaaaccgccgagatccacggcgacaactacgggggcccaggcgacaagatcacgatctgcaacggttccaccatcgtggaccagcgcttgggctcagagctgggttgctacactatcaaccgggtccgctccttcaagctgtgcgagaacagcgccaccggcaagaactgcgagatcgacagcgtgcccgtgaagtgccggcaaggctactgcctcaggatcactcaggagggacggggccacgtcaagctgtcccgggggagcgaggtggtgctggacgcgtgcgacacctcctgcgagatcatgatcccgaaggggaccggtgacatcctcgtcgactgcagcggaggccagcagcacttcctgaaagacaacctgatcgacttagggtgcccgaagatccccctgttgggcaagatggccatctacatatgccggatgtccaaccaccccaagaccacgatggccttcctcttttggttcagcttcgggtacgtcatcacttgcatcctgtgcaaagccatcttctacctgttgatcatcgtgggcaccctggggaagcgccttaagcagtacagagagctcaagccgcagacctgcaccatctgcgagaccacccccgtcaacgccatcgacgcggagatgcacgacctaaactgctcctacaacatctgcccctactgcgccagccgcctgacctccgacggcctcgcccggcacgtgatccagtgccccaagcgcaaggagaaggttgaggagaccgagctgtacctgaacctcgagcggatcccgtgggtcgtgcgtaagctgctccaggtgagcgagtcgacgggcgtagccctgaagcggagctcctggctgatcgtgctgcttgtgctgttcaccgtcagcctgtcccccgtccagagcgcccccatagggcagggcaagaccatcgaggcgtaccgcgcccgggaggggtacacctccatttgcctcttcgtgctgggcagcatcctgttcatcgtctcctgcctcatgaaggggctggtggacagcgtggggaacagcttcttcccgggcctgtctatctgcaagacgtgcagcatctccagcatcaacgggttcgagattgaatcccacaagtgctactgcagcctcttctgctgcccctactgccgccactgctccaccgacaaggagatacacaagctgcacctgtccatctgtaaaaagaggaagaccggcagcaacgtcatgcttgccgtgtgcaagctgatgtgcttccgcgccaccatggaggtgagcaaccgcgcgctgttcatccggagcatcataaacacgaccttcgtcctttgcatcctgatcttagccgtgtgcgtagtcagcacctccgccgtggagatggagaacctccccgccgggacctgggagcgcgaggaggacctgacgaacttctgccaccaggagtgccaggtgaccgagaccgagtgcctgtgcccctacgaggccctcgtgctgcggaagccgctgttcctcgacagcaccgcgaagggcatgaagaacctgctgaactccaccagtctcgagacctcccttagcatcgaggccccctggggcgccatcaacgtgcagtccacctacaagcccaccgtgagcacggcgaacatcgccctgagctggtccagcgtcgagcaccgcgggaacaagatcctcgtttccggccgctctgagtccatcatgaagctggaggagcgcaccgggatcagctgggatctgggcgtggaggacgcgtccgagagcaagctcctaacggtctccgtgatggacctgtcgcagatgtactcccccgtgttcgagtacctcagcggagaccggcaggtcgaggaatggccgaaggcgacctgcacgggcgactgccccgagcgctgcggctgcacctccagcacgtgcctgcacaaggagtggccccactcacggaactggaggtgcaaccccacctggtgctggggcgtggggaccgggtgtacgtgctgcggcctggacgtgaaggacctcttcaccgactacatgttcgtcaagtggaaggtggagtacatcaagaccgaggccatcgtgtgcgtcgagctgaccagccaggagcggcagtgctccctgatcgaagcaggtacccgattcaacctcggccctgtgaccatcacactgtctgagccccggaacatccagcagaagctgccgcccgagatcatcaccctccacccccgcatcgaggaggggttcttcgacctcatgcacgtgcagaaggtcctgtccgctagcacggtgtgcaagctccagtcctgcacccacggggtccccggtgacttgcaagtgtaccacatcgggaacttgctgaaaggcgacaaggtgaacgggcacctgatccacaagatcgagccccactttaacacttcctggatgagctgggacggctgcgacctggactactactgcaacatgggcgactggccctcctgcacctacacgggcgtcacccagcacaaccacgccagcttcgtaaacctcctgaacatcgagaccgactacaccaagaacttccacttccactccaagcgcgtgacggcccacggcgacaccccgcagctggacctcaaggcccgccccacttacggtgccggtgagatcaccgtcctcgtggaggtcgcggacatggagctgcacacgaagaagatagagataagcgggctgaagtttgcctccctggcctgtacgggctgctacgcctgcagctccggcataagctgcaaggtccgaatccacgtggacgagcccgacgagctgaccgtgcacgttaagtccgacgaccccgacgtggttgccgcgagctccagcctcatggcccgcaaactggagtttgggaccgactccacgttcaaggccttcagcgccatgccgaaaacctccctttgcttctacatcgtcgagcgggagcactgcaagagttgctccgaagaggacaccaagaagtgcgtgaacaccaagctcgaacagccccagagcatcctaattgagcacaagggcacgataatcgggaagcagaacagcacgtgcacggccaaggcgtcctgctggctggagtccgtgaagtccttcttctacgggctcaagaacatgctcagcggcatcttcgggaacgtctttatgggcatcttcctgttcttggcccccttcatcctccttatcctgttcttcatgttcggatggcgcatcctcttctgcttcaagtgttgccggcgcacccgcggcctgttcaagtaccggcacctgaaggatgacgaggagaccgggtacagacggatcatcgagaagctcaacaataagaagggcaagaacaagttactggacggcgagcgcttagccgatcggcgcatcgccgagctattcagcacaaagactcacatcgggtga

SEQ ID NO: 15285 - RNA, 5055 nt, synthetic construct
  misc_feature 1..5055: note = derived and/or modified CDS sequence (opt11) from CCHFV(IbAn7620)__KX013451.1__GP
  source 1..5055: mol_type = other RNA
atgcacatcagcctgatctatgccattctctgcctgcagctgtgcggactcggggagacctacggctcccacaacgagacccgccacaacaagacggataccatgaccacccccggggacaacctgagctccgagccgcccgtgagcacggccctgttcatcacccccgacccctccaccgtcaccccgacgacccccgcgagcggcctcgaggggtccggcgaagtctacaccagccctcccatcaccacgggctccctgccgctgcccgagaccacccccgaactccccgccaccacggggaccgataccagctccgccagcgacgtggacttctccacccagacggccggcgggaccagcgccctgaccgtccgtaccggcctgccggactcccccagcacgccctccacaccccaggacacccaccacccgatgcgcaatctcctgagcgtgacctcccccgggcccgacgagacgagcacgcccagcggcaccggacgggagtccagcgcgaccagtagcccgcaccccgtatccaaccgcccgcccacgccgcccgccaccgcccaggggcccaccgagaacgacagccacaacgccaccgagcaccccgagtctctgacgcagagcgcgactcccggcctgatgacctcccccacccagaccatccacccccagagcgccacgccgatcaccgtccaggacaagcagccctcccccaccaaccggagcaagcgcaacctggagatggagatcatcctgaccctctcccaggggctgaagaagtactacggaaagattctgcggctcctgcacctgacgctcgaggaggacaccgagggcctgctggagtggtgcaagcgcaacttagggctggactgcgacgacaacttcttccagaagcggatcgaggagttcttcatcaccggcgaggggcacttcaacgaggtcctgcagttccgcacccccggaacgctcagtaccaccgagtccaccccagccgggctgcccacggccgagcccttcaagagctacttcgccaagggcttcctatccatcgacagcggctattactccgcgaagtgctacagcgggaccagcaactcaggccttcagctgatcaacatcacccggcacagcacccgcatcgtggacacgcccgggccgaagatcaccaacctgaagaccatcaactgcatcaacctcaaggcctccatcttcaaggagcaccgggaggtcgagatcaacgtgctgctgccccaggtggccgtcaacctcagcaactgccacgtggttatcaagtcccacgtctgcgactacagcctggacatcgacggcgccgtgcgcctgccccacatctaccacgagggggtcttcatccccggcacctacaagattgtcatcgacaagaagaacaagctcaacgaccggtgcacgctgttcaccgactgcgtgatcaagggccgcgaggtgcggaaggggcagtccgtcctgcgccagtacaagaccgagatccggatcggcaaggccagcaccgggtcccgccggctcctgagcgaggagccgtccgacgactgcatcagccgcacgcagctgctccgcacggagaccgcggagatccacggcgacaactacgggggccccggcgacaagatcaccatctgcaacgggtccacgatcgtggaccagcggctgggcagcgagttggggtgctacaccatcaaccgcgtgaagtccttcaagctgtgcgagaacagcgccaccggcaagaactgcgagatcgactccgtccccgtgaagtgccggcagggctactgcctccgtataacccaggaagggcggggccacgtcaagctgagccgcgggagcgagatcgtgctggacgcctgcgacacgagctgcgagatcatgatccccaagggcaccggggacatcctcgtggattgcagcggcggccagcagcacttcctgaaggacaacctgatcgacctcgggtgcccgaagatccccctgctgggcaagatggccatctacatctgccggatgtccaaccaccccaagaccaccatggccttcctcttctggttcagcttcgggtacgtcatcacgtgcatcctgtgcaaggcgatcttctacctgctcatcatcatcggcaccctggggaagcgcctgaagcagtaccgggagctcaagccccagacctgcaccatctgcgagaccacgccggtgaacgccatcgacgccgagatgcacgacctgaactgctcctacaacatctgcccctactgcgccagccgcctgacctccgacggcctcgcccggcacgtgatccagtgccccaagcgcaaggagaaggtcgaggagaccgagctgtacctgaacctcgagcggatcccgtgggtggtgcgcaagctgctgcaggtcagcgagtccaccggcgtggcgctcaagcggagctcctggctgatcgtgctgttagtcctgttcacggtaagcctgtccccggtgcagtcagcccccatcgggcagggcaagaccaccgaggcctaccgcgcccgggaggggtacacatccatctgcctcttcgtcctgggcagcatcctgttcatcgtgtcctgcctcatgaaggggctggtggacagcgtcggcaattccttctttcccggcctgagcatctgcaagacgtgcagcatctccagcatcaacgggttcgagatcgagtcacacaagtgctactgtagcctcttctgctgcccgtactgccgccactgctccaccgacaaggagatccacaagctgcacctgagcatctgtaagaagcggaagacgggctccaacgtgatgctggcggtgtgcaagcgcatgtgcttccgcgccacgatggaggtcagcaaccgggccttattcatccgctccatcatcaacacgaccttcgtgctgtgcatcctcatcctggccgtgtgcgtcgtgagcacctcggcagtggagatggagaacctgcccgcggggacctgggagcgggaggaagacctcactaacttctgccaccaggagtgtcaggtcaccgagaccgagtgcctgtgcccctatgaggccctggtgctccgcaagcccctgttcctggacagcatcgccaagggcatgaagaacccgttaaactccaccagcctggagacgtccctgagtatcgaggccccctggggcgccatcgacgtgcagtccacctataagcccaccgtcagcaccgcaaacatagccctctcctggagcagcgtggaacacagggggaacaagattctggtgtccggccgctcagagtccatcatgaagctggaggaaaggacggggatcagctgggacctcggggtcgaggatgcctccgagagcaagctgctgacagtctccgtgatggacctcagccagatgtactcccccgtcttcgagtacctgagcggggaccgccaggtggaggagtggccgaaggccacctgtaccggcgactgccccgagcggtgcggctgcacgagcagcacgtgcctgcacaaggaatggccccactcccgcaactggcggtgcaaccccacctggtgctggggcgtggggaccggctgtacctgctgcggcctcgacgtcaaggacctgttcaccgactacatgttcgtgaaatggaaggtggagtacatcaagaccgaggccatcgtctgcgtggagctgaccagccaggagcgccagtgctccctcatcgaggcagggacgcggttcaacctgggcccggtgactatcaccctgagcgagccgcgcaacatccagcagaagctcccgcccgagatcatcacactgcacccccggatcgaggagggcttcttcgacctgatgcatgtccagaaggtgctctccgccagcaccgtgtgcaagctgcaatcatgcacgcacggggtccccggcgacctccaggtgtatcacatcgggaacctgttgaagggcgacaaggtgaacgggcacctgatccacaagatcgagccccacttcaacaccagctggatgagctgggacggctgcgacctcgactactactgcaacatgggcgactggccctcctgcacctataccggggtcacgcagcacaaccacgccagcttcgtgaacctgctgaacatcgagaccgactacaccaagaacttccacttccacagtaagcgcgtcaccgcccacggcgacactccgcagctcgacctgaaggcgcggccgacctacggggccggcgagatcaccgtgctggtggaggtcgccaacatggaactccacaccaagaagatcgagatcagcgggctcaagttcgcctccctgacgtgcaccggctgctacgcctgcagctccggcatcagctgcaaggtgcgcatccacgtggacgagcccgacgagctcaccgtccacgtgaagtccgacgaccccgacgtggtcgcggccagctccagcctgatggcccggaagctggagttcgggaccgactccacgttcaaggccttcagcgccatgccgaagacctccctctgcttctacatcgtggagcgcgagcactgcaagagctgctccgaggaggacaccaagaagtgcgtgaacaccaagctggagcagccccagagcatcctgatcgagcacaagggcacgatcattgggaaacagaactccacgtgcaccgcgaaggccagctgctggctcgagagcgtcaaatccttcttctacggcctgaagaacatgctgagcggcatcttcgggaacgtgttcatgggcatcttcctcttcctcgcccccttcatcctgctgatcctcttcttcatgttcgggtggcggatcctgttctgcttcaagtgctgccgccgcacacggggcctgtttaagtaccgccacctcaaggacgacgaggagacggggtaccggcgcatcatcgagcggctgaacaacaagaagggcaagaacaagctgctcgacggcgagcgcctggccgatcggcgcatcgccgagctgttctccaccaagactcacattgggtga

SEQ ID NO: 15286 - RNA, 5055 nt, synthetic construct
  misc_feature 1..5055: note = derived and/or modified CDS sequence (opt11) from CCHFV(Zahedan 2007)__KC867273.1__GP
  source 1..5055: mol_type = other RNA
atgcacatcagcctgatgtacgctgtgttctgcctccagctgtgtggcctggggaagaccaacggcccccacaacgggaccgagcacaacaacacgcatgtcatgaccaccccagacgactcccagagccccgagccgcccgtgtccaccgcgctccccgtgacgcccgaccccagtaccgtcaccccatccaccccggcgagcggcctggaagggtccggcgaggtgcacacgagctcccccatcaccaccaaaggtctgtcactccccgaggccacctccgagccgccgtctacgacctccgtcgtcaccagctccgccagcgacacggactccagcacccaggccgccggggacacccccacccccaccgtgaggacgtccctgcccagcagcccgtccacccccagcacttcccaaggcacccattaccccgtcaggagcttgctctccgtaacggggcccaagccggaggagacccccacccccagcaagtcgggcaaagacaacctggcgaccaacagcccccatccggcgacgtcccgccccaccacccccagcaccatcgcccagaagcccacggaaaacaactcccacaacaccaccgagcagctggagagcctcacccatctggccacgcttggttccaagatctctccgacccagaccgtgctcccccagtccgtgaccagcatcgcgatccaggacatccacacctcccccacgaaccggtcgaagcgcaacctggacatggagatcatcctgaccctctcccagggcctgaagaagtactacggcaagatcctgaagctcctgcggctgaccctcgaggaggacactgaggggctcctggagtggtgcaagcgcaacctaggcctggactgcgacgacaccttcttccagaagaggatcgaagagttcttcatcaccggggagggtcacttcaacgaggtcctgcagttccgaaccctcggcaccctgagcaccaccgagagcacccacgccgggtccccgactgtggagcctttcaagagctacttcgccaagggcttcctgagcatcgacagcgggtacttctccgccaagtgctacagccggacctccaacagcggactccaactgatcaacgtgacccgccactctaccaggatcgccgacacccccggacccaagatcacgaacctgaagaccatcaactgcatcaacctcaaggcgagcgtcttcaaggagcaccgcgaggtggagatcaacgtgctgctgccgcaggtcgccgtgaacctctccaactgtcacgtggccatcaagagccacatctgcgactattcccttgacaccgacggcgccatccggctgccccagatccaccacgagggcaccttcatccccgggacgtacaagatcgtcatcgacaagaaaagcaagctcaacgaccgctgcaccctgttcaccaactgcgtgatcaagggccgggaggtgagaaaggggcagagcgtcctgcggcagtacaagaccgagatcagaatcggccgggccagcacggggtcgcgccggctcctgagcgaggagagcggcgacgactgcatctcccgcacccagctcctccgcactgagaccgcggaggtgcacggcgacaactacgggggccccggagacaagataactatctgcaacggcagcaccgtcgttgaccagagactggggtccgagctgggttgctacaccatcaaccgagtgcggagcttcaaattgtgcgagaactccgccaccggcaagtcatgcgagatcgactccataccggtcaagtgtaagcaggggttttgcctcaagataacgcaggagggccgcgggcatgtgaagctgagccggggctccgaggtggtcctggacgtgtgcgactcatcttgcgaggtgatgatccccaagggcaccggggacatcctcgtcgactgctcaggcgggcagcagcacttcctgaaggacaacctggtggacctcggctgccccaagattcccctgctggggaagatggccatctatatttgccgcatgtccaaccacccgaaaacaaccatggccttcctcttctggttcagctttggatacgtgatcacgtgcatcctgtgcaaggcgatcttcttcctgctcatcatcttcggcaccctgggaaagcgcttcaagcagtaccgcgagctgaagccccagacctgcaccatctgcgagaccacgccagtgaacgcgatcgacgccgagatgcacgacctaaactgctcctacaacatctgcccctactgcgcctcccgtctgacctccgacggtctggcccgccacgtgacccagtgcccgcggcgcaaggagaaggtggaggagaccgagctctacctgaacctggagcggatcccctgggtcgtgcgcaagctcctccaggtgagcgagtccacggggaccgtcctgaagagatcgagctggcttatcgtgctgctggtgctgttcactgtctcactgagccccgtgcagtccgcccccatcggccacgggaagactatcgagacgtaccgcgtgcgcgaggagtacaccagtatctgcctgttcgttctcggctccatcctattcatcgtgagctttctgatgaagggcctcgtggacggtgtcggaaacatcttcttcccggggctgtcggtgtgcaagacctgcagcatcggctccatcaacggtttcgagatcgagagccatcgctgctactgctccctgttctgctgcccctactgcagacactgcagcgcggacggcgagatccaccagctccacctgtccatctgcaagaagcgcaagaccggcagcaacgtcatgctggccgtctgcaagcgtatgtgcttccgggccacgatggaggtgtccaacaaggtgctgttcatccgtagcatcatcaacacaaccttcgtcgtgtgtatcctgatcctggccgtgtgcgtcgtttccaccagcgcggtggagatggagtccctccccgccgggacgtgggagcgggaagaggacctgaccaacttctgccaccaggagtgccaggttaccgagaccgagtgcctgtgcccttacgaggccctcgtgctgcgccggccgctgttcctggacagcatcgtgaaggacatgaagaacctgctgaactccacgtccctcgagaccagcctgtccatcgaagctccctggggcgccatcaacgtccagagcacctacaagcccaccgtgtccacggcgaacatcgcactgagctggtccagcgtggagcaccgcggcaacaaggtcctcgtgtccggccgcagcgaatccattatgaagctggaggagcgcaccgggatcagctgggacctgggcgtggaggacgcttccgagagcaagctcctcaccgtatccgtgatggacctgagccagatgtactccccggtgtttgagtacctcagcggcgaccggcaggttgaggagtggcccaaggcgacctgcacgggggactgccccgaacgctgcggctgcacctccagcacgtgcctgcataaggagtggccccacagccggaactggcgctgcaacccgacctggtgctggggtgtggggaccggctgcacgtgctgcgggcttgacgtcaaggacctcttcaccgactatatgttcgtgaagtggaaggtggagtacatcaagaccgaggccatcgtctgcgtggagctgacaagccaggagcggcagtgctcgctgatcgaggccggcacccgcttcaacctcggttccgtgacaatcaccctgtcagagccccggaatatccagcagaagctcccgcccgagataatcacattacaccccaaaatcgaggagggcttcttcgacctgatgcacgtccagaaggtgctgtctgccagcacggtatgtaagctccagtcctgcacacatggggtccccggagacctccaggtgtaccacatcggcaacctgctcaagggtgaccgcgtgaacggccacctgatccacaagatcgagcagcacttcaacaccagctggatgtcctgggacgggtgcgacctggactactactgcaacatgggggactggcccagctgtacgtacaccggggtcacccagcataaccacgcctccttcgtgaacctcctgaacatcgagacggactacaccaagacgttccacttccacagcaagcgggtgactgcccacggcgacacgccccagctggacctcaaggcccgcccgacctacggcgccggtgagatcaccgtcctggtggaggtggcagacatggagctgcacaccaagaagatcgagatctccggcctcaagttcgccgggctgacgtgcaccggctgctacgcctgcagctccgggattagctgcaaggttcggatccacgtggacgagcccgacgagctgacggtgcacgtcaagtctgacgaccccgacgtggtggcggcctcttccagcctcatggcccgcaagctggagttcggtaccgacagcaccttcaaggccttctccgccatgccaaagaccagcctgtgcttctacatcgtcgaacgggagtattgcaagtcctgctcgaaggaggacacgcaaaagtgcgtgaacaccaaactagagcagccacagtccatcctgatcgagcacaagggcaccatcatcgggaagcagaacaacacgtgcaccgcgaaggcctcttgctggctggagtccgtcaagagcttcttctacggcctcaagaacatgctcgggggcatcttcggcaacgtctttatcgggatcttcaccttcctgacccccttcattctgctgatcttcttcttcatgttcggctggcgcatcctgttctgcttcaagtgctgcagacggacccggggactattcaagtaccggcacttaaaggacgacgaggagacgggctaccgcaagattatcgagcggctgaacaataagaagggcaagaaccgcctgctcgacggagagcggctggccgaccgcaagatcgccgagctgttttccacaaagacccacatcggctaa

SEQ ID NO: 15287 - RNA, 5055 nt, synthetic construct
  misc_feature 1..5055: note = derived and/or modified CDS sequence (opt11) from CCHFV(Afg09-2990)__HM452306.1__GP
  source 1..5055: mol_type = other RNA
atgcatatcagcctaatgtatgcggtgttctgcctccagctttgcgggcttgggaagactaatggcccccacaacgggaccgagcataacaacacgcacgtcatgactaccccggacgatagccagagccccgagccgcccgtgtccacggccctccccgtgacgcccgacccctccaccgttaccccttccaccccggcgagcggcctggaggggtccggcgaggtttatactagctcccccatcaccaccaagggcctgagcctccccgaggccacctccgagcccccggccacgacgagcgtggtcaccagtagcgcctccgacaccgactcctccacgcaggccgccggggacacccctacccccaccgtgcgcactagcctgccgtccagccccagcaccccctccacttcccaggggacccactaccccgtgcggtcattactcagcgtcacgtcccccaagcctgaggaaacccctacccccagcaagtccggtaaggacaacctggcaaccaacagccctcacccggccacgtcccgcccaaccacgcccccgaccaccgcacagaaaccgacagagaacaacagccataacaccaccgaacagctggagtccctcacgcacctggcgaccctggggagcatgatctcccccacccagaccgtgctcccccagtcggtgacctccatagcaatccaggatatccacaactccccgacgaaccggagcaagcgcaacttggacatggaaatcatcctcaccctcagccaggggctgaagaaatactacggcaaaatcctgaagctcctgcacttgactctcgaggaggacaccgagggcctgcttgagtggtgcaagcggaacctcgggctagattgcgacgacacgttcttccagaagcgcatcgaggaatttttcatcaccggcgaagggcacttcaacgaggtcttgcagtttcgaaccctcggcaccctgtccacgaccgaaagcacacacgcgggaagccccaccgtggagcccttcaagtcctacttcgccaaagggtttctgagcatcgactcgggctacttctctgccaaatgctactcccgcacgtcgaactccgggctccagctgatcaacgtgacccggcatagcacacgcatagcggacacccccggcccaaagatcacgaacctgaagaccatcaactgcatgaacctcaaggcctccgtcttcaaggagcatcgggaggtggagatcaacgtgctgcttccccaggtcgccgtgaatctcagcaactgtcacgtggccatcaagtcccacatctgcgactacagcctggacactgacggagccatccgcctaccacagatacaccacgagggcaccttcatccctggcacgtataagatcgtcatcgataagaaatccaagctcaacgaccggtgcaccctgttcaccaactgcgtgataaaggggcgcgaggtcagaaagggtcagtctgtcctgcgacaatacaagactgagatccggatcgggcgagcgtccgccggctcgcggcgcctcctgtccgaggagagcggcgacgactgtattagccggacgcagctgctccgcactgagaccgccgaggtgcacggcgacaactacggcgggccgggggataagattactatctgtaacgggagtacggtcgtggaccagcgcctggggagcgagctggggtgttacaccattaaccgggtgcgctccttcaaactctgtgagaacagcgccaccggcaagtcctgcgagatagatagcatcccggtcaagtgcaagcagggatattgcctcaagatcacccaggagggccgtggccacgtgaagttgagccgcgggtccgaggtcgtcctggacgtgtgcgactccagctgcgaagtgatgatccccaaggggacgggcgacattctcgtcgactgctccggcggccagcagcactacctgaaagacaacctggtggacctcgggtgccccaagatcccgctgctgggcaagatggccatctacatctgccggatgtccaaccaccctaagacaacaatggctttcctcttctggttctcctttggatacgtcattacctgcatcctctgcaaggccatctttttcctgctaatcattttcggcacgctgggtaagcgcttcaagcagtaccgggagctgaagccccagacatgcactatttgcgagacaacccccgtcaatgccatcgacgccgagatgcacgacctcaactgcagctacaacatttgcccgtactgcgcctcccgcttaaccagcgacgggctggcccggcatgtgacccaatgcccccgccggaaggagaaggtggaggagaccgagctctacctgaacctggaacgcatcccctgggtcgtgcgaaaactcctgcaggtctccgagagcaccggcacggtactgaaacgctccagctggctcatcgtgctgctggtccttttcaccgtcagcttgtcacccgtgcaaagtgccccgatcgggcacggcaagaccatcgagacctaccgggtgcgtgaggagtacacgtccatctgcctgttcgtcctcggcagcatccttttcatagtgtcgttcctgatgaagggcctcgtggatggcgtcggtaacatcttctttcccggcctgagcgtttgcaagacctgctccatcgggagcatcaacggcttcgagatcgagtcccacaagtgctactgctcgctgttctgctgcccctactgcagacattgctccgccgacggtgagatccaccagctccacctgagcatctgcaagaagaggaaaaccggaagcaacgtgatgctggccgtatgtaaacgaatgtgcttcagggcgacaatggaggtgtcgaacaaagccctattcatccggtccatcatcaacacgaccttcgtggtctgcatactgattctggccgtgtgtgtggtgagcacctccgccgtggagatggagagcctccccgccggcacctgggagcgggaggaggacctaacgaatttctgccaccaggagtgccaggtgacagagaccgagtgcctgtgcccgtacgaagcgttagtcctgcgcagacccctgttcctagactccattgtaaaggggatgaagaacctgctgaacagcaccagcctcgagacttccctgagcatcgaggccccctggggagccataaacgtgcaatccacctacaagccgaccgtcagcacggcgaacatcgccctcagctggagctccgtcgagcaccgagggaacaaggtgctcgtcagcggccggtccgagagcatcatgaagctggaggagcgcacgggaatcagttgggacctcggcgtggaagatgctagcgaatccaagctccttaccgtgagcgtcatggacctgtcccagatgtactcgcccgtgttcgagtacctcagcggcgaccggcaagtggaggaatggccgaaggctacctgcaccggggactgccccgagagatgcggctgcacgagctctacctgcctacataaggagtggccgcacagccggaactggcgctgtaaccccacttggtgttggggcgtcgggaccggctgcacgtgctgcgggctggacgtaaaggacctcttcacagactacatgttcgtcaagtggaaggtggagtacatcaagacggaggccatcgtctgcgtcgagctgaccagccaggagcggcagtgctccctgatcgaggccggcacgcgcttcaacctaggaagcgtgacaatcactctgtccgagccgcggaatatacagcagaaactgccaccggagatcatcaccctccacccgaagatcgaagagggcttcttcgacctgatgcatgtccagaaggtcctgtctgcctccacggtctgcaagctccagagctgcacgcatggggtgcccggcgatctgcaggtctaccacatcggcaacctgctcaagggggacagggtgaacggccatctgatccataaaatagagcagcacttcaacaccagttggatgtcatgggacgggtgcgacctggactactactgcaacatgggcgactggccatcctgcacctacaccggtgtaacgcaacacaaccacgcgagctttgtcaacctgctgaacatagaaacagactacaccaaaactttccacttccactccaagcgggtgaccgcccacggtgacaccccgcagctggacctcaaggcacgccccacctacggcgccggggagatcaccgtgctcgtcgaggtggcggacatggagctacacacgaagaagatagagatcagcggcctcaaattcgccggcctgacctgcaccggctgctacgcctgctccagcgggatcagttgcaaggtgcggatccacgtcgatgagcccgacgagttaacggtgcatgttaagagcgatgaccccgacgtggtggccgcctccagctccctcatggcgcggaagctggagttcggcacggatagcaccttcaaggcctttagcgccatgccgaagacctccttatgcttctacatcgtggagcgggagtattgcaagagctgcagtaaggaggacacccagaagtgcgtcaacacgaagctcgagcagccgcagagcatcctgatcgagcacaagggcaccattatcggaaagcaaaacaatacctgcaccgccaaggcctcctgctggctggagagcgttaagtccttcttctacggcctcaagaacatgcttgggggaatcttcggcaacgtgttcatcgggatcttcacgttcctgacccccttcatcctgctcattctgttctttatgtttggctggaggatcctgttctgctttaagtgctgccggcggacacgcggcctcttcaaatacaggcacctgaaggacgatgaggaaaccgggtaccgcaagatcatcgagcggctgaacaacaagaaggggaagaaccgcctcctggacggggagcggttggctgatcgcaaaatcgccgagctattcagcacgaagacgcacatcggctga

SEQ ID NO: 15288 - RNA, 5055 nt, synthetic construct
  misc_feature 1..5055: note = derived and/or modified CDS sequence (opt11) from CCHFV(SPU41/84)__AY900142.1__GP
  source 1..5055: mol_type = other RNA
atgcacatctcactgatgtacgcggtgctgtgcctgcagctgtgcggactaggcgagacccacggcagccacaacgggacccggtacaacaataccgacgcgacaacgacgcccggcgactctcagagccccgagccgcccgtgagcaccgcgtccagcatcacccacaacccgtccaccgtgaccagcaccacccccacctccgggagcgaaggctccggcgaggtttatactagctcccccatcacgaccgaaggactgtccccacccgggaccacgcccgaactgcccgcaacgaccgggatcgacacctccggcgccagcgacgcgaacccgtccacccaggccgcgcgggggactagcgccttaactgtgcatacctcccttcccagcagcccgtccaccccgccaatcagccaggacacgcaccaccccgtgcgcaacctgctctccgtgaccagccccatgcccgaggagacgaccgcgccatccggcagtggcaaggagtccagcgccacgtccagcccccaccccgcgtcggaccggccgcccacgccacccgccaccgcccaggggctgaccgagagcaactcccataatgccacggagcacctggagagcctcacccaatccgccacccccggcctggtcactagccccgcgcaaacggtgcacccccactctgcaacatctatagctgcccccgacacacatcccaaccccaccaatcgctccaagagaaacctggaaatggagatcatccttactctgagccaggggctgaagaagtactacggcaagatcttacgtttgctgcacctcaccctggaggaggacaccgagggcctgctcgagtggtgcaaaaggaatctgggcctggactgcgacgacaccttcttccagaaacgcatcgaggagttcttcatcacaggcgaggggcacttcaacgaggtcctccagttccggacaccgggcacagtctccacgaccgagtcaacccacgctgggccgcccaccgccgagcccttcaagagctacttcgctaaggggtccctgagcatcgactccggctactacagcgcaaagtgctactccgggactagcaactccggcctgcagctcatcaacatcacgcgccacagcacgaagatcgccgacacccccggacccaaaatcacgaacctgaagaccatcaactgcatcaacctaaaggccctcactttcaaggagcaccgggaggtggagatcaacgtgctgctgccccaggtcgcggtgaacctctcgaactgccacgtggtgatcaagtctcacgtgtgcgactactccctggacatcgacggaaccgttcgcctgccccacatccaccacgagggcatcttcatcccgggtacctacaagatagtaatcgacaagaagaacaagatgaacgaccggtgcaccctcttcacgaactgcgtgatcaagggccgcgaggtgcgcaagggccagagcgtcctgaagcagtacaagaccgagatccgaatcggcaaggcctccaccgggagccggcgcctgctctccgaggagtcaagcgatgactgcatctcccggacccagctcctgcgcaccgagaccgccgagatccacggcgacaactacgggggccccggcgataagatcaccatctgcaacgggagcaccgtggtggaccagcggctcggctcggaactggggtgctacactataaatcgagtcaagaccttcaaactgtgcgagaacagcgctactggcaagtcttgcgagattgacagcgtgcccgtcaagtgccgacagggctactgcctcaaaatcacccaggaagggcggggccacgtcaaactgtcacgcggaagcgaggtggtcctggacgcctgcgacacgtcctgcgaagtgatgatccccaagggcaccggggacatcctggtggactgctcaggcggccagcagcactttttaaaggacaacctgatcgacctggggtgccctaagatccccctcttggggaagatggccatttacatctgccgcatgtcgaatcaccccaagaccaccatggccttcttattttggttcagcttcgggtacgtcatcacgtgcatcatctgcaaagtgattttctacctgcttataatcgttggcaccctggggaagcgcttcaagcagtaccgggagctcaagccccagacctgcaccatctgtgaaactacgccggtcaatgccatcgatgctgaaatgcacgacttgaactgctcctacaacatctgcccctattgcgcgagccgcctgacctccgacggcttggctcggcacgtgacccagtgccccaagcgcaaggagaaggtggaggagacagagctgtacctgaacctcgagcggatcccatgggtagtgcgaaagctgctccaggtgagcgagtccacaggcgtcgccctgaagagaagctcatggttggtggtactgctcgtcctgttaaccgttagcttatcgcccgtccaatccgcccccatcagccatggaaagaccgtcgaggcctaccgcgcgcgggagggctacacctcgatgtgcctgttcgtactgggaagcgtcctattcctcgtctcgtgcctgatgaagggcctcgtggacagcgtggggaacacattcttccccggcctgtccatctgcaagacctgcagcatctccagcatcaacggcttcgagatcgaaagtcacaggtgctactgcagcctgttctgctgcccctattgccgtcactgcagcgccaataaggagatccaccagttacacctgagcatttgcaagaagagaaaggccggctcgaacgtcatgctggccgtatgcaaacggatgtgcttccgcgccactatggaggtgagcaacagagccctctttatccgctccatcataaacaccacattcgtcctgtgcatcttaatcctcgccgcctgcgtggtgtcgacctccgccgtggaaatggagagcctgcctgccggaacctgggaacgcgaagaggacttaactaacttctgtcatcaggagtgccaggtggcggacacagaatgcctctgcccttacgaggcgctggttctccggcgacccctcttcctggacagcattgtgaaggggatgaagaacctactcaactccacttcgctcgagacctctctgagcatcgaggccccgtggggagccatcaacgtacagtccacctacaagcccacggtgagtactgcgaacatcgccctttcctggagctccgtcgagcatagaggtaacaagatcctggtgagcggccgcagtgaaagcatcatgaagctggaggagcggaccggcatcagttgggacctcggagttgaagacgctagtgagtccaagctgctcaccgtcagcgtgatggacctctcccagatgtattcacccgtgttcgagtacctgtccggcgaccgtcaggtcgaggagtggcccaaggccacgtgcactggggactgcccagagcggtgcggttgcaccagctccacgtgcctccacaaggaatggccccactccaggaactggcggtgcaaccccacctggtgctggggcgtggggactggctgcacgtgctgcgggctcgacgttaaggacctgttcaccgattatatgttcgtcaaatggaaggtcgagtacatcaagacggaagccatcgtatgcgtcgagctgacgagccaggagcgccagtgctccctcatcgaggcgggcacccggtttaacctggggcccgtgaccatcacgctgtcagagccgcgcaacatccagcagaaacttccacccgaaatcatcacgctgcacccccgaatcgaggagggcttcttcgatctgatgcatgtccagaaggtgctctccgcgagcaccgtgtgcaagctgcagtcctgcacccacggcgtcccgggagacctccaggtgtaccacatcggaaacctcctgaagggggacaaggtgaacggccatctggtccacaagatcgagccccacttcaacacctcatggatgtcctgggacgggtgtgacctcgactactattgcaatatgggcgactggcccagctgcacgtacaccggcgtcacccagcataaccatgcctcctttgttaacatgctgaacattgagaccgactacacgaagaacttccactttcacagcaagcgtgtaacagcccacggggacaccccgcagctggatctcaaggcccgaccgacctacggcgcgggtgagatcaccgtgctggtggaggtcgcagacatggagttacacaccaagaaaatcgagatttccggactgaagttcacaagtctgacctgtacggggtgctacgcctgttccagcggaatctcctgcaaggtgcggatccacgtggacgaacctgacgagctgaccgtccacgttaagtcggaagacccggacgtggtcgccgcctcgagcagcctgatggcgcggaagctggagtttggcaccgactccaccttcaaggccttcagcgccatgcccaaaacgtccctgtgcttctatattgtggagcgtgagtactgcaagagctgcagcgaggaggacacccagaagtgcgtgaacaccaagctcgagcagccacaaagcattttgatcgagcggaagggaaccattatcggcaagcagaacaacacgtgtaaggcaaaggccgggtgctggctggagtccgtcaagagcttcttctacggcctcaaaaacatgctctccggcatcttcgggaatgtctttatcgggatattcctgtttttagcccccttcatcctactaatcctgttcttcatgttcgggtggcgcatcctcttctgcttcaaatgctgccggcgcactcgcggcctattcaagtaccggcacctgaaggacgacgaagagaccgggtatcgcaaaatcattgagcggttaaacaacaagaaaggcaaaaacaagctgctcgacggagagcgcctcgcggatcgccgcatagccgagctgtttagcaccaaaacgcacatcgggtaa

SEQ ID NO: 15289 - RNA, 5055 nt, synthetic construct
  misc_feature 1..5055: note = derived and/or modified CDS sequence (opt11) from CCHFV(SPU103/87)__DQ211634.1__GP
  source 1..5055: mol_type = other RNA
atgcacatcagcctcatgtacgccgtgctctgcctgcagctgtgcggcctcgggggcgcccatgggtcccacaacggcacccgctacaacaacaccggggcgctcacgacactgggcgacggccagtcctccgagcctccggtctcaaccgccccctccaccacgcataaccctagcacagtgacttcgaccacgcccgccagcgggtccgagggcagcggggaggtgtataccgcctcgccagtgaccaccgagggcctctctccgcccgggacgacccccgagctgcccgccaccaccggcatcgacacgtcaggtgcatccgacgccgacccctctacccaggcagccggggacacatccgcgctgaccgtgcggacctccctcccaagctcccccagcaccctgccgaccagccaggatacacaccaccccgttcgcaacctgctctccgtcacctcgccccggcccgaggaaacaacagccccgtccggctcagggatcgagtccagcgccacctccagcccacacccggcctccgaccgtcccccgacgccgcccgcagcggcccagggccccaccgagagcaactcccacaacgccaccgagcacctggagtctctgacccagagtgccacgcccgacctcgtgaccagtcccgcccagacagtgcacccccagtccgcgaccagcatcgccgcccccgacacgcatccttcccccaccaaccgcagcaaacgcaacctggaagtcgagatcatactgaccctctcccagggcctgaagaaatattacgggaagatcctgcgccttctgcacttgaccctcgaggaggacaccgaaggcctgctggagtggtgcaagaggaacctcgggctggactgtgatgacacgttcttccagaagcgtatagaggagttcttcatcaccggcgaggggcacttcaacgaggtgctgcagttccgcaccccaggcaccgtgagcacgaccgaaagcacccacgcgggcccgcccaccgccgaacccttcaaaagctacttcgcgaagggcttcctaagcatcgactccggatactacagcgccaagtgctactccgggacgtcaaacagtggcctgcagctgattaacataactagacacagcacccgcatcgccgacacccccgggcccaagatcacgaacttaaagaccattaactgcatcaacctgaaggcccttaccttcaaggagcacagagaagttgagataaacgttctccttccccaagtggccgtaaacttatccaactgccacgtggtgatcaagagccatgtctgcgactactccctcgacatcgacgggaccgtacgcctgcctcacatccaccacgagggcatcttcatccccgggacgtacaagatcgtcatcgacaagaagaacaaacttaacgaccggtgcaccctcttcaccgactgcgtcatcaagggcagggaggtgcggaaggggcaaagcgttctcaagcagtacaagaccgagatccggattggcaaggcgtccacggggagccggcgcctgctctccgaagagtcgtccgacgattgcatcagccggacccagttgctgcgcaccgagaccgccgagattcacggcgacaactacggcgggccgggcgacaagatcacgatctgcaacgggagcaccatcgtcgaccaacgcctcggctccgagctgggctgttacaccatcaaccgcgtgaagaccttcaagctgtgtgagaatagcgccacgggaaagtcctgtgagatcgacagcgtccctgtgaagtgcaggcagggctactgcctgaagatcactcaagaggggcggggccacgtgaagctatcccgcgggagcgaggtcgtgctggacgcctgcgacacctcctgcgaggtgatgatccccaagggaaccggcgatatcctggtggactgtagcgggggccagcagcatttcctcaaggacaacctgatcgacctgggttgccccaagatccccctcctaggcaagatggcaatctatatctgtcggatgtccaaccaccccaagacgaccatggcctttctgttctggttcagcttcgggtacgtgattacgtgcgtgctctgcaaggccatcttctacctgctgatcatcgttggcaccctcggcaaacgcctgaagcaataccgggaactgaagccgcagacgtgcaccatctgcgaaaccacccccgtgaacgccatcgacgctgagatgcacgacctcaactgctcctacaacatctgcccgtactgcgcgagccgcctgacctccgacgggctagcgcggcacgtgacgcagtgccccaagcgcaaggagaaggtcgaagagaccgaactctatctgaacctggagcggatcccctgggtggtgcgccggctcctgcaggtcagcgaatccacgggcgttgccctgaagcggagctcctggcttatcgttctgctggtcctcttcaccgtgagcctgtcccccgtgcagagtgcaccgatcagccacggcaaaacggtcgaggcctaccaggcgcgcgagggttacaccggtatgtgcctgttcgtgctaggcagcatcctgttcctggtgagctgcttgatgaaaggcctggtcgactccgtggggaacaccttcttccccggactgagcatctgtaagacttgctccatcagctccatcaacgggttcgagatcgagtcgcatcgctgctattgctcccttttctgctgcccctactgccggcactgcagcgccaacaaggagatccatcagctgcacctttcaatctgcaagaagagaaagacgggcagcaacgtaatgctcgccgtctgcaagcggatgtgtttccgtgccaccatggaggtgtccaaccgcgccctgttcatccggagtatcataaacaccaccttcgtgctgtgcatcttaatcctggcggtctgtgtggtgtcgacgagcgccgtcgagatggagtccctgcccgccgggacctgggagcgcgaagaggatctcaccaacttttgtcaccaggagtgccaggtgaccgacacggagtgcctgtgtccgtacgaggccctggtgctacggcgccccctgttcctggacaacatcgttaaaggcatgaagaacctcctgaacagcacgtccctggaaaccagcctcagcatcgaagcgccctggggcgccatcaacgtgcagtccacatacaaaccgacggtgtcaaccgccaacatcgctctgagctggagctccgtcgagcaccgggggaataagatcctggtgagcggccgctccgagagcatcatgaagctcgaggagcggaccgggatttcctgggacctgggcgtagaggacgctagcgagtccaagctgctcaccgtcagcgtgatggacctatcccagatgtacagccccgtgttcgaatacctgtccggcgaccgccaggtcgaggagtggccgaaggcaacgtgcaccggggactgccccgagcggtgcggctgcacctcttccacgtgtctacacaaagaatggccgcactctcgcaactggcggtgcaaccccacctggtgctggggcgtggggaccgggtgcacgtgctgcgggctggacgttaaggacctgttcaccgactacatgttcgtcaagtggaagatcgagtacatcaaaaccgaagccatagtgtgtgtggagctcaccagccaagagcgccagtgcagccttatcgaggctggcaccagattcaatctggggcccgtcaccatcacgctcagcgagccccgcaacatacagcagaaactgccgtccgagatcatcaccctgcacccccggatcgaggaggggttctttgacctcatgcacgtgcagaaggtcctgtcagcctccaccgtgtgtaagctgcagagctgtacccacggggtgcccggtgacctccaggtctaccacatcggtaacctgctgaagggggacaaggtgaacggccacctcgtgcacaagatcgagccgcactttaacacatcctggatgtcatgggatgggtgcgacctggactactactgcaacatgggcgactggccgagttgcacgtacaccggggtcacccagcacaaccacgcctcattcgtgaacctactcaacatcgagaccgactacacgaagaacttccatttccactccaagcgcgtgaccgcgcacggcgatacgccccagctggacctgaaggcccggcccacctacggtgccggcgagatcaccgtcctcgtggaagtggccgacatggagctgcacaccaagaagatcgagatcagcggcctgaagttcacctccctgacctgcacggggtgctacgcctgctcgtccggcatcagctgcaaggtccggatccatgtggacgagcccgacgagttaaccgtgcacgtcaagtccgacgaccccgacgtggtggcggcctcgtccagcctgatggcccggaagctagagtttgggaccgactcaactttcaaggccttctccgcgatgcccaagacgagcctgtgcttctacatcgtcgagcgcgagtattgcaaatcctgtagtgaggaagacactcagaagtgcgtgaacaccaagctggagcagccccagtccatcctcatcgaacacaagggcaccatcattggcaaacagaacaatacttgcaaagcccgagccgggtgctggctcgagagcgtgaagtccttcttctacggcctgaagaacatgctgagcgggatattcggcaacgttttcatcgggatatttctcttcctggccccgtttatcctgctaatcctgtttttcatgtttggctggcgcatcttattctgcttcaagtgctgccgccggacccgcggccttttcaaataccggcaccttaaggacgacgaggagaccgggtaccgcaagattatcgagcggctgaacaacaagaagggcaagaacaagctccttgacggggagcgccttgccgaccgccgtatcgcggagcttttctccaccaagacgcacatcggatga

SEQ ID NO: 15290 - RNA, 5055 nt, synthetic construct
  misc_feature 1..5055: note = derived and/or modified CDS sequence (opt11) from CCHFV(Iran-53)__DQ446216.1__GP
  source 1..5055: mol_type = other RNA
atgcacatcagtctgatgtacgccgtgttctgtctccagctgtgcggcctggggaagaccaacggcccccacaacgggaccgagcacaacaacacgcacgtcatgaccaccccggacgactcccagagccccgagccgccagtgagcaccgccctccccgtgacgcccgatcccagcaccgtcaccccctccaccccggcgagcggtctggagggaagcggcgaggtgtacacgagctcccccatcaccaccaaggggctatctctccccgaggctacctccgagcccccggccacgaccagcgtggtcacctccagcgcctccgacaccgacagctccacacaggccgccgggggcacccccacccccaccgttcggacgtctctgccctccagcccaagcaccccctccaccagccaggggacccactaccccgtgcggtccctgctcagcgtcacgtcccccaagccggaggagacccccaccccctccaagtccggcaaggacaatctggccaccaacagcccccacccggccacgtcccgccccaccgccccgcccaccaccgcccagaagcccacggagaacaactcccacaacaccaccgagcagctggagtccctcacccacctggccacgctggggtcgatgatctcccccacccagacagtgctcccccagtctgtgacctccatcgccatccaagacatccacacaagcccgacgaatcggtccaagcgcaacctggacgtcgagatcatcctgaccctctcccagggcctgaagaagtactacggcaagatcttgaagttactgcacctgactctcgaggaggacaccgagggcctgctggagtggtgcaagcggaatctcggcctggactgcgacgatacgttcttccagaagcgcatcgaggagttcttcatcaccggggaaggccacttcaacgaggtgttacagttccgcaccctcggcaccctgtccacgaccgagagcacccacgccgggagccccaccgtggagcccttcaagagttacttcgccaagggcttcctgagcatcgactccgggtacttcagcgcgaaatgctactcccgcacgagcaactccggcctccagttgatcaacgtgaccagacacagcacccgcatcgccgacacccccgggccgaagatcacgaacctgaaaaccatcaactgcatcaacctcaaggcctccgttttcaaggagcaccgggaggtggagatcaacgtgctgctgccccaggtggcagtgaacctcagcaactgtcacgtcgccatcaagtcccacatctgcgactacagcttggacaccgacggcgcgatccgcctgccccagatccaccacgagggcaccttcatccccgggacgtacaagatcgtgatagacaagaagtccaagctcaacgaccggtgcaccctcttcaccaactgcgtgatcaaggggcgcgaggtccggaaggggcaaagcgtgctgcgccaatacaagaccgagatccgcatcggccgcgcctccacggggagccggaggctcttatccgaggagagcggcgatgactgcatcagccggacccaacttctccgcaccgagaccgccgaggtccacggcgacaactacgggggccctggggacaagatcacgatctgtaacggctccaccgtggtggaccagcgcctggggagcgagctgggctgctacaccatcaaccgggtccgctcattcaagctgtgcgagaactctgccaccggcaagtcctgcgagatcgacagcatacccgtgaagtgcaagcaggggtactgcctcaagatcacgcaggagggcagagggcacgtgaagctgtcccgcggcagcgaggtagtgctggacgtctgcgactccagctgcgaggtcatgatccccaagggcaccggggacatcctcgtggactgctccggcgggcagcagcacttcctgaaggataatctggtggacctcgggtgccccaagatcccgctgctggggaagatggccatctacatctgccggatgagcaaccaccccaagaccactatggcgttcctcttttggttctccttcggctacgtcatcacgtgcatcctgtgcaaggccatcttcttcctgctcatcatctttggcaccctggggaagcgcttcaagcagtaccgggagctgaaaccccagacctgcaccatctgcgagaccacgcccgtgaacgccatcgacgccgagatgcacgacctcaactgcagctacaacatctgcccgtactgcgcctcccgcctgactagcgacggcctggcgcggcacgtgacacagtgcccccgccggaaggagaaggtcgaggagaccgaactctacctgaacctggagcgcatcccctgggtggtgcggaagctcctgcaggtctccgagagcacgggaactgtgctgaagcgatccagctggctcatcgtgctactcgtcctcttcaccgtgagcctgtcccccgtgcagagcgcccctatcggccacgggaaaaccatcgaaacctatcgggtccgcgaagagtacacctccatctgcctgttcgtgctcggcagcatcctgttcatcgtgtccttcctgatgaagggcctcgtcgacggggttggcaacatcttctttcccgggctgagcgtgtgcaagacctgctccatcggcagcatcaacgggttcgagatcgaatcacacaagtgttactgcagcttgttctgctgcccctactgccggcattgctccgccgatggcgagatccaccagctccacctgtcaatatgcaagaagcgcaagaccggctccaacgtcatgctggccgtgtgcaagcggatgtgcttcagggcgacgatggaggtgtcgaataaggccctcttcatccgctccatcattaacaccaccttcgtcgtgtgtatcctgatcctggccgtgtgcgtcgtcagcacctccgccgtggagatggaaagcctcccggccgggacgtgggagcgggaggaggacctgaccaacttttgccaccaggaatgccaggtcacggagaccgaatgcctgtgcccatacgaggcgctcgttctgcgacggcccctgttcctcgactccattgtgaagggcatgaagaacctgctgaactctacgtctctggagacatccctgagcatcgaggccccttggggcgccattaacgtccagtccacctacaagccgaccgtgagcacggccaacatcgccctgtcctggagctccgtggaacaccgcgggaacaaggtcctcgtgagtgggcggtccgagagcatcatgaagctggaggagcgcacaggcatctcctgggacctgggcgtggaggacgcgagcgagtccaagttgctgacagtcagcgtgatggacctgtctcagatgtactcacccgtgttcgagtacctctccggtgaccggcaagtcgaggagtggcccaaggcgacatgcacgggcgactgccccgaacgatgtggttgcaccagcagcacgtgcctgcacaaggagtggccgcacagccggaactggcgctgcaaccccacctggtgttggggcgtgggtaccgggtgtacgtgctgcggcctggacgtcaaggacctctttaccgactacatgttcgtgaagtggaaggtggagtacataaagaccgaggccatcgtctgtgtggagctgaccagccaggagcggcaatgcagtctgatcgaggccgggacccgcttcaacctcggcagcgtgaccatcaccctgtccgaaccccggaacatacagcagaagctgcccccggagatcatcaccctccaccccaagattgaggaagggtttttcgacctgatgcacgtccagaaggtgctgagcgcatccacggtgtgcaagctccagagctgcacacacggcgtccccggcgacctccaggtgtaccacatcgggaacctgctcaagggcgaccgcgtgaacgggcacctgatccacaagatcgagcagcacttcaacacctcctggatgagctgggacggctgcgacctggactactactgtaacatgggggattggccctcgtgcacctacacgggcgtaacccagcacaaccacgcgagcttcgtgaacctcctgaacatcgagaccgactacaccaaaactttccacttccactccaagcgggtgaccgcccacggcgacaccccgcagctggacctcaaggcccgccccacctacggggccggcgaggtcacggtgctggtggaggtcgctgacatggagctgcacaccaagaagatcgagatctccgggctcaagttcgcgggcctgacctgcaccgggtgctacgcatgctcgagcggcatcagctgcaaggtgcggatccacgtggatgagcccgacgagctgacggtccacgtcaagagcgacgaccccgatgtggtggccgcctccagctccctcatggcgcgcaagctggagttcggcaccgacagcaccttcaaggcattcagcgccatgccaaagacctccctgtgcttctacatcgtggagcgggagtactgcaagagctgctccaaggaggacacgcagaagtgcgtgaacaccaagctcgagcagccccagtccatcctgatcgagcacaaggggaccatcataggcaagcagaacaacacgtgcaccgcaaaggccagctgctggctggagagcgtcaagtccttcttctacgggttgaaaaacatgttaggcgggatcttcgggaacgtgttcataggcatcttcaccttcctgaccccctttatcttactcatcttattcttcatgttcggttggcgcatcttattctgcttcaagtgctgccggcgcacccgcggcctcttcaagtaccggcacctaaaggacgatgaggagacgggataccgcaagatcatcgagcggctgaacaacaagaagggcaagaaccgcctcctggacggcgagcggctggcggaccgcaaaatcgccgagctgttcagcaccaagacccacatcgggtga

SEQ ID NO: 15291 - RNA, 5055 nt, synthetic construct
  misc_feature 1..5055: note = derived and/or modified CDS sequence (opt11) from CCHFV(Iran-52)__DQ446215.1__GP
  source 1..5055: mol_type = other RNA
atgcacatcagcctgatgtacgccgtgttctgcctccagctgtgtggcctgggtaaaaccaacggcccacacaacgggaccgagcacaacaacacgcacgttatgactaccccggatgactcacagagccccgagccgccagtttccactgccctccccgtcactcccgaccccagcacagtcaccccatctacccccgcgtcgggcctggaggggtccggcgaggtgtatacgagctcccccatcaccaccaaaggcctgagcctgcccgaggccacctcagagccgccggcaacgaccagcgtggttacctccagcgcctccgacactgacagctccacgcaagccgcgggcgacacccccaccccaaccgtgcgcacgagcctgccatcctcaccgtccacgccatccaccagccaggggacccactaccccgtgcggagtctgctcagcgtcacgtcccctaagccggaggagacgcccaccccgagcaaatcgggaaaagacgacctcgctacaaacagcccgcatccggccacgagtcgccccacaaccccacccaccacggcacagaagccaaccgaaaacaacagccacaacaccaccgagcagctagagtccctcacgcacctggcgaccctgggcctcatgatcagccccacgcagaccgtgctgcctcagtctgtgacctccatcgcaatccaggacatccacaactccccgacaaaccgatctaagcgtaacctggacatggagataatactcaccctgtcccaggggttaaagaagtactacggcaaaatcctcaagctgctgcacctcaccctggaggaagacaccgagggcctgctcgagtggtgcaaacggaatctggggctagactgcgacgacacgttctttcagaagcggatcgaagagttctttattaccggagagggtcatttcaatgaggtgctccaatttcggaccctgggtaccctgtccacgaccgagtctacccacgccggaagccccaccgtggagcccttcaagtcctatttcgccaaggggttcctcagcatcgacagtggatatttctccgctaagtgctatagccgcacgagtaacagcggcctccaattgatcaacgttacccgacactccacccgcatcgcggacactcccggcccgaagatcacgaacctcaagaccatcaactgcatgaacctgaaagccagtgtcttcaaagagcaccgggaggtggagatcaacgtgctgctcccgcaggtcgccgtgaatctttccaactgtcatgtggccatcaaaagccacatttgcgactactccctggacacggacggtgcgatccgactcccccagatccaccacgagggcacatttatccccggcacctataagatcgtcatcgacaagaagtccaagctgaacgaccggtgcaccctgttcaccaattgcgtgatcaaggggcgcgaggtgcggaaggggcagagcgtcctccgccagtacaagaccgagatccggatcgggcgcgctagcacgggctcccgacggttactgagcgaggagtccggggacgattgcatctcccggacccagctcctgcgcaccgagaccgccgaagtgcacggcgacaactatggcggcccgggcgacaagatcacaatctgcaacggtagcaccgtagtggaccagcgcctgggctccgagctggggtgctacaccattaaccgggtgcgcagcttcaagctctgcgagaactctgcaaccggcaagtcttgcgagattgattccatacccgtcaagtgcaaacaaggctactgcctgaagatcacgcaggaagggcggggacacgtaaagctgagcagagggtccgaggtcgttctcgacgtgtgcgatagctcctgcgaggtcatgatccccaagggcaccggggatatccttgtcgactgcagcgggggccagcagcactttcttaaggacaatttagtggacttaggttgccccaaaatccctctgcttggtaagatggccatctatatctgccggatgagtaaccaccccaagaccaccatggccttcctgttctggttctcgttcgggtacgttattacctgcatcctgtgcaaggctatcttcttcctcctgatcattttcggcaccctgggcaagcgctttaagcagtaccgagagctaaagccccagacctgcaccatctgcgagaccacccctgtcaatgccattgatgccgagatgcacgacctgaactgctcctacaacatctgcccgtactgtgcctcgcgcctaacctccgacggactcgcacggcacgtaacccagtgcccaaggcggaaggagaaggtagaggagaccgagctgtatctgaaccttgagcgcattccctgggtcgtgcggaaactgctccaggtgagcgagtccacgggcacggtcctcaagcgtagctcttggctaatcgtactgctcgtgctgttcacagtcagcctgagcccggtgcagtccgcgccgatcggccacggaaagacaatcgaaacgtaccgggtgcgcgaggagtacacctcaatctgcttgttcgtcctgggctcgatcctgttcattgtgagcttccttatgaaaggcctggtggacggagtcgggaatatcttcttccccggcctgtccgtgtgcaagacctgcagcatcgggtcaatcaacggcttcgagatcgagagccataaatgttattgttcgctcttttgctgcccgtactgccggcactgcagcgctgacggagaaatacaccagctgcacctgtccatctgcaaaaagcgcaaaacaggctccaacgtaatgctggccgtctgcaagcggatgtgcttccgcgccacgatggaggtatccaacaaggcgctgtttatccgcagtatcatcaacaccaccttcgtagtatgcatcctcatactcgccgtgtgcgtggtctccacaagcgccgtggagatggaatccctccccgccgggacgtgggagcgggaagaggacttaaccaacttctgccaccaggagtgccaggttaccgaaaccgagtgcttatgcccgtacgaggccctggtcctccgccggccgctctttctagacagcatcgtgaaggggatgaagaacctgctcaattccacgtcgctagagacaagcctgtccatcgaggcgccctggggcgccatcaacgtgcagtctacctacaagccgactgtctccacagccaacatcgccctcagctggtccagcgtggaacaccgcgggaacaaagtgctagtctcaggccggagcgagtccatcatgaagctggaggaacgaaccggcatctcttgggacctcggggtagaggacgcctccgagagcaagctgctgaccgtgtccgtcatggatctcagtcagatgtactcccccgtgttcgagtatcttagcggcgaccgacaggtggaggagtggcctaaggcgacgtgcacgggggactgccccgagcgctgcggctgcacctccagcacgtgcctacacaaggagtggccgcactcgcgcaactggcgctgtaaccccacgtggtgctggggcgtcgggacagggtgtacgtgctgcggcctcgatgtgaaggacctgttcaccgactacatgttcgtcaagtggaaggtggagtatatcaagaccgaggccatagtgtgcgtcgagctgaccagccaggagcggcaatgctccctcatcgaggccggcacccgcttcaacctgggctccgtgaccatcaccctgagcgagccccggaacatccagcagaagttgcccccggagataatcaccctgcaccccaagatcgaggaaggcttcttcgacctgatgcacgttcagaaggtactctccgccagcacggtgtgtaagctgcagtcctgcacccacggggtgcccggagacctgcaggtttaccacatcggcaatctcctgaaaggggaccgcgttaacggccacctcatccataaaatcgaacagcatttcaacaccagctggatgtcctgggacgggtgcgacctcgactactactgcaatatgggcgactggcccagctgcacctacacgggtgtaacccagcacaaccacgcctccttcgtcaatctgctgaacatcgagaccgactacaccaagactttccatttccacagcaagcgggtgaccgcgcacggcgataccccgcagctcgatctaaaggcccgccccacctatggcgcgggggagatcacagtcctggtcgaggtggcggatatggagctccacaccaagaaaatcgagatctccgggctgaaattcgcgggtctgacctgcaccggctgctacgcctgtagctctggaatctcctgcaaggtgcggatccatgttgaggagcccgacgagctcacggtgcacgttaagtctgacgaccccgacgtagtggccgcctcctccagcctgatggcccgcaaattggagtttgggaccgattccacctttaaggcgttcagcgccatgccgaagaccagcctctgtttttacatcgtggagcgggagtactgcaagtcgtgcagcaaggaggatacgcagaagtgcgtcaacaccaaactagagcagccccagtccatactgatcgaacacaagggcacgataataggaaagcagaacaatacgtgcacggccaaagccagctgttggctcgaatcagtcaagagcttcttctacggcctgaagaatatgctcggtggcatctttggcaacgtcttcatcggtatcttcaccttcctgaccccctttatcctgctgatcctgttctttatgttcggctggcgcatactcttctgcttcaagtgctgccggcgtactcgcgggcttttcaagtaccgtcacctaaaggatgacgaggagacgggctaccgcaagatcatcgagcggctcaacaacaagaaggggaagaaccgcctgctggacggagagcggctcgcagaccgaaagatcgcggagttgttctccaccaagacgcacataggatga

SEQ ID NO: 15292 - RNA, 5055 nt, synthetic construct
  misc_feature 1..5055: note = derived and/or modified CDS sequence (opt11) from CCHFV(75024)__AB069671.1__GP
  source 1..5055: mol_type = other RNA
atgcacatcagcctcatgtgcgccgtgctctgcctgcagttgtacgggctgggggagacccacgggtcgagcaacgagaccgagcacaacaaaacaaatgtagtcaccaccccgggcgactcccagagcccggagccgctggtgtccactaccttacccgttaccttggattcctccaccgtaacccccaccacccccgcctcgggccccgaggggtccggagaggtgtacacctccccgcccatcaccaccgagggcctttccccgtcggaggccacctccgagttacccgcgaccaccgggatcggcatcagctccgcctctgacgtcgactcctcgacacaagcggccggggacacgtccacccccacagtgagaacctcgccacccaacagctccagcacgccgcccacctcccaggacacccaccatccgatgcggaacctcctgagcgtgacctccctgaagcccgaggagaccagcgctccctccaagagcggcaaggagtcccccgctgccagcagcccccacccagtagcctcccggccacccaccccacccaccactgcgcaggggcccattgagaacaactcccacaacaccaccggccagctggaatctgtgacccagtccgctacgctaggtcccatggcatctcccacccagaccgtgctgtcacagaacgtcaccagtatcgccatccaggacacccacccctcccccaccaaccggagtaagcgcaacctcgagatggagatcatcttaaccctgccccaggggctcaagaagtactacggaaaggttctacggctgctccagctgaccctggaggaggacactgaggggcttctggagtggtgcaagcgcaacctgggcctggactgcgacgacactttcttccagaaacggatcgaagaatttttcatcaccggcgaggggcacttcaacgaggtgctgcagttccgcacccccggcacgctgagtacgactgagtccacccatgccgagtcacccaccgcggagcccttcaagtcttactttgccaaggggtttttgagcatcgactccggctactttagcgccaagtgttattcgcggacaagcaactcagggctgcagctgataaacgtcacccgacactccacccggatcgccgacacccccggtccgaagatcacgaacctaaagaccatttcttgcatcaacctgaaggccagcgtgttcaaggagcaccgagaggtggaaattaatgtcctgctcccccaagttgcggtgaacctgtccaactgccacgttaccatcaagagccacgtgtgtgactactccctggacatcgacggcaccgtccgcctaccccacatccaccacgagggcaccttcatccctggaacctacaagatcgtcatcgacaagaaaaacaaacttaacgaccggtgcaccctgttcaccaactgcgtgataaaggggcgtgaggtccgcaagggtcagagcgtgctccggcagtacaagacggaaatccgcatcgggaaggcctccaccggcagccgtcgcctgctgagcgaggaatctggcgacgactgcatcagccggacccagctcttacgcaccgagacggctgagatccacggagacaactacggcgggccgggcgacaagatcaccatctgcaacgggtccaccattgttgaccaacgcctgggcagcgagatgggttgctacaccatcaaccgggtcaagtctttcaaactctgcgagaacagcgccacgggcaagtcctgcgagatcgacagcatcccggtcaaatgccgccagggttactgcctgaaaatcacccaggaggggcggggccatgtgaaattgtcccgcggcagcgaggtcgttctggacgcctgcgactcaagctgcgaggtgatgatccccaaagggacaggcgacatcctcgtcgactgctccgggggccagcagcacttcctgaaggacaacctgatcgatctcgggtgccctagcatcccgctactgggcaagatggcgatatacatctgtcggatgtccaaccaccccaagaccacgatggccttcctgttctggttcagcttcggatacgtcatcacgtgcatcctatgcaaggccatcttttacctgctcattattgtggggaccttaggcaagcgattcaagcagtaccgggagttaaagccccagacctgtacgatttgcgaaaccacccccgccaacgccatcgacgcggagatgcacgatctcaactgctcctacaacatctgcccgtactgcgcaagccgcctgacctccgacgggctggcccggcacgtcacccagtgcccaaaacgcaaggagaaggtggaggagacggagctctacctgaacctggagcgaatcccctgggtggtccgcaagctcctacaagtgagcgagagtaccggcgtggccctgaagcggtccagctggctcatcgtccttctagttctcttcgccatttctctgtcacccgtgcagagcgccccgatcgggcacggaaaaacgatagagacttaccaggcccgcgaggagtatacgtctatctgtctgttcgtcctcggctcgatcctgttcatcgtgagctgtctgatgaaggggctcgtggactccatcggcaacatcttctttcccgggctgagcatatgcaagacgtgctccattggcagcatcaacgggttcgaaatcgaatcccacaagtgctactgtagcttgctctgttgcccgtactgccggcactgctccgccgaccgcgagatccatcagctgcacctgagcatatgtaagaagcggaagaccggctccaacgttatgctcgccgtatgcaagcgcatgtgcttccgggcgaccatggaggtgtcaaacaaggccctgctaatccgctccatcatcaacacgaccttcgtcgtttgcatcctcatcctagccgtgtgtgtagtgagcaccagtgctgtggagatggagtccctgcccgccggtacctgggagcgcgaggaggacctcacgaacttctgccaccaggagtgccaggtcaccgagaccgagtgcctttgcccgtacgaggcactggtgcttcgcagaccactgttccttgacagcatagtgcgggggatgaagaaccagctcaattcgacctccctggagacgtccctcagcatcgaggccccctggggcgccatcaacgtccagtccacctacaagccgacggtgagtacagctaacatcgccttaagttggagctccgtcgagcacagaggcaacaagattctggttagcggccgctcggagagcatcatgaagctggaggaacgcacggggatatcctgggacctcggcgtggaggacgcgagcgagtccaagctgctgaccgtgtccgtcatggatctctcccagatgtactcacccgtcttcgagtacctgagcggcgaccgccaggtggaggagtggcccaaggcgacctgcacaggggactgccctgagagatgcggctgcacgaccagcacgtgcctgcacaaagagtggccgcactcccggaactggcgctgcaatccgacgtggtgctggggcgtcggcaccggctgcacttgctgcggactcgatgtgaaagatctgttcaccgactacatgatcgtgaagtggaaagtcgagtacatcaagaccgaggccatcgtttgcgtggagctgacgtcccaggagcggcagtgtagtctcatcgaagccgggacccgcttcaacctgggaagtgtcactatcacgctgagcgagccacggaacattcagcagaagctcccgcccgagatcatcacactgcaccctcgcatagaagagggcttctttgatctgatgcatgtgcagaaggtcctctccgcgagcaccgtatgcaaattgcaatcttgcacgcacggcgtgcccggggacctgcaagtctaccacgtgggcaacctattaaagggggacaaggtgaatggccacctgatccacaagatcgagcctcacctaaacacctcgtggatgtcgtgggacgggtgcgacctggactattattgcaacatgggcgactggcccagctgcacatacacgggggtcacccagcacaaccacgcctcgttcgtgaacctgctgaacatcgagaccgactacaccaagtcgttccacttccactccaagcgggtgactgcccacggcgacacgccccagctcgacctgaaggcccgccccacctacggcgccggggaaataaccgtcctcgtggaggtagccgacatggagttcacccccaaaaagatcgagatcagcggccttaaattcgcctccttgacgtgcaccgggtgctacgcctgcagctccggtatcagctgtaaagtacgcatccacgtggacgagccggatgagctcaccgtacacgtcaagagcgacgacccagatgtggtggcggcctccagctccctgatggcgcgcaagttggaatttgggacggacagcacattcaaggccttctcagcgatgcccaagacctcattatgcttctacatcgtagagcgggagtactgcaagagctgcagtaaggaggacacccaaaagtgcgtgaatacgaagctggagcagccccagtcaattctgatcgagcacaagggcaccatcataggcaagcagaacaacacgtgcaccgccaaggccagctgctggttggagtccgtcaagagcttcttctacgggcttaagaacatgctctccggcatcttcgggaacttgttcatgggcatcttcctgttcctcgcgccgttcatccttctcatattgtttttcatgtttggctggcgcatcctgttctgcttcaaatgctgccggcgcacgcgtggtctattcaagtaccggcatttgaaggacgacgaagaaaccggctaccggcggatcatcgagcgcctgaacaacaagaaagggaaaaacaagctcttagacggcgagcggctggccgacaggcggatcgccgaactgttcagtaccaaaacccacatcgggtga

SEQ ID NO: 15293 - RNA, 5055 nt, synthetic construct
  misc_feature 1..5055: note = derived and/or modified CDS sequence (opt11) from CCHFV(7803)__AB069672.1__GP
  source 1..5055: mol_type = other RNA
atgcacatcagtctgatgtgcgccgtgttatgtcttcagctgtacgggttgggggagacgcatggctcgagcaacgagaccgagcacaataagaccaacgtggtgaccacccccggagactcccagagcccggagcccctagtgtccaccacactgcccgtcactcttgacagctccaccgttacccccaccacgccggccagcgaacccgagggctccggggaagtctacacttccccgcccatcaccactgaaggcctgtccccgagcgaggctacctccgagctgccggtcaccaccggcatcgggatcagctccgcgagcgacgtggactccagcacccaggccgccggcgacacctccacccccaccgtgcgcacgagcccgcctaacagcccctccacaccacccaccagccaggacacccaccaccccatgcggaaccttctatccgtcacgagcttaaagtctgaggagaccagcgccccctctaaaagcgggaaggagtcgcccgcagcgagcagcccccacccggtggccagccggccgcccacccaccccatcaccgcccagggaccgacggaaaacaactcccacaacaccaccgggcagctcgagagcgtgacccagtcggcgacgctgggccccatggctagccccacgcaaaccgtcctgtcccagaacgtgaccagcatcgctattcaagatacgcaccccagtccgaccaacagaagcaagcgcaacttggagatggagatcatcctgacgctgccacagggcctcaagaagtattacggtaaggtgcttcggctgctccagctgaccctggaggaggacaccgagggccttctggagtggtgtaagagaaacctggggctcgactgcgacgacacgttcttccagaagagaatcgaggagttcttcatcacgggcgagggccacttcaacgaagtcctgcaattcaggaccccagggaccctgagcacgaccgagtccacccacgccgagagcccgaccgcggaacccttcaaatcctacttcgcgaagggcttcctcagcatcgactccgggtacttctctgccaagtgctactcccggacgagcgactccggactccagctgatcaacgtgactagacacagcacccggatcgccgacaccccagggcccaagatcacaaacctcaagacgatctcctgcatcaatctgaaggctagcgtgttcaaggagcaccgcgaggtcgagatcaacgtattactcccccaagtggccgtcaatctgtccaactgccacgtgaccatcaagagccacgtgtgcgactactccttagatatcgacggcaccgtccggctcccccacatccaccacgaggggactttcatccccgggacctacaagatcgtcattgacaagaaaaacaagttgaacgataggtgcacgctgttcaccaactgcgtcatcaagggacgtgaagttcgtaaggggcaaagcgtgctccgacagtacaagacggagatccgcatagggaaggcgtccaccgggagccggcggctgctgagcgaggagagcggcgacgactgcatcagcagaacccagctcctgcgcaccgagacggccgagatccacggcgacaactatgggggccctggggacaagatcaccatctgcaatggctcgaccatcgtcgaccagcgcctggggagcgaaatgggctgctatactattaaccgggtgaagtccttcaagctctgcgagaacagcgccacgggcaagtcctgtgagatcgactctatcccggtgaagtgccgccaggggtattgcctgaagatcacccaggaaggccgggggcacgtcaagctgtcccgcggcagcgaggtgattctggacgcctgcgactcgagctgcgaggtgatgatccccaagggaaccggggacatcctcgtcgactgctccggagggcagcagcactttctgaaggacaatctgatcgacctagggtgcccctccatacccctcctggggaagatggccatctacatctgccggatgtccaaccacccgaagaccactatggcgtttctcttctggttcagcttcggctacgtgatcacgtgcatcctgtgcaaggcgatcttctacctgttgatcatagtgggcacgctggggaagcgattcaaacagtaccgcgaactgaagccccagacctgcacgatctgcgagaccacccccgcgaacgccatcgacgccgagatgcacgacctcaactgctcctacaacatctgcccctactgcgcgagccgcctgaccagcgacggcctggcccggcacgtcacccagtgccccaagcgcaaagaaaaggtggaggagacggagctctacctgaacctcgagcggatcccctgggtggttagaaagctccttcaggtgagcgagagcaccggggtggccctgaagcggtcctcatggctcatcgtcctgctcgtcctgttcgccatctccctgagccccgtccagagcgcgcccatcagccacggcaagaccatcgagacctaccaagcccgcgaggagtacacgtccatctgcctgtttgtcctcggcagcatccttttcatagtgtcctgcctgatgaagggcctcgtggactctatcggcaacatcttcttcccggggctgtccatctgcaagacctgcagcatcggcagcatcaacgggttcgaaatcgagagccacaaatgttactgctcgctgctctgctgcccatactgccggcactgcagtgccgacagggagatccaccagctgcatctgagtatctgcaagaaacggaagaccggatctaacgtcatgctcgcagcctgcaagcgcatgtgctttagagcgaccatggaggtctcgaacaaggccttactgatccgcagcatcatcaatacgaccttcgtggtctatatcctaatccttgccgtatgcgtggtcagcacctcggccgtggagatggagtccttgcccgccgggacctgggagcgcgaggaggacctcacaaatttctgtcaccaggagtgccaagtgacggagaccgagtgcctgtgcccatacgaggcgctggtgctccgtcgcccgcttttcctggactccattgtgcggggcatgaagaaccccctcaactcaacctccttggaaacgagcctatccatcgaggccccctggggcgccatcaacgtgcagtccacctacaagccgactgtctcaaccgcgaacatcgctctcagctggtcttcagtggagcaccgtgggaacaagatcctggtttccggccggagcgagagcatcatgaagctggaggagcgcacggggatcagctgggaccttggcgtagaggacgcgtccgagagcaagctgctgaccgtgtccgtaatggacctcagccagatgtacagccccgtcttcgagtacttaagtggggaccgccaagtggaggagtggcccaaggcgacctgcaccggcgattgccccgagcgctgcggctgcacgacctctacgtgtctgcacaaggagtggccgcactcgcggaactggagatgcaaccccacctggtgctggggcgtgggcacggggtgcacgtgctgtggcctcgacgtcaaggatctgttcaccgactacatgatcgtaaaatggaaggtggagtacatcaagacccggggcatcgtatgcgtcgagctgacctcacaggagcgccagtgctccctcatcgaggccgggacacggttcaacttaggcagcgtgacgatcactctgtccgagccccgtaacatccagcagaagctgccgccagagatcatcacgctgcatccccgtatcgaagaggggttcttcgacctgatgcacgtccagaaggtgttaagcgcctccaccgtctgcaaactgcagagctgcacccacggcgtgcccggggacctccaggtgtaccatgtaggcaacctcctgaagggcgacaaggtgaacggacacctgatccacaagatcgagccccacctgaatacctcctggatgtcatgggacggctgcgacctggactactactgcaacatgggggactggccctcttgcacctatacgggcgtgacccagcacaaccacgcgagctttgtcaacttactcaacatagagaccgactacactaagtccttccacttccacagcaagcgcgtgactgcccacggggacacgccccagctggacttaaaggcccggcccacctacggcgccggcgagattaccgtgctcgtggaggtggccgacatggagttcacgcccaagaagatcgagatctctggacttaagttcgcgtcgctgacctgcaccggctgctacgcgtgcagcagcgggatttcatgtaaggttcgcatccacgtcgacgagccggacgagcttaccgtgcatgtgaagtccgacgatcccgacgttgtggctgcaagctccagcctgatggcccggaagctggagttcggcacggactccaccttcaaagcattcagcgccatgcccaagacctccctctgtttttacattgtggagcgcgagtactgcaagagctgctccaaggaggatacccagaagtgcgtcaacacgaagctggagcagccccagagcatcttgatcgagcacaagggaaccatcatcggcaagcagaacaacacgtgtaccgccaaggcctcctgctggctcgaatcggtgaagtcattcttctacggactgaagaacatgctgagtggcatcttcggcaacttcttcatggggatcttccttttcctggccccgttcatcctgctgatcctcttcttcatgttcggctggcggatccttttctgcttcaagtgctgccgccgcacgcggggcctgttcaagtacagacacctcaaggacgacgaagagaccgggtaccggcgcatcatcgagcggctaaacaacaagaagggaaagaacaaactgctcgacggtgagcgcctggcggaccggcgcatcgccgagctgttctccaccaaaacacacatcggatga

SEQ ID NO: 15294 - RNA, 5055 nt, synthetic construct
  misc_feature 1..5055: note = derived and/or modified CDS sequence (opt11) from CCHFV(Hodzha)__AY223476.1__GP
  source 1..5055: mol_type = other RNA
atgcacatcctgctcatgtgcgcggtgctgtgcctgcagcagtacggcctcggggagacccaccgccccaacaacggcacagagcacaacaagactaacgtcctgaccacccccggggataagctgtcccccgagctacccgtgtccaccgccctgtccgtgacccccgactccagcaccgtcacacccaccacccccgtgtccggcctggaggggtcgggcgatgtgtacaccagcccgcccgtcaccaccaaaggactcagcccgtccaaggccaccagcgagctgcccgcctcctcggggattgacacatccagcgcctccgacgtggatagctccactcaggccgcccgtgacaccagcacgctgaccgtgcgcacctcaccccctagctcgccgtcaacgccgcccacgtcccaggacacgtaccacctcgtccggaacctgctgtccgtgaccagcccctggccggaagagaccacggcgccctccaaatctggtaaggagtcccccgtggccaacagcccccacccggtcacctcccgccccagcagtccgcccatcacggtgcaggggcccaccgagaacagctcccacaacacgaccggccagctcgagtctatggcccagtccacaaccctggtacccatggccagccccacgcagactgtcctatcccagagcgtgacctccctcgcggtgcaagacgcccaccccagcccgaccaatcggagcaagcgcaacctggagatggtcattatcctgacgctcccccaggggctgaagaaatactacggcaaggtgttacggctcctgcagttaaccctcgaagaggataccgagggcctgctggaatggtgcaagcgcaacctggggctggactgcgacgacaccttcttccaaaagcggatcgaggagttcttcatcacaggcgaaggacacttcaacgaggtgctgcaattcaagacgccctcaaccctcagcaccaccgagtcaacgcatgccgtcagcccgactgccgagcccttcaagtcctacttcgccaaaggcttccttagcatcgacagtggctacttctcggccaagtgttactccaagaccagcaactccgggctgcaactcatcaacgtgacccgccacagcacgcggattgccgacacccccggccccaagatcaccaatctgaagaccatctcctgcatcaacctgaaggcctccgtgttcaaggagcaccgcgaggtcgagatcaacgtgctcctgccccaggtagctgtgaacctgtccaactgccacgtgacgatcaagagtcacgtctgcgattactccctcgacgtggacgggaccgtacggctgccccacattcaccacggcggaaccttcatccccggcacgtacaagatcgtcatcgacaagaagaacaagctgaacgaccgatgcacgttatacaccaactgcgtgataaagggccgggaggtgcgcaaggggcaaagcattctgcggcagtataaaaccgagatccgcatcggtaaggccagcaccggctcccgtcgtctgctaagcgaggagagtggcgacgactgtatctcacggacacagctgctgcgcactgagaccgctgagatccatggggacgactacggcggccccggggacaagatcaccatctgcaacggctccacgatagtcgaccagcgcctggggtccgagctcggctgctacaccattaaccgggtgaagtctttcaagctgtgcaaaaacagcgccaccgggaagtcctgcgagatcgatagcacccctgtgaagtgccgccagggctactgcctcaaaatcacgcaggagggccgggggcacgtcaagctctcccgcgggagcgaggtggtgctggacgcctgcgactccagctgcgaggtgatgatccccaaggggacaggcgacatcctagtggattgctccggcggtcagcaacatttcctcaaggacaacctgatcgacctaggctgtccccggatcccgctcctggggaagatggccatttacatctgcagaatgagcaaccatccgaaaaccaccatggcatttctgttctggttctccttcggctacgtcatcacgtgcatcctctgcaaggcgatcttctacctgctgattatcgtcggtaccctaggcaaaagattcaagcagtaccgcgagctgaagccccaaacctgcaccatctgcgagacgacccccgccaacgccatcgacgccgagatgcacgacctgaactgtagctataatatctgcccgtattgtgcctcccggctcacctcggacggcctggcccgccacgttacccaatgcccaaagagaaaggagaaggtggaggagaccgagctgtacctcaacttggagcgcatcccctggatcgtgcggaagttgctccaggtaagcgagtccacgggggtggcactgaagcgtagctcctggctgatcgtgctcctggtgctgttcgccgtgtctctcagtcccgtccagagcgcccccataggccacgggaagaccatcgaaacgtatcaggcgcgggaggactacacctccatctgtctgttcgtgctgggcagcatcctcttcatcgtgtcctgcctgatgaaggggctggtcgattcgatcggaaacatctttttcccgggtctcacgatatgcaagacctgctccattggcagcatcaacggcttcgagatcgagagtcacaagtgctattgcagcctgctgtgctgcccctattgccgccactgctccgccgaccgggagatccatcagctccacctaagcatctgcaagaagaggaagaccgggtccaacgtgatgctggccgtgtgcaaacggatgtgcttccgcgccaccatggaggtcagcaacaaggccctcctgatccgctccatcatcaatacgaccttcgtggtgtgcatcctgatcctcgcggtctgcgtggtgagcaccagcgccgtcgagatggaaagcctgccagctggcacctgggagcgggaggaggacctgacaaatttctgccaccaggagtgccaggtgaccgagaccgagtgtctctgtccctatgaggcccttgtactgcgccggcctctgtttctggacagcatcgtcaaggggaccaagaacctgttaaactccacgtctctggagacctccctgagcattgaggccccctggggcgcgatcaacgtgcagagtacctacaagcccaccgtttccaccgccaacatcgccctatcatggagctcagtcgagcatcgcggcaacaagatcctggtgagcggacggagtgagtcgatcatgaaactggaggagcgcaccgggatatcgtgggatctcggggtggaggacgccagcgagtccaagctgctgaccgtcagcgtgatggatctctcccagatgtacagcccggtctttgaatacctgagcggcgatcggcaggtcgaggagtggcccaaagcgacctgtacgggggactgccccgagagatgcgggtgtacctccagcacgtgcctgcacaaggagtggccacactcccggaattggcgctgcaatccgacctggtgctggggcgtggggaccggctgcacgtgctgcgggctcgacgtaaaggacctgtttaccgattacatgttcgtgaagtggaaggtggactacatcaagaccgaggctatagtctgtgtggagctgacgtcgcaggaacggcagtgctccttagtggaagccggcacccgcttcaacctgggccccgtcaccataactctgtctgagccccggaacatccaacagaagctcccgccggagatcatcacgctgcacccgcgcatcgaggaggggttcttcgacctgatgcacgtacagaaggtgctctccgccagcacggtctgcaagctgcagtcctgcacccacggcgtgcctggggacctccaggtgtaccacatcggtaacttactgaagggggacaaggtcaacggccacctgatccacaagatcgagccacacttcaacacgagctggatgtcctgggacggctgtgacctcgactactattgcaacatgggagactggccctcgtgcacctacaccggcgtgacccagcacaaccatgcctccttcgtgaacctgctgaacatcgagactgactacaccaagagtttccacttccactccaagcgggtcacggcgcacggggacactccccagctcgacttaaaggccagacccacatacggcgccggggagatcaccgtgctggtggaggtagccgacatggagctccacacgaagaagatcgagatcaccgggctgaagttcgccagcctgacctgcaccggatgctatgcgtgctccagcgggatctcctgcaaggtgcggatccacgtggacgaacccgatgagctcacggtccacgtaaaatccgacgacccggacgtggtcgccgccagctcctcactgatggcacgcaaactggagtttggaacggactccaccttcaaagccttctcagcgatgcccaagacatccctctgcttctacatcgtggagcgggagtactgcaagtcttgctcgaaggaggatacgcaaaagtgcgtgaataccaagctggagcaaccccagagcatcctgatcgaacgcaagggtaccatcatcggcaagcagaataacacgtgcacggccaaggcctcctgctggctggagagcgtcaagtccttcttctatgggctcaagaacatgctgtcgggcatcttcggcaacgtgtttgtgggcatcttcctgttcctcgccccgtttatccttctgatcctgttcttcatgttcgggtggcggatcctgttctgcttcaagtgctgccgccgcacccggggactgttcaagtacaagcacctcaaggacgatgaagagaccggctaccgccggatcatcgagaggctgaataacaagaagggcaagaacaagctgctcgacggggagcggctggccgaccgccggatcgcggagctgttctccaccaaaacgcacatcggttga

SEQ ID NO: 15295 - RNA, 5055 nt, synthetic construct
  misc_feature 1..5055: note = derived and/or modified CDS sequence (opt11) from CCHFV(Hodzha)__KX013448.1__GP
  source 1..5055: mol_type = other RNA
atgcacatccttctcatgtgcgctgttctgtgcctgcagcagtacggcctcggggagacccaccgccccaacaacggcaccgagcacaacaagacgaatgtattaaccacccccagcgacaagctgtcccccgagccgcccgtgagcaccgccttatccgtgacgcccgacagctccacagtcacccccaccacgcccgtctccgggctggaaggctccggcgaggtgtacaccagcccgcccgtcacgaccaagggcctgtcccccagtaaggcgacgtccgagctccccgcgaccacaggcatcgacaccagctccgccagcgacgtggactcctccacgcaggccgcccgggacacctccaccctgaccgtccgcacgagcccgccctccagcccctcaaccccacccacctcccaggacacctaccacctggtccggaacctcctgagcgtgacgagccccaggcccgaggagaccacggccccctccaagtccgggaaggagagccccgtggcgaactccccgcaccccgtcaccagccggccctccagcccgccaatcacagtgcagggtcccaccgagaactccagccacaacaccaccgggcagctggaatccatggcccagagcacgaccctcgtacccatggcctcccccacccagaccgtactgagccagtccgtgacgagcctggcggtgcaggacgcccacccgtcccctaccaatcgcagcaaacggaacctcgagatggagatcatcctgaccctgccccagggcctcaagaagtactacgggaaggtcctgcgcttgctccagctgaccctggaggaggacaccgagggcctcctggagtggtgcaagcggaacctggggctcgactgcgacgacacgttcttccagaagcgcatcgaggagttcttcataaccggggagggccacttcaacgaggtgttacaatttaagaccccgagcaccctgtccaccaccgagagcacccacgccgtgtcccccacggccgagcccttcaagagctactttgcgaaggggttcctctccatcgacagcggctacttctccgcgaagtgctacagtaaaacctccaacagtggcctgcagctgatcaacgtcacccggcactccacccgcatcgccgacaccccagggccgaagatcacgaacttaaaaaccatcagctgcatcaacctgaaggcctccgtgttcaaggagcaccgggaggtggagatcaacgtcctgctcccccaggtggccgtcaacctgtcgaactgccacgttaccatcaagtcccacgtgtgcgattacagcctggacgtcgatggcaccgtgcgcctcccgcatatccaccacggcggcacgttcatccccgggacctacaagatcgttatcgacaagaagaacaagctaaacgaccggtgcaccctgtacaccaactgtgtcatcaagggccgcgaggtgcggaaaggccagtccatcctccgccagtataagacggagatacggatcggaaaggctagcaccggcagccgccgactgctgtccgaggagtctggggacgactgcatctcacgcacccagctcctgcgcaccgagacggcggagatccacggtgacgactacgggggcccgggcgacaaaattaccatctgcaatgggagcaccatcgtggaccagcggctgggctccgaactggggtgctacaccatcaaccgcgtcaagtccttcaagctctgcgagaactccgccactggcaagtcgtgcgagatcgactccacacccgtgaagtgccggcaggggtattgcctgaagatcacccaggagggccgcggccacgtgaagttgagccgggggtccgaggtcgtgctcgacgcctgcgacagctcctgcgaggtgatgatccccaagggcacaggtgacatacttgtggactgcagcgggggccagcagcactttctgaaagacaacctcatcgatctggggtgccccaggatcccactgctcggcaagatggccatctacatttgcaggatgtccaaccaccccgagacgaccatggccttcttattctggttcagcttcgggtacgtgatcacgtgcatcctgtgtaaggcgatcttctacctcctgatcatcgtaggcaccctggggaagcgtttcaagcagtacagagagctcaagccccagacctgtaccatctgcgagaccaccccagccaacgccatcgacgccgagatgcacgacttaaactgctcctacaacatctgcccgtactgcgccagccgcctgacctccgacggcctcgcgcggcatgtcacgcagtgccccaagcgcaaggagaaggtggaggagacggagctgtatctaaacctcgagcgaatcccctggatcgtgcgtaagctgttgcaggtcagcgagtcgaccggcgtggccctcaagcggtccagctggctgatcgtgctgttggtcctgtttgccgtgtccctgagccccgtgcagtccgccccgatcgggcacggcaagaccatcgagacgtaccaagcgcgcgaggagtataccagcatctgcctcttcgtcctggggtccatcctgttcatcgtgtcatgcctcatgaagggcctggtggacagcatagggaacatcttcttccccggcctgaccatctgcaagacctgcagcatcgggtccattaacggattcgagatagaaagccacaagtgctactgctccctcctgtgttgcccctactgccggcattgccccgcggaccgcgagatccaccagctgcacctcagcatatgcaagaagaggaagacgggctccaacgtcatgctagccgtgtgcaagagaatgtgcttccgcgccaccatggaggttagcaacaaggccctgctcatccggtcgatcatcaacaccaccttcgtcgtttgcatcctgatccttgcggtatgcgtcgtgtctacgtccgccgtggaaatggagagcttgccggccgggacctgggagcgcgaggaggacctgacgaatttctgccaccaggagtgccaagtcaccgagacggagtgtctgtgcccctacgaggcccttgtgctgcggcgccccctgttcctcgacagcatcgtgaaaggcaagaagaacctgctgaactctaccagtctcgagacctccctgagcatcgaagccccgtggggcgcgatcaacgttcagtccacctacaagcccacggtgagcaccgccaacatcgccctgtcctggagctccgtggagcaccgtgggaacaaaatcctcgtcagcggccgctccgagagcatcatgaagctggaggagcggaccgggatctcctgggatctgggcgtggaggacgccagcgagtccaagctcctgaccgtttctgtcatggacctgtcccagatgtacagccccgtgttcgagtacctctccggggaccgccaggtggaggagtggcccaaggccacgtgcaccggcgactgcagcgagcggtgcggatgcaccagctccacgtgcctgcacaaggagtggccccacagtcgcaattggcggtgcaaccccacctggtgctggggcgtcggcaccgggtgcacgtgctgcggcctggacgtgaaggacctcttcaccgactacatgttcgtcaagtggaaggtggactacatcaagaccgaggcgatcgtgtgcgtcgaactgacctcccaggagcgccagtgcagcctggtggaggcggggacccggttcaacctcggccccgtgacaatcacgctgtccgagccgcgcaacatccagcagaagctgccgcctgagatcataactctccacccccggatcgaggagggcttcttcgacttaatgcacgtccagaaggtcctgagcgcctccaccgtgtgcaagctccagagttgcacccatggggtccccggcgacctccaggtgtaccacatcgggaacctgctgaagggcgacaaggtgaacggacacctgatccacaagatcgaaccgcacttcaacacctcctggatgtcctgggatggctgtgacctggactactactgcaacatgggcgactggccctcctgcacgtacaccggggtcacccagcacaaccacgccagcttcgtgaacctcctgaatatcgagaccgactacacgaagtccttccacttccacagcaagcgcgtgaccgctcacggcgacacgccccagctcgatctcaaagcccggcccacttacggggccggcgagatcaccgtcttggtggaggtggccgacatggagctgcacaccaagaagatagagatcaccgggctcaagttcgcctccctgacctgcacgggctgctacgcgtgcagctccggcattagttgcaaggtccgcatccacgtcgacgagccggacgagctcaccgtgcacgtcaagtccgacgatccagacgtggtggccgccagcagctccctcatggcgcggaagttagagttcgggaccgacagcaccttcaaggccttctccgcgatgcccaagacgagcctgtgcttctatatcgtcgagcgcgagtattgcaagtcctgcagcaaggaggacacccagaagtgcgtgaacaccaagctcgagcagccccaatccatcctaatagagcagaagggcaccatcatcgggaagcagaacaatacctgtaccgccaaggccagctgctggctggagtccgtaaagagcttcttctacggccttaagaacatgctctccgggatcttcggcaacgtattcgtgggcatcttcctgttcctggccccgttcatcttgctgatcctgtttttcatgttcgggtggcggattctcttctgcttcaagtgctgccgccgaacccggggcctgttcaagtacaaacatctgaaggacgacgaggagaccgggtaccgccggatcatcgaaaggttgaacaacaagaagggcaagaacaagctgctggacggagagcggctcgccgaccgccggatcgcggagctgttcagcacgaagacccacatcgggtga

SEQ ID NO: 15296 - RNA, 5055 nt, synthetic construct
  misc_feature 1..5055: note = derived and/or modified CDS sequence (opt11) from CCHFV(Baghdad 12)__AJ538197.2__GP
  source 1..5055: mol_type = other RNA
atgcacatcagcctgatctacgcagtcctctgcctgcaactgtacggcctcggggagacccacggctcctcctccgggaccgagcacaaccgcacgaacgtcgtggccacccccggcgggagtcagtccccggagcccctggtgagcaccacgctgcccgttacgctcgattccagcaccgtgacccccgcgacccaggcctccggccctgagggcagcggggaggtgtacacgtctcccccgaccaccaccgagggcctgagcccctccgacgccacaagcgagctgccgaccaccaccggcataggcatatccagctccagcgacgtcaactccagcacgcaggctgccggggataccagcacccccaccgcgcggacgtccctcccagacagcccttccaccccgcccacgagccaggacacccaccaccccatgcgcaacttgctgtccgtgacgagcctcaagcccgaggagacccccgccccctccaagagcggcaaggagagtcccgccgcctcgagcccccacccggtggcgagcaggccgcccaccccctccaccacggcccagggtcccaccgagaacaacagccgcaacacgaccgtccagttaaagtccgtgacgcagagcgccaccctggggcccatggccagccccactcagaccgtgctcctgcagagcgtcacgtcgatcgctatccaggatacccaccccagcccgaccaaccggagccgccggaacctggagatggagatcatcctcaccctgccccagggcctgaagaagtactacgggaaggtgctccgcctgctgcagctaaccctggaggaggatacagagggcctgctcgagtggtgcaagcggaacctgggtctggactgcgacgacaccttcttccagaagcgcatcgaagagttcttcatcaccggggagggccacttcaacgaggttctacagttccggacccccgggacactgtccaccaccgagagcactcacgcgggctcccccacggtagagcccttcaagagctacttcgctaaggggttcctgctcatcgactccggctactttagcgccaagtgctactcccgcacgagcaactctggcctgcagctgatcaacgtgacccggcacagcaccaagattgccgacacgcccgggcccaagatcaccaacctcaagaccatcagctgcatcaacttaaaggcaagcatctttaaggagcaccgcgagatcgagatcaacgtgctgctcccgcaagtcgcggtgaacctgtccaactgccacgtgaccatcaagagccacgtctgcgactactccctgaacatcgacggcacggtgaagctcccccacatccaccacgagggcatcttcatccccggcacctataagatcgtgatcgacaagaaaaacaagctaaacgaccggtgcaccctgttcaccaactgcgtcatcaaggggcgcgaggtgcggaagggccagagcgtcctccgccagtacaagacggagatccggatcggcaaggcctccaccgggagccgccggttgctgagcgaggagtccggcgacgattgcatcagccgcacccgcctcctgcggaccgagacggcagagatccatggagactcctacggcgggcccggcgataagatcaccatctgcaacggcagcaccattgtggaccaacgcctggggtcagagatgggctgttacaccattaaccgggtaaagagcttcaagctgtgtgaaaattccgccacaggcaagagctgcaagattgactccatcccggtgaagtgtcgccaggggtactgcctcaagatcacccaagagggccgggggcacgtgaaactgtcccgcggctccgaggtggtactggacgcctgtgacagttcctgcgaggtgatgatccccaaggggactggcgacatcctcgtggactgcagcgggggtcagcagcactttctgaaggacaacctgatcgacctcggctgccccaacattcccctgctggggaagatggcgatctacatctgccgcatgtccaaccacccgaagaccacgatggccttcctcttctggttcagtttcggctacgtcataacctgcatcctgtgcaaggccatattctacctgctcatcattgttgggaccctgggcaagcgctttaagcagtatcgcgagctgaaacctcagacctgcacgatctgcgagaccacccctgtgaacgcaatcgatgccgagatgcacgacctcaactgctcctacaacatctgcccctactgcgcgagccgcctgacctccgacgggctggcccggcacgtaacccagtgcccgaagcgcaaggagaaggttgaggagactgagctctacctgaacctggagcggatcccctgggtggtccgcaagctcctccaggtgagcgagagcaccggcgtggccctaaagcggtccagctggctcatcgtcctgctggtactcctggccgtgtccagctcccccgtccagagcgcgcccatcggctatggtaagaccatcgagacctaccaggccagagagggctacacgtccatctgcctgttcgtgctcgggagcatcctgtttatcgtctcctgcctgaccaagggcctcgtcgatagcatcgggaacatctttttcccgggcctgtccatctgcaagacatgcagcataggctcgatcaacgggttcgaggtggagtcccacaaatgctactgcagcctgctctgttgcccctactgccgccattgcagcgcagaccgcgagatccaccagctgcatctgtccatctgcaagaagaggaaaacaggcagctccgtgatgctcgccgtctgcaagcgcatgtgcttccgcgcaacgatggaggtgagcaacaaggcgctgctgatccggagcatcatcaacaccactttcgtggtctgcatcctcaccctggccgtgtgcgtggtctccacgagcgccgtggaaatggagtctctgcccgccgggacctgggagcgcgaggaggacctcactaatttctgccaccaggagtgccaggttaccgagacggagtgcctgtgtccctacgaagccctggtactccggaaaccgctgttcctggacagcatagtgaagggcaccaagaacctgctcaacagcaccagcctggagacctccttgagcatcgaggcgccctggggcgccatcaacgtgcagtcaacgtacaaacccaccgtcagcaccgccaacatagccctgtcctggagctccgtggagcacagagggaacaagatcctggtgagcggtcggtccgagagcatcatgaagctcgaggagcgcaccggtatctcgtgggatctgggcgtcgaggacgccagcgagtccaagctgctcacggtgagcgtgatggacctgagccagatgtactccccggtcttcgagtacctgagcggggaccgccaggtggaggagtggcccaaagcgacctgcaccggcgactgccccgagcggtgcggctgcaccacgtctacctgcctccacaaggagtggccccactcccgtaactggcgctgcaacccgacctggtgctggggcgtgggcaccgggtgcacgtgctgcggcctggacgtaaaggacctgttcaccgactacatgttcgtgaagtggaaggtagagtacatcaagaccgatgccatcgtctgcgtggagctcacctcccaggagcggcagtgcagcctgatcgaggccgggacgcgcttcaacctgggctccgtcaccatcaccctctctgagccccggaacatccagcagaagctgccgcccgagatcatcacccttcacccccgcatcgaggagggcttctttgacttaatgcacgtccagaaggtgctgtccgccagcactgtctgcaagctacagtcctgcacgcacggggtgccgggcgacctccaggtgtaccacatagggaatctgctgaagggcgacaaggtcaacgggcacctaatccacaagatagagccccacttcaacaccagctggatgtcctgggacggctgcgacctggactactactgcaacatgggcgactggcccagctgcacctacacaggggtgacgcagcacaaccacgcgtcattcgtgaacctgctcaacattgagaccgactacaccaagagcttccacttccactccaaaagagtaaccgcccacggcgacacgccgcagcttgacctgaaggtgcgccccacctacggggccggcgagatcacggtgctggtcgaggtggccgacatggagctgcacaccaagaagatcgagatcagcgggctgaagttcgcctccctcacgtgcaccggctgctacgcgtgcagcagcggcatatcctgcaaggtacggatacacgtcgacgaacccgacgagctgaccgtgcacgtcaaaagcgacgaccccgacgtcgtggccgccagtagctccctgatggcccgcaagctagagttcgggaccgactcgacgttcaaggccttctccgctatgccgaagaccagcctgtgcttctacatcgtggagcgggagtactgcaagtcctgcagcaaggaggacacccagaagtgcgtcaacaccaagctggagcagccccagtccatcctcatcgagcacaaaggcacaatcatcgggaagcagaacaatacctgcaccgccaagaccagctgctggctggagagcgtgaagtctttcttctacggcctgaagaacatgctgagtggcatcttcgggaactttttcatgggcatattcctcttcctcgcccccttcatattgctcatcctgttcttcatgttcggttggcgcatcctgttctgcttcaagtgctgcaggcgcacgcgaggcctcttcaagtaccggcacctaaaggacgatgaagagaccgggtaccgccggatcatcgagagactgaacaacaagaagggcaagaacaagctcctggacggcgagcggctggccgaccgccggatcgccgagctgttcagcaccaagacccacatcgggtga

SEQ ID NO: 15297 - RNA, 5055 nt, synthetic construct
  misc_feature 1..5055: note = derived and/or modified CDS sequence (opt11) from CCHFV(TADJ/HU8966 )__AY179962.1__GP
  source 1..5055: mol_type = other RNA
atgcacatgctgctcatgtgcgccgtgctctgcttacagctctatggactcgggggcaccctgaggagcaacaacgggaccgagcacaacaagacgaacgtccttaccacccccggcgacaagctgtccccggagccacctgtaagcaccgccctgcccgtgactccggactccagcacagtgactccgaccacgccggcgtccgggctggagggctcaggcgaggtgtacacatccccgcccatcaccaccaaagggctgtccccctccgaagctacgagcgagccgccagccacaaccggtatggggatttccagcgcctcgggagtggacttttcgacccaggctgctcgggacacgtccacactaaccgtcctcaccagcccgccgaactcccccaacacgcccccgaccagccaggacacccaccatcctgtgcgtagcctactgagcgttacttcgccgcggcccgaagaaacgaccgccccgtccaagtcagggaaggagagccccgcagccaacagctcccaccccgtgacatcccgcccctccagcccgttaatcactgttcggggccccacggagaactccagccataacaccaccggccagctggagtctatgacccagagcacgaccttagtgcccatggcctcccccacccaaaccgtcctcagccagtccgtgacgagcatagccgtgcaggatgcccacccgagcagcaccaatcgctccaagcggaacctggagatggagattatcctgaccctcccgcaggggctgaagaagtactacggtaaggtcctgcgcctcctgcagctgaccctcgaggaggacacagagggtcttctggagtggtgcaaacggaacctcggcctggactgcgacgacaccttcttccagaaacggatagaggagttcttcatcaccggcgaagggcacttcaacgaggtgctgcagttccgtacccccggcaccctcagcacaacggagagcacccacgctgggtcccctacggccgagccatttaagagttatttcgcaaaggggttcctgtctatagactctgggtacttctccgccaagtgctacagccgcacgtccaacagcggcctgcggctcatcaacgtgacccgccactccacccggatcgccgacaccccgggccccaagatcaccaacctaaaaaccataagctgtatcaacctgcgcgcctccattttcaaagagcacagggaggtcgagatcaatgtcctcctcccccaggtggccgtcaacctgagcaactgccacgtagcgatcaagtcgcacgtgtgtgactacagtctcgacgtcgatgggaccgtgcgcttaccccacatacatcacggcgggacttttatcccaggcacttacaagatcgtgatagacaagaagaacaaactgaacgacaggtgcacgcttttcaccaattgcgtaattaaagggcgcgaggtgcgtaagggccagtccattctgcgccagtacaaaaccgagatccgcatagggaaggccagcacggggagccggaggctgctctccgaggaaagcggcgacgactgcatctcgcggacccagttgctgcgcacggagaccgcggagatacacggcgacgattacggcgggcccggcgacaagatcacgatatgcaacggttccaccatcgtcgaccagcggctggggtccgaactcgggtgctacaccataaaccgagtcaagagcttcaagctgtgcgagaactcagccaccgggaagaactgcgagattgacagcgtgccagtgaagtgcaggcaaggctactgcctgaagattacgcaagagggacgcggacatgtcaagctctcgcgaggcagcgaggtggtccttgatgcctgtgactcctcatgcgaggtgatgatacccaaggggaccggcgacatatccgtggattgttccgggggccagcaacacttcctgaaggacaacctaatcgacttgggctgccccaagattcccctgctcgggaaaatggctatctacatctgccgtatgtccaaccacccgaagaccacaatggccttcctgttctggttcagcttcggctacgtcatcacgcggatcctgtgcaaggccatcttctacctccttatcatcgtagggaccctgggcaagcgcttcaaacagtacagagagctcaagcctcagacatgcaccatctgtgagacgacgcccgccaacgcaatcgacgcggagatgcacgacctgaactgctcctataacatctgcccctactgcgcgtctcgcctgacctccgacgggctcgcccggcacgtgacacagtgcccgaagcggaaggagcgggtcgaggagaccgagctgtacctgaacctcgaacgcatcccctggatagtgcggaagctcctccaggtaagcgagtccacaggcgtcgccctgaagcgcagcagttggctgatagtgctgttagtcctgttcaccgtttcattaagccccgtgcagtccgcgccaatcggttacgggaacaccattgagacttaccaggcacgcgaggaatacaccagcatctgcctcttcgttctgggctccatcctgttcatcgtcagctgcttaatgaaaggattagttgattccattggaaacatattcttccccgggctgacaatatgcaagacctgctcgatcggctccatcaacggcttcgagatcgaaagccacaagtgctactgctccctcctgtgttgcccgtactgccggcactgtagtgccgaccgcgagatacaccaacttcacctctctatatgcaaaaagcggaagaccgggagcaacgttatgctggccgtatgcaaacgcatgtgcttccgggccacgatggaggtatccaacaaagcgctcctcattcggagcatcatcaacaccaccttcgtggtctgcatcctgatcctggccgtctgcatcgtgtccactagcgccgtcgagatggagagcctccccgccggcacgtgggagcgggaggaggacctgactaacttctgccatcaggagtgtcaggtgaccgaaaccgagtgcttatgtccctatgaggcactcgtgctccgccggccgttgttcctcgattcgatcgtgaaagggatgaagaacccactgaacagcacgtcactggagacctctctctccattgaggctccttggggcgctatcaacgtgcagagcacctacaagccgaccgtgtccacggccaacatcgccctcagttggtccagcatcgagcaccgcgggaacaacatcctggtctccggtaggagcgagtccataatgaagctagaagaacgcaccggcattagcggggacctgggcgtcgaggacgcctctgagtccaagctgctcaccgtgtcagttatggacctgagccagatgtactcccccgtgttcgagtatctatccggggaccgccaggtggaagaatggccgaaggcgacctgcacgggcgactgccccgagcgatgcggctgcacctcatctacatgcctccacaaggagtggccccacagccgtaactggcgctgcaaccccacctggtgttggggcgtcggcaccgggtgcacgtgttgcggcctggacgtgaaggacctgtttatcgactacatgttcgtcaagtggaaagtggactacatcaagaccgaggccatcgtgtgcgtcgagctcacctcccaagagcgacagtgttctctggtcgaggccgggaccaggttcaacttagggccggtgaccatcaccctatccgagccccgaaacatccagcagaagctccctcccgagatcataaccctgcacccccgcatcgaggaggggttcttcgacctaatgcacgtccaaaaggtgttgagcgcctccacggtgtgtaagctgcaaagctgtacccacggggtacccggcgacctgcaggtctaccacatcgggaacctcctgaaaggcgataaagagaacgggcacctcatccacaagatcgaaccgcacttcaatacctcctggatgagctgggacggctgtgacttggactactactgcaacatgggagactggccgtcctgcacatacacgggggtaactcaacacaaccatgcgagcttcgtaaacctactaaacatcgaaaccgactacaccaagtccttccacttccactccaagcgggtgaccgcccacggcgacacgccccagctggacctgaaggccaggcccacttacggagccggagagatcaccgtgcttgttgaggtggccgacatggagctgcacacgaagaagatcgagatcacggggctaaagttcgcgtctctgacctgcaccggctgctacgcctgcagctccggcatcagttgcaaggtgcgcatccacgtggatgagccagatgagctgaccgtgcacgtgaagtccgacgaccccgacgtcgtcgccgccagctccagcttgatggcccggaagctcgagttcgggacggacagcaccttcaaggcgttctccgccatgcccaagacctccctgtgcttctacatcgtggaacgcgagtatcggaaatcatgctctaaggaggatacccagaagtgcgtcaacacgaagctggaacagccgcagtccatcttaatcgagcataaggggaccatcatcggaaaacaaaacaacacgtgcaccgctaaggccagctgctggttggaatccgtcaaatcctttttctacggcctgaagaatatgctctccggcatcttcggcaacgtgttcgtgggcatatttctattcctagcccccttcatcctgctcatcctgttcttcatgttcgggtggcgtatcctcagctgctttaagtgctgtcggcgcacacgtggcctcctgaagcacaggcatctgaaggacgatgaggagaccggctaccgccgcatcatcgagcggctgaacaacaagaagggcaagaataagctccttgacggcgagcgcctcgcagatcggcggatcgccgaactgttctccacgaagacccacataggttga

SEQ ID NO: 15298 - RNA, 5055 nt, synthetic construct
  misc_feature 1..5055: note = derived and/or modified CDS sequence (opt11) from CCHFV(K168_40)__KX013457.1__GP
  source 1..5055: mol_type = other RNA
atgcacatcagcctgatgtgcgctgtgctctgcctgcagctgtacggccttgggggcacccacgggctgcacaacggcacggagcacaacaagacgaacgccgtcaccacctccagcaactcccagagctccgaaagccccgcgagaaccgccccgcccgtgacgccagactcccctaccgtgaccccgactacgcccgcgtcggcccccgaggggtccggcgaggcccacagcagcccgcccaacaacaccgagggcccctccctgcccgagtccaccagcgagccccctgctgctacctccaccgggatccccagcgcctccgacgtcaacagctccacccaggccgcgcgcgataccagcacccccactgtgcgaacctcgcccccgaactccccctctacaccgcccacgccccaggaaacccatcaccccgtacggaacctcctgagtgtcacaagccataagccagaggagacctccgcccccagcgagtccggcaaggagagcccggccgccaactctccccaccccgtggccagccggcccccgacaccatccacgaccgcgcaggggcccaccgagaacaataactacaacacgacaggccagctggaatccctcacccagtccaccaccctggggccgatgacgagcctgacccagaccgacctcccccagtcggtgacatcaatcgccgtgcaggacacgcacccttcccccaccaaccgcagcaagcgcaacctggagatggagatcatcctgaccctcccgcagggactgaagaagtactacggcaaggtcctgcggctcctgcagctgaccctcgaggaggacaccgaggggttactggagtggtgcaagcgcaacttaggcctggactgcgacgacacgttcttccagaagcggatagaggagttcttcatcaccggggaagggcacttcaacgaggtgctgcagttccgcacccccggcaccctctccacgaccgagagcacccacgcggggctgcccaccgccgagcccttcaagagctacttcgccaagggctttctgtccatcgacagcgggtacttttccgcgaagtgctacagccggacgtccaacagcggcctccagctgattaacgtcacccgccactccacgcggatcgccgacaccccggggcccaagatcacgaacctgaagacgatcagctgcatcaacctcaaggcctccgtgttcaaggagcaccgggaggtggagatcaacgtcctgctgccccaggtggccgtgaacctcagcaactgccacgtcaccatcaagtcccacgtgtgcgactacagcctggacatcgatggcacggtgagactgccccacatccaccatgacggcacgttcatccccgggacctacaagatcgtcatcgaccgcaagaacaagctcaacgaccggtgcaccctgttcaccaactgcgtcatcaagggccgcgaagtgcggaaggggcagtccgtcctgcgccaatacaaaacggagatccggatcggcaaagcctccaccgggtcccggcgcctcctgagcgacgagtccggcgacgactgcatctcgcggactcagctgctccgcaccgagacggcggagatccacggcgacaactacgggggccccggcgacaagataactatctgcaatggcagcaccatcgtggaccagcgcctggggtccgagctgggctgctacaccatcaaccgcgtcaagagcttcaagctctgcgagaactccgccacgggcaagagctgtgaagtggactccatccccgtgaagtgccggcaggggtactgcctgaagatcacccaagaggggcgcgggcacgtcaagctgtcgcgtggctccgaggtggtactggacgcctgtgactcatcctgcgaggtcatgatccccaagggcaccggggacatcctcgtggactgcagcggcgggcaacagcacttccttaaggacaatctaatcgatctcgggtgcccgaagatccccctgctggggaagatggctatctacatatgccgcatgtccaaccaccccaagaccacgatggccttcctcttctggttcagcttcggctacgtgatcacttgcatcgtctgtaaggcgatcttctacctgctgatcatcgtgggcacccttgggaagcggtttaagcagtaccgcgagctgaagccccagacctgcacgatctgcgagacaaccccgacaaacgccatcgacgccgagatgcacgacctgaactgctcctacaacatttgcccctactgcgccagccggctcaccagtgacggcctggcgcgtcacgtgacgcactgccccaagcggaaggagaaagtagaggagaccgagctgtacctcaacctggagcgcatcccctgggtggtccgcaagctgctccaagtctcagagtccacgggggtggccctgaagcgcagctcctggctcatcgtgctccttgtactgttcgcggtaagcctcagcccggtgcagtccgcccccatcggccacgggaagaccatcgagacgtaccaggtccgtgaggagtacaccagcatctgcctgttcgtgcttggctccatcctcttcatcgtgagctgcctaatgaagggcctggtcaactccgtagggaacatcttcttccccggcctcagcatctgcaagacctgctcgatcgggtcaatcaacggcttcgagatcgagtcccacaagtgctactgcagcctgttatgctgcccgtactgccgccactgctccgcggaccgggagatccaccagctccatctgagcatctgcaagaagcgcaagaccgggagtaacgtaatgctggcggtatgcaagcgcatgtgcttcagagccactgtggaggtaagcaacaaggccctttccatccgcagcatcatcaacaccacgttcgtcgtgtgcatcctgatccttgccgtttgcgtggtgtccaccagcgccgtggagatggagtccctccccgcggggacgtgggagcgggaggaggacctgaccaacttctgccaccaggagtgccaggtgaccgagaccgagtgcctgtgcccctacgaggccctcgtgctgcgccggcccctgtttctcgacggcatcgtgaaagggatgaagaacctgctgaacagcacgagcctcgagacctccctgagcatcgaggccccgtggggcgccatcaacgtccagtccacctacaagcccaccgtgagcgccgcgaacatcgccctgtcctggagctccgtggagcatcgcgggaacaagatcctcgtcagcggcaggtccgagagcatcatgaagctcgaggagcgcacggggatctcctgggacctgggcgttgaggacgccagcgagtccaagctcctgaccgtgtcggtcatggacctgtcccagatgtactcgcccgtattcgagtacctctccggtgaccgtcaggtggaggagtggcccaaagcgacctgcaccggggactgcccggagcgctgcggctgcacgagctccacctgtctgcacaaggagtggccccacagccggaactggcgctgcaaccccacctggtgctggggagtcggcaccggctgcacgtgctgcgggctggacgtgaaggacctcttcaccgactacatgttcgtgaagtggaaggtcgagtacatcaaaaccgaagccatcgtatgcgtcgagctgacctctcaggagcggcagtgctccctgatcgaggccggcacgcgcttcaacctcgggccggtgaccatcacactgagcgagcctcggaacatccagcagaagctgccacccgagatcatcacgctccacccccgcatcgaggagggcttcttcgacctgatgcacgtgcagaaggtcctgtcagcaagcacggtgtgcaaactccagtcctgcacccacggggtgcccggcgatctgcaggtctaccacatcggcaacctgcttaagggggacaaggtgaatggccacctgatccacaagatagagccccacttcaacaccagctggatgtcctgggacgggtgcgacctggactactactgcaacatgggcgactggcccagctgcacctacaccggggtgacacaacacaaccacgcctccttcatcaacttactgaacatcgagacagactacaccaagagcttccacttccactccaagcgggtcaccgcccacggcgacactccacagctggacttaaaggcgcgcccgaactacggcgccggagagatcaccgtgctcgtcgaggtcgccgacatggagctgcacacaaagaagatcgagatcagcggcctcaagttcgcctccctgacctgcacggggtgctacgcctgcagctccggcatcagctgcaaggtgcggatccacgtggacgagcccgacgagctgaccgtccacgtgaagtccgacgaccccgacgtggtcgcggccagctccagcttgatggcccgcaagctggagttcgggaccgacagcacctttaaggccttttccgccatgcccaagacgtcgctgtgcttctacatcgtggagcgggagtactgcaagtcctgcagtaaggaggacacccagaagtgcgtgaacaccaagctcgagcacccgcagtccatcctgatcgagcataagggcaccatcatcggaaagcagaacaacacgtgcaccgcgaaaaccagctgctggctggagtccgtcaagagcttcttctacgggctcaagaacatgctatccggcatctttgggaacgtgttcgtgggtatcttcctgttccttgctcccttcattctgctgatcctgttcttcatgttcggctggcgcatcctcttctgtttcaagtgctgccgccggacccgcgggctgttccggtacaagcacctggaggacgacgaggagacgggctaccgccggatcatagagcgcctcaacaataaaaaggggaagaacaaacttctggacggcgaacggctcgccgacagacggattgccgagctgttcagcaccaagacccacatcgggtga

SEQ ID NO: 15299 - RNA, 5055 nt, synthetic construct
  misc_feature 1..5055: note = derived and/or modified CDS sequence (opt11) from CCHFV(K128_76)__KX013454.1__GP
  source 1..5055: mol_type = other RNA
atgcacatcagcttgatgtgtgccgtgctgtgcctgcagttgtacggcctcgggggcacccacgggtcccacaacgagacagagcacaacaagacaaacgccgtcaccaccagctccgacagccagtcccccgagccgcccacccgcacgaccctgcccgtgacccccgatagcccgaccgtaacgcccaccacgcccgcgtccgcgcccgaaggcagcggggaggtccacacctccccgcccaacaccaccgagggcccctcactgcccgagagtaccccggagccgcccaccgccactagcacgggcatcccctccgccagcgacgtgaactccagcacccaggccgcacgggacacctccaccccgaccgtgcacacctcaccgcccaactcccccagcacccctcccacgttgcaggagactcaccaccccatgcgcaatctgctgagcgtaaccagccacaagcccgaggagacctcagccccgtccgagtcagggaaggagtcccccgccgccaacagcccccaccccgtagctgacagaccgtccaccagctccaccaccgcccaggggcccaccgagaacaactcttataacacgaccgagcagctcgagtccctgacccagagcaccactttggggcccatgaccagtctcacccaaaccgtgctgagccagtccgtcacctctatcgccgtgcaggacacgcacctgtccccgaccaatcgaagcaaacggaacctcgagatggagatcattctgactctgccccagggcttgaagaagtactacggaaaggtgctccgcctgctccagttgaccctggaggaggacacggagggtctcctggagtggtgtaagcggaacctggacctcgattgcgacgacacgttcttccagaagcgcatcgaggagttcttcattacaggcgaggggtacttcaacgaggtcctgcaattccggacacccggcacgctgtccaccactgagagcacccacgccgggttacccactgccgagccgttcaagtcatacttcgcgaagggcttcctgtccatcgactctggctacttctccgccaagtgctacagccgcacctccaacagcgggctgcagctcatcaacgtgacccggcactccacccgcatcgccgacacgcccggccccaagatcacaaacctgaagaccatcagctgcatcaacctgaaggcctccgtgttcaaggagcaccgggaggtcgagatcaacgtgctcctcccccaggtggccgtcaacctgagcaactgccacgtgaccatcaagtcccatgtgtgcgactactctctcgacatcgacgggacggtcaagctgccgcacatccaccatgacggcaccttcatccccgggacctacaagatcgtaatcgaccgcaagaacaagttaaacgaccggtgcaccctattcacaaactgtgtgatcaagggccgcgaggtcaggaagggccagtccgttctgcgccagtacaagaccgagatccggatcgggaaggcgtccaccggctcccgccgactgctctcggacgagtccggggacgactgtatcagccgcacccagctactgcgcacggagactgccgagatacacggcgacaactacgggggccccggcgacaagatcaccatctgcaacgggagcaccatcgtcgaccaacggctcggctccgagctggggtgctacacgatcaaccgcgtcaagagcttcaagctgtgcgagaacagtgccaccggtaagagctgcgagatcgactccatcccggtgaagtgccggcaggggtactgcctgaagataacccaggagggccgcggccacgtgaagctcagccgggggtccgaggtggtgctggacgcctgcgacagctcctgcgaggtcatgattccgaagggcacgggggacatcctggtggactgcagcggcggccagcagcacttcctcaaggacaacctgatcgatctggggtgccccaagatcccactcctgggcaagatggccatctacatttgccgcatgtccaaccaccccaaaacgaccatggcgttcctgttctggttcagcttcgggtacgtgatcacgtgcatcgtctgcaaggccatcttctacctcctgatcatcgtcggcaccctggggaagcggttcaagcagtaccgcgagctcaagccgcaaacctgcacgatctgcgagaccacccccaccaacgccatcgacgcagagatgcacgacctgaactgctcctacaacatctgcccctactgcgccagtcggttgacttccgacggcctcgcgcgccacgtaacccactgccccaagcggaaggagaaggtcgaggaaaccgagctatacctgaacctcgagcgcatcccgtgggtcgtgcggaagctgctgcaggtcagcgagtccaccggcgtggccctcaagcgcagctcctggctgatcgtgctgttggtcctgttcgccgtgagcctgagccccgtgcagtccgcccccatctcacacgggaagacgatcgagacctaccaggtccgggaggagtacacctccatctgcctcttcgtgctggggagcatcctgttcatcgtgtcctgcctcatgaaggggctggtcaacagcgtgggcaacatcttcttccccgggctgtccatctgtaagacctgcagcatcggctccatcaacggcttcgagatcgagagccacaagtgctactgctccttactgtgctgcccgtactgcaggcactgctcagcggaccgggagatacaccagctgcacctctccatttgcaagaagcgcaagacggggagcaacgtgatgctggcagtctgtaagcgaatgtgcttccgcgccaccatggaggtgtccaacaaggccctgttcatccgaagcatcatcaacactaccttcgtggtctgtattctcatcctggccgtgtgcgtggtttccacgagcgcggtggagatggagtccctgcccgccggcacgtgggagcgggaggaggacctcaccaacttctgccaccaggagtgccaggtgaccgagacggagtgcctgtgcccctacgaagccctggtcctcagacggccgctgttccaagacagcatcgtgaaggggatgaagaacctgctaaacagcacctccttagagaccagcttgtccatcgaggccccctggggcgcgatcaacgtccagagcacctacaagccggcggtctccgccgccaacattgccctcagctggtccagcgtagagcaccgcgggtccaagatcctggtgagcgggcggtccgagagcatcatgaagctggaggagcgcacgggcatctcctgggacttgggggtcgaggacgccagcgagagcaagctgttaaccgtgagcgtgatggacctctcacagatgtacagccccgtcttcgagtatctgtccggtgaccgccaggtggaggagtggccgaaggcgacgtgcaccggggactgccccgagcgctgcggctgcacgagcagcacgtgccttcacaaggagtggccacactcccggaactggcggtgcaaccccacctggtgctggggtgtggggaccggctgcacctgttgcgggctcgacgtcaaggacctgttcaccgactacatgttcgtgaaatggaaggtggagtacataaagactgaggctatcgtctgcgtggagctgaccagccaggagcggcagtgttccctcatcgaggccggcacgcgcttcaacctggggccggtcacgatcaccctgagcgagccccgtaacatccagcaaaagctcccgcccgaaattatcaccctgcaccccagaatcgaggagggcttcttcgaccttatgcacgtgcagaaggtgctctccgccagcaccgtctgcaagctgcagtcctgcacgcacggcgtgcccggggacctccaggtgtaccacatcggtaacctgctgaagggagaccgggtcaacggtcacctcatccacaagatcgagccccacttcaataccagctggatgtcctgggacgggtgcgatctcgactactactgcaacatgggcgactggcccagctgcacgtacaccggcgtgacgcaacacaaccacgcgtccttcgtgaacctgctaaacatagagaccgactacaccaagagcttccacttccactccaaacgcgtgaccgcccacggggacacgccgcagctcgacctgaaggcccggcccaactacggcgccggggagatcaccgtgctagtggaggtagccgatatggagctccacaccaagaagattgagatcagcgggctgaaattcgcgtccctgacctgcacggggtgctacgcctgctcatccggcatcagctgcaaggtgcgcatccacgtggacgagcccgacgagctcaccgtccacgtgaagtccgacgacccagacgtggtggccgccagcagctcactgatggcccggaagctggagttcggcaccgacagcaccttcaaggcgttctccgccatgccgaagacgagcctctgcttctacatcgtggagcgcgagtactgtaagtcctgcagcaaggaggatacccagaagtgcgtgaacaccaagctggagcagccccagtctatcctgatcgagcacaaggggaccatcatcggcaagcagaacaacacctgtaccgccaagaccagctgctggctcgagtccgtcaagagcttcttctacggtctaaagaatatgctttccggcatcttcgggaacgtgttcgtcggcatcttcctcttcctggcccccttcatcctgctgatcctcttcttcatgttcggctggcggatcctgttctgcttcaaatgctgccgccgcacgcgggggctgttccgctacaagcacctagagaacgacgaggagacgggctacaggaggatcatcgagcggctgaacaacaagaaggggaagaacaaacttttggacggcgagcgcctggccgaccggcgcatcgcggagctgttctccaccaagacccacatcggctga

SEQ ID NO: 15300 - RNA, 5055 nt, synthetic construct
  misc_feature 1..5055: note = derived and/or modified CDS sequence (opt11) from CCHFV(K168_125)__KX013460.1__GP
  source 1..5055: mol_type = other RNA
atgcacatctcactgatgtgcgccgtgctctgccttcagctgtacggcctcggcgggacccacgggttgcacaacgggaccgagcacaacaagacgaacgcggtcactacctccagcaactcccagagctccgagagccccgcgcggaccgccccacccgtgacaccggattcccccaccgtgaccccgaccacgcctgcctccgcccccgaggggagtggcgaggctcacagctccccgcccaacaacaccgagggccccagcctgcccgagtcaacaagcgagccccctgcagccacctccacggggatccccagcgcgtccgacgtcaacagctcgacccaagcggcgcgggacaccagcacccccacggtgcggaccagcccaccgaactccccctctactccgcccaccccgcaggagacgcaccaccccgtgcgaaatctcctgtccgtcaccagccacaagccggaggagacaagtgccccctcggagtccggcaaagagagcccggccgccaacagcccccaccccgtggccagccggcccccgaccccctccacgaccgcgcagggcccaacggagaacaacaactacaacaccacgggccagcttgagagcctaacacagtccaccaccctgggtccaatgacaagcctgacccagaccgacctcccccagtccgtgaccagcattgccgtccaggacacgcacccctcccccaccaaccgctcgaagcgcaacctggagatggaaatcatcctgaccctcccacagggcttaaagaagtactacggcaaggtgttacggctgctgcagctgaccctcgaggaggacaccgaggggctgctggagtggtgcaagcgcaacctcggcctggactgcgacgacaccttcttccagaagcggatcgaggagtttttcatcaccggggagggccacttcaatgaggtgctgcagttccgcacccccgggaccctgtccactacagagagcacccatgccggccttcccaccgccgagcccttcaagagctactttgccaagggcttcctgtccatcgacagcgggtacttctccgcgaagtgctacagccggacgtccaacagcggcctccagctgatcaacgtcacccgccattccacacggatcgccgacaccccggggctgaagatcacgaacctcaagaccatcagctgcatcaacctgaaggcctccgtgttcaaggagcaccgcgaggtagagatcaacgtcctgctcccccaggtggccgtgaacctgagcaactgccatgtcaccatcaagtcccacgtgtgcgactacagcctggacatcgacggcaccgtacggctcccccacatccaccacgacggcacgttcatccccgggacctacaagatcgtcatcgaccgcaagaacaagctgaacgaccggtgcaccctgttcacgaactgcgtgatcaagggcagagaagtgcggaaggggcagtctgtcctccgtcagtacaagacggagatccggatcggcaaggcctccaccgggtcccgcaggctgctgagcgacgagtccggcgacgactgcatctcacggacccagctactgcgcaccgagacggcggagatacacggcgacaactacgggggcccgggggacaagatcactatctgcaacggcagcaccatcgtggaccagcggctggggtccgagctcgggtgctacaccatcaaccgcgtaaaatccttcaagctgtgcgagaactccgccactggcaaaagttgcgaagtggactccatccccgtgaagtgccggcaggggtactgccttaagatcacccaggagggccgcgggcacgtcaagctgagccggggctccgaggtggtgctcgacgcctgtgacagctcatgcgaggtcatgatcccaaagggcaccggggacattctggtggattgcagcggcgggcagcagcacttcttaaaggacaacctcatcgacttaggctgccccaaggtgccgctgctcgggaagatggccatatacatctgccgcatgtccaatcaccccaagaccacgatggcattcctgttctggttctcgttcggctacgtcataacctgcatcgtttgcaaggcgatcttctacctgctcatcatcgtgggtaccctgggtaagcggttcaaacagtaccgcgagctgaagccccagacctgcacgatttgcgagaccacccccaccaacgccatcgacgccgagatgcacgatctcaactgctcctacaacatctgcccgtactgcgccagccggctgaccagcgacggcctggcgcgtcacgttacgcactgccccaagcggaaggagaaggtggaggagaccgagctctacctgaacctggagcggatcccctgggtggtgcggaagctcctccaggtgtcagagtccaccggggtggcactgaagcgaagctcctggctcatcgtactcctggtgctgttcgccgtgagtctgagccccgtgcagtccgccccgatcggccacgggaagaccatcgagacttatcaggtgcgtgaggagtacacgagcatctgcctgttcgtgctcggctccatcctgttcatcgtcagctgcctgatgaagggcctcgtcaactccgtggggaacatcttcttccccggcttaagcatctgcaagacctgctccatcgggagcatcaacggctttgaaatagagtcccacaagtgctactgcagcctgctctgctgcccctactgccgccactgctccgccgaccgggagatccaccagctgcacctgagcatctgcaagaaacgcaagaccggatccaacgtcatgttggcggtgtgcaagcgcatgtgcttccgggccacggtggaggtctccaacaaggccctgtccatccgcagcatcatcaacaccaccttcgtggtttgcatcctgatcctggcagtatgcgtggtgtccaccagcgccgtcgagatggagtccctgccggcgggcacgtgggagcgggaggaggacctgactaacttctgtcaccaggagtgccaagtgaccgagaccgagtgcctctgcccctacgaggctctggtgctgcgccggcccctcttcctcgacagcatcgtgaagggtaagaagaacctgctcaacagcacgtccctggagaccagcctgtccatcgaggccccttggggtgccataaacgtgcagagcacgtacaagccgaccgtgagtgcggcgaacatcgccctcagctggtccagcgtcgaacaccgcgggaacaagatcctggtctccgggcggagcgagtccatcatgaagctggaggagcgcaccggcataagctgggacctcggggtggaggacgcctccgagagcaaactgctgaccgtctccgtgatggacctcagccagatgtattcccccgtgttcgagtacctgagcggcgacagacaggtcgaggagtggcccaaggcgacctgcaccggcgactgccccgagcgctgcgggtgcacttccagcacatgcctgcacaaggagtggccgcatagccggaattggcgctgcaaccccacctggtgctggggcgtggggaccggctgcacgtgctgcggccttgacgtgaaggacctgttcaccgactacatgttcgtcaagtggaaggtggagtacattaagaccgaggccatcgtctgcgtcgagctgacctcccaggagcggcagtgctcgctcatcgaggccgggacccgctttaacctgggccccgtgacaatcaccctgtccgagccccggaacatccagcagaagctcccgcccgagatcatcaccctgcacccccgcatcgaggaggggttcttcgacctgatgcacgtccagaaggtgctcagcgcctccacggtgtgcaagctgcagagctgtacccacggcgtccctggagatctccaggtgtaccacatcggcaacctgctgaagggcgacaaggtgaacgggcacctcatccacaagatcgaaccgcacttcaacacctcctggatgagctgggacggctgcgacctcgactactactgcaacatgggggactggccctcctgcacctacaccggcgtcacgcagcacaaccacgcgagcttcatcaacctgctgaacatcgagaccgactataccaagagcttccactttcacagcaagcgggtcaccgcccatggagacacaccccagctggacctgaaagctcgccccaactacggcgccggcgaaatcaccgtgcttgtcgaggtggccgacatggagctccacaccaagaagatcgagatctccgggctgaagttcgcctcgctgacctgcacgggctgctacgcctgctcctctgggatctcctgcaaggtccggatccacgtcgacgagccggacgaactcacggtgcacgtcaagagcgacgaccccgacgtggtagcagcctcctcaagcctgatggcccgcaagctggagttcggcaccgactccaccttcaaggccttcagcgccatgcccaagacgtcgctctgcttctacatcgtggagcgagaatactgcaagagctgctccaaggaagacacccagaagtgcgtaaacaccaagctggagcacccccagagcatcctgatcgagcacaagggtacaatcatcggcaagcagaacaacacgtgcaccgcaaagacctcctgctggctcgagagcgtgaagtccttcttctacggcctgaagaacatgctgagtggtatcttcggcaacgtgttcgtcgggatcttcctcttcctggcccccttcatcctgctgatccttttcttcatgttcggctggcggattctgttctgtttcaaatgctgccgccggacccgcggactgttccggtacaagcacctcgaggacgacgaggagacgggataccgccggatcatcgagcgcctgaacaacaagaagggcaagaacaagctgctcgatggagagcggttagccgaccgccggatcgccgagctgttctccaccaagacccacatcggctga

SEQ ID NO: 15301 - RNA, 5052 nt, synthetic construct
  misc_feature 1..5052: note = derived and/or modified CDS sequence (opt11) from CCHFV(Kosova Hoti)__EU037902.1__GP
  source 1..5052: mol_type = other RNA
atgcacaccctgctcgtgtgcttcatcctgtacctgcagctccttggcctcgggggcgcacacgggcaaagcaacgccacggagcacaacggcacgaacaccaccaccgcgcccgggacgtcccagagcccgaagccgcccgcctccaccacccccagccacgcccccgagccctccaccatcaagctcacgacccccacaagcgagaccgagggctccggcgagacgacgccaccgaccaacaccacgcaggacagcccgcccctggagacgacccccgagcgctccgctaccacggccacaagcacctccgggaccgacaatatgaacagcacgacccagatgaccgacaatacccccacgtccaccgtcagcacctccctgagctccagcccctccaccccaagcacgagccaaggcatgcaccaccccgtgcggtccctcctgtctgtgtcgagcccgaaaacagcgaccacccccacgcccatgtcccccggggagatgagctccgagaccagctcccagcacagcgccatgtcccgcaccccgacgccccacaccgccacccaggtcagcaccgagaatgccaaccggtccaccagccgccagtcagagagctccgcacagcccgccacccagagccccgtgacgtccccggcccagagcatcctgcttatgagcgccacccccaccacaatccagaacatccacccctcccccactaaccgtagcaagcgcaacctagagatggagatcatcctgaccctctcccagggcctgaagaaatactacggtaagatcctgaaacttctgcacctgaccctcgaggaggacaccgagggtctgctggagtggtgcaagcggaacctcggcagcaactgcgacgacgacttcttccagaagcgcatcgaggagttcttcatcacgggggagggctacttcaacgaggtgctgcagttcaagaccctgtccaccccgtcctccaccgagccgagccacgcccgcctccccacggcggagccgttcaagtcctacttcgccaaggggttcctgagcatcgacagcggctacttcagcgccaagtgctacccccgctccagcacctccggcctgcagctcatcaacgtcacccagcaccccgcccgtatcgccgagacccccgggccgaagacgaccagcctgaagaccatcaactgcatcaacctgcgcgcgtccgtgttcaaggagcaccgggaggtggagatcaacgtcctcctgccccagatcgccgtgaacctgagcaactgtcacgtggtcatcaacagccacgtgtgcgactactccctcgacaccgacggccccgtgagactgcccaggatctaccacgaggggacgttcatgccgggcacctacaagatagtcatcgaccgcaagaacaagctgaacgaccggtgcaccctcgtgaccaactgcgtgatcaaggggcgcgaggtccggaagggccagagcgtgctgcgccagtacaagacggagatcaagatcggcaaggcccccactgggtcccggaagctgctcagcgaggagcccggcgacgactgcatctcccgcacccagctgctgcgcaccgagacggccgaaatccacgacgacaactacgggggccccggggacaagatcaccatttgcaacggcagcaccatcgtggaccagcggctcggctccgagctggggtgctacaccatcaaccgtgtcaagagcttcaagctgtgcgagaactccgccacgggcaagacctgcgagatcgacagcaccccggtgaagtgccggcaggggttctgcctcaagatcacccagaagggccgcgggcacgtgaagctgtcccggggcagcgaggtcgtgctggacgcctgcgactccaactgcgaggtcatgatccccaagggcaccggggacatcctggtggactgcagcggcgggcagcagcacttcctcaaggataacctgatcgacctgggctgcccccacatccccctcctgggcaagatggccatctacatctgccgcatgtccaaccatccgaagacaaccatggccttcctgttctggttcagcttcgggtacgtgataacctgcatcttctgcaaggccctcttctactccctgatcatcatcggcaccctggggaagaagatcaagcagtaccgggagctcaagccccagacgtgcaccatctgcgagaccgcccccgtgaacgctatcgacgccgagatgcacgacctgaactgcagctacaacatctgcccctactgcgcctcccgcctgaccagcgatggcctcgcccggcacgtgaagcagtgcccgaagcgcaaggagaaggtggaggagacggagctgtacctgaacctcgagcggatcccctgggtcgtgcgcaagctgctgcaggtaagcgagtccaccggggtcgcgctcaagcggagctcctggctgatcgtgctgctcgtgctgctgaccgtcagcctctcccccgtgcagagcgcccctgtgggccacggcaagaccatcgagacgtaccagacccgcgaggggttcacctccatctgcctcttcatgctgggcagcatcctcttcatcgtatcctgcctggtgaaggggttggtggacagcgtctccgacagcttcttcccgggcctctccgtgtgcaagacctgcagcatcgggtccatcaacggcttcgagatcgagagccacaagtgctactgctccctgttctgctgcccctactgccggcactgcagcgccgaccgcgaaatccaccagctgcacctcaacatctgcaagaagcggaagacgggctccaacgtgatgctggccgtctgcaagcgcatgtgcttccgggccaccatcgaggcgagccgccgcgccctgctgatccggagcatcatcaacaccaccttcgtgatctgcatcctgacgctgaccatctgcgtggtctccaccagcgccgtggagatggagaacctacccgccgggacttgggaacgcgaggaggacctgacgaacttctgtcaccaggagtgccaggtgaccgagaccgagtgcctgtgcccgtatgaggccctcgtcctgagaaagcctctgttcctcgactccatcgtgaagggcatgaagaacctgctgaacagcacctccctcgagacgagcctgtcgatcgaggcgccctggggcgccatcaacgtgcagagcaccttcaagcccaccgtctccaccgccaacatcgccctgagctggtccagcgtggagcacagggggaacaagatcctcgtgacggggcgttccgagagcatcatgaagttagaggagcgcaccggcatctcctgggacctgggcgtcgaggacgccagcgagtccaagctcctgaccgtgagcatcatggacctgtcccagatgtacagcccggtgttcgagtacctcagcggggaccgccaggtcgaggagtggcccaaggcgacctgcacgggcgactgcccccagcgctgcgggtgcacctccagcacgtgcctgcacaaggagtggccccactcccggaactggcgctgcaacccgacctggtgctggggcgtggggaccggatgtacctgctgcggcgtggacgttaaggacctgttcaccgaccacatgttcgtgaagtggaaggtggagtacatcaagaccgaggccatcgtctgcgtggagctcaccagccaggagcggcagtgctccctgatcgaggccgggacgagattcaacctgggccccgtcaccatcaccctcagcgagccccggaacatccagcagaagctgcccccggagatcataaccctgcaccccaagatcgaggaggggttcttcgacctcatgcacgtccagaaggtgctatccgccagcacggtgtgcaagctgcagtcgtgcacccacggcatccccggtgacctccaggtctaccacatagggaacctgctgaagggcgaccgcgtgaacgggcacctcatccacaagatcgagccccacttcaacaccagctggatgtcttgggacggctgcgacctggactactactgcaacatgggggactggccgagctgcacctatacgggcgtgacccagcacaaccacgcggccttcgtcaacctgctcaacatcgagaccgactacaccaagacgttccatttccactccaagcgggtgaccgcccacggcgacacgccccagctggacctgaaggcgcgcccaacctacggggcgggcgagatcacggtcctcgtggaagtggcggacatggagctgcacaccaagaaggtcgagataagcgggctgaagttcgcctccctcgcctgcaccggctgctacgcctgcagctccgggatcagctgtaaggtgcggatacacgtggacgagccagacgagctaaccgtccacgtgaagtccagcgacccggacgtggtcgccgcgggcacgagcctgatggcccgcaaactcgagttcggcaccgactccacctttaaggccttcagcgccatgcccaagacctccctgtgcttctacatcgtggagaaggagtactgcaagtcctgctccgaggacgacacgaagaagtgcgtggacaccaagctggagcagccccagagcatcctcatcgagcaccgggggaccatcatcggcaagcagaacgatacctgcacggccaaggcatcctgctggctggagtcggtcaagtccttcttctacgggctgaaaaacatgctcggcagcgtgttcgggaacttcttcatcggcatcctgctgttcctcgctcccttcgtgctgctggtcctgttcttcatgttcggctggaagatcctcttctgcttcaagtgctgccgccggacccgcgggctgttcaaataccgccacctgaaggacgacgaggagaccggctaccggcgcatcatcgagcggctcaacaacaagaaggggaagaaccgcctgctggacggcgagcggctcgccgaccgcaagatcgccgagttattctccaccaagacgcacatcggctga

SEQ ID NO: 15302 - RNA, 5049 nt, synthetic construct
  misc_feature 1..5049: note = derived and/or modified CDS sequence (opt11) from CCHFV(Oman)__DQ211632.1__GP
  source 1..5049: mol_type = other RNA
atgcacaccttactcgtgtacgccgtcttctgcttgcagctatggtctcccggcgggacccgcggcctctcaaatgagacgcagcataacgagacagggatcacccgggccccggagggcagccagggcccctccctgcctgtgagtaccgcgagccccataatgagcgacccgtccatcactacccccagcgccagcaccagcggcctggaaggaagcggggacacgacgccacccgccattacccagggccctaccccgcccgagaccacgcccgagcccagcaccaccaccggaacaaacgccttctccaccgcaatcgccaacgtcagcacccaaaccgtcaaggacacgccaacccccactgtgcagacctccccgccgagcacgcccgacgcgtccaccatcccccagggcacacaccacaccgctcgagggctcctaagcgtgaccgtcaccaagcccgaagaggtgccgaccccgaccggccccgagcaagcctccatcgagacgaactcgccccggctggcgacctctaagactccgtcccccagcccaacggcccaagtgacgaccgagaacagcaaccccaacacctctcgccagctcgtcctgtccacccagccggccaccagctccccagttacgagcccggcccagttaatcttcgtgcagagtgccaccaccgtcgcggtgcaggacgcgcacccgagccccacaaaccgttccaagcgcaacctcgaaatggaggtaatactgacgctgtcgcagggcctccggaagtactacgggcgcatccttaagctgctcgacctgacgcttgaagaggataccgagggcctccttgagtggtgcaagcgaaacctggggctcacgtgcgacgacaacttcttccagaaacgcatcgaggagttcttcctgacgggcgagggccacttcaacgaagtcctgcagttcaagacaccctccaccctctcttccaccgaaagcgcctcagtcgggctgcccacggtggagccgttcaaatcttacttcgccaaaggcttcttgtctatcgacagcgggtacttctcagccaagtgctaccccagagcgtccaacagcggtctccagctgatcaatgtgacccagcactccgcccgcatcgccgacacccccggtcccaagatcaccaaccttaagacgataaactgcatcaaccttaaggccctggtgttcaaggaacatcgggagatcgagatcaacgtcttactcccccaagtcgccgtgaacttatctaactgccatgtgcacatcaagtctcacgtctgcgattacagcctggacattgatggcaccgtccgactcccccggatccaccacgagggcacctttatccccgggacctacaagatcgtgatcgacaagaagaataagcagaacgaccgctgtaacctggtgacgaactgcgtgattaagggcagggaggtccgaaaggggcaatccgttctgcgccagtaccgcaccgagatacggatcgggaaggccagctccgggagccgcaggctgcttagtgaggagtcaggcgaagactgcatttcacgaacccaactgctccgtaccgagactgccgagatccacggcgacaattacgggggtcctggggacaaaatcaccatctgcaacggtagcaccatcgtggaccagcggctggggtccgagctgggctgctacaccatcaaccgcgtcaagagcttcaagctctgtgagaactcagccacaggcaagtcgtgtgagattgacaacaccccggtgaagtgcaagcaaggattctgcctgaaaatcacccaggagggccgggggcacgtcaagctgagccgcgactccgaggtagtgctggacgcgtgcgacagctcctgcgagatcatgattccaaaaggcaccggcgatatcctcgtcgactgctcgggaggccagcagcacttcctgaaggacaacctgatcgacctaggctgccccaacatacccctgctaggcaagatggccatctacatctgccggatgagtaaccacccgaagacgaccatggcgtttctcttctggttctccttcgggtacgtcatcacgtgcatcctgtgcaaagtgatcttctacttactcatcgtagtcggcaccctgggcaagaagttcaaacagtacagagaactgaagccccagacctgcacaatctgcgagacaacgcccgtgaatgccatcgacgccgagatgcacgacctcaactgcagttacaacatttgcccctactgtgctagccggctgacctccgacggtctggcgcgccacgtgatgcagtgtccgaagcggaaggagaagatcgaggagacggagctctaccttaacctagagcgcatcccctgggtcgttaggaagctcctccaggtgagcgaatccactggagtagccttgaagcggagctcctggctcatcgtactgttagtgctcctgaccgttagcctgagccccgtgcagtccgccccaatcgggcacggcaagaccatcgagacttatcagacacgggagggatacacctccatctgcctcttcgtgctgggctccatcctgttcatcgtctcacacctcatgaagggcctggtggattcggtagggaacagcttcttcccgggtctgagtatctgcaagacctgtagtatcgggtccatcaacggcttcgagattgagagccacaagtgtttttgctccctcttctgctgcccttattgtagacactgcagcgccgacaaggagatccacaagctgcacctgtcaatttgtaagaagcggaaggctgggagtaacgtcatgctcgcggtgtgcaagcgaatgtgcttccgggccacgatggaggtgtccaacaaagccctgctgatccgcagcgtcatcaataccactttcgttgtgtgcatcctcatcctggctgtctgcgtcgtgtccactagcgccgtcgagatggagtccctccccgcgggcacgtgggagcgcgaggaggacctcacgaacttttgccatcaagagtgccaggtgaccgagaccgaatgcctgtgcccatacgaagccctggtactccggaaacccctgttcctggatagcattgccaagggtatgaagaatcttctaaactccacgtcgctggaaacctccttaagcatcgaggccccctggggcgccattaacgtccagtcaaccttcaagccgaccgtgtcgaccgccaacatcgccctgtcatggtctagcgtggaacacagagggaacaagatcctggtctccgggcggagcgagtccatcatgaagctcgaggagagaaccggtatcagctgggatctgggggtggaggacgcctccgagagcaagttgcttaccgtgtccgtcatggatctgagccagatgtactcccctgtattcgagtacctaagcggggaccgccaggtagaggagtggccgaaggcgacctgcacaggagactgccccgagcggtgcgggtgcaccagcagcacgtgcctccacaaggagtggccccacagccggaactggcggtgtaaccccacctggtgctggggcgtcgggaccggctgcacgtgttgcggcctggacgtgaaggacctgttcacggactacatgttcgtgaagtggaaggtggagtatatcaagaccgaggccatcgtgtgcgtcgagctcaccagccaggagcggcagtgctccttaatcgaggccgggacccgctttaacctgggccccgtgaccatcaccctcagcgagccccgcaacatccagcagaagctgccaccggagatcgtgacgctgcacccccgcatcgaggagggcttcttcgacctcatgcacgttcagaaggtgttgtccgcctccaccgtatgtaagctgcagagctgcacccacggcgtccccggggacctccaggtgtaccatattggcaacctgctgaagggcgataaggtgaacgggcacttaatacataaggttgagccacacttcaacaccagctggatgagctgggacggctgcgatctggactactactgcaacatgggggactggccgtcttgcacctacacgggcgtgacccagcacaaccacgctgcctttgtcaacctgctcaacatcgaaacagactatacgaagaactttcacttccacagcaagcgggtcacggcgcatggggacacccctcagctggacttgaaggcacgccccaattacggcgccggcgaagtgactgtgctcgtcgaggtggccgacatggagcttcacaccaagaaaatcgagatctctgggctgaagttcgcatccttaacgtgcaccggctgctacgcatgctccagcgggatcagctgcaaggtacggatccacgtcgacgaacccgatgagcttaccgttcacgtcaagtccgaagaccccgacatagtggccgcctccagctccctgatggcgcgcaagctcgagttcggcaccgacagcacttttaaagccttctccgcgatgcccaaaactagcctttgtttctacatcgtggagcgcgagtactgcaagtcctgcagcaaagaagacacccaaaagtgcgtgaatgccaagctggagcgcccccagagtatactcatagagcataaggggacgatcatcggtaagcaaaacgacacgtgcaccgccaaagccagctgctggctggaatcggtcaagagcttcttttacggcctgaaaaacatgctcagcgggatctttggaaacgtattcatcgggatctttctgttcctggcgcccttcatactgctgatcctgttcttcatgttcgggtggcggatcctgttctgcttcaagtgctgtcgacgcacccgaggtctcttcaagtaccgccacctgaaggacgacgaggagaccgggtaccgaaagatcatcgagcgcctgaacaacaagaagggcaagaacaagctcctggacggggagcgcctggccgaccgcaaaatcgctgagctttttagcaccaaaacccacatcggctga

SEQ ID NO: 15303 - RNA, 5049 nt, synthetic construct
  misc_feature 1..5049: note = derived and/or modified CDS sequence (opt11) from CCHFV(Oman_812956)__KY362518.1__GP
  source 1..5049: mol_type = other RNA
atgcacaccctgctcgtgtacgccgtgttctgcctgcagctgtggagccccggcgggacccgcggcctatccaacgagacgcagcacaacgagaccggcatcacccgggccccggagggcagccaggggccctccctgcccgtgagcaccgcgtcccccatcatgagcgacccgtccatcacgaccctgagcgcctccaccagcggcctcgagggctccggggacaccactccacccgccatcacccagggccccaccctgccggagaccacgcccgagcccagcaccaccaccgggacgaacgccttctccaccgccatcgcgaacgtgtcgacccagaccgtcaaggacacgcccaccccgaccgtgcagacctccccgcccagcacgcccgacgcctccaccatcccgcaaggtacacaccacaccgcccgcgggctcctcagcgtgacggtcaccaagcccgaggaggtgcccaccccaaccggcccggagcaggcctccatcgagacgaacagcccccggctggcgaccagcaagaccccctcccccagcccgaccgcccaggtgacgaccgagaactccaaccccaacaccagccgccagctggtcctctccactcagcccgccaccagctcccccgtgacgagccccgcccagctgaacttcgtgcagtcggccacaaccatcgcggtccaggacgcccaccccagccccaccaaccggtccaagcgcaacctggagatggaggtgattctcacgctgagccagggcctgcggaagtactacgggcgcatactcaagctgctggacctcaccctggaggaggacaccgagggcctgttggagtggtgcaagcggaacttagggctgacctgcgacgacaacttcttccagaagcgcatcgaggagttcttcctcacgggcgagggtcacttcaacgaggtgctgcagttcaagaccccgtccaccctgagccccaccgagtccgccagcgtcggtctgcccacggtggagcccttcaagtcctacttcgccaagggcttcctgagcatcgattccgggtacttcagcgccaagtgctacccgcgggcgagcaattccggcctgcagctcatcaacgtgacccagcacagcgcccgcatcgccgacactcctgggcccaagatcaccaacctgaagacgatcaactgcatcaacctgaaggccctcgtgttcaaggaacaccgggagatcgagatcaacgtgctgctcccccaggtggccgtcaacctttccaactgccacgtgcacatcaagagccacgtgtgcgattactccctggacatcgacggcaccgtccgcctgccgcggatccaccacgagggcaccttcatccccgggacctacaagatcgtgatcgacaagaagaacaagcagaacgaccgctgtaacctcgtcacgaactgtgtgatcaagggccgggaggtccgcaaggggcagagcgtcctgcggcagtaccgcacggagatccggatcggcaaggcgtccagcggttcccgccgcctgctcagcgaggagtccggcgaggactgcattagccggacccagctgctgcggaccgagacggccgagatccacggcgacaactacgggggccccggggacaagatcaccatctgtaacggttccaccatcgtggaccagcggctcggctctgagctgggctgctacaccatcaaccgcgtgaaatccttcaagctgtgcgagaacagcgccacgggcaagtcctgcgagatcgacaacacccccgtcaagtgcaagcaggggttctgcctgaagatcacccaggaaggccgggggcacgtgaagctcagccgcgacagcgaggtggtcctggacgcctgcgactccagctgcgagatcatgatcccaaagggcaccggcgacatcctggtggactgctccgggggccagcagcacttcctcaaggacaacctgatcgacctggggtgccccaacatccccctcctaggtaagatggccatctacatctgccggatgagcaaccaccccaagacgaccatggctttcctgttctggttctccttcgggtacgtgatcacgtgcatcctctgcaaggtcatcttctacctgctgatcgtggtgggcacccttggcaagaagttcaagcagtaccgcgaactgaagccgcagacctgcaccatctgcgagacaacccccgtcaacgccatcgacgccgagatgcacgacctgaactgcagctacaacatctgcccctactgcgcgtccagactcactagcgacgggctggcgagacacgtgatgcagtgccccaagcggaaggagaagatcgaggagacggagctgtacctcaatctggagcgcatcccgtgggtggtccggaagttactccaggtgtccgagagcaccggcgtggccctgaagcgctccagctggctgatcgtcctcctggtgctgctcaccgtgtccctgtcacccgtccagtccgcacccatcgggcacggcaagaccatcgagacgtaccagacccgggaggggtacaccagcatttgcctgttcgtgctcggctcaatcctgttcatcgtgagccacctgatgaagggcctcgtcgactccgtggggaacagcttcttccccggcctgagcatctgcaagacctgctccatcggtagcataaacggcttcgagatcgagtcccacaagtgctactgcagcctgttctgctgcccgtactgccgccactgctccgccgacaaggagatccacaagctccacctgagcatctgcaagaagcggaaggccgggtccaacgtgatgctggcggtctgcaagcgcatgtgcttccgggccacgatggaggtgagcaacaaggccctcctgatccgctccgtgatcaacaccaccttcgtcgtgtgcatcctgatcctcgccgtgtgcgtagtgagcacatccgccgtggagatggagagcctgcccgcgggcacgtgggagcgcgaggaggacctgaccaacttctgccaccaggagtgccaggtcaccgagaccgagtgcctctgcccctacgaagccctggtgctgcggaagcccctcttcttcgactccatcgccaagggcatgaagaacctgctgaacagcacctccctcgagacctcgctctccatcgaggccccctggggcgccatcaacgtgcagagcaccttcaagcccaccgtctccacggcgaacatcgccctgagctggagctccgtggagcaccgcgggaacaagatcctcgtgagcgggcggtccgagagcatcatgaagctggaggagcgcaccggcatctcctgggacctgggggtcgaggacgccagcgagtccaagctcctgaccgtgagcgtgatggacctgtcccagatgtacagccccgtcttcgagtacctctccggcgaccgccaggtggaggagtggccgaaggcgacctgcacgggcgactgccccgagcggtgcgggtgcaccagctccacctgtctgcacaaggagtggccccacagccggaactggcgctgcaaccccacctggtgctggggcgtggggaccggctgcacgtgctgcggcctggacgtcaaggatttgttcaccgactacatgttcgtgaagtggaaggtcgagtacatcaagaccgaggccatcgtgtgcgtggagctgacctcccaggaacggcagtgcagcctgatcgaagccgggacccgcttcaacctcggcccggtcaccatcaccctgtccgagccccggaacatccaacagaagctgccgcccgagatcgtgacgctccacccccgcatcgaagaggggttcttcgacctgatgcacgtgcagaaggtcctgagcgcctccacagtgtgcaagctccagagctgcacccacggcgtgcccggagacctgcaggtctatcacatcggcaacctgctcaagggcgacaaggtgaacgggcacctgatccataaggtggagccccacttcaacaccagctggatgtcctgggacggctgcgacctggactactactgcaacatgggggactggcccagctgtacctacacgggcgtcacccagcacaaccacgccgccttcgtgaatctcctgaacatcgagaccgactacaccaagaactttcacttccactccaagcgggtgacggcgcacggggacaccccgcagctggacctcaaggcccgccccaactacggcgccggcgagatcaccgtcctggtggaggtggcggacatggagctgcacaccaagaagatcgaaattagtgggctcaagttcgcctccttaacgtgcaccggctgctacgcgtgcagctccgggatcagctgcaaggtccggatccacgtggacgagcccgacgagctgaccgtgcacgtcaagtccgaggaccccgacatcgtggccgccagctccagcctcatggcccgcaagctggagttcggcaccgactccacgtttaaggccttcagcgcgatgccgaagacatccctgtgcttctacatcgtggagcgggagtactgcaagagctgctccaaggaggatacccagaagtgtgtcaacgccaagctcgagcgcccccagagcatcctgatagagcacaaggggaccatcatcggcaagcagaacgacacgtgcaccgccaaggcctcctgctggctggagagcgtcaagagcttcttctacggcctcaagaacatgctgtccgggatcttcggcaacgtgttcatcgggatcttccttttcctggcgcccttcatcctcctgatcctgttcttcatgttcggctggcggatcctcttctgtttcaagtgctgccgccggacccgcggcctattcaagtaccgccacctgaaggacgacgaggagaccgggtaccggaagatcatcgagcgcctcaacaacaagaaaggcaagaacaagctcctggacggggagcggctcgccgaccgcaagatcgccgagctgttcagcacgaagacccacatcggctga

SEQ ID NO: 15304 - RNA, 5049 nt, synthetic construct
  misc_feature 1..5049: note = derived and/or modified CDS sequence (opt11) from CCHFV(Oman-199809166)__KR864901.1__GP
  source 1..5049: mol_type = other RNA
atgcacacactgctcgtgtacgccgtattctgtctgcagctctggagccccggcgggacccgcggcctctccaacgagacgcagcacaacgaaaccgggatcacacgggcccccgagggcagtcaggggccatccctgcccgtgagcaccgcgagccccataatgagcgatccttccattacgaccctgtctgcttccacttcgggcctcgagggctccggcgacacaacgccgcccgccatcacccagggccccactctgccagagaccacacccgagcccagcaccaccaccgggacgaacgcgttctccactgccatcgcgaacgtcagcacccaaaccgtcaaggacacgcccaccccaaccgtgcagacctccccgcccagcacgcccgacgcctccaccattccacagggcacgcaccacacagcccgcgggctgctcagcgtgacggtcaccaaacccgaggaggtgcccactcccactggcccggagcaggcctccatcgagacgaacagcagccggcttgcgacctccaagacccccagcccctccccgaccgcccaagtgacgaccgagaactccaatccgaatacttcccgccagttagtcctcagcacccagcccgccacttccagccccgtgacgtcccccgcacagttgaacttcgtgcagtcagccaccaccatcgcggtccaggacgcacacccgtcccccactaaccgaagcaaacgcaacctggagatggaggtcatactaacgctgtcccaaggcctgagaaagtactacgggcgcatcctcaaacttctggacctcacgctggaggaggacaccgagggcttactcgagtggtgcaagcggaacctggggctgacctgcgacgacaacttcttccagaagcgcatcgaggagttctttctcacgggcgagggccacttcaacgaggtgctgcagttcaagacccccagcacgctgtctccgaccgaaagcgcctccgtcgggctccccacggtggagcccttcaagagctacttcgccaagggcttcctgtccatcgacagcggttacttcagcgccaagtgctatccgcgggcgtccaacagcggcctgcagctcatcaacgtgacccagcacagtgcccgcatcgccgacaccccggggcccaagatcaccaacctgaagacgatcaactgcataaacctcaaggccctcgtcttcaaggagcaccgggagatagagatcaacgttctgctgccccaggtggccgtcaacctcagcaactgtcacgtgcacatcaagtcccatgtgtgcgactacagcctggacatcgacggcaccgtccgactgccccggatccaccacgagggcaccttcatcccggggacctacaaaatcgtgatcgacaaaaagaacaagcagaacgaccgctgcaacctagtcactaactgcgtgatcaagggccgagaggtgcgcaaggggcagtccgtcctgcggcagtatcgcaccgagatccggattggcaaggcgagctccgggagccgccgcctcctctccgaggagagcggggaggactgcatctcccggacccagctgctgaggaccgaaacggccgagatccacggggacaactacgggggcccaggggacaagatcaccatctgcaacggcagcaccatcgtggaccagcggctagggtccgagctgggctgttacaccataaaccgcgtcaagtcctttaagctgtgcgagaactccgccacgggcaagtcctgcgagatcgacaacactcccgtgaagtgcaaacaggggttctgcctgaagattacccaggagggccgggggcacgtgaagctcagccgcgactctgaggtggtcttggacgcgtgcgatagctcctgcgagattatgatccccaagggcaccggcgacatcctggtggactgctctgggggccagcagcacttccttaaggataacttgatcgatttaggatgccccaacatacccctcctgggcaagatggccatctacatctgcagaatgtccaaccatcccaagacgaccatggcgttcctattctggttcagcttcgggtacgtgatcacgtgcatcctctgcaaagtcatcttttaccttctgatcgtggtgggcaccctcggcaagaagttcaagcagtaccgggagcttaagccccagacatgcaccatctgcgagaccaccccagtaaacgctatagatgccgagatgcatgacctgaactgctcctacaatatctgcccctactgcgccagccggttaacctccgatgggctagcgcgccacgtcatgcagtgcccgaagcggaaggagaagatcgaggagacggagctgtacctcaacctggagcgcatcccctgggtggtacggaagctgctccaggtaagcgaatccaccggtgtagccctgaagcgcagctcctggctgatcgtactacttgtgctgttgaccgtcagcctgtccccggtacagagcgcccccatcgggcacgggaagacaatcgagacgtaccaaacccgggagggatacacgtccatctgtctgtttgtgctcggcagcatccttttcatcgtgtcacacctgatgaagggcttagtcgacagcgtggggaacagcttcttccccggcctgtccatctgcaagacctgcagcatcgggtccatcaacggcttcgagatcgagagtcacaagtgctactgcagcttgttctgctgcccctactgccgccactgtagcgccgacaaggagatccacaagctccatttgtccatctgcaagaagcggaaggccgggagcaacgtgatgctggcggtctgcaagcgcatgtgcttcagagccacgatggaagtgtccaacaaggccctcctgattcgcagcgtaatcaacaccacctttgtcgtgtgcatcctgatcttggccgtgtgcgtcgtgagcaccagcgccgtggagatggagtccctcccggcgggcacctgggagcgcgaggaagacctaaccaacttctgccaccaggaatgccaggtcaccgagaccgagtgcctctgtccctacgaggccttagtgttgcgaaagcccctattcctggacagcatcgctaaggggatgaaaaacctgctcaattccacgagcttggagacctccctgagcatcgaggccccgtggggcgccatcaatgtgcagtccaccttcaaacccacagtcagcacggcgaacatcgcgctcagctggtccagcgtggagcaccgcgggaacaagatcctggtgtctgggcggagcgagtccatcatgaagctagaggagcgcacgggcatcagttgggacctcggggtcgaggacgccagcgaaagcaaacttctgaccgtgtccgtgatggacctcagccaaatgtactcccccgtcttcgagtacctgagcggcgaccgccaagtggaggagtggcccaaggcgacctgcacgggagactgcccggaacggtgcggatgcacctccagcacgtgcctgcacaaggagtggccgcactcccggaactggcgctgcaaccccacctggtgttggggagtggggaccggctgcacgtgttgcggcctcgacgtcaaggacttgttcaccgactacatgttcgtgaagtggaaggtcgagtacatcaagacagaggcaattgtgtgcgtagagctgaccagccaagagcggcagtgctccctcatagaggccggtacccgctttaacctgggccctgtcaccatcacccttagcgagccgcgtaacatccagcagaagctcccgccggaaattgtgacgctgcaccctcgcatcgaggagggcttcttcgacctaatgcacgttcagaaggtcctctccgccagcaccgtgtgcaagctgcagagctgtacccacggcgtgcccggggacctgcaggtctaccacatcggcaacttattgaagggcgacaaggtgaatgggcacctgattcacaaggtggagccacacttcaacacatcctggatgagctgggacggctgcgacctcgactactactgcaatatgggggactggccctcctgcacctacacgggcgtcacccagcacaaccacgccgccttcgtgaacctgctgaacatcgagactgactacaccaagaacttccacttccattcgaagagagtgacggcgcacggggacacgccccagctcgacctgaaggcccggccgaactacggcgccggtgagatcaccgtcctggtagaagtggccgacatggagttacacaccaagaagattgagatctccgggctgaagttcgccagcctgacgtgcaccgggtgctacgcgtgctccagcgggatctcctgcaaagtccggatccacgtcgacgagcccgacgagctcaccgtgcacgttaagagcgaggaccccgacatcgtcgcggcctccagcagtttgatggcccgcaagctggagttcggcaccgactccacgtttaaggccttcagtgcgatgcccaagaccagcctatgcttctacatcgtggagcgggagtactgcaagtcctgcagcaaggaggatacccagaagtgtgtgaacgccaagctagagaggccgcaatccattctgatcgaacacaaggggacaatcattggtaagcagaacgatacttgcactgccaaggcctcttgctggctcgagagcgtgaagtccttcttctatggcctgaaaaacatgctaagcggaatcttcggcaacgtgtttatcgggatcttcctgtttctagcgccgttcatcctgctgattctcttcttcatgttcggctggcggatcctgttttgcttcaaatgctgccgccggacacgcggcctatttaagtaccgccacctcaaggacgacgaggaaaccggataccggaaaatcatcgagcggctgaacaacaagaagggcaagaacaagctgttggatggggagcggctcgccgaccgtaagatcgccgagctgttttccacgaagacgcacatcgggtga

SEQ ID NO: 15305 - RNA, 5055 nt, synthetic construct
  misc_feature 1..5055: note = derived and/or modified CDS sequence (opt11) from CCHFV(BA66019)__AF350448.1__GP
  source 1..5055: mol_type = other RNA
atgtacaccctgctcgtgtgcgccgtcctgtgcccccagctatggagcctcgagggcacccacgtgccacacaacgagacgaagcacaacgggaccggcatcactgccgcgcccggggagtcccaaggccccatgagccccgcctccaccgccgtgccgctgacgcccgagccgcccaacaccaagcccgccgccagcgcgtccgagctggagtcatccggggagggccacaccagcctcctggccaccacgcagggcctgacttcccccgaggccacccccgagctccccaccacgaccgacaccggggtctcgagtaccagcgtggtggacatcggcacgcagatggccaaggacacgccgacctccaccgcgcacacgagcctgccctccaaccccagcgccccctccaccgcccagggaacccaccacaccatccgcggcctgctcagcgtcacgtccaccaagccggaggaggccagcacccccaccgaccccgggaaggccggcgcggagacgggcagcccccggccggccatctcccgcaagccgaccctgagccccaccgccgaggcccccacagagatcaacaactccagcacgccgaagcagcccgagccctccatccagcccgccaccccgagcctggtgatctcccccgcgcagcccgccttcccgcaaagcgccacctccaccgccgcccaggacatctacagctcccccacgaaccggagcaagcgcaatctcaagatggagatcatcttgaccctgtcccaggggctcaagaagtactacggcaagatccaaaagaccctggggctgaccctcgaggaggacaccgagggcctgctggagtggtgcaagcggaacctcggcctgacgtgcgacgataacttcttccaaaagaggatcgaggagttcttcctcaccggggagggctacttcaacgaggtgctccagttcaagacccccagcacccccgggtccacggagccgacccacgcggaggcccccaccgtcaagcccttcaagagctacttcgcccggggcttcctgaccatcaactctgggtacttcagcgccaagtgctactcctggacgagcaactcgggcctgcagctcatcaacgtgacccagcaccccgcccgcatcgcggacaccccgggccccaagatcaccaacctgaaaacgatcaactgcatcaacctgaaggcctccgtgttcaaggagcaccgggagatagagatcaacgtcctcctgccccaggtggccgtgaacctgagcaactgccacgtcctcatcaagtcccacgtgtgcgactacagcctggacatcgacggtaccatccgcctgccccggatctaccacgagggcaccttcatcccggggacctacaagatagtgatcgacaagcgcgataagcagaacgatcggtgcacgctcgtcacaaactgcgtgatcaaaggccgcgaggtgcggaaggggcagtccgccctgcgtcagtaccggaccgagatccgcatcggcaaggcgagcgccggctcccggcgcctgctcagcgaggagtccggggacgactgcatctcgcggacccagctgctgcgcacggagaccgccgaggtccacggcgacaactacgggggccccggggacaagatcaccatctgcaacggctccaccatcgtggaccagagactcggcagcgagctggggtgctacacgatcaaccgggtgaagtcattcaagctgtgtgagaacagcggcaccgggaagtcctgcaagatcgacaagcaccccgtcaagtgccgccagggcttctgcctcaagatcacccaggagggccgggggcacgtgaagctgagccgcggctccgaggtcgtgctggacgcctgcgacagcagctgcgaaatcatgatccccaaggggaccggcgacatcctggtggactgctccgggggccagcagcacttcctcaaggacaacctggtcgacctcggctgcccgaacatccccctcctggggaagatggccatctacatctgccggatgagcaaccaccccaagacgaccatggcgttcctgttctggttctccttcggctacgtgatcacgtgcatcttctgcaagatcatcttctacctcctgatcgtcgtcgggaccctgggcaagaagttcaaacagtaccgcgagctcaagccccagacctgcaccatctgcgaaaccaccccgacgaatgccatcgacgccgagatgcacgacctgaaatgcagctacaacatctgcccctactgcgcctcccggctgaccagcgacgggctcgcccgccacgtgacccagtgccccaagcggaaggagaaggtggaggagaccgagctgtatctgaacctcgagcgcatcccctggatcgtccggaaattactccaggtgtccgagagcaccggcgtggcgctgaagcgctccagctggctgatcgtcctcctcgtgctgctgacggtgtccctcagcccggtccagtccgcccccatcggccacgggaaaaccatagaggcctaccagactcgggagggctacaccagcgtgtgcctgttcatgctcgggggcatcctgttcgtggtctcctgcctgatgaaggggctggtggactctgtgtccaacagcttcttccccgggctctccatctgcaagacgtgcagcatcggcagcgtaaacgggtttgagatcgagtcccacaagtgctactgcagcctgctgtgctgcctctactgccgccactgctcggccgaccgggagattcaccagctgcacctgagcatctgcaagaagcggcgggccggcgggaacgtgatgctcgcggtgtgcaagcgcatgtgcctgagggccaccatggaggtctccaacaaggtgctgtttattcgcagcatcatcaacaccacattcgtgatctgcatcctcgtcctggccgtgtgtatcgtgagtacgagcgccgttgagatggagtccctgccggcgggcacctgggagcgcgaggaggacctcaccaacttctgccaccaggagtgccaggtgaccgagacggaatgcctctgcccctacgaggccctggtgctccggaagcccctgttcagcgactccatcgtcaaggggatgaagaacctgctcaacagcacctccctggagaccagcctgtccatcgaggccccctggggcgctatcaacgtgcagagcaccttcaagccgacggtgtctaccgccaacatcgcgctcagctggtccagcgtcgagcaccgcggcaacaagattctggtgagcgggcggtccgagagcatcatgaagctggaggagcgcaccggcatctcctgggacctcggggtggaggacgccagcgagtccaagctgctgaccgtctcagtgatggatctctcccagatgtacagccccgtgtttgagtacctgtccggcgaccggcaggtcgaggagtggcccaaggccacgtgcaccggggactgccccgaccgctgcgggtgcaccagctccacgtgcctgcacaaggagtggccgcacagccggaactggcgctgcaaccccacttggtgctggggcgtggggaccggctgcacatgctgcgggctcgacgtgaaggacctgttcaccgactacatgttcgtcaagtggaaggtggagtacattaagaccgaggccattgtgtgcgtggagctgaactcacaggagcggcagtgtagcctcatcgaggccggcacccgcttcaacctgggccccgtgaccatcaccctgtccgagccccggaacatccagcaaaagctcccgcccgagatcatcacgctgcacccccgcatcgaggaggggttcttcgacctgatgcacgtgcagaaggtcctcagcgcgtccaccgtgtgcaagctgcagagctgtacccacggcgtccccggggacctgcagatctaccacatcggcaacctcctgaagggggacagggtgaacggccacctgattcacaagatcgagccgcacttcaatacctcctggatgagctgggacggctgcgacctcgactactactgcaacatgggggactggccctcttgcacgtacaccggcgtgactcagcacaaccacgccgccttcgtcaacctactgaacatcgagaccgactacaccaagaacttccacttccactccaagcgcgtgacagcccacggggacacgccccagctcgacctcaaggcccggcccacatacggcgcgggggagatcacagtgctggtcgaggtggccgacatggagcttcacaccaagaaaatcgccatcagcggcctgaagttcgcctccctgacctgcaccggctgctacgcgtgcagctccgggatcagctgcaaggtgcgcatccacgtcgacgagccggacgagctcaccgtgcacgttaagtccgaggaccccgacatcgtcgccgccagctccagcctcatggcccggaagctcgagttcggcacggactctaccttcaaggccttcagcgcgatgcccaagacttccctctgcttctacatcgtggagcgcgagtactgcgagagctgctccaaggaggacacccagaagtgcgtcaacacgaagctggaacagccccagagcatactgatcgaacataaggggaccatcatcggcaagcagaacgacacgtgcaccgccaaggcctcctgctggctcgagagcgtcaagtccttcttctacggcctgaagaacatgctgagcgggatcttcggcaacgtgttcatcgggatcttcctcttcctggccccgttcatcctgctgatcctcttcttcatgttcggctggcggatcctgttctgcttcaagtgctgccgcagaacccgcgggctgttcaagtacaggtacctcaaagacgatgaggagagcggctaccggcgcatcatcgagcgactgaacaacaagaagggcaagaacaagctgctcgacggggagcgcctggccgaccggcgcatcgcggaactgttctccaccaagacccacatcggctga

SEQ ID NO: 15306 - RNA, 5055 nt, synthetic construct
  misc_feature 1..5055: note = derived and/or modified CDS sequence (opt11) from CCHFV(SPU 18/88)__KJ682810.1__GP
  source 1..5055: mol_type = other RNA
atgtacacgcccttgctctgcgccatcctttgcctgcagttatggagcctggagggcatctatgggctgtccaacaagactcagcacaacgacaccagcaccatcaaggtgccggaagagtcgcagaagaccagcctccccgcgaacaccgcctcccccatcacgagcgacccctccagcgcaacctccaccgcgctggccagcggaccagaggggtccggcgacaccagcacgtctcccagcgtcaccacccagggtcccaccctgctcgagacgacccccgaaccgcacaccaccatcgacatcgatgagtccagcacggccatcgcggacatctccacccagaccgtgaaggacattcccacccccacgacccacaccagcctgcccagtacaccgagcgcccccacgatcccccaggaggcccaccacactgcccgcggtctgctcagcgtaacttcaaccaagccaggcgaaacgagcacaccgacctcgccgggggaggcgtctaccgaagcgtcctctccccagcccactatctccgaaaccccgagcccgccgcccactacccaagcccccacggagataaacaaccccaacacctcccgacagcccatgcccagcacccagccggccgcccccaacagtgtcacacccccggtgcagccaaccttcagccagtccgatgtgagcactgtcgcgcaggacatccacccctcacccaccaaccgcagcaagcggaacctagaaatggaaataatcttaaccctcagtcagggcttgaagaagtactacgggaaggtccttaaacttttggacctgaccctcgaggaggacacggagggcctgttagagtggtgcaaacgtaacctcgggctgacgtgcgacgacaatttcttccagaagcggatcgaggagtttttcctgaccggcgagggccatttcaatgaggtgctccagtttaagacgccttccacgctgtcccccaccgagcccgccagagtagagagccctaccgtagagccgttcaaaagctacttcgctaaggggtttctgtccatggactcgggctacttttccgccaagtgctaccccaagagctccaacagtgggctccagcttatcaacgtgacccagcactccattcggatcacagacaccccaggccccaagataaccagtctgaagaccatcaactgtataaacttgaaggccctggtattcaaggagcaccgcgagattgagatcaacgtgctgctcccccaagtggcggtaaacttatcgaactgccacgtgctgatcaagagccacgcctgcgactactccctcgacatcgacggacccgtccggttaccccgcatccaccacgaggggacgtttatccctggcacctacaagatcgtcatcgacaagaagaacaagcagaacgaccggtgcaccctggtgaccaactgcgtgattaaggggcgcgagatccggaagggtcagagtgtcctccgccagtaccggacggagatcaaaatcggaaaggcctccagcggctcccgccggctgctgagcgaggaaagcaacgacgactgcctcagccgtacccagctcctgcggaccgagaacgccgagatccactccgacaactacggcggaccgggcgacaagatcaccatctgcaacgggtccacgatcgtggaccagcgcctcggcagcgaattggggtgctacaccattaaccgggtcaagtccttcaagctgtgcgagaacagcgccaccggcaagtcctgcgagatagacagcactcccgttagatgtaggcagggcttttgcctgaagatcacgcaggaggggcgaggccacgtgaaactcagccgcggtagcgaggtcgtgctggacgcatgcgactctagctgcgagatcatgatccccaagggcaccggggacatcctggtcgactgctccggcggccagcagcatttcctcaaggacaacctggtcgacctggggtgtcctaacatcccgctcctgggcaagatggcaatctacatctgccggatgagcaaccaccccaagaccaccatggggttcctgttctggttctccttcggctacgtgataacatgcatcctctgcaaagtaatcttctacctgctgatcgtcgtgggaaccctcgggaagaagttcaagcagtaccgcgagctgaagccccagacctgtacgatctgcgagacgaaccccgtgaacgcaatcgatgcagagatgcacgacctcaattgcagctacaacatatgcccgtactgcgcctccagattaacctcagacggcctggcgcgccacgtcatgcagtgcccgaagcggaaggagaagatcgaggaaaccgagttatacttgaatctggaacgcatcccctgggtggtgcggaagttactccaggtcagcgagagcaccggggtggccctgaagcgctccagctggctcgtgatcctcctcgtactgctcaccgtgagcctgtccccggtgcagagcgcccccatctcccatggcgagacggtcgaggtgtaccagacccgggagggatacaccagcatctgcctgttcgtgctcggctccatcctattcctggtcagctgcctcatgaagggcctcgtggactccgtggggaacagcttctcccccggcctgagcatctgtaagacctgctccatcggcagcataaacggcttcgagatcgagtcccacaagtgctactgctccctcttctgctgcccctactgcaggcactgctcggccgacatcgagatccacaagctgcacctgagcatttgcaagaagcggaagacggggtccaacgtcatgctcgcggtgtgcaagcgcatgtgctttcgcgccaccgtggaggtgagcaacaaggccctcctgatccgcaacatcatcaacaccacgttcgtggtgtgcatcctcattcttgccgtctgcgtggtgtcaacaagcgccgtcgagatggaaaacctgcctgcgggcacctgggagaaggaggaggacctcaccaacttctgccaccaggaatgccaggtgaccgagacggagtgcctgtgcccctacgaggccctcgtgctccggaagcccctgttcctggactcaatcgtcaagggcaaaaagaacctcctgaacagtacgagcctggagacctccctctctatcgaggccccctggggcgccatcaacgtgcagtccacgttcaaaccgacggtgtcggccgcgaatatcgccctgtcatggagttccgtcgagcaccgcgggaacaaaatcctggtgagcgggcggtccgagagtatcatgaagctcgaggagcgaaccgggatctcatgggacctgggggtggaggacgccagcgagtccaagctgctcaccgtgagcgtgatggacttatcccagatgtacagccccgtgttcgagtacctgtccggggaccgccaggtcgaagagtggcccaaggcgacctgcacgggcgactgccccgagcgctgcgggtgcaccagcagcacgtgcctccacaaggagtggccgcactcccgcaactggcggtgcaaccccacctggtgctggggcgtggggacgggatgcacgtgctgcgggctggacgtgaaggacctgttcaccgactacatgttcgtcaagtggaaggtggactatatcaagaccgaggccatcgtgtgcgtcgaactaacatcgcaggagcgacaatgctccctgatagaggccggcacccggttcaacctcggcccggtgaccatcactctctctgagccgagaaacatccagcagaagctgccgcccgagattgttacgctgcacccccggatcgaggaagggttcttcgacctcatgcacatccagaaggtgctgtccgccagcaccgtgtgcaagctgcagtcttgcacccacggcgtccccggggacttacagatctaccacatcggcaacctgctgaaaggcgacaaggtcaacggacacctcattcacaagatcgagccgcacttcaacaccagctggatgtcgtgggacggctgtgacctggactactactgcaacatgggggactggcccagttgctcctacacgggcgtgactcagcacaaccacgccgccttcgtcaacatgctgaacatcgagaccgactacaccaagaactttcacttccacagcaagcgcgtgactgcccacggcgacacaccccagctcgacctgaaggcacggcccacctacggggctggcgagatcaccgtgctggtcgaggtggcggacatggagctccacaccaagaaaatcgagatctccggactgaagttcgccagcctaacgtgcaccgggtgctacgcgtgctccagcgggatctcctgcaaggtgcgcatccacgttgacgagccggacgaactcaccgttcacgtcaagagcgaagaccccgacattgtggctgcctcctctagcctgatggcccggaagctggagttcggcactgactccacattcaaggccttcagcgcgatgcccaaaacctccctctgcttctacatagtggagcgcgagtactgcaagagctgctccaaggaggacacccagaaatgcgtgaacaccaagctggagcagccccaaagcatcctgatcgagcataaggggacgatcatcggcaagcaaaacgacacgtgcactggcaaggccggatgctggctcgagtccataaagagcttcttctacggcctgaagaacatgctgagtggcatcttcgggaacgtcttcatcgggatcttcctgttcctcgccccgttcatcatgctgatcctgttcttcatgtttgggtggcggatcctcttctgctttaagtgctgccgccggacccgcggactattcaaataccggcacctgaaggatgacgaggaaatcgggtatagaaaaatcatcgagcgtctcaagaacaagaagggcaagaacaagctgctggacggcgagcgcctcgccgaccggaagatcgccgagctgttcagcaccaagacacacatcggctga

SEQ ID NO: 15307 - RNA, 5055 nt, synthetic construct
  misc_feature 1..5055: note = derived and/or modified CDS sequence (opt11) from CCHFV(66019)__AB069669.1__GP
  source 1..5055: mol_type = other RNA
atgtacaccctgctcgtgtgcgccgtactgtgcccgcagctgtggagcctcgagggcacccacgtaccgcacaacgagacgaaacacaacgggaccggcatcaccgccgcgcccggggaatcccagggccccatgagccccgcgtctaccgccgtgccgctgacgcccgagccgcccaacaccaagcccgccgccagcgcgtccgagctggagagctccggggagggccacaccagcctcctggccaccacgcagggcctgaccagtccagaggccacccccgagctccccaccacgaccgacaccggcgtcagctccaccagcgtggtggacatcggcacgcagatggccaaggacacccccacaagtacggctcacacgagcttaccctccaaccccagcgccccctccaccgcccaggggacccaccacaccatacggggcctgctcagcgtcacgtccaccaagccggaggaagccagcacccccacggaccccgggaaggccggcgcggagactggcagcccccgaccggccatctcccgaaagcctaccctgtcacccaccgccgaagcccccaccgagatcaacaactccagcacaccgaagcagcccgagccctccatccagcccgccaccccgagcctggtgatctcccccgcgcagcccgcattcccgcagagcgccacctctaccgccgcccaggacatctacagctcccccacgaaccggagcaagcgcaacctcaagatggagatcatccttaccctgtcccaggggctcaagaagtactacggcaagatccagaaaaccctggggctgaccctcgaggaggacaccgagggccttctggagtggtgcaagcggaacctcggtctgacgtgcgacgacaactttttccagaagcgcatcgaggaatttttcctgactggggagggctacttcaacgaggtgctccagttcaagacccccagcacccccgggtccacggaaccgacccacaccgaagcgcccaccgtcaagcccttcaagagctacttcgcccgggggttcctgacgattgacagcggatacttcagcgccaagtgctactcccgcaccagcaacagcggcctgcagctcattaacgtcacccaacaccccgcccggatagccgacacccctggccccaagatcacgaacctgaagacaatcaactgcatcaacctgaaggcgtccgttttcaaggagcaccgcgagatcgagattaacgtcctcctcccccaggtggccgttaacctgagcaactgccacgtcctcatcaagtcccacgtgtgcgactactccctggatatcgacggtaccattcggctgccccgcatctaccacgagggcacgttcatcccggggacgtacaagatcgtgatcgacaagcgggacaagcaaaacgaccgctgcacgctcgtcaccaactgcgtgatcaaggggcgggaggtgcgtcgcgggcagtccgccctgcgccagtaccggaccgagatccgcatcggcaaggccagcgcgggctcccgacgcctgctcagcgaggagtccggggatgactgcatctcccgcacacagttattgcggaccgagaccgccgaggtccacggcgacaactacgggggccccggggacaagatcactatctgcaacggatccacgatcgtggaccagcgcctcggctctgagctggggtgctacaccatcaaccgggtgaagtccttcaagctgtgcgagaacagcggcaccgggaagtcatgcaagatagacaacacccccgtcaagtgccgccagggtttttgcttgaagatcacgcaggagggccgggggcacgtgaagctgagcagggggtccgaggtggtgctggacgcctgcgacagcagctgcgagatcatgatccccaaggggaccggcgacatcctggttgattgtagcgggggccagcagcacttcttaaaggacaacctggtcgacctgggttgcccgaatattcccctcctcggtaagatggccatctacatctgccggatgagcaaccaccccaagaccaccatggccttcctgttctggttcagcttcggctacgtgatcacgtgcatcttctgcaagatcatcttctacctcctgatcgtggtcggcaccctgggcaagaagttcaagcagtaccgcgagctcaagccccagacctgcaccatctgcgagacgaccccgaccaacgcgatagacgccgagatgcacgacctgaagtgcagctacaacatatgcccctactgcgcctcccggctgaccagcgacgggttggcccgccacgtgacccaatgccccaagcgcaaggagaaggtggaggagacggagctgtacctgaacctcgagcgcatcccatggatcgtccggaagctgctacaggtgtccgagagcaccggcgtggcactcaaacgctccagctggctgatcgtccttcttgtgctactgaccgtgtccctcagcccggtccagtccgcgcccatcggccacgggaagaccatcgaggcctaccagacgcgggagggctacaccagcgtgtgcctgttcatgcttgggggcatcctctttgtggtctcgtgcttgatgaaggggctggtggacagcgtgtccaacagcttcttccccggcctgtccatctgcaagacctgcagcatcgggagcgttaatgggttcgagatcgagtcccacaagtgctactgcagcctgctgtgctgtctctactgccgccactgttccgccgaccgggagatccaccagctgcatctgagcatctgcaagaagcgccgggccggcgggaacgtcatgctcgccgtgtgcaagcgaatgtgcctacgtgcaaccatggaggtcagcaacaaggtgctgttcatccggagcatcatcaacacgaccttcgtgatctgcatcctcgtcctggccgtgtgcatcgtgagtaccagcgccgtggagatggagtccctgcccgccggcacctgggagcgcgaggaggaccttacgaacttctgccaccaggagtgccaggtgacagagactgaatgcctgtgcccctacgaggcgctggttcttcggaagcccctgttcagcgactccatcgtcaaggggatgaagaacctgctcaacagcacctccctggagacgagcctgtccatcgaggcaccctggggcgccatcaacgtgcagagcactttcaagccgaccgtttccactgccaacatcgccctcagctggagtagcgtcgagcaccgcggcaacaagatcctggtgagcggccggtccgagagcatcatgaagctagaggagcgcacggggatctcctgggacctcggggtggaggacgccagcgagtccaagttgttgaccgtctcggtgatggacctctcccagatgtacagccccgtgttcgagtacctgtccggcgaccggcaggttgaggagtggcccaaggcgacctgcaccggcaactgccccgaccgctgcgggtgcacgagctccacctgtctgcacaaggagtggccgcacagccggaactggcgctgcaaccccacctggtgctggggcgtggggaccggctgcacgtgctgcgggctcgacgtgaaggacctgttcaccgactacatgttcgtgaagtggaaggtggagtacatcaagaccgaggccatcgtctgtgtcgaactgaactcccaggaacggcagtgtagcctcatcgaggccggcacccgcttcaacctgggccctgtgacgatcaccctgtccgagccccggaacatccagcagaagctcccgagcgagatcatcaccctccacccccgcatcgaagaggggttctttgacctgatgcacgtgcagaaggtcctctccgccagcacggtgtgcaagctgcagtcttgcacgcacggcgtccccggggacctgcagatctaccacatcggcaacctcctgaagggggaccgggtgaacggccacctgatccacaagatagagccccacttcaacactagctggatgagctgggatggctgcgacctcgactactactgcaacatgggggattggccgtcctgcacctacaccggcgtgacccagcacaaccacgcggctttcgtcaacctgctgaacatcgagacggactacaccaaaaacttccacttccactcgaagcgcgtgaccgcacacggggacaccccacagctcgacctgaaagctcggcccacgtacggcgccggggagattaccgtgctggttgaggtagccgacatggagctccataccaaaaagatcgctatctccggcctgaagttcgccagcctgacctgcacgggctgctacgcctgctctagcggaatctcctgcaaggtgcgcatccacgtcgacgagcccgacgagctcaccgtgcacgttaagagcgaggacccggacatcgtggcggcctccagctccctgatggcccgcaagctggagttcggcaccgacagcaccttcaaggccttctccgccatgcccaagacgtcactttgcttctacatcgtggagcgcgagtactgcgagtcctgcagcaaggaggacacccagaagtgcgtgaacaccaagctggagcagccccagtccatcctaatcgagcacaagggtaccatcatcggcaaacagaacgacacgtgcacagctaaggcaagctgctggctcgagagtgttaagagcttcttctacggcctgaagaacatgttaagcgggatcttcggcaacgtgttcatcggaatcttcctcttcctggcccccttcatcctgctgatcctcttcttcatgttcggctggcggatcctgttctgcttcaagtgctgccgcagaacccgggggctgttcaagtaccgctatctcaaggacgacgaggagtccgggtaccggcgcatcatcgaacggctgaacaacaagaagggcaagaacaagctgctcgacggggaacggctggccgaccgccgcatcgccgagctgttcagcaccaagacgcacatcggctga

SEQ ID NO: 15308 - RNA, 5052 nt, synthetic construct
  misc_feature 1..5052: note = derived and/or modified CDS sequence (opt11) from CCHFV(Gaib)__KX013445.1__GP
  source 1..5052: mol_type = other RNA
atgtatatccccctggtgtacgccgtcatatacctccagctgtacggcctcgggggcgcccacgggctccttaacaagactgaacagaatgagacgggcatcacggctacccacgggcgcgtacagggcccgccaagcgcctccatcactctgcccgtgacccccgacccgctctccgccacgtccgccgctagcacatccggtcccgaggggagcggcgaggtccccacctccccctccaccataacgcaggggttgacctccagcgagaataccccgcagctgcccaccgcgacggacaccggcatctccagtacctccatcatcgacgtgagtacccagacggccggggacacctccacccccaccgcccacacgtctctccccaattccccgagcgcacccttcacctcccaggacacccggcacaccgttcggggcctgctgaccgtcaccagcaccaagagcgacgaggcgagtaccctcaccgaccccaaggaagctagcaccgaggcccgtagtccaagcccgtcaatcagccgcacccccaccccctctcccacggtccaggcaagcaccgagaacaacaccccctccacgccacggcaacccgagcccaccacccgcccagccctgcccagccccaccacgtcccccacccaaccgagcctgtcccagagcgcgacgtcggccgcgatccaggatatgcacccaagcccgaccaaccggtcccggcggaacctcgaaatggagatcattctgacactgagccagggcctcaagaagtactacggcaaaatcctgaaactgctcgacctgaccctggaggaagacacggagggcctcctggagtggtgcaagcgcaacctggatctaacctgtgacgagaacttcttccttaagcggatcgaggagttcttcctgtccggtgagggccacttcaacgaagtgctccagttcaaggccccgagcacgatgtcttcgaccgagcccacgcacgccggaccgcccaccgtcgagccctttaagagctacttcgcgaaagggttcctgtccatcgacagcggctacttctccgctaagtgttacccccgtaccagcaactccgggctgcagctaatcaacgtaacccaacacacggctcgcatcgccgacacgcccggccccaagatcaccaacgttaagaccatcaactgcatcaacctgaaggcaagcgtgttcaagaaacacagagaggtggagatcaacgttctgctcccgcaaatcgcggtcaatctgtccaactgccacgtgctgatcaagagccacgtgtgtgactactccctcaacttcgacgggatggttagattaccccgcatccaccacgaaggcacgttcatccccggcacctataagatcgtgatcgatcggaagaacaagcagaacgaccgctgcaccctggtgaccaattgcgtcatcaagggccgtgaggtgcgcaaaggccagtctgccctccggcagtaccgcacggaaatcaaaatcggcgaggcctccatcggcagcaggcggttgctgtccgaagagagctccgacgattgcataagccggacccagctcctgcggacggagaccgccgagatccacaacgacaactacgggggccccggggacaaaatcacgatctgcaacgggagcaccatcgtggaccagcgtctcggctccgagctcgggtgctacaccatcaaccgggtcaagtctttcaagctgtgcgagaactccgcgaccggcaagagctgcgaaatagactccatcccggtaaagtgccgccaaggcttctgcctgaagattacgcaagaggggcggggccacgtcaagctgtcacgcggctccgaggtggtgctcgacgcgtgcgacagctcctgcgagatcatgatccccaagggaacgggggacatcctggtagactgcagcggcggccagcagcacttcctgaaggacaacctcatcgacctggggtgccccaacatccccctgctcggcaagatggccatctacatctgcaggatgtccaaccaccccaaaaccaccatggccttcctgttctggttcagcttcgggtacgtgatcacgtgcatcttctgcaaggccatcttctaccttctcatcatcgtggggacgctggggaagaagttcaaacagtaccgcgagctgaagccccagacctgcaccatctgtgagacgacacccgtcaacgctatcgacgcagagatgcatgacctcaactgctcctacaacatctgcccctactgcgcctctcggctgacctccgacggcctggcccgccacgtagtgcactgcccgaagcggaaagagaagatcgaggagaccgagctctacctgaacttagagagggtcccctgggtggtgcggaagctcttacaagtcagcgagtccaccggcgtggccctgaagcgcagctcctggctcatcgtactgctggtcctcctgacggtgagcctaagccccgtgcagagtgcgcccatcgggcacggaaagaccatcgagacataccagacccgggaggggtacacgagcatctgcctcttcgtgttaggcgggatcctgttcatcgtgtcatgcctcatgaagggactggtggacagcgtcggtaacaacttcttcccggggctgaccatctgcaaaacctgcagcatcagctccatcaatggcttcgagatcgagagccacaagtgctactgcagcctcctgtgctgcccgtactgccgccactgcagcgctgaccgggagatccaccaactgcacctctccatctgcaagaagcgcaaaaccgggagcaatgtgatgcttgcagtgtgcaagcgcatgtgtctgcgggtcacgaccgaagtgtccaatagagccctcttcattcggagcataatcaataccacctttgtgatctgcatcctcatcctggcggtctgcgtgatctccacgagcgcggtggagatggagaacttacccgccggcacctgggagcgcgaggaggatctgaccaacttctgccaccaggaatgtcaagttaccgagacggaatgcctgtgcccgtacgaggccctcgtgctgcggaagcccctcttctccgattcaatcgtgaaggggatgaaaaacctcctgaactccaccagccttgagaccagcttgtccatcgaggccccctggggcgccataaacgtccagtcaaccttcaagccaacggtgtccaccgcgaacatcgcgctgtcttggtccagcatcgagcaccgcggcaacaagatcctggtctccgggaggagcgagtccatcatgaaactcgaggagcgcaccggcatctcttgggacctcggggtcgaggacgccagcgagagccggctgttgaccgtgtccgtgatggacctgagccagatgtactccccggtcttcgagtacctgagcggcgaccgtcaagtagaggagtggcccaaggccacgtgcaccggagactgccccgagcggtgtggctgcacctccagcacgtgcctccacaaggagtggcctcactcccgcaactggcggtgcaacccgacttggtgctggggcgtgggcaccggctgtacgtgttgcgggctagacgtcaaggacctgttcaccgactatatgttcgtgaaatggaaggtggagtacattaagaccgaggctatcgtctgtgtggagctcaccagccaggagcgccagtgcagcctgatcgaggccggcacccggttcaacctgggccccgtgaccattacgttgtccgagccccgcaatatccagcaaaagctgcccccggagattatcaccctccatccgcggatcgaggaggggttcttcgacctcatgcatgtccagaaggtgctgagcgcctccaccgtgtgcaagttacaaagttgcacccacggtgtccccggggatttacaggtgtaccacatcggcaacctgctgaaaggggacaaggtcaatggccacctcatccataagatcgagcctcacttcaacacctcctggatgagctgggacggctgcgacttggattactactgcaacatgggggactggccgtcttgcacgtacaccggcgtgacccaacacaaccacgccgccttcgtcaacctgttaaacatcgagaccgactacacgaagaacttccacttccactctaagcgcgttaccgcccacggggacacaccgcagctggacctgaaggcccggcccacttacggcgctggggagataaccgtgctcgtggaggttgccgacatggagctgcacaccaagaagatcgaaatcagcgggctgaagttcgccagcttgacgtgcaccggctgctacgcgtgttccagcgggatctcctgcaaggtgcgcatccacgtggacgagcccgacgagctaacggtccatgtcaagagcgaggacccggacatcgtcgccgcgtccagctccctgatggcccggaagctcgagttcggcaccgacagcacctttaaggcctttagcgcgatgcccaagaccagcctgtgcttctacatcgtggaacgcgagtactgcaagagctgctcccgcgaggacacccagaagtgcgtgagcaccaagctggagcagccccagtccatcctcatcgagcacaaaggcaccatcatcggcaagcagaacaacacgtgcaccaccaaaacgacctgctggctggagagcgtgaagtccttcttctatgggctgaagaacatgttatcatccatcttcggcaacgtcttcgtcggcatcttcagcttccttgcccctttcatcctgctgatactcttcttcatgttcgggtggcggatcctgttctgcttcaagtgctgccgcagaacccgcggtctattcaagtaccggcacctcaaggacgacgaggagaccggttaccgccggataatcgagcgcctaaacaacaagaaaggcaagtccaagctgctcgacggcgagcggctggccgaccgcaagatcgccgaactgttcagcaccaagacccacatcggctga

SEQ ID NO: 15309 - RNA, 5055 nt, synthetic construct
  misc_feature 1..5055: note = derived and/or modified CDS sequence (opt11) from CCHFV(SPU415/85)__DQ211635.1__GP
  source 1..5055: mol_type = other RNA
atgtacacgcccctggtgtgcgccgtcatctgcctccagctgtggaacctgggcgggaccctcgtgttcatcaaccgcacgcagcacaacgagacgggcaccgtggccacaccggaggggacgctgcggccgcgcctgccggtcagcaccgcgttgcccaccaagtcagaccggccgtcagtgggccccgccgcctccagctccgggctggagggcagcggcgagcccaacacctcccccagcatcacgaccaaggggctgaccccgcccgagaccacgcccgccctccccaccgccaccgacacagacgcatccagcacgggcgtggtcgacgtgtccacccagatgaccaaggacatcccgatgagcaccgcctacacgaaccctccctccacccccagcgccccctccacgccccaggggacccaccacaccgcccgcggcctgctgagcgtggcgtccaccaagagcgaggaggtctccatgagcaccagccccgccaagacctccacggagaccagcagcccgccgcccgccacctccgagacccccacgccctcccccaccacccaggtgcccaccggcaacaacaaccccaacacgagccggcagcccaccccgtccgcccagcccgccatgagcaaccccgcgacctccccggcccagcccaacctctctcagtctgcgcccccaaccgccgaccagggcgtgcacccgagccccaccaaccgctccaagcggaacctggagatcgagatcatcctaacgctcagccagggcctgcgcaagtactacgggaagatcctgaagctcctggacctgaccctcgaggaagacacggagggcctgctggagtggtgcaagcggaacctcgggctgacctgcgacgacaatttcttccagaagcgcatcgaggagttcttcctgacgggcgagggctacttcaacgaggtcctccagttcaaggtgccctccaccctgagctccaccgagccgacccatacgcggccgcccaccgtggagcccttcaagagctacttcgccaaggggttcctgtccatgaacagcggctacttcagcgccaagtgctacccccgcacctccaacagcgggttgcagctgatcaacgtcaccaagcactccgccaagatcgccgacacgccgggccccaagatcaccaacctaaagaccatcaactgcatcaacctccgggccagcgtgttcaaggagcaccgcgaggtggagatcaacgtcctgctgccccaggtggccgtgaacctctccaactgccacgcgcagattaagagccacgtctgcgactactccctggccaccgacgggatggtgcgtctgccccacatccaccacgagggcacgttcatcccgggcacctacaagatcgtgatcgacaagaagaacaagcagaacgatcgctgcaccctcgtcaccaactgcgtgatcaagggacgggaggtccgcaagggccaaagtgccctgcggcagtacaagactgagatacgcatcgggaaggcctccagcggaagtcggcgcctactcagcgaggagtccgacggggactgcatcagccgcactcagctgctgcggaccgagaccacggagatccacagtgacaactacggcggccccggggacaagatcaccatctgcaacggcagcaccatcgtggaccagcggctcgggtccgagctgggctgctacaccatcaaccgggtcaagagcttcaagctgtgcgagaacagcgccacggggaagtcctgcgagatcgacagcacccccgtgaagtgccgccagggattctgcctcaagatcacccaggagggccgggggcacgtgaaactgtcccgcggcagcgagatcgtgctggacgcgtgcgactccaactgcgagataatgattcccaaggggaccggcgacatcctggtcgactgcagcggcgggcagcagcacttcctcaaggacaacctgatcgatctgggctgcccgaacatccccctcctggggaagatggccatctacatctgccggatgtccaaccatcccaagacaaccatggccttcctgttctggttcagcttcggctacgtgataacctgcatcctctgcaaggtgatcttctacctgctgatcgtcgccgggacagtgggcaagaagttcaagcagtaccgcgagctccggccccagacgtgcaccatctgcgagaccatcccggtcaacgcgatcgacgccgagatgcacgacctgaactgctcctacaacatctgcccctactgcgcctcccgcctgacctccgacggcttagcccggcacgtcatgcagtgccccaagaggaaggaaaaggtagaggagaccgagctgtacctgaacctcgagcggatcccgtgggtggtccgcaagttgctccaggtgagcgagtccacgggtgtggccctgaagcggagctcctggctcaccgtcctgttggtgctgctgatcgtgagcctctcccccgtccagagcgcgcccatcggccacgggaagaccatcgagacctaccaggcccgcgagggctacacgtccttctgcctgttcatcctggggtcgatcctcttcgtggtgagctgcctggtcaaggggctgatcgactccgttggcaacagctttttccccgggctctccatctgcaagacctgctcgatcggctccatcaatgggttcgagatcgagagccacaagtgctactgctccctgttctgctgcccgtactgccggcactgcagcgccgaccgcgagatccacaagctgcacctctccatctgcaagaagcggaagaccggcagcaacgtgatgctggccgtctgcaagcgcatgtgcttccgcgccaccatcgaggtgtccaaccgggcactgctcatccgcaacatcatcaacacgaccttcgtggtctgcatcctgaccctggccgtgtgcgtggtcagcacctccgccgtggagatggagagcttacccgccgggacgtgggagaaggaggaggacctgaccaacttctgccaccaggagtgccaggtgaccgagaccgagtgcctgtgtccctacgaggccctcgtcctgcggaagcccctgttcctcgactccatcgtgaagggcatgaagaacctgctcaacagcacgtccctcgagacctctctgtccatcgaggcgccgtggggcgccatcaacgtccagagcaccttcaagcccaccgtcagcgccgccaacatcgcgctgtcctggagctccgtggaacaccgcgggaacaagatcctcgtgagcggccggtccgagagcatcatgaagctggaggagcgcacggggatctcctgggaccttggcgtggaggacgccagcgagtccaaactcctgaccgtgagcgtgatggacctgtcccagatgtacagccccgtcttcgagtacctctccggggaccggcaagtggaggagtggcctaaggcgacctgcaccggcgactgcccggagcgctgcggctgcacgagctcgacctgcctgcacaaggagtggccccacagccggaactggcgctgcaaccccacctggtgctggggcgtcgggaccgggtgcacgtgctgcggcctggacgtcaaggacttgttcaccgactacatgttcgtgaagtggaaggtggagtacatcaagaccgaggccatcgtctgcgtggagttaacctcccaggagcggcagtgcagcctgatcgaggccggcacacgcttcaacctcgggcccgtcaccatcaccctgtccgagccgcgtaatatccagcagaagctgccgcccgagatcatcactctccacccccgcatcgaggagggcttcttcgacctgatgcacgtgcagcgggttctgagcgccagcacggtctgcaagctccagtcctgcacccacggggtgcccggggacctccaggtgtaccacatcgggaacctgctgaagggggacaaggtcaatggccacctgatccacaagatcgagccccacttcaacaccagctggatgtcctgggacgggtgcgacctggactactactgcaacatgggcgactggcccagctgcacctacaccggtgtgacgcagcataaccacgccgccttcgtgaacctcttaaacatcgagaccgattacaccaagaacttccacttccactccaagagagtcaccgcccacggcgacacgccccagctggatctcaaggcccggccgacctatggggcgggcgaggtgaccgtgctggtcgaggtggccgacatggagctgcataccaagaagatcgagattagcggcctcaagttcgcctccctgacgtgcaccgggtgctacgcctgcagctccggcatcagttgcaaggtgaagatccacgtcgacgagcccgacgagctgaccgtgcacgtgaagtccgaggaccccgacatcgtcgccgcggggagctccctcatggcccgcaagctggagttcggcgccgacagcaccttcaaggccttctccgcgatgcccaagacgagcctgtgcttctacatcgtggagcgggagtactgcaagtcctgcagccgcgaggacacccggaagtgcgtgaacaccaagctcgaccgcccgcagtccatcctgatcgagcacaaggggaccatcatcggcaagcagaacaacacgtgcaccgccaaggcctcgtgctggctggaaagcgtcaagtccttcttctacggcctcaagaacatgctgagcgggatcttcggcaacgtgttcatcgggatcttcctgttcatcgcccccttcgtgctcctgatcctgttcttcatgttcggctggcgcatcctgttctgcttcaagtgctgccggcgcacccggggcctcttcaagtaccgccacctgaaggacgacgaggagaccgggtaccggaagatcatcgagcgcctgaacaacaagaagggcaagaacaagctcctggacggggagcggctggccgaccgcaagatcgcggaactcttctccaccaagagccatatcggctga

SEQ ID NO: 15310 - RNA, 5055 nt, synthetic construct
  misc_feature 1..5055: note = derived and/or modified CDS sequence (opt11) from CCHFV(SPU 431/85)__KJ682812.1__GP
  source 1..5055: mol_type = other RNA
atgtacacacccctcgtatgcgcagtaatctgccttcagctctggaatttaggaggaacattggtatcaacaaaccgcacacaacataacgagaccggcaccgtcgcgaccccagagggcactctccgacctcgcctcccggtctccacagccctccccaccaaatccgatcgcccgtcggtcggacctgccgcctcatcctccggcctggaaggcagtggcgaacccaacaccagcccatcgatcacgacaaaagggttaacaccaccagaaaccacacccgccttacccacagccaccgacactgacgcctcgtctacgggcgtcgtagacgtatccacacagatgactaaagacattccaatgagcaccgcctacactaacccgcccagtaccccgtctgccccctcaacaccgcagggtacccaccacacagcacgagggttgctaagtgttgcatctaccaagtccgaagaagtctcaatgtctacaagccccgctaagacatcaaccgaaacatcgagtcccccacccgcaactagcgaaacacccacaccctccccaacgacacaggtccccaccgggaacaataacccaaacacatcgcgacaacctaccccgagcgctcaacccgccatgtccaaccccgccacgtcccctgcccaaccgaatcttagtcaatccgccccgcccacagccgatcaaggcgtacaccccagccccacgaaccgttctaaaagaaacctagaaatagaaatcatcctcacgctctcacaaggcctgcgaaaatactacggaaaaatacttaagctattagacctcaccctggaagaggatacagaaggcctactagagtggtgcaaacgcaacctgggccttacctgcgacgacaacttcttccaaaaacgcatcgaggagttctttctcacaggggaaggctacttcaatgaagtcctccaattcaaagttccgagcaccctgtcaagcaccgaacccacccacacgcgtcccccgacagtcgaaccgttcaaatcctacttcgccaaaggcttcctcagcatgaactccggctacttctccgcaaagtgttacccgcgtacctccaacagtggtctccaactcatcaacgtgacaaagcactccgccaagatagcagatacccctgggccaaaaattacgaacctcaaaacgataaactgcatcaatctgcgagcaagtgtatttaaggaacaccgggaggtcgaaatcaacgtactactaccccaggtagccgtcaacttaagcaactgccatgcgcaaataaaaagccacgtttgtgactattccctcgccacagatggcatggttcgcctgccccacatccaccatgaagggacctttatcccaggcacctacaagatcgtaatagataagaaaaacaagcaaaacgaccgatgtaccttggtgaccaactgtgtcataaaaggacgagaggtccgcaaaggccagtccgccctcagacaatataaaactgaaatacgcatcggcaaggcttcctccggatccaggcggctcttatcagaagaatccgacggagactgcatatcacgaacacagcttttgcgcacagagaccacagaaatccacagcgacaactatggcgggcccggcgacaaaataacaatctgcaacggctccaccatagtcgaccaacgcctcgggagcgaactaggatgttacaccatcaaccgcgtcaaatcatttaaactatgcgaaaactcggcaaccggaaaaagctgcgagatcgattctacacctgttaaatgccgacaggggttctgcctcaaaataacacaagaaggccgtggacacgtcaaactatcacgtggatcagaaatagtcctagacgcatgcgactccaactgtgaaattatgatacccaagggtaccggagacatattagtcgactgttcagggggacaacagcacttcctcaaagacaacctcatcgatttaggctgtcccaacatcccacttctgggtaagatggctatatacatctgccgtatgtcaaaccatccgaaaaccaccatggcattcctattctggttcagtttcggctacgtaatcacatgcatactgtgcaaagtcatattctacctactaatagtagccgggactgtgggcaaaaagttcaaacaataccgagaactccgaccccaaacatgcaccatatgcgaaaccatccccgtgaatgcgattgacgcggaaatgcacgacctaaactgctcctacaacatatgtccctattgcgcaagccgccttacatccgacgggctcgcccgacatgtcatgcagtgccccaaaagaaaagagaaggtagaagaaacggaactttaccttaacttagagcgcatcccatgggtcgtgcgtaaacttctacaagtcagcgaatcaacaggcgtcgcccttaaacgaagctcctggctcacagtcctcctagtgctcctcattgtatcattaagccccgtccaatcagcccctattggacacggcaaaactatagaaacataccaagcccgtgaaggctacaccagcttttgcctcttcatactgggaagcattttattcgttgtcagctgtctcgtaaaaggcctaatagattcagtaggaaactctttctttccaggcctgagcatatgcaaaacatgctcgatcggaagcatcaacggcttcgaaatcgaatcccataagtgttactgttccctcttttgctgcccctactgtcgccactgccccgccgacagagagatacataaactccacctgtccatctgcaagaaacgaaaaacaggctccaatgtcatgctcgccgtatgcaaacgcatgtgcttccgagccaccatcgaagtatccaaccgcgccctcctcatacggaatataatcaatacaaccttcgtcgtatgcatcctcacactcgccgtctgtgtagtctctacatcagcagttgagatggaaagtctgcccgccggaacctgggaaaaagaagaagacctcaccaacttctgccatcaagaatgccaggtcaccgaaactgaatgtctctgcccctacgaagccctggtcctcagaaaaccactcttcctagattcaatcgtaaaaggtcgtaagaatttacttaatagcacatctcttgaaaccagcctatccatcgaagcgccttggggagccattaatgtccaaagcaccttcaaacccaccgtttcagccgctaacatcgcactgagctggtcctccgtcgagcaccgcggcaataaaattctcgtatctggtcgctcagaaagcataatgaagctcgaggaacgcacaggcatctcctgggacctaggcgttgaagacgcatccgagtcaaaactgttaaccgtatcagtaatggacctatcccaaatgtattcgccagtatttgaatacctctcaggcgaccgacaggtcgaagagtggccaaaagcaacgtgtacaggagactgccccgaacgctgcggctgcacctcctcaacgtgtctccacaaggaatggccccactcacgtaactggcgctgtaaccctacttggtgctggggagtcggaacaggttgcacatgctgcggcctcgacgtgaaagatctcttcaccgactacatgttcgtcaaatggaaagtggaatacatcaaaacagaagctatcgtttgcgtcgaactgacctcccaggaacgccagtgttctttaatagaggctggcaccagattcaacctaggccccgtaaccatcacactcagcgaaccaaggaacattcaacaaaaactacccccagagataatcacattacatccgcgcatcgaagaaggcttcttcgatttaatgcacgttcaaagagttctgtcagcctccaccgtctgcaaactacaatcttgcactcacggtgtccccggcgatctacaagtctaccacattggcaacctactcaaaggagacaaagtaaacggccaccttatacacaaaatagagccccatttcaatacatcatggatgtcctgggacggctgcgacctggactactattgcaacatgggcgactggccctcctgcacctataccggggtcacgcaacataatcacgctgcgttcgtaaacttactcaacatcgaaacggactacactaaaaacttccacttccactcaaaacgtgtcacggcgcacggagacacaccccaactagacctgaaagcacggcctacctacggagccggagaagtcacggtactcgtcgaagtagcagatatggaactacacacgaaaaagatcgagatatccggcctcaaatttgcctcattaacctgcaccggctgctacgcctgttcctctggtatctcatgcaaagtcaagatccacgtagacgaaccagacgagctaaccgttcatgttaaaagtgaagacccagacatagtagccgcaggatcctctctgatggcgcgcaagttagagttcggcgcagattcaacctttaaggccttctccgccatgccaaaaactagcctctgcttctacattgtagaacgcgaatactgcaaaagctgctcacgtgaagacaccagaaagtgcgtcaacaccaaactcgaccgcccccaatcaatactcatcgaacacaaaggtacgatcattggaaaacaaaacaacacgtgtacagctaaagcatcatgctggctcgagtccgtaaaatcatttttctacgggcttaaaaacatgctctcgggaatattcggcaacgtctttatcgggatcttcctcttcatcgccccttttgtactcctgatcctcttctttatgtttgggtggcgaatacttttctgtttcaaatgctgccgccgtacccgcggcctcttcaagtacaggcaccttaaagacgatgaggaaaccggctatagaaagatcattgaacgactgaataataagaaaggcaaaaacaaactcctagacggagaacgactggccgacagaaaaatcgcagaactcttcagcacgaaatcccacataggataa

SEQ ID NO: 15311 - RNA, 5055 nt, synthetic construct
  misc_feature 1..5055: note = derived and/or modified CDS sequence (opt11) from CCHFV(8402)__AB069674.1__GP
  source 1..5055: mol_type = other RNA
atgtacactcccctgctctgcgccgtgctgtgtctgcaactctggagcctggagggctcccacgggctgagcaacaagacccaacactccaacaccagcaccaccaaggccccggaggtctcgcaggagctcggccttcccgtcagcaccgtgtccacgatcaccagcgacccgccctcgatcaccagcgcggtttccgtgagcgggtccgagggcagcggggacaccaacacgtctcccagcgtgaccacccagggccccaccctgcccgagacgaccctcgagcccctgacgaccacggacaccgacgcctccagcaccgtcgtggtggacgtctccacccagacggtgaaggacaccccgataagcaccacctacacgagcctgccctccacccccagcgaacccaccaccccgcaaggaacgcaccacaccgcccgcgggctcctatccgtgaccagcaccaagcccgaggaggcctccacccaggccaaccccggcaagatcagcatggagaccaacgggccccgtctggcgatcagtgagaccccgagcttctcccccaccacccaggcccccactgaaaacagcaaccccatcacctcgaagcaacttatgcttagcgcccagccggtcacccccaaccccatgacctcccccgtgcagccggccctgagccagtccgacacgagcaccgcgatccaggatgtgcacccatcgcccactggccgcagcaagcggaacctcgagatggagatcatcctgaccctgtcccagggattaaagaagtactacggcaagatcctgaagctgctcgacctgacgctggaggaggacaccgaaggcctcctggagtggtgcaagagaaacctggggctcgtctgcgacgacaacttcttccagaagcggatcgaggagtttttcctgacaggcaaggggcacttcaacgaggtgctgcagttcaagaccccctcgacgctctcgccgaccggccccgcccgcaccggctcccccacagtggaaccgttcaagagctacttcgccaagggattcctgtccatggacagcggctacttctcagccaagtgctacccacgggccagcaactccgggctgcagctcatcaacgtgacacaacacagcaccaggatcactgacacccctggccccaagatcacgaacctgaagaccatcaactgcatcaacctgaaggcgtccgtgttcaaggagcaccgggagatcgagatcaacgtcctcctgccgcaggtcgccgtgaacttaagctcctgccacgtgctaatcaagagccacgtctgcgactactccctggacatcgacgggcccgtgcgcctgccccggatccaccacgagggcaccttcatccccggcacctataagatcgtcatcgacaagaagaacaagcagaacgaccggtgcacgctcgtgaccaattgcgtgatcaaggggagggagatccgcaagggccagagcgtccttcgacagtaccgtaccgagatcaagatcgggaaggcctccagcggctcccggcgcctgttgagcgaggagagcggggatgactgcatctcgcggacccagctgctgcgcacggagaccgcagagatccacaacgataactacggcggccccggggacaagatcaccatctgcaacggcagcaccgtggtggaccagcggctggggtccgagctcgggtgctacacgatcaaccgcgtcaagagcttcaagttatgcgagaactccgccaccggcaagagctgcgagatcgactccacccccgtgaagtgccgccaggggttctgcctgaagatcacccaggagggcagggggcacgtgaaactcagccgcggctcggaggtcgtactggatgcgtgcgattcctcctgcgagataatgatccccaaggggacgggcgatatcctggtggattgcagcggcggccaacagcactttttaaaggacaacctgatagacctgggctgccccaacatcccgctcctggggaagatggccatctacatctgccggatgtccaaccatcccaagaccaccatggcattcctgttctggttctctttcggctacgtcgtgacctgcatcctctgcaaggtgatcttctacctgctgatcgtagtggggacgctcggcaagaagttcaagcagtaccgcgagctgaagccccagacctgcaccatttgcgagacaacccccgtgaacgccatcgacgccgaaatgcacgacttgaattgctcctacaacatctgcccgtactgtgcgagccggctcacgtccgacggcctggcacgccacgtcatgcagtgccccaagcgaaaggagaaaatcgaggagaccgagctgtacctcaacctggagcgcatcccctgggtggtgcggaagttactccaggtcagcgagtccaccggggtagccctgaagcgtagcagctggctggtggtcctcctggtgctgctcactgtgtccctgagccccgtccagtccgccccgatcggccacgggaagacggtggagacctaccaaacccgggagggctacaccagcatctgcctgttcgtgctcgggtccatcctgttcatcgttagttgcttaatgaagggcctcgtggactccgtcggcaacagctttttccccgggttgagcatctgcaagacgtgcagcatcggctccgtcaacgggttcgagatcgagagccacaaatgttactgctccctgttctgctgtccctactgccgccactgcagcgcagaccgggagatccaccgcctccacctgtccatctgcaagaagcggaagaccggcagcaacgtgatgctggcggtgtgcaagcgcatgtgcttccgcgccaccgtcgaggtgtccaacaaagccctcctgatccgcaacatcattaacaccacgtttgtgctgtgcatcctcatcttagcggtctgcgtggtgagcacgtccgcggtagagatggagagcttacccgccgggacctgggagcgggaggaggacttaaccaacttctgccaccaggagtgccaggtgacggagaccgagtgcctgtgcccgtacgaggcccttgtgctccgcaagcccttattcagcgactccatcgtcaagggcatgaagaacctgctcaatagcacctccctggagacaagcctgtccatcgaggccccttggggcgccatcaacgtgcagagcacgttcaaaccgaccgtgtccgcggccaacatcgctctcagttggtccagcgtggagcaccgtgggaacaagatcctggtgtccggccggtctgagtccatcatgaagctggaggagcgcaccgggatcagctgggacctcggcgtggaggacgcttccgagagcaagctgctgaccgtctccgtgatggacctcagccagatgtactccccagtctttgagtacctgagcggggaccgccaggtggaagagtggcccaaggccacgtgcaccggcgattgccccgagcggtgcggctgtaccagctccacgtgcctgcacaaagagtggccccacagccgaaattggcgctgcaaccccacctggtgctggggcgtggggaccgggtgcacgtgctgcggcctcgacgtcaaggacctgttcaccgactacatgttcatcaaatggaaggtggagtacatcaagaccgaggcgatcgtttgcgtcgagctgacaagccaggagcggcagtgcaccctaatcgaggcaggcacgcgcttcaacttagggcccgtgacgatcaccctgtccgagccccggaacattcagcagaagctcccgcccgagatcgtgacactgcacccccgcatcgaggagggcttcttcgacctgatgcacgtccagaaagtgctctccgccagcaccgtgtgcaagctgcagtcctgcacccacggggtccccggcgacctccaggtgtaccacattggaaacctactgaagggcgacaaagtgaacggccacctgatccacaaaatcgagccgcacttcaacaccagctggatgtcctgggacgggtgcgacctcgactactactgcaacatgggcgactggcccagctgcacctacaccggggtcacgcagcacaaccacgccgccttcgtgaacatgctgaacatcgagacagactacaccaagaacttccacttccactccaagcgggtgaccgcgcacggcgacactccccagctggacctcaaggcccgccccacctacggagccggcgagatcaccgtcctggtggaggtggccgacatggagctgcataccaagaagatcgagatcagcggcctcaaattcgcctccctgacctgcacggggtgttacgcctgcagctccggcatcagctgcaaggtccggatccacgtggacgagccggatgagctgaccgtgcacgtcaagtccgaggatcccgacatcgtggccgccagctccagcctcatggcccgcaagctggagttcgggaccgatagcaccttcaaggcgttctccgccatgcccaagacgagcctgtgcttctacattgtggagagagagtattgtaagagttgcagcaaggaggacacgcagaagtgcgtcaacaccaagctcgagcaaccccagtccatcctcatcgagcacaaaggaaccatcatcgggaaacagagcaacacgtgcaccgccaaggcctcctgctggttagagagcgtgaagtcctttttctacggcctgaagaacatgctcagcggcatcttcgggaacgtgttcatcggcgtcttcctgttcttcgccccgttcatcctactcatcctgttcttcatgtttgggtggcgtatcctgttctgcttcaagtgctgccggcgcacccggggcctcttcaagtaccgccacctgaaggacgacgaggagaccggctatcggaagatcatcgagcgactgaacaacaagaagggcaagaacaagctcctggacggcgagcgcctggcggaccggaaaatcgccgagcttttctccacgaagacccacatcgggtga

SEQ ID NO: 15312 - RNA, 5055 nt, synthetic construct
  misc_feature 1..5055: note = derived and/or modified CDS sequence (opt11) from CCHFV(SPU 383/87)__KJ682806.1__GP
  source 1..5055: mol_type = other RNA
atgtacacgcccctgctctgcgccattctgtgcctccagctctggagcctggagggcatctacgggctgtccaaccgcacccagcacaacgacaccagcaccatcaaagtgccggaggagtcccagaagaccagcctccccgccaacaccgcgtcccccattacgagcgacccgccctccaccaccagcaccgcctccgccagcggccccgaggggtccggcgacacgagcacctccccgcccgtcaccacccaggggcccacaccgcccgagaccacccccgagccccacaccacgatcgacatcgacaagagctccaccgccatcgccgacatcagcacccagaccgtgaaggacatccccacgcccaccacccacacctctctgcccagcacgctgtccgcgccgaccatcccccaggaggcccaccacaccgcccggggcctcctgagcatcaccagcacgaagcccggcgaggcctccacccccatcagcccgggggaggcgtctaccgaggcctctagcccccagcccaccatctccgagacgccctccccaccgccaaccgcccaggcccccaccgagatcaactcccccaacacctcccgccagcccatgcccagcacgcaaccggccgcgcccaactccgtgacccaccccgcccagcctaccccgagccagtccgacgtccccaccgccgcccaggacattcaccccaaccccatcaaccggagcaagcgcaacctggagatggagatcatcctcaccctgtcccagggcctgaagaagtactacgggaaggtgctaaagctgctggacctaacgctggaggaggacaccgagggcctgctcgagagctgcaagcggaacctggggctgacatgcgacgacaacttcttccagaagcgcatcgaggagttcttcctcaccggcgagggtcacttcaacgaggtcctgcagttcaagacgccttccacactgagccccaccgagcccgcccgggtcgagtcccccaccgtggagccgttcaagagctacttcgcgaaggggttcctcagcatggactccggctacttcagcgccaaatgctactccaagtcttccaacagcgggctgcagctgatcaacgtgacgcagcaccttatccgcatcaccgacacccccggcccaaagatcaccaacctaaagacgataaactgcatcaacctgaaggccctcgtcttcaaggagcaccgggagatcgagatcaacgtgctgctgccccaggtggccgtcaacttgtccaactgccacgtgctgatcaagagccacgtgtgcgactactccctggacattgacggccccgtccgcctcccccggatccaccacgaggggaccttcatccccggcacctacaagatcgtgatcgacaagaacaacaagcagaacgaccgctgcaccctggtgaccaactgcgtcatcaaggggcgggagatccgcaagggccagagcgtgctgcgccagtaccgcaccgagatcaagatcgggaaggcctccagcggctcccggcgcctcctgagcgaggagtcgaacgacgactgcctgagccggacccagctcctgcgcaccgagaacgcggagatccactccgacaactacggagggcccggcgacaagatcacgatctgcaacgggagcaccatcgtggaccagcggctgggcagcgagctcgggtgctacaccatcaaccgcgtcaagtccttcaagctgtgcgagaacagcgctaccggcaagtcctgcgagatcgatagcacgccggtgcgctgccggcagggcttttgtctgaagataacacaggaggggcgcggccacgtgaagctgtcccgggggagcgaggtcgtgctcgacgcctgtgactccagctgcgagatcatgatccccaagggcaccggggacatactggtcgactgctccggcggccagcagcacttcctgaaggacaacctcgtggacctggggtgccccaacatccccctgctcggcaagatggctatctacatctgccgcatgagcaaccacccgaagaccacgatggccttcctgttctggttctccttcgggtacgtgatcacgtgtatactgtgcaaggtaatcttctacctcctggtggtggtcggcaccctgggcaagaagttcaagcagtacagggagctcaagccccagacctgcaccatctgcgagaccaaccccgtgaacgctatcgacgccgagatgcacgacctgaactgtagctacaacatctgcccgtactgcgcctcccgcctgaccagcgacgggctcgcccggcacgtgatccagtgccccaagcgcaaggagaagatcgaggagacagagctatacctgaacctggagcggatcccctgggtcgtgcgcaagttactccaggtatccgagagcacgggcgtcgcgctcaagcggtcctcgtggctggtgatcctgctcgtgctgctgaccgtctccctgtcccccgtgcagagcgccccgatctcccacggggagaccgtggaggtctaccagacccgcgagggctacaccagcatctgcctgttcgtgctggggtccatcctcttcctggttagctgcctgatgaagggcttagtcgactcagtgggcaacagcttcttccccgggctgtccatctgcaagacgtgcagcataggctccatcaacgggttcgaaatcgagagccacaagtgctactgctccctgttctgctgcccctactgtcggcactgcagcgccgacatcgagatacaccgcctccacctgtccatctgcaagaagcggaagaccggcagcaacgtgatgctggccgtctgcaagcgcatgtgcttccgggccaccgtggaggtctccaacaaggcgctcctgatccgcaacatcatcaacaccacgttcgtagtgtgcatcctgatcctcgccgtgtgcgtcgtgagcacctccgccgtggagatggagaacctgccggccgggacctgggagaaggaggaggacctgaccaacttctgccaccaggagtgccaggtcacggagaccgagtgcctctgcccgtacgaggccctggtgctgcgcaagcccctcttcctggacagcatcgtgaagggcatgaagaacctgctcaactccaccagcctggagaccagcctgtccatcgaggcgccctggggcgccatcaacgtccagagcacgttcaagcccaccgtgtccgccgccaacatcgccctcagctggtccagcgtggagcaccgcgggaacaagatcctggtctccggccgaagcgagtccatcatgaagctggaggagcggaccgggatcagctgggacctcggcgttgaggacgcatccgagagcaagctgctgaccgtgtccgtcatggacctcagccagatgtactcccccgtgttcgagtacctgagcggggaccgccaggtggaggagtggcccaaggccacgtgcaccggcgactgccccgagcggtgcggctgcacttcctccacgtgcctgcacaaggagtggccccacagccgcaactggcggtgcaacccgacctggtgctggggcgtcgggaccgggtgtacctgctgcggcctcgacgtgaaggacctgttcaccgactacatgttcgtgaagtggaaggtcgactacatcaagaccgaggccatcgtgtgcgtggaactgaccagccaggagcgccagtgcagcctcatcgaggcagggacccggttcaacctgggccccgtcaccatcacgctgtccgagccccgcaacatccagcaaaagctgcccccggaaatcgtgacccttcaccccagaattgaggagggcttctttgacctgatgcacatccagaaggtcctcagcgcgtccaccgtgtgcaagctacagagctgcacccacggggtacccggcgacctgcagatctaccacatcgggaatctcctgaagggcgacaaggtcaacggccacctgatccacaagatcgagccccacttcaacacgtcctggatgagctgggacgggtgcgacttagactactactgcaacatgggcgactggccgtcctgcagctacaccggggtgacccagcacaaccacgccgccttcgtgaatatgctgaacatcgagaccgactacaccaagaacttccacttccactccaagcgcgtcaccgcccacggcgacactccccagctggacctcaaggcccggcccacctacggggcgggcgagatcaccgtgctggtggaggtcgccgacatggagctgcacaccaagaagatcgagatcagcggcctcaagttcgcctccctgacctgcaccgggtgctacgcctgcagctccggcatctcatgcaaggtgcgaatccacgtggacgagcccgacgagctgaccgtccacgtgaagtccgaggacccggacatcgtggccgcgagctccagcctcatggcccggaagctggagtttgggacggactccaccttcaaggccttcagcgccatgcccaagaccagcctgtgcttctacatagtcgagcgcgagtactgcaagtcctgcagcaaggaggacacccagaagtgcgtgaacacgaagctcgagcagccccagtccatcctgatcgagcacaagggcaccatcttcggtaagcagaacgacacgtgcaccgcaaaggcgagctgctggctggagtccgtcaagagcttcttctacggcctcaagaacatgctttccggcatcttcgggaacgttttcatcggcgtgttcctgttcctggccccgttcatcatgctcatcctgttcttcatgttcgggtggcggatcctgttctgcttcaagtgctgccgccggacccgcggcctcttcaaataccggcacctgaaggacgacgaggagatcgggtaccgcaagatcatcgagcggctgaacaacaagaagggcaagaacaagctcttggacggcgagcgcctggccgaccgcaaaatcgccgagctgttcagcaccaagacccacatcgggtga

SEQ ID NO: 15313 - RNA, 5055 nt, synthetic construct
  misc_feature 1..5055: note = derived and/or modified CDS sequence (opt11) from CCHFV(SPU 497/88)__KJ682808.1__GP
  source 1..5055: mol_type = other RNA
atgtacacgcccctgctctgcgccatcttatgcctgcagctctggagcctggagggcatctacgggctgtccaataagacccagcacaacgacaccagcaccatcaaggtgccagaggagtcccagaagaccagcctccccgccaatatcgcgtcccccaccacgagcgatcccccgtccgccaccagcaccgcctccgcctcgggccccgaggggtccggggacaccagcacgtcccccagcgtcaccacccaggggccgaccccgctggaaatcacgcccgagccccacaccaccatcgacatagacaagtcctcaacctccatcgccgacatcagcacgcgcaccgtgaaggacatccccaccccgacaacgcacacctctcttcccagcacccccagcgcgcccaccataccgcaggaggtgcaccacacggcccggggcctcctgtccgtcacaagcaccaagcccgaggaggcctccaccctgacgagccccggcgaggcctccaccgaggcgagcagcccccagccgaccatctccgaaacccccagtcccccgcccacgacccaggcacccaccgagatcaacaaccccaacacctcccgccagcccatgccctccacgcagcccgccgcccccaactcagtgaccccacccgtgcagcccaccttctcccagagcgacgtctccaccgctgcgcaggacatccaccccagcccgaccaacaggtccaagcgcaacctcgagatggagatcatcctgacgctgagccaggggctcaagaagtattacggcaaggtgctgaagctgctcgacctgaccttagaggaggacaccgaagggctcctggagtggtgcaagcggaacctaggcctgacctgcgacgacaacttcttccagaagcgcatcgaggagttcttcctgacgggggaaggccacttcaacgaggtgctgcagttcaaaaccccctcaaccctcagccccaccgagcccgcccgggtcgagagcccgacggtggagccctttaagtcctacttcgctaagggattcctgagcatggactccgggtacttctctgccaagtgctaccccaagtccagcaactctggcctccagctcatcaacgtgacccagcacctgatccgcatcaccgacacccccgggcctaagatcacgaacctgaagaccatcaactgcatcaacctcaaagccctggtcttcaaggagcaccgggagatcgagatcaacgtgctgctcccccaggtcgcggtaaacctgagcaactgccacgtgctgatcaagagtcacgtgtgcgactactctctcgacatcgacggccccgtcagattaccccggatccaccacgagggcactttcatcccggggacatacaagatcgtgatcgacaagaagacgaagcagaacgaccggtgcaccttagtgaccaactgcgtcatcaagggccgggagatccgcaaggggcagtccgtgctccgccagtaccgcaccgagattaagatcggcaaggccagctccgggtctcggcgcttgctgtccgaggagagcaacgacgactgcctctcccggacgcagttgctcaggaccgagaacgccgagatccactccgacaactacggcggccccggggacaagatcaccatctgcaacggcagcaccatcgtggaccagcggctcgggagcgagctgggctgctacacgattaaccgcgttaagagcttcaagttatgcgagaactccgccacaggaaagagctgcgagatcgactcaacccccgttcgttgccggcagggcttttgcctcaagatcacccaggagggcaaggggcacgtcaagctcagccgcggctccgaggtggtgctggacgcctgtgacagctcctgcgagattatgatccccaaggggacgggcgacattctggtcgactgcagtgggggccaacagcacttcctcaaagacaacctggtggacttagggtgcccgaatatccccctcctggggaagatggcgatctacatctgccgaatgtccaaccaccccaagaccaccatggtgttcctgttctggttcagcttcggctacgtcatcacttgcatcctctgcaaggtgatcttctacctactgatcgtggtcgggacgctgggcaagaagttcaagcagtaccgcgagctgaagccccaaacctgcaccatctgcgagaccaacccggtgaacgccattgacgcggagatgcacgacctgaactgttcctacaacatctgcccctactgcgccagccggctcacgtccgacggcctggcccgccacgtgatgcagtgccccaagcggaaggaaaagatcgaggagaccgagctgtacctcaacctggagcgcatcccgtgggtcgtgaggaagctgctacaggtgagcgagtccaccggggtcgcgctgaagcgcagctcctggctagtgatcttgctggtgctgctcaccgtcagcctgagcccagtgcaatccgcccccatctcgcacggcgagaccgtggaggtctaccagacccgggaggggtacacctccatttgcctgttcgtgctcggcgggatcctgttcctggtaagctgcctcatgaagggcctggttgactccgtgggcaacagcttcttccccgggctgtccatctgtaagacctgttcaatcggcagcatcaacgggttcgagatcgagagccacaagtgctactgctccctcttctgctgcccgtactgccgtcactgcagcgccgacatcgagatccacaagctgcacctgtccatctgcaagaagcggaagacatggagcaacgtgatgttagccgtgtgcaaaagaatgtgcttccgggcgacggtggaggtgtccaataaggcgctgctgatccgcaacatcatcaacaccaccttcgtcgtgtgcattctcatcctggccatctgcgtggtcagcacctccgccgtggagatggaaaacctgcccgccggcacgtgggagaaggaggaggacctcaccaacttctgccatcaggaatgtcaggtgaccgagaccgaatgcctttgcccctacgaggcgctggtcctccggaagcccctgttcctggactcgatcgtgaagggcatgcgcaacctcctgaacagtaccagcctggagaccagcctctccatcgaggccccatggggcgccataaacgtacagagcacgttcaagcccaccgtctccgcggccaacatcgctctgagctggtcgagcgtggagcaccggggcaacaagatcctggtgtccgggagaagcgaatccatcatgaagctcgaggaacgcacgggcatcagctgggacctgggggtcgaggatgcctccgagagcaagctactcacggtgtcggtgatggatctgagtcagatgtattccccagtcttcgagtacttgagcggcgaccgccaggtggaggaatggcccaaggcgacctgcaccggggactgcccagagcggtgcggctgtactagcagcacctgtctccacaaagagtggccccactcccggaactggcgctgcaacccaacctggtgctggggcgtgggcaccggttgcacgtgctgcgggctggacgtcaaagacctgttcaccgactacatgtttgttaagtggaaggtggactacatcaagaccgaggccatcgtatgcgtggagctgaccagccaggagcggcagtgcagcctgatcgaggccggcacgcgcttcaacctggggcccgtcacgatcaccttatccgagccgcggaatatccagcagaaactgcctcccgagatcgtgaccctgcatccccgcatcgaggagggctttttcgacctcatgcacatccagaaggtgttaagcgcctccacggtctgcaagctgcagagctgcacgcacggcgtgccgggggacctccagatctaccacatcggcaacctgctgaaaggggacaaggtgaacggccacctaatccacaagattgagccccacttcaacacctcctggatgagctgggacggctgcgacctggactactactgcaacatgggggactggccctcctgcagctacaccggcgtaacgcaacacaaccacgccgccttcgtgaacatgctgaatatcgagacggactataccaagaactttcacttccactcgaagcgggtgaccgcccacggagacacgccccagctcgacctgaaggcgcgcccaacctacggcgccggggagatcaccgtcctagtggaggtcgccgacatggagctccacaccaagaagatcgagatcagcggcttgaagttcgcctccctgacctgcacgggctgctacgcctgtagctccggcataagctgcaaggtccggatccacgtggacgagcccgacgagctcaccgtgcacgtcaagtccgaggaccccgacatcgtggcggccagcagtagcctgatggcccgcaagctggagttcggcaccgattccacattcaaggccttcagtgccatgcccaagacgagcctctgcttctacattgtggagcgggagtactgcaagtcctgctctaaagaggacacccaaaagtgcgttaacaccaagctggagcagccgcagtccatcctgattgaacacaaggggaccataatcggcaagcagaatgacacgtgcaccgcccgcgccagctgctggctcgagtccataaagagcttcttctacgggctgaagaacatgctgtccggcatattcggcaacgtgttcatcgggatctttctgttcttcgcccccttcatcatgctaatcctgttcttcatgttcggctggcggatcctgttctgcttcaagtgctgccgccggacccgcggactcttcaagtaccgtcatctgaaggacgatgaggaggtaggctatcgcaagatcatcgagcggctgaacaataagaaggggaagaataaactcctggacggcgagcgcctggccgaccgcaagatcgccgaactcttcagcaccaagacgcacatcggctga

SEQ ID NO: 15314 - RNA, 5055 nt, synthetic construct
  misc_feature 1..5055: note = derived and/or modified CDS sequence (opt11) from CCHFV(88166)__AB069675.1__GP
  source 1..5055: mol_type = other RNA
atgtacactcccctgctctgcgccgttctgtgtctgcagctgtggagcctggagggctcccacgggctcagcaataagacccagcactccaacaccagcaccaccaaagccccggaggtctcccaggagctaggcctgcccgtgagcaccgtgtccacgataacctccgacccgccctccatcacgagcgcggtcagtgtgagcgggagtgagggcagcggggacaccaatacgtccccgagcgtgaccacccaaggccccaccctgcccgagacgaccctcgagcccctgactaccacggacaccgacgcctccagcaccgtcgtcgtggacgtctctacccaaacggtgaaggacaccccgatcagcaccacctacacgagcctgccctccaccccctctgagcccaccaccccgcagggcacgcaccacaccgcccgcgggctcctgtccgtgacaagcactaaacccgaggaggcctccacgcaggccaaccccggcaagatcagcatggagactaacagcccccgtctggcgatcagcgaaaccccgtccttcagccccactacgcaggcccccaccgaaaattccaacccaatcaccagcaagcaactcatgctgtccgcccagccggtcacccccaaccccatgaccagcccagtgcaaccggccctgtcccagagcgacacgtccaccgcgatccaagacatccaccccagccccaccggtaggtccaagcggaacctcgagatggagatcattctgaccctgagccagggtctcaagaagtactatgggaagatcctgaaacttcttgacctcacgctggaagaggacaccgagggactcctggagtggtgcaagcgcaacctgggccttgtttgcgacgacaacttcttccagaagcggatcgaggagttcttccttaccgggaagggccacttcaacgaggtcctgcagttcaagacacccagcacgctctccccgaccgggcccgcgcgcaccgggagccccacagtggagccgttcaagtcctacttcgccaagggcttcctgagcatggactccgggtatttcagcgcaaaatgctatccccgggcctccaacagcggcctacagctgataaatgtgacgcagcattccacacgtatcaccgacacccccgggcctaagatcacgaacttaaagaccatcaactgcatcaacctgaaagcgagcgtcttcaaggagcaccgggaaatcgagatcaacgtactcctgccccaggtagccgtcaacttatccagctgtcacgtgctcatcaagtcccacgtgtgcgattacagcctggatatcgatggccctgtccgcctgccccggatccaccacgagggtaccttcatcccaggcacctacaagattgtaatcgacaagaagaacaagcaaaacgaccgctgcaccctcgtgaccaactgtgtgatcaagggccgggagatcagaaaaggtcagtccgtgctgcgtcagtaccgcaccgagattaagataggcaaagccagctccgggagccggcgcctgctcagcgaggagtccggcgacgactgcatctcacggacccagctactgaggacggagaccgccgagatccactctgacaactacgggggcccgggcgacaaaatcaccatctgcaacgggtcaaccgtcgtcgaccagcggctgggctccgagctcgggtgctacacgatcaaccgagtcaagtcctttaaactgtgcgagaactccgccaccggcaagagctgcgagatcgactccacccccgtcaagtgtcgccaagggttctgcctgaagatcacccaggagggccgtggccacgtgaaacttagccgcgggtccgaggtggtcctggacgcgtgtgacagctcctgcgaaatcatgatcccaaagggcacgggggacatcctggtggattgctcgggcggccagcagcacttcctcaaggacaacctgatcgatctgggatgccccaacatccccctcttgggtaagatggctatctacatctgccggatgtcaaaccaccccaagactaccatgggcttcctcttctggtttagcttcggctatgtggtgacctgcatcttgtgcaaggtgatcttttacctgctaatcgtggtagggacgctcgggaagaagttcaagcaataccgcgagctgaaaccacagacctgcaccatctgcgagaccactcccgtgaacgccatcgatgccgagatgcacgacctaaactgctcctacaacatatgcccatactgtgcctcacgtctaacgtccgacggcctggcgcgtcacgttatgcagtgtcccaagcggaaggagaagattgaggagaccgagctgtacctcaacctggagcgcatcccctgggtcgtgcggaagttgcttcaggtgagcgagagcacgggggtcgccctgaaacgctccagctggctcgtggtactcctggtcctgctcaccgtgtccctatcccccgtgcagtccgccccgatcggccacggtaagacggtcgagacctatcagacccgcgagggctacaccagcatctgtctgttcgtgttggggtccatcttgttcatcgtgagctgcctgatgaagggactcgtcgactccgtgggcaacagcttcttccccgggctgtccatctgcaagacgtgcagcatcggctccgtgaacgggttcgagatcgaaagccacaagtgctattgttccctgttctgctgcccctactgccgccactgctcagccgaccgggagatccaccgcctccacttgtccatctgcaagaagcggaagacctggagcaatgtcatgctggccgtgtgcaagcgcatgtgcttccgagcgaccgtagaggtctccaacaaggccttgctgatccgcaacatcatcaacaccacgttcgtgctgtgcatcctgatcctagccgtgtgcgtcgtgagcaccagcgccgtggagatggagtctctgcccgcgggcacgtgggagcgggaggaggacttgaccaacttctgccaccaggaatgccaggtcacggagacagagtgcctgtgcccatatgaggccctggtgctccgcaagcccctgttctcggactccatcgtgaaggggatgaagaacctgctcaacagcacctccttagagaccagcctgtccatagaggccccctggggcgccatcaacgtccaaagcacgttcaaaccgaccatgtccgccgcgaacatcgccctcagttggtccagtgtcgagcaccgcggcaacaagatcctggtgtccggccggagcgagtccatcatgaagctggaggagcgaacgggaattagctggaacctcggggtcgaggacgcatccgagagcaagctgctgaccgtgagtgttatggacctcagccagatgtacagccctgtctttgagtacctttccggagatcgccaggtcgaggagtggcccaaggccacgtgcaccggggactgccccgagcgatgcggatgcaccagctccacgtgcctgcacaaggagtggccgcacagtcggaactggcgctgcaaccccacctggtgctggggcgttgggaccggttgcacgtgctgcggtctcgacgtgaaggacctgtttaccgattatatgttcatcaagtggaaagtggaatacatcaagaccgaggccatcgtctgcgtggagcttacctcccaggagcggcaatgtaccctcatcgaggctggcacccgcttcaacctaggccccgtgacaatcacactgagcgagccccggaacatacagcagaagctgcctcccgagatcgtcaccctgcacccccgcatcgaggaggggttctttgacctgatgcatgtgcagaaggtgctctccgccagcaccgtctgcaagctgcaatcctgcacccacggcgttcccggggaccttcaggtgtaccacatcggcaacctgctaaagggggacaaggtcaacggacacctgatccacaagatcgagccgcatttcaatacaagctggatgtcctgggacggctgcgacctcgactactactgcaacatgggagactggcccagctgcacctacaccggcgtgacccagcacaaccacgcggcctttgtgaacatgctgaacatcgagacggactataccaagaacttccacttccactccaagcgggtcaccgcccacggagacacgccccagctggatctcaaggcgcgtcccacctacggggccggggagatcaccgtgctggtggaagtcgccgacatggagctgcacaccaagaaaatcgaaatcagcggcctcaaattcgcctccctcacgtgcacgggctgctatgcgtgcagctcagggatcagctgcaaggtgcgcatccacgtggacgagccggacgaactgaccgtccacgtgaagtccgaggaccccgacctcgtagccgccagtagctccctgatggcgcggaagttagagttcggcaccgacagcacgtttaaggccttctccgcgatgcccaagacgagcttatgtttctacatcgtcgaacgggagtactgtaagtcctgcagcaaggaggacacgcagaaatgcgtaaacaccaagctggagcagccccagtccatcctgatagagcacaagggtaccatcatcggtaagcaaaacaacacgtgcactgccaaggcgagctgctggctggagagcgtcaagagcttcttctacgggctaaagaacatgctgtccggcatcttcggcaacgtcttcatcggcgtgttcctgttcttcgccccattcatcctcctgatcctgttcttcatgttcggctggcgaatcttgttctgcttcaagtgctgccggcgtacccgggggctgttcaagtaccgccacctgaaggatgacgaggagaccggctaccggaagatcatcgagcgcctcaacaacaagaagggcaagaacaagctgctggacggggaacgcttagccgaccggaaaatcgcggagcttttcagcacgaagacccacatcgggtga

SEQ ID NO: 15315 - RNA, 5055 nt, synthetic construct
  misc_feature 1..5055: note = derived and/or modified CDS sequence (opt11) from CCHFV(strain BA88166)__AF338470.1__GP
  source 1..5055: mol_type = other RNA
atgtacacgcccctactctgtgccgtactgtgcctgcaactctggagcctggagggctcccacgggctgagcaacaagacccagcactccaacaccagcaccaccaaggccccggaggtctcccaggagctcggcctgcccgtgagcaccgtgtctaccatcaccagcgacccgccctccatcaccagcgctgtgtccgtgagtgggtccgagggcagcggcgacacaaacacgtccccgagcgtgaccacccagggccccacccttccggagacgaccctcgagccgctgaccactacggacaccgacgcatccagcaccgtcgtggtggacgtctccacccagactgtgaaggacacccccatcagtaccacctacacgagcctgccctccaccccaagcgagcccaccaccccgcagggcacgcaccacaccgcccgcgggctcctgtctgtgacctctaccaagccagaggaggcctccacgcaggccaaccccggcaagatcagcatggagaccaacagcccccggttagctatctccgagaccccgtccttcagccccaccacgcaggcccccaccgagaactccaaccccatcaccagcaagcaactcatgctgtcagcccagccggtaacccccaaccccatgaccagccccgtgcaaccggccctgtcccagagcgacacgtccaccgcgatccaggacatccaccccagccccaccgggcgctccaagcggaacctcgagatggagatcattctgaccctgagccaggggctcaagaagtattacgggaagatcctgaagctgctcgacctgacgctggaggaggacacagagggccttctggagtggtgcaagcgcaatctgggcctggtgtgcgacgacaacttcttccagaagcggatcgaggagttcttcctgacggggaagggacacttcaatgaggtcctgcaattcaagactcctagcacgctctccccgaccgggcccgccaggaccggctctccgaccgtggagccgttcaagtcctacttcgccaagggcttcctgagcatggacagtgggtacttcagcgccaagtgctacccccgggcctccaacagcggcctgcaactcatcaacgtgacgcagcactccacccgcatcaccgacacccccgggcctaagatcacgaacctgaaaactatcaattgcatcaacctgaaggccagcgtcttcaaggagcaccgggaaatcgagatcaacgttctactgccccaggttgccgttaacctttccagctgccacgtgctcatcaagtcccacgtgtgcgactacagcctggacatcgacggccccgtccgcctgccgcgcatccaccacgaggggaccttcatccccggcacctacaagatcgtgatcgacaagaagaacaagcagaacgaccgatgcacgctcgtcaccaactgcgtgatcaagggccgggagatccgcaaggggcagtccgtgcttcggcagtaccgcaccgagatcaagatcggcaaagcctcatccgggagccggcgtctgctcagcgaggagtccggggacgactgcatcagccgcacccagctgctgcgcacggagaccgccgagatccactccgacaactacgggggcccaggcgacaagataaccatctgcaacgggagcaccgtcgtagaccagcggctgggctccgaactcgggtgctacacgatcaaccgcgtcaagagcttcaagctgtgcgagaactccgccaccggcaaatcgtgcgagatcgactccacccccgtaaagtgccgccagggcttctgcctgaagatcacccaggaaggccggggccacgtgaagctcagccgcgggtccgaggtagtcttggacgcctgcgatagctcctgcgagataatgatcccaaaaggtaccggggacatcctggtggactgcagcggcggccagcagcatttcctcaaagacaacctgatcgacctggggtgccccaatatcccgctcctgggcaagatggccatctacatctgccggatgtccaaccaccccaagaccaccatggggttcctattctggttcagcttcggctacgtggttacctgcatcctctgcaaggggatcttctacctgctgatcgtggtgggcacgctcggtaagaagttcaagcagtacagagagctgaagccccagacctgcaccatctgtgagaccacccccgtcaatgccatcgatgccgagatgcacgacttgaactgctcctacaacatctgcccgtactgcgcaagccggctcacgtcagacgggctggcgcggcatgtgatgcagtgccccaagcggaaggagaagatcgaggagaccgagctgtacctcaacctggagcgcatcccctgggtggtccggaagctgttacaggtgagcgagagcaccggcgtggccctgaagcgctcgagttggctggtcgtgctcctggtgctgctcaccgtctccctgtctcccgtgcagtccgccccgatcgggcacggcaaaacagtagagacataccagactagggaggggtacaccagcatctgcctgttcgtcctcggctccatcctgttcatcgtgagctgcctgatgaagggcctcgtggactccgtcgggaatagcttcttccccggcctatccatctgcaagacgtgcagcatcgggtccgtgaacggcttcgagatcgagagccacaaatgctactgctccctgttctgctgcccctattgccgccactgcagcgctgacagagagatccaccgcctccacctgtccatctgcaagaagcggaagacctggagcaacgtgatgctggccgtttgcaaacgcatgtgtttccgggcgaccgtggaggtgtccaacaaggccctcctgatccgcaacatcatcaacaccacgttcgtcttgtgcatcctcatcctggccgtgtgcgttgtcagcaccagcgccgtggagatggagtccctgcccgccggcacctgggagcgggaggaggacctcacgaacttctgccaccaggagtgccaggtgacagagaccgagtgcctgtgcccgtacgaggccctggtcttacgcaagcccttgtacctggacagcatcgtgaagggcatgaagaacctcctgaatagcaccagcctggagacctcactctccatcgaggccccctggggcgccataaacgtgcagtccacgttcaagccgaccatgagcgccgcaaacatagctttatcatggagctccgtcgagcacagggggaacaagatcctggtcagcggccggtccgagagcatcatgaagctcgaggagcgcaccgggatctcctggaacctgggcgtggaggacgccagcgagtctaagctgctcaccgtctccgtgatggacctgtcccagatgtacagccccgtgttcgagtacctgagcggggaccggcaggtcgaggagtggcccaaggccacgtgcaccggcgactgcccggagcgctgcggctgcacctccagcacgtgcctccataaggagtggccgcactcccggaactggcgctgcaaccccacctggtgctggggcgtggggaccgggtgcacgtgctgcggcctggacgtcaaggacctgttcactgactacatgttcatcaagtggaaagtcgagtacatcaagaccgaggccattgtgtgcgtcgagctcaccagccaggagcggcagtgtaccctgatcgaggcgggcacccgcttcaacctggggcccgtgatcatcacgctctccgagcccagaaacatccagcagaagctgccgcccgagatcgtgaccctgcacccccgcatcgaggagggcttcttcgacctcatgcacgtccagaaggtgctgagcgcctccactgtgtgcaagttacagagctgcacccacggggtccccggcgacctccaggtgtaccacatcgggaatctgctgaagggcgacaaggtgaacggccacctcatacacaagatcgagccccacttcaacacctcctggatgagctgggacgggtgcgacctggactactactgcaacatgggtgactggccctcctgcacgtacaccggtgtcacccagcacaaccacgctgccttcgtgaatatgttgaacatcgagaccgactacacgaaaaattttcacttccacagcaagcgggtgaccgcccacggcgacacgccacagctcgacctgaaggcgcgccccacctacggggccggcgagatcaccgtcctggtagaggtggccgacatggaattacacaccaagaagatcgagatctccggcctgaagtttgcaagcctgacatgcaccggatgctacgcgtgctccagcggcatctcctgcaaggtccggatccacgtggacgaacccgacgagctcacggtgcacgtcaagagcgaggaccccgacattgtagccgcctccagcagcctgatggcccgcaagctggagtttgggaccgactccactttcaaggccttcagcgcaatgcccaagacctccctctgcttctacatcgtggagcgagagtactgcaagagctgctccaaggaagacacgcagaagtgcgtcaacaccaaactggagcagccccagagcatcctaatcgagcacaagggcacgatcatcggcaagcagaataacacttgcaccgccaaggcctcctgctggctggagagcgtgaagtccttcttttacggcctcaaaaatatgctgagcggcatcttcgggaacgtgttcatcggcgtcttcctgttcttcgcccccttcatcctcctcatcctgttcttcatgttcggctggcgcatcctcttttgcttcaagtgctgccggcgcactcggggcctgttcaagtaccgccacctgaaagacgacgaggaaaccggctaccggaagatcatcgagcgcctcaacaacaaaaaggggaagaacaagctgctggatggcgagcgcctcgccgaccggaagatcgcggagctgttctccaccaagacgcacatcgggtga

SEQ ID NO: 15316 - RNA, 5055 nt, synthetic construct
  misc_feature 1..5055: note = derived and/or modified CDS sequence (opt11) from CCHFV(SPU 130/89)__KJ682807.1__GP
  source 1..5055: mol_type = other RNA
atgtacacgccccttctctgcgccatcctgtgcctgcagctctggagcctggagggcatctacgggctgtccaacaagactcagcacaacgacaacagcacgaccaaggcgccggaggagtcccacaagaccagcctccccgcgaacaccgcctcccccatcacgagcgacccgccttccacaaccagcaccacgtccgccagcggccccgaggggtccggcgacacgagcacctccccgcccgtgaccacgcaggggcccgccagccccgagaccacccccgagccccatactacgatcgacatcgacaaatccagcaccgccatcgcggacatcagtacccagaccgtcaaggacatcccgacgcccaccacccacaccagcctgccctccacgctgagcgcccccaccatcccgcaggaagcgcaccacaccgcccgcggcctcctgtcagtgacccggcacaagcccggcgaagcgagcaagcccacgagccccggggaggcctccaccgaggccagctccagccagccgaccatctccgagacccccagcccgccacccacgacccaggccccaaccgagatcaacaaccccaacacctcccgccagcccatgcccagcacgcagcccgccgcgccctccagcgtgacccacccggcccagcccacgccgtcccagagcgacgtccccaccgccgcccaggacatccacccgtcccccaccaaccggagcaagcgcaacctggagatggagatcatcctcacgctgtcccagggcctgaagaagtactacgggaaggtgttaaagctgctggacctcaccctggaggaggacaccgagggcctgctcgagtggtgtaagcggaacttagggctgacctgcgacgacaacttcttccagaagcgcatcgaggagttcttcctcacgggcgaaggccacttcaacgaggtgctgcagtttaagacccccagtaccttgtcccccaccgagcccgcgcgggtcgaaagccccacggtggagcccttcaagagctacttcgcgaagggtttcctctccatggacagcggctacttctcagccaagtgctaccccaaaagctccaatagcgggctgcagctgatcaacgtgacccagcacctcatccgcatcaccgacaccccgggccccaagatcacgaacctgaagaccatcaactgcatcaacctgaaggccctcgtcttcaaggagcaccgggaaatcgagatcaacgtgctcctgccccaggtggccgtcaacctctccaactgccacgtgctgatcaagtcccatgtgtgcgactactccctggacatcgatggccccgtccgcctcccgagcatccatcacgaggggaccttcattcccggcacttacaagatcgtgatcgacaagaagaacaagcagaacgaccggtgcaccctggtgaccaactgcgtcatcaaggggcgcgagatccggaagggccagtccgtgctgcgccagtaccggaccgagatcaagatcgggaaggccagttccggcagccgccggctcctgtccgaggagcccaactacgactgcctgagccgcacccagctcctgcggactgagaacgcggagatccactccgacaactatggcgggcccggcgacaagatcaccatctgcaatgggagcaccatcgtggaccagcgactgggcagcgaactcgggtgttacaccatcaaccgggtaaagtccttcaagctgtgcgagaactcagccacgggcaagtcctgcgagatcgacagcaccccggtgaggtgccgccaaggcttctgcctgaagatcacccaggaggggcggggccacgtgaagctgtcccgcgggagcgaagtcgtgctcgatgcttgcgactccagctgtgagatcatgatccccaagggcaccggtgacatcctggtcgactgctccggcggccaacagcacttcctgaaggataacctcgtcgacctggggtgccccaatatccccctgctcggcaagatggccatctacatctgccggatgtctaaccacccgaagacgaccatggccttcctgttctggttctccttcgggtatgtgattacgtgtatcctgtgcaaggtcatcttttacctcctgatcgtagtgggcactctaggcaagaagttcaagcagtaccgcgaactcaagccacagacctgtaccatctgcgagaccaaccccgtcaacgcgatcgacgccgagatgcatgacctgaactgcagctacaacatctgcccgtactgcgcaagtcggctcaccagcgacgggctcgcccgccacgtgatgcaatgccccaagcggaaggagaagatcgaggagacggagctgtacttaaacctcgagcgcatcccctgggtggtccggaaactgctccaggtgtccgagagcaccggcgtggcgctgaagcgctccagctggctggtcgtgctcctcgtgctgctgaccgtctccctcagccccgtgcagagcgccccgatctcccacggggagaccgtggaggtctaccagacccgggagggatatacgagcatctgcctgttcgtgctggggagcatcctcttcctggtgagctgcctgatgaagggcctcgtcgattccgtgggcaacagcttcttccccggtctgtccatctgcaagacctgcagcatcggctccatcaacgggttcgagatcgaaagccacaagtgctactgctccctgttctgctgcccctactgccgccactgcagcgccgacatcgagatccacaagctccacttgtccatctgcaagaagcggaagaccggcagcaacgtgatgctggcagtctgcaagcgcatgtgtttccgggcgaccgtagaggtgtccaacaaagcgctcttaatccgcaacatcatcaacacgaccttcgtcgtttgtatcttaatcttggccgtgtgcgtcgtgagcacctccgccgtggagatggagaatctgcccgccgggacctgggagaaggaggaagacctgacgaacttctgccaccaagagtgccaggtcaccgagaccgagtgcctctgcccctacgaggccctggtgctgcggaagcctctcagcctggactccatagtgaagggcatgaagaacctgctcaacagcacgagcctggagacgtccctgtcaatcgaggcgccctggggcgccatcaacgtccagtccacgttcaagcccaccgtgagcgccgccaacatcgccctctcctggagctccgtggagcaccgcgggaacaagatcctggtcagcggccggtccgagagcatcatgaaactggaggaacgcacggggatctcctgggacctcggcgtggaggacgcgagcgagtccaagctgctgactgtaagcgtcatggatctctcccagatgtactcgccggtgttcgagtacctgtccggggaccgccaggtggaggagtggcccaaggcgacatgcaccggcgattgccccgagcggtgcgggtgcacctcctccacgtgcctgcacaaggagtggccacacagccgcaactggcggtgcaatccaacctggtgctggggcgtcgggaccgggtgcacgtgctgcggcctggacgtgaaggacctgtttacggactacatgttcgtgaagtggaaggtcgactacattaagaccgaggctatcgtgtgtgtggagctgaccagccaggagcgccagtgctccctcatcgaggcagggacacggttcaacctgggcccagtcacgatcaccctgagcgagccccgcaacatacagcagaagctgcccccagagatcgtgaccctccacccccggattgaggagggcttcttcgaccttatgcacatccagaaggtcctatccgcctcaaccgtgtgtaagttacagtcttgcacgcacggggtgcccggcgacctgcagatctaccacatcgggaacctcctgaagggcgacaaagttaacggccacctgatacacaagatcgagccccacttcaacaccagctggatgtcctgggacgggtgtgacctggactactactgcaacatgggagactggccgagctgctcctacaccggggtgacccagcacaaccacgccgccttcgtgaacatgctgaacatcgagactgactacaccaagaacttccacttccacagcaagcgcgtcaccgcccacggcgacactccccaactggacctcaaagcccggcccacctacggggcgggcgagatcaccgtgctggtggaggtcgccgacatggagctgcacaccaagaaggtggagatctcgggcctcaagttcgccagcttaacctgcaccgggtgctacgcctgctccagcggcatatcctgcaaggtgcgcatccatgtcgacgagcccgacgagttgacggtgcacgtcaagagcgaggacccggacatcgtggccgcgtcgagctccctaatggcccggaagctggagttcgggaccgacagcacctttaaggcctttagcgccatgcccaagacctccctgtgcttctacatcgtggaacgcgaacactgcaagagctgctccaaggaggacacgcagcggtgcgtgaacactaagctcgagcagccccagagcatcctgatcgagcacaagggcaccatcatcgggaagcaaaacgacacgtgcaccgcgaaggcgagttgctggctggagtcaatcaagtccttcttctacggcctcaagaatatgcttagcggcatcttcgggaacgtcttcatcggcgttttcctgtttttggccccgtttataatcctcatcctgttcttcatgttcgggtggcgcattctgttctgcttcaagtgctgccgtcgcacccgaggcctcctaaagtaccgccacctgaaggacgatgaggagatcgggtaccggaaaatcatcgagcgcctcaataacaagaagggcaagaataagctgctggacggcgaacggctcgccgaccgtaagatcgccgagctgttctccaccaagacccacatcgggtga

SEQ ID NO: 15317 - RNA, 5052 nt, synthetic construct
  misc_feature 1..5052: note = derived and/or modified CDS sequence (opt11) from CCHFV(4701-ST-2009)__KR814872.1__GP
  source 1..5052: mol_type = other RNA
atgcacaccctgctagtgtgctttatcctgtacctgcagttgagtggcctcgggggcgcgcacggtcagtccaacgcgaccgagcacaatggcactaacaccaccaccgctcccgggacaagccagtccccgaagcctcccgccagcacgacgctgccccacacccccgagagtagcacggtcaagctcaccacccccacctccgagacagagggcagcggcgagactacgcccccgcccaacaccacccaggggttacccctgaccggcaccacccccgagcgcagcgccacgaccgccacctccacctccagcacggacaacatgaactcgaccacccaggtgacagacaacacgcccactagcactgtgtccatcagcccttcctcaagtagtagcatgccctccacgccccaggggacccaccaccccgtccggagcctcctgtccgtgtcgtctccgaagaccgtgaccacccccacgccaatgagccccggcgagatgtccccggagaccagctcccaacactcagccatgtcccgcgtccccaccctgtacaccgcgacccaggtgagcacggagaacaccgaccggtccacgccccgccagtctgagtcctccgtgcagcccgccacccagtcgccgataaccagcccagcccagaccatcctcctgatgtccgccgcacccaaggctatccaggacatgcacccgagcccgaccaaccggagcaaacgcaacctggaggtcgagatcatcctcaccctgtcgcaggggctgaagaagtactacggcaagatcctcaagctcctgcatctaacgctggaggaggacaccgagggcctgctcgagtggtgcaagcggaacctgggaagcaactgcgacgacgacttcttccagaagcggatcgaggagttcttcatcactggcgaagggtacttcaacgaggttctgcagtttaagaccctctccacgcttagccccaccgagccctcacacgtgcggctgccaaccgctgagccgttcaagagctatttcgccaagggcttcttatccatagacagcgggtacttctccgccaagtgctacccccgctcctccaccagcgggctgcagctcatcaacgtcacgcagcaccccgcgcgcatcgccgagaccccaggcccaaagaccacctccctcaagacaatcaactgcataaacctccgcgccagcgtgttcaaggaacaccgggaggtggaaattaacgtcctgctccctcagatcgccgtgaacctgtccaattgccacgtagtcatcaacagtcacgtgtgcgactactccctggacaccgacgggcccgttcgcctcccgcggatccatcacgagggtaccttcattcccgggacctataaaatcgtcatcgaccgcaaaaacaagctgaatgaccggtgcagcctggtcaccaactgcgtaatcaagggcagggaggttcggaagggccagagcgtgctccgccagtacaagacggagatcaagatcgggaaagcctctacaggcagccgtaagctgctgtccgaggagcccggggacgactgcatctcgagaacccagctccttaaaacggagaccgcggagatccacgacgacaactacggcgggcccggcgacaagatcaccatctgcaacggctcgaccgtcgtggatcagcgcctggggagcgaacttggttgctatacgatcaaccgggtgaagtccttcaagctgtgcgagaactcagcgaccgggaagacatgcgaaatcgactccacccctgtcaagtgccgccagggcttttgcctgaagatcacacaggaagggcggggacacgtgaaactgagccgaggctccgaagtggtcctcgacgcctgcgacagctcctgtgagatcatgatccccaaagggaccggcgatatcctggtggactgtagcggtggccagcagcacttccttaaggacaacctcatcgatctgggctgcccccacatccccctgctcgggaagatggccatctatatctgtcggatgtccaaccacccgcgcactaccatggccttcctgttctggttcagcttcggctacgtgatcacgtgcatcttctgcaaggcgctgttctactcactcatcatcatcgggaccctgggcaagaagatcaagcagtaccgggaactgaagccccaaacctgcaccatctgcgagaccgccccagtaaacgccatcgacgccgagatgcacgacctgaactgtagctacaatatctgcccctactgcgcctctcgtctgacgagcgacgggctggcgcggcacgtaacacaatgcccgaagcgcaaggagaaagtggaggagaccgagctgtacctgaacctggagcggatcccctggattgtgagaaagctcctccaagtgagcgagtccaccggcgtggccctgaagcggtcctcttggctcatcgtactgctggtgctcctgacggtgagcctgtcccccgtgcaaagcgcccccgtgggtcacgggaagaccattgagacctaccagacccgcgagggcttcacgtccatctgcttgttcatgctggggagcatcctgttcatcgtgtcctgtctcgtcaagggcctggtggattctgtctccgacagcttcttccctgggctgtccgtctgcaagacctgtagcattggctccatcaacggcttcgagatcgagagccacaagtgctactgctccctcttctgctgcccctactgccggcactgcagtgccgatcgcgagatccaccagttgcacctgtccatctgcaagaagcggaagaccgggagcaacgtgatgctcgcggtgtgcaagcgcatgtgcttcaaagccacaatcgaggccagcagacgcgccctgctgatccgctccatcatcaacacaaccttcgtcatgtgcatactcaccctcgccatctgcgtggtaagcacctccgcggtcgaaatggaggacttacccgccggtacgtgggagcgggaggaggacctcaccaacttttgtcaccaggaatgccaggtgaccgagaccgagtgcctgtgtccgtacgaggcgttagtgctcagaaagcccctgtttctggacagcatcgttaaagggatgaagaacctccttaactccacgagcctggagacctccctcagcatcgaggcaccctggggagccatcaacgtgcagagtaccttcaagcccaccgtgagcacggcgaacatcgccctgtcctggagctccgtcgagcaccgggggaacaagatcctcgtgaccggccgcagcgagtccatcatgaagctcgaggagcggacgggcgtgagctgggacttgggggtcgaggacgcatccgagtcgaaactgcttacggtgagcatcatggacttaagccaaatgtactcgccggtgttcgagtacctgtccggcgaccgccaggtcgaggagtggcccaaggccacgtgcaccggggactgccccgagcggtgcggctgcaccagcagcacgtgcctccacaaggaatggccccactcacgcaactggcggtgcaacccgacctggtgctggggcgtggggaccggctgcacgtgttgcggcgtggacgtcaaggacctgttcaccgaccacatgttcatcaagtggaaggttgagtacatcaagaccgaggccatcgtgtgcgtcgaactgacctcccaggagaggcagtgcagcctcatcgaggcgggcacccggttcaacctgggccccgtgaccataaccctgtccgagccccgcaacatccaacagaagctgcccccggagattatcacgctccaccccaagatcgaggagggcttcttcgacctgatgcacgtgcagaaggtcctcagcgcctccaccgtgtgcaaacttcagtcgtgcacccacggcatccccggggacttacagatctaccacatcgggaacctcttaaaaggtgaccgggtcaacggccacctgatccataagatcgagccccacttcaacacctcctggatgagctgggacgggtgcgacctcgactactattgcaacatgggcgattggccgtcctgcacgtacaccggcgtgacccagcacaaccacgccgcgttcgtgaatctactgaacattgagacggactacacgaagaccttccacttccatagcaagcgcgtcaccgcgcacggggacacgccacaactcgacctgaaggcccggcccacctatggcgccggggagatcaccgtgctggtagaggtagccgatatggagctccacaccaagaaggtcgaaatctccggcctgaagttcgcctccctgacctgcacgggatgctacgcgtgttcctcaggcatctcctgcaaggtgcgcatccacgtcgatgagcccgacgagctcaccgtgcacgtcaagagcagcgacccggacgtggtggccgcctccaccagcctcatggcccggaagctcgagttcggcaccgactccacgttcaaggctttcagcgcgatgcccaagacctctctctgcttttacatcgtggaacgcgagtactgcaagagctgttccgaggacgacaccaagaagtgcgtcgacaccaaactggagcagccccagtctatcctgatagaacataaggggaccatcatcggcaagcagaacgatacctgcaccgccaaggcctcctgctggttggagagcgtgaagtccttcttctacggcctgaagaacatgctgggcagcgtgtttgggggcttctttgtcggcatcttactgtttctggcccccttcgtattactcgtgctgttcttcatgtttggctggaagatcttattttgcttcaagtgctgccggcgcacccggggcctgttcaagtaccgccacctaaaggacgacgaagagaccgggtatcgccggatcattgagagattaaactccaagaaggggaagaaccgactcctggacggcgagcgcctggccgaccggaagatcgcggagctattctcaaccaagacccacatcgggtga

SEQ ID NO: 15318 - RNA, 5052 nt, synthetic construct
  misc_feature 1..5052: note = derived and/or modified CDS sequence (opt11) from CCHFV(36-ST-2014)__KR814857.1__GP
  source 1..5052: mol_type = other RNA
atgcacaccctcttagtgtgctttatcctgtacctgcagctcagcggcctcgggggcgcgcacgggcagtccaacgcaaccgagcacaacggcacgaacaccaccaccgtgccggggaccagccaatctccgaagccacccgcatcgaccacgctgccccataccccggagtcgagcacggttaagctgacgacccctacctccgagaccgagggctcaggcgaaaccacaccacccccgaataccacgcaagggctgccaccacccggcaccaccccggagcgccccgccaccaccgcgacgtcaatgagctccaccgacaacatgaacagcaccacacaggtgaccgacaatacccctacctcaacggtttctatctcccccagctccagcccctccatgcctagcacaagccaagggatccactaccccgtgcggtccctgctgagcgtgtccagccccaagaccgtcaccacgccgacccccatgtcccccggtgaaatgagccccgagacttccagccagcacagcgccatgagccggattccgaccctgtacacggccacccaagtttccaccgaaaacaccaacagatctacaccccgccagtccgagagctccgctcagcccgctacgcaaagccccaccacatccccgacccagacgattctgctcatgagcgccgcccccaaagcgatccaagacatgcacccctctccgacaaatcgatcaaagaggaacctcgaagtggagatcatactgacgctcagccaggggctgaagaagtactacggcaaaatcctgaaactcctgcacctgaccctcgaggaggacactgagggcctgctcgagtggtgcaagcgtaacttagggtccaactgcgacgacgacttcttccagaagcgaatcgaagagttcttcatcaccggcgaagggtactttaacgaggtcctgcagttcaagaccctgagtaccctatcccccacggagcccagccacgtgcggctgccaaccgccgagccgttcaagtcctactttgccaagggcttcctgagcatcgactccggctatttcagcgccaagtgctacccgcgttcctcaacctccggtctccagcttatcaacgtgacccagcacccggcccggattgctgagacgcccggcccgaagaccacctctctgaagaccataaattgcatcaacctccgcgcctccgtcttcaaggagcatcgggaagtcgagattaatgtgctgctgccccagatcgccgtaaacctcagtaactgccacgtggtcatcaactcccacgtctgcgactacagcctggacacggacgggcccgtgaggctgccccggatccaccatgagggcacattcatccccgggacctacaaaatcgttatcgacaagaaaaacaagctcaacgaccgctgctccctggtcactaactgcgtgatcaaggggcgagaggtgcgcaagggacagagcgtcttacggcagtacaagacggagatcaagatcgggaaagcaagcaccggctcccgcaagctcctctcggaggagcccggggacgactgcatctcccggacccagctgctcaaaaccgagacggctgagatccacgacgacaactatggcgggcccggcgacaagatcaccatctgcaacggaagtaccattgtggaccagcgcctgggatccgagttgggctgttacaccatcaaccgtgtcaagagcttcaagctctgtgagaactccgcgacggggaagacctgcgaaatagacagcacgcccgtgaagtgccggcagggcttctgcctcaagattactcaggaggggagggggcacgtgaagctctcccggggcagcgaagtcgtgctggacgcctgcgactccagctgcgagatcatgatcccgaaggggacgggcgacatcctcgtggactgctccgggggccagcagcatttcctgaaagacaacctgatcgaccttggctgcccccacatccccctgctggggaagatggccatctacatctgccgcatgtcaaaccatccccgtaccaccatggcattcctcttctggttctcctttggctacgtcataacctgcatcttttgcaaggcactcttctacagcctgatcataatcggcactctcggcaagaagatcaagcagtaccgcgagctgaaaccccaaacgtgcactatctgtgagaccgcgcccgtaaacgccatcgacgccgagatgcacgacctgaactgctcctacaatatttgcccctactgcgccagtcgcctcacctccgacgggctcgcccgccacgtgacccagtgtcccaagcggaaggagaaggtcgaggagactgagctgtatctcaacctggagcgtatcccgtggatcgtccggaagctgctccaggtgagcgagagcaccggcgtagcgctgaagcgctccagctggctgatcgtgctcctggtactactcactgtctcactgagccctgtgcaatccgcccccgtgggccacgggaagaccatcgagacctatcagacccgggagggctttaccaacatatgcctgttcatgctcggtagcatcctcttcatcgtctcctgccttgtgaaaggcttagtggacagcgtctccgatagcttcttcccggggctgtccgtatgcaagacctgctcaatcggatccattaacggcttcgaaatcgaaagccacaagtgctactgcagcctgttctgttgcccctactgccgccactgtagcgccgaccgagagattcaccagctgcacctgggtatctgcaagaagcgaaaaacaggctcaaacgtgatgctggccgtctgcaagcggatgtgtttcaaggcgaccatcgaggccagccgccgggccctcttgattcggtccataatcaacaccacgttcgtgatctgcatcctgaccctcgccatctgcgtggtcagcacctccgccgtggagatggagaacttgcccgctggcacctgggagcgagaggaagacctgaccaacttttgccaccaagagtgccaggtgtccgagaccgaatgcctgtgcccctacgaggccctagtcctccggaaaccgttattcctggacagcatcgtgaagggaatgaagaacctgctcaactcgacgagcttggaaacctccctgagtatcgaggccccgtggggagccatcaatgtgcagtccacgttcaagcccaccgtcagcaccgctaacattgcgctttcctggtcatccgtggaacatcgcggcaacaaaatcctcgttaccggccggagcgaatcgatcatgaagctcgaggaacgcacaggagtctcgtgggacctcggcgtggaggatgcaagcgaaagcaagctgctgaccgtgtccatcatggacctaagccagatgtactccccggtcttcgagtacctgagcggcgatcggcaggtcgaagagtggccgaaggccacttgcacaggcgattgccccgaaagatgcgggtgcacgagcagcacctgtctgcacaaggagtggcctcacagccggaactggcgctgcaaccccacctggtgctggggcgtggggaccggttgcacgtgctgcggtgtcgacgtgaaggacctattcacagaccacatgttcatcaagtggaaggttgagtacatcaagaccgaggcgatcgtctgtgtggagctaacctcccaggagcggcagtgcagcctgatagaggccggtacccgctttaacctcggacccgtgacgatcaccctgtccgagccccggaacatccagcagaagctgcccccagagatcatcaccctacatccgaagatcgaggagggatttttcgacctgatgcacgtccagaaggtgctgagcgcgtcgaccgtgtgcaagctccagagctgcactcatgggatccccggcgacctgcagatctaccatatcgggaacctgctcaagggcgaccgacttaatggtcacctgatccacaaaatcgagccacacttcaacacctcctggatgagctgggacggatgcgacctcgactattactgtaacatgggagattggccctcatgcacctacacaggtgtaacgcaacacaaccacgccgcctttgtgaatctgctgaatatcgagaccgactacacgaagaccttccacttccactccaagcgggtaacagcgcacggcgacactccgcagctcgacctgaaagcgcgccccacctacggggccggcgagatcaccgtgctggtggaggtcgccgacatggagctccacaccaagaaggtggagatttccgggctgaagttcgccagcctggcctgcacgggctgctatgcgtgttcgagcggcatatcctgtaaagtccggatccatgtcgacgagcccgacgagctcaccgtgcacgtaaagtcctccgacccggacgtcgtagccgcctctacttcgctgatggcgcgcaagctagagttcgggacggattccaccttcaaggccttctctgcgatgccgaaaacctccctctgtttctacatcgtagagagagagtactgcaagagttgctccgaggacgacacgaaaaagtgcgtcgacacgaagctggaccagccccagagcatactgatcgaacacaagggaaccatcatcgggaagcagaacgatacctgcaccgccaaggcatcttgctggctcgagagcgtgaagtccttcttctacggcctaaagaatatgctgggaagcgtgttcggcaacttcttcgtcggcatcctcctgttcctggcgccgttcgtgcttctagtcctgttcttcatgtgcgggtggaagttcctgttctgtttcaagtgctgccgccggacgagaggcctcttcaagtaccgacacctgaaggacgacgaagagaccggttaccgccgcattatcgagcggctcaattccaaaaagggcaagaatcgcctcctagacggcgagcggctggccgacaggaagattgcggaactctttagcactaagtcccacattgggtag

SEQ ID NO: 15319 - RNA, 5055 nt, synthetic construct
  misc_feature 1..5055: note = derived and/or modified CDS sequence (opt11) from CCHFV(Matin)__AF467769.2__GP
  source 1..5055: mol_type = other RNA
atgtacaccctgctgctgtgcgccattctgtgcagtcagctctggtccagcgaggggatccacgggctgtccaacgagacccagcacggcaacgccagcacaatcaaggcccccgaggtgtcacaggggctgggcctccccgtttctaccgcgccgcccatcacctccgacccgccctcaatcacctccgccgccagcgtttcggggcccgagggcagcggcgacaccaacaccagccctcccgtgaccactcaggggctaaccctccccgagaccaccctcgagctgctgaccaccaccaacaccggcgccagctccaccgtcatcgtggacgttagcacccagactgtcaaggacacccccgtgtctaccgcccacaccagcccgcccgggaccccctccgccccaaccacgccccagggcacgcaccacaccgcccgcgggctcctgagcgttaccagcaccaagtccgaggaggccagcacccagaccaaccccaagaagacctccatggagaccaatagcccgggccccgcgacgtccgagaccccctccccctcccccaccacccaggcccccacggagaacaacaaccccaacacaccccggcagccgacgccgcccacacagcccgccaccccgagccccgtcacgtcccccgccctgctcgccagctcccagggtgacaccagcaccgccgtgcaggacgtgcatccttcccccaccaaccgcagcaagcggaacctggagatggagatcatcctcacgctctcccaggggctgaagaagtactacggcaagatcctgaagctcctggacttaaccctcgaggaggacaccgaggggctgctggagtggtgtaagcgcaacctcggcctggtctgcgacgacagcttcttccagaagcggatcgaggagttcttcctgaccggcgaggggcacttcaacgaggtgctccagttcaagacgccctctacgctgagccccaccgagccggccagggccggctcccccaccgtggagcccttcaagagctacttcgcccgggggttgctcagcatggactccggctacttcagcgccaagtgctatccccgcgcgtccaacagtgggctgcagctgatcaacatcacgcaacactccgcccggatcaccgacaccccgggccccaagatcactaacctcaagacgatcaactgcatcaacctgaaggccagcaccttcaaggagcaccgcgagatagagattaacgtcctgttacctcaggtggccgtgaatctgtccagctgccacgtcctgatcaagagtcatgtgtgcgattactcactcgacatcgacggcccggtgagactgccgcgcatccaccacgaggggacctttatacccggcacctacaagatagtcatagacaagaagaacaagcagaacgaccgatgcacgatcgtgaccaactgcgttatcaaggggcgcgagatccggaagggccagtccgtcctgagacagtataagaccgagatcaagatcgggaaggccagctccggcagtcggcgccttctgtccgaggagagcggcgacgactgcatctcccggacccagctgctccgcacggaaaccgcggagatccacagcgactcgtacgggggccccggggataagattaccatctgcaacggctccaccgttgtcgaccagcggctggggagcgagctaggctgctacacgatcaatcgcgtaaaatccttcaagctgtgcgagaacagcgccaccggcaagtcttgcgagatagacagtacccccgtgaagtgccgccaggggttttgcctcaagatcacccaggagggccggggccacgtcaagctgtcgcgcggctcagaggtggtgctcgacgcatgcgacagtagctgcgagatcatgatccccaagggcacgggggacatcctcgtcgactgctcgggcgggcagcagcacttcctgaaggacaacctgatcgacttaggctgccccaacatccccctgctggggaagatggccatctacatctgccggatgagcaaccaccccaagaccaccatggtgttcctcttctggttctccttcggctacgtgatcacgtgcatcctgtgtaaggtcatcttctacctgctcatcgttgtgggcacgcttgggaagaagttcaagcagtaccgcgagctgaagccgcagacttgcaccatctgcgagaccacccccgttaacgccatcgacgcggagatgcacgacctcaactgctcatacaacatctgcccatactgcgcctcccgactgacgtcggacggcctggcccgccatgtgatgcagtgccccaagcggaaggagaagatcgaggagaccgagctctacctgaacttggagcggatcccctgggtggtccggaagctcctccaggtgtccgagagcaccggcgtggccctgaagcgcagtagctggctcgtcgtgctgctggtgctcctgaccgtcagcctgtcccccgtgcagagcgcgcccatcggccacgggaagacggttgagacctaccagatccgggagggctacacctccgtctgcctcttcgtgctgggcagcatcctgttcatcgtctcctgcctcatgaaggggctggtcgacagcgacggcaactccttcttccctggcctgagcatttgcaagacgtgctccatcggcagtattaacgggttcgagatcgagtcccacaagtgctactgcagcctcttctgctgcccttactgccgccactgctccacggaccgggagatccacaagttacacctgagcatctgcaaaaagcgcaagactggctccaacgtgatgctcgccgtgtgcaagcggatgtgcttccgagccaccgttgaggtgagcaacaaggccctgctcatccggtccatcatcaacaccacgttcgtggtctgcatcctcatcctggccgtgtgcgtggtcagcacctccgcggtggagatggagagcctgcccgccggcacctgggagcgcgaggaggacttgatcaacttctgccaccaagagtgccaggtaaccgagacggagtgcctgtgcccctacgaggccctagtcctccggaaaccgctgttcctggacagcatcatcaagggaatgaagaacctcctgaactccaccagcctggagacgtccctcagcatcgaggcgccctggggcgccatcaacgtgcagtccactttcaagcccacgatgagcgcggctaatatagccctgtcctggagctccgtggagcaccgcgggaacaagatcctggtctctggccgatccgagagcattatgaagctcgaggagcgaaccggtatttcctgggacctgggcgtggaggacgccagcgagtccaagctgctcactgtgagcgtcatggacctgtcccagatgtacagccccgtgttcgagtacctgagtggcgaccgccaggtggaggagtggccgaaggcaacgtgcacgggggactgccccgagcggtgcggatgcaccagctccacgtgcctacacaaggagtggccccactcccgcaactggcggtgcaaccctacctggtgctggggcgtgggcacaggctgcacgtgctgcggactggacgtgaaggacctgttcaccgactacatgttcgttaagtggaaagtcgagtacataaagaccgaggtgatcgtttgtgtggagctcacgagccaggagcgccagtgctccctgatcgaggcgggcacccggttcaatctgggtccggtgaccataaccctcagcgaacccaggaacatccagcagaagctgccgcctgagatcgtcacgctgcacccacggatcgaggagggctttttcgacttaatgcacgtgcagaaggtgctgtccgccagcaccgtctgcaaactgcagtcgtgcacccatggggtgcccggcgacctccaagtgtaccacatcggcaacctcctgaagggggacaaggtcaacggtcacctcatccacaagatcgagccccacttcaacaccagctggatgtcctgggacggctgcgacctggactactactgcaacatgggcgactggcccagctgctcctacaccggggtgacgcagcacaaccacgccgcgttcgtgaacatgctgagcatcgagaccgattacaccaagaacttccacttccactccaagcgcgtcaccgcccacggcgacacgccgcaactcgacctcaaggcccgtcccacctacggcgccggggagatcaccgtgctggtggaagtcgccgacatggaactccataccaagaagatcgagatcagcggcctgaagttcgcgtccctgacgtgcaccggttgctacgcgtgcagctcgggcatcagctgcaaggtgcgaatccacgttgacgagcccgacgagctcaccgtccatgtgaagtccgaagatcccgacatcgtggccgccagcagcagtctgatggcccggaaactggagttcgggaccgatagcaccttcaaggccttctccgcgatgccgaaaactagcctctgtttctacattgtcgagcgcgagtactgcaagtcctgcagcaaggaggacacccagaagtgcgtgaacacaaagctggagcagccccagtccatcctaatagagcacaagggcacgatcatcggcaagcagaacgacacgtgcaccgccaaagccagctgctggctcgagtccgtcaagagcttcttctacgggttaaagaacatgctttccggcatcttcgggaacgtcttcatcgggatcttcctgttcctcgcccccttcgccctgctgatcctcttcttcatgttcggctggcggatcctgttctgcttcaagtgttgccgccggacccgcgggctgttcaagtaccggcacctcaaagacgacgaggagacgggctaccgcaagatcattgagcggctgaacaacaagaaggggaagaacaagctgctcgacggcgagcggctggcggaccgcaagatcgctgagctgttcagcactaagacccacgtggggtaa

SEQ ID NO: 15320 - RNA, 5052 nt, synthetic construct
  misc_feature 1..5052: note = derived and/or modified CDS sequence (opt11) from CCHFV(UCCR4405)__KY484029.1__GP
  source 1..5052: mol_type = other RNA
atgcacgccttgctcgtgtgcttcatcctgtacctgcagctcagcggtctcggcggcgcccaccgccagtccaacgcgaccgagcacaacggaaccaacacgaccaccgcccccggcaccagtcagtccccaaagccgcccgtcagcacgaccctgccccacacccccgaagcctccaccatcaagctgacgacccccaccagcgagaccgaggggtccggcgagacgaccccgccgcccaacacgacccagggcctacccctgcccgggacgacccccgagcggagcgccaccaccgcaacctccactagctccacagacgatatgaacagcaccacgcagatgacagacaacacccccacctcaactgtgagcatcggcctctccagctccccctctatgcccagtaccagccaagggatccactaccccgtccgctccctgctgtccgtcagcagtccgaaaaccgcgaccacgcccacccccatgagcccgggcgaggtgtccccggagaccagctcgcagcacagcgccatgtcccggatccccacgctctacacggccacccaggtgtctaccgagaacaccaaccgctcaatcccccggcaaagcgagtcctcggtccagcccgccacccagtccccgatcacgagccccgcgcaaaccatcctgctgatgtccgccgccccgaccgccatccaggacatgcacccctctccgaagaaccgctccaagcggaatctcgaggtggagatcatcttgaccctgagccaggggctcaagaagtattatggaaagatcctgaagctgctacacctgacgctagaggaggacaccgaaggcctcctggagtggtgcaagcgcaacctggggtcgaactgcgatgacgacttcttccagaagcggatcgaggagttctttatcaccggcgaggggtactttaacgaggtgctccagttcaaaaccccctccacgctgagccccaccgagccatcccacgtccgcctgcccactgccgagccctttaaaagctacttcgcgaagggattcctgtccatcgacagcggctatttctccgccaagtgctacccccggagctccacctccgggctgcagctgatcaacgtgacgcagcacccggcccgcatcgccgagacccccggccccaagaccacttccctcaaaacaatcaactgcatcaacctgcgggccagcgtgttcaaggagcaccgcgaggtcgagatcaacgtgctgctcccccagatcgcggttaacctgtccaactgccacgtggtgatcaacagccacgtgtgcgattactccctggacaccgacggcccggtccggctgccccgcatccaccacgaaggcgccttcatccccgggacctacaagatcgtgatagacaagaagaacaagctgaacgaccggtgcagcctggtgaccaattgcgtcatcaagggccgcgaggtgcggaaaggccagagcgtactcaggcagtacaagacggagatcaagatcgggaaggccagcaccggctcccggaagctgctgtccgaggaacccggggacgactgcatcagccgcactcagcttctgaagaccgaaactgccgaaatccacgacgacaactacggagggcccggcgacaagatcaccatctgcaacggctccaccatcgtcgaccagcgcttagggagcgagctcggctgctacaccatcaaccgggtgaagtccttcaagctgtgcgagaacagcgccaccgggaagacctgcgagatcgactcgacccccgtcaagtgccgccagggcttctgcctgaagatcacccaggaggggcggggccacgtgaagctgagccgcggctccgaggtggtcctcgacgcgtgcgacagctcctgcgaggtcatgatccccaaggggacgggcgacatcctggtcgactgcagcgggggccagcaacacttcctgaaggacaacctaatcgacctgggctgcccccacatcccgctgctcgggaagatggccatctacatctgccggatgtccaaccacccccgcaccaccatggcctttctgttctggttcagcttcggttacgtcatcacatgtatcttctgcaaggccttattctactccctcatcatcattgggaccctgggtaagaaaatcaagcagtacagagagctgaagccccagacctgcacgatctgtgagaccgcccccgtgaatgcgatcgacgcagagatgcacgatctcaagtgcagctacaacatctgcccgtactgcgcctcccgcctgacctcggacgggctggcccggcacgtgacgcagtgtcctaagcgcaaggagaaggtcgaggagaccgaactctacctgaacctggagcggatcccctggatcgtgcgcaagctcctccaggtgtccgagagcaccggcgtcgcgctgaagcggtcctcctggctcatcgtgctgctggtgctcctgaccgtctcactgtcccccgtgcagagcgctcccgtgggccacgggaagacaatcgagacctaccagacccgcgagggcttcacctccatctgcctctttatgctggggagcatcctgttcatcgtctcctgcctagtgaagggcctggtggacagcgtctccgacagcttctttcccgggctttcggtgtgcaagacgtgtagcataggctccatcaatggcttcgagatcgagagccacaagtgctactgctccctcttctgctgcccctactgccggcactacagcgcagatcgcgagatacaccagctgcacttatccatctgcaagaaacggaagaccgggagtaacgtgatgctcgcagtctgcaagcgcatgtgcttcaaggccaccatcgaggcgtcccggcgcgcactgttaatacgcagcatcatcaacaccacgttcgtgatctgcatcctcatcctggccatctgtgtggtcagcaccagcgccgtcgaaatggagaacctgccggccggcacctgggagcgggaggaggacctcaccaacttctgtcaccaggagtgtcaggtgacggagaccgagtgcttgtgcccgtacgaggcgcttgtcctccgcaaacccctgttcctggactcgaccgtgaaggggatgaagaacctcctgaactccaccagcctggagacctccctctctatcgaggccccctggggcgctatcaacgtgcagtccaccttcaagccaacagtcagcaccgccaacatcgcattatcatggtcttccgtggagcaccgcgggaacaagatcctggtgacgggacgcagcgagtccatcatgaagctggaggagcggaccggcgtcagctgggacctgggggtagaggacgcgtccgagagcaagctgctcaccgtttccatcatggacctgagccagatgtactcccccgtcttcgagtacctgagcggcgaccgccaggtagaggagtggcccaaggcgacctgcacgggggactgccccgagcggtgcggctgcaccagcagcacgtgcctccataaggagtggccgcactcccgcaactggcggtgcaaccccacctggtgctggggcgtggggaccggctgcacgtgctgcggggttgacgtgaaggacctgttcaccgaccacatgttcgtgaagtggaaggtcgagtacatcaagaccgaggccatcgtttgcgtggagctgacctcccaggagcgccaatgcagcctcatcgaggcaggcaccagattcaacctggggcccgtcaccatcactctgtccgagccccgcaacatccagcaaaagctcccgcccgagatcatcaccctgcaccccaaaatcgaggagggcttcttcgacctgatgcacgtgcagaaggtgctcagcgcctccacggtctgcaagctgcagagctgcacccacggcatccccggggacctgcagatctatcacatcggcaacctcctgaagggggaccgagtgaacggccacctaatccacaaaatcgagccgcacttcaacacctcctggatgagctgggacggatgcgacctcgactactactgcaacatgggcaactggcccagttgcacctacacgggcgtcacccagcacaaccatgccgccttcgtgaacctgctgaacatcgagaccgactacaccaagacgttccacttccactcgaagagggtgacggcccacggggacacgccccagctcgacctgaaggcccgcccgacctacggcgcgggggagatcaccgtcttagtggaggtggccgacatggagctccacaccaagaaggtcgagatttccggcctgaagttcgcgagcctggtgtgcaccgggtgctacgcctgctccagcggcatctcttgcaaggtgcgcatccacgtcgacgagcccgacgagctcaccgtgcacgtaaagtcctcggaccccgacgtggtggccgcgagcacgagcctcatggcccggaagctcgagttcggaaccgactccatcttcaaggccttcagcgcgatgcccaagacctccctctgcttctacatcgtggagcgcgagtactgcaagagctgctccgaggacgacaccaagaagtgcgtcgacacgaagctggaacaaccccagagcatactcatcgagcacaaggggaccatcatcggcaagcagaacgatacgtgcaccgccaaggcgtcctgctggctcgagagcgtgaagtccttcttctacgggctgaagaacatgctgggcagtgtgtttgggaacttcttcgtcggcatcctcctattcctggccccgttcgtgctactcgtgctattcttcatgttcggctggaagatcctgttctgcttcaagtgctgccggcgcacccggggcctcttcaagtaccgccacctgaaggacgacgaggagaccgggtaccgccggattatcgaacgcctgaactccaagaaggggaagaaccggctcctggacggcgagcgcctggccgatcggaagatcgccgagctgttcagcactaagacccacatcggctga

SEQ ID NO: 15321 - RNA, 5052 nt, synthetic construct
  misc_feature 1..5052: note = derived and/or modified CDS sequence (opt11) from CCHFV(Drosdov)__DQ211630.1__GP
  source 1..5052: mol_type = other RNA
atgcacgccctgctcgtgtgtttcatcctgtacctgcagctctccgggctcgggggcgcgcaccgacagtccaacgcgactgagcataacgggaccaacacgaccaccgcccccggcaccagccagtccccgaagccgccagtcagcacgaccctgccccacaccccagaagcctccaccatcaagctgacgacccccaccagcgagaccgaggggtccggagagacgaccccgccgcccaacactacccagggcctgcccctacccgggacgacccccgaacggtccgccaccactgctacgtctaccagctccaccgacgacatgaacagcaccacacagatgaccgacaacacccccacctccacggtgagcatcggcctctccagctcccctagcatgccctccaccagccaagggatccactaccccgtacgcagcctgctgtctgtcagctccccgaagaccgcgaccacgcccacccccatgagccccggcgaggtgtccccggagacgagctcccagcacagcgccatgtcccggatccccaccctctacacggccacccaggtgagcaccgagaacaccaatcgctccatcccccggcagagtgaatcctcagtccagcccgccactcagagtccgatcacgagccccgcgcagaccatcctgctgatgtcagccgcccccaccgccatccaggacatgcaccccagcccgaagaaccgctccaagcggaacctcgaagtggagatcatcctgaccttaagccaggggctcaagaagtactacggcaaaatactgaaactgctccacctgacgctggaggaggacaccgagggcctcctggagtggtgcaagcgcaacctggggagcaactgcgacgacgacttcttccagaagcggatagaagagttcttcatcaccggcgagggatacttcaatgaggtgctccagttcaagaccccctccacgttaagccccaccgagccctcccacgtccgcctgcccaccgccgagcccttcaagagctacttcgcgaagggcttcctctctatcgacagcggctacttctccgccaagtgctacccccggagctccaccagcgggctgcagctgatcaacgtgacgcagcacccggcccgcatcgccgagacccccggccccaagaccacctccctcaagacgatcaactgcatcaacctgcgtgctagcgtgttcaaggagcaccgcgaggtcgagatcaacgtactgctcccccaaatcgcggtgaacctgtccaactgtcacgtcgtgatcaacagccacgtgtgcgactactcgctggacaccgacgggccggtccggctcccccgtatccaccacgagggcgcctttatccccgggacctacaagatcgtgatcgacaagaagaacaagctgaacgaccggtgcagcttggtgaccaactgtgtcatcaagggccgagaggtgcggaaaggccagtccgtgctccgccagtataagactgagatcaagatcggaaaggctagcaccggcagccggaagctgctgtccgaggagcccggggatgactgcatctcgcgcacccagcttttaaagaccgagacggccgagatccacgacgacaattacggcgggccgggggacaagatcaccatctgcaacggctccaccatcgtcgaccagagactgggcagcgagctcgggtgctacaccatcaaccgggtgaagtcattcaagctgtgtgaaaacagcgccacggggaagacctgcgaaatcgactccacccccgtcaagtgcaggcagggcttctgcttaaagatcacccaggaggggcgcgggcacgttaagctgagccgcggctccgaggtggtcctcgacgcgtgtgacagctcctgtgaggtgatgatacccaaggggacgggcgacatcctggtggactgcagcgggggccagcagcacttcctgaaggacaacctcatcgatctaggctgcccccacatcccgctgctcgggaagatggccatttacatttgccggatgtccaaccacccccgcaccaccatggccttcctgttctggttcagcttcggctacgtcatcacgtgcatcttttgcaaggcgctgttctactccctcatcatcatcgggaccctgggtaagaagatcaagcagtaccgggagctgaagccccagacctgcaccatctgcgagaccgcccccgtgaacgcaatcgacgccgagatgcacgacctcaaatgcagctacaacatctgcccgtactgcgcctcccgcctgaccagcgacgggctggcgcggcacgtgacgcagtgcccgaagcgcaaggagaaggtcgaagagaccgagctctacctgaacctggagcgaatcccctggatcgtgcgaaagctccttcaggtgtccgagagcaccggcgtcgcgctgaagcggagctcctggctgatcgtgctgctggtgctcctgaccgtcagcttgtcccccgtgcagagcgcccccgtgggccacgggaagacgatcgagacttaccagacccgcgagggcttcacctccatctgcctcttcatgctggggtcgatcctgtttatcgtctcctgcttagtgaagggcttggtggacagcgtctccgacagcttcttccccgggctgtccgtgtgcaagacgtgcagcatcggctccattaacggcttcgagatcgaaagccacaagtgctactgctccctcttctgctgcccctactgtcggcactacagcgccgaccgcgagatccaccagctgcacctgtccatctgcaagaagcggaagaccgggagcaacgtgatgctcgccgtctgcaagcgcatgtgctttaaggccaccatcgaagcgtcccgtcgcgccctgctgatccgcagcatcatcaacaccacattcgtgatatgcatcctcatcctggcgatctgcgtggtcagcacatccgccgtggagatggagaacctcccggccggcacctgggagcgggaggaggacctcaccaacttttgccaccaggagtgccaggtgacggaaaccgagtgcctgtgcccctacgaggcgctggtcctcaggaagcccctgttcctggacagcaccgtgaaggggatgaagaaccttctgaactccaccagcctggaaacttccctcagcatcgaggccccgtggggcgccatcaacgtgcaatccacctttaagccgaccgtttcgaccgccaatatcgccctgtcctggtcatccgtggagcaccgtgggaacaagatcctggtgacgggccgctcggaatccatcatgaagctggaggaacggactggcgtcagctgggacctgggggtcgaggacgcctccgagtcaaagctgctcaccgtgtccatcatggacctgtcacagatgtactcccccgtctttgagtacctgagcggcgacagacaggtggaggaatggcccaaggcgacctgcacgggggactgccccgaacggtgcgggtgcaccagcagcacgtgcctccataaggagtggccacactcccgcaactggcggtgcaaccccacctggtgctggggcgtggggaccggctgcacgtgctgcggcgtcgacgtgaaggacctgttcaccgaccacatgttcgtgaagtggaaggtcgaatacatgaagaccgaggctattgtgtgcgtcgagctgacgtcacaggagcgccagtgcagcctcatcgaggccggtacccggttcaacctggggcccgtaaccatcaccctgtccgagccccgcaacatccagcagaagctcccgcccgagatcatcaccctgcaccccaagatcgaggagggcttcttcgatttaatgcacgtgcagaaggtgctcagcgcctccacggtctgcaagctgcagagctgcacccacggcatccccggggacctgcagatctaccacatcggcaacctcctgaagggggaccgggtgaacggccacctgatccacaagatcgagccgcactttaacacctcctggatgagctgggacgggtgtgacctcgactactactgcaacatggggaactggccctcctgcacctacacgggcgtcacccaacataaccacgccgccttcgtgaacctgttgaacatcgagactgattataccaagacgttccacttccatagcaagcgcgtgaccgcccacggggatacgccccagctcgacttgaaggcccggcccacctacggggcgggagaaatcaccgtcctggtggaggtggccgatatggagctccacaccaagaaggtcgagatctccggcctgaagttcgccagcctggtgtgcaccgggtgctacgcctgctccagcggcatctcatgcaaggtccgcatccacgtcgacgagccagacgagctcaccgtgcacgtcaagagttccgaccccgacgtggtggccgcgagcacgagcctgatggcacggaagctggagttcggcaccgactccatcttcaaggccttcagcgccatgcccaagacctccctctgcttctacattgtggaacgcgagtactgcaagtcttgctccgaggatgacaccaagaagtgcgtcgatacgaagctggagcagccccagagcatcctgatcgagcacaaagggaccatcatcggcaagcagaacgacacgtgcactgccaaggcgtcctgctggctcgagagcgtgaagtccttcttctacgggctgaagaacatgctgggcagcgtgttcgggaacttcttcgtcggcatcttgctgttcttggcgccgttcgtgctgctcgtgctgttcttcatgttcggctggaaaatcctgttctgcttcaagtgctgccggcgcacccggggcctgttcaagtaccgccacctgaaggacgacgaggagaccgggtatcgccggatcatcgagcgcctgaactccaaaaagggcaagaaccggctcctggacggcgagaggctggccgaccggaagatcgccgagctgttcagcaccaagacccacatcggatag

SEQ ID NO: 15322 - RNA, 5052 nt, synthetic construct
  misc_feature 1..5052: note = derived and/or modified CDS sequence (opt11) from CCHFV(44-ST-2010)__KR814859.1__GP
  source 1..5052: mol_type = other RNA
atgcacaccctgttagtgtgcttcatcctctatctgcagctcagcggcctcgggggagcccacggacagtccaatgcgaccgagcacaacggcacgaacaccacaaccgtccccgggacgagccagagcccgaagcccccggcgagcaccaccctgccccacaccccggagtccagcactgtgaagctgaccacacccaccagcgagacggagggcagcggcgagaccacgcccccgcccaacaccacgcagggcctgcctccacccggcaccacccctgagcgccccgccactacagccacctccatgagctccaccgacaacatgaatagcaccacccaggtgaccgataacacccccaccagcacggtctcaatatcccccagctccagcccttccatgcccagcacctcgcaggggatccactatcctgtgcggtccctgctcagcgtctccagtcccaagaccgtcaccacgccgaccccaatgtcccccggcgagatgagccccgagacctccagccagcactccgccatgagccgcatcccgaccctgtacacggccacccaggtgtccaccgagaacaccaatcggagcactccccgacagtccgagagctccgcgcagcccgccacgcagagccccaccacctccccgacccagactatccttctcatgagcgccgcacccaaggcgatccaggatatgcacccctccccgaccaaccgaagcaagcgcaacttggaggtggagatcatcctgaccctcagccaggggcttaagaagtactacggtaagatcctgaaactcctgcacctgaccctcgaggaggacacggagggcttactggagtggtgcaagcgaaacttagggtccaactgcgacgacgacttcttccaaaaacgcatcgaggagttcttcatcaccggcgaggggtacttcaacgaggtcctgcagttcaagactctaagcacgctctcccccacggagcccagccacgtgcggctgcccaccgcagagccgttcaagtcatacttcgccaagggattcctgagcatcgactccggctacttcagcgccaagtgctacccgcgctccagcacctccgggctccagctgatcaacgtgacccagcatcccgcccggatcgctgagacgcccggaccgaagaccaccagcctgaagaccatcaactgcatcaacctccgcgcctccgtcttcaaggagcaccgggaggtggagatcaacgttctgctgcctcaaatcgccgttaacctttcaaactgccacgtggtcatcaactcccacgtatgtgactacagcctggacacggacgggcccgtgcgcttaccccggatccaccacgagggcaccttcatcccggggacctacaagatcgtgatcgacaagaagaataagctcaacgaccgctgctccctggtgaccaactgcgtcataaagggccgggaggtgcgcaagggccagagcgtcctgcggcaatacaagacggagatcaagatcggtaaggcctccaccggctcccgcaaactcctgagcgaggagcctggcgacgactgcatttcacggacccagctgctcaagacggaaacggccgagatccacgacgacaactacggcgggcccggcgataagatcaccatctgcaacggcagcaccatcgtggaccagcgcctcggctccgagctgggctgctacaccatcaaccgagtcaagagcttcaaactctgcgaaaactccgccacgggtaagacctgcgaaatcgacagcacccctgtaaagtgccggcagggcttttgcctaaagatcacccaggaggggcgcggccacgtgaagctgtcccggggatctgaggtggtgttggacgcctgcgactccagctgcgagatcatgatcccgaaaggaacgggcgacatcctcgtggactgttccgggggtcagcagcatttcctgaaggacaacctgatcgacctcggttgcccccacatccccctgctgggaaagatggcaatctacatatgccgcatgagcaatcacccccggactaccatggcgtttctcctttggttctccttcggctacgttattacctgcatcttctgtaaggccctgttctacagcctcatcatcatcgggaccctgggcaagaagatcaagcagtaccgcgagctgaagccgcagacctgcactatctgcgagactgcgcccgtgaacgccatcgacgccgagatgcacgacctcaactgctcctacaacatctgcccatattgcgcctcacggctgaccagtgatggactggcccgccacgtcacgcagtgccccaaacggaaggagaaagtcgaggagaccgagctctacctgaacctggagcgcatcccttggatcgtgcgaaagctcctgcaggtcagcgagagcaccggagtcgcacttaagcgctcctcgtggctcatcgttctgttagtgctcctgaccgtctccctgagccccgtgcagtccgcgcccgtgggccacggcaagacgatcgagacctaccaaacgcgggaggggttcaccaacatctgccttttcatgctggggagcattctgttcatcgtctcctgcttagtgaaaggattggtggactcagtctccgactcgttcttcccggggctgtccgtgtgcaagacgtgcagcttcggctccatcaacggcttcgagatcgagagccataaatgttactgctccctcttctgctgcccctactgcaggcactgcagcgcggatcgggagatccaccagctgcacctggggatctgcaagaagcggaagaccggcagtaacgtgatgctcgccgtctgcaagcggatgtgctttaaggcgaccatcgaagcctccaggcgggccctcctgatccgctccatcatcaacactacgttcgttatttgcatcctcaccttggctatctgcgtggtcagcacctcggccgtggagatggagaacctgccggccgggacctgggagcgcgaagaagacctcacgaacttctgccaccaggagtgccaagtgtccgaaacggagtgcctgtgcccctacgaggccttagtccttcggaaaccgctgttcctggactctatagtgaagggcatgaagaacctcctgaactcaacaagcctggaaacctccctcagcatcgaggccccctggggcgccatcaacgtgcagtccacgtttaagcccaccgtcagcaccgccaacatcgcgctgtcatggagctccgtggagcaccgcgggaacaagatcctggtgaccggccggagcgagagcatcatgaagctcgaggagcgcacgggggttagctgggacctgggcgtggaggacgcctccgagagcaaactattaactgtttccatcatggacctgagccagatgtactcccccgtcttcgagtaccttagcggggaccgccaggtggaggagtggccgaaggcgacctgcactggcgactgccccgaacggtgcgggtgcaccagctccacgtgtctccataaggagtggcctcatagccggaactggcgctgcaaccccacctggtgctggggcgtgggcaccgggtgcacgtgctgcggcgtcgacgtgaaagacctgttcaccgaccacatgtttatcaagtggaaggttgagtacatcaagacggaggccatcgtctgcgtggagctcacctcccaggagcggcagtgcagcctcatcgaggccgggacccgcttcaacctcggcccggttacgataaccctgtccgagcccagaaacatacagcagaagctcccgcccgagatcatcaccctgcaccccaagatcgaggagggtttcttcgacctgatgcacgtccagaaggtcctcagcgcctccaccgtgtgcaagctgcagagctgcacgcacgggatccccggcgatctgcagatctaccacattgggaacctcctgaaaggcgaccgcctgaacgggcacctcattcataagatcgagccccacttcaacacatcctggatgagctgggacggctgcgacctggactactactgcaacatgggcgattggccctcctgcacctataccggggtcacgcagcacaaccacgccgccttcgtgaacctgctcaatatcgagaccgactataccaagacattccacttccatagcaagcgggtcacggcccacggcgacaccccgcagctggacctgaaggcgaggcctacctacggggccggcgagattacggtgctcgtggaggtcgccgacatggaactgcacacaaagaaggtggagatctccggtctgaaattcgccagcctcgcatgtactggctgctacgcgtgctcaagcggcatctcctgcaaggtgcggatccacgtcgacgagcccgacgagctgacggtgcacgtgaagtcatcagaccccgacgtcgtcgccgccagcaccagcctgatggcgcgcaaactcgagttcgggaccgactccaccttcaaagccttcagcgcaatgccgaagacctccctgtgcttctacatcgtggagcgggagtactgcaagagctgttccgaggacgacaccaagaagtgcgtcgacacgaagctggaccaaccccagagcatcctcatcgaacataagggcaccattatcggaaagcagaacgacacctgtaccgccaaggcctcgtgttggctggagtcagtcaagagcttcttctacggcctgaagaatatgctcggcagcgtgttcggcaacttcttcgtgggcatcctgctgttcctggcccccttcgtgctcctggtgctgttcttcatgtgcgggtggaagatcctcttctgcttcaagtgctgccgccggacgcgcggcctgttcaagtaccggcacctaaaggacgatgaggagaccgggtaccgccgcatcatcgagcggctcaattccaagaagggtaagaaccgcctgctggatggagagcggctagctgaccgcaagatcgcggagctgttcagcaccaagtcccacatcggctag

SEQ ID NO: 15323 - RNA, 5052 nt, synthetic construct
  misc_feature 1..5052: note = derived and/or modified CDS sequence (opt11) from CCHFV(3756-ST-2007)__KR814866.1__GP
  source 1..5052: mol_type = other RNA
atgcacaccctgctcgtgtgcttcatcctgtacctgcagctcagcggcctcgggggcgcccacgggcagtccaacgccaccgagcacaaccgcacgaacaccaccaccgtccccggcacgagccagtccccgaaaccgcccgcgagcaccaccctgccccacacccccgagtccagcacggtgaagctgaccacccccacctccgagacggaggggagcggcgagaccaccccgccgcccaacaccacgcagggcctgcccctgcccgggaccacccccgagcggtccgccacaacggccaccagcacctccagcaccgacaacatgaacacgaccacccaggtaacggacaacacgcccacctccaccgtcagcatctcccccagctccagcccctccatgcccagcaccagccagggcatccactacccggtgcgctccctccttagcgtctccagccccaagacggtcaccacccccacccccatgtccccgggggagatgagccccgagacgtccagccagcactccgccatgagccggatccccaccctgtacaccgccacccaggtgtccaccgagaacatcaaccgcagcacgccccggcagtccgagtcatccgtgcagccggcgacccagagccccatcacctcccccgcccaaaccatcctcctgatgagcgccgcccccaaggcgattcaggacatgcacccttcccccacgaatcgcagcaagcgtaacctggaggtcgagatcatcctcaccctgagccagggcctgaagaagtactacgggaagatcctcaagctgctgcacctcaccctggaggaggacacagagggcctgctcgagtggtgcaagcgtaacctgggctccaactgcgacgacgacttcttccagaagcggatcgaggagttcttcataacgggggagggctacttcaacgaggtgctgcagttcaagacgctctcaaccctgtcccccacagagccgagccacgtgcgcctgcccacggccgagcccttcaagtcctacttcgccaaggggttcctcagcatcgactccggctacttcagcgccaagtgttacccccggtccagcacctccggcctgcagctgatcaacgtcacccagcacccggcccggatcgcggagacccccgggcccaagacgaccagcctcaagaccatcaactgcatcaacctgcgggcctctgtgttcaaggagcacagagaggtggagatcaacgtcctgcttccccagatcgccgtgaacctgagcaactgccacgtggtcatcaactcccacgtgtgcgactacagcctggacacagacggcccggtgagactcccccgcatccaccacgaggggacgttcatccccggcacctacaagatcgtcatcgaccggaagaacaagctgaacgaccgctgctccctggttacaaactgcgtgatcaaggggcgggaggtccgcaagggccagagcgtgctccggcagtacaagaccgagatcaagatcggcaaggccagcacgggttcgagaaagctgctgagcgaggagcccggcgacgactgcatctcccgcacccagctcctaaagaccgagaccgcagagatccacgacgacaactacgggggcccgggggacaagatcacgatctgcaacggcagcaccatcgtcgaccagcggctgggctccgagctcgggtgttacaccatcaaccgagttaagagcttcaagctgtgcgagaactccgcaaccggcaagacgtgcgagatcgacagcaccccggtgaagtgtcggcaggggttctgcctgaagatcacccaggagggccgcgggcatgtcaagctgtcccggggcagcgaggtggtgctcgacgcctgcgactccagttgcgagatcatgatccccaagggcaccggggacatcctggtcgactgctccggcgggcagcagcacttcctgaaggacaacctcatcgacctgggctgcccccacatcccgttactcggcaagatggcgatctacatctgccgcatgagcaaccatccacggaccaccatggccttcctgttctggttctccttcgggtacgtgattacctgcatcttctgcaaagccctgttctacagcctcatcatcatcggcaccctggggaagaaaatcaagcagtaccgcgagctgaagccccagacctgcacgatctgcgagaccgcgcccgtgaacgccatcgacgccgagatgcacgacctcaactgctcctacaacatctgtccgtactgcgccagccgacttacctccgacggcctggcccgccacgtcacccagtgccccaagcggaaggagaaggtggaggagacggagctctacctgaacctggagcgcatcccctggatcgtgcggaaacttctgcaggtcagcgagagcaccggggtggcgttgaagaggtccagctggctcatcgttctgctggtcctcctgaccgtgtccctgagcccagtgcagtccgctccggtcggccacggcaagaccatcgagacgtaccagacccgggaggggttcaccagcatctgcctcttcatgctgggctccatcctgttcatcgtgagctgcctggtgaaggggctggtcgactccgtgagcgactccttcttccccggcctgagcgtgtgcaagacatgctccatcgggagcatcaacggcttcgagatcgagtcccacaagtgctactgtagcctcttctgctgcccctactgccgccactgctccgccgaccgggagatccatcagctgcacctgagcatctgcaagaagcgcaagacaggctccaacgtcatgctcgccgtgtgtaaacggatgtgtttcaaggcgaccatcgaggccagccgccgcgccctgctgatccggagcatcatcaacaccaccttcgtgatctgcatcctgacgctggccatctgtgtcgtgtccaccagcgccgtggagatggaggacctgccggcggggacctgggagcgcgaggaggacctcaccaacttctgccaccaggagtgccaggtcacggaaaccgaatgcctgtgtccctacgaggccctggtgctccggaaacccctgttcctggactccatcgtgaagggcatgaagaacctcctaaacagcacctccctggagaccagcctctccatcgaggccccctggggcgccatcaacgtccagagcacgttcaagccgaccgtgtccaccgccaacatcgcgctgagctggtccagcgtggagcacagagggaacaagatcctggtcaccgggcggtccgagagcatcatgaagctcgaggagcgcacgggcgtgagctgggacctgggcgtggaggacgccagcgagtccaagctgctcaccgtcagcatcatggacctgagccagatgtacagccccgtgttcgagtacctgagcggggaccgccaggtggaggagtggcccaaggcgacctgcaccggcgactgccccgagcggtgcgggtgcacgtcctccacctgtctccacaaggagtggcctcacagccggaactggcgctgcaaccctacctggtgctggggcgtcgggaccggctgcacgtgctgcggcgtggacgtgaaggacctgttcaccgaccacatgttcatcaagtggaaggtcgagtacatcaagactgaggccatcgtgtgcgtggagctgacgagccaggagcggcagtgctccctcatcgaggccgggacccgcttcaacctgggccccgtcacgatcaccctgagcgagccccggaacatccagcagaagctcccgcccgagatcatcaccctgcaccccaagatcgaggaggggttcttcgacctgatgcacgtgcagaaggtgctctccgccagcaccgtctgcaagctgcagtcctgtacgcacggcatccccggcgacctgcagatctaccacatcgggaacctcctgaagggcgaccgcgtgaacgggcacctgatccacaagatagagccgcacttcaacaccagctggatgtcctgggacggctgcgacctcgactattactgcaacatgggggactggccctcgtgcacctacaccggcgtcacgcagcacaaccacgccgccttcgtgaacctgctgaacatcgagaccgactacactaagaccttccacttccactccaagcgggtgacggcccacggcgacaccccacagctcgacctgaaggcacgccccacctacggggccggcgagatcaccgtcctggtggaggtggccgacatggagctccacacgaagaaggtcgagatcagcggcctgaagttcgcctccctgacctgcaccggctgctacgcctgctcatccgggatcagctgcaaggtgcggatccacgttgacgagccggacgagctcaccgtccacgtgaagtccagcgaccccgacgtggtcgcggccagcacgtccctgatggcccgcaagctggagttcggcaccgacagcaccttcaaggccttctccgccatgcccaagaccagcctctgcttctacatcgtggagagagagtactgcaagtcctgcagcgaggacgacacgaagaagtgcgtggacaccaagctggaacagccccagtccatcctgatcgagcacaagggcaccatcattgggaagcagaacgacacgtgcaccgcgaaggccagctgctggctcgagtccgtcaagagcttcttctacggcctgaagaacatgctggggtccgtgttcggcagcttcttcgtggggatcctcctgttcctgaccccgttcgtcctgctcgtgctgttcttcatgtttggctggaagatactgttctgcttcaagtgctgccgccggacccgcggcctcttcaagtaccgccacctcaaggacgacgaggagaccgggtaccggcgcatcatcgagcggctgaactccaagaagggcaagaaccgcctactggacggggagcggctggccgaccgcaagatcgccgaactcttcagcacgaagactcacatcggctaa

SEQ ID NO: 15324 - RNA, 5052 nt, synthetic construct
  misc_feature 1..5052: note = derived and/or modified CDS sequence (opt11) from CCHFV(47-ST-2013)__KR814861.1__GP
  source 1..5052: mol_type = other RNA
atgcacaccctgctggcctgcttcatcctgtacctgcagctcagcggcctcggcggggcccacgggcagtccaacgcgaccgagcacaacgggaccaacacgaccacagtgcccgggaccagccagtccccgaagccgcccgccagcaccaccctgccccacacccccgagtccagcaccgtgaagctcaccaccccgacgtccgagaccgagggcagcggcgagaccaccccgccgcccaacaccacccaggggctgcccccgcccggaaccacccccgagcgttccgccaccaccgccaccagcacctccagcaccgacaacatgaactccacgacccagatgaccgggaacacccccacgcccaccgtcaacatgagcccctccagctccccgagcatgccctccaccagccagggcatccactacccggtgcggagcctgctctccgtccccagccccaagaccgccacgacccccacccccgtgtcccccggcgagatgagtcccgagacctccagccaacactccgcgacgagccgcatccccaccttatacaccgccacccaggtgtccaccgagaacacgaaccggagcactccccgccagtccaagagctccgtccagcccgccacccagagccccatcacgccgcccgcccaaacgatcctgctcatgtcagcggccccgaaggccatccaggacatgcacccctcacccaccaaccggtctaagcgcaatctggaggtggagataatcctgaccctcagccagggcctgaagaagtactacggcaagatcctgaagctcctgcacctgaccctcgaggaggacacggaggggctgttggaatggtgcaagcggaacctcggctccaactgcgacgacgacttcttccagaagcgcatcgaggagtttttcatcaccggggagggctatttcaacgaggtgctgcagttcaagaccctgagcactctcagccccacggagccgtcccacgtccggctgccaaccgccgagcccttcaagagctactacgccaagggcttcctgtccctcgacagcgggtacttctccgcgaagtgctacccccgcagctccaccagcggcctgcagctgatcaacgtgacccagcatccggcccggatcgccgagacgccggggcccaagaccacctccctcaagaccatcaactgcatcaacctgcgcgccagcgtgtttaaggagcaccgggaggtcgagatcaacgtgctgctcccccagatcgccgtgaacctgtccaactgccacgtcgtgatcaactctcacgtgtgcgactacccgctcgacacggacggccccgtccgcctcccccggatccaccacgaggggaccttcatccccggcacctacaagatcgtgatcgacaagaagaacaagctgaacgaccgctgctccctggtgaccaactgcgtcatcaagggtcgggaggtgcgcaaggggcagagcgtgctccggcaatataagacggagatcaagatcggcaaggcgtccaccgggagccgcaagctgctgtccgaggagccgggcgacgactgcatcagccggacccagctcctgaagaccgagacggccgagatccacgacgacaactacgggggccccggcgacaagatcaccatctgcaatgggagcaccatcgtcgaccagcgcctgggctccgagctcgggtgctacaccatcaaccgcgtcaagtccttcaagctgtgcaagaactccgccacgggcaagacctgcgagatagacagcacccccgtaaagtgcagacaggggttctgcctgaaaatcacccaggagggccgcggacacgtgaagctgtcccggggcagcgaggtggtcctcgacgcctgcgactccagctgcgagatcatgatccccaagggcacgggggacatcctggtggactgctccggcggccagcagcacttcctgaaggacaacctcatcgaccttgggtgcccgcacatccccctgttaggcaagatggccatctacatctgccgcatgagcaaccacccccggaccaccatggcgttcctgttctggttctccttcgggtacgtgatcacgtgcatcttctgcaaggccctgttctacagcctgatcatcatcggcaccctagggaagaagatcaagcaataccgcgagctgaagccccagacgtgcaccatctgcgagaccgccccggtcaacgccatcgacgccgagatgcacgacctcaactgctcctacaacatctgcccctactgcgcgagccggctgacctccgacggcctggcccgccacgtgacgcagtgtcccaagcgtaaggagaaggtggaggaaaccgagctctacctgaacctggagcgcatcccgtggatcgtccggaaactcctccaggtgagcgaatccaccggcgtggctctgaagcgcagctcctggctcatcgtcctgctggtgctcctgaccgttagcctgagccccgtacagtccgcacccgtggggcacggcaagacgatcgagacctaccagacccgggaggggttcaccagcatctgcctcttcatgctgggctccatcctgttcatcgtgagctgcctcgtcaaggggctggtggactctgtaagcgacagcttcttccccggcctgagcgtctgccgcacgtgctccatcggcagcatcaacgggttcgagatcgagtcccacaagtgctactgcagcctcttctgctgcccgtactgccggcactgctccgcggaccgcgagatccaccagctgcacctgagcatctgcaagaagcggaagaccggctccaacgtgatgctcgccgtttgcaagcgcatgtgcttcaaggccaccatcgaggccagtcggcgcgccctgttcatccgctccattatcaataccacgttcgtgacctgcatcctgaccctcgcgatctgcgtggtgagcacctccgccgtcgagatggaggacctgcccgccggtacgtgggagcgggaggaggatctgaccaacttctgccaccaggagtgccaggtgaccgagaccgagtgcctctgcccctacgaggccctggtgctgcgcaagcccctcttcctggacagcatagtcaagggcatgaagaacctgctcaactctacgtccctggagaccagcctgtccatcgaggccccgtggggcgcgatcaacgtgcagagcaccttcaagcccaccgtgtccacggccaacatcgccctcagctggtccagcgtcgagcaccggggcaacaagatcctggtgaccggccgctccgagagcatcatgaagctggaggagcggaccggggtgtcctgggacctcggcgtagaggacgccagcgagtccaagctgctgaccgtgagcatcatggacttgtcccagatgtacagccccgtgttcgagtacctgtccggcgaccgccaggttgaggagtggcccaaggccacgtgcaccggagagtgcccggagcggtgcgggtgcaccagcagcacatgcctgcacaaggagtggccccacagccgcaactggcggtgcaaccccacttggtgctggggcgtgggcaccgggtgcacgtgctgcggcgtggacgtcaaggacctcttcaccgaccatatgttcatcaagtggaaggtggagtacatcaagaccgaggcgatcgtgtgcgtcgaactgacgagccaggagcgccagtgctccctgatcgaggccgggacccggttcaacctcggccccgtgaccatcacgctgagcgagccgcgcaacatccaacagaagctgccgcccgagatcatcacgctccatcccaagatcgaggagggcttctttgacctgatgcacgtgcagaaggtcttatccgccagcaccgtgtgcaagctccagtcctgcacccacgggataccgggcgacctgcagatctaccacatcgggaacctgctcaagggcgaccgggtgaacgggcacctgatccacaagatcgagccccacttcaacaccagctggatgtcctgggacggctgcgacctggactactactgtaacatgggcgactggcccagctgcacgtacaccggggtcacccagcacaaccacgccgcgttcgtgaacctcctgaacatcgagaccgactacacgaagaccttccacttccactccaagcgcgtcaccgcccacggcgacacgccacagctggacctcaaggcccggccgacctacggggccggcgagatcaccgtgctggtggaggtcgccgacatggagctgcacaccaagaaggtggaggtgagcgggctcaagttcgcgtccttggcctgcaccggttgttacgcctgcagctccggcatctcttgcaaggtccgcatccacgtggacgagcccgacgagctgacggtgcacgtcaagtccagcgatcccgacgtggtggccgcctccaccagcctcatggcgcggaagctggagttcgggaccgactccaccttcaaggccttcagcgccatgcccaagacgagcttatgcttctacatcgtcgaacgcgagtactgcaagtcctgcagcgaggacgacaccaagaagtgcgtggacaccaagctcgagcagccgcagtccatcctgatcgagcacaagggcaccatcatcgggaagcagaacgacacgtgcaccgccaaggccagctgctggctggagtcagtcaagagcttcttctacggactgaagaatatgctggggagtgtcttcggcaacttctttgtgggcatcttgttgttcttggctcccttcgtgctgctggtcctcttcttcatgttcgggtggaagatcctgttctgcttcaagtgctgccggcgcacccggggcctgttcaagtacaggcacctcaaggacgacgaggagaccgggtatcgccggatcatcgagcgcctgaacagcaagaagggcaagaaccggctgctcgacggcgagcgccttgccgaccggaagatcgccgagctgttctctacgaagacccacatcgggtga

SEQ ID NO: 15325 - RNA, 5052 nt, synthetic construct
  misc_feature 1..5052: note = derived and/or modified CDS sequence (opt11) from CCHFV(1-CR/HU-2015)__KU161584.1__GP
  source 1..5052: mol_type = other RNA
atgcacactctgctcgtgtgtttcatcctttatcttcagctcctgggactaggcggggcccacgagcaaagcaatgccaccgaccacaaccgcacaaacactatcaccgcgcccagcacctcgcagaacccgaaaccgcctgcctccactacgcctccccacaccccggagagctccaccatcaaacttatcaccagcaccggggaggccgaggggtccggggagaccacaccgcccctgaacaccacccagggcccattcccgcccgaaaccaccagcgagcaccccgcctccaccgctaccaacaccagctccacaaacagcatgaactcaaccacacagatgaccgacaacaccctgacgagcacggtctccaccagcctctccataagcccgtccaccccaagcacgtcccagggcatccattaccccgtacggtccctgctgagcgtgtccagtcccaaaaccgcggccacccccacccccatgtctacgagagagatgagctccgagaccagctcacaacatagcgccatgtcccggacacccactttccacacagccacacaggtcagcaccgagaacgcgaaccgctcgacgccccgccagagcgagtccagcgcccagcccgccacccaaagccccatgacgagccccgcccagtccatcttcctcgtgagcgccgcgccgaccacaatccagaacatccatccctctcccactaaccgatccaagcggaacttagaaatggagatcatcctgacgctcccccaggggctgaagaaatactacggcaagatcttaaagctcctgcacctgactctcgaggaggacaccgaggggctgctggagtggtgtaagcgcaacttaggctctaactgcgatgacgagttcttccagaagcgtattgaggagttcttcatcaccggggagggttacttcaacgaggtgctgcagtttaagacgctgtccaccctcagcccaaccgagccctctcacgcccggccgcccaccgccgagccgttcaaaagctactttgccaagggcttcctgtccatcgacagtgggtacttctccgccaagtgctacccccggagctccacgagcggcctgcagctcatcaacatcacccagcaccctgcgcggatcgccgagacccccgggccgaagacgacgtccctgaagacaatcaactgcatcaacctgagggccagcgtcttcaaggagcaccgcgaagtcgagataaacgtattgctgccccagattgccgtcaacctgtccaactgccatgtggtgataaacagccatgtctgcgactactccctcgacactgacggccccgttagactcccccgcatttaccacgagggcaccttcatcccggggacgtacaagatcgtgatcgataagaagaacaagctgaacgatcggtgcaccttggtcaccaactgcgtgatcaagggccgcgaagtgcggaaagggcagagcgtcctgcgccagtacaaaaccgagatcaagatcgggaaggctagcactgggtcccgcaagctgctctcagaggagcccggagacgactgcatctcccgcactcagctgctgcgcaccgagaccgcggaaatccatgacgacaactatggcgggcccggcgacaagatcacgatctgcaacgggagcaccatcgtggaccagcggctcggctccgagctggggtgctacaccattaacagagtcaagtcatttaagctgtgcgagaactccgccaccggcaagacgtgcgagatcgacagcacacccgtcaagtgcagacagggcttttgcctcaagatcacccaggaggggcgcggccacgtgaagctgtctagaggttctgaggtggtcctggacgcctgcgacagtagctgtgaggtgatgattcccaagggcaccggtgacatcctggtcgactgttccggcggccagcagcatttcctcaaggacaacctgatcgacctggggtgcccccacatacctctcctgggtaagatggccatatacatctgccgcatgagcaaccacccccggacaaccatggccttcctgttctggttctccttcgggtacgtgataacctgcatcttctgcaaagccctgttctacagcctgatcatcatcggcaccctgggcaagaagatcaagcagtatcgcgagcttaaaccgcagacctgcacgatctgcgagaccgcccctgtgaacgccatagacgccgaaatgcacgacctgaactgttcctacaacatctgcccctactgcgcgagccggctgaccagtgacgggctcgcccgccatgtcacccagtgccccaagcgaaaggagaaggtggaggagacggagctgtacctgaacttagagcgcatcccgtggatagtgcggaagctgctgcaggtcagcgaaagcaccggcgtggccctcaagcgctcctcgtggctgatcgtcctgctcgtactgctgacagtgtccctctcacccgtgcaatccgcccccgtcggtcacggcaagaccatcgagacgtaccagacacgggaggggttcaccagcatctgcctgttcatgttaggctccatcttattcatcgtgtcgtgcctagtaaagggcctggtcgacagtgtgtcggactccttcttccccgggctcagtgtgtgccggacctgctccatcggcagcattaatgggttcgagatcgagtcccacaagtgctactgcagcctgttctgctgcccgtactgccggcactgctccgccgaccgcgaaatacatcagctgcatctcagcatatgcaagaaacgcaagaccggctccaacgtcatgctggcggtctgcaagcgcatgtgcttccgcgccaccatggaggccagtcggcgcgccctgctcatacggagcatcatcaacacaaccttcgtgatctgcatcctgacgctgaccatttgcgtcgtgtccaccagcgccgtggagatggagaacctccccgccgggacctgggagcgcgaggaggacctaacgaacttctgtcaccaggaatgccaggtcacagagaccgagtgcctgtgtccctacgaggccctcgtgttgcggaagccgttattcctcgactccatcgtgaaaggcatgaagaacctcctgaacagcacctccctcgagactagcctgtccatcgaggccccctggggcgccatcaacgttcagagcacattcaagcccaccgtgtccaccgccaacatcgctctgagctggtctagcgtggaacaccgagggaacaaaatcctcgtcacgggccggtccgagagcatcatgaagctggaggaacgcaccggtgtgtcctgggacctgggggtggaggacgccagcgagtcaaagctcctcaccgtctcgatcatggacttgtcccagatgtacagcccggtgttcgagtacctctcaggggaccgccaggtggaagagtggccgaaggcgacctgcacgggcgactgccccgagcgctgcggctgcacttcctccacgtgtctgcacaaggagtggccccactcccggaactggcgctgcaaccccacctggtgctggggagtgggcacagggtgcacgtgctgcggcgtggacgtgaaggacctgttcaccgaccacatgttcgtcaagtggaaggtggagtatatcaagactgaggccatcgtgtgcgtggagctcaccagccaggagcggcagtgctccctgatcgaggcggggacgcgcttcaacttgggacctgtgaccataactctcagcgagccgcggaacatccagcagaagctgccgcccgagatcatcaccttgcatcctaagatcgaggagggcttcttcgacctcatgcacgtgcagaaggtcctttccgccagcacggtgtgcaagctgcagtcctgcacccacgggataccaggcgatctccaggtgtaccacatcgggaacctcttgaagggcgaccgcgtcaacggccacctgatccacaagatcgagccccacttcaacacctcctggatgtcctgggacgggtgcgacctggactactactgtaatatgggggactggcccagctgcacttacacgggtgtgacccagcacaaccacgctgccttcgtgaacctgctcaacattgagaccgactacaccaagactttccacttccactccaagagggtcaccgcccacggcgacaccccgcaactggacctgaaagcgcgccccacctacggggccggagagatcacggtgctcgtcgaggtggcggatatggagctgcacaccaagaaggtggaaatcagcgggctgaaattcgcctccctagcctgtaccgggtgctacgcgtgcagctccggcataagctgcaaggtcagaatccacgtggacgagcccgacgagctgaccgtgcacgtgaagtccagcgaccccgacgtggtggccgccagcacatccctgatggctcgcaagttagagttcggaaccgatagcaccttcaaggccttctctgcgatgcccaagactagcctgtgcttctacatcgtcgaacgggagtactgcaagtcctgcagcgaggacgacacgaagaagtgcgtggacaccaagctggagcagccccagagtatcctcatcgagcacaagggcaccatcatcgggaagcagaacgacacgtgcacagccaaggcctcctgttggctggagagcgtcaagagcttcttctacggcctgaagaacatgctcggctccgtcttcgggaacttcttcatcggcatcctgctgttcctcgcccccttcgtgctgctggtgctgttctttatgtttggatggaagatcctcttctgcttcaagtgttgccgccgcacccggggcctgttcaagtaccgccacctgaaggacgacgaagagaccggatataggcgcatcatcgagcggctcaacaataagaaaggcaagaaccgcctattggacggtgagcggctggcggaccgcaagatcgccgaactgttcagcaccaagacacacattgggtga

SEQ ID NO: 15326 - RNA, 5049 nt, synthetic construct
  misc_feature 1..5049: note = derived and/or modified CDS sequence (opt11) from CCHFV(3820-ST-2007)__KR814868.1__GP
  source 1..5049: mol_type = other RNA
atgcacaccctgctcgtgtgcttcatcctgtacctgcagctcagcgggcttgggggcgcccacgggcagtccaacgccaccgagcacaacggcaccaacaccaccaccgtccccgggacgagccagtccccgaagccacccgcgagcacgaccctgccccacacccccgagtcctcgactgtgaaactcaccacccccacatccgagacggagggtagcggcgagaccaccccgcccaacacaacgcaggggctgcccctgcccggcaccacccccgagcgctccgccaccacggccaccagcacctccagcaccgacaatatgaactccacgacccaggtgacggacaatacccccacgtcaaccgtctccatcagcccatccagctccagcagcatgccgtccaccagccaggggatccaccaccccgtgcggtccctcctgagcgtgtcgagccccaagaccgtcacgaccccgaccccaatgtcccccggcgagatgagccccgagacctccagccagcactccgccatgagccgcgtaccgacgctgtataccgccacccagatatccactgagaacaccgaccggagcacgccccgccagtccgagagctccgtgcagcccgcgacccagagcccaatcacctccccagcccagaccatcctcctgatgagcgccgcccccaaggcgatccaggacatgcatcccagccccacgaaccggtcgaagcgcaatctggaggtcgagatcattctcaccctgagtcaggggctgaagaagtactatggcaagatcctcaagctgctgcacctcaccctggaagaggacaccgagggcctgctggagtggtgcaagcggaacctggggtccaactgcgacgacgatttcttccagaagcgcatcgaggagttcttcatcacgggcgaggggtacttcaacgaggtgttgcagttcaagaccctcagcaccctgagtccgaccgagcccagccacgtgcggctacctacggccgaaccgttcaagtcctacttcgccaaaggattcctcagcatcgactccggctacttcagcgccaaatgttacccccgctccagcacgtccgggctgcagctgatcaacgtcacccagcaccccgcccggatcgcggagacccccggcccaaagacgacctcactcaagaccatcaactgcatcaacctgcgcgcctccgtgttcaaagagcaccgggaggtggagatcaacgtccttctcccccagatcgccgtgaacctgagcaactgccatgtggtcatcaattcccacgtctgcgactacagcctggacactgacgggcccgtgcgcctcccccggatccaccacgagggcacgtttatcccggggacctacaagatcgtcatcgatcgcaagaacaagctgaacgaccggtgctccctggtgaccaactgcgtgatcaagggcagggaggtccggaagggccagtccgtcctccgccagtacaagaccgagatcaagatcgggaagacgagcaccggctcccggaagctgctgagcgaggagcccggggacgactgcatttctcgcacccagctcctgaagaccgagacggccgagatccacgacgacaactacggctcgcccggggacaagatcaccatttgcaatggcagtaccatcgtcgaccagcggctcggcagcgagctcgggtgctatacaatcaatcgggtgaagtccttcaagctgtgcgagaacagcgctacgggcaagacctgcgagatcgactccacccccgtgaaatgccgccagggattctgcctgaagataacccaggagggccgggggcacgtcaagctgtcccgcggctccgaggtggtgctcgacgcatgcgacagctcgtgcgagatcatgatcccgaagggcactggggacatcctggtcgactgcagcggcgggcagcagcacttcctgaaggacaacctcatcgacctgggctgcccccacatcccgctgctcggcaagatggccatttacatctgccggatgtccaaccacccccgcaccaccatggccttcctgttctggttcagcttcgggtacgtgattacctgcatcttctgcaaggccctgttctattccttgatcatcatcggcaccctggggaagaagatcaagcagtaccgggagctaaagccgcagacgtgcaccatctgcgagacagcccccgtgaacgcgatcgacgccgagatgcatgacctcaactgcagctacaacatctgcccctactgcgcgagccgcctgacctccgacggcctggcccggcacgtcacgcagtgccccaagcgcaaggagaaggttgaggagaccgagctctatctgaacctggagcggataccatggatcgtgcgcaagctcctccaggtcagcgagtctaccggagtggccctgaagcggagctcctggctcatcgtgctgctggttctcctggcagttagcctgtcccccgtgcaaagcgcccccgtcggccacggcaagacgatcgagacgtaccagacccgcgaggggttcacgtccatctgcctattcatgctgggctctatcctgttcatcgtgagctgcctcgtgaaggggctggtcgacagcgtgtccgactcattcttccccggcctgtcggtgtgcaagacctgcagcatcgggtccatcaacggcttcgagatcgaaagccacaagtgctactgctccctcttctgctgcccgtactgcagacactgcagcgccgaccgcgagatccatcagctgcacctgtccatctgcaagaagagaaagacaggctccaatgtcatgctcgccgtgtgcaagcgcatgtgcttcaaggcgaccatcgaggccagcagacgcgccctgctgatccgctccatcatcaacaccaccttcgtgatgtgcatattaacacttgccatctgcgtcgtgagcacctccgccgtggagatggaggacctgcccgcggggacctgggagcgggaggaggacctcaccaacttctgccaccaagagtgccaggtcacggagaccgagtgcctgtgcccctatgaggccctggtgctccgcaagccactgttcctggacagcatcgtgaaggggatgaagaacctcctgaactccaccagcctggagaccagcctctcaatcgaggctccctggggcgccatcaacgtccagtccacgttcaagcccaccgtgagcaccgccaacatcgcactctcctggtcttccgtggagcaccgggggaacaagatcctggtcaccgggcgcagcgagtccatcatgaagctcgaggagcggacgggcgtgagctgggacctgggcgtagaggacgcatccgaaagcaagctgctcaccgtctccatcatggacctgtcccagatgtactcgcccgtattcgagtacctgtccggggaccgccaagtggaggagtggccgaaggctacctgcaccggcgattgccccgagcggtgcgggtgcacgagctccacatgcctccacaaggagtggccccacagccgcaactggcggtgcaaccccacttggtgctggggcgtcgggaccggctgtacgtgctgcggcgtggatgtgaaggacctgtttaccgaccacatgtttatcaagtggaaggtcgagtacatcaagaccgaggccatcgtgtgcgtggagctgacctcccaggagcgccagtgcagcctcatcgaggccgggacccggttcaacctgggcccggtaacgatcaccctgtccgagccccgcaacatccagcagaagctcccgcccgagatcataaccctccatcccaagatcgaggaggggttcttcgacctgatgcacgtacaaaaggtgctcagcgcgtccaccgtttgcaagctgcaaagctgcacgcacgggatccccggcgacctgcagatctaccacattgggaacctcctgaaaggcgaccgggtgaacgggcacctgatccacaagatcgagccccacttcaacacttcctggatgagctgggacggctgcgacctcgactactactgcaacatgggggattggccctcctgcacctacaccggcgtcacgcagcacaaccatgccgccttcgtgaacctgctgaacatcgagaccgactacaccaagaccttccacttccacagcaagcgcgtgacagcccacggcgataccccgcagctcgaccttaaggcgagacccacctacggggccggagagatcaccgtcctggtggaggtggccgacatggagctccacacgaagaaggtcgagatctccgggctgaagttcgccagcctgacctgcaccggctgctacgcctgcagcagcgggatcagctgcaaagtgcgcatccacgtggacgagcccgacgagctcaccgtccacgtgaagtccagcgaccccgacgtggtcgcggcgtccactagcctgatggcccggaagctggagttcggcaccgactccaccttcaaggcctttagcgccatgccgaagacctccctctgcttctacatcgtggagcgcgagtactgcaagagctgctccgaggacgacacgaagaaatgcgtggacaccaagctcgagcagccccagagtatcctgatagagcacaaaggcaccatcatcgggaagcagaacgacacctgtacggctaaggcctcctgttggctcgaaagcgtcaagagcttcttctacggcctgaaaaacatgctggggagcgtgttcggctccttcttcgtggggatactcctgttcctggcccccttcgtcctgctcgtgctgtttttcatgttcggttggaaaatcctgttctgcttcaagtgttgccggcgcacccggggcctcttcaagtaccgccatctgaaggacgacgaggagacaggctaccgccggattatcgagcgcctgaacagcaagaagggcaagaacagacttctggacggggagcgcctggccgaccggaagatcgccgaactcttctcgaccaagacccacatcggctga

SEQ ID NO: 15327 - RNA, 5052 nt, synthetic construct
  misc_feature 1..5052: note = derived and/or modified CDS sequence (opt11) from CCHFV(Ast199)__KX056051.1__GP
  source 1..5052: mol_type = other RNA
atgcacaccctgctggtgtgcttcatcctgtacctgcagctctccggtctcggtggggcccatgtccagagcaatgcaaccgagcacaacggcaccaacaccaccaccgtgcccggcaccagccagtcgccaaagccgcccgcaagcaccacgctgccccacacccccgagtccagcaccgtgaagctgaccacccccacctccgaaacggagggttcaggtgagaccactccgccacccaacaccacccagggcctgcccccgcccgggaccacccccgaacggcccgccaccacggccaccaccacttcttcgaccgacaacatgaactccaccacccaggtcaccgacaacacacccacctccaccgtgtccataagcccctcgagcaacccgtccatgccctcgacctcccaaggcatccactaccccgttcggtccctgctctcggtctcgagtcctaagacggtgacaactcccactcccatgtcgcccggagagatgagccccgagacgtcctcgcaacattccgccatgtcgcggatcccgacgctgtacactgccgcccaggtgtccactgagaatacgaatcggagcacgcctcgtcagtccgagagctccgcacagcctgccacccagagccccaccaccttcccggcccaaacgatcccccttatgtccgcggccccaaaggctatccaggacatgcacccgagcccaaccaaccgctccaagcgcaacctggaggtagagatcatcctgaccctgagtcagggcctcaagaagtactacgggaagatactgaaacttctccacctgaccctggaggaggacacggagggcctccttgagtggtgcaaacgaaacctgggctccaactgcgacgacgacttctttcagaaacgaatcgaggagttcttcataaccggcgagggttacttcaatgaggtgctccagttcaagacccccagcaccctgagccccacggagccctcccatgtgcggctgccgaccgcagagccgttcaagagctacttcgcaaaggggtttctctccatcgacagcggctacttctccgcaaagtgctacccccgcagctccaccagcgggctgcagctaatcaacgtgacccagcaccctgcccggatcgccgagaccccagggcccaagaccacgtcgctcaagacaatcaactgcatcaacctgagagccagcgtgttcaaagagcaccgggaggtggagatcaacgtcctactcccccaaatcgccgtgaatctgtccaactgccacgtggtcataaacagccacgtgtgcgactactccttggacacggacggcccggtgagactcccccggatccaccacgaagggacttttatcccgggcacctacaagatcgtcatcgacaagaagaataagctaaacgaccgctgcagccttgtaaccaactgcgtgatcaaagggcgggaggtcagaaagggacagtccgtgctccggcagtacaagacggaaattaagattggtaaggcgagcactgggtcccgcaaactgctgagcgaggaacccggcgacgactgcatcagccggacccagctcctgaagaccgagacggccgagatccacgatgacaactacgggggcccgggggacaagatcaccatctgcaacggctccacaattgtcgaccagcgtctgggcagcgaactcgggtgctataccatcaaccgcgtgaagtccttcaaattatgtgagaacagcgcgacgggcaagacctgcgagatagactccacccccgtcaagtgccgtcaggggttctgcttaaagatcacccaggaaggccgcgggcacgtcaagctcagcagaggctcggaggtggttctggacgcatgcgacagctcgtgcgaaattatgatccccaagggcaccggtgacatcctagtagactgcagcggcgggcagcagcacttcctgaaagacaacctcatcgacctgggctgcccccatatcccgctgttgggaaagatggctatctacatatgccgcatgagtaaccacccccgaactaccatggcgttcctgttctggtttagctttgggtacgttattacatgcatcttctgcaaggcgttgttttactcccttatcataatcggcaccctgggaaagaagataaaacagtaccgcgagctaaaaccccaaacgtgcaccatctgcgagaccgcgcccgtgaacgctatcgacgccgagatgcacgacttaaactgcagctacaacatctgcccgtactgcgcgtctcggttaaccagcgacggcctggcccgccatgtcacacagtgtccaaagagaaaggagaaggtggaggagactgagctgtacttaaacctggagcgcatcccctggatcgtgcggaagctattgcaagtctccgagagcacaggtgtggcgttaaaacgctgctcctggctcatcgtgctgctggtcctcctgaccgtgagcctgagtccagtgcagtccgcccccgtcggccacgggaagacgatcgagacctaccagacccgggaggggttcaccaacatctgcctctttatgcttggcagcatcctgttcatagttagctgtttggtgaaggggctggtcgacagcgtgtccgactcattcttccccgggctctcagtgtgtaagacttgcagcattgggtcaatcaatggattcgaaatcgaaagccacaagtgctactgctcgctcttttgctgcccgtactgccgccactgtagcgcggaccgggagatccaccagctgcacctgggcatctgcaagaagcgcaagaccgggtccaacgtcatgctcgcggtgtgcaagcgaatgtgcttcaaggccacaatcgaggccagccgccgggccctgctgatccgctccattatcaacactacgttcgtcatatgcatcctcaccttagcgatatgcgttgtgagcacctccgccgtcgaaatggagaaccttccggccggtacctgggagcgcgaagaggacctcacgaatttctgccaccaggagtgccaggtcaccgagaccgagtgcttgtgtccgtacgaggccctggtgctccggaagcccctgttcttagactccatcgtgaaagggatgaagaacctcctgaactccaccagcctggagaccagcctaagcatcgaggccccctggggcgcgatcaatgtacaaagcaccttcaagccgaccgtgtccaccgccaacattgccctgagctggtcatctgtagagcaccgcgggaacaagatcctggtcacgggccggtccgagagcataatgaaacttgaagaacgtaccggcgtctcatgggacctgggggtcgaggacgcctctgagtccaagctgctcaccgtcagcatcatggacctgtcccagatgtatagccccgtattcgagtacctgtccggcgaccgccaggtggaggaatggcccaaggcgacctgcacaggggactgccccgaacgctgcggatgtaccagctctacctgcctccacaaggagtggccgcacagccggaactggcgctgcaaccccacctggtgctggggcgtcggcaccggctgcacttgttgcggggtggacgtaaaagacctgttcactgatcatatgttcatcaaatggaaagtcgagtacatcaagaccgaggcgattgtgtgtgtggaactgacctcccaggagcggcagtgctcacttatcgaggctggtacacgctttaacctgggacccgtcaccatcacccttagcgagccacgcaacatccagcaaaagctcccgcccgagattatcaccctgcaccccaagattgaggagggatttttcgacttgatgcacgtgcagaaggtgctgtccgccagcacggtctgcaagctgcagtcctgtacccacggcatccccggggacctgcaaatctaccacatcggcaacctcctgaagggggaccggctgaacggccacctcatacataaaatcgaaccgcacttcaatacctcttggatgagctgggacggctgcgacctggactactattgcaacatgggcgactggcctagctgcacctacactggcgtgacacagcacaatcacgccgcatttgtcaatctgctcaacatagagaccgactacaccaagacgtttcacttccactccaagcgtgtgacggcccacggggatacgccacagctggacctgaaggcccgacccacatacggcgccggagaaatcacggtactcgtcgaggtggccgatatggagctgcacactaaaaaggtggaggtctctggcctgaagttcgcgtctctagcctgtaccgggtgctacgcgtgcagctccggcatcagctgtaaggtgcggatccacgtggacgagcctgacgagctgacagtccacgttaaatcaagcgaccccgatgtggtcgccgcctccacgagcctgatggcgcggaagctcgagttcggaaccgactccaccttcaaggccttctcggccatgcccaagacttccctgtgtttctatatcgtagagcgggagtactgcaagtcgtgcagcgaggacgacacgaagaagtgcgtagacaccaagctggagcagccccagtcgatcctcatagagcacaaggggaccatcatcggcaagcagaacgacacgtgcacggccaaggccagctgctggctggagtcggtcaagagcttcttttatgggcttaagaacatgctcgggtccgtgttcgggaacttctttgtgggcatactgctgttcctcgcgccgttcgttctgctggtcctgttctttatctttggctggaagatactcttctgcttcaagtgctgccgccggacacgcgggctgttcaagtaccggcacctcaaggatgacgaggagaccggctatcgcaagatcatcgagcgcctcaacagcaagaaggggaagaaccggctgctggacggcgagcgcttagccgaccgtaagatcgccgagctgttttcgaccaagacgcatatcggttga

SEQ ID NO: 15328 - RNA, 5052 nt, synthetic construct; identical to SEQ ID NO: 12042
  misc_feature 1..5052: note = derived and/or modified CDS sequence (opt11) from CCHFV(Turkey200310849)__DQ211636.1__GP
  source 1..5052: mol_type = other RNA

SEQ ID NO: 15329 - RNA, 5052 nt, synthetic construct
  misc_feature 1..5052: note = derived and/or modified CDS sequence (opt11) from CCHFV(5170-R-2011)__KR814873.1__GP
  source 1..5052: mol_type = other RNA
atgcacaccctgctcgtgtgctttatcctgtacctgcagctcagcggcctcgggggcgcccacggacagtccaacgagaccgagcacaacggtacgaatacgaccactgtcccaggcacgagccagtccccgaagccgcccgccagcaccaccctgcagcacacccccgaatccagcacggtgaagctcaccacccccacctctgaaactgagggcagcggcgagaccaccccgccgcccaacaccacgcaggggctgcccccacccggcaccacccccgagaggtccgcgacgacggccacaagcacttccagcacagacaacatgaactccaccacacaagtgaccgacaacacccccactagcaccgtcagcataagcccctccagctcccccagcatgcccagcacctcccaggggatacactaccccatccggagcttgctctccgtgagttcccctaaaaccgtgacgacccccacccccatatcaccgggcgaaatgtcccccgagaccagctcccagcacagcgccatgtcacgtatccccacgttatacaccgcaacccaggtcagcaccgagaacaccaacagatccacgccccgccaaagcgagtccagcgtgcagccggccacgcagtcccccattacctcgcccgctcagaccatactgctcatgtccgccgcccccaaggccatccaggacatgcatccgagtcccacgaaccggagcaaacgcaacctggaggtagagataatactgacccttagtcagggtctgaagaagtactacggcaagatccttaaactcctgcacctgacactcgaggaggacaccgagggcctgctggagtggtgcaagcggaacttagggagcaactgcgacgacgacttctttcagaagcgcatcgaggagttcttcattacaggcgaggggtactttaatgaggttctgcagttcaaaactctgtcaaccctaagcccgaccgagctgtcacacgtgcggctaccgacggccgagcccttcaaaagctacttcgccaagggcttcttatccatcgacagcggttacttttccgccaagtgctacccccgcagctccaccagcggactgcagctgatcaacgtgacccagcaccccgcccggatcgccgagaccccgggcccaaagacgacctccctcaagaccattaactgcatcaacctgcgagcatctgtattcaaagagcatcgggaggtggagatcaacgtgttgctcccccagatcgccgtcaacctgtccaactgtcacgtggtgatcaatagccacgtctgcgactattccctggacaccgatgggccagtgcgcttgccgcggatacaccacgaaggcacgttcatccccgggacctataagatcgtgatcgacaagaagaacaagctgaacgatcggtgctcgctggtgaccaattgcgtgatcaagggacgggaggtgcgcaagggccagtccgtcctcaggcagtacaagacagagatcaagatcgggaaagcctccacgggcagcaggaagctcctgtccgaggagcccggggacgactgcatcagccggacccagttgctgaaaaccgagaccgccgagatacacgacgacaactacggcggacccggcgacaagattacgatttgcaacggttccaccatcgtggaccagcgcctggggagcgagctcggctgctacaccatcaaccgcgtaaagtccttcaagctgtgcgagaactctgcgaccggaaagacgtgcgagatcgactccaccccggtgaagtgtaggcagggcttttgcctcaagatcacccaagaggggcgcggccacgtgaagctaagccgggggtccgaggtcgtcctcgacgtgtgcgattcttcctgtgagatcatgatccccaaggggaccggcgacattttggttgactgcagcgggggccaacagcatttcctgaaagacaaccttatcgacctgggctgccctcacatccccctgctagggaagatggcaatctacatctgccgcatgtccaaccacccgcggacgacaatggccttcctgttctggttcagcttcggctatgtcatcacctgtatattctgcaaagccctcttctactccctcatcatcatcgggacgttgggcaagaaaatcaagcaataccgtgagcttaagccccagacctgtacaatctgcgagaccgcccctgttaatgccatcgacgcggagatgcacgatctcaactgcagctacaacatctgcccctactgtgccagcagactgacctcggaggggcttgcacgccacgtcacccagtgcccgaagcgtaaggaaaaagttgaagagacggagctctacctgaacttagagcgcataccatggatagttcggaaactcctgcaggtcagcgagtcgaccggcgtggctctcaaacgctcgtcctggctcattgtactgctggtcctcctgacggtcagcctgagtcccgtgcagagcgcccccgtgggccacgggaagaccatcgagacgtaccagacccgtgagggcttcacatccatctgcctcttcatgctggggagcattttattcattgtgtcctgcctcgtgaagggcctggtcgactcggtttctgacagcttcttcccgggcctgtcggtgtgcaagacctgcagcatcggatccatcaacggctttgagatcgagtcccacaagtgctactgctccctcttctgctgcccctactgccgccactgcagcgctgaccgggagatccaccagctgcacctgtccatctgtaagaaacgcaagacggggagcaacgtcatgctcgccgtgtgcaagcggatgtgcttcaaggccaccatagaagccagccgccgggcgttactgatccgctctattatcaacaccacctttgtgatctgcatcctcacgctggccatctgcgttgtgagcacctccgccgtggaaatggaggatctgcccgccgggacctgggagcgcgaggaggacctcaccaatttttgccaccaggagtgccaggtcacggagaccgagtgcctgtgcccatatgaagccctggtgctgcggaagccactgttcctagacagcatcgtgaaagggatgaagaatctccttaactccaccagcttggagacatcgctgagcatcgaggcgccctggggcgccatcaatgtccaatccacgttcaagcccaccgtgagcaccgccaacatcgccctgagttggagctccgtggagcatcgcgggaataagatcctcgtcaccggacggagcgagtccatcatgaagctcgaggaacgcacgggcgtgagctgggacttaggtgtggaggacgcctccgagtccaagctgctcaccgtctccatcatggatctgagccagatgtacagcccggtgttcgagtacctgtccggcgaccgacaggtggaggagtggcccaaggcgacctgcaccggggactgcccagagcggtgcgggtgcacgagctctacctgcctccacaaggagtggccccactcccggaactggcgctgtaaccccacctggtgttggggcgtcggcaccggctgtacgtgctgcggggtggacgtgaaggatcttttcaccgaccacatgttcatcaagtggaaggtcgagtacatcaagactgaggctatcgtgtgcgtggagctgacctcccaagaacggcaatgtagcttaatcgaggccggtacccgtttcaacctgggccccgtcacaataaccttgtcagagccccggaacatacagcagaagttacccccggagatcatcaccctgcaccccaagatcgaggagggcttctttgacctgatgcatgtgcaaaaagtgctcagcgcctccacagtctgcaagctccagagctgcacgcacggcattcccggggacctgcagatctaccatatcggcaacctcctgaaaggggacagggtgaacggccacctgatccataagattgagccccacttcaacacctcttggatgtcttgggacgggtgcgatctcgattactactgcaacatgggcgactggccgtcatgtacgtacaccggcgtcacacagcacaaccacgccgcgtttgtgaacttgctgaacatcgagaccgactacactaaaacctttcacttccacagcaagcgggtcacggctcacggtgacacgccccagctcgatctgaaagcccgccccacctacggtgccggggagataaccgtccttgtggaggtggcggacatggagcttcacaccaagaaggtagaaatctccggactgaagttcgccagcctgacctgcacggggtgctacgcttgctcatcggggatctcctgcaaggtgcggatccacgtggacgagcctgacgaactcaccgtccacgttaagagcagcgatccggatgtggtcgccgcctccacgagcctgatggcgcgcaaactggagttcggcaccgactcaacctttaaggcttttagcgccatgcccaaaacctccctctgcttctacatcgtggaacgggaatattgcaagagctgttccgaggacgacacgaagaagtgcgtggacaccaagttagagcagccccagagcatcttaatcgagcacaaggggaccatcatcgggaagcagaacgatacctgcacggccaaggcctcctgctggctcgaaagcgtcaagtccttcttctacgggctcaagaatatgctgggcagcgttttcgggtccttctttgtgggcatcttgctgttcctggcgcccttcgtcctcctcgtgctgttcttcatgttcggctggaagatcctgttctgtttcaagtgctgccgcagaacccgtggtctcttcaagtaccggcacctcaaggacgacgaggaaaccgggtaccgccgcatcatcgagcggctgaacagcaagaaggggaagaaccgcctcctggacggcgagcgactggccgaccgcaagatagccgaactcttctccacgaagacgcacatcggctga

SEQ ID NO: 15330 - RNA, 5055 nt, synthetic construct
  misc_feature 1..5055: note = derived and/or modified CDS sequence (opt11) from CCHFV(SCT ex Afghanistan)__KC344856.1__GP
  source 1..5055: mol_type = other RNA
atgtacaccctgctcgtgtgcgccatcctgtgcccccagccatggagcctggagggcacccacgttcccctcaacgggacgaagcacaacggcaccggaatcacagccgcaccgggcgggtcccagggccccacgagcccggcttccacggccgtgagcctgactcccgatcctttcacaactgagcccacggcatccgccgtggagctggagagctccggcgaagggcacaccagcctctccgtcactacacagggtctcacgagcccggagaccactcccgggttacccaccgtgacggataccggcgtttcatcaacctccatcttcgggataggcatccgcgtcgcgggcgacacccccacgagcaccacccacacagggctcccgtcatctccctccatgcccagcacggcgcagggaccacaccacgccgtacgggggctgcttagcgtgagcagcacgcgcccgggcgaggccagcaccataactgtacccggcgaggcggggacggaggcgaacagctccagctcagccatcagcaagaagccggccccatccccgactgctgaagcgatcaccgaggccaacaacagctccaaccctcggcagcccgagctcagtacccagccagcaattccaggcctggtgacttccagcgcccagcccatcctgcttcagtccgccaccagcaccgcggcccaggacatctatccatcccccaccaaccgcagcaagcggaatctggagatggagatcatcctgacgctctcccaggggctgaagaaatattacgggaagatcttaagaatcctcgacctgacgctggaggaggataccgagggactactcgagtggtgcaagcggaacctgggcctgacctgtaacgacaacttctttcaggagcgcattgaggagttctttttgaccggggaggggcactttaacgaagtgctgcagtttaaaacgcccagcaccctatcccccaccgaacccacccacacgcggactccgactgtcaagccctttaagagctacttcgctcgcggcttcctgtcgatcgactccgggtacttcagtgccaaatgctactccaagaccagcaactcaggactgcaactcatcaatatcacacagcaccccgcccggatcgccgacaccccaggaccgaagatcaccaacctgaaggcaatcaactgcatcaacctgaaggccagcgtgttcaaggagcatcgcgagatcgaaatcaacgtgctcctgccccaagtcgccgtgaacttatccaactgccatgtgctcataaagagccatgtctgcgactactccctagacatcgacggtgccgtgcggctgccccacgtgcatcacaagggcaccttcatccccggcacgtacaagatcgtgatcgacaagcgcaacaagcagaacgaccggtgcaccctagtgaccaactgcgtgatcaagggcaaggagatccgcaaggggcagagcgccctacgacagtaccgcaccgagatccggatcggcaaggcctccgccggcagccgcagacttctttccgaggagtcaggcgacgactgtatctcccgcacacagctgctgcgcactgagaccgcagaggtgcacaatgacaattacggcggcccgggcgacaagatcaccatctgcaacgggagcacgatagtagaccagcgcctcggctccgagctgggctgctacaccatcaaccgcgtcaagagcttcaaactgtgtgagaatagcgcgacaggcaaatcctgcaagatagacagcacccccgtgaagtgccggcagggcttctgcctgaagatcacgcaggagggccgaggccacgtgaagctctcccggggcagcgaggtcgtgctggacgcgtgcgactccagctgcgaaatcatgatccccaagggcaccggcgacatcctggtcgactgctccgggggccagcagcacttcctcaaggataacctgatcgacctgggctgccccaacatcccgctactgggcaagatggcaatctacatctgccgcatgagcaaccatcctaagaccacaatggcctttctgttctggttctccttcgggtacgttatcacgtgtatcttctgcaaggtgatcttctacctcctgatagtggtcggcaccctcggcaaaaagttcaagcagtacagagaactcaagccccagacctgcactatctgcgaaaccacccccaccaacgccatcgacgcggaaatgcacgatctgaactgtagctacaacatatgcccgtactgcgcgtcccgcctcactagcgacgggttggctcggcatgtgactcagtgccccaagaggaaggagaaggtggaagagaccgagctgtacctgaatctcgagcggataccctggatcgtcaggaagctgctccaggtgagtgagagcaccggcgttgcccttaaacggtcctcatggttgatcgtcctgctcgtactgctgaccgtgtccctctcccccgtccagtccgctccgatcggacatggcaagacaatcgagacgtaccagaccagagaggggtacatcagcgtgtgcctgttcgtgctgggtggcatcctcttcgtcgtgagctgcctgataaaaggcctggtcgattccgtcggcaacagctttttccccgggctctccatctgcaagacctgtagcatcggctcagtgaatggtttcgagatcgagtctcacaagtgctattgcagcctgctctgctgcccttactgccggcactgttccaccgaccgcgagatccaccagctccacctgtcaatatgcaagaagcggcgcactgggggcaacgtgatgctggcggtctgcaagcggatgtgtttccgcgcgaccatggaagtgtcaaacaaggtcctgttcatccgcaacatcatcaacaccaccttcgtaatctgcatcctgatcctggccgtgtgtgtggtttccacgagcgctgtggagatggagtccttgccggccgggacttgggagcgtgaagaggacctgaccaacttttgccatcaggagtgccaagtcaccgagacggagtgcctgtgcccgtatgaggcactggttctgcgcaagcccctgttcctcaacagcatcgtgaagggcatgaaaaacctgctgaactccacaaacctcgagaccagtctgtccatcgaggccccatggggcgcaataaatgtgcagagtaccttcaagccgacggtctctaccgcaaacatcgcgctgagctggagctccgtggaacaccgggggaataagattctagtgagcggccgctccgagagtatcatgaaattggaggagcggaccggaatctcctgggacctgggtgtcgaggacgccagcgagtcgaaatcactgaccgtgtccgtgatggacctgtcccagatgtactcccccgtcttcgagtacctgagcggggaccgccaggtggaggaatggcccaaggccacgtgcaccggcgactgtcccgagcggtgcggatgcaccagtagcacgtgcctccacaaggagtggccccactcccgcaactggcggtgcaaccccacctggtgctggggcgtggggaccgggtgcacgtgctgcggcctggacgtcaaagacctgttcacagactacatgttcgtaaagtggaaagtggaatatatcaagaccgaggccatcgtctgcgtggaactcaccagccaggagcgacagtgctccctaatcgaagcagggacccggttcaacctggggcccgtcaccatcacgctcagcgagcctcgcaacatccagcagaagctcccgcctgagatcatcaccctgcacccccggatcgaggaggggttcttcgacctcatgcacgtgcagaaggtgctatccgcatcaaccgtctgcaagctgcagagctgcacccacggtgtgcccggcgacctccaggtgtaccatattgggaacctgctgaaaggagataagctaaacgggcacatgatccacaagatcgagccgcacttcaacacgtcttggatgagctgggacggctgcgacttagactactactgcaacatgggcgactggccctcgtgcacatacaccggcgttacgcaacacaaccacgccgcgttcgtgaacctgctcaacatagagaccgattacacgaagaatttccacttccactctaagagagtgacggcccacggcgatacgcctcagttagacctgaaggcgcggcccacctacggcgcgggcgagatcaccgtcctagtggaggtggccgacatggagctgcatacaaagaaaatcgacatctccgggctgaaattcgccagcctgacttgtgccggctgctatgcctgctccagcggcatctcctgcaaggtgcgcatccacgttgacgagccggacgagctcactgtgcacgtcaagagcgaggaccccgacatcgttgcggcctcaacgagcctgatcgcccggaaactcgagctgggaaccgattccacctttaaggccttctccgcgatgcccaagacctccctgtgcttctacatcgtggaacgcgaatactgcaagagctgctccaaggaagacacgcagaagtgcgtcaacactaaactagagcacccccagggcatcctgatagagcacaaggggacaattatcggcaagcaaaacgacacatgcaccgcaaaggctgggtgttggctggagagcgtgaagtccttcttctacggcctcaagaatatgctgagcggaatcttcgggaacgtgttcatcggtatatttctgttcctggctccattcgtcctcctaatcctgttcttcatgttcgggtggcggctcctcttctgcttcaagtgctgcaggcggacccgcggcctgttcaagtaccgccacctcaaagaggacgaggagagcgggtaccgacgcatcatcgagcggctgaacaacaagaagggcaagaacaagctgctcgatggcgagcgccttgccgatcggcgcatcgcggagctgttctccactaagacccacatcggctag

SEQ ID NO: 15331 - RNA, 5055 nt, synthetic construct
  misc_feature 1..5055: note = derived and/or modified CDS sequence (opt11) from CCHFV(SPU 44/08)__KJ682805.1__GP
  source 1..5055: mol_type = other RNA
atgtacacgcccctgctctgcgccatcctgtgcctgcagctctggagcctagagggcatttacgggctgtccaacaacacccagcacaatgacaccagcaccatcaaggttccggaggagtcccagaaaacgagcctccccgccaacaccgctagccccatcacgtctgacccgccgcctaccacccctaccgcctccgccagcggccccgaggggtccggcgatacgagcacctccccgcccgtcaccacccagggacccactcccccggagaccacccccgagccccacacgacgattgacatcgacaagtccagtaccgccatcgccgacatcagcacccagaccgtgaagaacatccccacgccgaccgcccacacctccctgcccagcaccctgtccgcccccacgatgccccaggaggcccatcacaccgcccgcggcctcctgagcgtgacctccaccaagcccggcgaggcgagcactcccaccagccccggggaggcctccaccgaagcaagcagcccccagccgaccatccgggaaacgccctccccgccgcccaccacgcagacaccaacggagatcaacaaccccaacacctcccgccagcccatgccctctacccaaccggccgccccgtcgagcgtcacccaccccgcgcagcccaccccctcccagtcagacgtgcccacggctgcccaggacatccacccgtcccccaccaaccggagcaagcgcaacttagagatggagatcatcctcaccctgtcccagggcctgaagaagtactacgggaaggtgctaaagctgcttgacctcaccctggaggaagatacggaggggctgcttgagtggtgcaaacgcaacctgggtctgacctgcgacgacaacttctttcaaaagcgcatcgaggagtttttcctcaccggcgagggccacttcaacgaggtcctgcagttcaagaccccctcaacgctttccccgacagagccggcccgggtggagagcccgacggtggaaccctttaaatcctacttcgccaaggggttcctccttatggacagcggctacttctccgcgaagtgctatcccaagagcagcaacagcgggctccagctcatcaacgtaacccagcatctgatccgcatcacggacaccccgggccccaaaatcacaaacctcaagaccataaactgtatcaaccttaaggccctggtgttcaaggagcaccgggagatcgagatcaacgtgctgctcccccaggtcgccgtgaacctgagcaattgccacgtcctgatcaagtcccacgtctgcgactacagcatcgacatcgacggccccgtacgcctcccgcggatccaccacgagggcacgttcatccccggcacctacaaaatcgtgatcgacaagaagaacaagcagaacgatcggtgcaccttggtcactaattgcgtgatcaaggggcgggagatccgtaagggccagtccgtcctgcggcagtaccgaacggaaatcaaaattgggaaggccagctccggcagccggcgtctcttgtccgaggagagcaacgacgactgcctgtcccggactcagttgctacgaaccgagaacgccgagatccacagcgacaactacggtgggcccggcgataagatcaccatctgcaatgggtccacgatcgtggaccagcggctgggcagcgagctagggtgctacaccatcaaccgcgtgaagtccttcaaactgtgtgagaacagcgcaaccggcaagtcctgcgagatcgacagcacccccgtgcgctgccggcagggcttctgcctgaagatcacccaggaggggcgcggccacgtaaagctgagccgggggtccgaggtagtcctcgacgcctgcgacagctcctgcgaaatcatgatcccgaagggtaccggggacatcctggtagactgctcgggcggccagcagcacttcctgaaggacaacctagtggacttagggtgcccgaatatcccgctgctcggcaaaatggctatctacatctgtaggatgagtaaccatccgaaaaccaccatggcgttcctcttttggtttagcttcgggtacgtaataacgtgcatcctgtgcaaggccatattctatttactgatcgtggtgggcaccctgggaaagaagttcaagcaataccgggagctcaagccccagacctgcaccatttgcgagactaaccccgttaacgccatcgacgctgagatgcacgatctgaactgttcctacaacatctgtccctactgcgccagccgcctgacctccgacgggctcgcccggcatgtgatgcagtgcccgaagcgcaaggagaagatcgaggagactgaactgtacctgaacctcgagcggattccctgggtggtccgcaagctgctccaggtgagcgagtccaccggtgtggcgctcaagcggagctcctggctggtcatcctgctcgtcctgctgaccgtcagcctctcccccgtccagtcggcccccatctcccacggagagacggtggaggtctaccagacacgcgagggctacacctcaatatgcttattcgtccttgggtccatcctcttcctcgtgagctgcctcatgcggggactcgtggactccgtctcgaacagcttcttcccgggcctgtcgatctgcaagacttgcagcataggctccatcaacggcttcgagatcgagagccataagtgctactgcagcctgttctgctgcccgtactgccgccattgctccgccgacatcgagatccacaagctccacctgtccatatgcaagaagcggaagaccgggagtaacgtgatgcttgccgtgtgcaagcgcatgtgtttccgggccaccgtcgaggtcagcaacaaggcgctcctgatccgcaacatcattaacaccaccttcgtggtctgcattctgatcctcgccgtctgtgtggtcagcacgtccgccgtggagatggagaacttacctgccggtacctgggagaaagaggaggacctgaccaacttttgccaccaggagtgccaagtcaccgagacagaatgcctctgcccctacgaggccctggtcctcaggaaacccctcttcctggatagcatcgtgaagggtatgaagaacctgctcaacagtaccagcctggagaccagtctgagcatcgaggcgccgtggggcgctatcaacgtgcagtccaccttcaagcccacggtcagcgccgcgaacatcgccttgagctggtcctccgtggagcaccgcggcaacaagatcctggtgagtgggcgcagcgagtccatcatgaagctagaggagcggaccggcataagctgggacctcggggtcgaggacgcgtccgaatctaagctcctgaccgtgagcgtcatggatctcagccaaatgtactcccccgtcttcgagtacctgagtggcgatcgacaggtggaggagtggccgaaggcgacctgtacgggggactgccccgaacggtgcggctgcacctcctccacgtgcctccacaaggagtggccccattcccgcaactggcggtgtaaccccacctggtgttggggcgtggggaccggctgcacttgctgcgggctcgacgtcaaggacctgttcaccgactacatgttcgtgaagtggaaggttgactacatcaagaccgaagccatcgtctgcgtggagctgaccagccaggaacgccaatgctccctcatcgaggccggcacgcggttcaacctggggccggtgaccatcaccctgagcgagccccgcaacatccagcagaagctcccgcccgagatcgtaacgctgcacccccggatcgaggagggcttcttcgacctgatgcatatccagaaggttctctccgcatctaccgtctgcaaactgcagagctgcacgcacggagtgcccggggacctgcagatctaccacatcggcaaccttctgaagggggacaaggtgaacggccacctgatccacaagatcgaaccacacttcaacacctcctggatgagctgggacggctgcgacctcgactactactgcaacatgggggactggccctcctgcagctacactggcgtcacccagcacaaccacgccgccttcgttaacatgctgaacattgagaccgactacaccaagaacttccatttccactctaagcgcgttaccgcacacggggacacgccacaactggacctcaaagcccggcccacttacggcgcgggggagatcaccgtgctggtggaggtggccgacatggaactgcacaccaaaaagatcgagatcagcggtctcaagttcgcctcgcttacgtgtaccggctgctacgcatgcagctccgggatctcgtgcaaggtccgcatccacgtggacgagcccgacgagctgaccgtgcacgtcaagtccgaggacccggatatagtggccgcgagcagtagcttaatggccaggaagctggagtttggcaccgattccacgttcaaggccttcagcgctatgccaaaaacctccctgtgcttctacatcgttgagcgcgagtactgcaaaagctgctccaaggaggatactcagaagtgcgtaaacaccaagctcgagcagccccagagcatcctgatcgagcacaagggtacgatcatcggaaagcagaacgacacgtgcaccgccaaggcaagctgctggctggagtccatcaagagcttcttttacgggctaaagaacatgctgtccggcatattcgggaacgtgtttatcgggatctttctgttcctagcccccttcatcatgctcatcctattcttcatgttcgggtggcggatcttgttctgcttcaagtgctgccgccggacccgcgggcttttcaagtaccggcacctgaaagacgacgaggagatcgggtaccgcaagatcatcgaacggctgaacaacaagaaggggaagaacaagctccttgacggcgagcgcctggccgaccgcaagatcgccgagctgttcagcacgaagacccacatcggctga

SEQ ID NO: 15332 - RNA, 5052 nt, synthetic construct
  misc_feature 1..5052: note = derived and/or modified CDS sequence (opt11) from CCHFV(K323_27)__KX013472.1__GP
  source 1..5052: mol_type = other RNA
atgcacaccctgctggtgtgcttcatcctgtacctgcagcttagcggcctcgggggcgcccatggccagtccaacgccaccgagcacaacggcacgaataccaccaccgtccccgggacgagccagtccccgaagccgcccgcaagcaccaccctgccacacaccccagagtccagcactgtgaagctcaccaccccaacctccgagacggagggctcgggcgagaccacaccaccgcccaacaccacgcaggggctgcccctgcccggtaccacacccgagcgctctgccaccacggccacctcgacctccagcaccgacaacatgaactccacgacccaggtgaccgataatacccccacgagcaccgtctccatcagcccctccagctcgcccagcatgcccagcacctcccaggggatccaccacccggtacggagcctcctgtccgtgtcctcccccaaaaccgtcacgacccccactcccatgagcccgggcgagatgtcccccgagaccagctcccagcacagcgccatgtctcgtatccccacgctgtacacggccacccaggtgagcacagaaaacaccgaccggtccacgccccgccaaagcgagtccagcgttcaaccggcgacccaatctcccatcaccagcccggcccagaccatcctcctgatgtccgccgcccccaaggcgatccaggatatgcacccgagccccacgaaccggagcaagcgcaacctggaggtcgagatcatcctcaccctgtcccaggggctaaagaagtactacggcaagatcctaaaacttctgcacctcacactggaggaagacaccgaaggcttactcgagtggtgcaaacggaacctggggtctaattgcgacgacgacttctttcagaagagaatcgaggagttcttcatcacgggcgaggggtacttcaacgaggtgctgcagttcaagaccctatccaccctgtcccccaccgagtccagccacgtgcggctgccgacggccgagccattcaagtcctacttcgccaaaggcttcctcagtatcgactcagggtacttttccgccaagtgttacccccgttcctctacctccgggctgcagctgatcaacgtcacccagcaccccgcccggatcgcagagaccccgggacccaagactacctccttaaagaccatcaattgcatcaacctgcgcgcctccgttttcaaagagcaccgggaagtggaaataaacgtcctgctcccccagatcgccgtgaacctgagcaactgccacgtcgtcatcagtagccacgtgtgtgactacagcctggacaccgacggacccgtgcggctcccgcggatccatcacgagggcacgttcatccctgggacctacaagatcgtcatcgacagaaaggacaagctgaacgatagatgctccctggtgaccaactgcgtaatcaagggccgcgaggtacgcaagggccaaagcgttctccgccagtacaagaccgaaatcaagatcgggaaggcgtccacgggctcccggaagttactgtccgaggagcccggggatgactgcatcagcaggacccagctcctgaagacagagacagccgagatccacgacgacaattacggtgggcccggagacaagatcacgatctgtaacggctccaccatcgtggaccagcgcctggggtcagagctcggctgctacaccattaaccgggtgaagtccttcaagctgtgcgagaacagcgcgaccgggaagacgtgcgagatcgactccaccccggtgaaatgccgccagggattctgcctgaagatcacccaggaggggcggggccacgtcaaactgagcaggggctccgaggtggtgctagacgcctgtgacagctcctgcgagatcatgatcccgaaagggaccggcgatatcctggtcgattgtagcgggggccaacagcacttcctgaaggacaaccttatcgacctgggctgcccccatatccccctgctcgggaaaatggccatatacatctgtcggatgtccaaccacccgcgcacgaccatggccttcctcttctggttcagctttggctacgtgatcacgtgcatcttctgtaaggccctcttctacctcctcatcatcatagggaccctgggaaagaagatcaagcagtaccgggagctcaagcctcagacctgtaccatatgcgagacggccccagtgaacgccatcgacgccgagatgcacgatctgaattgctcctacaacatctgcccctattgcgccagccgcctgaccagcgacgggttggcccggcacgtcacccagtgcccgaagcgcaaggagaaggtagaggagacggagctgtacctgaacctcgagcggatcccctggatcgtgcgcaagctgctgcaagtctccgagagtaccggcgtggccctcaagcggtcgagctggctgaccgtgctgctcgtactgctgaccgtgtccctctcgcccgtgcagtccgcgcccgtcggccacgggaacactatcgagacctatcagacccgcgaaggcttcaccagcatctgcctgttcatgctggggtccatcctcttcatcgtgagctgcctggtgaaaggcctggtcgactccgtgagcgactccttcttcccggggctcagcgtgtgtaaaacatgctccatcggcagcatcaacggcttcgagatcgagtcccataagtgttactgcagcctcttttgctgcccccattgccggcaccggtccgccgaccgtgaaatccaccagctgcacctcagcatctgcaagaagcgcaagaccgggtccaacgtcatgttggccgtgtgcaagcggatgtgccccaaggcgaccatagaggcctcccgcagagctctgccgattcggagcatcatcaacaccacgctcgtgatgtgcatcctgaccctggccatctgcgtcgtgtccaccagcgctgtggagatggaggacctcccggcgggtacgtgggaacgcgaggaagacctgacgaacttctgccatcaggagtgccaggtgaccgaaaccgagtgtctgtgcccctacgaggcccttgtgctgagaaagcccctgttcctcgactccatagccaaggggatgaagaacttactgaacagcacctccctcgagacgtcgttatccatcgaggccccgtggggcgctattaacgtgcaaagcactttcaagcccacagtatccaccgcgaacatcgccctcagctggtcctcggttgaacaccgagggaacaagatcctcgttacgggccgatccgagagcatcatgaagctggaggaacgcaccggggtctcctgggacctgggggtcgaggacgccagcgagtccaagctactgaccgtgagcatcatggacctgtcacagatgtactcccccgtcttcgagtacctcagcggtgaccgccaggtggaggagtggcccaaagcgacctgcacgggggattgcccggaacggtgtggctgcacatccagcacgtgcctgcataaggagtggccccactcccggaattggcgctgcaatcccacatggtgctggggcgtggggaccggctgtacttgctgcggggtcgacgtgaaagacctgttcacagatcacatgtttatcaagtggaaggtggagtacatcaagaccgaggccatcgtctgcgtggagctcaccggccaggagaggcagtgcagcctgatcgaggccgggacccgcttcaacctgggccccgtgaccataacgctctccgagccgcggaacatccagcagaagctcccgcccgagatcatcaccctgcaccccaagatcgaggagggcttcttcgatctcatgcacgttcaaaaagtgctgagcgcttccacggtgtgcaagctgcagagttgtacccacgggatccccggagacctccagatttaccatatcgggaacctgctgaagggcgaccgcgtcaacgggcacctcatccacaagatcgagcctcacttcaacacctcctggatgagctgggacggctgcgacctggactactactgcaacatgggcgactggccctcatgtacctacacgggggtgacccagcacaaccacgccgccttcgtcaacctgctcaacatcgagaccgattacaccaagacgtttcacttccacagcaagcgggtcaccgcgcacggcgacacaccgcagctggacctaaaggcccgaccgacctacggggccggcgagatcaccgtgctcgtcgaggttgccgatatggagctgcataccaagaaggtggagatctctgggttaaagttcgctagcctgacgtgtacgggctgctacgcgtgctcctctggcatctcctgcaaggtccggatccacgttgatgagcccgacgagctgacggtgcacgtcaagagctccgaccccgacgtggtggccgcgtccaccagtctgatggcccgcaagctcgagttcggcacggactccaccttcaaagccttcagcgcgatgcccaagacgtccctgtgcttttacatcgtcgagcgcgaatactgcaaaagctgctccgaggacgacaccaagaagtgcgtggacaccaagctggagcagccgcagagcatcctcattgagcacaagggcaccatcatcgggaagcagaacgacacgtgcactgcgaaagcctcctgctggctggagagcgtgaagtccttcttttacggccttaagaacatgctcgggagcgtcttcggctccttctttgtgggcattcttctgtttctggcccccttcgtgctcctggttcttttcttcatgttcgggtggaagatcctcttctgcttcaagtgctgccgtcggacccgcggcctgtttaagtatagacacctgaacgacgacgaggagactgggtaccggcgcatcattgagcggctcaatagcaagaagggcaaaaaccgcctgctggacggagaacgactcgcggaccgcaagattgcggagctgttttccacgaagacccacatcgggtga

SEQ ID NO: 15333 - RNA, 5052 nt, synthetic construct
  misc_feature 1..5052: note = derived and/or modified CDS sequence (opt11) from CCHFV(1231-CR/TI-2015)__KU161585.1__GP
  source 1..5052: mol_type = other RNA
atgcacaccctgctcgtgtgcttcattctgtacctgcagctcctgggcctagggggcgcccacgagcagagcaatgccaccgaccacaatcgcacgaacactatcaccgcgccttccactagccagaacccgaagccgcccgcctccacgacgcccccacacacccccgagagctccaccatcaagctcatcacgagcaccggcgaggccgaaggctccggggagactacacccccgctgaacacgacccagggcccgttccctcccgagaccacaagcgagcaccccgcttccacggccaccaacaccagttccaccaacagcatgaactctacgacccagatgaccgacaagaccctgacgagcaccgtctccaccagcctcagtatcagcccgtcgacccccagcacgagccagggaatccactaccccatccggtccctgctgagcgtgtcgtcaccccgcaccgctgccacgccgacccccatgtccacgcgggagatgtcctccgaaaccaacagccagcactccgccgtgagccgcacccccaccttccacacggccacccaggtctccaccgagaacgacaaccggtcaacaccccgccagagtgagagctccgcgcagccggccacccagagccccatgacgtcgcccgcccagagcatcctcctggtttccgccgcacccaccaccatacagaacatccacccgtcgcccaccaatcggagcaaacgcaacctggagatggagatcatcctcacgctgccgcaggggctgaagaagtactacggcaagatcctgaagctgctgcacttaaccctggaggaggacaccgaggggctgctcgagtggtgcaagcggaacctggggtccaactgcgacgatgagttcttccagaaacgcatcgaggagttcttcatcaccggggagggctacttcaacgaggtgctgcagttcaagacgttaagcaccctgtcccccatggagccgagccacgcccggccacccaccgccgagccgttcaagtcttacttcgccaagggcttcctgagcatcgactccgggtacttcagcgccaagtgctacccccgctccagctccagcggcctccagctgatcaacatcacccagcaccccgcccggattgctgagacgcccgggccgaagaccacctccctgaagaccatcaactgtatcaacctccgcgccagcgtcttcaaggagcatcgggaagtcgagatcaacgtgctgctgccccagatcgccgtcaacctctccaactgccacgtggtgatcaacagccacgtctgcgactactccctggacacggacggccccgttcgcctgccccggatctatcacgagggcaccttcattccggggacctacaaaatcgtgatcgacaagaagaacaagctcaacgaccgctgcaccctggtcacgaactgcgtgaccaagggccgggaggtgcgcaaggggcagagcgtgctgcggcagtacaagaccgagatcaagatcgggaaggcctctaccgggtcccgcaagctcctgagcgaggaacccggggacgactgcatctcccgcacgcagctgctccgaaccgagaccgccgagatccacgacgacaattatggagggcccggcgacaaaatcaccatctgcaatgggagcaccatcgtggaccagcggctgggctccgagctggggtgctacaccatcaaccgggtaaagagcttcaagctctgcgagaactccgcgaccggcaagacctgcgagatcgacagcacccccgtcaagtgccgccagggcttctgcctgaagatcacccaggaggggcggggccacgtgaagctctcccgcggaagcgaggtggtcctggacgcctgcgactcctcttgcgaggtgatgatccccaaaggcacgggggacatcctcgtcgactgctccggcggccagcagcacttcctcaaggacaacctgatcgacctcgggtgcccccacatcccgctgctgggcaagatggccatctacatctgtcggatgagcaaccacccccggaccacgatggccttcctgttctggttctccttcggatacgtgataacctgcatcttctgcaaggccctgttctacagcctgataatcatcggcaccctcggcaagaagatcaagcaataccgagagttgaagccgcagacctgcaccatttgcgagaccgcccccgtgaacgccatcgacgccgagatgcacgacctgaactgctcctacaacatctgcccctactgcgcctcgcgcctcacctccgacgggttagcgcggcacgtcacccagtgccccaagcgcaaggagaaggtggaagagaccgagctgtacctcaacttggagcgaatcccgtggattgtgcgcaagctgctccaggtcagcgagagcacgggggtggccctgaagagatcctcgtggctgatcgtcctcctggtcctgctcaccgtgtccctgagccccgtgcagtccgcccccgtcgggcacggcaagaccatcgagacctaccagacgcgcgaggggttcaccagcatctgcctgttcatgctcggctccatcctgttcatcgtgagctgcctggtgaagggcctcgtcgagtccgtgagcgattcctttttccccgggctgagcgtgtgccggacctgctccatcggcagcatcaacgggtttgagatcgagtcccacaagtgctactgcagcttattctgctgcccgtactgccgccactgctccgccgaccgggagatccaccagctccacttaagcatctgcaagaagcgtaagaccggatccaacgtcatgctggccgtgtgcaagcgcatgtgtttccgggcgactatggaggccagccgtcgggccctcctgatccgctcaatcatcaacaccaccttcgtgatctgcatcctgactctcacgatctgcgtcgtgtccaccagcgccgtggagatggagaacctgcccgccggaacctgggagcgggaggaggacctgaccaacttctgccaccaggagtgccaggtcacggagaccgaatgcctctgcccctatgaggcgctggtgctgcgcaagccactcttcctggactccatcgtgaagggcatgaagaacttactcaacagcacctccctggagaccagcctgagcatcgaggccccctggggcgccataaacgtccagagcacgttcaagcctaccgtctccaccgccaacatcgccctcagctggtccagcgtggagcaccgcggtaacaagatactggtgaccggccgctccgagagcatcatgaagctggaggagcggacgggggtctcctgggacctcggcgtggaggatgcgagtgagtccaaactgctgaccgtcagcatcatggatctctctcaaatgtacagccccgtcttcgagtacctgagcggggaccgacaggtggaggagtggccgaaggcaacctgcaccggcgactgccccgagaggtgcggctgcacgtccagtacctgcctgcacaaagaatggccccacagccgtaactggcggtgtaaccccacctggtgctggggagtcggcaccgggtgcacgtgctgcggcgtggacgtgaaggacctctttaccgaccacatgttcgttaagtggaaggtggagtacatcaagaccgaggccatcgtgtgcgtagagctgaccagccaggagcgccagtgctccctgatagaggccgggacgcggtttaacctcggcccggtgacgatcaccctgagcgagccccgcaacatccagcagaagctgccacccgagatcatcactctccacccgaagatcgaggagggcttcttcgacctgatgcacgtgcagaaggtcctgtccgcgagcaccgtgtgcaagttgcagtcctgcacgcacgggatccccggcgacctacaggtgtaccacatcgggaacctgctcaagggcgaccgggtcaacggccacctgatccacaaaatcgagccccacttcaacacctcatggatgtcctgggacgggtgcgacctggattactactgcaacatgggcgactggcccagctgcacctacaccggggtgacgcagcacaaccacgccgcgttcgtgaacctcctgaacatcgagaccgactacaccaagaccttccacttccactccaagcgcgtcacggcccacggcgacacaccccagctggacctcaaagcccggcccacctacggggcgggcgagatcaccgtactggtcgaggtagccgacatggagctgcacacgaaaaaggtggagataagcggccttaagttcgcgtccctggcctgcaccggctgctacgcctgcagttccggcatcagctgcaaggtacgcatccacgtggatgagcccgacgagctgaccgtgcacgtcaagtctagcgaccccgacgtggtggcggccagcacctccctcatggcccggaagctggagttcgggacggacagcacgttcaaggccttctccgcaatgccaaagaccagcctgtgcttctacatcgtcgagcgcgagtactgcaagtcttgctcagaggacgacaccaagaaatgtgtggacacgaagctcgagcagccccagtccatcttgatcgagcacaaggggaccatcatcgggaagcagaacgatacctgcaccgcgaaggccagctgctggctggagtccgtaaagagcttcttctacggcctcaagaacatgctgggttccgtcttcgggaacttcttcatcggcatcctactcttcttggcccccttcgtgttactggtactcttcttcatgttcggatggaagatactgttctgcttcaagtgctgccgccggacgcgcggtctgttcaagtaccggcacctcaaggacgacgaggaaaccgggtaccgccggatcatcgagcgcctgaacaacaagaagggcaagaaccggctgctcgacggggagcgcctggccgaccggaagatcgcggagctgttcagcaccaagacccacatcgggtga

SEQ ID NO: 15334 - RNA, 5052 nt, synthetic construct
  misc_feature 1..5052: note = derived and/or modified CDS sequence (opt11) from CCHFV(K229_194)__KX013463.1__GP
  source 1..5052: mol_type = other RNA
atgcacactctcctcgtgtgcttcatactttatctgcagctcagcggactcggtggggcccacgggcagagcaacgccaccgagcacaacgggaccaataccaccaccgtccccgggaccagccagtccccgaaaccgcccgcaagcaccaccctgccccacacccctgagtccagcaccgtgaagctcaccacccccacctccgagaccgagggcagcggcgagaccacgccgccgcccaacactacccaggggctgccgccacccggcaccacccccgagcgcccagccaccacggccacctcgaccagctccaccgacaacatgaacagcacgacgcaagttaccgacaacacacccatctccacggtgagcatttcccccagcagcagcccgtcgatgccctcgaccagccaggggatccactaccccgtgcggtccctcctaagcgtgagtagccccaaaaccgtcaccacgccgacccccatgagccctggcgagatgagccccgaaacctccagccaacatagtgccatgagccgcataccgaccttatacacggccacccaggtgtccactgagaacaccaaccggagcacgcccagacagtccgagagttccgcccagcccgccacgcaatcacccaccacctccccgacccagacgatcctgctcatgagcgccgcccccaaggctatccaggacatgcacccctcccctaccaaccggtcaaagcgcaacctggaagtggagatcatcctgaccctctcccaggggctgaagaagtactacggcaagatcctgaagctcctgcacctgacactcgaggaggacacggagggcctgttggaatggtgcaaacggaacctgggctcgaactgtgacgacgatttcttccagaagcgcatagaggagttcttcatcaccggggaggggtatttcaacgaagtcctgcagtttaagaccctgaacaccctcagccccactgagccctcccatgttcggctgcccaccgccgagccgttcaagagctacttcgccaagggctttttatcggtggacagcggctacttctccgccaaatgctacccccgcagctccaccagcgggctccagctcatcaacgtcacgcaacaccccgctcggatagccgagacgcctggaccgaagaccacctccctgaagaccataaactgcatcaacctacgcgccagcgtattcaaggagcaccgagaggtcgagatcaatgtcctgctgccccagatcgcggtgaacctctccaattgccacgtggtaatcaacagccacgtgtgcgactactcccttgacacggacggtcccgtgagattaccccggatccaccacgagggcaccttcattccggggacctacaagatagttatcgacaagaaaaacaagctcaacgaccgctgcagcctggtgactaactgcgtaatcaagggccgggaggtccgcaaaggccagtccgtgctgcggcaatacaagacggagatcaagatcgggaaggccagcaccggcagccgaaagctcctgtccgaggagcccggggatgactgtatcagccggacccagctgctcaagactgagacggccgagatacacgacgacaattacggcgggcccggcgataagatcaccatctgcaacggctcaactatcgtcgaccagcgcctgggcagcgagctgggctgctacaccatcaaccgcgtcaagtccttcaaactttgcgagaactctgcgacggggaagacctgtgaaatcgactcgaccccagtgaagtgccgacagggcttctgcctgaagataactcaggaggggaggggccacgtcaagctgagccggggctccgaggtcgtgttggacgcctgcgatagctcctgcgaaataatgatcccgaaggggacgggcgacatcctcgtggattgcagcggtggccagcagcacttcctaaagggaaacctgatcgacctcgggtgtccgcacatccccctgctgggaaagatggcgatttacatctgccgcatgtccaaccacccccggaccacgatggccttcctgttctggttcagcttcggttacgtgatcacgtgcatcttctgcaaggccctgttctactcactgatcatcatcggcaccctcgggaagaagattaagcagtatcgcgagctgaagccgcagacgtgcaccatctgcgagaccgcgcccgtgaacgccatcgacgccgagatgcacgacctgaattgcagctacaacatatgcccctactgtgccagtcggctcacctcggacggcctggcccggcacgtcacgcagtgccccaagaggaaggagaaggtggaagagacagagctgtacctcaacctggagcgcataccgtggatcgtgcggaagctgttacaggtctctgagagcaccggcgttgcgctgaagcgcagctcttggttgatagtgctcctggtcctgctaaccgtgagcctgtccccggtgcagagcgcccccgtcgggcacgggaagacgatcgagacgtatcaaacccgggaggggttcaccaacatctgcctgttcatgctcggatccatcctgttcatcgtgagctgccttgtgaaggggctcgtcgactccgtgagcgactccttcttcccgggcctgagcgtatgcaagacgtgctcgattggcagcatcaacgggttcgagatcgagtcacacaagtgctactgttctctgttctgctgcccctactgccgccattgctccgccgaccgggagatccaccagttgcatctgggcatctgcaagaagcgcaagaccgggagcaacgtcatgctcgccgtctgcaagcggatgtgcttcaaggcgaccatcgaggcgtcccgccgggccctcctgatcagaagcatcatcaacaccacattcgtgatctgcatcctgaccctagccatctgcgtcgtgtccacctccgccgtggagatggaaaacctgcccgcaggcacctgggagcgcgaggaagacctgacgagcttctgccaccaagagtgtcaggtaaccgagaccgagtgcctctgcccttacgaggccctcgtgctgcggaagccactgttcctggactctatagtgaaggggaagaagaacctgctcaacagcaccagtctggagacgagcctgtcaatcgaggcaccctggggcgcaatcaatgtccagagcaccttcaagcccaccgtgtccacagccaacattgcgcttagctggtccagcgtggagcaccgcggcaacaagatcctcgtcacggggcggtccgagtcaatcatgaagctggaggagcgcaccggcgtgtcctgggacctcggggtggaggacgcgtccgagtccaagctgctgaccgtctcgatcatggatctctcccagatgtacagccctgtgtttgagtacctgtccggcgaccgccaggtggaggagtggccgaaggcgacctgcacgggggactgccccgagcgctgcggatgcaccagctccacgtgcctgcacaaggaatggccccactcgcggaactggcgctgcaacccaacctggtgctggggcgtcgggaccggctgcacttgctgcggggtggatgtgaaggacctcttcacggaccatatgttcataaaatggaaggtcgagtacatcaagactgaggccatcgtttgcgtggagctgaccagccaggagcgccagtgctccctgattgaggccggcacgcgcttcaacctcggcccggtcactatcaccctttccgagccccggaacatccagcagaagctgccgcccgagatcatcacactccaccccaagatcgaggaggggttctttgacttaatgcacgtccagaaggtgctgtccgcgagcacggtctgcaagctgcagtcgtgcacccacgggatccccggggacctgcaaatctaccacataggaaacctgctcaagggagaccgcctgaacggtcacctgatccacaagatagagccccactttaacactagctggatgtcctgggatggctgtgacctcgactactattgtaacatgggagactggcccagctgcacctacacgggagtaacgcagcacaaccacgccgccttcgtcaacctgctgaacatagagactgactacaccaagacgttccactttcactccaagcgggtgaccgcccatggggacaccccgcagctcgatctgaaagctcgccccacttacggcgccggggagatcacggttctggtcgaggtcgccgacatggagcttcacaccaagaaggtggagatctctggcttgaagttcgcctccctggcctgcaccggatgctacagctgctccagcgggatctcctgtaaggtccggattcacgtagacgagcccgacgagctcaccgtgcacgtaaagagctccgaccccgacgttgtggcggccagcacgagcctgatggcacgcaagctggagttcggcaccgactcgaccttcaaggcgttcagcgccatgccgaagacatccctctgcttctacattgtcgagcgggagtactgcaagtcgtgctccgaggacgacactaaaaagtgtgtggacaccaagttggaacaaccccagagcatcctgatcgagcacaagggtaccatcatcggcaagcagaacgacacgtgcacagcgaaagcctcctgctggctcgagagcgtgaaatccttcttctacgggctgaagaacatgctgggcagcgtattcggcaacttcttcgtggggatcctcctgtttctggcccccttcgtactgttagtcctgttcttcatgttcggctggaagatcttattctgtttcaagtgttgccgacggacccgcggcctcttcaagtacagacacttgaaggacgatgaggagaccggctaccgcaagatcatcgagcgcctgaactccaagaagggcaagaaccggctcctggacggggagcgcctggccgaccggaagatcgccgagctgttcagcaccaagacgcacattgggtag

SEQ ID NO: 15335 - RNA, 5052 nt, synthetic construct
  misc_feature 1..5052: note = derived and/or modified CDS sequence (opt11) from CCHFV(K315_14)__KX013469.1__GP
  source 1..5052: mol_type = other RNA
atgcacaccctgctcgtgtgcttcatactgtacctgcagctcagcggcttgggcggcgcccacgggcaatccaacgagactgagcacaacggcacgaacaccaccacggtccccgggacgagccagtccccgaagccgcccgccagcaccaccctgcagcacacccccgagtccagcacggtgaagctcaccacccccacctcggagacggaaggctccggcgagaccactcccccgcccaacaccacccaggggttgcccccaccgggcacgacacccgagcgctctgcgaccacggccacgagcacctctagcaccgacaacatgaactccacaacccaggtgaccgacaacacaccaacaagcacggtctcgatcagcccctctagttcccccagcatgcccagcacttcccaggggatccactaccccatccggtcactcctctctgtgagcagccccaagacagtaacgacccccacccccatctcgcccggtgagatgtcccccgagacaagctcccaacacagcgccatgtcccgcatccccacgctctacaccgccactcaggttagcaccgaaaacaccaaccggtccacgccccgccaaagtgaatccagcgtgcaaccggccacacagtcccccatcacctctccagcccaaactatccttctcatgagtgcggccccaaaggccatccaggacatgcacccgagccccacgaaccggagcaagcgcaacctggaagtggaaatcatcctgaccctctcccagggacttaagaagtactacggcaagattttaaagttgctccacctgaccctcgaagaggacacagaaggcctgctcgagtggtgcaagcggaacctcgggagcaactgtgacgacgacttcttccagaagcgcatcgaagagttctttatcacgggcgaggggtacttcaacgaggtcctgcagtttaagaccctgtccaccctcagccccaccgaaccgtcccacgtgaggctgcccacggcggagccctttaagtcgtacttcgcaaaaggcttcctgagtatcgacagcggctacttcagtgccaagtgttacccacgcagctccaccagtgggctccagctgatcaacgtgactcaacaccctgcaagaatcgccgagacccccggccccaaaactacctccctgaagaccatcaactgcatcaacctccgcgccagcgtctttaaggagcaccgggaggtggagatcaacgtccttctgccccagatcgccgttaacctctctaactgccacgtggtaatcaacagccacgtctgcgactactccttggacaccgatgggccggtgaggctgccccggatccaccatgagggcaccttcatacccgggacctataagatcgtgatcgacaagaagaataagctcaacgacagatgcagcctggtcaccaactgcgtaatcaaaggccgggaggtgcgcaagggccagagcgtcctgcgccaatacaagaccgagatccgcatcgggaaggcatccacgggcagccggaagctcctgtccgaggagcccggcgacgactgcattagccgtacccagctgctaaagaccgagaccgccgagatccacgacgataactacggcggcccgggcgacaaaatcacaatttgcaacggctccaccgtggtcgaccagcgcctggggagtgagctgggatgttacaccataaaccgggtgaagtccttcaagctctgtaagaatagcgcgactggcaaaacgtgcgaaattgactccacccccgtgaagtgccgccagggcttctgtttaaaaattacccaggaagggcggggccacgtcaagctgagccgcggctccgaggtggtgttagacgtctgtgactcttcctgcgagatcatgattcccaaggggaccggcgatatcctcgtagactgcagcggcgggcagcagcacttcctgaaggacaacctgatcgacctcgggtgcccccacataccgctgctgggcaagatggcgatctacatctgtcggatgtccaaccacccacgcacgaccatggccttcttgttctggttctcattcggctatgtgattacctgcatcttctgcaaagccctgttctactcactgatcatcatcgggaccctcggcaagaagatcaagcagtaccgggagcttaagccacagacctgcactatctgcgaaaccgcccccgtcaacgccatcgacgcggagatgcacgacctgaactgctcctacaatatctgcccatactgcgcttcccgccttaccagcgaggggctagcccggcacgttacccagtgccccaagcgcaaggagaaggtggaggagacggagctctaccttaacctggagcggatcccctggatcgtgcgcaagctgctccaggttagcgagtccacaggcgtcgccctaaaaaggtcttcctggcttatcgtcctcctggtactgctcacagtatcgcttagccccgtccagtcagccccggtgggccacgggaagaccatcgaaacataccagacccgcgaggggttcacatccatctgcctgttcatgctcgggtcaatcctgttcatcgtgtcctgcctggttaaggggctggtgtacagcgtgtccgacagcttcttccccgggctgtctgtttgtaagacctgctccatcggctccatcaacggcttcgagatcgagagtcacaagtgctactgctccctgttctgttgcccctactgccgccactgcagcgcggatcgcgagatccatcagctccacctgtccatttgcaagaagcgtaaaaccgggagcaacgtgatgctcgccgtgtgcaagcgcatgtgcttcaaggccactatcgaggctagccgccgcgcgctccttatccgctccatcataaacaccacgttcgtgatctgtatcctaacgctcgcaatctgtgtggtgagcacctctgccgtcgaaatggaggacctgccggccggcacctgggagcgggaggaagacctgaccaacttctgccaccaggagtgccaggtgactgagaccgagtgcctctgcccgtatgaggccctggtgctgcgcaagcccttattcctggacagcatcgtcaaggggatgaagaagctgctcaactccacctccctggagacctccttgagcatcgaggcaccctggggcgccatcaatgtgcagtccacgttcaagccaacagtgagcactgccaacatcgctctctcctggagctccgtcgagcaccgagggaataagatcctggtgaccggccgcagcgagtccatcatgaaactcgaggagcgtacgggcgtgtcctgggacctcggggtcgaggacgcctccgagagtaagctgctgacggtgtccattatggatctcagccaaatgtacagccccgtattcgagtatctgtccggtgaccgccaggtcgaggagtggcccaaggcaacctgcacaggggactgccccgagcgttgcggctgcacgagcagcacttgcctgcacaaagagtggccgcacagccgcaactggcggtgcaaccccacctggtgctggggagtgggcaccggctgcacatgctgcggggtggacgtcaaggacctcttcaccgaccatatgttcataaagtggaaggttgagtacatcaaaaccgaggccatcgtgtgtgtcgagctgacctcacaggagcgccagtgcagcttaatcgaggcgggcacccggttcaacctcgggcccgtgactatcaccttgtctgagccccgcaacatccagcaaaagctgccgccggaaatcatcacgctccatcccaagatcgaggagggcttctttgacctcatgcacgttcaaaaggtcctgagcgcctccaccgtatgcaagctccagtcttgcacgcacggcatccccggcgacctgcagatctaccacatcggcaacctgctcaagggggaccgagtcaacggtcacctcatacacaagattgaaccgcatttcaacacctcctggatgagctgggacgggtgcgacctggactactattgcaacatgggcgattggccctcctgcacctacaccggcgtgacgcaacacaaccacgccgcgttcgtgaacctcctgaacatcgaaaccgactacacaaagaccttccacttccacagcaagcgggtcacggcccacggggacactccccagctggacctcaaggcccggcccacctacggtgccggggagattaccgtgctggtggaggtagcggacatggagttgcacacgaagaaggtggagatctccggcctcaagttcgcctccctgacctgcaccgggtgctacgcctgctccagcggcatcagttgtaaggttcgcatacacgtcgacgaaccggacgagctgaccgtgcacgtaaagtccagcgatccggacgtcgtggccgcctccacgtctctcatggcccggaagctggagttcggcaccgactccaccttcaaggctttcagcgccatgcccaagacctctctgtgcttctatattgtggagcgcgagtactgtaaaagctgctccgaggatgacaccaagaaatgcgtcgacaccaagctcgagcagcctcagagcatccttatcgagcacaaaggcaccatcatcggcaagcagaacgacacgtgcacggcaaaggcctcctgctggctggagagtgtgaagtcatttttctacgggctaaagaacatgctgggcagcgtgttcgggtccttcttcgtcggcatcctcctcttcctggcgccgttcgtactgctggtgctgttcttcatgttcggctggaaaatcctgttctgcttcaaatgctgccggcgcaccagagggctgttcaaataccgccacctcaaggacgacgaggagacgggctaccgccggatcatcgagcgcctgaacagcaagaaaggtaagaaccggctgctcgatggcgagcgcctggccgatcggaagatcgccgagctgttctccaccaaaacgcacatcggttga

SEQ ID NO: 15336 - RNA, 5055 nt, synthetic construct
  misc_feature 1..5055: note = derived and/or modified CDS sequence (opt11) from CCHFV(BA8402)__AF350449.1__GP
  source 1..5055: mol_type = other RNA
atgtacacgcccctgctctgcgccgtgctgtgcctgcagctctggagcctggagggctcccacgggctgagcaacaagacccagcattccaataccagcaccaccaaggccccggaagtctcccaggagctcgggctgccagtgagcaccgtgtccaccatcaccagcgaaccgccctcaattaccagcgcggtctccgtgtctgggtccgagggcagcggggacaccaacacttccccgagcgtcaccacccagggcccaaccctgcccgagacgacccttgagcccctgaccaccacggacaccgacgcctccagcacggtcgtggtggacgtctccacgcagacggtgaaggataccccgatctctaccacctacaccagcctgccctcaacccccagcgagcccaccaccccgcagggaacccaccacaccgcgcgcgggctcctgtccgtgacgagcaccaagcccgaggaggcgagcccccaggccaatcccggcaagatcagcatggagacgaacggaccgcggctggcgatctctgagaccccctccttctcccccaccacccaggcccccacggagaacagcaatccgatcacgtccaagcagctcatgctgagcgcccagccagtcacccccaaccccatgacctccccggtgcagcccgccctgagccaatccgacaccagcacggcgatacaggacgtgcacccctcccccaccggccgctctaagcggaacctcgagatggagatcatcctgaccctatcccaggggctcaagaagtactacggcaagattctgaagctgctcgacctgaccctggaggaggatacggagggcctcctggagtggtgcaagcgcaacctaggcctagtctgcgacgacaacttcttccagaagcggatagaggagttcttcctgaccggcaaggggcatttcaacgaggtgctgcagttcaagaccccgagcaccctcagccccacgggccccgcccgcaccggctcgccgaccgtggagcctttcaaaagctacttcgccaaggggttcctgtccatggactccgggtacttctccgccaagtgctatccccgagccagcaactccgggctgcagctcatcaacgtcacccagcacagcacacgcatcaccgacacccccggcccgaagatcaccaacctgaagacgatcaactgcatcaacctgaaggcgtcagtgttcaaggagcaccgggagatcgagatcaacgtgctcctgccccaggtcgccgttaacctaagctcctgtcacgtgcttatcaagagccacgtgtgcgactactccctggacatcgacgggcccgttcgcctgccccggatccaccatgagggcactttcatcccgggcacctataagatcgtaatcgacaagaagaacaagcagaacgaccgctgcaccttggtgacgaactgtgtgatcaaggggcgggaaatccgcaagggacaaagcgtcctgcggcagtaccgaaccgagatcaagatcgggaaggcctcctcgggctcccggcgcctgctcagcgaggaaagcggtgacgactgcatctcgcggacccagttactgcgcaccgagacggcggagatccacaacgacaactacggcggccccggggataagatcaccatctgcaatggcagcaccgtggtggaccagcggctagggtccgagctcggctgctacaccatcaaccgcgtcaatagtttcaacctgtgcgagaacacggccacgggtaagtcctgtgagatcgacagcacccctgtgaagtgtcgccagggcttctgtttaaagatcactcaggagggccgggggcacgtgaagctctcccgcggcagcgaggtcgtgctggacgcgtgcgagtccagctgcgagatcatgatccccaaagggacgggcgacatcctggtggactgctccggcgggcagcagcacttcctcaaggataatctgatcgacctgggctgtccgaatatccccctcctggggaagatggccatctacatctgcaggatgagcaaccatcccaagaccaccatggccttcctgttctggttctccttcggctacgtcgtgacctgcatcctctgtaaagtgatcttctacctgctgatcgtcgtgggaacactcggcaagaagttcaaacagtatcgcgagctgaagccccaaacctgcaccatctgcgagaccaccccggttaacgccatcgacgctgagatgcacgacctgaactgcagctacaacatctgcccctactgcgcatcccggcccacgagcgacggcctcgcccgccacgtcatgcagtgcccaaagcggaaggagaagatcgaggagaccgccctgtacctcaacttggagcgcatcccgtgggtggtgcggaagctgctgcaggtctccgagagcaccggtgttgcactcaaacgctccagctggctggtggtcctgctcgtgctgctgaccgtgagcctctcccccgtccaatccgcccccatcggccatgggaagacagtggagacctaccaaacccgggagggctacacctccatctgcctgttcgtgctggggagcatcctcttcatcgtgtcctgtctgatgaagggccttgtcgacagcgtgggcaactccttcttccctgggttaagcatatgcaaaacgtgctccatcggcagcgtcaacgggtttgagatcgagtcccacaagtgctactgcagcttattctgctgcccgtactgccgccactgctccgcggaccgggagatacaccgcctgcacttgagcatttgcaagaagcggaagaccggctccaacgtgatgctggccgtgtgcaagcgcatgtgtttcagagccaccgtcgaggtgagcaacaaggccctgctcatacgcaacatcatcaacaccacgttcgtgctgtgcatcctgatcctcgcggtgtgcgtggtgtccacgagcgctgtcgagatggagagcctgcccgccgggacctgggagcgtgaggaggacctgaccaacttctgccaccaggagtgccaggtgacggaaaccgagtgcctctgtccctacgaggccctggtcctgcgcaagcccctcttcagcgacagcatcgtcaagggcatgaaaaacctgctgaactccacctctctcgagacctccctgagcatcgaggccccctggggcgcgatcaacgtgcagtccacgttcaagccgaccgtgagcgccgccaacattgccctgtcttggagcagcgtcgagcaccgcgggaacaagatcctcgtgagcggccggtccgagagcatcatgaagctggaggagcgcaccgggatctcctgggacctgggcgtggaggacgccagcgagtccaaacttttgaccgtcagcgtcatggacctgtcacagatgtatagccccgtcttcgagtacctctccggggaccgccaggttgaggaatggccgaaggcgacgtgcaccggcgactgtcccgagcggtgcggctgcaccagcagcacgtgcctgcacaaggagtggccccactcccgcaactggcgctgcaatcccacctggtgctggggcgtgggcaccggatgcacgtgctgcggcctggacgtcaaggacctcttcacagactatatgttcatcaagtggaaagtagagtacatcaagaccgaggccatcgtgtgcgtcgaactgaccagccaggagcggcagtgcactctgatcgaggccggcacccgcttcaacctcgggccggtgacgatcaccttgtccgagccccggaacatccagcagaagctgccgcccgaaatcgtgaccctacacccccgcatcgaggagggcttcttcgacctgatgcacgtccagaaggtgcttagcgcgtccaccgtgtgcaagctccagagctgcacccacggggtccccggcgacctccaagtgtaccacatcgggaacctgctcaagggcgacaaggtgaacggccacctgatccacaagatcgagccccacttcaacacgtcctggatgagctgggacgggtgcgacctgcactattactgcaatatgggtgactggccctcctgcacctacaccggggtaacccagcacaatcacgccgcgttcgtcaacatgctcaacatcgagacggactacaccaagaatttccacttccacagcaaacgggtgaccgcccacggcgacaccccgcagctagacctgaaggcccggcccacgtacggggccggcgagatcaccgtcctcgtggaggtggcggacatggagctgcacaccaagaagatcgagatctccggcctgaagttcgccagcttaacctgcacggggtgctacgcctgctccagcggcatctcctgcaaggtccggatccacgtggacgagcccgacgagctgaccgtgcacgtcaagtccgaggaccccgacatcgtggccgcctccagctccctcatggcgcgcaagctcgagttcgggaccgatagcaccttcaaggcctttagcgcaatgccgaagacgtccctgtgcttctacatcgtggagcgggagtattgcgagagctgctccaaggaggacacccagaagtgcgtcaacaccaagctggagcagccccagagcattctcatagagcacaagggcaccatcatcgggaagcaatccaacacttgcaccgccaaggcaagctgctggctggagtccgtcaagagcttcttctacggcctgaagaacatgctgtccggcatcttcgggaacgtgtttatcggcgtgtttttattcttcgcgcccttcatcctgctgatcctcttcttcatgttcgggtggcgcatcctgttctgtttcaagtgctgccggcgcacccggggcctgttcaagtaccgccatctcaaggacgatgaggagaccggctaccggaagatcatcgaacgcctgaacaacaagaaggggaagaacaagctgctcgacggcgagcgcctggccgaccggaaaatcgccgagctgttcagcacgaagacccacatcgggtga

SEQ ID NO: 15337 - RNA, 5055 nt, synthetic construct
  misc_feature 1..5055: note = derived and/or modified CDS sequence (opt11) from CCHFV(UCCR4459)__KY484032.1__GP
  source 1..5055: mol_type = other RNA
atgtacacgcccctcctctgtgccgtgctgtgcctgcagttatggagcctggagggctcccacgggctgagcaacaagacccagcactcgaacaccagcaccacgaaggccccggaggtctcccaggagttcggcctccccgtcagcaccgtgtccacgatcacctccgatccgcccagcatcaccagcgcggtctccgtgagcgggtccgaaggcagcggggataccaacacgtcccccagcgtgaccacccagggcctgacgctgcccgagacgaccctcgagctgctaaccaccacggacaccgacgcctccagcaccgtcgtggtggacgtctccacgcagacggtgaaggacacccccatcagcactacccatacgagcctccccagtaccccgagcgccaccaccacgccccagggaacccaccacacagcccgcgggctgctgtccgtgaccagcacgaagcccgagggcgcctccacccaggcgaaccccgagaaaatcagcatggagaccaactcaccgcggctcgccatcagcgagaccccctccttcagccccactacccaagcccccacggagaactccaacccgatcactagcaagcagctgatattctccgcccagcccgtcacccccaatcccgtgacgccgcccgtgcagcccgcgctttctcaatccgacacgagcaccgccatccaggacatccacccctccccgaccagccgctcaaagcggaacctcgagatggagatcatcctgacgctgagccaggggctcaagaagtactacggcaagatcctgaagctgctcgacctgacgctggaggaggacaccgaggggctcctggaatggtgcaagcgcaacctgggcctcgtctgcgacgacgacttcttccagaagcggatcgaggagttcttcctgactggcgaggggcacttcaacgaggtgctgcagttcaagacgcccagtaccctctcacccaccggccccgccagaaccgggagcccgacggtggagccctttaagtcctacttcgccaagggattcctgagcatggactcaggctacttcagcgccaagtgctacccccgggcgtccaactctgggctgcagctcatcaacgtcactcagcactccacccgcatcaccgacacgccgggcccgaaggtgactaacctgaaaaccatcaactgcatcaacctgaaggcgtcagtgttcaaggaacaccgggagatcgagatcaacgtcctcttaccccaggtggccgtgaatctgtccagctgccacgtcctcatcaagagtcacgtgtgcgactacagtctggacatcgacgggcccgtccgcctgccgcggatccaccatgagggcaccttcatccccgggacatacaagctcgtgatcgacaagaagaacaaacagaacgaccgctgcaccctgatcaccaactgcgtgatcaagggccgggagatccgcaagggccagtccgtcctgcgacagtaccgcaccgagatcaagatcgggaaggcctcgtctggcagccggcgcctcctgagtgaggagtccggcgacgactgcattagccggacgcagctgtcccgcaccgagaccgccgagatccacagcgacaactacggcggccccggtgacaagatcaccatctgcaacggctccactatcgtggaccagcggctggggagcgaacttggctgctacaccatcaaccgcgtgaagtccttcaaactgtgcgagaacagcgcgaccgggaagtcctgcgagatcgacagcacccccatcaaatgccgacagggcttctgcctgaagatcacgcaggagggccggggccacgtcaagctctcccgcggcagcgaggtggtgctggacgcctgcgactcctcatgcgagatcatgatcccaaaagggaccggcgacatactcgtcgactgctccgggggccagcagcacttcctcaaggacaacctgatcgatttgggctgccccaacataccccttctggggaagatggccatctacatctgtcggatgagcaaccaccccaagaccaccatggccttcctgttctggttctccttcggctacgtgatcacgtgcatcctctgcaaggtgatcttctacctgctgatcgtcgtggggaccctcgggaagaagttcaagcaataccgcgagctgaagccgcagacctgcaccatctgtgagaccacgcccgtgaacgccatcgacgcggagatgcacgacctgaactgctcttataacatctgcccctactgcgcctcacggctcaccagcgacgggctggcccgacacgtcatgcagtgccccaagcgcaaggagaaggtggaggagaccgagctgtacctcaacctggaaaggatcccatgggtggtccggaagctgctacaggtgagcgagtccaccggcgtggccctgaaacgcagctcctggctggtcgtgctcttagtgctgctcactgtcagcctgtcccccgtgcagagcgcccccatcggccacgggaagacagtggagacgtaccagacccgggagggctacacgtccatatgcttgttcgtcctcgggagcatcctgttcatagtgtcgtgcctgatgaagggcctcgtggacagcgttggcaacagcttcttccccggcctgagcatctgcaagacctgttccataggcagcatcaacgggttcgagatcgagtctcacaagtgctactgcagcctgttctgctgcccgtactgccgccactgctccgcggacagagagatccataagctccacctaagcatctgcaagaagcgcaagaccgggtccaacgtgatgctggcggtgtgcaagcgaatgtgcttccgcgccaccgtcgaggtgagcaacaaggccctgctgatccggaacatcattaacacgaccttcgtagtctgcatcctgatcctcgcggtgtgcgtggtcagcacctccgccgtggagatggagagcctgcccgctgggacctgggagcgcgaggaggacctgacgaacttctgccaccaggagtgccaggtgaccgagaccgagtgcctctgcccctacgaggccctggtcctgcggaagcccctcttctccgacagcatcgtgaagggtatgaagaacctgctgaactccaccagcctcgagacgtccctgagcatcgaggccccgtggggcgcgatcaacgtgcagtccaccttcaagccaaccgtcagcgccgccaacatcgccctgtcctggtcttccgtggaacaccgcgggaacaagatcctcgtgagcggccgatccgagagcatcatgaaactggaggaacggaccgggatctcctgggacctgggcgtcgaggacgccagcgagtccaaactcctgacagtgagcatcatggacctaagccagatgtactcccccgtcttcgagtacctctcgggggaccgccaggtagaggagtggccgaaggcgacctgcaccggcgattgccccgagcggtgcgggtgcacctccagcacgtgcttacataaagagtggccccactcccgcaactggcggtgcaaccccacctggtgctggggcgtgggcaccgggtgcacgtgctgcggcctggacgtcaaggaccttttcaccgactacatgttcgtgaagtggaaggtggaatacatcaagaccgaggccattgtctgcgtggagctgaccagccaggagcgccagtgttccctgatcgaggccggaacccggttcaacctcggcccggtaacgatcaccctgagcgagcctcgcaacatccagcagaagctgccgcccgaaatcgtcaccctccaccctcggatcgaggagggcttcttcgacctgatgcacgtcaagaaggtgctgtccgccagcaccgtctgcaagctccagtcctgcacgcacggagtgcccggcgatctccaggtgtaccacatcgggaacctgctcaagggcgacaaggtcaacgggcacctgatccacaagatcgagccccacttcaacacgagctggatgtcctgggacggctgcgacctggactactactgcaacatgggcgactggcccagctgctcctacaccggggtgacccagcacaaccacgccgcattcgtgaacatgctcaatatcgagaccgactacacgaagatcttccacttccacagcaagcgcgtcaccgcccacggggacaccccgcagctggacctgaaggcccggcccacctacggggccggcgagatcacggtgctcgtcgaggtcgcggacatggagctccacaccaagaagatagagatatccgggctgaagttcgccagcctgacctgcaccggctgctacgcctgctccagcgggattagctgcaaggtgcgcatccacgtcgacgagcccgacgagctgacggtccacgtgaagtccgaggacccagacattgttgccgccagttccagcctgatggcgcggaagctcgagttcgggaccgactccaccttcaaagccttcagcgccatgccgaagacctccctgtgcttctacatcgtcgagcgcgagtactgcaagagctgctccaaggaggacacgcagaagtgcgtaaacaccaagctggaacagccccagtcaatcctcatagagcacaagggcaccatcatcgggaagcagaacgacacgtgcacctccaaggccggctgctggctggagagcgtgaagtccttcttctacgggctgaagaacatgctgagcggcatctttggcaacgtcttcatcgggatcttcctcttcctggcccccttcatcctgctcatcctgttcttcatgttcggctggcgtattctcttctgtttcaagtgctgccgcagaacgcgcggcctcttcaagtacaggcacctgaaggacgatgaggagaccggctaccgcaaaatcatcgagcgcctgaacaataagaagggcaagaacaagctcctggacggggaacgcctggcggaccgcaagatcgctgagctattctccaccaagacgcacattggctga

SEQ ID NO: 15338 - RNA, 5052 nt, synthetic construct
  misc_feature 1..5052: note = derived and/or modified CDS sequence (opt11) from CCHFV(Ast149)__KX056054.1__GP
  source 1..5052: mol_type = other RNA
atgcataccctgctagtgtgcttcatcctgtacctgcagctcagcggcctcgggggcgcccatgggcagtccaacgccacggagcacaacggcacgaacaccaccaccgcgcccgggacgtcgcagtccccgaagccgcccgccagcaccaccccgcctcacacccccgagtccagcacggtcaagctgaccaccccgacctccgaaacggaggggagcggcgagaccacacccccgcccaacaccacgcaggggctgccgccgcccggcaccacccccgagcgccccgccacgacggcaacctccaccagctccaccgacaacatgaacagcacgacccaggtgaccgacaacacgcccacttccaccgtgagcacatcccccagctccagcccctccatgcccagcaccagccaggggatccactaccccgtccggtccctgctgagcgtgtccagccccaagacggtgaccacccccacccccatgtcgcccggcgagatgagcccggagacgtccagccagcactccgccatgagccgcattcccaccctctacaccgcggcccaggtctcgaccgagaacgccaaccggagcacaccccgccagtcagagagctccgcccagcccgcgacgcagagcccgaccaccttccccgcgcagacgatcctgctgatgtccgccgctcccaaggcgatccaggacatgcacccgagcccaacgaacagatccaagcgcaacctcgaggtggagatcatcctcaccctgagccaggggctcaagaagtactacggcaagatcctgaagctgctccacctgacccttgaggaggacaccgaaggcctcctggagtggtgcaagcggaacttgggtagcaactgcgacgacgacttcttccagaagcgcatagaggagttcttcatcacgggcgagggctacttcaacgaggtgctccaattcaagaccttatccaccctgagccccaccgagccctcccacgtccggcttccgacggcggagccattcaagtcgtacttcgccaagggcttcctgtccatcgacagcggttacttctccgccaagtgctacccccgtagctccaccagcgggctgcagctcatcaacgtgacccagcaccccgcccggatcgccgagaccccgggccccaagacgaccagtctgaagaccatcaactgcatcaacctgcgcgcgagcgtgttcaaggagcaccgggaggtcgagatcaacgtactcctgccccagatcgccgtcaacctatccaactgccacgtcgtcatctacagccacgtgtgcgactactccctcgacaccgacggacccgtccgtctgcctcggatccaccacgagggcacgttcatccccgggacctacaaaatcgtgatcgacaaaaagaataagctgaacgaccgctgcagcctcgtgaccaactgtgtgattaagggccgggaggtgcgcaagggccagtccgtgctgcggcagtacaagaccgagatcaagattgggaaggccagcacgggcagccgcaagctgctcagtgaggagccaggggacgactgtatcagccggacccagctgctgaagaccgagaccgccgagatacacgacgacaactacggcgggcccggcgacaagatcacgatctgcaacggctccacgatcgtggaccagcgcctcgggagcgaactgggctgttacaccatcaacagagtgaagtccttcaagctgtgcgagaactcggccaccgggaagacgtgcgagatcgactccaccccggtcaagtgccgccagggcttctgcctcaagatcacccaggaggggcgcggccacgtgaaactgagccggggctccgaggtggtccttgacgcgtgcgacagctcctgcgagatcatgatccccaagggtaccggcgacatcctggtggactgcagcgggggtcagcaacactttctcaaggacaacctgatcgatctgggctgcccacacatccccctcctggggaagatggccatctacatctgtcgcatgtctaaccacccgcggacgaccatggccttcctgttctggttcagcttcggatacgtgattacctgcatcttctgtaaggccctcttctactccctcatcatcattgggaccctgggcaagaagatcaagcagtaccgcgagctcaagccccagacttgcacgatctgcgagaccgctccggtcaacgccatcgacgcagagatgcacgacctgaactgcagctacaacatatgcccctactgcgcctcccggctgaccagcgacgggctcgcccgccacgtgacccagtgcccgaagagaaaggagaaggtggaggagacggaactgtacctaaacctcgagcgcattccctggatcgtccggaaacttctccaggtgtccgagagcaccggggtggcgctgaagcgcagctcctggctaattgtactactcgtgctgctgaccgtgagcctctcgcccgtccagagcgccccggtgggccacgggaagaccatcgagacgtaccagacccgggaaggcttcaccaacatctgcctgttcatgctggggagcatcctcttcatcgtgtcttgcctggtcaagggattagtggactccgtgagcgactccttcttccccgggctcagcgtgtgcaagacctgctccattggcagcatcaacggcttcgagattgagtcccacaaatgctactgtagcctgttctgctgcccttactgccgccactgctccgccgaccgggagatccaccagctgcacctcgggatctgtaagaagcgcaagacgggcagcaacgtgatgctggccgtgtgcaagcggatgtgcttcaaggccaccatcgaggcgtcccgccgggccctgccgataagatcgatcatcaacaccaccttcgtcatctgcatcctcacgctggccatctgcgtggtgtccaccagcgccgtcgagatggagaacctgccggccgggacgtgggagcgcgaggaggacttgaccaacttctgccaccaggagtgccaggtcacggaaaccgagtgcctgtgcccctacgaagctctggtactccggaagcccttgttccttgatagcatcgtaaagggcatgaagaatctcctgaactccaccagcctggagacctccctcagcatcgaggccccctggggcgcaatcaacgtgcagagtacgtttaagccgaccgtgagcaccgccaatatcgccctgtcctggagctccgtcgaacaccgcgggaacaagattcttgtgaccggccggagcgagtccatcatgaagctcgaggaacgcacgggggtgagctgggacctgggcgtcgaggacgcgtccgagagcaagctgctcaccgtgtccataatggacctgagccagatgtattccccagtgttcgaatacctgagcggggaccggcaggtcgaggagtggcccaaggcgacgtgcacgggcgactgtcccgagcgctgcgggtgcacgtcctccacctgtctccacaaggagtggccgcacagccggaactggcgctgcaaccccacctggtgctggggcgtgggcaccgggtgcacgtgctgcggcgtggacgtcaaggacctgttcaccgaccacatgttcatcaagtggaaggtggaatacatcaagaccgaggccatagtgtgcgtcgagctgaccagccaggagcggcagtgcagcctcatcgaggccgggacccgcttcaacctgggccccgtgacgatcaccttgtccgagccccgtaacatccagcagaagctcccgcccgaaatcatcaccctgcacccaaagatcgaggagggcttcttcgacctgatgcacgtgcagaaggtcctcagcgcgtccaccgtgtgcaagctgcagagctgcactcacgggatccccggggacctgcagatctaccacatcgggaacctcctgaagggcgaccgcctgaacgggcacctcatccacaagatcgagccgcactttaacacctcctggatgagctgggatggctgcgacctggactactactgcaatatgggcgactggccatcctgcacgtacaccggagtgacgcagcacaaccacgccgccttcgtcaacctgctcaacatcgagaccgactacaccaagactttccacttccacagcaagcgggtgacggcccacggcgacacgccccagctagacttgaaggcccgccccacctacggagcgggcgagatcaccgtcctcgtggaggtggccgacatggagctgcacaccaagaaggtcgaggtgtccgggctgaagttcgccagcctcgcctgcaccggctgctacgcctgctccagcggcatatcctgcaaggtgcggatccacgtcgacgagccggacgagttaactgtgcacgtgaagtcttccgacccggacgtcgtggctgccagcacctccctgatggcccgcaagctcgagttcgggacggacagcaccttcaaggccttcagcgccatgcccaagacctccctgtgcttctacatcgtggagagagagtactgcaagagctgctccgaggacgacaccaaaaagtgcgtcgacacgaagctggagcagccccagtccattctcatcgagcacaagggcacaatcatcggtaagcagaacgatacctgcacagcgaaggcctcctgctggttggagagcgtgaagagtttcttttacggccttaaaaacatgctagggagcgtgttcggcaacttcttcgtcggcatcctgctgttcctcgccccgttcgtgctgctggccctgttcttcatcttcgggtggaagatcctcttctgcttcaagtgctgccgccggacgcgcggcctgttcaagtaccggcaccttaaggacgacgaggagaccgggtaccgcaagatcatcgagcgactcaactccaagaaaggcaagaaccggctgttagacggcgaacgcctcgcggaccggaagatcgccgagctgttcagcaccaagacccacatcgggtga

SEQ ID NO: 15339 - RNA, 5052 nt, synthetic construct
  misc_feature 1..5052: note = derived and/or modified CDS sequence (opt11) from CCHFV(Ast137)__KX056057.1__GP
  source 1..5052: mol_type = other RNA
atgcacaccctcctcgtgtgcttcatactgtacctccagctcagcggcctcggcggggctcacgggcagagcaacgctaccgagcacaacggtaccaacacaacgaccgtcccagggacaagccagtccccgaagccgcccgcgtcaaccaccctcccccacacccccgagtccagcaccgtgaaactcaccactcccacctccgagaccgagggttctggcgaaaccacgcctccgcccaacaccacccagggactgcccccacccggcaccaccccagagcgccccgccaccacggccacctccactagctccaccgataacatgaacagcacgacccaggtgacagacaacacccctacctccaccgtctcaatatcccctagctccagcccgtccatgccgagcaccagccaggggatccactatcccgtgcggtcattgctcagcgtgtctagccccaagaccgttacgacccccaccccgatgtcacccggtgagatgagccccgagaccagtagccagcattccgctatgagccgcatcccgactctgtataccgccgcccaagtgtccaccgaaaacaccaaccggtcaacaccccggcagtccgaaagcagcgcacagcccgccacgcagagccccaccaccttcccggcccagaccatcctgcttatgtccgcggctcccaaggctatccaggacatgcatcccagcccgaccaatcggtccaagcgcaacctggaagtggagattattctgaccctcagccaggggctgaagaagtactacggcaagatcctgaagctcctgcacctgaccctcgaggaggacaccgagggcctcctggagtggtgcaagcggaaccttgggagcaactgcgacgacgacttcttccagaagcgcatcgaggagttcttcattactggggagggatatttcaacgaggtcctgcagttcaagaccctgtccacactcagccccaccgagccctcccacgtgcggctgcccacagccgagccgttcaaatcctactttgccaaaggcttcctgtccatcgacagcggttacttctccgcgaagtgctacccccgctcctctacgagcggcctccaactgattaacgtgacccagcatccggcccggatagccgagacccccggcccgaagacgacctcgctgaagaccatcaattgcatcaacctcagggccagcgttttcaaggagcaccgcgaggttgagatcaacgtgttactgccccagatcgccgtaaacctctccaactgccacgttgtgatcaacagccacgtctgcgactactccctggacaccgacggacccgtgcgcctgccccggatccaccatgaaggcacgttcattccgggcacctacaaaatcgtgatcgacaaaaagaacaagctcaacgaccgctgcagcctggtcaccaactgcgttatcaagggtcgcgaggtaagaaagggccagtccgtcctgcggcaatacaagaccgaaatcaagattgggaaggcgagcacgggcagccgcaagctactgtccgaggagcctggggacgactgcatcagccggacccagctgctcaagaccgagaccgccgagatccacgacgacaactacggcgggcctggcgacaagatcacgatctgcaacggctccactatcgtggaccagcgcctggggagcgagctgggctgctacaccatcaaccgcgtaaagtccttcaaactttgcgagaactccgccacagggaagacgtgcgagatcgactctacacccgtgaagtgccggcagggcttctgcctgaagatcacccaggaggggaggggccatgtgaagctgagccggggctcggaggtcgtgttagatgcctgcgactcttcctgcgagatcatgatcccaaagggaaccggcgacatcctcgtggactgctccgggggacagcagcattttctgaaggacaacctgatcgacctcggctgtccccacatccccctgctggggaagatggccatccacatttgtcgcatgtcgaaccacccccggacgaccatggcgttcctcttttggttcagttttggctacgtcatcacgtgcatcttctgtaaggcactgttttattcactgatcattatcgggaccctcggcaagaagatcaagcagtaccgcgagctgaaaccgcagacctgcacgatttgcgagaccgcccccgtgaacgcaatcgacgccgagatgcacgacctgaactgcagctataacatctgcccctactgcgcgagccggctgactagcgacgggctggcccgccacgtgacccagtgccccaagcggaaggagaaggtcgaggagacagagctctacctcaacctggaacgcatcccgtggatcgtgcggaagctgctccaggtgtcagaaagtaccggtgtagccctgaagcgcagctcctggctgatcgtgcttctcgtgctgctaaccgtaagcctgtcacccgtgcagagcgcccccgtgggccatgggaagaccatagagacgtaccagactcgggagggcttcaccaatatatgtctgttcatgctcggctccatcctgttcatcgtcagttaccttgtaaagggtctcgtggactccgtcagcgattccttcttcccggggctcagcgtgtgcaagacctgctccatcggcagcatcaacggcttcgagatcgagtcccacaagtgttactgcagcctgttctgctgcccctactgccgccattgctccgcggaccgagagatccaccagctccacctggggatctgcaagaagcgcaagacgggcagcaatgtgatgctggcggtctgcaagcggatgtgcttcaaggccaccatcgaggcctcccggcgggccctcctgattcgttccatcatcaacaccaccttcgttatctgcattcttacgttggcgatctgcgtggtctcgacctctgccgtggagatggagaacctgcccgcagggacctgggagcgagaggaggacctgaccaacttctgccaccaggagtgtcaggtgacggagaccgaatgcctctgcccctacgaggccctggtcctgaggaagcctctgttcctggacagtatcgtgaagggcaccaagaacctgctcaactccaccagcctggagacgtccctgagcatcgaggccccctggggcgcgatcaatgtacagtctaccttcaagcccaccgtaagcaccgccaacattgccctctcctggagctcagtggagcacaggggcaacaaaatcctggtgacgggccggagcgagtccatcatgaagctggaggaacgcaccggggtctcttgggacctcggggtggaagatgcctctgaaagcaagctgctgaccgtatccatcatggatctcagccaaatgtactccccggtcttcgagtatctgagcggggaccgccaggtggaggagtggccgaaggcgacctgcacgggcgactgccccgagcgctgcgggtgcacctcctccacgtgcctacacaaggagtggcctcacagcaggaactggagatgcaaccctacctggtgctggggcgtgggcaccgggtgcacgtgctgcggcgtagacgtgaaggacctcttcaccgaccacatgttcatcaagtggaaggtggagtacatcaagacagaggccatcgtctgtgtggagctgacctcccaggagcgtcagtgcagcctgatagaagccgggacgcgcttcaacctcggcccggtgacaatcacactttccgagccgcggaacatccagcagaagctgcctcccgagatcatcaccctccacccgaaaatcgaagagggcttctttgacttaatgcacgtccagaaggttctgagtgcctccacggtgtgcaagctccaaagctgcacccacgggatccccggcgacctgcagatctaccacatcggtaacctgctcaagggcgaccgcctaaacgggcacctgatccacaagatcgagccacactttaacacctcctggatgagctgggatgggtgcgacctcgactactactgcaacatgggcgactggccctcctgtacctacacgggggtcacccagcacaaccacgccgcgttcgtaaacctgctgaacatagagaccgactacaccaagacgtttcacttccacagcaagagggtcacagcccacggagacaccccgcagctcgatctgaaggcccgccctacctacggggccggagagatcactgtgctggtggaggtcgccgacatggagctccacaccaagaaggtggaggtctccgggctgaaattcgcaagcctggcctgcaccggctgctatgcgtgctccagcggcatctcctgtaaggtgcgcatccacgtcgacgagcccgacgagctcaccgtgcacgtcaagagctccgaccccgacgtagtggccgccagcacgtccctgatggcgcgcaagctggagttcggaacagacagcacattcaaagccttcagcgccatgccgaagacctccctttgcttctacatcgtcgagcgggaatactgtaaaagctgctccgaggacgacaccaagaagtgcgtggacaccaagctggagcagccccagtcaatcctgatcgagcacaagggcaccattatcgggaagcagaacgacacttgcacagccaaagcctcctgttggctcgagagcgtgaagtcctttttctacgggctgaagaacatgctggggtcagtctttggcaacttcttcgtcggcattctcctgttcctggcgcctttcgtgctgctcgtcctgttcttcatcttcgggtggaagatcctgttctgcttcaagtgctgccgccgcacccgcggcctcttcaagtaccggcatctaaaagacgacgaggagaccgggtatcgcaagatcatcgagcgcctgaactccaagaagggcaagaaccggctcctggacggcgagaggctggccgaccggaagatcgcagagctgttcagcacaaagacgcacatcgggtga

SEQ ID NO: 15340 - RNA, 5055 nt, synthetic construct
  misc_feature 1..5055: note = derived and/or modified CDS sequence (opt11) from CCHFV(C-68031)__DQ211629.1__GP
  source 1..5055: mol_type = other RNA
atgtacacgcccctgctctgcgccgtgctgtgcctgcagctgtggtccttagagggttcccacgggctgagtaacaagacccagcactctaacacctcgaccaccaaggccccggaagtctcccaggagttcggcctccccgtgtcgaccgtgtccacgatcaccagcgatccgccctccatcacctcagctgtctccgtgagcggttccgagggcagcggtgacaccaacacgtcccccagcgtgaccacccagggcctgaccttgcccgagacgaccctcgagctgctgaccacaacggacaccgacgcctccagcaccgtcgtggttgacgtctccacccaaacggtaaaggacacccccataagcaccacccacacgagcctcccctccaccccgtccgcccccacgacgccccagggcacccaccacaccgcccgcgggctgctgtccgtcaccagcaccaagcccgagggcgcctccacgcaggcgaacccggagaagatcagtatggagaccaatagcccccggctcgccatctccgaaaccccctcgttcagccccaccacgcaggcgccgaccgagaactccaaccccatcactagcaagcagctgatcctgtccgcccaacccgtcacgcccaacccagtgaccccgcccgtgcagccagcgctgagccagtccgacacgagcaccgccatccaggacatccacccttcccccaccagccgcagcaagcggaacctggagatggagatcatcctgaccttaagccagggtctgaagaagtactacggtaagatcctgaagctccttgatctgacgctcgaagaggatactgagggactgctggagtggtgtaagcgcaacctcggcctggtgtgcgacgacgacttcttccagaagcggatcgaggagttctttctgaccggcgaggggcatttcaacgaggtgctccagttcaaaacacccagcacgctgtcccccaccggcccggcccgcacggggagcccgaccgtggagcccttcaagtcctatttcgccaagggcttcctgagcatggacagtgggtacttcagcgccaagtgctacccgagggcgtccaacagcgggctccagctgatcaacgtcacgcagcactccacccgcatcaccgacactccgggccccaaggtcacgaatctgaagaccatcaactgcatcaacctcaaggctagcgtcttcaaggagcaccgggagatcgagatcaacgtcctgctgccccaggtggccgtgaacctctccagctgccatgtcctgatcaagtcccatgtgtgcgattacagcctggatattgacggtcccgtccgcctcccccggatccaccacgagggcacatttatccccgggacctacaagctggtgatcgacaagaagaacaagcagaacgaccgatgcacgctgatcaccaactgcgtgatcaaaggtcgggagatccgcaagggccagtccgtcctccggcagtaccgtaccgagatcaagatcgggaaggcctcatccggcagccgccggctgctgagcgaggagtccggggacgactgcatcagccggacccaactgagcaggaccgagaccgccgagatacacagcgacaactacggcggtcccggcgacaaaatcacaatttgcaacggatcgacgatagtggaccagcgtctagggagcgagctgggctgttacacgatcaaccgagtgaagtcgttcaagctgtgcgagaacagcgcgaccgggaagtcctgcgagattgacagcaccccgattaaatgccgccagggcttctgcctcaaaatcactcaggaggggagaggccacgtcaagctgtcccgcggcagcgaagtcgtccttgacgcctgcgactccagctgcgagatcatgatccccaaggggacgggcgacatactcgtcgattgctccggcgggcagcagcacttcttgaaggacaacctgatcgacctagggtgccccaacatccccctgctgggcaagatggcaatctacatttgcaggatgagcaatcacccgaagaccaccatggccttcctcttttggttctctttcggatacgtcatcacgtgcatcctgtgcaaggtgatcttctacctgctcatcgtcgtggggaccctggggaagaagttcaagcagtaccgcgagctgaagccccagacctgcaccatctgcgagaccacccccgtgaatgccatcgacgccgagatgcatgacctaaactgcagctacaacatctgcccctattgcgcctcccgactgacgagcgatgggctggcccgccacgtcatgcagtgcccgaagcggaaggaaaaggtggaggagaccgagctctacctaaacttagagcgcatcccctgggtggtccggaaactcctccaggtgagcgagtccacaggcgtagccctgaaacgcagctcctggctcgtagtgctgctggtgttgctgaccgtatcgctgtccccagtgcagagcgcacccatcggccacggaaagacggtggagacctaccagacccgggagggctacacctccatctgcctcttcgtcctggggagcattttatttatcgtgtcctgcttaatgaaggggctagtggacagcgtcgggaactccttcttccctgggcttagcatatgcaagacgtgctccatcggcagcatcaacgggttcgagaccgaaagccacaagtgctactgtagcctcttttgctgcccctactgccgccactgctccgcggaccgtgagatccacaagctgcacctgagcatctgcaagaaacgaaaaaccggctccaacgtgatgctcgccgtatgcaagcggatgtgcttccgcgccaccgtcgaggtaagcaacaaggccctgctgatccggaacatcatcaacactaccttcgtggtctgcatcctcatcctggcagtgtgcgtggtcagcacttctgccgtggagatggagagtctgcccgccggaacctgggagagagaggaggacctcacgaacttctgccaccaggagtgccaggttaccgagacggagtgcctgtgcccctacgaggccctggtcctacggaaaccgctgttctccgatagcatcgtgaagggcatgaagaacctgctcaattctaccagcctggagacgtccctaagcatcgaggccccctggggagcgattaacgtgcagtccaccttcaagcccactgtcagcgccgccaacatcgccctctcctggagctccgtagagcaccgcgggaacaagatcctggtgagcggccgctccgagtcgatcatgaagctggaggagcggaccgggatctcctgggacctcggcgtcgaggatgccagcgagtccaagctactgacggtgagcatcatggacctcagccagatgtactccccggtgttcgagtacctgtccggggaccgccaggtcgaggagtggcccaaggcgacctgcaccggcgactgtcccgagagatgcgggtgcacctccagcacgtgcctgcacaaggagtggccccattctcgcaactggcggtgcaatccgacctggtgctggggcgtgggcaccgggtgcacgtgttgcggcctggacgtcaaggacctgttcaccgactacatgttcgtgaagtggaaggtggagtacatcaagactgaggccatcgtctgcgttgagctaaccagccaggagcgccagtgctccctcatcgaggccgggactcggtttaacctgggacccgtgaccatcaccctgagcgagccccgcaacatccagcagaagctgcccccggagatcgtcaccctgcatcccaggatcgaggagggcttcttcgatctgatgcacgtgaagaaagtgctttccgccagcaccgtgtgcaaacttcaatcttgcacccacggggtgcccggcgatctccaagtgtaccacatcggaaacctgctgaagggcgacaaggtcaacgggcacctgatccacaagatcgagccccacttcaacacgtcatggatgtcctgggacggctgcgacctcgactattactgcaacatgggcgactggccgtcgtgtagttacaccggcgtaacccaacacaaccacgccgcgttcgtgaacatgctgaacatcgagaccgattacacgaagatcttccacttccacagcaagcgcgtcaccgcccacggggacacgccccagctggacctcaaggcccggcccacctacggggccggagaaatcaccgtgctggtggaagtcgcggacatggagctacacaccaagaagatagagatctccggactcaagttcgccagcctgacctgcacgggatgttacgcctgctccagcggcatcagctgtaaggtgcgcatccacgtcgacgagcccgatgagctgacggtccacgtgaagtccgaggacccggacatcgtagccgcctcatcctcgctcatggcgcggaagctggagttcgggaccgactccacattcaaggccttcagcgccatgcctaagacctccctctgcttctacatcgtcgagagggagtattgcaagagctgctccaaggaggatacgcagaagtgcgtgaacaccaagctagagcagccccagagcatactgatcgagcacaagggcaccattatcgggaagcagaatgacacgtgcacctccaaggcaggttgctggctggagagtgtgaagtccttcttctatgggctgaagaacatgctcagcggcatcttcgggaacgtcttcatcgggatcttcctgttcctggcccccttcatcctcctgatactgttcttcatgtttggctggcggatcttattctgcttcaagtgctgccggcggacccggggcctgttcaagtaccggcacctgaaagacgacgaggaaacgggctaccgcaagatcatcgagcggctcaacaacaagaagggcaagaacaagctgctggacggggagcgcctcgcggaccgaaagatcgccgagctgttttccacgaagacgcacatcgggtaa

SEQ ID NO: 15341 - RNA, 5052 nt, synthetic construct
  misc_feature 1..5052: note = derived and/or modified CDS sequence (opt11) from CCHFV(K340_6)__KX013475.1__GP
  source 1..5052: mol_type = other RNA
atgcacacgctacttgtctgcttcatcctttatctccaactaagcggactaggaggcgcccacgttcaaagcaacgccactgaacacaacggaaccaatacaaccacggcaccgggcacctctcagtcccctaaacctccagcgtccacgacactaccacacaccccggagtcgtctacagtaaaaccaaccaccccaacctccgagacagaaggctctggcgaaacaaccccaccacccaacacaacccaagggcttcctcccacaggaaccacccccgaacgctcagccactaccgctaccagcaccagcagtacagacaatatgaactctaccacgcaagtaacagactccacccccacctccactgtgtcaacctccccctcgtccagtagctccatgcccagcacaagtcaaggcatacaccaccccgtccgctctctacttagcgtatcttcacccaaaacagtaacaacgcccaccccaatgtccccaggtgaaatgtcccccgaaacatcatcccagcactccgccatgtcccgcgtacccactctatacactgcaactcaagtctccacagaaaacacagatagatcaactccacgccaatcagaatcgagtgtccaacccgccacacaatccccaattaccagcccggcacagaccatattacttatgagcgccgcccccaaggcgatacaagacatgcacccctccccgaccaaccgatctaagagaaatctggaggtagagatcatccttacgctgtcacagggcttgaagaaatattacggcaaaatcctcaaacttctccacctcacactcgaggaagatacggaaggcctactcgaatggtgtaaacggaacctcggatccaactgcgacgatgactttttccagaaacgcatcgaggagttcttcattacgggcgaaggatatttcaacgaagtcctacaattcaaaaccctatccacgctttcaccaactgaaccctcccacgtgcgtctaccaacggcagaaccgtttaaaagttacttcgcgaaaggcttcctaagcattgactccggatatttcagcgccaaatgctacccacgctcctctacatccggtctacaactaataaacgtcacacaacaccccgcccgtatcgcagaaacccccggccccaagactacatccctcaagaccatcaactgcatcaacctccgtgcgagcgtcttcaaagaacaccgtgaggttgagatcaacgtgctactaccacaaatcgccgtcaacctgagcaactgccacgttgtaatcaattcccacgtctgcgactactccctagacactgacgggcccgtaagactgccgcgcatccaccacgaaggcaccttcataccgggcacctacaaaatcgtcattgaccgaaagaacaagctcaatgaccgctgcagccttgtgaccaattgcgtcatcaagggacgagaagtccgaaagggccaaagcgtcctccgccaatacaagactgagataaaaattggcaaagcctcaaccgggtctcgaaaactactaagtgaggaaccaggcgacgattgcatcagccgcacacagttacttaaaacggaaactgcagaaatccatgacgacaattacggaggacccggagataaaataacaatatgcaacggtagcactatagtagatcaacggctgggctccgaactaggctgctacacgataaatcgcgtcaaatcctttaaactctgcgagaacagcaccacaggaaagacctgcgaaatagactccacccctgttaaatgtaggcaaggattctgtctaaagataacccaagaaggtcgcggacacgttaagctatcccgcggctcagaagtcgtattagacgcctgcgatagctcctgcgaaataatgatccctaaaggcaccggagacatactggtcgattgcagcggaggccagcaacactttctcaaagataatctaatcgacctaggatgccctcacataccaccccttggtaagatggcaatctatatctgccgtatgtcaaaccacccccgtaccaccatggctttcttattctggttcagcttcggatacgtcataacatgcatattctgcaaagcgcttttctactcactcataataatcggcactctcggaaagaaaatcaagcaataccgggagctgaaaccccagacatgcaccatctgtgaaacagcacctgtaaacgccatcgacgctgaaatgcatgatctaaactgcagctacaacatctgcccctactgcgctagccgcctcacatctgacggcctcgcccgtcatgtaacccaatgtcccaaacggaaagagaaagtcgaagaaacagaactctacttaaacctcgaacgcatcccatggatagtccgaaaactactccaagtctcagaaagcaccggcgtagcactaaagcgttcttcctggctcatcgtcctgctggtgcttcttacggtttcactatctccggtccaaagcgcgcccgtcggccacgggaaaacgatcgaaacctaccaaacacgcgaaggattcacctctatctgtcttttcatgctaggctccattctcttcatcgtaagctgcctcgtcaaaggccttgtcgactcagtctctgattccttcttccctggtctgtcggtgtgcaagacctgttcgatcggctcaattaacggcttcgagatagaaagccacaaatgctactgctccctgttctgctgcccatactgccgacactgcagcgccgatagagaaatccatcaactgcatttatcaatttgcaagaaacgcaaaaccggtagcaacgtaatgctcgcggtatgcaaacgcatgtgctttaaagccaccatcgaggcttcacgccgcgcactcctcatccgttccatcattaacactacatttgtaatgtgcatattaaccctagccatttgcgtcgtcagcacatctgcagtcgaaatggaggaccttcccgcaggaacctgggaacgcgaggaagacctgaccaatttctgccaccaggagtgccaagtaactgaaaccgaatgtctctgtccgtacgaagcgctagtcctacgaaaaccactttcacttgatagcattgtaaaaggtatgaaaaacttactcaatagcacgagcctagagacatcgctctccatcgaggcaccatggggtgcaataaacgtacaaagcaccttcaaacccaccgtctctaccgcaaacatcgcactctcatggtcttcagtagagcaccgcgggaacaaaatccttgtaacaggacgaagcgaatctatcatgaaactcgaagaacgaactggagtatcctgggacctaggcgtcgaggacgcctctgaatccaaactattaaccgtaagcatcatggacctctctcagatgtattccccagtctttgaatacctctctggcgaccgccaagttgaagagtggcccaaagccacatgtacgggcgactgccccgagcgatgtgggtgcacatcttcaacctgcctacacaaggaatggccccactcgcggaactggcggtgcaacccaacttggtgctggggcgtcggaacgggatgtacctgctgcggtgttgacgtaaaagacctcttcactgaccacatgttcatcaagtggaaagtcgaatatatcaaaacagaagccatcgtatgcgtggagctcacgtcccaggagcggcaatgctccctaatcgaggctggtacgagattcaacctcgggcccgtaaccataaccttatcagaacctagaaacatacaacaaaagttaccaccggaaatcattactctccatcccaaaatcgaagaggggtttttcgacctcatgcacgtccagaaggtactctctgcatccaccgtctgcaaactccagtcttgcacccatggcatacctggggatctccaaatatatcacatcggcaacctactcaaaggcgatcgcgtaaacggccacttaatacacaagatcgaacctcacttcaacacatcttggatgagctgggacggatgcgacctggactactactgcaacatgggtgactggccatcgtgcacttataccggtgtcacacagcacaaccacgccgccttcgttaaccttttaaacatcgagacggactataccaagacattccattttcacagcaaacgggtcaccgcacatggcgacacaccccaattagatctaaaggcacgccccacctatggcgccggagagataaccgtactggtcgaggtcacagacatggaactccacaccaagaaagtagaaatctctggtctcaaatttgccagtcttacctgtaccggatgctacgcctgctcctccggcatctcttgtaaagtccgtatacacgtcgacgagcccgacgaactgacagtccacgtaaagagcagcgacccagacgtggtcgctgccagcacctcactcatggcgcgcaaactcgagttcggaaccgactccaccttcaaggcattctcagccatgcccaaaacatcactctgcttctacatagtcgaaagagaatattgcaaatcctgtagtgaagacgacaccaagaaatgcgtcgataccaaactcgaacaaccacagagtatcctcatcgaacacaaaggaacaataatcggcaaacagaacgatacctgcactgccaaggcctcatgttggctcgagagcgtgaaatcattcttctacgggcttaaaaatatgctaggaagtgtcttcggatccttcttcgtaggaatcctcctattcctagccccattcgtgctcctcgtcctcttctttatgttcggctggaaaatacttttctgcttcaaatgttgccgccgcaccagaggactcttcaaatacagacacttcaaggacgacgaggagaccggctacaggagaatcatcgaaagattgaactcgaagaaagggaaaaaccgtctgcttgacggagagcgacttgccgaccgcaaaattgccgagctgttctcaaccaaaacacacataggataa

SEQ ID NO: 15342 - RNA, 5055 nt, synthetic construct
  misc_feature 1..5055: note = derived and/or modified CDS sequence (opt11) from CCHFV(Hy13)__AY900145.1__GP
  source 1..5055: mol_type = other RNA
atgtacacgcccctgctctgcgccgtgctgtgcctacagttgtggagcctggaggggtcccacgggctgagcaacaagacccaacactccaacaccagcaccaccaaggccccggaggtgtcccaggagttcggcctccccgtgtcgaccgtgtccacgatcacgagtgacccgccctccatcaccagcgccgtctccgtgagcgggtccgaggggagcggggacaccaacacgtcccccagtgtgaccacccagggcctgaccctgcctgagacgaccctcgagctgctgacgaccacggacaccgacgcctccagcaccgtcgtggtggacgtatccacccagacggtgaaagacacccccatcagcaccacccacacgagcctcccctccaccccgagcgccaccaccacgccccagggcacccaccacacggcccgcgggctgctaagtgtgaccagcacgaagcccgagggcgcctccacccaggcaaaccccgagaagatcagcatggagaccaactccccgcggctcgctatcagcgagaccccctccttcagccccacgacccaggcccccaccgagaactcgaaccctatcaccagcaagcagctgatcttctccgcccagcccgtcacacccaaccccgtgaccccgcccgtgcagcccgcgctgagccagtccgacaccagcacagccatccaggacatccacccctccccgaccagccgctccaagcggaacctcgagatggagattatcctgacgctgagccaggggctcaagaagtactacggcaagatcctgaagctgctcgacctgacactggaggaggataccgaggggctcctggagtggtgtaagcgcaacctgggcctcgtttgcgacgccgacttcttccagaagcggatcgaggagttcttcctgaccggcgaggggcacttcaacgaggtgctacagttcaagacccccagcaccctctcccccaccggccccgcccgcaccgggtcaccgacggtggaacccttcaagtcctacttcgccaagggcttcctgagcatggactccggttactttagcgcaaagtgctacccccgggcctccaacagtggactgcagctcatcaacgtcacccagcactccacccgcatcaccgacacgccgggccctaaggttaccaacttgaagaccatcaactgtatcaacctgaaggccagcgtgttcaaggagcaccgggagatcgagataaatgtcctcctgccccaggttgccgtgaacctgtccagctgccacgtccttatcaagtcccacgtgtgtgactacagcctagacatcgacgggccagtccgcctgccgcggatccaccacgagggcaccttcatccccgggacgtacaagctcgtcatcgacaagaaaaacaagcagaacgaccgctgtaccctgatcaccaactgcgtgatcaagggccgggagatccgcaagggccaatctgtcctgcggcaataccgcaccgagatcaagatagggaaagccagctccgggagccggcgcctcctgagcgaggagtcgggggatgactgcatcagccggacgcagttatcccgcaccgagaccgcggagatccacagcgacaactacggagggcccggggacaagatcaccatctgcaacggctccacgatcgtggaccagcggctggggagcgagttggggtgctacaccatcaaccgcgtgaagtccttcaagctgtgcgagaactctgccaccgggaaaagctgcgagatcgacagcacccccatcaagtgccgccagggcttctgcctgaagatcacgcaggaggggcggggccacgtcaaactctcccgtgggagcgaggtcgtgctggacgcctgcgactccagctgcgagatcatgatccctaaggggaccggcgacatcctggtcgattgctccgggggccagcagcatttcctcaaggacaacctgatcgacctaggctgccccaacatccccctactggggaagatggccatctacatctgccgtatgagcaaccaccctaagaccaccatggccttcttgttctggttctccttcggctacgtgatcacatgtatcctctgcaaggtgatattctacctgctgatcgtagtgggtaccctcggcaagaagtttaagcagtaccgcgagctgaagccgcagacctgcaccatctgcgagaccacgcccgtgaacgcaatcgacgccgagatgcacgacctgaactgcagctacaacatctgcccctactgcgcctcccggctcacgagcgacgggctggcccgccacgtcatgcagtgccccaagcggaaggaaaaggtggaggagaccgagctgtacctcaacctggagcgcattccgtgggtggtccggaaacttctccaggtgagtgagtccaccggtgtggctctgaagcgcagctcctggttagtcgtgctcctggtactgctcacggtgagcctgagtcccgtgcagagcgcgcccatcggccacgggaagacagtggagacatatcaaacacgggagggctacacgtccatctgtctgtttgtcctcgggtccatactgttcatagtgtcctgcctgatgaagggtctcgtggacagcgtcgggaactccttcttccccggcagctccatctgcaagacctgctcgatcggctctatcaacgggttcgagatcgagagccacaaatgctactgctccctgttctgctgtccatattgccgccactgcagcgccgaccgggagatccacaagctgcacctctccatctgcaagaagcgcaagacgggcagcaacgtgatgcttgccgtgtgcaagcggatgtgcttcagagccaccgtcgaggtgagcaacaaagcgctgctcatccggaacatcatcaacacgaccttcgtggtctgcatactgatcctggcggtatgcgtggtctccaccagcgccgtggagatggagtccctcccggccgggacctgggagcgcgaggaggacctgacgaacttctgtcaccaggaatgccaggccacagagaccgagtgcctgtgcccttacgaggcgctcgtgctgcggaagccactgtttagcgacagtatcgtcaagggcatgaagaacctcctcaacagcacctcgctggagacctcgctctcaatcgaggccccatggggcgccataaatgtgcagagcaccttcaagcccaccgtttccgccgccaacatcgcgctgagctggtccagcgtcgagcaccgcgggaacaagatactggtatccggacgaagcgagtccatcatgaagctcgaggagagaaccgggatcagctgggacctcggtgtggaggacgcctccgagagcaagctgctcacggtgagcatcatggacctgtcccagatgtactcgcccgtgtttgagtacctgtccggggaccgccaggtggaggagtggcccaaagcgacctgtacaggcgactgccccgaacggtgcgggtgcacaagctccacgtgcctccacaaggagtggccccacagccgcaactggcggtgcaaccccacctggtgctggggcgtcgggaccgggtgcacgtgttgcggtctggacgtgaaggacctgttcacggaccatatgttcgtcaagtggaaggtggagtacattaagaccgaggccattgtgtgcgtcgagctcacctcccaggagcgccagtgcagcctgatcgaggccgggacccggtttaatctgggcccggtgacgatcacactcagcgagccccgcaacatccaacagaagctgccaccagagatcgtgaccctgcacccccggatcgaggagggcttctttgacctcatgcacgtcaagaaggtgctgagcgcatccaccgtgtgcaagctgcagagctgcacccacggggtacccggcgacctccaggtgtaccacatcgggaacctgttgaagggcgacaaggtgaacggccacctcatccacaagatcgagccccactttaacacgtcgtggatgagctgggacggctgcgacctggactactactgcaacatgggcgactggccctcctgctcgtacaccggagtcacccagcacaaccacgccgccttcgtgaacatgctgaacatcgagaccgactacacgaagatcttccacttccactccaagcgcgttaccgcccacggcgacaccccgcagctcgatcttaaggcgcggcccacctacggcgccggtgagataacggtcctcgtggaggtcgccgacatggagctccacaccaagaagatcgagatcagcgggttaaagttcgcctccctgacctgcaccggctgttacgcctgcagctccggcatcagctgcaaggtccgaatccacgttgacgaacccgacgagttaacggtgcacgtcaagagcgaggaccccgacatcgtggcggcctcgagctcgctgatggcccggaagctcgagttcgggaccgacagcaccttcaaggccttctccgcaatgccgaagaccagcctctgcttctacatcgtcgagcgcgagtactgcaagtcctgctccaaggaggacacgcagaagtgcgtcaacaccaagctggagcagccccaatccatcctgatcgagcacaagggcaccatcatcgggaagcagaacgacacgtgcaccagcaaagcgggctgctggctcgagtccgtcaagagcttcttctatgggctgaagaacatgctgtccggcattttcggcaacgtgttcatcgggatcttcctgttcctcgcccccttcatcctgctgatcctcttcttcatgttcggctggcggatcctgttctgtttcaaatgctgccgccggacccgcgggctgttcaagtatcggcacctcaaggacgacgaagagaccggctaccgcaagatcatcgagcggctgaacaacaagaagggcaaaaacaagctgctcgacggggagcgcctggcggaccgcaagatcgctgagctgttcagcaccaagacgcacatcggctga

SEQ ID NO: 15343 - RNA, 5052 nt, synthetic construct
  misc_feature 1..5052: note = derived and/or modified CDS sequence (opt11) from CCHFV(4574-ST-2008)__KR814870.1__GP
  source 1..5052: mol_type = other RNA
atgcacaccctgttagtgtgcttcatcctgtacctgcagctcctgggccccgggggcgcccacgggcagccgaacgccaccgagcacaaccgaacgaatactaccaccgcgccctcaacgtctcagagccccaagccgcccgtcagtaccgccccgccccacgcgctggagtcccccaccatcaagtctaccacgcctaccagcgagaccgagggcagtggggagaccacgagcccgcccaacaccacccagggaccctccctccccgagaccacgcctaagcggcctgccaccaccgccaccagcacgccctccaccgacaacactaactctaccacgcacgtgaccgacaacaaccccacgtccaccattagcacgtcccccagcagtagcccctctacgcccagcaccccgagaggcatccaccatcccgcgcggaacctgctgagcgtctccagccccaagaccgccacgacccccaccccgacttcacccggggagataagctccgaaacgagctccctccactcggctatgtcccgaaccagcactctgtacaccgccacccaggcgtccacggaaaatgccaaccactcggcgcctcgtcagtccgaaagcccggcccagccgactaccacctccctgatgacgtcgcccgcccagtccatcctcgtcatgagcgcggctcccaccgccatacagaacatccacccgtcccccaccaaccgctccaagcggaacctagagatggagatcatcctgaccctctcacagggccttaagaagtactacgggaagatcctcaagctcttgcacctgacgctcgaggaagacaccgagggtctgttagagtggtgcaaacgcaacctcggcagtaattgcgaggacgacttcttccagaagcggatcgaagagttcttcatgaccggcgagggctacttcaacgaagtgctgcagttcaagaccttatcgaccctctcccccacggagcccagccacgcgcgcccgcccaccgtcgagcccttcaaaagttacttcgcaaaagggttcctgagcatcgactctgggtacttcagcgcgaaatgctacccccggtcaagcacctcggggctgcagctcatcaacgtcacgcagcaccctgcccgcatcgccgagactcccggcccaaagaccacctcactaaagacgatcaactgcatcaacctgcgggcctcagtgttcaaggagcaccgcgaaatcgagatcaacgtgctcttaccccagatcgccgtaaacctgtcgaactgccatgtggtgatcaactcccacgtctgcgattactcgctcgacacagacggccctgtgcggctgccccacatctaccacgaggggacattcatccccgggacctacaagatcgtgatcgacaaaaagaacaagttgaatgaccgctgcacgctcgtcaccaactgcgtgatcaagggtcgggaggtgcgcaagggccagtccgtcctgcggcagtacaagaccgagatcaagatcgggaaggtgagcaccggcagccgcaaactgctctcagaggagagcggtgacgactgcatctccagaacgcagttactgcgcactgaaaccgcggagatccacgacgacaattacgggggccccggggacaagatcaccatatgcaacggcagcactatcgtggaccagcgcttgggttcagagctgggctgttatacgatcaaccgcgtcaagagcttcaagctgtgcgagaactccgccaccggaaaaacatgcgagatcgatagcacccccgtgaagtgtcgccaggggttctgcctcaagatcactcaggagggaagagggcacgtgaagctgtcccgcggctctgaggtagtgctggacgcatgtgactccagctgcgaggtcatgatccccaaggggaccggcgacatcctggtggactgttccggaggacagcagcacttcctaaaggacaatctgatcgatctgggctgcccccacatccccctcctcgggaagatggccatctacatctgccgtatgtccaatcacccgcgcaccaccatggccttcctgttctggttctccttcggttatgtgatcacgtgcctcttctgcaaggcgctgttctacagcctgatcattatcggcactctcggaaagaagatcaagcagtaccgggagctacgcccccagacctgcacgatatgtgagacggcccccgtcaacgccatcgacgccgaaatgcacgacctgaactgctcctacaacatatgcccctactgcgcgagccgtctcacatccgacggcctggcccgtcacgtgccgcagtgccctaagcggaaggagaaggtggaggagaccgagctgtacctcaacctggagcggatcccctggatcgtccggaagctgctccaggtgagcgagagcaccggagtagccctgaagcgctcctcttggcttatcgtgctgttagtgctgctcacggtgagtctgagcccagtccaatccgcccccgtgggccacgggaagaccatcgagacataccaaacgcgggagggcttcactagcatctgcctgttcatgctcggctctatcctgttcctggtgagctgcttagtcaagggtctggtggattcggtcagcgactccttcttccccggcctcagcgtctgcaagacctgctctattggtagcatcaacggctttgaaatcgagtcccacaaatgctactgcagcctgttgtgctgcccctactgcaggcattgctcggccgaccgggagatccaccagctgcacctcagcatctgcaaaaagcgcaagaccgggtccaacgtgatgctggcggtgtgcaaacggatgtgcttccgcgccaccatagaggcgagccgtcgggcactgctcatccgcagcatcatcaacacgaccttcgtaatttgcatactgaccctgaccatttgcgttgtatccaccagcgccgtcgagatggaaaatctcccctccggcacctgggagaaagaggaggatctcaccaacttctgccaccaggagtgccaagtgaccgagacggagtgcctgtgcccctacgaggcgctcgtgctccgtaagcccctattcctcgacagcatcgtcaagggcatgaaaaacctgctgaactccaccagcctcgaaacatccctgagcatcgaagccccctggggcgccatcaacgtgcagtccaccttcaagccgacggtgagtaccgccaacatcgccctatcctggtcgtccgtcgaacaccgcgggaacaagatcctcgtgacggggcggagcgagtcgatcatgaagctggaggagcgcaccggcgtgtcttgggacctgggggttgaggacgcgtctgagagcaagctcctgaccgtgtccatcatggacctgagccagatgtactcccccgtgttcgagtacctgtccggcgaccggcaggtcgaggagtggccgaaggcgacctgcaccggcgactgccccgagcggtgcgggtgcaccagctccacgtgcctgcacaaggagtggccgcacagccggaactggcgctgcaaccccacctggtgctggggcgtggggaccggctgcacgtgttgcggggtggacgtcaaagacctgttcaccgaccacatgttcgtgaagtggaaggttgaatacatcaagacggaggcgatcgtctgcgtggagctcacctcccaagagcggcagtgcagcttaatcgaggccggcacccgctttaacctgggcccggtgaccatcacgctgtccgaaccccggaacatccagcagaagctacctcccgagatcatcaccctgcaccccaaagtcgaagaggggttctttgacctcatgcatgtgcagaaggtactgagcgcttccaccgtctgcaagctgcagtcctgcacccacggcatccccggcgacctccaggtgtaccacattggcaaccttctgaagggtgaccgcgtgaacgggcacctcatccacaagatcgagccacattttaacacctcctggatgagctgggacggctgcgatctagattattactgcaacatgggtgactggccctcctgcacctacaccggagtcacccagcataaccacgccgcatttgtgaacctgctcaatatcgagacggattacaccaagaccttccacttccacagcaagcgggtgaccgcccacggggatacgccccagcttgacctgaaagcacgccccacctacggcgcaggcgagatcaccgtcctcgtggaggtagccgacatggagcttcacaccaagaaggtggagatctctgggctcaaattcgccagcctcgcctgcactggctgttacgcctgtagcagcgggatcagctgcaaggtccgaatccacgtggacgagccagacgagctgaccgtgcacgtgaaatcctctgaccccgacgtggtggcggcatccaccagcctgatggcccgcaaacttgagttcggcaccgactccacatttaaggccttcagcgccatgcccaagacctccctgtgcttctatattgtggagcgggaatattgcaagagctgctccgaggaggacacccaaaagtgcgtcgacaccaaactggagcagccccagagcatcctcatcgagcacaaggggacgattattggcaagcagaacgacacgtgtacagcaaaggccagctgctggcttgagtctgtgaagtcctttttctacggcctgaagaacatgctcggcagcgttttcggcaacttcttcatcgggattctgctattcctggcccccttcgtactcttagtgctgttcttcatgttcggctggaagatcctcttctgcttcaagtgctgccgcagggcccgcgggctgttgaagtaccgccatctcaaggacgacgaggaaacaggctacaggaagatcatcgagcggcttaacaacaagaaaggcaagaaccggctgcttgacggggagaggctcgccgaccgtaagatagccgagctgttctcaaccaaaactcacataggctga

SEQ ID NO: 15344 - RNA, 5052 nt, synthetic construct
  misc_feature 1..5052: note = derived and/or modified CDS sequence (opt11) from CCHFV(75-ST-2010)__KR814864.1__GP
  source 1..5052: mol_type = other RNA
atgcacaccctgctcgtgtgcttcatcctgtacctgcaactcctgggccccgggggcgcccacgggcagccgaacgccaccgagcacaaccgcacgaacaccaccaccgcgcccagcacgtcccagagccccaaacccccggtctccaccgccccgccccacgccctggagagccccaccatcaagtccaccacgcccaccagcgagaccgagggctccggggagaccacgcccccgcccaacactacccagggccccagcctccccgagacaacgcccgagcggcccgccaccaccgccacctctacgccgagcaccgacaacaccaactccaccacgcatgtgaccgacaacaacccaaccagcaccatctccacgagcccctccagctcccccagcacgccgtccacgccccgcggcatccaccaccccgcccggaacctgctgagcgtgagctcccccaagaccgccaccaccccgacacccaccagccccggggagatttccagcgagacgtccagcctccactccgccatgtcaaggacctccaccctgtacaccgccacccaggcgagcacggagaacgccaaccactccgcgccccgtcagagcgagtccccggcccagcccaccaccaccagcctgatgacgtcccccgcacagagcatcctcgtcatgtccgccgccccgaccgccattcagaacatccaccctagccccaccaaccgctccaagcggaacctggagatggagatcatcctgaccctcagccagggcctgaagaagtactacggaaagatcctgaagctcctgcacctgacgctggaggaggacactgagggcctgctggagtggtgcaagcgcaacctcgggtctaactgcgacgacgacttcttccagaagcggattgaggagttcttcatgaccggagagggctacttcaacgaggtgctgcagttcaagaccctgtccacgctcagccccaccgagccatcccacgcccgcccgcccaccgtggagcccttcaagagctacttcgccaaggggttcctgtccatcgacagcggctacttttccgccaagtgctacccccggagctccaccagcgggctgcagctcatcaacgtcacgcagcaccccgcccgcatcgccgaaacccccggccccaaaaccacctctctgaagacgatcaactgcatcaacctgcgtgccagcgtgttcaaggagcaccgcgagattgagatcaacgttctcctgccgcagatcgccgtcaacctgtccaactgccacgtcgtgatcaacagccacgtctgcgactactccctcgacaccgacggccccgtgcggctgccgcacatctaccacgaggggaccttcatccccggcacctacaagatcgtgatcgacaagaagaacaagctgaacgaccgctgtacgcttgtcaccaactgcgtgatcaaggggcgggaagttcgcaagggccagagcgtcctgcggcagtacaagaccgagatcaagatcgggaaggtgtccaccggcagccgcaagctgctcagcgaggagtccggcgacgattgcatctcacggacgcagctgctgcgcacggagaccgcggagatccacgacgacaactacgggggcccgggggacaagatcaccatctgcaacggctccacgatcgtggaccagcgcctcgggagcgagctgggctgctacaccatcaaccgggtcaagtccttcaaactgtgcgaaaacagcgccaccggcaagacctgcgagatcgactccacgcccgtgaagtgtcgccaggggttctgcctcaagataacccaggagggccgggggcacgtgaagctgagccgcggctccgaggtcgtgctggacgcctgcgacagctcctgcgaggtcatgatccccaaagggaccggcgacatcctggtggactgcagcggcgggcagcagcacttcctcaaggataacctgatcgacctgggctgcccccacatacccctcctggggaagatggccatctacatctgccggatgtccaaccacccccgcaccaccatggccttcctgttctggttcagcttcggctacgtgatcacgtgcctcttctgcaaggcgctgttctactccctgatcatcatcgggaccctcgggaagaaaatcaagcagtaccgggagctgcgcccccagacctgcacaatctgcgagacggcccccgtcaacgccatcgacgccgagatgcacgacctgaactgcagctacaacatctgcccgtactgcgcgtcccggctcaccagcgacggactggcccgccatgtgccgcagtgccccaagcggaaggagaaggtggaggagaccgagctgtacctcaacctggagcgcatcccgtggattgtccggaagctgctccaggtgtccgagagcaccggggtggccttgaagcgcagctcctggctgatcgtcctcctggtactgctcacggtgagcctgtcccccgtccagagcgcccccgtgggccacgggaagaccatcgagacctaccagacccgggagggcttcacgtccatctgcctgttcatgctcggcagcatcctgttcctggtgtcctgcctcgtcaaggggctggtggacagcgtgtcggacagcttctttcccggcctgtccgtctgcaagacctgtagcatcgggtccatcaacggcttcgagatcgagagccacaagtgctactgctccctcctgtgctgcccgtactgccgccactgctcagccgaccgggagatccaccagctgcacctctccatctgcaagaagcgcaagaccgggagcaacgtgatgctggcggtgtgcaagcggatgtgcttccgcgccaccatcgaggcctcccgccgggccctgctcatccgaagcatcatcaacacgaccttcgtcatctgtatcctgaccctgaccatctgcgtggtgagcacctccgccgtcgagatggagaacctcccgagcggcacctgggagaaggaggaggacctgaccaacttctgccaccaggagtgccaggtgaccgagaccgagtgcctgtgcccctacgaggcgctcgtgctgcggaagcccctgttcctcgactccatcgtcaaaggcatgaagaacctgctgaacagcacctccctcgagaccagtctgtccatcgaggccccgtggggcgcaatcaacgtgcagagcaccttcaagcccacggtgtccaccgccaacattgccctgagctggagtagcgtcgagcaccgcgggaacaagatcttggtgacggggcggtccgagagcatcatgaagctggaggagcgcaccggcgtgtcctgggacttgggggtcgaggacgctagtgagtccaagctcctgacggtgagcatcatggacctgtcccagatgtacagccccgtgttcgagtacctcagcggcgaccggcaggtcgaggagtggccaaaggcgacctgcaccggcgactgcccggagcgctgcgggtgcacctccagcacgtgcctgcacaaggagtggccccactcccggaactggcgctgcaaccccacctggtgctggggcgtggggaccggctgcacgtgctgcggggtggatgtcaaggacctgtttaccgaccacatgttcgtgaagtggaaggtggaatacatcaagaccgaggccatcgtctgcgtggagctcacctcacaagagcggcagtgctcccttatcgaggccggcacccgcttcaacctgggccccgtgaccatcacgctcagcgagccgcggaacatccagcagaagctgccgcccgagatcatcaccctgcaccccaaggtcgaggaggggttcttcgacctcatgcacgtgcagaaggtgctgtccgccagcaccgtctgcaagctgcagagctgcacccacggcatccctggggacctccaggtgtaccacatcggcaacctgctgaagggcgaccgcgtgaacgggcacctcatccacaagatcgagccccacttcaacacgagctggatgagttgggacggctgcgacctggactactactgcaacatgggggactggcccagctgcacctacaccggcgtcacccagcacaaccacgccgccttcgtgaacctgctcaacatcgagacggactacaccaagaccttccacttccactccaagcgggtcaccgcacacggggacacgccccagctagacctgaaggcccgcccgacctacggcgcgggcgagatcaccgtgctcgtagaggtcgccgacatggagctgcacaccaagaaggtggagatcagcgggctgaagttcgcctccctcgcctgcacgggctgctacgcctgcagctccgggatcagctgcaaggtgcggatacacgtcgacgagcccgacgagctgaccgtgcacgtcaagtctagcgaccccgacgtcgtggcggccagcacctccctgatggcccgcaagctcgagtttggcaccgacagcacgttcaaggccttctccgccatgcccaagaccagcctgtgcttctacatcgttgagcgggagtactgcaagtcctgcagcgaggaggacacccagaagtgcgtcgacactaagctggagcagccgcagtccatcctcatcgagcacaaggggacgatcatcggcaagcagaacgacacgtgcaccgcgaaggccagctgctggttagagtccgtcaagagcttcttctacggcctgaagaacatgctcgggtccgtgttcggcaacttcttcatcgggatcctgctgttcttggcccccttcgtgctcctggtgctgttcttcatgttcggctggaagatactcttctgcttcaagtgctgccgccgggcccgcgggctgctgaagtaccgccacctcaaggacgacgaggagaccggctaccggaagatcatcgagcgcctgaacaacaagaagggcaagaaccggctgctcgacggggagcgcctggcggaccggaagatcgccgagctgttcagcaccaagacccacatcggctga

SEQ ID NO: 15345 - RNA, 5052 nt, synthetic construct
  misc_feature 1..5052: note = derived and/or modified CDS sequence (opt11) from CCHFV(37-R-2013)__KR814858.1__GP
  source 1..5052: mol_type = other RNA
atgcacaccctgctcgtgtgcttcatcctgtaccttcagctcctgggcctcgggggcgcccaccgccagagcaacgccaccgagcacaacgggacgaacaccacaacagcgccctccacgagccagtccccgaagccgcccgtcagcaccgcgccgccccacgcccccgagacctccaccatcaagcccacgacccccgccagcgagaccgagggctccggggagaccacgccccctcccaacaccacccagggccccagcccgcccgaggccacccccgagcggcccgccacgaccgtgacctccacccccagcacggacaacaccaactccaccacccacgccacggacaacaaccccaccagcaccatctccacctccccctccagctcccccagcacgccgtccacgccccagggtatccaccaccccgcccgcaacctcctgagcgtgagctcccccaagaccgccaccactccgacccccaccagccccggggacatttccagcgagacctccagcctgcactccgcgatgagccggacgcccaccctccataccgccacccaggcctccaccgagaacgccaaccacagcgccccgcgccaatccgagagctccgcgcagcagacgaccacctcgcccatgacctcccccgctcagccgatcctggttatgagcgccgcccccacggccatccagaacatccacccctcccccaccaaccggagcaagcgcaacctggagatggagatcatcctcaccctgtcccagggcttgaagaagtactacggtaagattctcaagctgctgcatctaaccctagaggaggacacggagggcctgctcgagtggtgcaagcggaacctggggagcaactgcgacgacgacttcttccagaagcgcatcgaggagttcttcatgaccggcgagggctacttcaacgaggttctgcaattcaagaccctcagcaccctgtccccgacggagcccagccacgcgagaccgcccaccgtggagcccttcaaatcctacttcgccaagggcttcctgagcattgactccggctacttcagcgccaagtgctacccccgcctcaccacctccgggctgcagctgatcaacgtcacgcagcaccccgcccggatcgccgagacccccgggccgaagaccaccagcctcaagacgatcaactgcatcaacctgcgcgcgtccgtgttcaaggagcaccgggagattgagatcaacgtgctgctcccccagatcgccgtcaacctgagcaactgccacgtggtgatcaactcccacgtctgcgactacagcctggacaccgacggcccggtgcgactcccccacatctaccacgaggggaccttcatcccgggtacctacaagatcgtgatcgacaagaagaacaagctgaacgaccggtgcacgctggtcaccaactgcgtgatcaaggggcgcgaggtgcggaagggccagtccgtcctccgccagtacaagactgagatcaagatcgggaaggccagcaccggctcccggaagctgctgagcgaggagcccggcgacgactgcatctcccgcacgcagctcctgcggaccgagaccgccgagatccacgacgacaactacgggggccccggggacaagatcaccatttgcaacggcagcacgatcgtggaccagcgcctggggagcgagctcggctgctacaccatcaaccgcgtgaagtccttcaagctgtgcgagaacagcgccaccggcaagacctgcgagatcgactccacgcccgtcaagtgccggcaggggttctgcctgaagatcacccaggagggtcgcgggcacgtgaaactcagccggggctccgaggtggttttagacgcgtgcgacaccagctgcgaggtgatgatcccgaaggggaccggcgacatcctggtcgactgctccggcgggcagcagcacttcctgaaagacaacctgatcgacctgggctgtccccacatccccctgctcgggaagatggcaatctacatctgccgcatgagcaaccacccccggaccacgatggccttcctgttctggttctccttcggctacgtgatcacgtgcattttctgcaaagccctgttctacagcctcattatcatcggcaccctggggaagaagatcaagcagtatcgtgagcttaagccgcagacctgcaccatctgcgagaccgcgcccgtgaacgccatcgacgccgagatgcacgacctcaactgctcctacaacatctgcccctactgcgccagccggctgacctccgacggtctggcccgccacgtcccgcagtgccccaagcggaaggagaaggtggaggagaccgagctctatctgaacctggagcgcatcccctggatcgtgcggaagctcctgcaggtcagcgagtccacgggggtggcgctgaagcgcagctcctggctcatcgtactgctggtcctcctgaccgtgagcctgagccccgtgcagagcgccccggtcggccacgggaagaccatcgagacctaccagacgcgggagggcttcaccagcgtgtgcctcttcatgctgggctccatccttttcctcgtgagctgcctggtcaaggggctggtggactccgtgtctgactccttcttccccggcctcagcgtctgcaagacctgttccatcgggagcatcaacggcttcgagatcgagtcccacaagtgctactgcagcctcttctgctgcccctactgccgccactgctccgccgaccgggagatccaccagctgcacctcagcatctgcaagaagcgcaagatggggtccaacgtgatgctggccgtgtgcaagcggatgtgcttccgcgccaccatcgaggcaagccggcgcgccctgctgatccgctccatcatcaacacgaccttcgtcatctgcatcctgaccttaaccatctgcgtggtgtcaacgtccgccgtggagatggagaacctccccagcgggacctgggagcgggaggaggacctgaccaacttctgccaccaggagtgccaggtgaccgagacggaatgcctatgcccgtacgaggccctcgtgttacgcaagccactgttcctcgactccatcgtaaagggcatgaagaacctgctgaatagcaccagcttggagacctccctgtctatcgaggccccctggggcgcgatcaacgtccagtccaccttcaagcccacggtgagcaccgccaacatcgccctgtcctggagctccgtggagcaccgggggaacaagatcctcgtgaccgggcgcagcgagtccatcatgaagctggaggagcggaccggcgtgagctgggacctgggggtcgacgacgcctccgagagcaagctcctgacggtgtccatcatggacctgagccagatgtactccccggtgttcgagtacctcagcggggaccgccaggtcgaggagtggcccaaagcgacctgcaccggcgactgccccgagcggtgcgggtgcacgtccagcacgtgcctgcacaaggaatggccccactcccgcaactggcggtgcaaccccacctggtgctggggcgtggggaccggctgcacctgttgcggggtagacgtcaaggacctgttcaccgaccacatgttcgttaagtggaaggtggagtacatcaagaccgaggccatcgtctgcgtggagctcaccagccaggagcgccagtgcagccttatcgaggccggtacccggttcaacctgggccccgtaacaatcacgctctccgagccccgcaacatccagcagaaacttcccccggagatcatcaccctacaccccaaggtcgaggaggggttcttcgacctcatgcacgtacagaaggtgctgagcgcctccaccgtctgcaagctgcagagctgcacccacggcatccccggggacctccaggtgtaccacatcggcaacctgctgaagggcgaccgggtgaacgggcacctcatccacaagatcgagccgcacttcaacacgtcctggatgagctgggacggctgcgacctggactactactgcaacatgggggactggccgtcctgcacctacaccggcgtcacccagcacaaccatgccgcgttcgtgaacctgctcaacatcgagacggactacaccaagaccttccacttccacagcaagcgcgtcaccgcccacggggacacaccccagctagacctgaaggcccggcccacctacggcgccggcgagatcaccgtgctcgtggaggtcgccgacatggagctgcacaccaagaaggtggagatctccgggctgaagttcgcgagcctcgcctgcacgggctgctacgcctgctccagcgggatctcctgcaaggtgcgcatccacgtcgacgagcccgacgagctgaccgtgcacgtcaaatctaacgacccggacgtggtggccgcctccaccagccttatggcgcggaaactcgagttcggcaccgactccacgttcaaggctttcagcgccatgcccaagaccagcctgtgcttctacatcgtggagcgcgaatactgcaagtcttgcagcgaggaggacacccagaagtgcgtcgacactaagctggagcaaccccagtccatcctcatcgagcacaaggggacgatcatcggcaaacagaacgtgacctgcaccgccaaggcgagctgctggctggagtccgtcaagagcttcttctacggcctgaagaacatgctcgggtccgtgttcggcaacttcttcatcgggatcctgctgttcctcgccccgttcgtgctgctggtgctgttcttcatgttcgggtggaagatcctcttttgcttcaagtgttgccggcgcacccgggggctgctgaagtaccgcctcctgaaggacgacgaggagacgggctaccgccggatcatcgagcgcctgaacaacaagaagggcaagaaccggctcctggacggggagcgcctggccgatcggaagatcgccgagctgttcagcaccaagacccacatcggctga

SEQ ID NO: 15346 - RNA, 5052 nt, synthetic construct
  misc_feature 1..5052: note = derived and/or modified CDS sequence (opt11) from CCHFV(Kashmanov)__DQ211631.1__GP
  source 1..5052: mol_type = other RNA
atgcacaccctgttggtgtgcttcatcctgtacctgcagctgctgggcctcggcggggcccacgggcagtcgaacgccaccgagcacaacgggaccaacacaaccaccgccccctccaccagccagtccccgaagcccttagtcagcaccgccccgccccacgccctggagtccagcacgatcaagcccaccacccccgcctccgagaccgaggggagcggcgagaccacgccgccgcccaacaccacccagggccccagcccgcccgagaccacccccgagcggcccgccaccaccgccaccagcaccccctccaccgacaacaccaacagcaccactcacgtgacggacaacaaccccacctccaccatcagcacctccccgagctccagcccctccacgccctccacgccccaagggatccaccacccggcccggaacctgctcagcgtgtccagccccaagaccgccaccacgcccacccccacctccccgggcgagatcagctctgaggccagctccctgcacagcgcgatgtcccgcaccagcacgctgtacaccgccacccaggtctccaccgagaacgccaatcatagcgcgccccggcagtccgagagctccgcccagcccaccacgaccagcccgatgacctcccccgcgcagagcatcctcgtcatgtccgccgcccccatagccatccagaacatccaccccagcccgaccaaccgcagcaagcggaatctggagatggagatcatactgacgctctcgcaggggctgaagaagtactacggcaagatcctgaagctcctccacctgaccctcgaggaggacacagaggggctgctggagtggtgtaagcgcaacctcggctcgaactgcgacgacgacttcttccagaagcggatcgaggagttcttcatgaccggcgaggggtacttcaacgaggtgctgcagttcaagacgctgtccaccctcagccccaccgagccctcccacgccggcccgcccaccgtcgaacccttcaagagctacttcgcgaaggggttcctgtccatcgacagcggctacttctccgccaagtgctacccccgcagctccacgagcggccttcagctcatcaacgtgacccagcaccccgcccggatcgccgagaccccagggcccaagaccacgtccctgaagaccatcaactgcattaacctgcgcgcctccgtgttcaaggagcaccgggaaatcgagatcaacgtcctcctgccccagatcgcggtgaacctgtccaactgccacgtggtcatcaacagccacgtgtgcgactactccctcgacaccgacggccccgtgcgcctgccgcacatctaccacgaagggaccttcatccccggcacgtacaagattgtcatcgacaagaagaacaagctgaacgaccggtgcaccctcgtgaccaactgcgtgatcaaagggcgcgaagttcggaagggccagagcgtgctgcgccagtacaagaccgagatcaagatcggaaaggcgagcacggggtcccggaagctgctcagcgaggagcccggggacgactgcatctcccgcacccagctgctgcggaccgagaccgccgagatccacgacgacaactacgggggccccggggacaagatcacgatctgcaacggcagcaccatcgtggaccagcgcctcggctccgagttagggtgctacaccatcaaccgggtcaagagcttcaagctgtgcgagaactccgccaccggcaagacatgcgagatcgacagcaccccggtgaagtgccgccagggattctgcctcaagatcactcaagaggggcgcgggcacgtgaaactgtcccggggcagcgaggtcgtgctggacgcctgcgactccagctgcgaggtcatgatccccaagggcaccggggacatcctggtggactgctccggcgggcagcagcactttctcaaggacaacctgatcgatctgggctgcccccacatccccctcctgggcaagatggcgatctacatctgccgcatgagcaaccacccgcggacgaccatggccttcctgttctggttctccttcgggtacgtgatcacgtgcatcttctgcaaggccctcttctacagcctgatcatcatcggcaccctggggaagaagatcaagcagtaccgcgagcttaagccccagacctgcacgatctgcgagaccgcccccgtcaacgcgatcgacgccgagatgcacgacctgaactgctcctacaacatctgcccctactgcgccagccggctgacctccgacggcctcgcccgtcacgtgccgcagtgccccaagcggaaggagaaggttgaggaaaccgagttatacctgaacctcgagcgcatcccctggatcgtccggaagctgctccaggtgagcgagagcacgggggtggccctcaagcgcagcagctggctgatcgtcctgctcgtgctgctgaccgtgtcgctcagccccgtccagtccgcgccagtgggccacgggaagaccatcgagacctaccagacgcgggaggggttcacgagcatctgcctgtttatgctgggctccatcctcttcctggtgagctgcctggtcaaggggctcgtggactccgtaagcgactccttcttccccggcctgagcgtctgcaagacctgcaccatcgggtccataaacggcttcgagatcgagagccacaagtgctactgctccctgttctgttgcccctattgccgccactgcagcgccgaccgggagatccaccagctccacctgtccatctgcaagaaacgcaagacgggaagcaacgtgatgctggctgtctgcaagcggatgtgcttccgcgccaccatcgaggcctcccggcgcgcgctcctgatccggagcatcatcaacaccaccttcgtcatctgcatcctgacgctcacgatctgcgttgtgagcacctccgccgtcgagatggagaacctgccgagcgggacctgggagagagaggaggacctgacgaacttttgccaccaggagtgccaggtgaccgagaccgagtgtctctgcccctacgaggccctggtgctgcgcaagcccctcttccttgactccatcgtcaagggcatgaagaacagcctgaactccaccagcctcgagacgtccctgagcatcgaggccccctggggcgccatcaacgtgcagtccaccttcaagccgaccgtgagcaccgcgaacatcgccctgtcctggagctccgtcgagcaccggggcaacaagatcctcgtgacggggcgcagcgagtccatcatgaagctggaggaacggaccggcgtgagctgggacctgggcgtcgaggacgcctccgagagcaagctcctgaccgtgtccatcatggacctgagccaaatgtacagccccgtgttcgagtacctctccggggaccgccaagtcgaggagtggcccaaggcgacctgcacgggcgactgcccagagcggtgcgggtgcaccagcagcacgtgcctgcacaaggaatggccgcacagccgcaactggcggtgcaaccccacctggtgttggggagtggggacggggtgcacgtgctgcggcgtggacgtcaaggacttattcaccgaccacatgttcgtgaagtggaaggtggagtacatcaagaccgaagcgatcgtctgcgtggagctcacctcccaggagcgccagtgcagcctgatcgaggccgggacgcggttcaacctgggccccgtcaccatcaccctctccgagccccgcaacatccagcagaagctgccgcccgagatcatcaccctgcaccccaaggtcgaggaggggttctttgacctcatgcacgtgcagaaggtgctgagcgcctccacggtctgtaagctgcagagctgcacccacggcatccccggcgacctccaggtgtaccacatcgggaacctgctgaagggcgaccggatcaacgggcacctcatccacaagatcgagccgcacttcaacacctcctggatgtcatgggacggctgtgacctggactactactgcaacatgggggactggccctcctgcacctacacgggcgtgacccagcacaaccacgccgccttcgtcaacctgctcaacatcgagaccgactacaccaagacgttccacttccacagcaagcgcgtgactgcgcatggcgacacgccccagctggacctgaaggctcggcccacctacggggccggcgagatcacggtcctcgtggaggtggccgacatggagctgcacaccaagaaggttgagatctccggactgaagttcgccagcctcgcgtgcaccggctgctacgcctgctccagcgggatctcctgcaaggtgcgcatccacgtggacgagccggacgagctgaccgtccacgtgaagtccagcgaccccgacgtggtcgccgcctccacgagcctgatggcccgaaagctcgagttcggcaccgactccaccttcaaggcgttcagcgccatgcccaagacctccctatgcttctacatcgtggagcgcgagtactgcaagagctgctccgaggaggacacgcagaagtgcgtcgacaccaagctggagcagccgcagagcatcctcatcgagcacaagggcaccatcatcgggaagcagaacgacacgtgcacggccaaggcctcctgctggctggagagcgtcaagtccttcttctacggcctgaagaacatgctcgggagcgttttcggcaacttcttcatcgggatcctgctgttcctcgcgccgttcgtgctgctggtcctgttcttcatgttcggctggaagatcctcttttgcttcaagtgctgccggcgcaccaggggcctgctgaagtaccgccacctcaaggacgacgaggagacggggtaccggcgcatcatcgagcgcctgaacaacaagaagggcaagaaccggctgctcgacggggagcgccttgctgatcggaagatcgccgagctgttctccaccaagacgcacatcggctga

SEQ ID NO: 15347 - RNA, 5052 nt, synthetic construct
  misc_feature 1..5052: note = derived and/or modified CDS sequence (opt11) from CCHFV(Haskovo-V46/13)__KR092379.1__GP
  source 1..5052: mol_type = other RNA
atgcacaccctgctggtgtgcttcatcctgtacctgcagctcctgggcctcggcggggcccacgggcagtccaacacgaccgagcacaacgggaccaacaacaccaccgcccccgggacctcccagtctccgaagccccacatgtccaccaccccgccccacgcgccggagagctccaccatcaagcctaccacccccaccagcgagaccgagggctccggcgagaccacgccgcccagcaacaccacccaggggcccagcccgcccgagaccaccagcgagcggcccgccaccaccgccatctccaccagctccaccgacaacatgaaccccaccagccagatgaccgacaacacgcccacctccaccgtcagcatctcccccagctccagccccagcaccccctccacgccccagggcatgcaccaccccgcccggagcctcctgagtgtgagctctccgaagaccgccaccacccccacgccgaccagccccgtggaggtcgggtccgagaccagctcccagcacagcgcgatgtccagcacccctacgccccacaccgccactcaggtgtccacggagaacaccaaccacagcacgccccgccaatccgagcccagcgctcagcagaccaccccgtcccccatgcccagcccggcccagtccacactgctcatgagcgcggcccccacggccgtgcagaacacccacccctcccccaccaaccggtccaagcgcaacctggagatggagatcatcctgaccctctcccagggcctgaagaagtactacgggaagatcctgaagctcctgcacctgaccctcgaagaggacaccgagggcctgctagagtggtgcaagcggaacctcggctccaactgcgacgatgatttcttccagaagcgcatcgaggagttcttcatgaccggggagggctacttcaacgaggtcctgcagttcaagaccctgagcacgctctccccgatggagcccagccacgccgagctgccaaccgcagagcccttcaagtcctacttcgcgaaggggttcctgagcatcgactccggctacttcagcgccaagtgctaccctaggtccagcacctccggcctccagctgatcaatgtgacgcagcaccccgcccgcatcgccgagacgcccgggcccaagaccaccagcctcaaggccatcaactgcatcaacctccgggcgtccgtgttcaaggagcaccgcgagatcgagatcaacgtcctgctgccgcagatcgccgtaaacctcagcaactgccacgtggtcattaactcccacgtgtgcgactacagcctggataccgacgggcccgtgcggctgccccacatctaccacgaggggacgttcatacccggcacctataagatcgtcatcgacaagaagaataagctcaacgacagatgcaccctggtgaccaactgcgtgatcaaggggcgggaggtccgcaagggccagagcgtgctgcggcagtacaagacggagatcaaaatcggcaaggcctccaccgggagccgcaagctcctgtccgaggagctgggcgacgactgcatcagccggacccagctcctgcgaacagagacggccgagatccacgacgacaactacgggggtccgggggacaagatcaccatctgcaacggctccaccatcgtggaccagcggctgggcagcgagctcgggtgctacaccatcaaccgcggcaagtccttcaagctgtgcgagaacagcgccacggggaagacctgcgagatcgactccacccccgtcaagtgccggcagggcttctgcctgaagatcacccaggaggggcgcggccacgtgaagctcagccgcggctccgaggtggtcctggacgcgtgcgacagctcctgcgaggtgatgatccccaaggggacgggcgacatcctggtcgactgcagcgggggccagcagcacttcctgaaggacaacctcatcgacctgggctgcccccacataccgctgctcggtaagatggccatctacatctgccggatgtccaaccacccccgcaccaccatggctttcctgttctggttcagcttcggttacgtgattacttgcatcttctgcaaggccctgttctactccctcatcatcatcgggaccctgggcaagaagatcaagcagtaccgggagctgaagccgcagacgtgcaccatctgcgagaccacccccgtgaacgccatcgacgcggagatgcacgacctcaactgtagctacaacatctgcccgtactgcgcctctcgcctgacgagcgacgggctggcccggcacgtcacccagtgccccaagcgcaaagaaaaggtggaggagaccgagctctacctgaacctggagcggatcccctggatcgtgcgcaaactcctgcaggtcagcgagtccacaggcgtggccctgaagcggagctcctggctcatcgtgctgctggtcctcctaccggtgagcctgtcccccgtgcagagtgcgcccgtcggccacgggaagacgatcgagacctaccagacccgcgagggcttcacctccatctgcctcttcatgctggggagcatcctgttcatcgtgtcctgcttagtgaagggcctggtcgacagcgtgggggactccttcttccccggcctgtcggtgtgcaagacgtgctccatcggcagcatcaacgggttcgagatcgagtcccacaagtgctactgcagcctcttctgctgcccgtactgccggcactgctccgccgatcgcgagattcaccaactgcacctgagtatctgcaagaagcggaagaccggctccaacgtcatgctcgccgtgtgcaagcgcatgtgcttccgggccaccatcgaggccagccgccgggcgctgctgatccgcagcatcatcaacaccacgttcgccatgtgcatcttaaccctgaccatctgcgtggtcagcaccagcgccgtggagatggagaacctgcctgccgggacgtgggagcgcgaggaggacctcaccaacttctgccaccaggagtgccaagtgaccgagaccgagtgcctgtgcccctatgaggccctggtcctccgcaagcccctgttccttgactccatcgtgaagggcatgaagaacctcctgaacagcacgtccctggagaccagcctctccatcgaggcaccgtggggcgcaatcaacgtgcagagcaccttcaagcccaccgtctccacggccaatatcgccctgagctggagcagcgtggagcaccgcggcaacaagatactggtgaccggccggtccgagagcatcatgaagctcgaggaacgcaccggggtctcctgggacttaggcgtggaagacgccagcgagtcaaagctgctaaccgtaagcatcatggacctgtcccagatgtacagccccgtcttcgagtacctgagcggggaccgccaggtggaggagtggcccaaagcgacgtgcaccggcgactgcccggagcgctgcgggtgcacctccagcacgtgcctccacaaggagtggccccactcccggaactggcgctgcaaccccacttggtgctggggcgtgggcaccgggtgcacgtgctgcggcgtcgacgtgaaggacctgttcaccgaccacatgttcgtgaagtggaaggtcgagtacatcaagaccgaggccatcgtgtgcgtggagctgacgagccaggagcggcagtgctccctcatcgaggccgggacccgcttcaacctgggccccgtcaccatcacactgagcgagcctcgcaacatccagcaaaagctgccgcccgagatcatcacgctgcaccccaagatcgaggaaggcttcttcgacctgatgcacgtgcagaaggtgctctccgccagcaccgtctgcaagctccagtcctgcacccacgggatcccgggcgacctccaggtgtaccacatcgggaacctcctgaagggcgaccgcgtaaacgggcacctgatccacaagatcgagccccacttcaacaccagctggatgtcctgggacggctgcgatctcgactactactgcaacatgggcgactggcccagctgcacgtacacgggggtcacccagcacaaccacgcggccttcgtgaacctgctgaatatcgagaccgactacacgaagaccttccacttccactccaagcgggtgaccgcccacggcgacacgccccagctcgacctgaaggcccgcccgacgtacggggcaggagagatcaccgtcctggtggaggtcgcggacatggagctccacaccaagaaggtggagatcagcgggctgaagttcgcctcgctgacctgcacgggctgctacgcctgcagctcaggcatcagctgcaaggtgcggatccacgtcgacgagcccgacgagctcactgtgcacgtgaagtccagcgaccccgacgtcgtggctgccggtaccagcctgatggcgcgcaagctggagttcggcaccgactccacgttcaaggccttcagcgccatgcccaagacctccctctgcttctacatcgtggagcgggagtactgcaagtcctgctccgaggatgacacccagaagtgcgttgacaccaagctggagcagccacagagcatcctgatcgagcacaaggggacgatcatcggcaagcagaacgacacgtgcaccgcccgcgcctcctgctggctcgagagcgtgaagtccttcttctacgggctgaagaacatgctgggcagcgtgttcggcaactttctcatcgggatcctgctgtttctcgcgcccttcgtcctgctggtgctgttcttcatgttcggctggaagatcctcttctgcttcaagtgctgccggcgcacccgggggctgttcaagtaccgccacctgaaggacgacgaggagacgggctaccggcgcatcatcgaacgcctcaactccaagaagggcaagaaccggctgctggacggggagcgcctcgccgaccggaagatcgcagagctgttcagcaccaagacccacatcggctga

SEQ ID NO: 15348 - RNA, 5052 nt, synthetic construct
  misc_feature 1..5052: note = derived and/or modified CDS sequence (opt11) from CCHFV(Min)__KX013481.1__GP
  source 1..5052: mol_type = other RNA
atgcacaccctgctggtgtgcttcatcctgtacttacaactcctgggcctcggcggggcccacgggcagagcaacgccaccgagcacaacgggaccaacaccaccactgccccctccacctcccagtccccgaagcccctcgtcagcaccgccccgccccacgccctagaatccagcaccatcaagcccaccaccccggcttccgagactgaaggaagcggcgagaccacgccccctcccaacacgacccagggccccagcccgcccgagaccacccccgagcgccccgccaccaccgcgaccagcaccccctccacggacaacaccaacagcaccacccacgtgacggataacaaccccacctccaccatcagcacctccccgagctccagcccctccaccccctctacgccccaggggatccaccacccggcccgaaacctgctcagcgtgtcctcgctgaagaccgccaccacgcccacccccacctcccccggcgagatcagctccgagaccagctccctgcacagcgccatgtcccgcacgagcaccctctacaccgcgacccaggtctccaccgagaacgccaaccacagcgccccgcgacagtccgagagctccgcccagcccacgaccaccagccccatgacatcccccgcccagagcatcctggtgatgtccgcggccccgatcgccatccagaacatccatcccagccccacgaaccgcagcaagcggaacctggagatggagatcatcctcaccctgtcccaggggctgaagaagtactacggcaagatcctcaaactcctgcacctcaccctggaggaggacaccgaggggctgctcgagtggtgcaagcgcaatctgggcagcaactgcgacgacgacttcttccagaagcggatcgaggagttcttcatgacgggcgaggggtacttcaatgaggtgctgcagttcaagaccctctccacgctgagcccgaccgagccctcccacgcccggccgcccacggtcgagccgttcaagagctattttgccaagggcttcctgagcatcgactcagggtacttctccgcgaagtgctacccccggagctccaccagcggcctccagctgatcaacgtgacccagcaccccgcccgcatcgccgagacccccggcccgaagacgacctccctgaagaccatcaactgcatcaacctccgggccagcgtgttcaaggagcaccgcgagattgagatcaacgtcctgctgccccagatcgccgtgaacctctccaactgtcacgtggtcatcaacagccacgtgtgcgattactccctggacaccgacgggcccgtgcggctgccccacatctaccatgagggcacgttcatcccggggacctacaaaatcgtcatcgacaagaagaacaagctcaacgaccgctgcaccctagtgactaactgcgtgatcaagggccgggaggtccgcaaggggcagagcgtgctgcggcagtacaagacggagatcaagatcggcaaggcgagcaccggctcccgcaagctcctgagcgaggagcccggggacgactgcatctcccggacccagctgctccgcaccgagacggccgagatccacgacgacaactacggcgggcccggcgacaagatcaccatctgcaacgggagcaccatcgtggaccagcggctgggctccgaactgggctgctacaccatcaaccgcgtcaagagcttcaagctctgcgagaactccgccacggggaagacttgcgagatcgacagcacccccgtgaagtgccgccagggcttctgcctgaagatcacccaggaggggcggggccacgtgaagctgtcccgcgggagcgaggtcgtcctggacgcctgcgactccagctgcgaggtcatgatccccaagggcacgggcgacatcctcgtggactgctccgggggccagcagcacttcctgaaggacaacctgatcgacctcggatgcccccacatccctctgctgggcaagatggccatctacatctgccggatgagcaaccacccccgcaccaccatggcgttcctcttctggttctcatttggctacgtgatcacgtgcatcttctgcaaggccctgttctacagcctgatcatcatagggaccctcggcaagaagatcaagcagtaccgggagctgaagccgcagacgtgcaccatatgcgagaccgcccccgtcaacgccatcgacgcggagatgcacgacctgaactgctcctacaacatctgcccctactgcgccagccgcctcacctccgacgggctggcccggcacgtgccccagtgcccgaagcgcaaggagaaggtggaggagacggagctgtacctcaacctggagaggatcccctggatagtccgcaagctgctccaggtgagcgaaagcaccggcgtggccctgaagcggtccagctggctgatcgtcctccttgtgctgctcaccgtgtccctgagccccgtccagtccgcgccggtggggcacggtaagacaatcgagacctaccagacccgcgagggcttcaccagcatctgcctgttcatgcttgggtccatcctgttcctggtgagctgcctcgtcaagggcctggtggattccgtgagcgactccttcttccccgggttgagcgtctgcaagacctgcacgatcggctccatcaacgggttcgagatcgagtcacacaagtgctactgctccctcttctgctgtccctactgccggcattgcagcgcggaccgcgagatccaccagctgcatctgtccatctgcaagaagcggaagaccggcagcaacgtgatgctcgccgtgtgcaagcgcatgtgcttccgggccaccatcgaggcctcccgccgggcactgctgatccgcagcatcatcaacaccacgttcgtcatctgcatcctcaccctgaccatctgcgtggtgagcacctccgcggtcgagatggagaacctgcccagcggcacgtgggagcgcgaggaggacctcaccaacttctgccaccaggagtgccaagtgaccgagaccgagtgcttatgcccgtacgaggccttggtgctccggaagcctctgttcctggactccatcgtcaaggggacgaagaacctcctgaacagcacctccttagagaccagcctctccatcgaggccccctggggcgccatcaacgtgcagagcaccttcaagcccacggtgtccaccgccaacatcgcgctgtcatggtccagcgtcgagcaccgcgggaacaagatcctggtgaccggccggtccgaaagcatcatgaagctcgaggaacgcacgggggtgtcctgggacctgggcgtcgaggacgccagcgagtccaagttactcacggtgagcatcatggacctgtcccagatgtacagcccggtgttcgagtatctgagcggcgaccggcaggtcgaggagtggcctaaggcgacctgcaccggggactgccccgagcgctgcggctgcacctccagcacgtgcctccacaaggagtggccccactcccggaactggcgctgcaacccgacgtggtgctggggcgtgggcaccgggtgcacgtgctgcggcgtggacgtaaaagacctgttcaccgaccacatgttcgtgaagtggaaggtggagtatatcaagacggaggccatcgtctgcgtggagctgaccagccaggagcggcagtgctccctcatcgaggcgggcacccgcttcaacctggggcccgtgaccatcacgctgtcagagccccggaacatccagcagaagctgccgcccgagatcatcaccctgcaccccaaggtcgaggagggcttcttcgacctgatgcacgttcagaaggtactctccgccagcaccgtctgcaagctgcagagttgcacccacgggatccccggcgacctccaggtgtaccacatcggcaacctcctgaagggggaccgcatcaacggccacctgatccacaagatcgagccccacttcaacacgagctggatgtcctgggacgggtgcgacctcgactactactgcaacatgggcgactggcccagctgcacctataccggggtgacccagcacaaccacgcagccttcgtcaacctgctgaacatcgagactgactacaccaagaccttccacttccactccaagcgggtgaccgcccacggcgacacgccccagctcgacctgaaggcgcgccccacctacggcgccggggagatcaccgtcctggtcgaggtggccgatatggagctccacaccaagaaggtcgagatcagcggtctgaagttcgcctccctggcctgcacggggtgctacgcgtgcagctccggcatcagctgcaaggtgcggatccacgtggacgagcccgacgagctcaccgtccacgtgaagtccagcgacccggacgtggtcgccgccagcacctccctgatggcccgcaagctggagttcgggaccgacagcacgttcaaggccttctccgcgatgcccaagaccagcctttgcttctacatcgtggaacgggagtactgcaagtcctgcagcgaggaggacacccagaagtgcgtggacaccaagctggagcagccccagtccatcctgatcgagcacaagggcacgatcatcggcaagcagaacgacacgtgcaccgccaaggccagctgctggctcgagtccgtcaagagcttcttctacgggctgaagaacatgctgggctccgtgttcgggaacttcttcatcggcatcctcctgttcctggcgcccttcgtgctgctcgtcctgttcttcatgttcggctggaagatcctgttttgcttcaagtgctgccgccgtacccgcggcctcctgaagtaccggcacctgaaggacgacgaggagacgggctaccgccgcatcatcgagcggctcaacaacaagaaggggaagaaccgcctgttggacggcgagcggctcgcggaccgcaagatcgccgagctgttcagcaccaagacccacattggatga

SEQ ID NO: 15349 - RNA, 5052 nt, synthetic construct
  misc_feature 1..5052: note = derived and/or modified CDS sequence (opt11) from CCHFV(Kosovo/9553/2001)__AY675511.1__GP
  source 1..5052: mol_type = other RNA
atgcacaccctgctcgtatgcttcatattatacctgcagctcctgggcctgggaggcgcgcacgggcagagtaacgccaccgagcacaacggcacgaacaccaccaccgcgcccggaacgtcccagagcccgaagcctcccgcatccaccacccccagccacgccccggagtccagcaccataaagctcacaacccccacttccgagaccgagggcagcggcgagaccaccccgcccacctccaccacgcaggggagcccgcccctggagaccacccccgagcgctccaccacgaccgccaccagcacctccggcacggacaacatgaacagcaccacccagatgaccgacaacacgcccaccctgaccgcctcaaccagcccgtccagctcccccagcacgcccagcacctcccaggggctccactaccccgtccggagcctgctgtcggtgagctccccgaagaccgtgaccactcccactcccatgagccccggtgaaatgtccagcgagaccagtagccagcacagtgcgatgagccgcaccccgacgccccacaccgccacccaagtctccacagagaacgccaaccggagcacctcccgccaaagcgagtcctcagcccagcccgcgacgcagtcccccgtgaccagcccggcccagagcattctcctgatgtccgccacccccaccacgatccaaaatatccaccccagccccaccaatcgctccaagcgcaacctcgagatggagatcatcctcaccctgagccaggggctgaagaagtactacggcaagatactcaagctgctgcacctcaccctggaggaggacacggagggcctgctcgagtggtgcaagcggaacctgggctccaactgcgacgacgacttcttccaaaagcgcatcgaggagttcttcattaccggcgaggggtacttcaacgaggtgctgcagttcaagaccctcagcaccccgtcccccacggagcccagccacgcccggctgccgaccgccgagcccttcaagtcctacttcgcgaagggcttcctgtccatcgactccggctactttagcgccaagtgctacccccgctccagcacctccgggctccagctgatcaacgtcacccagcaccccgccaggatcgccgagacgccgggccccaagatcactagcctgaagacaatcaactgcatcaacctccgcgcctccgtgttcaaggagcaccgggaggtggaaattaacgtcctgctgccccagatcgcggtgaatctcagcaactgccacgtggttatcaacagccacgtgtgcgactactcgctggacaccgacgggcccgtgcgcctgccgcggatctaccatgagggcacgttcatgcccgggacttacaagatcgtcatagaccgcaagaacaagctcaacgaccggtgcaccctggtgaccaactgcgtgatcaagggccgcgaggtccggaagggccagtccgtgctgcgccaatacaagacggagatcaaaatcgggaaggcccccaccggatcccggaagctcctgagcgaggagcccggagacgattgcatctcccgcacccagctgctccgcaccgagactgccgagatccacgacgacaactacggcgggccgggggacaagatcaccatttgcaacggcagcaccatcgtggaccagcggctggggtccgagctcggttgctacaccatcaaccgcgttaagtcattcaaactttgcgagaacagcgccacggggaagacatgcgagatcgacagcacccccgtgaagtgccggcaaggattctgcctgaagatcacgcaggaggggcgcggccacgtgaagctgtcccggggcagcgaagtcgtgctggacgcctgcgattccagctgcgaggtgatgatccccaaggggaccggcgacatcctcgtggactgcagcgggggccagcagcacttcctgaaggacaacctgatcgacttgggctgcccccacatcccgctgctggggaagatggcaatctacatcgcccgtatgtcgaaccaccccaagacgaccatggcgtttctcttctggttctccttaggctacgtgataacctgcatcctgtgcaaggccctcttctacagcttgatcatcatcgggacactgggcaagaagatcaagcagtaccgggagctcaagccccagacgtgcaccatctgcgagaccgcccccgtcaacgcgatcgacgccgagatgcacgacctgaactgctcctacaacatctgtccgtactgcgccagccgcctgactagcgatgggctcgctcggcacgtgaagcagtgccccaagcgcaaggagaaggtggaggagacggagctgtacctgaacctcgagaggatcccctgggtcgtgcgcaagctgttacaggtgtctgagagcaccggcgtagcgctcaagcggagcagctggctgattgtgctgctcgtgctgctgaccgtctccctcagccccgtgcagtccgctccggtgggccacgggaagacgatcgagacgtaccagacccgcgagggcttcaccagcatctgcctgttcatgctggggtccattctcttcatagtcagctgcctcgttaagggcctagtggactccgtcagcgactccttcttccccgggttgagcgtgtgcaagacatgcagcatcggcagcatcaacggcttcgagatcgagtcccacaagtgctactgcagcctgttttgctgcccctactgccggcactgctccgccgaccgcgagatccaccaactgcacctcagcatctgcaagaagcggaagacggggagcaacgtgatgctggccgtctgtaagcgcatgtgcttccgggccaccatcgaggcgtcccgccgcgcactgctcatccggagcatcatcaataccaccttcgtgatctgcatcttaactctgacgatctgcgtagcatccacctccgccgtggagatggagaccctcccggccgcgacgtgggagcgcgaggaggacctgaccaacttttgccaccaggagtgccaggtgcccgagaccgaatgcctgtgcccctacgaggccctcgtgctgaggaagcccctgttcctcgatagtatcgtcaaggggatgaagaacctgttaaacagcacctccctcgagacgagtctgtccatcgaggccccgtggggcgcaatcaacgtgcaatctacattcaagcccaccgtgtccaccgccaacatcgcgctgagctggagcagcgtcgagcaccgcgggaacaaaattctcgtgaccgggcgctccgagagcataatgaagctggaggaacgcaccggggtttcctgggacctgggcgtcgaggatgcgagcgagtccaagctcctgaccgtgagcatcatggacctgagccagatgtactcccccgtgtttgagtacctcagcggcgaccggcaggtcgaggagtggcccaaggcgacctgcacgggcgactgcccggagcgctgcgggtgcacctccagcacatgcctgcacaaggagtggccccactcccggaattggcgctgcaaccctacctggtgctggggcgtagggaccgggtgcacgtgctgcggcgttgacgtcaaggacctgttcaccgatcacatgtttgtgaagtggaaggtggagtacatcaagaccgaggccatcgtctgtgtggaactcaccagccaggagcggcagtgttccctgatcgaggccgggacgcgcttcaatttgggccccgtgaccatcaccctcagcgagccgcggaacatccagcagaagctgccgcccgagatcatcactctgcaccccaagatcgaggaggggttctttgacctcatgcacgttcagaaagtgctgagtgcctctacggtgtgcaagctccaaagttgcacccacggcatccccggtgacctccaggtctaccacatcgggaatctgctgaagggagaccgcgtaaacgggcacctcatccacaagattgagccccacttcaacacctcatggatgtcctgggacggctgcgacctcgactactactgcaacatgggggactggcccagctgcacctacacaggtgtcacccagcacaaccacgccgccttcgtcaacctgctcaacatagagaccgactacacgaagacgttccacttccacagtaagcgggtgaccgcccacggcgacacaccccagctggacctgaaggcgcgcccgacctacggggccggtgagatcacggtgctagtggaggtggccgacatggagctgcacaccaagaaggtcgagataagcgggctgaagttcgcctccctcgcctgcaccggctgctacgcttgcagctccgggatcagctgcaaggtgcggatccacgtcgatgagcccgacgaactgaccgttcacgtaaagagcagcgaccccgacgtggtcgccgccagcacgtccctgatggcccgcaaactcgagttcggcaccgacagcaccttcaaggccttctccgcgatgcccaagaccagcctgtgcttctacatagtggagaaggagtactgcaagtcctgcagcgaggacgacacgaagaagtgtgtggacaccaagctcgagcagccgcagtccatcctcatcgaacaccggggcaccatcatcgggaagcccaacgacacgtgccccgccaagacgagctgttggctggagtccgtcaagagctttttctacggcctgaagaacatgctcggttcagtgttcggcaacttcttcatcgggatcctgcttttcctggcccccttcttcctctggatgctgagcttcatgttcggctggaagatcctgttttgctttaagtgctgccgccggacccgcggcctcttcaagtaccgccacctgaaggacgacgaggagaccgggtacaggcgtatcatcgagcggctgaacaacaagaaaggcaagaaccgcttactggacggggagcggctggccgaccgcaagatcgcggaactcttctccacaaagacgcacatcggatga

SEQ ID NO: 15350 - RNA, 5052 nt, synthetic construct
  misc_feature 1..5052: note = derived and/or modified CDS sequence (opt11) from CCHFV(4495-ST-2008)__KR814869.1__GP
  source 1..5052: mol_type = other RNA
atgcacaccctgctcgtgtgcttcatcctgtacctgcagctcctgggccccggtggcgcacacgggcagccgaacgccaccgagcacaaccgcacgaacaccaccaccgcgcccagcacgtcccagagccccaagcccccggtctccacggcaccaccccacgccctggaaagccccaccatcaagtccaccaccccgaccagcgagaccgaggggtccggggagaccacgccaccgcccaataccacccagggccccagtccacccgagaccacgcccgagcggccggccaccaccgccacctccacgcccagcaccgacaacactaattccaccacgcacgtgaccgacaacaaccccaccagcaccatctccacgagcccctccagctccccgagcaccccctccacaccccgcggcatccaccaccccgcgcggaacctcctgagcgtgagctccccgaagacggccacgaccccgactcccaccagccccggtgagatctccagcgagacgtccagcctgcactccgccatgagccgcacctccaccctctacaccgccacccaggcgagcacggagaacgccaaccactccaccccgcggcagagcgagtcccctgcccagcccaccaccacgagcctgatgacctcaccggcccagagcatcctggtcatgtccgccgcgcccaccgccatccagaacattcaccccagccccaccaaccgctccaagcggaacctcgagatggagatcatcctgacgctgtcgcagggcctcaagaagtactacgggaagatcctgaagctgctccatctgaccctggaggaggacaccgagggcctcctggagtggtgcaagcgcaacctggggagcaactgcgacgacgacttcttccagaagcgcatcgaggagttcttcatgaccggcgagggctacttcaacgaggtgctccagttcaagacgctgtctacgctgagcccgaccgagccctcccacgccagaccacccaccgtggagccgttcaagagctacttcgccaaggggttcctctccatcgacagcggctacttctccgccaagtgctacccccggagctccacgagcgggctgcagctgatcaacgtcacccagcaccccgcgcgcatcgccgagacccccggcccgaagaccacgtccctcaagaccataaactgcatcaacctgcgggccagcgtgttcaaggagcaccgcgagatcgagatcaacgtgctgctcccccagatcgccgtcaacctgtccaactgccacgtggtgatcaacagccacgtctgcgactactccctggacaccgacggccccgtgcggctcccccatatctatcacgaggggaccttcatcccgggcacgtacaagatcgtgatcgacaaaaagaacaagctcaacgaccgctgcacccttgtcaccaactgcgtgatcaaggggcgggaggtgcggaaggggcagagcgtcctccggcagtacaagaccgagatcaagatcgggaaggtgtccacgggcagccgcaagctgctgagcgaggaatccggcgacgactgcatcagccggacccagctcctgcgcaccgagaccgccgagatccacgacgacaactatgggggccccggggacaagatcacgatctgcaacggctccaccatcgtggaccagcgcctggggagcgagctcggctgctacaccatcaaccgggtcaagtccttcaagctgtgcgagaacagcgcgaccggtaagacgtgcgagatcgactccacccccgtgaagtgccgacaggggttctgcctgaagatcacccaggagggccgggggcacgtgaagctcagccgcggctccgaggtcgtgctggacgcctgcgacagctcctgcgaggtcatgatccccaaggggaccggcgacatcctggtggactgcagcggcgggcaacaacacttcctgaaggacaacctcatcgacctgggctgcccgcacatccccctgctcgggaagatggccatctacatctgccggatgtccaaccacccccgcaccacgatggcctttctgttctggttcagcttcggctacgtgataacctgcctgttctgcaaggccctcttctactccctgatcatcatcggcaccctggggaagaagatcaagcagtaccgggagctccgcccccagacctgcacgatctgcgagaccgccccggtcaacgccatcgacgccgagatgcacgacctgaactgcagctacaacatctgcccctactgcgcctcccggctgaccagcgacggcctcgcgcgccacgttccccagtgcccgaagcggaaggagaaggtggaggagaccgagctgtacctgaacctcgagcgcatcccctggatcgtccggaagctgctacaggtgtccgagagcactggggtggccctcaagcgcagctcctggctgatcgtcctgctcgtgctgctgaccgtgagcctctcccccgtccagagcgcccccgtgggccacgggaagaccatcgagacctaccagacgcgggagggcttcaccagcatctgcctgttcatgttgggctcaatcctcttcctggtgtcctgcctggtcaaggggctcgtggactcggtgtccgacagctttttcccgggcctctccgtctgcaagacctgcagcatcgggtccatcaacggattcgagatcgagagccacaagtgctactgctccctgctctgctgcccctactgccgccactgcagcgccgaccgggagatccaccaactgcacttatccatctgcaagaagcgcaagaccgggtctaacgtgatgctcgccgtgtgcaagcggatgtgcttccgcgcgacgatcgaggcctcccgacgggccctgctgattcgcagcattatcaacaccaccttcgtcatctgcatcctcaccctgacgatctgcgtggtcagcacctccgccgtagagatggagaacctgcccagcggcacctgggagaaggaggaggatctcaccaacttctgccaccaggagtgccaggtgacggagaccgagtgcctgtgcccttacgaggccctggtgctccggaagccgctgttcctggactccatcgtcaagggcatgaagaacctcctgaacagcacctccctggagaccagcctctccattgaggcgccctggggagccataaacgtgcagagcacgttcaagcccaccgtgagcaccgccaacatcgccctgagctggtccagcgtcgagcaccgcggcaacaagatcctggtgaccgggcggtccgagagcatcatgaagctcgaggagcgcacgggcatctcctgggacctgggggtggaggacgccagcgagtccaagctgctcactgtcagtatcatggacctgtcccaaatgtacagccccgtgttcgagtacctgagcggcgaccgtcaggtggaggagtggcccaaggcgacctgcaccggcgactgccccgagaggtgcgggtgtacgtccagtacctgcctccacaaggagtggccccactcccggaactggcgctgcaacccgacctggtgctggggcgtcgggaccggctgtacctgctgcggggtggacgtaaaggacctgttcacggaccatatgttcgtcaagtggaaggtggagtacatcaagaccgaggccatcgtctgcgtcgagcttaccagccaggaacggcagtgctccctcatagaggccggcacccgcttcaacctaggcccggtgacgatcaccctgagcgagccccggaacatccagcagaagctaccgcccgagatcataaccctgcacccgaaggtggaggaggggttcttcgacctgatgcacgtccagaaggtgctctccgccagcaccgtgtgcaagctgcagtcctgcacgcacggcatccccggggacctgcaggtataccacatcggcaacctcctgaagggcgaccgcgtgaacgggcacctgatccacaagatcgagccgcacttcaacaccagctggatgtcctgggacggctgcgacctcgactattactgcaacatgggggactggccgagctgcacctacaccggcgtgactcagcacaatcacgcggccttcgtcaacctgctgaacatcgagaccgactacactaagaccttccacttccactccaagcgggtgaccgcccacggggacaccccgcagctagacctgaaggcccgccccacctacggcgccggcgagatcaccgtcctggtggaggtggcggacatggagctccacacgaagaaggtcgagatcagcgggctgaagttcgcctccctggcctgcaccggctgctacgcctgcagctccgggatcagctgcaaggttcgcatccacgtggacgagcccgacgagctcaccgtccacgtaaagtccagcgaccccgacgtggtcgccgcgtccacctccctgatggcccgcaagctggagttcggcacggacagcaccttcaaggccttctccgccatgccgaagaccagcctctgcttctacatcgtggagcgggagtactgcaagtcctgcagcgaggaggacacccagcgctgcgtggacacgaagctggagcagccccagtccatcctgatcgagcacaaggggaccatcatcggcaagcagaacgatacctgcaccgccaaggcgagctgctggctcgagtccgtcaagagcttcttctacggcctgaaaaacatgctggggtccgtgttcggtaacttcttcatcggcatcttgctgttcctggcccccttcgtgctgctcgtcctgttcttcatgttcggctggaagatcctcttctgcttcaagtgctgccggcgcgcccgcggactcctgaagtaccggcacctgaaggacgacgaggagacgggctaccgcaagatcatcgagcggttaaacaacaagaagggcaagaaccgcctgctggacggggagcggctcgccgaccgcaagatcgcggagctgttcagcactaaaacccacatcggctga

SEQ ID NO: 15351 - RNA, 5052 nt, synthetic construct
  misc_feature 1..5052: note = derived and/or modified CDS sequence (opt11) from CCHFV(Mamon)__KX013478.1__GP
  source 1..5052: mol_type = other RNA
atgcacaccctgctggtgtgctttatactgtacctgcaactgctgggcctcggcggggcccacgggcagagcaacaccaccgagcacaacgggaccaacaccactaccgccccttccaccagccagtccccgaagcccctcgtcagcacggcgccgccccacgccctggagtcctcaaccatcaagcccaccactcccgcctccgagaccgaagggagcggcgagaccacaccgccgcccaacattacccagggccccagcccgcccgagaccacccctgaacgccccgcaacaaccgccaccagcaccccctccactgacaacaccaacagcaccacccatgtgaccgacaacaaccccacctccacgatctccacctccccgagctccagcccctccacacccagcacgccacagggtatccaccacccggcccggaatctgctctcagtgtccagccccaagaccgccaccacgcctacccccacctccccgggcgagatctcatccaagaccagctcgcttcacagcgctatgtcccgaacgagcaccctgtacaccgccacacaggtctccacggaaaacgcgaaccacagcgcgccccggcagagcgagagctccgcgcaacccacaaccaccagcccgatgacctccccggcccagagcatcctcgtgatgtcggccgcgcctacggccatccagaacatccaccccagcccgaccaaccgcagcaaacgaaacctggagatggagatcatcctgaccctctcccaggggctgaagaagtactacggcaagatcctcaagctcctgcacctgaccctagaggaggacacggaagggctgctggagtggtgcaagcgtaacctcggcagcaactgtgacgacgacttcttccagaagcggatcgaggagttcttcatgaccggcgagggatactttaacgaagtgttacaattcaagaccctgtccaccctaagccccacggagccctcccacgcccggccgcccacggtcgagcccttcaagagctacttcgccaagggcttcctgtccatcgacagcgggtacttctccgccaagtgctacccccggagctccaccagtggcctgcagcttatcaacgtgacccaacaccccgcgcgcatagccgagacgcccggccccaagaccacctccctgaagacaatcaactgcatcaacctgcgggccagcgtgttcaaggagcaccgtgagattgagatcaacgtcctcctgccccagatcgccgtgaacctgtccaactgccacgtggtaatcaacagccacgtgtgcgactattccctcgacaccgatgggcccgtgcggctcccccacatctaccacgagggcacctttatacccggcacctacaagatcgtcatcgacaagaagaacaagctgaacgaccgctgcaccctcgtgacgaactgcgtgatcaagggccgggaggtccgcaaggggcagagcgtgctgcggcaatacaagaccgagatcaagatcggcaaggcgagcactggctcccgcaaactgctctctgaggagcccggggacgactgcatctcccggacccagctgctgcgcaccgagaccgcggagatccacgacgacaactacggcgggcccggagacaaaatcaccatctgcaacgggagcacaatcgtggaccagcggctcggctccgagctgggctgttacaccatcaaccgcgtcaagagtttcaagctgtgtgagaactccgcgaccgggaagacctgcgagatcgacagcaccccggtgaagtgcaggcagggcttctgcctcaagatcacgcaggaggggcggggccacgtgaagctgtcccgcgggagcgaagttgtgtccgacgcctgcgacagctcctgcgaagtcatgatccccaaggggaccggcgacatcctggtggactgcagcgggggccagcagcacttcctgaaggacaatctcatcgacctggggtgcccccacatcccgctgctcggcaagatggcaatctacatctgccggatgagcaaccacccgcgcaccaccgtggcgttcctgttttggttcagctttggctacgtcatcacgtgcatcttctgcaaagcgctgttctactccctcatcattatcgggactcttggcaagaagatcaaacagtatcgggagctgaagccccagacatgtaccatctgcgagaccgcccccgtgaacgccatcgacgccgagatgcacgacctcaactgctcatacaacatctgcccctactgtgcgtcccgcctgacgagcgacgggctggcccggcacgtgccgcagtgccccaagcgcaaggagaaggtcgaggagaccgaactctacctgaacctggagcggatcccctggatcgtgcgcaagctcttgcaagtgtctgagtccaccggcgtcgccctgaagcggagctcctggctcatcgtgctgctggtgctcctgaccgtcagcctgtccccagttcagagcgcccccgtggggcacggcaagacgattgagacctaccagacccgcgagggcttcacctcaatctgtctcttcatgcttgggagcatcctgttcctcgtctcctgcctggtgaagggcctggttgactcagtctccgacagcttcttccccgggttgtccgtgtgcaagacctgtagcatcggctccatcaatgggttcgagatcgagagccacaagtgctactgctcccttttctgttgcccctactgccggcactgcagcgcagaccgcgagatccaccagctgcacctctccatctgcaagaagcggaagaccggcagcaatgtgatgctggccgtctgcaagcgcatgtgcttccgggccaccatcgaggccagccgccgggccctgctcatccgctccatcatcaacaccacgttcgtgatctgtatcctgaccctgaccatctgcgtggtctctacctccgccgtggagatggagaacctcccgtcgggcacgtgggagcgcgaggaggacctgaccaacttctgccatcaggaatgccaggtgaccgagaccgagtgcttgtgcccctacgaggcgttagtcctgcggaagcccctgttcctcgactccatcgtgaaggggatgaagaaccttctgaacagcacgtccctcgaaaccagcctgtccatcgaggccccctggggcgcaatcaacgtgcagtcgaccttcaagccgacggtctccacggccaacatagccctgagctggtccagcgtggagcaccgcgggaacaagatcctcgtgaccggccggtccgagagcatcatgaagctcgaggaacgcaccggggtctcctgggacctgggcgtggaggacgcgtctgagtccaagctcctaaccgtaagcatcatggacctgagccaaatgtactcccccgtcttcgagtacctcagcggcgaccgccaggtggaggagtggccgaaggcgacgtgcaccggtgactgccccgagaggtgcggctgcacctcctcaacgtgcctgcataaggaatggccccactccagaaactggcgctgcaaccccacctggtgttggggcgtgggcacagggtgcacgtgctgcggcgtcgacgttaaggaccttttcaccgaccacatgtttgtgaagtggaaagtcgagtacatcaagaccgaggccatagtttgcgtggagctcacgagccaggagcggcagtgctccctgatcgaggccggcacccgcttcaacctggggcctgtcaccatcaccctcagcgagccccggaacatccagcagaagctgccgccggagatcatcacgctgcaccccaaggtggaggagggcttcttcgacctcatgcacgtgcagaaggtcctgtccgcgagcaccgtgtgcaagttacagtcctgcacccacgggatccccggcgacctccaagtgtaccacatcggcaatctgctgaagggggaccgcgtcaacggacacctcatccacaagatcgagccgcacttcaacaccagctggatgtcctgggacgggtgcgacctggactactactgcaacatgggagactggcccagctgcacgtacaccggggtgacccagcacaaccacgccgccttcgtcaacctgctcaacatcgagaccgactacacgaagacgttccacttccactccaagcgggtgaccgcccacggagacacgccccagttggacctgaaggcccgccccacgtacggcgcaggggagatcaccgtgctcgtcgaggtggccgacatggagctgcacacgaagaaggtggagatcagcggcctgaagttcgcctccctcgcctgcacagggtgttacgcctgcagctccggcatttcctgcaaggtccggatccacgttgacgagccggacgagctgacggttcacgtcaagagctccgaccccgatgttgtggcggccagcacctctctgatggcccgcaagctcgagttcgggacggacagcaccttcaaggccttctccgccatgcccaagacgagcctgtgcttctacatcgtcgagcgggagtactgcaagtcctgcagcgaggaggacacccagaagtgcgtggacaccaagttagagcagccccagtcaatcctcatcgagcacaagggaaccatcataggcaagcagaacgacacgtgcaccgcgaagacctcgtgctggctggagtccgtgaagtccttcttctacgggctgaagaacatgctcggctccgtcttcgggaactttttcatcggcattctgctgttcctcgccccgttcgtgctgctggtgcttttcttcatgttcgggtggaagatcctcttctgcttcaagtgctgtcgccggacccgcggtctgctgaagtatcggcacctcaaggacgacgaggagacgggttaccgcaggatcatcgagcggttgaacaacaagaaggggaagaaccgcctgctcgacggcgagcgcctggcagaccgcaagatcgccgagctgttcagcaccaagacccacatcgggtga

SEQ ID NO: 15352 - RNA, 5052 nt, synthetic construct
  misc_feature 1..5052: note = derived and/or modified CDS sequence (opt11) from CCHFV(81-R-2014)__KR814865.1__GP
  source 1..5052: mol_type = other RNA
atgcacaccctgctggtgtgcttcatcctgtacctgcagctcctgggcctcggcggagcccacgggcagtccaacgccaccgagcacaacggcaccaatacaaccaccgttccctccaccagccagtccccgaagcccctcgtgagcaccaccccgccccacgcgctggagtcgagcaccatcaagcccaccacccccacctccgagaccgaggggtctggcgagacggcgcccctgcccaacaccacccagggcccgccgccacccgagaccacgccggagcggcccgccaccactgtgacctccacgcccagcaccgacaacaccaactccaccatccacgtgacggacaacaacccaaccagcaccatctccaccagcccgtccagctcccccagcacgccctccacgccccaggggatccaccacccggcccggagcctcctatctgtgtccagccccaagaccgccaccacgcccacccccacctccccgggcgagatcaacagcgagacctccagcctgcactccgccatgagccgcacgcccaccctccacaccgctacccaggtgtccaccgagaacgccaaccacagcgcgccccggcagtccgagagctccgcccagcccacgaccacgagcttgatgacctccccggcccagagcatcctgctcatgtccgccgcccccacggccatccagaacacccaccccagcccgaccaaccgctccaagcggaacctggagatggagatcatcttgacccttagccaggggctgaagaagtactacggcaagatcctgaagctcctgcacctgacgctcgaggaggacacagaggggctgctcgagtggtgcaagaggaacctcggcagcaactgcgacgacgacttcttccagaaacggatcggcgagttcttcatgaccggggagggctacttcaacgaggtcctgcagttcaagaccctgtccacgctcagccccaccgagccgtcccacgcgcgcctgcccaccgtggagccgttcaagagctacttcgccaaggggttcctgtccatcgacagcggctacttctccgctaagtgctacccccggagctccaccagcggcctccagctgatcaacgtgacgcagcaccccgcccgcatcgccgagacccccgggccgaagaccacctccctgaagacgatcaactgcatcaacctccgtgcgagcgtcttcaaggagcaccgcgagatcgagatcaacgtgctgctgccccagatcgccgtgaacctctccaactgccacgtcgtgatcaacagccacgtgtgcgactactccctggacaccgacggccccgtccggctgccccacatctaccacgaggggaccttcatcccgggcacctacaagatcgtgatcgacaagaagaacaagctcaacgaccgctgcacgctcgtgaccaactgcgtcattaaggggcgggaggtgcgcaagggccagagcgtgctgcggcagtacaagacggagatcaagatcggcaaggcctccaccgggagccgaaagctcctgagcgaggagcccggcgacgattgcatcagtcggacgcagctcctccgcacagagaccgcggagatccacgacgacaattacgggggccccggggacaagatcaccatctgcaacggctcgacgatcgtcgaccagcggctggggtccgagctggggtgctacaccatcaaccgagtcaagagcttcaaactgtgcgagaactccgccactggcaagacctgcgagatcgacagcacgcccgtgaagtgccgccaggggttctgcctcaaaatcacccaggagggccgggggcacgtcaagctgtcccgcggcagcgaggtggtcctggacgcgtgcgacagtagctgcgaggtgatgatccccaagggcaccggggacatcctcgtggactgctccggcgggcagcagcacttcctgaaggacaacctgatcgacctcggctgcccccacatccccctgctgggcaagatggctatctacatctgccggatgagcaaccacccccgcaccacaatggccttcctcttctggttttccttcgggtacgtcatcacgtgcatcttctgcaaggccctgttctacagcctgatcatcatcggcaccctcgggaaaaagatcaagcagtaccgagagctgaagccgcagacctgcacgatctgcgagacggcccccgtgaacgcgatcgacgccgagatgcacgacctgaactgctcctacaacatctgcccctactgcgccagccgcctcacctccgacggcctggcccggcacgtgccccagtgtccgaagcgcaaggagaaggtcgaggagaccgagctgtacctcaacctggagcggatcccctggatcgtgcgcaagctgctccaggtgagcgagtccacgggggtcgcgctgaagcggagcagctggctgatcgtactcctggtgctgctcacggtctccctgagccccgtacagtccgccccggtgggccacggcaagaccatcgagacgtaccagaccagggaggggttcacgagcatctgcctgttcatgctcggttccatcctgttcctggtcagctgcctggtgaaggggctggtggactccgtcagcgacagcttcttccccggcctgagcgtgtgcaagacctgctccatcgggtctatcaacggcttcgaaatcgagtcccacaaatgctactgcagcctcttctgctgcccctactgccggcactgctccgccgaccgcgagatccaccagctccacctgagcatctgcaagaagcggaagaccggctccaacgtgatgctcgccgtctgcaagcgcatgtgcttccgagccaccatcgaggcgagccgccgggcactgctgatccgctccatcatcaacacgaccttcgtgatctgcatcctcaccctgaccatctgcgtggtcagcacgagcgccgtggagatggagaacctgcccgccgggacctgggagcgcgaggaggacctcaccaacttctgccaccaggagtgccaggtgaccgagacggagtgcctgtgcccgtacgaggccctggtcctccggaagcccctgttcctggactccatcgtgaagggcatgaagaacctcctgaacagcacctccctggagaccagcctctccatcgaggcgccctggggcgccatcaacgtgcagagcaccttcaagcccacggtatccaccgccaacatcgccctgagctggtccagcgtggagcaccgcgggaacaagatcctggtgaccgggcggtccgagagcatcatgaagctcgaggagcgcaccggggtctcctgggacctcggcgtggaggacgccagcgagtccaagctgctcacggtgtcaatcatggacctgtcccagatgtacagcccggtcttcgagtacctcagtggggaccgccaggtggaggagtggcccaaggcgacctgcaccggcgactgccccgagcgctgcgggtgcaccagcagcacgtgcctccataaggagtggccccactcccggaactggcgctgcaacccgacctggtgctggggcgtggggaccggctgcacgtgctgcggcgtcgacgtgaaggacctgttcaccgaccatatgttcgtgaagtggaaggtcgagtacataaagacggaggccatcgtgtgcgtggagctgacctctcaggagcggcagtgctccctcatcgaggccgggacccgcttcaacctgggccccgtcaccatcacgctgagcgagccccggaacatccagcagaagctgccgcctgagatcatcactctacaccccaaggtggaggaggggttcttcgacctaatgcacgtgcagaaggtcctctccgccagcaccgtgtgcaagctgcagtcctgcacccacggcatccccggcgacctccaggtgtaccacatcgggaacctcctgaagggcgaccgcatcaacgggcacctgatccacaagatcgagccccacttcaacacgagctggatgtcctgggacggctgcgacctcgactactactgcaacatgggggactggcccagctgtacctacaccggcgtcacccagcacaaccacgcggccttcgtgaacctgctgaacatcgagacggactacaccaagaccttccacttccactccaagcgggtcaccgcccacggcgacacgccccagctcgacctgaaagcccgacccacttacggggccggcgagatcaccgtgctggtggaggtcgcggacatggagctccacaccaagaaggtggagatcagcgggctgaagttcgcctccctggcttgcactggctgctacgcctgttcttccgggatctcctgcaaggtgcggatccacgttgatgaacccgacgagctcaccgtgcacgtgaagtccagcgacccggacgtcgtggccgcgtccaccagcctgatggcccgcaagctggagttcggcaccgacagcacgttcaaggccttctccgccatgcccaagaccagcctctgcttctacatcgtggagcgggagtactgcaagtcctgcagcgaggaggacacccagaagtgcgtcgacacccgcctggagcagccccagtccatcctgatcgagcacaaaggcacgatcatcgggaagcaaaacgacacgtgcaccgccaaggcgagctgctggctcgagtccgtcaagagcttcttctacggcctgaagaacatgctggggtccgtgtttggcaacttctttatcgggatcctcctgttcctggcacccttcgtactgctcgtgctgttcttcatgttcggctggaaaatactgttctgcttcaagtgctgccggcgcacccgaggcctcctgaagtaccgccacctgaaggacgacgaggagacggggtaccgccggatcatcgagcgcctcaacaacaagaagggcaagaaccgactgctggacggggagcgcctcgcagaccggaagattgccgagttgttcagcaccaagacccacatcggctga

SEQ ID NO: 15353 - RNA, 5052 nt, synthetic construct
  misc_feature 1..5052: note = derived and/or modified CDS sequence (opt11) from CCHFV(5180-R-2011)__KR814874.1__GP
  source 1..5052: mol_type = other RNA
atgcacacactgctagtgtgcttcattttatatctgcagctcctgggcctcgggggagcccaccgccagagcaacgccaccgagcacaatggcacgaacacaaccaccgcgccctccacgtcacagtccccgaaaccgcccgtctcgaccgccccaccttatgcccctgagagttcaaccatcaaacccacgacgcccgcctccgagaccgaaggaagcggagaaaccacgcctccgcccaacaccacccagggcccgtccccgccggaggccacccctgagcgccccgccaccacggccacatccaccccttccaccgacaacactaatagcaccacacacgccaccgacaacaaccccacgtccaccattagcaccagtccctcatccagtccctccaccccgagcacgccccagggtatccaccaccctgcccgaaacctcctgagcgtgtcttcacccaaaacagcgaccactccgacccccacgtcgcccggggacataagttccgaaaccagctcccttcatagcgccatgtctcgaaccccaacgctccacaccgccacccaggccagcaccgaaaatgccaaccactctgcgccacgacagagcgagtctagcgcccagcagaccacgacctcccccatgaccagccccgcccagcccatactggtcatgtccgccgcccccaccgcgatccagaacatccaccccagccccacgaaccgctccaaacgcaacctggagatggagataatcctcaccctgagccaagggctgaagaagtactacggcaagatcctcaagctgctgcatttgacgctggaggaggacacagaaggcctgctcgagtggtgcaaacggaacctggggtcaaactgcgacgacgacttcttccaaaagcggatcgaagagttctttatgacgggcgagggctacttcaacgaagtcctgcagtttaagaccctttccaccctgagccctactgagccttcccatgcccggccgcccacggtggagccattcaagagctacttcgctaaaggattcctttctatcgattcaggatacttctccgccaaatgctatcctcggctctccacctccgggctgcagctgatcaacgtgacccaacatcccgcccggatcgctgagacccccggcccgaagacgaccagcctcaaaacaatcaactgtatcaacctgcgcgcatcagtcttcaaggagcaccgcgagatcgagataaacgtactgctcccccaaatcgccgtgaacttaagtaattgccacgtagtcataaactcccacgtgtgcgactacagtttggacaccgatggcccagtccgcctcccccacatctatcacgaagggacgttcatcccgggaacctacaagatagtgattgacaagaaaaacaagctgaacgaccgatgcaccctggtgaccaactgcgtcatcaaaggtagagagatccgaaagggtcagtccgtgttacgccaatacaagacggaaatcaagattgggaaggccagcacaggttcccgtaagctgctgagcgaggagcccggcgacgactgcatcagccgcacgcagctcctgcggaccgaaactgccgagatccacgacgataactacggaggtcccggtgacaagatcactatctgcaacggctctaccatagtggatcaacgcctggggtcagagctcggctgttacactatcaaccgcgtcaagtccttcaaactttgtgagaacagcgccacgggcaagacctgtgagatagattccaccccagtgaaatgtcggcagggtttctgcctgaagatcacccaggagggtcgtgggcacgtgaaactttctcgcggctccgaagtggtgctggacgcctgcgacacaagctgcgaggtgatgatcccgaaggggaccggggatatcctggtcgattgttccggcggtcagcagcacttcctgaaagacaacctcatcgacctcggctgcccccacatccccctgctcgggaagatggccatctacatctgcagaatgtctaaccacccgcggacaacgatggcctttctattctggttttccttcggttatgtgataacgtgcattttctgtaaagcgctgttttacagcctcatcatcatcggtaccctgggcaagaagattaagcaatatcgcgagctgaagccacagacatgcaccatctgcgagaccgcccccgtgaacgcaatagacgccgaaatgcacgacctaaactgctcctacaatatctgcccctactgcgcctcacggctcacgtccgacggcctggcgcgccacgtgccacagtgccccaagcgaaaggagaaggtggaggagacagagctatacctgaatctggaacgcatcccctggatcgttcggaagctcctacaggtgagcgagtctaccggagtggccctgaagaggtcgtcctggctgattgtcctgttggtgctcctaacggtaagcctgtcgcccgtccagtccgccccagtgggccacggtaaaacgattgagacgtatcaaacccgtgagggcttcacttccgtatgtctcttcatgctgggctccatcctcttcctcgtctcctgcttagtgaagggactggtcgactccgtctcagattccttcttcccaggactcagcgtgtgtaagacgtgttccatcgggagcatcaacggcttcgagatcgagtctcacaagtgctactgcagcctgttttgctgcccctattgccgccattgttcagccgacagggaaatccatcagctccatctcagcatctgtaagaaacgaaaaatggggtccaacgtgatgctcgccgtctgtaaaagaatgtgcttccgcgcgaccatcgaagccagtcgtcgcgccctactgatccgctccatcatcaatacaacctttgtgatatgcatcctgacgctgactatctgtgtggttagtacctccgccgtggagatggaaaatctgccctcgggcacctgggagcgggaggaggacctgacgaacttctgccatcaggagtgtcaggtgaccgagactgagtgcctgtgcccgtacgaagccctcgtcctgcgcaagcccctcttcctcgacagcatcgtgaaaggcatgaagaacttgcttaactccaccagcctcgagacgtccctgagcatcgaagcgccctggggcgccataaacgtgcagtcaaccttcaaacccaccgtcagcaccgccaatatcgctctgtcctggagctcggtagagcaccgggggaacaaaatcctcgttacggggcgttctgaatccatcatgaagctagaggagcggacaggggtctcttgggatctgggggtggaggacgcgtcggagagcaagctcctgaccgtgtccatcatggacctgagccaaatgtactcccctgtatttgaatacctctcaggggaccgtcaagtggaggaatggcctaaggcgacatgcacaggggattgccctgagcggtgcgggtgtacgtcctccacctgtctgcacaaggagtggcctcatagccgcaactggcgttgcaatcctacctggtgctggggcgtcgggaccggctgcacgtgttgtggggtcgatgtcaaagatctgttcaccgaccacatgttcgtgaagtggaaggtcgagtacataaagaccgaagcgattgtgtgcgtggaactcacatctcaggaacgccagtgcagcttaatcgaggccggcacgcggttcaacctgggccccgtaacaatcaccctctctgagccaagaaacatccagcagaaactgccgccggagatcatcaccctacaccccaaggtggaggaaggtttcttcgacctcatgcacgtacagaaggtcttatcggcctccacggtgtgcaagctacagagctgcacacacggtatcccgggggatctacaggtttatcacatcgggaatctgctgaaaggagaccgggtgaacggccacttaatccacaagatcgagccccactttaacacgtcgtggatgtcctgggacggctgcgacctcgactactactgcaacatgggggactggccgtcctgtacctacacgggagtgacccagcacaatcacgccgcctttgtgaacctcctcaacatcgagacggactacaccaagacttttcacttccacagcaagcgcgtcaccgcccatggagacacgccccagctggacctgaaagcccggccgacctacggcgcgggcgagatcaccgtgctcgtcgaggtggctgacatggagcttcacaccaagaaagtcgagatatcagggttgaagttcgccagcctcgcctgcaccggctgctacgcctgcagtagcgggatctcctgcaaggtccgcatccatgtggacgagcctgacgaactgaccgtacacgttaagtcaaacgaccccgacgtagtggccgcgtccaccagcctgatggccagaaagttagagtttggtaccgactccaccttcaaggcctttagcgcaatgcccaagaccagcctgtgtttctacattgtcgaacgcgagtactgcaagagttgttcagaggaggacacccagaagtgtgttgacaccaagctggagcaaccccagagcattctcatcgaacacaaggggaccatcatcggtaagcagaacgatacgtgcactgccaaggcctcgtgttggcttgagtccgtcaagagctttttctacggcctaaagaacatgctcgggtccgtatttgggaacttcttcatcgggatcctactgttcctcgcgccgttcgtgctcctagtactgttcttcatgttcgggtggaagatcctcttctgcttcaaatgctgccggagaacccgtgggctcctgaagtaccgcctcctgaaggacgacgaggagacgggctaccgccgaatcatcgaacgccttaacaataagaagggcaagaaccggctcctggacggggagcgactggccgaccgcaagatcgcggagctatttagcaccaagacgcacataggctaa

SEQ ID NO: 15354 - RNA, 5052 nt, synthetic construct
  misc_feature 1..5052: note = derived and/or modified CDS sequence (opt11) from CCHFV(24-R-2012)__KR814856.1__GP
  source 1..5052: mol_type = other RNA
atgcataccctgttagtgtgcttcattctgtacctgcagctcctgggccttgggggcgcccaccgccagagcaacgccaccgagcacaatgggacgaacaccaccaccgcgccctccacgagccagtccccgaagccgcccgtcagcaccgcgccgccacacgcccctgagtccagcaccatcaagcccaccacgccagcctccgagaccgagggcagcggcgagaccacgcccccgcccaacaccacccagggcccctccccgcccgaggccacccccgagcggaccgccacgaccgccaccagcaccccctccaccgacaacacgaacagcaccacgcacgccacggataacaacccgacgtccacaatctccacctcccccagctccagcccctccacccccagcaccccgcagggcatccatcaccccgcccgcaacctcttaagcgtgtccagccccaagaccgcgaccacgcctaccccgacgtcccccggcgacatcagctccgagacatcttccctgcacagcgccatgtcccggacgcccaccctccacaccgccacccaggcttctaccgagaatgcaaaccacagcgcgccccgacagtccgaatccagcgcccagcaaacgactacctccccgatgaccagccccgcccaacccatcctggtgatgtccgccgccccgacggcgatccagaacatccaccccagcccgaccaatcggtccaagcgcaacttggagatggagatcatcctcaccctgagccagggcctgaagaagtactacgggaagattctcaagctcttgcacctgaccctggaggaggacacggagggcctgctcgagtggtgcaagcgaaacctggggagcaactgcgacgacgatttctttcaaaagcgcatcgaggagttcttcatgaccggcgaaggctatttcaacgaggtactgcagttcaaaacactttccacgctgagccccacggagccgtcccacgcccggccgcccaccgtggagccctttaagagctacttcgccaaggggttcctgagcatcgacagcggctacttctccgccaagtgttacccccgcctcagcacctccgggctgcagctgatcaacgtgacccagcaccccgcccggatcgcggagacgcccggccccaaaaccaccagcctcaagaccatcaactgcatcaacctgcgcgcctccgtcttcaaggagcacagagagattgaaatcaatgtgctgctcccgcagatcgccgtgaacctgagcaactgccacgtcgtgatcaactcacacgtgtgcgactatagcctggacacggacggccccgttcgcctcccccacatctaccacgaggggaccttcatccccggcacctacaagatcgtcatcgacaagaagaacaagctgaacgaccggtgcactcttgttacgaactgcgtcatcaagggacgtgaggtgcggaagggccagtccgtgctccgtcagtacaagaccgagatcaaaatcggaaaggcaagcacgggctccagaaaactgcttagcgaggagccgggcgacgactgcatcagccgcacccagctcctgcggacggagaccgccgaaatccacgacgacaactacgggggccccggggacaagataaccatctgcaacggctccaccatcgtcgaccagcgcctggggagcgagctcggctgctacacgatcaaccgcgtgaagtccttcaagctgtgcgagaatagtgcgaccggtaagacctgcgagatcgactccacccccgtgaagtgccggcaggggttctgcctgaagatcacgcaggagggtcgcgggcacgtcaagctgagccggggaagtgaggtggtgctggacgcctgcgacacaagctgcgaggtcatgattcccaagggaaccggcgacatcctggttgactgctccggcgggcagcagcacttcctgaaggacaacctcatcgacctgggctgcccgcacatccccctgctcggaaagatggccatttacatctgccgcatgagcaaccacccccggaccaccatggccttcctgttctggttttccttcggctacgtcatcacgtgcatcttctgcaaggcgctgttctacagcctcatcatcatcggcaccctggggaagaagatcaagcagtaccgcgagctcaagccgcagacctgcaccatctgcgagactgccccggtgaatgccatcgacgcagagatgcacgacctcaactgctcctacaatatctgcccctattgcgcaagccggctgacctccgacggcctggcgcgacacgtgccccaatgcccgaagcggaaggagaaggtcgaggagaccgagctctacctgaacctggagcgcattccctggatagtgcggaagctcctacaggtgagcgagtccaccggggtcgccctgaagcggagctcctggctaatcgtgctgctggtgctcctgacggtcagcctgagccccgtgcagtccgcgcccgtgggccacgggaagaccatcgagacgtaccagacccgggaggggttcacgagcgtctgcctcttcatgctgggctccatcctgttcctcgtgagctgcctggtgaaggggctggtcgattccgtgagcgactccttcttcccaggcctcagcgtgtgcaagacctgttccatcggcagcataaatggcttcgagatcgagtcccacaagtgctattgctctctgttctgctgcccttactgccgccactgctcggccgaccgggagatccaccagctgcacctcagcatctgcaagaagcgcaagatggggtccaacgttatgctggccgtgtgcaagcggatgtgcttccgcgcgaccatcgaggccagccggcgcgccctgttgatccgatccatcatcaacaccacgttcgtgatctgcatcctgaccctgacaatctgcgtcgtgagcacctccgccgtggagatggagaacctccccagcggcacctgggagcgtgaggaggacctgaccaacttttgccaccaggagtgccaggtcaccgagaccgagtgcctgtgcccgtatgaggccctcgtcctgcgcaagccgctgttcctcgacagcattgtcaagggcatgaagaacctgctgaactcgacaagcctcgagacctccctgtcaatcgaggcgccctggggcgccattaacgtccagtctaccttcaaacccaccgtgagcacggccaacatcgccctgtcctggagctccgtggagcaccgggggaataagatcctcgtcaccgggcgcagcgagtccatcatgaagctggaggagagaaccggcgtgagctgggacctgggggtggaggacgcgtccgagagcaagctcctgaccgtctccatcatggacttgagccagatgtactccccagtgttcgagtacctcagcggcgaccgccaggtggaggagtggccgaaggccacgtgcaccggcgactgccccgagcggtgcggctgcacttccagcacgtgcctgcacaaggaatggccccacagccgcaactggcggtgcaaccccacctggtgctggggcgtagggaccggctgcacgtgctgcggggtggacgtgaaggacctcttcaccgatcacatgttcgtcaagtggaaggtggagtacatcaagaccgaagccatcgtgtgcgtcgaactcacttcccaggagcgccagtgctccctgatcgaggccggcacccggttcaacctgggcccggtgaccatcaccctctccgagccccgaaacatccagcagaagctgccgcccgagatcatcacgctgcaccccaaggtggaagaggggttcttcgacctcatgcacgtccagaaggtgctgagcgcctccaccgtgtgtaagctgcaaagctgcacccacggcatccccggggatctccaggtctaccacatcggcaacctgctgaagggggatcgggttaacgggcatctcattcacaagatcgagccccacttcaacacctcctggatgagctgggacggctgcgacctggactactactgtaacatgggcgactggccctcctgtacgtacaccggcgttacccagcacaaccacgcggccttcgtcaacctgctcaacatcgagaccgactatacgaagaccttccatttccacagcaagcgcgtgaccgcccacggtgacactccacagctggacctgaaggcccggcccacctacggcgccggcgagatcaccgtcctcgtggaggtggcagacatggaactgcacaccaagaaggtcgagatctccgggttgaagttcgccagcctcgcctgcaccggctgctacgcctgctccagcgggatctcctgcaaggtgcgcatccacgttgacgagcccgacgagttgacggtccacgtcaagagcaacgaccccgacgtggtggccgcgtccactagcctgatggcccgaaagctggagttcggcaccgactccaccttcaaggccttcagcgccatgccgaaaacgagcctgtgcttctatatcgtggagagagagtactgtaagagttgcagcgaggaggacacccagaagtgcgtggatacaaagctggagcaacctcagtccatcctcatcgagcacaaggggaccatcatcggcaaacagaacgacacttgcaccgcgaaggccagctgttggctagagtccgtcaagtctttcttctacggcctgaagaacatgctcgggtccgtgttcggcaacttcttcatcgggatactgctgttcctcgcccctttcgtgctgctggtcctgttctttatgttcggctggaagatcctcttctgcttcaaatgctgccggcgcacccgggggctgctgaagtaccgcctcctgaaagacgacgaggagaccggataccgccggatcattgagcgcttgaacaacaagaagggcaagaacagactcctggacggggaacgcttggccgaccggaagatcgccgagctgttttcgacgaaaacccacatcggctga

SEQ ID NO: 15355 - RNA, 5052 nt, synthetic construct
  misc_feature 1..5052: note = derived and/or modified CDS sequence (opt11) from CCHFV(46-ST-2012)__KR814860.1__GP
  source 1..5052: mol_type = other RNA
atgcacactctactcgtctgcttcatcctttaccttcaactcctcgggctcggcggtgcacacggccaaagcaacgccactgaacacaatggaaccaacacaacaacagtcccatcgacgtcacaatcacccaaacccctagtctccacgacacccccacatgctcttgaatcaagcactatcaaaccaacaacccccacgagcgaaaccgagggctctggtgaaaccgccccactaccgaacactactcaaggcccgcccccacccgaaaccactccggaaagacccgcgacgacagtcacctccaccccgtccacagacaataccagctcgacaatccacgtaaccgataacaaccccacatccaccatctccacgtcaccaagctctagtcctagtaccccctctacaccccagggcatacaccaccccgcacgcagcctgctcagcgtcagcagccccaaaaccgcaaccacccccacccccacctccccaggcgaaataaactctgaaacctcctccctacatagtgccatgagccgaacgcctacactccacaccgcaacccaagtctccacagaaaacgccaaccactccgccccgcgccaatccgagtcatccgcccaaccgaccacaacatccctcatgacatcccccgcacaatccatcctccttatgtccgccgcccccactgcaatccagaacatacatccatcacccacaaaccgctccaagaggaaccttgaaatggagataatcctaactttatcccaagggttgaagaaatactacggcaagatcctaaaactcctacaccttacactggaagaagacacggaaggactcctagaatggtgcaaacggaaccttggctccaactgtgatgatgatttcttccagaaaaggatcgaagagttcttcatgacaggcgaaggctacttcaacgaagtcttacaattcaaaaccctcagtaccctgtcccccacagaaccctcccacgcacgattaccaactgtagaaccatttaaaagctattttgctaaggggttcctcagtgtagatagtggctatttcagcgcaaagtgctatccacgatcctccacgagcgggctgcaactaatcaacgtaactcaacaccccgcacgcatcgcagaaacaccgggcccaaagaccacctcactcaaaactatcaactgcatcaacctccgagccagcgtcttcaaagaacaccgcgaaatagaaataaacgtgctactcccccaaatcgccgtgaacctctccaactgccacgtcgtcatcaactcgcacgtatgtgactacagcttggacaccgatggtcctgtccgcctccctcacatctaccacgaaggcacgttcatcccggggacttacaaaatagttatagacaagaagaacaagttaaacgacagatgcaccttagtaacgaactgtgtcatcaagggccgagaagtacgaaagggccagagcgtgctccgccaatacaaaaccgaaatcaaaataggaaaagcatcgacgggctcccgaaaacttctctcagaagaacccggtgacgactgcatttcccggacgcaacttctccgaacggaaaccgccgaaatccacgacgacaactacggaggtccgggcgacaagattactatttgcaatggctccacaatcgtagaccaacggctcgggtccgaactcggctgttataccatcaaccgcgtgaagtcgtttaaactgtgcgaaaactcagccacgggcaaaacatgtgaaatcgacagcacccccgttaaatgtaggcaaggcttttgcctaaaaatcacacaggagggccgcggacacgtaaaacttagccgaggttccgaggttgttctcgacgcatgtgactcgtcatgtgaagtcatgataccaaagggaactggcgatatcttagtcgactgctctggtggacaacagcacttcctaaaagacaacctcatcgacctagggtgcccacacatacccttacttgggaagatggccatatatatatgccgcatgagcaaccacccccgcaccaccatggccttcctattttggttttccttcggatatgttatcacgtgcatattctgcaaagctctcttctactccctaataataatcgggacgctcggcaaaaagatcaaacaatatcgagaactcaagcctcaaacatgcacaatctgtgaaaccgctccggtcaacgccatagacgcggaaatgcatgacttaaactgttcatacaacatctgcccctactgtgcctcgagacttaccagcgacggcctcgctagacacgtgccccaatgcccaaagcgcaaggaaaaagtcgaagagacggagctatacctcaatctcgaacgaataccatggattgtccgtaagctcctacaagtgtcagaatcgaccggcgtcgcgctcaaacgaagttcttggctaatcgtcctgcttgtcttactcaccgtgtccctctccccggtacaatccgctccagtcggtcacggcaaaacgatcgaaacatatcaaactagagaaggttttacctccatatgcctcttcatgttgggcagcatccttttccttgtctcatgtctagtaaaggggctagtcgactcagtttctgactccttcttccctggtctcagcgtctgcaaaacgtgttccataggctctattaacggtttcgaaatagaaagccacaaatgctactgttcccttttctgctgtccatactgccgccactgctctgccgatcgagaaatccaccaactgcatctctccatctgcaagaaacgcaaaacaggttcaaatgtaatgctcgccgtatgcaaacgcatgtgctttcgcgcaactatagaagctagccgccgcgccctccttatcagaagcatcatcaatgccacatttgtgatatgcatcctaacccttacgatatgtgtagtctcaacctccgccgtagaaatggagtctctacctgctggcacatgggagcgagaagaagacttgaccaacttctgccaccaagaatgccaggtaaccgaaacggaatgcctatgcccctacgaagccctcgtcctcagaaagccactgttcctggactccatagtaaaaggaatgaagaacctcctcaattcaacgtccctagaaaccagcctatccatagaagccccatggggagcgataaacgtacaatcaacctttaaaccaaccgtcagcaccgccaacatcgctctcagctggtcatcggtcgaacatcgcggaaacaagattctagtaaccggacgatccgaatccattatgaaactagaggaacgtaccggggtaagctgggacctaggcgtagaagacgcctcggaatcgaaacttctaaccgtcagcataatggacctatcccaaatgtactcccccgtatttgaatacctaagtggtgaccgccaggtcgaggaatggccaaaagccacgtgcacaggggactgccccgaaagatgcggctgcacctccagcacttgcctacataaggagtggccgcactcacgcaactggcgttgcaacccaacgtggtgctggggtgtcggcacagggtgcacatgctgtggggtagatgttaaggaccttttcacagaccacatgttcgtaaaatggaaagtagaatatatcaaaacagaagccatagtatgtgtagaactaacatcccaagaacgccaatgctccctaatcgaagccgggaccagattcaacctcggaccagtcaccatcaccctctccgaaccgcggaacatacaacaaaaactccctcctgaaatcattaccctacatcccaaggtagaggaaggcttctttgacctcatgcacgtacaaaaggtgctctcggcgagcaccgtctgcaaactccaatcctgcacacacggcattcctggcgacttacaagtctaccacatcggaaacctgctcaaaggagaccgcataaacggccaccttatccacaagatagaaccacacttcaatacttcatggatgtcatgggatggctgcgacctcgactattactgtaacatgggtgactggccatcatgcacatatacaggcgtcacccagcataaccacgcagccttcgtcaatctgcttaacatagaaaccgactataccaagacctttcacttccactcgaaacgggtaacggcccacggagacacaccccagttagacctcaaggccagacctacatatggagccggcgaaatcaccgttctcgtagaggttgcagatatggaactacataccaagaaggtcgaaatctcaggcttaaaattcgcgtcccttgcatgcacgggatgctacgcgtgctcatcaggcatttcctgcaaagtcagaatccacgtggacgagcccgacgagctgactgtgcacgtcaagtcatccgaccctgacgtcgttgcggcatccacttcccttatggcgcgaaagctcgagttcggaacagattccaccttcaaggccttctccgctatgccaaaaaccagcctgtgtttttatatagttgaacgcgaatactgcaaatcatgcagtgaagaagacacccaaaaatgcgtggacacccgcctagaacaaccacagagcatcctaatagaacacaaaggaacaataatcgggaaacaaaacgacacctgtacagcaaaagccagctgctggctggagtcggtaaaatcattcttctatggcctgaaaaacatgctaggcagcgtttttggcaactttttcataggaatcctgctatttctcgcgcccttcgtgttacttgtcctctttttcatgttcgggtggaaaatactattctgctttaaatgctgccgccgaaccagaggactactcaaatacagacacctaaaagacgacgaagaaaccggctaccgccgcatcatagaacgtcttaataacaagaaagggaaaaacaggcttttagatggcgaaagactcgccgacagaaaaatagcggaactattcagcaccaaaactcacataggataa

SEQ ID NO: 15356 - RNA, 5052 nt, synthetic construct
  misc_feature 1..5052: note = derived and/or modified CDS sequence (opt11) from CCHFV(ROS/HUVLV-100)__DQ206448.1__GP
  source 1..5052: mol_type = other RNA
atgcacaccctgctggtgtgcttcatactgtacttgcagctcctgggcctcggcggggcccaccgccagagcaacgcaaccgaacacaacgggaccaacaccaccaccgccccgtccaccagccagtccccgaagcccctcgtcagcaccgctccgccccacgccctggagtccagcaccatcaagcccaccactcccgtgtccgagaccgaagggagcggggagaccacgcccccgcccaacaccacccagggccccagcccgcccgaggccacccccgagcgccccactaccacggccaccagcaccccctccacggacaacaccaacagcaccacccacgtgacggacaacaaccccacctccaccatcagcaccagcccgagctcgagcccttccacgcccagcacgccccagggcattcaccacccggcgcgaaacctgctaagcgtctccagcccaaagaccgccaccacgcccacccccacctcaccgggggagatcagctccgagaccagctccctgcacagcgccatgtcccggacgagcacgctgtacaccgcgacccaggtgtccaccgagaacgcgaaccacagcgcgccccgccagtccgagagctccgcgcaacagacgaccaccagccccatgacctcacccgcccagagcatcctcgtgatgtccgccgcgccgacggccatacagaacatccaccccagccccaccaaccggagcaagcgcaacctggagatggagatcatcctgaccctctcccagggcctgaagaagtactacgggaagatcctgaagctcctgcacctgaccctcgaggaggacacggagggcctgctggagtggtgtaaacggaacctcgggagcaactgcgacgacgacttctttcagaagagaatcgaggagttcttcatgaccggcgagggctacttcaacgaggtcctgcagttcaagaccctgtccaccctctctccgacggagccctcccacgcccggccgcccaccgtggagccgttcaagagctacttcgccaaggggttcctgtccatcgacagcggctacttctccgccaagtgctacccccgcctgagcacctccgggctccagttgatcaacgtgacccagcaccccgcgcggatcgccgagacgcccggtccgaagaccaccagcctgaaaaccatcaactgcatcaacctccgcgcctccgtcttcaaggagcaccgggagatcgagatcaacgtgctgctgccccagatcgccgtgaacctcagcaattgccacgtcgtgatcaactcccacgtgtgcgactacagcctggacacggacggccccgtccgcctgccccacatctaccacgagggcaccttcataccgggcacctacaagatcgtgatcgacaagaagaacaagctcaacgaccggtgcacactggtgacgaactgcgtcatcaaggggcgtgaggtgcggaagggccagtccgtgctgcgccagtacaagaccgagatcaagatcgggaaggccagcaccggcagccggaagctcctgtccgaggagcccggagacgactgcatcagccgcacccagctgctccgcacggagaccgcggagatccacgacgacaattacgggggccccggggacaagatcaccatctgcaacggctccaccatcgtcgaccagcggctggggagcgagctgggctgctacacgatcaaccgcgtgaagtccttcaagctctgtgaaaacagcgccaccggcaagacctgcgagatcgactccacccccgtgaagtgccggcaggggttctgcttaaagatcacgcaggagggccgcgggcacgtcaagctgagccggggctccgaggtggtcctggacgcctgcgacagctcctgcgaggtgatgatcccgaagggaaccggcgacatcctcgtcgactgcagcggcgggcagcagcactttctgaaggacaacctgatcgacctcggctgcccccacatccccctgctagggaagatggccatctacatctgccgcatgtccaaccacccccggaccaccatggccttcctcttctggttcagcttcggctacgtaatcacgtgcatcttctgcaaggcgcttttctattccttaatcatcatcggcacgctcgggaagaagatcaagcagtaccgcgagctgaaaccgcagacctgcaccatctgcgagaccgcccccgtgaacgccatcgacgccgagatgcacgacctgaactgcagctacaacatctgcccctactgcgcgtctcggctcacgagcgacggcctggcccgccacgtgccccagtgcccgaagcggaaggagaaggtcgaggagaccgagctgtacctcaacctggagcgcatcccatggatcgtgcgcaagctgctccaggtgtccgagagcaccggggtcgccctgaagcgcagctcctggctgatcgtgctcctggtgctgctcaccgtcagcctgtcccccgtgcagagcgcgccggtgggccacgggaagacgatcgagacctaccagacccgggagggcttcacctccatctgcctgtttatgctcggtagcatcctgttcctggtctcctgcctcgtgaaggggctggtggactcggtctccgacagcttcttcccaggcctgtccgtgtgcaaaacgtgcagcatcgggtccatcaacggcttcgagatcgagagccacaagtgctactgctccctcttctgctgcccctactgcaggcactgcagcgccgaccgcgagatccaccagctgcacctgagtatctgcaagaagcgcaagaccgggagcaacgtgatgctcgcggtctgcaagcggatgtgcttccgcgccaccatcgaggcctcccggcgcgccctactgatccgcagcatcatcaacaccacgttcgtcatctgcatcctcaccctgaccatctgcgtggtcagcacctccgccgtggagatggagaacctgcccagcggcacgtgggagcgggaggaggacctcaccaacttctgccaccaggagtgccaggtgaccgagaccgaatgcctgtgcccgtacgaggcgcttgtcctccgcaagcccctgttcctggactccatcgttaagggcatgaagaacctcctgaacagcacgtccctggagaccagcctctccatcgaggccccctggggcgccatcaacgtgcagagcacattcaagcccaccgtctccacggccaacatcgccctgagctggtccagcgtggagcaccggggcaataagatcctggtgaccgggcgctccgagagcatcatgaagctcgaggagcggacaggcgtctcctgggacctgggggtggaggacgcgagcgagtccaagctgctcaccgtgagcatcatggacctgtcccagatgtacagcccggtcttcgagtacctgagcggcgaccgccaggtggaggagtggcccaaggccacgtgcaccggcgactgccccgagcggtgcgggtgcacctccagcacgtgcctccacaaggagtggccccactccaggaactggcggtgcaacccgacctggtgctggggcgtggggaccggctgcacgtgttgcggggtcgacgtgaaggacctgttcaccgaccacatgttcgtgaagtggaaggtagagtacatcaagaccgaggccatcgtgtgcgtggagctgacgagccaggagcgccagtgctccctcatcgaggccggcacccggttcaacctgggccccgtcaccatcaccctgagcgagccccgcaacatccagcagaagctgccgcccgagatcatcacgctgcaccccaaggtggaggaggggttcttcgacctgatgcacgtgcagaaggtcctttccgcgagcaccgtgtgcaagctgcagtcctgcacccacggtatcccaggggacctccaggtgtaccacatcggcaacctccttaagggcgaccgggttaacgggcacctgatacacaagatcgagccccacttcaacacaagctggatgtcctgggacggctgcgatctcgactactactgcaatatgggggactggcccagttgcacgtacaccggcgtgacccagcacaaccacgccgccttcgtcaatctgctgaacatcgagaccgactacacgaagaccttccacttccactccaagcgcgtgaccgcccacggggacacgccccagctcgacctgaaggcccggcccacgtacggcgcaggcgagatcaccgtgctggtcgaggtggccgacatggagctccacaccaagaaggtggaaatcagcgggctgaagttcgcctccctggcctgcacgggctgctacgcctgcagctcggggatcagctgcaaggtccgcatccacgtggacgagcccgacgagctcacggtgcacgtcaagtccagcgacccggacgtggtggcggccagcacctccctgatggcccggaagctggagttcggcaccgacagcaccttcaaggccttctccgccatgcccaagacgtctctctgcttctacatcgtcgagcgcgagtactgcaagtcctgcagcgaggaggacacccagaagtgcgtggacaccaagttagagcagccccagtccatcctgatcgagcataaggggaccatcatcggcaagcagaacgacacgtgcaccgcgaaggccagctgctggctcgagtccgtaaagtccttcttctacggcctgaagaacatgctggggagcgtcttcggcaacttctttatcgggatcctcctgtttctggcccccttcgtgctgctcgtgctgttcttcatgttcggctggaagatcctgttctgcttcaagtgctgcaggcgcacccggggcctcctgaagtatcgcctgttgaaggacgacgaggagaccggctaccgccggatcatcgagcgcctgaacaacaagaagggcaagaaccggctgctcgacggggagcgcctggccgaccggaagatcgcggagctgttcagcacgaagacccacatcgggtga

SEQ ID NO: 15357 - RNA, 5052 nt, synthetic construct
  misc_feature 1..5052: note = derived and/or modified CDS sequence (opt11) from CCHFV(Saf)__KX013487.1__GP
  source 1..5052: mol_type = other RNA
atgcacaccctgctggtgtgcttcattctgtacctgcagctgctgggcctcggcggggcccacgggcagagcaacgccacggagcacaacgggaccaacacgaccaccgccccctccaccagccagtcccctaagcccttagtcagcaccgctccgccccacgccctggagtccagcaccatcaaacccaccacccccgcctccgagaccgaggggagtggcgagaccacgcccccgcccaacaccacccaaggccccagcccgcccgagaccacccccgagcgccccgccaccaccgcgaccagcaccccctccaccgacaataccaacagcaccacccacgtgacggacaacaaccctacctccaccattagcacctcccctagctccagcccctccacgccctcaacaccgcaagggatccatcacccggcccggaacctgctctcagtttccagccccaagactgccaccacgcccacccccacctccccgggcgagatcagctccgagaccagctcccttcactctgcaatgtcccgcacgagcaccctgtacaccgccacccaggtctccacggaaaatgccaaccacagcgcgccgagacagtcggaaagctccgcccagcccacgaccaccagccccatgacctccccggcccagagtattctcgtgatgtccgcggcccccacggccatccagaacatccaccctagcccgaccaaccgctcgaagcggaacttagagatggagatcatcctgaccctctcccaggggttaaagaagtactacggcaagatcttaaagctcctgcatctgaccctcgaggaggacacggaggggctgctggagtggtgcaagcgcaacctcggcagcaactgcgacgacgacttctttcagaagagaatcgaagagttcttcatgaccggcgaaggttacttcaacgaggtgctgcagttcaagaccctgtcgaccctgagcccaacggagccctcccacgcccgcccgcccaccgttgagcccttcaagagctactttgccaagggcttcctatccatagatagcgggtatttttcagcgaagtgctatccccgtagctccaccagcggcctgcagctcatcaacgtgacccagcaccccgcccgcattgccgagacgccgggccccaagaccacctccctgaagaccatcaactgcatcaacctacgggccagcgtgttcaaggagcaccgcgagatcgagatcaacgtcctcctgccccagatcgccgtgaatctgtccaactgccacgtggtcatcaacagccacgtgtgcgactactccctcgacacagacgggcccgtgagactgccgcacatccaccacgagggcaccttcatccccgggacatataaaatcgtcatcgacaaggagaacaagttaaacgaccgctgcaccctcgtgacgaactgcgtgatcaagggccgggaggtccgcaaggggcagagcgtgctgcggcagtacaagaccgagatcaagatcggcaaggcgagcaccggctccagaaaactgctcagcgaggagcccggggacgattgcatctcccggacacagctgctgcgcacggagacggccgagatccacgatgacaactacggcgggcctggcgacaagatcaccatctgcaacgggagcaccatcgtggaccagcggctcggctccgagctgggctgctacacgatcaaccgggtcaagagcttcaagctgtgcgagaactccgccactggtaagacctgcgaaatcgacagcaccccggtgaagtgccgccagggcttctgcctcaagatcacgcaggaagggaggggccacgtgaagctgtcccgcgggagcgaggtcgtgctagacgcctgcgattccagctgcgaggtcatgatccctaaggggaccggcgacatcctggtggattgctccggaggccagcagcactacctcaaggacaacctgatcgacctggggtgcccccacatccccctcctgggcaagatggccatctacatctgtcggatgagcaatcacccgcgtaccaccatggcgttcctcttctggttctccttcggctacgtgatcacgtgtatcttctgcaaggccctcttctatagcctgataatcatcgggacgctggggaagaagatcaagcagtaccgggagctaaagccccagacctgcaccatctgcgagaccgcccccgtcaacgccatcgacgctgagatgcacgacctgaactgctcctacaatatctgcccctactgcgccagccgcctgacgtccgacgggctggcccggcacgtaccgcagtgccccaagcgcaaggagaaggtggaagagaccgagctgtacctgaacctagaacggatcccctggatcgtacgcaagctacttcaggtgagcgagagcaccggcgtggcccttaagcgctccagctggctgatcgtcctgctcgtgctgctgaccgtgtccctcagcccggtccagtccgcccccgtggggcacggcaaaacgatcgagacctaccagacccgagagggcttcaccagcatctgccttttcatgctggggtccatcctcttcctggtgagctgcctggtcaagggcctagtggactccgtgagcgactccttcttccccgggctgagcgtctgcaagacctgttccatcggcagcatcaacgggttcgagatcgagtcccacaagtgctactgcagcctgttctgttgcccctactgccggcactgctccgcggaccgcgagatccaccagctccacctgagcatctgcaaaaagcggaagaccggctccaacgtgatgttagccgtgtgcaagcgcatgtgtttccgggccaccattgaggccagccgccgggccttactgatccgcagcataatcaacacaacgttcgtcatctgtatcctgaccctcaccatctgcgtggtatccaccagcgcggtcgaaatggagaacctgccgtccggcacgtgggagcgcgaggaggacctgaccaacttctgccatcaggaatgccaggtgaccgagaccgagtgcctctgtccctacgaggccctggtgctgcggaagcccctcttcagcgactccatcgtcaagggtatgaagaatctgctgaacagcacgtccctcgagaccagcctttccatcgaggccccctggggcgccatcaacgtccaatcgactttcaagccgaccgtgtccacggccaatatcgcgttaagctggtcctcggtcgagcaccgcgggaataagatcctcgtgaccggcaggtccgagagcatcatgaagctggaggagcgcaccggggtgtcctgggacctgggagtcgaggacgccagcgagtccaagctattaaccgtgagcatcatggatctgagccagatgtactcccccgtgttcgagtacctcagcggcgaccggcaggtcgaggagtggcccaaggccacgtgcaccggggactgcccggagcgctgcggctgcacctcgagcacgtgcctgcacaaggagtggccgcactcccggaactggcgctgcaaccctacctggtgctggggcgtgggcaccgggtgtacctgctgcggcgtggacgtcaaggacctgttcaccgaccacatgttcgttaagtggaaggtggagtacatcaaaaccgaggccatcgtttgcgtggagctcacgagccaggaacggcagtgctccctgatcgaggcgggcacccgcttcaacctggggcccgtgaccatcaccctcagcgaaccccgaaacatccagcagaagctgccgcccgagatcatcacgctgcaccctaaggttgaggaaggcttcttcgacctcatgcatgtacagaaggtactgtccgccagcaccgtctgcaagctgcagtcctgcacccacgggatccccggcgacctccaggtgtaccacatcggcaacctgctgaagggggaccgcgtgaacgggcacctcatccacaagatcgagccgcacttcaacacaagctggatgtcctgggacgggtgcgaccttgactactactgcaacatgggcgactggcccagctgcacgtacaccggggtcacccagcacaaccatgccgctttcgtgaacctgctaaacatcgagaccgactacatgaagacgtttcacttccactccaagcgggtcaccgcccacggcgacacgccccagctggacttgaaggcacgccccacctacggcgcaggggagatcaccgtgctggtggaagtcgccgatatggagctgcacaccaagaaggtggagatcagcggcttaaagttcgtgtccctggcttgcaccgggtgctacgcctgcagctccggaattagctgtaaagtccggatccacgtggacgagccggacgagctgaccgtgcacgtcaagtcatccgaccccgatgtggtggcggccagcacgtccctgatggcccgcaagctcgagttcgggaccgacagcaccttcaaggctttctcggccatgcccaagaccagcttgtgcttctacatcgtcgagcgggagtactgtaagtcatgcagtgaagaggatacgcagaagtgcgtggacaccaaactggagcagccccaatccatcctcatcgagcacaagggaaccatcataggcaagcagaacgacacgtgcacggcgaaggccagctgctggctggagtccgtgaagtccttcttctacgggctgaaaaacatgctcggctccgtcttcgggaatttcttcatcggaatcctactgttcctcgcccctttcgtcctgctggtgcttttcttcatgttcgggtggaagatcctcttctgcttcaagtgctgccgccggacccgcggcctgctgaagtaccgccacctcaaggacgacgaagagaccggctaccgccgcatcatcgagcggctgaacaacaagaaggggaagaaccgcctgctcgacggcgagcggctggccgaccgcaagatcgcggagctgttcagcaccaagacgcacatcgggtga

SEQ ID NO: 15358 - RNA, 5052 nt, synthetic construct
  misc_feature 1..5052: note = derived and/or modified CDS sequence (opt11) from CCHFV(52-R-2014)__KR814862.1__GP
  source 1..5052: mol_type = other RNA
atgcacaccctgctcgtgtgcttcattctgtacctccagctcctgggcctcgggggcgcacaccgccagagcaacgccaccgagcacaacgggacgaacaccaccactgcgccctcaacgagccagtccccgaagccgccagtcagcaccgcgccaccccacgcccccgagtccagcaccatcaagcccaccacacccgcctccgagactgagggcagcggggagaccactcccccgcccaacactacccagggcccttcgccgcccgaggccacccccgaacgccccgccaccacagccactagcaccccctcgaccgacaacacgaactcgaccacccacgccaccgacaataaccccacgtccaccatatccacctcacccagctcctcgccctccaccccgagcactccccagggcattcaccaccccgcccgcaacctcctgagcgtgtccagccccaagaccgcgaccaccccgacgcccacctcccccggcgacatctcgtccgagaccagctccctgcacagcgccatgtccagaacccccacgttgcacaccgccacccaggccagcaccgagaacgccaaccattccgcgccgcggcaaagcgagtccagcgcacagcagaccacgacctcccctatgacctcgcccgcccagccgatcctggtgatgtccgccgcccctacagcgatccagaacatccacccaagccccacgaaccggtccaagcgcaacctggaaatggagatcatcctcacactgagccagggcctgaagaagtactacgggaagatcctcaagctgctgcacctcaccctggaggaggacaccgaaggcctgctcgagtggtgtaagcggaacctggggagcaattgcgacgacgactttttccagaaacgtatcgaggagttcttcatgacgggcgagggctacttcaatgaggtcctgcagttcaagaccctcagtaccctgagcccgactgagccttcccacgcacggccacccactgtggagccatttaaaagctacttcgcgaaggggttcctcagtatagacagcggttacttctccgccaagtgctacccccgcctcagcacctccgggctgcagctgatcaatgtgacccagcaccccgcccggatcgcggagacccctggcccgaagacgaccagcctcaagaccatcaactgcatcaacctgcgcgcctccgtcttcaaggaacaccgggagatagagatcaacgtgctgctcccccagatcgcagtgaacctgagcaactgccacgtcgtgattaactctcacgtgtgtgactacagcctggacaccgacggccccgtccgcctgccccacatttaccacgaggggacgttcatccctggcacctacaagatcgtaatcgataagaagaacaagctgaacgaccggtgtaccctggtgaccaactgcgttatcaaggggcgcgaagtgaggaagggccagtccgtcctcaggcagtacaagacggagatcaagattgggaaggccagcaccggctcccggaagctgctgtcggaagaacccggcgatgactgcatctctcgcacccaactcctgcggacagagacagccgagatccacgacgataactacggtggccccggggacaagatcaccatctgcaacggctccaccatcgtcgatcagcgcctggggagcgagctcggctgctacaccatcaaccgcgttaaatctttcaagctgtgcgagaacagcgctacgggtaagacttgcgagatcgactccacccccgtgaagtgccggcagggattctgcctaaagatcacccaagagggccgcgggcacgtcaagctcagccgtggctccgaggtggtgctggacgcctgcgacacaagctgcgaagtaatgatcccgaaggggaccggcgacatcctggttgactgctccgggggccagcagcacttcctgaaggacaacctcatcgacctgggctgcccccacgtgcccctgttggggaagatggccatctatatctgtcgcatgagcaaccacccacggaccacaatggccttcctgttctggttctccttcggctacgtgatcacgtgcatcttctgcaaggcgctgttctatagcctcatcatcatcggcactctggggaaaaagatcaagcagtaccgcgagctgaagccgcagacgtgcaccatctgcgaaaccgcccccgtgaacgccatcgacgccgagatgcacgacctcaactgctcctacaacatctgcccctactgcgccagccgcctgaccagtgacggcctggcgcgccacgtccctcagtgccccaagcggaaggagaaggtggaggagaccgagctctaccttaacctggagcgcatcccctggatcgtgcggaagctcctgcaggtcagcgaatccaccggggtggccctgaagcgcagctcctggttgatagtgctgctggtcctcctgaccgtgagcctgagccccgtgcagtccgcccctgtcggccacggcaagacgatcgagacataccagacccgtgaaggcttcaccagcgtgtgcctcttcatgttgggctccatcctgttcctcgtgagctgcttagtcaaaggactggtggactccgtgtctgattccttcttcccgggcctcagcgtctgtaagacgtgttccatcgggagcatcaacggtttcgagatcgagtcccacaaatgctactgcagcctgttctgctgcccctactgtcgccactgctccgcagaccgggaaatacaccagctacacctcagcatctgcaaaaagcgcaaaatggggtccaacgtgatgctggcggtgtgcaagagaatgtgcttccgcgcgaccatcgaggccagccggagggccctgctcatccgctcgatcatcaacaccacctttgtcatctgcatcctgacgcttaccatctgcgtggtgagcacctccgccgtcgagatggagaacttacccagcggcacctgggagcgggaggaagacctaacaaatttctgccaccaggaatgccaggtgaccgagacggaatgcctgtgcccgtacgaggccctggtgctgcgcaagccgctgttcttagacagcatagtcaagggcatgaagaacctgctgaactccaccagcctcgagacgtccctgagcatcgaggctccgtggggagccatcaacgtccaatccaccttcaagcccaccgtcagcaccgcaaacatcgccctgagttggagctccgtcgagcaccgggggaacaagatcctcgtgacgggtcgctctgagtccatcatgaagctggaggagcggacaggcgtgagctgggacctgggggtcgacgacgcgtccgagtccaagctcttgaccgtgtccatcatggacctgtcccagatgtattccccggtgttcgagtacctcagcggcgacaggcaggtcgaggagtggcccaaggctacctgcacgggcgactgcccggagcgatgcggctgcacgtcctccacgtgcttgcacaaagaatggccccacagccgcaactggcggtgcaacccgacctggtgctggggcgtagggaccggctgcacatgctgtggggtggacgtcaaggacctgttcaccgaccacatgttcgtgaagtggaaggtggagtacattaagacggaggccatcgtctgcgtggagctcaccagccaggagcgccagtgcagcctgatcgaagccggcacccggtttaacctgggtcccgtgaccataaccctctcggagccccgcaacattcagcaaaagttaccacctgagatcatcaccctgcacccaaaggtcgaggaagggttctttgacctgatgcacgtgcagaaggtgctgagcgcctccacggtctgcaagctgcagagctgcactcacggaatccccggggaccttcaggtgtaccacatcggcaacctgctgaaaggcgaccgggtcaacggccacctcatccacaaaatcgagcctcactttaacacatcctggatgagctgggacggctgcgacctggactactactgcaacatgggggactggccgtcctgcacctacacgggcgtcacccagcacaaccacgccgccttcgtgaacctcctcaacatcgagaccgactacaccaagacgttccacttccatagcaagcgcgtcaccgcccatggtgacacgccgcagctggacctgaaggcccggcccacctacggcgccggcgagatcaccgtgctcgtggaggtcgcagacatggagctgcacaccaagaaggtggaaatcagtgggctgaagttcgcctccctcgcctgcaccgggtgctacgcctgctcgtcaggtatctcttgcaaggtgaggatacatgtcgacgagcccgacgagctgaccgtgcacgtcaagagcaacgacccggatgtcgtggccgcgtccacgagcctgatggccagaaagctggagttcggcaccgactccaccttcaaagcctttagcgccatgcccaagacctcgctatgcttctatatagtggagcgcgagtactgcaagagctgcagcgaggaggacacgcagaagtgcgtcgacaccaagctggagcagccccagtccattctcatcgagcacaaggggacgatcatcggaaagcagaacgacacgtgcaccgcgaaggccggctgctggctggaaagcgtgaaatccttcttctacggtctgaagaacatgctcggctcggtgttcgggaacttcttcatcggcatcttattattcctcgccccgttcgtccttctggttctgttcttcatgttcgggtggaagatcctcttctgcttcaagtgctgccggcgcacccggggcctgctgaagtaccgcctcctgaaggacgacgaggagaccggctatcgccggatcatcgagcgcctgaacaacaagaaggggaagaaccggctcctggacggcgagcgcctggcagaccggaagatcgccgagctgttctccacgaagacccacatcgggtga

SEQ ID NO: 15359 - RNA, 5052 nt, synthetic construct
  misc_feature 1..5052: note = derived and/or modified CDS sequence (opt11) from CCHFV(Turkey-Kelkit06)__GQ337054.1__GP
  source 1..5052: mol_type = other RNA
atgcacacgcccctggtgtgctttatcctctaccttcagctgctctgccttggcggggcccacggccaactgaacgccaccgaacacaacggtaccaacaacaccaccgccccgggggccagccagtcccccaaaccgcccatgagcaccacgcctccccacgcccctgagtccagcaccatcaaacctaccacacccatatccgaggccgaggggagcggcgagacaaccagcccgcccaacaccactcaaggcctcagctcccccgagacgaccagcgagcgccccgccacaacctctatatcaacgtccagcaccgactcaaccaaccccaccacgcagatgactgacaacacgcccacccctacggtcagtacttccccgagctctagccccagcaccccctccacgccgcagggcattcaccacccggcgcggtcactcctttccgtgtcttcacccaagactgtgaccacccccactcccacaagcccgggcgagatgtccagcgaaacgtcctctcagcactccgctatgtcacgcatccccacgccccataccgccacccgggtctccacagagatcaccaaccaccgcacgccccggcagagcgagagtagcgcccagcaaaccaccccgtcccccatgaccagccccgcgcagtccatacttttaatgagcgcggccccgactgccgtacaagacatccaccctagccccaccaaccgctccaagcgcaacctggagaccgagatcatcctaaccttgtcacaggggctgaagaagtactacggaaaaatcctgaagctgctgcacctcaccctggagcaggacaccgagggcctgcttgagtggtgtaaaggcaacctgggctccaactgcgatgacgacttcttccaaaagcgcatcgaagagttcttcatgacgggggaatgctactttaacgaggtgcttcaattcaagaccctcagtacgctgtcccccaccgaacccagccacgcgcggctgcccacggccgaacccttcaagtcctactttgccaagggcttcttaagcatcgattccgggtacttcagcgccaagtgctacccccgctcatcagcatccggcctgcaactgatcaacgtcacgcagcacccagcgcgcatcgcggagacccccggcccaaagaccacgagcctcaagaccatcaactgcatcaacctacgcgcatctgtcttcaaggagcatagggaggtggagataaacgtgctactcccccagatcgcagttaaccttagcaattgccacgtggtcatcaactcccacgtgtgcgactacagcctggacaccgacggcccggtccgcctcccccgaatctaccacgagggcaccttcatccccgggacctacaagatcgttatcgacaaaaagaataagctgaacgaccggtgcaccctggtgaccaactgcgtgatcaagggacgggaggtccgcaagggtcagagtgtgttacggcaatacaagaccgaaatcaagatcggcaaggcctcaacgggcttccgcaaactgctgagtgaggagcccggggacgattgcatctcccggacccagctgctgcgcaccgagaccgctgagattcacgatgacaactacggcgggccgggcgataagataacgatctgcaacgggagcaccatcgtggaccagcgcctgggctccgagctcggctgctacaccatcaatcgggttaagtcattcaagctgtgcaaaaactccgctaccgggaagacgtgcgaggttgactccacgcccgtgaagtgcagacagggcttttgtctgaagatcacccaagagggccggggccacgtcaagctctcccgcgggagcgaggtggtcctggacgcatgcgattcctcatgcgaggtgatgatacccaagggaaccggcgacatcctggtggactgctctggcgggcaacaacacttcctgaaggataacctcatcgacctgggctgcccacacatcccgctgctcgggcggatggccatctacatttgccgcatgagcaaccacccgcggacgacgatggccttcctgttttggttctccttcggctacgtcattacgtgcatcttctgcaaagccctgttctacagcctcatcatcatcgggaccctgggcaagaagatcaaacagtaccgcgagctgaagccccagacttgcactatctgcgagaccgcgcccgtgaatgccatcgacgctgagatgcacgacctcaactgcagttacaacatctgcccgtactgcgccagccgtctcacctccgacgggctggcgcgccacgtgacccagtgccctaagagaaaggaaaaggtagaggagacggagctctacctgaacctggagcgcatcccctggatcgtacggaagctcctccaggtgagcgagtccaccggcgtagccctgaagcgcagtagctggctgatcgtgctcctggtgctcctgaccgtctccctgagcccggtgcagtcagcccccgtggggcacggcaagacgatcgagatctaccagacccgggagggattcgccagcatctgcctcttcatgctggggtccatcctgttcatcgtctcgtgcctcgtgaagggcctcgtggattcagtcagcgagtccttcttccccgggctgagcgtgtgcaagacatgcagcatcggcagcgtcaacgggttcgaaatcgagtcccacaagtgctactgcagcctcttctgctgcccttactgccgtcactgctccgcagatcgggaaatccaccagctgcacctgagcatctgcaagaagcgtaagaccggatccaacgtcatgctcgcggtttgcaagcggatgtgcttccgcgcgactatcgaggccagccgacgggccctgctgatacgtagcatcatcaatacgaccttcgtgatttgcatcctcaccctaaccatctgcgtcgtatccacgagcgcggtggagatggagaacctaccagctggcacctgggagagagaggaagacctcaccaacttctgccaccaggagtgtcaggtcaccgagacggaatgcctgtgcccctacgaggccctggtgcttcgcaagcccctgttcctggactccatcgtgaaggggatgaagaacctcctgaactctacctccctggagacctctttatccatagaggccccttggggcgccatcaacgtccagtcaaccttcaagccgacggtttccaccgcgaacatcgcgctgagctggtcctcggtggtccaccgggggaacaagatcctggtgaccggccgctcagagagcattatgaagctcgaggagagaacaggggtgtcctgggacctgggcgtggaagacgcgagcgagtcaaagctgttgactgtgagcatcatggacttatcccagatgtacagcccagtgttcgagtacctgagcggggaccgccaagtcgaggagtggcccaaagctacttgcaccggagattgccccgagcggtgcggctgcacctcctcaacgtgtctccacaaggagtggagccacagccgcaactggcggtgcaacccgacctggtgctggggcgtggggaccgggtgcacatgttgcggtgtggacgttaaggacctgttcaccgaccacatgtttgtgaagtggaaggtagagtacatcaagaccgaggccatcgtctgcgtggcgctgacgtcccaggagagacagtgcagcctcatcgaggccggcaccaggttcaacctcgggccggtgaccataacgctctccgagccacgcaacattcaacagaagctgcccccggagatcatcaccctccaccccaagatcgaggagggcttcttcgacctgatgcacgtacagaaggtgctcagcgcctccaccgtgtgcaagttacagagctgtacccacggcatccccggcgacctgcaggtctaccacatcggcaacctcctgaagggagaccgggttaacggccacctaatacacaagatcgagtcccactttaacactagctggatgtcttgggatgggtgcgacctcgactactactgcaatatgggcgactggcccagctgcacttacacgggggtcacccaacataatcatgccgccttcgtgaacctgctgaacatcgagacagactacaccaagaccttccacttccacagcaagcgagtgaccgcgcacggcgacaccccgcagctcgacctgaaggcccggcccacctacggtgccgggggcatcacagtcctggtggaggtggcggacatggagctccacacgaagaaggtcgaaatcagcgggctgaagttcgccagcctggcctgcacgggctgctacgcctgtagctctgggatctcgtgtaaggtgcgcattcacgtggacgaacccgacgaactcaccgttcacgtcaagtcttctgaccccgacgtcgtggccgccagcacctccctgatggcgcggaaacttgagtttggtaccgacagtacattcaaggcattctccgctatgccgaagaccagcctctgtttctacatcgttgagcgtgagtattgcaaatcctgttcagaggacgacacccagaaatgcgtggacacacggctggagcagcctcagtccattctgatcgagcacaagggaacgatcatcgggaagcagaatgacacgtgcaccgccaaggcgagctgctggttagagtccgtgaagtctttcttctatgggcttaagaacatgttggggtccgtcttcggcaacctcttcatcgggatcctgttgttcctcgcgccctttgtgctgctggtactgttcttcatgttcggttggaagatcttgttctgcttcaagtgctgccgccgcacccggggccttttcaagtatcgccacctgaaggacgatgaggagaccgggtaccggcggattatcgagcggctcaacagcaagaagggcaagaaccgcctgttagacggagatcgactcgccgatcgcaaaattgccgagctgttctccaccaagacccatattggctga

SEQ ID NO: 15360 - RNA, 5052 nt, synthetic construct
  misc_feature 1..5052: note = derived and/or modified CDS sequence (opt11) from CCHFV(V42/81)__GU477490.1__GP
  source 1..5052: mol_type = other RNA
atgcataccctgctcgtatgcttcatcctgtacctgcagctcctgggcctcggcggggctcacgtccagccgaacgccaccgagcacaaccgcacgaacaccaccacggcgccggggacgagccactcactcaagccgctggtgagcactaccccgccgcaggcccccgagagctcaaccatcaagcccacgacccccacctccgagaccgaggggagcggggaggccacgcccctgtcaaacacaatccaggcaccgtcgtcccccgagacgaccagcgaacgacccgccacagcggtgatctccactagcggcaccgactccaccaacagtacgacccagacgacggacaacaatcccacgacgaccgtcggcacctccccgagctccagcccctccacgcccagcacacctcaggggatccaccaccacgcgcgcagcctcctgtccgtaacgagcccggagaccgtaaccacccccaagccgaccagcccgcgggaaatgagctccgagacctcgaaccagcactccgccatgagccgaaccccgacccaccacaccgtcacccaggtgtccaccgagaacacaagccattccacgcccagacagcccgagagttccgcccaaccaactagctccagtccgatgacgtcccccgcgcagtctaccctgctaatgtccgccgcgcccaccgccgtgcaaagcatacaccccagcccgaccaaccgctccaagcggaacctagagaccgagatcatcctcacgctcagccagggcctgaaaaagtactacgggaagatcctgaagctcctgcacttgaccctcgaggaagacaccgagggcctgctggagtggtgcaagcgcaacctcgggtccaactgcgacgatgacttcttccagaagcggatcgaggagttcttcatgaccggcgagggctacttcaacgaggtcctgcagttcaaaacgccctcgaccgtatcgcccaccgagccgtcccacgcacgcctgcccaccgcggagcccttcaaatcctacttcgccaagggtttcctaagcatcgattccggctacttcagcgccaagtgctacagtcggagctccacgtctgggctgcagctgatcaatgtaactcagcaccctgcccgcatcgccgagaccccgggccccaagaccacgagcctcaagaccatcaactgcataaacctgcgggcgagcgtcttcaaggagaacagggagatcgagatctccgttctgctcccccagatagccgtgaacctgagcaactgccacgtcgtgatcaacagccacgtgtgcgactactcccttgatacagatggccctgtccggctaccacgcatcaaccacgaggggaccttcatcccaggcacgtacaagatcgttatcgacaaaaagaataagctgaatgaccggtgcaccctagtgactaactgcgtcatcaaggggcgcgaggtacggaagggccagagcgtcctcagacagtacaagaccgagatcaagatcggcaaggcctccacgggctcacgcaagctgctgagtaaggagcccggcgacgattgcatcagccgcacccagctcatgcgcaccgagaccgcagagatccacgacgacaactacgggggccccggagacaagataacgatctgcaacggatccaccatcgtcgaccaacgactgggaagcgagctgggctgctacaccatcaaccgcgtgaagtccttcaagctctgcgagaatagtgccactggcaaggcgtgcgaggtcgactccacgccggtgaagtgccgtcaggggttctgcttgaagatcacccaggagggccgcgggcacgtgaagctgagccggggttccgaggtagtgctcgacgcatgtgacagctcctgcgaggtgatgatccccaagggcaccggcgatatcctggttgattgctcaggcgggcagcagcactttctgaaggacaacctgatagacctcgagtgcccccatatccccctgctgggaaagctcgccatctacatctgccgcatgtccaaccacccgcggaccaccatggccttcctgttttggttcggcttcggctatgtgattacgtgcatcctgtgcaaggccctcttctatagcctgataattatcggcaccctgggcaagaaaatcaagcagtatcgcgagttgaagccccagacatgcaccatctgcgagacggcccccgtgaacgccatcgacgcggaaatgcacgacctgaactgctcctacaacatatgcccctactgcgccagccggctgaccagcgacggcctcgcgcgccacgtcacacagtgcccgaagcggaaagagaaggtcgaggagaccgagctgtacctgaacctcgaacgcatcccctggatcgtgagaaagctgctgcaggtctcggagagcacgggagtggtgctcaagcgctccagttggctgatcgtcctgctcgtgctactgaccgtgtccctcagccccgtccagtccgctcccgtgggccacgggaagaccatcgagacataccagacgcgggaagggttcaccagcatctgcctattcatgctaggttccatactcttcatcgtgagctgcatcgtcaaggggctggtggactccgtgagcgatagcttcttcccgggtctgagcgtctgcaagacctgctccatcagctccatcaacgggttcgagatcgagagccacaaatgctactgctccctcttctgctgcccctattgccgccactgcagcgccgatcgggagatacaccagctgcacctgtccatctgccgcaaacggagaaccggctccaacgtgatgctcgccgtttgtaagcgcatgtgcttccgggccacgatcgaggtttcgcgccgtgcgctgctgatccgttccatcataaacaccaccttcgtgatctgcatactaaccctgacgatttgcgttgtcagcacctccgccgtggagatggagaacctgcctgccgggacctgggagcgggaggaagacttgaccaacttctgtcaccaggagtgccaggtaaccgagaccgagtgcctgtgcccgtatgaggccctggttctcagaaagcccctgttcctggacagcatcgtgaagggcaagaaaaacctcttgaactccaccagccttgagacatccctctcgatagaggccccatggggcgccatcaacatccaatccacgtttaagcccacagtaagcgccgctaacatcgcgctgagctggagctcagtcgagcaccgggggaacaagatcctggtgagtggccgcagcgagagcatcatgaagctcgaggaacggaccggcgtgtcctggaaccttggcgtggaggacgccagcgagagcaagctgctcaccgtgtccatcatggacctgagccagatgtattcccccgtgtttgagtacctgagcggggacagacaggtcgaggagtggcccaaggctacttgtaccggtgactgccccgagcggtgcgggtgcacctcctcgacgtgcttacacaaggagtggccccacagccgcaactggcggtgcaacccgacgtggtgctggggcgtggggaccgggtgcacgtgttgtggcgtggacgtcaaggatctgttcatcgaccacatgtttgtgaagtggaaggttgagtacatcaagaccgaagctatcgtctgcgtagagctgaccagccaggagcgacagtgtagcctcattgaggccgggaccagattcaacctgggacccgtcaccatcaccctgagtgagccccgcaatatccagcagaaactgccccctgagatcatcaccctgcatcccaagatcgaggagggcttcttcgacctaatgcacgtccagaaggtgctctcagcctcgactgtctgcaagctgcagtcctgcacccacggcatccccggtgacctccaggtgtatcatatcgggaacctcctgaagggtgaccgggtgaacggccatctcatccataagatcgagccccacttcaacaccagctggatgtcttgggacgggtgcgacctcgactactactgcaacatgggcgactggccgagctgtacctacacgggggtgacccaacacaaccacgcggccttcgtgaacctgctgaacatagagaccgactacaccaagacgtttcatttccactccaagcgcgtgaccgcccacggcgagacgccccagctcgacctgaaggctcgtcccgcctacggggcaggcgagatcacagtcctggtggaggtggccgacatggagctccacaccaagaaggtcgagatcagcggcctgaagtttgcctccctcgcctgcaccgggtgctacgcctgcagcagcggcatttcctgcaaggtgcgcatccacgtggacgagcccgacgagctcaccgtccatgtcaaaagcaacgacccggacgtggtggcagcctcgacaagcctgatggcccggaagttagagtccgggacggacagcaccttcaaggccttctccgccatgcccaaaacctcactctgcttctacatcgtggaacgcgagtactgcaagtcctgcagcgaggacgacacccagaagtgcgtggagacgaagctggagcagccccaatccatcctgatcgagcacaagggcaccatcatcgggaagcagaacgacacgtgcaccgcgaaggccagctgctggctcgagtccgtcaagagcttcttctacggcctgaagaacatgctgggctccgtgttcggcaacttcttcatcggcattctcctgttcctggcccccttcgtgttactggtactgttcttcatgtttgggtggaagatcctgttctgcttcaagtgctgccgccggacccgcggcctcttcaagtaccggcacctgaaggaagacgaggagaccggataccgccggatcatcgagagactgaacagcaagaaggggaaaaaccggctcctggacggcgagcgtctggccgacagaaagatcgccgagctgttctcgaccaagacccacatagggtga

SEQ ID NO: 15361 - RNA, 5052 nt, synthetic construct
  misc_feature 1..5052: note = derived and/or modified CDS sequence (opt11) from CCHFV(75-R-2012)__KR814863.1__GP
  source 1..5052: mol_type = other RNA
atgcacaccctgctggtgtgtttcatcctgtacctgcagctcctaggcctcggcggcgcccatcgccagagcaacgccaccgggcacaacgggaccaacaccaccaccgccccctcgacctcgcaatccccgaagcccctcgttagcaccgccccgccgcacgcgctggagagttcaatcattaagcacaccacccccgtgtccgagaccgagggcagcggcgaaaccacgccaccgcccaacaccacccagggcccgtcgccccttgagaccacacccgagcggcccgcgaccaccgcgaccagcacgccatccaccgacaatacaaacagcaccacccacgtgaccgacaataatccgacgtcgaccatcagcacctcccccagctccagcccaagcaccccgagcacaccccaggggatccaccaccccgcgcgcaacctcctgtccgtctctagcctgaagacggccaccacccccaccccgacctctcccggcgagatcagctctgagaccagctccctccacagcgcgatgtcccggaccagcacactgtacaccgccacacaggtatctaccgagaacgccaatcatagtgccccacgccagtccgagtcttccgcccagcaaaccacgaccagccccatgacatccccggcccaatcgatcctggtgatgtccgctgcgcccaccgccattcagaacactcacccctcacccacgaaccgaagcaagagaaacctcgagatggagatcatcttgaccctatctcaggggctcaagaagtactacggcaagatactgaagctgttgcacctgaccctggaggaagacaccgagggtttactggagtggtgcaagcggaatctaggcagcaactgtgacgacgatttcttccaaaagcgcatcgaggagttcttcatgaccggcgagggttacttcaatgaggtgctccagttcaagacgctgtccacccaaagcccgacggagcccagtcacgcccggcccccgacggtggagcctttcaaatcatacttcgcgaagggcttcctgagtattgacagcgggtacttctccgccaagtgctatccccgcctctcaacctccggcctgcagttgatcaacgttacccaacatcccgcgcggatcgccgagacaccgggccccaaaacgacaagcctgaagaccatcaactgcatcaacctgcgcgcctcggtctttaaggagcaccgggagatcgagatcaacgtgctgctcccccagatcgccgtaaacctttccaactgccacgtcgtgattaacagtcacgtctgcgactatagcctggatacggacgggcccgtccgtctccctcatatctaccacgaaggcaccttcatccccgggacctacaagatcgtgatcgataagaagaataagctgaatgaccggtgcaccctggtaacgaactgcgtcataaagggccgcgaagtccggaagggtcaatccgtgctccgccagtacaagaccgagatcaagataggcaaggccagcactggcagccggaagctgctgtccgaggagccaggggacgactgcatcagccgcacccagttgctgcggacggaaaccgccgagatccacgacgacaactacggaggccccggcgataaaatcacgatctgtaacggttccaccattgtcgaccaacgactgggcagcgagctcggttgttacacgatcaaccgcgtaaagtccttcaagctctgcgagaacagcgccaccgggaagacctgcgagatcgactccgcgccggtgaagtgcagacagggcttctgcctgaagataacccaggaggggcgcggccacgtcaagctgtctcgggggtccgaggtggtcctagacgcgtgcgacagctcctgcgaggtgatgatccccaaaggcacgggcgatattttagtggattgtagcgggggccagcaacacttcctgaaggacaatctcatcgacctggggtgtccacacatacccctcctcgggaagatggccatctacatctgtcgcatgtccaaccacccccggaccactatggcgttcttattctggtttagcttcggatacgtcattacctgcatcttttgcaaggccctgttctactccctcatcataatcggtacccttggcaaaaagatcaagcagtaccgcgagctgaagccccaaacttgcaccatctgcgagaccgccccggtgaacgccatagacgcggaaatgcacgacttgaactgctcatacaacatctgcccctactgcgcctcccggctgacatctgacggactggcccgccacgtgccacagtgccccaagcggaaagagaaggtagaggagacggagctctacttaaatctggagcggatcccctggatcgtgcgcaagctcctccaggtgtccgagagcaccggggtcgccctgaagaggagcagttggctcatcgtgttactggtgctcctgaccgtctctctgtcccccgtgcagtcggccccggtggggcatggcaaaaccatcgaaacgtatcagacacgggaaggcttcaccagtatctgcctcttcatgctgggtagcatcttgttcctggtttcctgtctggtgaaggggctagtgaactcggtctccgacagtttcttccccggtctctcagtgtgcaagacctgcagcatcggctccatcaacgggttcgagatcgaaagccacaaatgttactgctccctgttctgctgtccctattgccgccactgcagcgcggatcgggagatccaccaactgcacctctccatttgtaagaagcgcaagactggcagcaatgtgatgttggccgtctgcaagcggatgtgcttccgcgccaccatcgaggcctcccggcgcgccctgctgatccggagcatcatcaacaccaccttcgtgatctgcatcctgacgctaaccatctgcgttgtcagcacctccgcggtggaaatggagaacctaccgagcggcacctgggaacgagaggaggacctgacgaacttttgccaccaggagtgccaggtgactgagaccgagtgcctgtgcccctacgaggccctcgtcctgcgcaaacccctgttcctcgactccatcgtgaaagggatgaagaacctgctgaatagcacctccctcgagacgagcctgtcaatcgaggcaccctggggcgccatcaacgtgcagagcactttcaagccgaccgtcagtaccgccaatatcgcgctgagctggtcctcagtggagcatcgggggaacaagatcttggtgacgggccgctccgagtccataatgaaacttgaagaacggaccggggtctcctgggacctgggcgtggaggacgccagcgagtccaagctcctgaccgtgtcaatcatggacctctcccagatgtacagcccggtgttcgaatacctaagtggcgacagacaagtggaagagtggcccaaggcgacctgcacgggggactgccccgaacggtgcggctgcacctcctccacgtgcctgcacaaggaatggccgcactcccgcaactggcggtgtaaccccacctggtgctggggagttggcaccgggtgcacgtgctgcggagtcgacgtcaaggacctgttcaccgaccacatgtttgtgaaatggaaggtcgagtacattaagaccgaggccatcgtgtgcgtcgagctcactagccaggagcgccaatgttccctgatcgaggcgggcacgcgctttaatctgggacccgtcaccatcaccctaagcgaaccgcgcaacatccagcagaagctgcctcccgagatcatcaccctgcatcccaaggtggaggagggcttctttgaccttatgcacgtgcagaaggtcctgtccgccagcaccgtgtgcaagctacagtcgtgcacccacggaatccccggcgacctccaagtttaccacatcggaaatctgctgaagggggaccgggtaaacggacacctcatccacaagatagagccgcacttcaacaccagctggatgtcctgggacgggtgcgacctggactactactgcaacatgggcgactggcccagctgcacctacacgggagtgacacagcacaaccacgccgccttcgttaacctgctcaacatcgagaccgactacactaagaccttccacttccactcaaagcgcgtgacagcccacggcgacacgccacagcttgacctcaaggcgcggcccacctacggcgccggggagatcacggtgcttgtcgaggtggcggacatggaactgcataccaagaaggtggagatcagcggcctgaagttcgcctccctcgcctgcacggggtgctacgcctgcagctccggcatcagctgcaaagttcgcatccacgtggacgagcccgacgagctaaccgtgcacgtcaagtccagcgacccggacgtggtagccgccagcacgtccctgatggccaggaagctcgagttcgggacagacagcaccttcaaggccttctccgcaatgccaaaaaccagcctgtgtttctatatcgtcgaaagagagtactgcaagtcctgcagcgaggaggacacacagaagtgcgtggataccaagctggagcagccgcagtcgatcctcatcgaacataagggcacgatcatcgggaaacagaacgacacgtgcacggccaaggccagctgctggctagagtccgtcaagagtttcctgtacgggctcaagaacatgctgggatccgtcttcgggaacttcttcattggcatcctactgttcctcgccccttttgtgctgctggtcttgttctttatgttcggatggaaaatcttattctgcttcaagtgctgccgacgcacccggggtctgctgaagtacagattactcaaggacgacgaagagaccggctatcgccggatcatcgagcgcctcaacaacaagaaggggaagaaccggctgctggacggcgaaaggctcgcggataggaagatcgccgaattgttctccaccaaaactcacatcgggtga

SEQ ID NO: 15362 - RNA, 5052 nt, synthetic construct
  misc_feature 1..5052: note = derived and/or modified CDS sequence (opt11) from CCHFV(VLG/TI29414)__AY179961.1__GP
  source 1..5052: mol_type = other RNA
atgcacacgctgctggtgtgcttcatcctttacctgcagctcctgggcctcgggggcgcccacatccagagcaacgccaccgagcacaacgggaccaacacgaccaccgccccctccaccagccagtccccgaagcccctcgtcagcaccgccccgccccacgccctggagtccagcaccatcaagcccaccacccccgtgtccgagaccgagggcagcgggggcaccacgcccccacccaataccacccagggccccagcccgcccgaggccacccccgagcgccccgccaccacggcgaccagcacaccctccaccgacaacacgaacagcaccacccacgtgacggacaacaaccccacgtccaccatcagcacctccccgagctccagcccctccacccccagcacgccccaggggatccaccacccggcccggaacctgctcagtgtctccagccccaagaccgccaccacccccacacccacttccccgggcgatatcagcagtgaaacctcttctctgcacagcgccatgtcccgcacatcaacgctgtacaccgcgacccaggtgtcaaccgagaacgccaaccacagcgcgccccggcagtccgagagctccgcccagcagaccacgaccagccccatgacctccccggcgcagccgattctcgtgatgagcgcggcccccaccgccatccagaacatccacccctccccgacgaaccgcagcaagcggaacctggagatggagatcatcctgaccctcagccaggggctgaagaagtactacggcaagatcctgaagctcctgcacctgaccctcgaggaggacaccgaggggctgctggagtggtgcaagcgctccctcggcagcaactgcgacgacgacttctttcaaaaacggatcgaggagttcttcatgacgggcgaggggtacttcaacgaggtactgcagttcaagaccctgtccaccctcagccccaccgagccctcccacgcccggccgcccacggtggagccctttaagagctacttcgccaagggcttcctgtccatcgacagcgggtacttctccgcgaaatgctacccccggctgagcacctccggcctccagctgatcaacgtgacgcagcaccccgcccgcatcgctgagacccccggccccaagacgacaagcctgaagaccatcaactgcatcaacctccgggcctccgtcttcaaggagcaccgcgagatcgagatcaacgtgctgctgccccagatcgccgtgaacctcagcaactgccacgtcgtgatcaactcccacgtgtgcgactacagcctggacaccgacgggcccgtccggctgcctcacatctaccacgagggcacgttcatccccgggacctataagatcgtgatcgacaagaagaacaagctcaacgaccgctgcaccctggtgaccaactgcgtcattaagggacgggaggtgcgcaaggggcaatccgtgctgcggcagtacaagaccgagatcaagatcggcaaggcgagcaccggcagccgcaagctcctgtccgaggagcccggggacgactgcatcagtcggacccagctgctccgcgccgagcccgccgagatccacgacgacaactacggcgggccgggcgacaagatcaccatctgcaacgggtccacgatcgtcgaccagcggctgggctccgaactgggctgctatacaatcaaccgcgtgaaatccttcaagctctgcgagaacagcgcaaccgggaagacctgcgagatcgattccacgcccgtcaaatgccgccagggcttctgcctgaagatcacccaggaggggcggggccacgtcaaacttagccgcgggtccgaggtggtcctggatgcctgcgatagctcctgcgaggtgatgatccccaagggcaccggcgacatcctcgtggactgcagcgggggccagcagcacttcctgaaggacaatctgatagacctcgggtgcccccacatccccctgttgggcaagatggcgatctacatctgccggatgtccaaccacccccgcaccacgatggccttcctcttttggttcagctttggctacgtcatcacgtgcattttctgcaaggccctgttctactccctgatcattatcgggaccctcggcaagaagatcaagcagtaccgggagcttaagccccagacctgcaccatctgcgagacggcccccgtgaacgcgatcgacgccgagatgcacgacctgaactgctcatacaacatctgcccgtactgcgcctcccgcctcaccagcgacgggctggcccggcacgtgccccagtgccccaagcgcaaggagaaggtcgaggagaccgagctgtacctcaacctggagcggatcccgtggaacgtgcgcaagctgctccaggtgtccgagagcaccggcgtcgccctgaagcggagttcctggctgatcgtgctcctggtgctgctcacggtctcattgtcccccgtgcagagcgcgcccgtggggcacggcaagaccatcgagacctaccagacccgcgagggcttcacgtccatctgcctgttcatgctcgggagcatcctgttcctggtctcctgtctcgtcaagggcctggtggacagcgtctccgacagcttctttcccgggctgtccgtgtgcaagacctgctcgatcggctccatcaacgggttcgagatagagagtcacaagtgctactgctccctcttctgctgcccgtactgccggcactgcagcgccgaccgtgagatccaccagctgcacctgtccatctgcaagaagcggaagatgggcagcaacgtgatgctcgccgtctgtaagcgcatgtgcttccgagccaccatcgaggcctcccgccgggcgctgctgatccgcagcatcatcaacaccacgttcgtgatctgcatcctcaccctgaccatctgcgtggtcagcacctccgccgtagagatggagaacctgcccagcggcacgtgggagcgcgaggaggacctcaccaacttctgtcaccaggagtgccaggtgaccgagactgagtgtctgtgcccctacgaggccctggtcctccggaaacccctgttcctggactccatagtgaaggggatgaagaacctcctgaacagcacgaacctggagacctccctcagcatcgaggccccgtggggcgccatcaacgtgcagtccaccttcaagcccaccgtcagcacggcgaacatcgccctgtcttggagctccgtcgagcatcgcgggaacaagatcctggtgaccggccggagcgagtccatcatgaagctcgaggagcgcaccggggtcagctgggacctcggcgtggaggacgcctccgagagcaagctgctcaccgtgtccatcatggacctgagccagatgtactcccccgtcttcgagtatctgagcggcgaccgccaggtggaggagtggcccaaggccacgtgcaccggggactgcccggagcgctgcggctgcaccagcagcacgtgcctccacaaggagtggccccacagccggaactggcgctgcaaccccacctggtgctgggaggtggggaccgggtgcacgtgctgcgggtggaacgtcaaggacctgttcaccgaccacatgttcgtgaagtggaaggttgagtacatcaagacggaggcgatcgtctgcgtggagctgacctcccaggagcggcagtgcagcctcatcgaggccggcactagattcaacctgggccccgtgacaatcaccctctccgagccgcggaacatccagcagaagctgccgcccgagatcatcacgctgcaccccaaagtcgaggaggggttcttcgacctaatgcacgtgcagaaggtgctcagcgcctccaccgtctgcaagctgcagagctgcacccacggcatcccgggggacctccaggtgtaccacatcggcaacctcctaaagggcgaccgcgtgaacgggcacctgatccacaagatcgagccccacttcaacacctcctggatgagctgggacggctgcgacctcgactactactgcaacatgggggactggccctcctgcacgtacaccggcatgacccagcacaaccacgccgccttcgtcaacctgctgaacatcgagacagactacacgaagaccttccacttccacagcaagcgggtgaccgcgcacggggacacgccccagctcgacctgaaggcccgcccgacgtacggcgccggcgagatcaccgtcctggtggaagtggccgacatggagctccacaccaagaaggtcgagatctccgggctgaagttcgccagcctggcgtgcaccggctgctacgcctgctccagcgggatctcctgcaaggtgcggatccacgtggacgagcccgacgagctcacggtccacgtgaagtccaacgaccccgatgtgatcgccgcctccaccagcctgatggcccgcaagctggagttcggcaccgacagcaccttcaaggcgttctccgctatgcccaagacgagcctctgcttctacatagccgagcgggagtactgcaagtcctgcagcgaggaggacacccagaagtgtgtcgacaccaaactggaacagccgcagtccatcctgatcgagcacaaggggaccatcatcggcaagcagaacgacacgtgcaccgccaaggcgagctgttggctcgagtccgtgaaatccttcttctacggcctgaagaacatgctggggtccgtgttcggcaacttcttcatcgggatcctcctgttcctggcccccttcgtcctgctcgtgctgtttttcatgttcggctggaagatcctgttctgctttaagtgctgccgccggacccgcgggctcctgaagtacaggctgctcaaggacgacgaggagaccggctaccgccgcatcatcgagcggctgaacaacaagaagggcaagaaccgcctgctcgacggggagcggctggccgatcgcaagatcgctgagctgttcagcacgaagacccacatcggctga

SEQ ID NO: 15363 - RNA, 5055 nt, synthetic construct
  misc_feature 1..5055: note = derived and/or modified CDS sequence (opt11) from CCHFV__KJ648916.1__GP
  source 1..5055: mol_type = other RNA
atgcatatcagtctgatgtacgccatcctctgcctgcagctgtgcggcctgggggagacccacggttcccacaacgagacgcgccacaacaagacggacaccatgaccacccccggggacaacccgagctccgagccgcccgtgagcactgccctgagtatcaccctggacccctccaccgtcacccccacgacccccgcgtccggcctcgagggcagcggcgaggtgtacacctccccgcccatcaccacgggcagcctgcccctgtccgagaccacccccgagctccccgtaactacggggaccgacaccctgagcgccggcgacgtcgacccttccacccagactgccgggggcacttcggccccgaccgtgcggacgtccctgccgaacagtccctccacgcccagcaccccgcaggacacccaccaccccgtgcgcaacctcctgtccgttaccagcccggggcccgacgagacgagcaccccgtccggcaccggcaaggaaagctccgccacctcttctcctcaccctgtatcgaaccggcccccgacgcctcccgcgaccgcccaggggcccacagagaacgactcccacaatgccaccgagcaccccgagagcctgactcaatccgccacgcccggcctcatgacgagccccacccagattgtgcacccgcagtccgcgacccccataacggtccaggacacgcaccccagccccaccaacgcctccaaggcaaacctgaagatggagattattctgacactcagccaggggctgaagaagtactacggcaagatcctgcgcctcctgcagctcacgcttgaggaggataccgagggcctgctggagtggtgcaagcggaacctcgggctggactgcgacgacacctttttccagaagcgcattgaggagttcttcatcaccggcgaagggcacttcaacgaggtgttacagttccggacgccgggaaccttgtccaccaccgagagcacgcccgccgggcttcccaccgccgagccgttcaagtcctacttcgcgaagggattcctgagcatcgactccggctactactcggccaagtgctacagtgggacctccaacagcggcctccagttgatcaacatcacccgccactccacgcggatcgtggacaccccggggcccaagatcaccaacctgaagaccatcaactgcatcaacctaaaagccagcatctttaaggagcaccgcgaggtcgagatcaacgtgttgctgccccaggtggccgtcaacctctccaactgccacgtggtgataaagagccatgtctgtgactactccctggacatcgacggcgccgtgcggctgcctcacatctaccacgagggggtgttcatcccaggcacgtacaagatcgtcatcgacaagaagaacaagttgaacgaccgctgcaccctgttcaccgactgcgtgatcaagggccgggaggtacgcaaggggcagagcgtcttgcggcagtacaagaccgaaatccgcatcggcaaggcgagcacggggagccggcgcctcctgagcgaggagcccagcgacgactgcatctcacggacccagctgctccgcaccgagaccgccgagatccacggcgataactacgggggccccggcgacaagattacgatatgcaacggaagcaccatcgtggatcagcggttaggatccgagctgggctgctacaccatcaaccgagtccgcagcttcaagctgtgcgaaaattccgccaccggcaagaactgcgagatcgacagcgtgccagtgaagtgccggcagggctactgcctccgcatcacgcaggaaggacggggccacgtcaagctgagcagagggtccgaggtagtgctggacgcctgcgacaccagctgcgagatcatgatcccgaagggaaccggggacatcctcgtcgactgctccggcggccaacagcacttcctaaaggacaacctgatcgacctcggctgccccaaaattcccctgctgggcaagatggccatctacatctgccggatgagcaaccaccccaagaccacgatggcgttcctcttctggttctcctttgggtacgtgatcacttgcatcctgtgcaaggccatattctacctgctcatcatcgtgggcaccctggggaaacgcctcaagcagtaccgggagctcaagccgcagacctgcaccatctgcgagacgacccccgtcaacgccatcgacgccgagatgcacgacctgaactgtagctacaacatctgcccctactgcgcctcccgcctaaccagcgacggcctcgcgcggcacgtgatccagtgccccaagcgcaaggagaaggtggaggagaccgagctgtacctgaacctcgagcggatcccgtgggtcgtgcgcaagctgctacaagtgtccgagagcacgggcgtcgccttaaagcggtcctcctggctgatcgtgctgctcgtgctgttcaccgtctctctgagcccagtgcagtccgcccccatcgggcagggtaagacaatcgaggcctatcgcgctcgggagggatacaccagcatctgtctcttcgtgctggggtccatactgttcatcgtcagctgcctcatgaaggggctggttgactccgtgggcaattcatttttcccgggcctgagcatctgcaagacatgctccattagctccataaacgggttcgagatcgagagccacaaatgctactgctccctcttctgctgcccctactgccgccactgctcgaccgacaaggagatccacaagctgcacttatccatctgtaagaagcggaaaaagggcagcaacgtcatgctcgccgtgtgcaagctcatgtgcttccgcgccaccatggaggtgtccaaccgggccctgtttatccgcagcatcatcaacaccacattcgtcctatgcatcctgatcttggccgtgtgcgtggtctccaccagcgcggtagagatggagaacctccccgccgggacctgggagcgcgaggaggacctgacaaacttctgccaccaggagtgccaggtaacggagaccgagtgcctttgtccctacgaggccctcgtcctgcggaagccgttattcctcgactcaaccgccaagggcatgaagaatctgctgaacagcacctccctcgagacgtctctgtccatcgaggccccctggggcgcgatcaacgtgcagagcacctacaagccaaccgtgtctaccgccaacatcgccctgagctggagctccgtcgagcaccgcgggaacaagatcctcgtgagcggccggtcagagagcatcatgaaactggaggagcgcacaggtatctcctgggacctgggcgtggaggacgcctctgagtccaagctccttaccgtcagcgtgatggacctgtcccagatgtactctcccgtgttcgagtacctctccggggaccggcaggtcggcgagtggccgaaagcgacctgcaccggcgactgccccgagcgctgcggttgcacgagctccacctgtctgcacaaggagtggccccacagccggaactggaggtgcaaccccacctggtgctggggcgtggggaccggctgtacgtgctgcggcctggacgtgaaggacctcttcaccgactacatgttcgtcaagtggaaggtggagtacatcaagaccgaggccatcgtgtgcgtcgagctgacctcccaggagagacagtgcagcctgatcgaggccggcacgcgcttcaacctcggcccggtgaccatcaccctctcggagccccggaatattcagcagaagctgccgcccgagatcatcaccttgcacccccgcatcgaggaggggttcttcgacctgatgcacgtacagaaagtcctgagcgcctcgaccgtgtgcaagctccagagctgcacgcacggggtacccggtgatctccaggtgtaccacatcggcaacctgctgaagggggacaaggtgaacggccacctcatccacaagatcgagccccatttcaacacctcctggatgtcctgggacggatgcgacctggactactactgcaacatgggcgactggcccagctgcacttacacaggcgtcacgcagcacaaccacgcctccttcgtgaacctcttgaacatcgagaccgactacaccaaaaacttccacttccacagcaagcgggttacggcgcacggggacacgccgcagctggacctcaaggcccgtcccacctacggagccggcgagatcaccgtcctagtggaggtcgccgacatggagctgcataccaagaagatcgagatctccggcctcaagttcgccagcctggcgtgtacggggtgctacgcctgctccagcgggatctcctgcaaggtccggatccacgtggacgagcccgacgagctgaccgtgcacgtcaagagcgacgaccccgacgtggtggccgcctccagctccctcatggcccgcaagctggagttcggcactgacagcacctttaaagcgttctccgccatgccgaagacgagcttatgtttctacatcgtcgaacgggagcactgcaagtcctgcagcgaggaggacaccaagaagtgcgtgaacaccaagctcgagcagccccagagtatcctcatcgagcacaaggggacgatcatcggcaagcagaatagcacgtgcaccgccaaggccagctgttggctggagtccgtcaagagcttcttctacggcctgaagaacatgctctccggtattttcggcaacgtgttcatggggatcttcttattcctggcccctttcatcctcctgattttattcttcatgttcggctggcgcatcctcttctgtttcaagtgctgccggcgcacccggggcctgttcaagtaccgccacctgaaggacgacgaggaaaccggctatcggagaatcatcgagaagctcaacaacaagaagggcaagaacaagttgctggacggggagcgcctcgcggaccggcgcattgcggagctgttcagcacgaaaacccacatcggatga

SEQ ID NO: 15364 - RNA, 3495 nt, synthetic construct
  misc_feature 1..3495: note = derived and/or modified CDS sequence (opt11) from CCHVF(CCHVF 10200)__U39455.2__Gn-NSm-Gc
  source 1..3495: mol_type = other RNA
agcgaggagccctccgacgactgcgtgtcccgcacccagctgctccggacggagacggccgagatccacggcgacaactacgggggcccgggggacaagatcaccatctgcaacggctccaccatcgtcgaccagcgcctggggtcggagctgggctgctacaccatcaaccgggtgcgatccttcaagctctgcgagaactccgccacgggcaagaactgcgagatcgactccgtgcccgtcaagtgccggcaggggtactgcctgcgcatcacccaggaaggccgggggcacgtgaagctgagccgcggctccgaggtggtcctcgacgcgtgcgacaccagctgcgagatcatgatccccaaggggaccggcgacatcctggtggactgctccggcgggcaacagcacttcctgaaggacaacctcattgacctgggctgccccaagatcccgctgctcgggaagatggccatctacatctgccggatgagtaaccaccccaagacgaccatggccttcctgttctggttctccttcggctacgtgatcacgtgtatcctgtgcaaggctatcttctacctcctgatcatcgtcggcaccttggggcgccggctcaagcagtatcgcgagctgaagccccagacctgcaccatctgcgagactacccccgtgaacgccatcgacgcggagatgcacgacctgaactgcagctacaacatctgcccgtactgcgcctcccggctcacgagcgacggcctggcccgccacgtgatccagtgccccaagcggaaggaaaaagtcgaggagaccgagctgtacctcaacctggagcgcatcccctgggtggtgcggaagctgctccaggtctccgagtccaccggggtggccttaaagcgctccagctggctgatcgtgctcctggtcctgttcaccgtgagcctctcccccgtgcagagcgcgccgatcggccaggggaaaacgatcgaggcctaccgggcacgcgagggctacacctccatctgcctgttcgtcctgggcagcatcctcttcatcgtgtcctgccttatgaaagggctggtggacagcgtcggcaactccttcttccccgggctcagcatctgtaagacctgttccatcagctccatcaacggctttgagatcgagtcacacaagtgctactgctccctgttctgctgcccctactgccggcactgcagcaccgacaaggagatccacaagctgcacctttccatctgcaagaagcgcaagacggggagcaacgtgatgctggccgtctgcaagctgatgtgcttcagagccaccatggaggtgtccaaccgggcgctgttcatcagaagcatcatcaacaccaccttcgtgctgtgcatcctgatcctcgccgtctgcgtggtgtccacgagcgctgtcgagatggagaacctgcccgccggcacctgggagcgggaggaggacctgaccaacttctgccaccaggaatgccaggtgaccgagacggagtgcctgtgcccgtacgaggccctcgtgctgcgcaagcccctgttcctcgacagcaccgcaaagggcatgaagaacctcctcaattccaccagcctggagacctccctgagcatcgaggccccctggggcgccatcaacgtccagtccacgtacaagcccaccgtgagcaccgccaacatcgccctgtcctggagctccgtggaacaccgggggaacaagatcctcgtcagcgggcgctccgagtcgatcatgaagctggaggaacggaccggcatctcctgggatctgggggtggaggacgcgagcgagtccaagctcctgaccgtgagcgtcatggacctgtcccagatgtactctccggtgttcgagtacctcagcggcgaccgccaggtggaggagtggcccaaggccacgtgcaccggcgattgccccgagcggtgcgggtgcacctccagcacgtgcctgcacaaggagtggccccactcccgcaactggcggtgcaatccgacctggtgctggggcgtcgggaccggctgtacgtgctgcggcctcgacgtgaaggacctcttcaccgactacatgttcgtgaagtggaaggtcgagtacatcaagaccgaggccatcgtgtgcgtggagctgaccagccaggagcgccagtgctccctgatcgaggccgggacccggttcaacctcggccccgtcaccatcacgctgagcgagcccagaaacatccagcagaagctgcccccggagatcatcacactccacccccggatcgaggaggggttctttgacctgatgcacgtgcagaaggtgctgtccgccagcaccgtctgcaagctccagtcctgcacccacggcgtgcccggggacctccaggtgtaccacatcggcaacctgctcaagggcgataaggtcaacgggcacctgatccacaagatcgagccgcatttcaacacgagctggatgtcctgggacggctgcgacctcgactactactgcaacatgggggactggcccagctgcacctacaccggcgtgacccagcacaaccacgcgtccttcgtgaacttactgaacattgagacggactacaccaagaacttccacttccacagcaagcgcgtcactgcccacggggacacgccccaactggacctcaaggcacggcccacctacggcgcaggcgagatcaccgtgctggtggaggtcgcggacatggagctccacaccaaaaagatcgagatctccgggctcaaattcgccagcctggcctgcaccggctgctacgcctgctccagctcaatctcgtgcaaggtgcgcatccacgtggacgagccggacgagctgacggtccacgtcaagagcgacgaccccgacgtggtggccgcgtccagctccctcatggcccgaaagctggagttcgggaccgacagcacctttaaggccttctccgccatgcccaagaccagcctgtgcttctacatcgtggagcgcgagcactgcaagtcctgcagcgaggaggacacgaagaagtgcgtgaacacaaagctcgagcagccccagtccatcctgatcgagcacaagggcaccattatcgggaagcagaacagcacgtgcaccgccaaggcttcctgctggctggagagcgtcaaatccttcttctacggcctcaagaacatgctgagcggcatcttcgggaacgtgttcatgggcatcttcctgttcctcgccccgttcatcctgctcatcctcttcttcatgttcgggtggcggatcctgttctgcttcaagtgctgccgtcgcacccggggcctgttcaagtaccgccacctcaaggacgacgaggagaccgggtaccggcgcatcatcgagaagctgaacaacaagaagggcaaaaacaagctgctcgacggcgagcggttagccgacgggcgcatcgccgagctgttctccaccaagacccacatcggc

SEQ ID NO: 15365 - RNA, 3495 nt, synthetic construct
  misc_feature 1..3495: note = derived and/or modified CDS sequence (opt11) from CCHVF(CCHVF IbAr10200)__AF467768.2__Gn-NSm-Gc
  source 1..3495: mol_type = other RNA
agcgaggagccctccgacgactgcatcagccgcacccagctgctccggaccgagaccgccgagatccacggcgacaactatgggggcccgggggacaaaatcaccatctgcaacggctccaccatcgtggaccagcgcctggggagcgagctgggctgctacaccatcaaccgggtccgctcattcaagctctgcgagaacagcgccacgggcaagaactgcgagatcgactccgtgcccgtgaagtgccggcaagggtactgcctgcgcattacccaggagggccgggggcacgtgaagctgagccgcggctccgaggtggtgctcgacgcgtgcgacaccagctgcgagatcatgatccccaaagggaccggcgacatcctggtcgactgctccggcgggcagcagcacttcctgaaggacaatctcatcgacctgggctgccccaagatcccgctgctcgggaagatggccatctacatctgcaggatgagcaaccaccccaagacgaccatggccttcctgttctggttctccttcggctacgttatcacgtgcatcctgtgcaaggccatcttctacctcctgatcatcgtgggcaccctggggaaacgcctcaagcagtaccgggagctgaagccccagacctgcaccatctgcgagaccacccccgtcaacgccatcgacgcggagatgcacgacctgaactgcagctacaacatctgcccgtactgtgcctcccgcctcacgagcgacggcctggcccggcacgtgatccagtgccccaagcgcaaggagaaggtggaggagaccgagctgtacctcaacctggagcggatcccctgggtcgtgcgcaagctgctccaggtgtccgaaagcaccggggtcgcccttaagcggtcgagctggctgatcgtgctcctggtgctgttcaccgtcagcctctcccccgtgcagagcgcgccgatcggccaggggaagacgatcgaggcctacagagcccgggagggctacacctccatctgcctgttcgttctgggcagcatcctcttcattgtatcctgcctgatgaaggggctggtggacagcgttggcaactccttcttccccgggctcagcatctgcaagacctgctccataagctccatcaacggcttcgagatcgagagccacaagtgctactgctccctgttctgctgcccctactgccgccactgctcgaccgacaaggagatccacaagctgcacctctccatctgcaagaagcggaagaaggggagcaacgtcatgctggccgtatgcaagctgatgtgctttcgcgccacgatggaggtctccaaccgcgccctcttcatccggagcatcatcaacaccaccttcgtgctctgcatcctgatcctcgccgtgtgcgtcgtgtccaccagcgccgtggagatggagaacctgcccgccgggacgtgggagcgcgaggaggatctgaccaacttctgccaccaggagtgccaggtcaccgagaccgagtgtctgtgtccgtacgaggccttggtgctgcggaagcccctgttcctcgatagcacagcgaagggcatgaagaacctgctgaactccacctctctcgagacctccctgagcatcgaggccccctggggcgccatcaacgtgcagtccacctacaagcccacggtcagcaccgccaacatcgccctgtcatggtcttccgtggagcaccgcgggaacaagatcctcgtgagcgggcggtccgagagcatcatgaagctggaggagcgcaccggcatctcctgggacctgggggtggaggacgcgtctgaatccaagctcctgacggtgagcgtgatggacctgtcccagatgtacagcccggtcttcgagtacctcagcggcgaccgccaggtgggcgagtggcccaaagcgacctgcacaggggactgccccgagcggtgcggctgcacctccagcacgtgcctgcacaaggagtggccccactcccggaactggcggtgcaacccgacctggtgctggggcgtggggaccggctgcacgtgctgcgggctggatgtcaaggacttattcaccgactacatgttcgtgaagtggaaggtggaatacatcaagaccgaggccatagtctgcgtggagctgaccagccaggagcggcagtgctccctgatcgaggccggcacccgcttcaacctcgggcccgtgaccatcaccttgagcgagcccaggaacatccagcagaagctgccgccggaaattatcacgctccacccccgcatcgaggagggcttcttcgacctgatgcatgtccagaaggtgctgtccgccagcaccgtgtgcaagctccagtcctgcacccacggggtccccggcgacctccaagtgtaccacatcggcaacctgctaaagggggacaaggtgaacggccacctgatccacaagatcgagccgcacttcaacaccagctggatgtcctgggacgggtgcgacctggactactactgcaacatgggcgactggcccagctgcacgtacaccggggtcacccagcacaaccacgcgtccttcgtgaacctcctgaacatcgagaccgactacacgaagaacttccacttccacagcaagcgggtgaccgcccacggcgacacgccccagctggacctcaaggcccgccccacctacggcgccggggagatcaccgtcctggtagaggtggcggacatggagctgcacaccaagaagatcgagatctcgggcctaaagttcgccagcctggcctgcaccgggtgctacgcctgctccagcggcatctcctgcaaggtccggattcacgtggacgagccggacgagctgaccgtgcacgtcaagagcgacgaccccgacgtggtggccgcgtcatccagcctcatggcccgcaagctggagttcggaactgacagtaccttcaaggcgttcagcgccatgcccaagacctccctgtgcttctacatcgtcgagagagagcactgcaagagctgctccgaggaggacaccaagaagtgcgtgaacactaagctcgagcagccccagagcatcctgatcgagcacaagggcaccatcataggcaagcagaactccacgtgcaccgccaaggcgagctgctggctggagtccgtcaagagcttcttctacgggctcaagaacatgctgtccggcatcttcggcaacgtgttcatgggcatcttcctgttcctggccccgttcatcctgcttatcctcttcttcatgttcggatggcgcatcctgttctgcttcaaatgctgccgccggacccgcggcctgttcaagtaccggcacctcaaggacgacgaggagaccggctaccgccggatcatcgagaagctgaacaacaagaaggggaagaacaagctgctcgacggcgagcgcctggccgaccggcgcatcgccgagctgttcagcaccaagacccacatcggg

SEQ ID NO: 15366 - RNA, 3495 nt, synthetic construct
  misc_feature 1..3495: note = derived and/or modified CDS sequence (opt11) from CCHVF(CCHVF Turkey-Kelkit06)__GQ337054.1__Gn-NSm-Gc
  source 1..3495: mol_type = other RNA
tcagaagaacccggagacgactgcatcagtcgcacccagctattgcggacggaaacagctgaaatccacgacgacaactacggcggacccggagacaaaatcaccatatgtaacggatccacaatagttgaccagcgcctagggtcagagctaggctgctacaccataaaccgcgtgaagtcattcaaattatgtaaaaactcagccaccggaaagacatgcgaagtcgacagcacccccgtaaaatgtcgccaaggcttctgcctcaagatcacccaagaaggacgtggtcacgtcaaactttcacgaggctccgaagtagtcctcgacgcatgcgacagctcatgcgaggtaatgatacccaagggcaccggcgacatactggtcgactgctcaggcggacaacaacacttcctgaaagacaatctaatagatctaggctgcccccacatccccttactgggccggatggcaatatacatctgccgcatgtccaaccacccccgcacgaccatggccttcttattctggttcagcttcgggtatgtaatcacatgcatcttctgcaaagctctcttttactctttaataattatcggtacattggggaagaaaattaaacagtaccgcgaactgaaacctcaaacctgcaccatctgcgagaccgcaccggtcaacgctatcgacgccgaaatgcacgacctcaactgctcatacaacatatgcccgtactgcgcttccaggctaacaagcgacggccttgcccgccacgtcacacagtgtcccaagcgaaaagagaaagtcgaagagaccgagctctatctaaaccttgaacgtattccttggattgttcgaaaactcctacaagtgtcagaaagcacgggcgtcgcactaaaaagatcatcttggcttattgtactcctggtactactcacagtttcactctccccagtccagtccgcccccgtcggacacggcaaaaccattgaaatctaccaaacaagggagggattcgcctccatttgcctattcatgctaggtagtatcttgttcatcgtttcctgtctagtcaaagggctagtggactcagtcagcgaatcgttctttccaggactcagcgtgtgcaaaacctgcagcataggctcagtgaacggcttcgagatcgagtcacacaaatgctactgctccctattctgttgcccatattgccgacactgctcagctgaccgcgaaatccaccaattacacctttcaatctgcaagaaaagaaagaccgggtccaacgtcatgctcgcagtctgcaaacgcatgtgcttcagagccaccatcgaggcttcacgacgcgctctcctaattagatcgataattaacacaacctttgtaatctgcatactcaccttgaccatttgcgtagtctccacatcagcagttgaaatggaaaacctgccagccggaacatgggaacgggaagaagacctcaccaacttctgccaccaggaatgccaagtaacagaaacagaatgcctatgcccatatgaagccctagtactccgcaaaccactgttcctagacagcattgttaaaggcatgaaaaatctgctcaattccaccagcctcgaaacctcactgagcatagaagctccctggggagcaataaacgttcaatctacattcaaacccaccgtgtctaccgccaacatcgcactgtcatggtcctccgtagttcaccggggcaacaaaatcctcgtcacaggaagaagtgaatccataatgaaacttgaggagcgaaccggcgtctcgtgggacctcggagtggaagacgccagcgagtcgaagctcctcaccgtcagtatcatggacctgagccagatgtacagccccgtattcgaatacttatccggcgaccgccaagtagaagagtggccaaaggcaacctgtactggtgactgccccgagcgatgcggctgcacttcctccacatgccttcacaaagaatggtcccactcccgcaactggagatgcaacccaacgtggtgttggggcgtcggtaccggctgcacctgttgcggcgtagacgtcaaagacctcttcacggaccacatgttcgttaaatggaaggtcgaatacatcaagaccgaagcaatcgtgtgcgtggcactaacaagccaagaacgccaatgctccctcatagaagccggcacccgcttcaaccttggtcccgtaacaataacactctcagagcctcggaacatccagcaaaaattaccacctgaaatcataacgctccacccaaaaatcgaggaaggcttcttcgatctcatgcacgtacagaaagtactgtccgcatcgacagtctgcaagctacaatcatgcacgcacggcatacccggggacctccaagtctaccacatcggaaaccttctgaagggcgaccgagtaaacggacatttaatccacaaaatcgaaagtcacttcaatacaagctggatgtcatgggatggatgcgacctggactactactgcaacatgggcgactggccatcctgcacatacaccggagtcacccaacacaaccacgccgcctttgtcaatctcctgaacatagagacggactacacaaaaacttttcactttcactctaaacgggtgacagcgcacggcgacacaccccaacttgacttaaaagctcgacctacctacggggcaggcggcataaccgtcctcgtcgaagtagcggacatggaattgcacaccaagaaagttgaaatatcaggactcaagttcgcgtccctcgcctgcaccggctgctacgcctgctcatccgggatatcatgcaaagtgcgcattcacgtagacgagccagacgagctaaccgttcatgttaagtccagcgaccccgacgtcgtagctgcttcaaccagcctaatggcacgaaaactcgagttcggcaccgactcaacttttaaagcattctccgcaatgcccaagacctcgctatgtttctacatcgtcgaacgcgaatactgcaaaagctgttccgaagatgacacccaaaagtgcgtcgacacccgcctcgaacaaccacaatccatcctaatcgagcacaaaggaaccataataggcaaacaaaacgatacgtgcaccgcaaaagcctcctgctggctagagtccgtcaagtccttcttctacggccttaaaaacatgcttgggtcagtcttcggcaacctatttatcggaatacttctcttcctagccccatttgtcctactcgtcctcttcttcatgttcggctggaaaatcctattctgcttcaaatgctgccggcgaacccgtggtttattcaaataccgccacctgaaagatgacgaggaaaccggatacagacgaatcatagaacgactcaacagcaagaaaggcaaaaatcgcctactcgacggtgaccgcctcgcagaccgcaaaatcgcggaattattctccaccaaaacccacatcggc

SEQ ID NO: 15367 - RNA, 3498 nt, synthetic construct
  misc_feature 1..3498: note = derived and/or modified CDS sequence (opt11) from CCHVF(CCHVF SR3)__AJ538199.1__Gn-NSm-Gc
  source 1..3498: mol_type = other RNA
agcgaggaatccggtgatgactgtatctcgaggacccagctcctccgtaccgagacagccgaggtccatggggacaactacggtgggccgggggacaaaatcaccatctgcaacgggtcaaccgtagtagaccaacgcctgggcagcgagctgggctgctacaccatcaaccgggtgcgctcatttaagttgtgcgaaaacagcgctacgggaaaatcctgcgaaatcgatagcatccccgtcaagtgcaagcagggctactgcctgaaaatcacacaagaggggcggggccacgtgaaactgtcccgcgggtctgaggtggtattggacgtgtgcgactccagctgcgaggtgatgatccccaagggcacgggtgacatacttgttgactgctccgggggccagcagcatttccttaaggataacctcgtggacctggggtgccctaagataccattgctcggcaaaatggcgatctatatctgccggatgagcaatcatcccaagacaacgatggccttcctgttctggttcagtttcggctacgtgatcacgtgcatcctgtgcaaggccatcttcttcctcctgatcatcttcggcaccctgggcaagcgcttcaaacagtatcgtgaactgaaacctcagacctgcacgatctgcgaaaccacccccgtcaacgccatagacgccgagatgcacgacctaaattgcagctacaacatttgcccatactgtgcgtcccgactgacgagcgacgggctcgcgcggcacgtaacgcagtgcccgcgacggaaggaaaaggtggaagagacggaactttacctgaacctcgagcgcatcccctgggtcgtgcgaaaactgttacaagtttccgagagtacgggcaccgtcctgaagcgatcgtcctggctgatcgtccttctagtattattcacggtcagcctatcccccgtgcaatcggcccccatcgggcacggcaaaacgatcgagacctaccgggtgcgcgaggagtacaccagtatctgcctcttcgtcctaggcagcatcctgttcatcgtatcctttctcatgaaggggttggtcgacggcgttgggaatatctttttcccagggctgtccgtgtgtaagacatgctccatcgggagcatcaacggcttcgagatcgaatcccataaatgctactgcagcctcttctgctgcccctactgtcggcattgcagcgccgatggcgagatccaccaactgcacctgagtatctgcaagaagagaaaaaccgggtcaaacgtcatgctcgcggtgtgcaagaggatgtgcttcagggccacgatggaggtgagcaacaaggccctgttcatacgatcgatcatcaacaccacgttcgtaatgtgcatcctgaagggcgagttcgccgccgtcaagagcatccaccctatcgaaatggaatccctaccggccggaacttgggagcgggaagaggacctgacgaacttctgccaccaggaatgccaggtgactgagacggagtgcctgtgcccgtacgaggctttggtgctacgccgccccctgttcctggacagcatcgtgaagggaatgaaaaacctcctaaatagcacctccttggagaccagcctctccatcgaggccccatggggcgccatcaacgtgcagagcacttacaagccgactgtctccaccgccaacattgccctgagctggtcctctgtggagcaccgcgggaacaaggtgctggtcagcggccggagcgagtccatcatgaagctcgaagagaggacagggatcagctgggatctgggagttgaggacgcttccgagagcaagctcctaaccgtttccgtaatggacctgagccaaatgtacagcccggtgttcgagtatctgagcggggaccgacaggtggaggagtggcccaaggcgacctgcacgggcgactgtcccgagagatgcgggtgtacaagctccacatgccttcacaaagagtggccccacagccgcaactggcgctgcaacccgacctggtgctggggcgtcgggaccgggtgtacgtgttgcggcctggacgtgaaggacctatttacggactacatgttcgttaagtggaaggtcgagtacatcaagaccgaggccatcgtgtgcgttgagttaacctcccaggaacggcagtgctccttaatagaagcggggacccgctttaacctgggctccgtgaccatcacgctcagcgagccccggaacatccagcaaaagctcccgccagagattataacgctacaccccaagatagaggagggattcttcgatctcatgcacgtgcagaaggtactctccgctagcaccgtctgcaagctgcagtcctgcacccacggagtgcccggcgacctccaggtgtaccatatcggtaatctgctcaagggcgatcgcgtgaacgggcacctcatccacaagatcgagcagcatttcaatacgtcttggatgtcctgggacggctgtgacctggactactattgcaatatgggcgactggcctagctgcacgtataccggggtgacacagcataaccacgcctccttcgtcaatctgctcaacatcgagaccgactacacgaagactttccatttccatagcaagcgggtcaccgcccacggcgacacgccccagctagatctgaaggcccgaccgacctacggagccggtgagatcaccgtattagttgaggtcgcagacatggaactgcacaccaagaagatcgaaatctcaggactgaagttcgccggcctgacttgtacagggtgctacgcctgcagctccggtatttcctgcaaggtgcggatacacgtggatgagcccgacgaactgaccgtccatgtgaagtccgacgatcccgacgttgtcgccgcgagcagctccttaatggcccgtaagctcgagttcggtaccgacagcacatttaaggcattctccgccatgccaaaaacgtcactgtgtttttacatcgtggagcgagagtactgcaagtcctgcaataaggaggacacccagaaatgcgtgaacaccaagctggagcagccccaaagcatattgatagaacacaaggggaccatcatcggcaagcagaacaatacgtgcaccgcaaaggcgtcctgttggcttgagtcggttaaatccttcttctacggcttgaagaacatgctaggcggcatcttcggcaacgtattcataggcatcttcaccttcttaacccctttcatcctgcttatcctgtttttcatgttcggctggagaatcctattctgcttcaagtgctgccgacgtaccagggggcttttcaaatatcggcacttgaaggatgacgaggagacgggataccgcaagataatcgagcggctgaacaacaagaaggggaagaaccgcttgctggacggcgagcggctggccgaccgcaagattgccgagctgtttagcaccaagacccacatcgga

SEQ ID NO: 15368 - RNA, 3498 nt, synthetic construct
  misc_feature 1..3498: note = derived and/or modified CDS sequence (opt11) from CCHVF(CCHVF UCCR4413)__KY484038.1__Gn-NSm-Gc
  source 1..3498: mol_type = other RNA
agcgagtccagcgcctccggctgcattagccgcacgcaaatgattaagtccgagacagccgaaatccacgacgacatatacgggggccccggcgagaaactgacgatctgcaacggtaccaccgtggtcgaccagaggctcgggagcgagctgggctgctacaccatcaaccgcatcaagacgtacaagctgtgtgagaactccgttaaggagaagacctgcgagatagacagcgtgccggtcaagtgccggcagggcctctgcttgaagatcacacaggagggtcgcggccacgtgaagctgtcacggggtagcgagatcgtgctcgacatatgcgactccagttgcgagctgatgatcccgaagggcaccggcgacatcctggtagattgctccggcggccagcagcacttcctccaggacaacttagttgacctggggtgccctaacatacccctcttgggcaaggtggcgatatacatctgccgcatgtcaaaccatccgaagacgacaatggcctttctgttttggttctcctttgggtacgtcattacctgcatcctctgcaagatcctgttctatctgctcatcatcacaggcacgctaggcaagaagctgaagcagtaccgggaactcaagccccagacctgcaccatctgcgagagcacccctgtgaacgccatcgacgccgagatgcacgacctgaactgctcctacaacatctgcccctactgcgctagccgcctgacgtccgacgggctcatccggcacgtgaacctgtgtcccaagcgcaaggagaaggtcgaggagaccgagctctacctcaacctcgagcggattccctggttcgtccgcaaactgctccaggtgtcggagtcaaccggcgttgcgctgaagcgatcaagctggctcctcatcctggtcatcctgctcaccgtttctatgagccccgtccagtccgcccccatcaaccagcagcgcgccgtagaagcataccaggcgcgggagggttatacgggcatttgcctattcatcctggggtccgtcctcttcatgacttcctggctgaccaagggcctgatcgacagcatcggcgactccttcttcccggggctgttcgtgtgcaagacctgcagcatcggctccataaacgggttcgagattgagagtcaccgctgctactgctcactactctgctgcccctactgccggacgtgcagcgccgacaaagactcccaccagttgcacctgagcatctgcaagaagaaaaaggccggctctaacgtgatgctggccgtgtgcaaaaggatgtgcttcaaagccaccatcgaggcgtccaaccgggtccttctgatcaggtccatcatcaacaccaccttcatcatttgcatgctgatactggtggtctgcgtgatcagcacgagcgccgtggaaatggaggacctccccgccgggacctgggagcgggaggaggacctgacgaacttctgccaccaggagtgccaggtcacggagacggaatgtctgtgtccctatgaggccttcgtcctccgcaagccgctgttcctgtccagcatcgtgaagggcaagaagaacttactgaactccgccagcctggaaacctcgctcagcatcgaggcgccctggggcgccatcaacgcccagtccaccttcaagcccaccatcagcaccgccaacatcgccctgagttggagctccgtcgagcaccgcgggaacaaggtgctggtgtccggccggtccgagagcattatgaagctcgaggagcggaccgggatctcctggaacctgggtgtcgaggacgcgagcgagtcccggatgctgaccgtgagcgtgatggacctcagccagatgtacctgcccgtcttcgagtacctgtccggtgaccgccaggtggaggagtggcccaaggccacctgtaccggcgactgccccgagcggtgcggctgcacgagctccacatgcctccacaaggagtggccccacagccggaactggcggtgcaaccccacctggtgctggggtgtgggcaccgggtgtacatgctgcggcctggacgtcaaagacctgttcaccgactacatgttcgtgaagtggaaggtggagtacatcaaaaccgaggccatcgtctgcgtggagcttacctcccaggagcgccagtgcagcctgatcgaagcaggcacgcggttcaacctggggccggtgaccatcactctctccgagccccgcaacatccaacagaagctgcccagcgagatagtcaccttacacccgaaaatcgaagagggcttcttcgacctaatgcacgtgcaaaaggtgctttccgccagcacggtgtgcaagctgcagtcctgcacccacggggtggcgggcgacctccaggtgtaccacgtcgggaacctgctgaagggcgacaagatcaacggccacagcatccacaagatcgagccgcacctcaacacctcctggatgtcgtgggacgggtgcgacctggattactattgcaacatgggcgactggccctcctgcacctacacgggcgtaacccaacacaaccacgcagccttcgtgaacttgctcaacatcgaaaccgactataccaagagcttccatttccactccaagcgtgtcaccgcccatggcgacacgccccagctggacctgaaggcgcgccctatgtacggggccggcgagatcaccgtgctcgtggaagtcgccgatatggagctgcacagcaagaacatcgagatatccggccttaagttcgccagccttacctgcagcggatgctacgcctgttccagcggcatctcctgcaaggtgcgaatacacgtcgacgagcccgacgagctggcggttcacgtcaagagcgacgacctggacgtggtggccgcctccagctccctcatggcccgcaagatcgagttcgggaccgatagcacctttaaggcgttttccagcatgcccaaggagtccctgtgcttctacatcgtggagcgagacttctgcaagagctgcgctgccgaggatacccagaagtgcgtgaaggccaagctcgagcagccccagtccatcctcatcgagcacaagggaaccataatcgggaaacagaacgacacttgcagcaccaagacctcctgctggttggagagcttcaaatctttcttctacggcctcaagaacatgctcagcggagtgttcgggagtgccatcatgggcatcctgctgttcctcgccccgttcatcctgttgatcctcttcttcttctttgggtggcgcatcttattctgcctgcggtgttgcagacggacccgcggtctcttcaagtataagcatattaaggacgacgaggaggcggggtacaagaagatcatcgagaagctgaacaacaaaaagggagggaccagtaagctgctcgacggggagcgccttgccgaccggaaaatcgctgagctgttcagcaccaaggcccatatcggc

SEQ ID NO: 15369 - RNA, 3495 nt, synthetic construct
  misc_feature 1..3495: note = derived and/or modified CDS sequence (opt11) from CCHVF(CCHVF 66019)__AB069669.1__Gn-NSm-Gc
  source 1..3495: mol_type = other RNA
agcgaggagtccggcgatgactgcatcagccgcacccagctgctccggacagagacggccgaggtgcacggggacaactacggcgggcccggcgacaagatcaccatctgcaatgggtccaccatcgtggaccagcgcctgggctccgagctgggctgctacaccatcaaccgggtgaagtccttcaagctctgcgagaacagcgggacgggcaagtcctgcaagatcgacaacaccccggtgaagtgccggcaggggttctgcctgaagatcacccaggagggccgggggcacgtcaagctgagccgcggctccgaagtggtgctcgacgcctgcgacagctcctgcgagatcatgatccccaagggcaccggggacatcctggtcgactgcagcggcgggcagcagcacttcctgaaagacaaccttgtggacctgggctgccccaatatccccctgctcggcaagatggcgatttacatctgccggatgtccaaccacccgaagacgaccatggccttcctgttctggttcagcttcgggtacgtgatcacgtgcatcttctgcaagatcatcttctacctgctcatcgtcgtgggaaccttagggaagaagttcaagcagtaccgcgagctgaagccccagacctgcaccatctgcgagaccactcccacgaacgccatcgacgccgagatgcacgacctcaagtgctcctacaacatctgtccttactgcgccagccggctgacctccgacggcctggcgcgccacgtgacccagtgcccgaagcggaaggagaaggtcgaggagacggagctctacctgaacctggagcgcatcccctggatcgtgcggaagttgctccaggtgagcgagtccacgggggtcgccctgaagcgtagcagctggctcatcgtgctgctggtgctcctgaccgtctccctgagccccgttcagtccgcccccatcggccacggcaagaccatcgaggcctaccagaccagagaagggtacacgagcgtgtgcctcttcatgctgggcgggatcctgttcgtcgtgtcctgcctcatgaagggcctggtggacagcgtctccaacagcttcttcccggggctgtccatctgcaagacctgcagcatcggctccgtgaacggcttcgagatcgagagccacaagtgctactgctccctcctgtgctgcctgtactgccgccactgcagcgcggatcgggagatccaccagctccacctgtccatctgtaagaagcgccgggccgggggaaacgtcatgctggccgtgtgcaagcgcatgtgcctccgggccaccatggaggtcagcaacaaggtcctgttcatccgctccatcatcaacaccacgttcgtgatctgcatcctggtgctcgccgtctgcatcgtgagcacctccgcggtggagatggagagcctgcccgccgggacctgggagcgcgaggaggacctgaccaacttttgccaccaggagtgccaggtcacggagaccgagtgcctgtgcccctacgaggccctcgttctgcggaagccccttttcagcgattccatcgtgaagggcatgaagaacctcctgaacagcacctcactggagaccagcctctccatcgaggccccgtggggcgccatcaatgtacagagcacgttcaagcccaccgtgtccaccgcgaacattgccctgagctggtccagcgtggagcaccgcgggaataagatcctggtctccggccggagcgagtccatcatgaagctcgaggagcgcaccgggatcagctgggacctgggcgtggaggacgcctccgagagcaagctgctcaccgtgtccgtcatggacctgagccagatgtacagccccgtgttcgagtacctgtccggggaccgccaggtggaggagtggcccaaggccacgtgcaccggcaactgcccggaccggtgcggctgcaccagctccacgtgcctccacaaggagtggccccacagccggaactggcgctgcaaccccacctggtgctggggcgtcgggaccgggtgcacgtgctgcggcctggacgtgaaggacctgttcaccgactacatgttcgtgaagtggaaggtcgagtacatcaagaccgaggccatcgtgtgcgtggagctcaactcccaggagcggcagtgcagcctgatcgaggcggggacccgcttcaacctgggccccgtcaccatcaccctctccgagccgcggaacatccagcagaagctgcccagcgagatcataacgctgcatccccgcatcgaagagggcttcttcgacctcatgcacgtgcagaaggtgctgtccgcgagcaccgtctgcaagctgcagtcctgcacccacggggtgcccggcgacctccagatctaccacatcgggaacctgctgaagggcgaccgggtgaacgggcacctcatccacaagatcgagccgcacttcaacaccagttggatgtcctgggacggctgcgatctggactactactgcaacatgggcgactggcccagctgcacgtacaccggtgtcacccagcacaaccacgccgccttcgtgaacctgctcaacatcgagaccgactacacgaagaacttccacttccattccaagcgcgtgaccgcccacggcgacacgccccagctggacctgaaggcgcgtccaacctacggggccggcgagatcaccgtcctcgtggaggtggctgacatggagctgcacaccaagaaaatcgcaatcagcgggctgaagttcgcgtccctgacctgcaccggctgctacgcctgcagctccggcatcagctgcaaggtccgcatccacgtggacgagcccgacgagttgacggtgcacgtcaagagcgaggaccccgacatcgtggccgcctcctcctccctgatggcccggaagctcgagttcgggaccgacagcaccttcaaggcgttctccgccatgcccaagaccagcctgtgcttctacatcgtggagcgcgagtattgcgagtcctgcagcaaggaggacacgcagaagtgcgtcaacaccaagctggagcaaccgcagtctatcctcatcgagcacaagggcaccatcatcgggaagcagaacgacacgtgcaccgccaaggccagctgctggctggagtccgtcaagagcttcttctacggcctgaagaacatgctctccgggatcttcggcaatgtgttcattggcatcttccttttcctggcccccttcatactcctgatcctgttcttcatgttcgggtggcggatcctcttctgcttcaagtgctgccgccgcacccgtggcctgttcaaatacagatacctgaaggacgacgaggagagcgggtaccggcgcatcatcgaacggctcaacaacaagaagggaaagaataagctgctggacggcgagcgcctcgcggaccggcgaatcgccgagctgttctccaccaagacccacatcggg

SEQ ID NO: 15370 - RNA, 3495 nt, synthetic construct; identical to SEQ ID NO: 12084
  misc_feature 1..3495: note = derived and/or modified CDS sequence (opt11) from CCHVF(CCHVF 7001)__AB069670.1__Gn-NSm-Gc
  source 1..3495: mol_type = other RNA

SEQ ID NO: 15371 - RNA, 3495 nt, synthetic construct
  misc_feature 1..3495: note = derived and/or modified CDS sequence (opt11) from CCHVF(CCHVF 75024)__AB069671.1__Gn-NSm-Gc
  source 1..3495: mol_type = other RNA
agcgaggagtccggcgacgactgcatcagccgcacccagctgctccggaccgagacggccgagatccacggagacaactacggcggacccggcgacaagatcaccatctgcaacgggtccaccatcgtggaccagcgcctgggcagtgagatgggctgctacaccatcaaccgggtgaagtccttcaagctgtgcgagaacagcgccacgggaaagtcctgcgagatcgacagcatcccggtgaagtgccgccagggctactgcctcaagatcacccaggaggggcggggccacgtgaagctgtcccgcggtagcgaggtcgtgctggacgcgtgcgactccagctgcgaggtgatgatccccaaaggcaccggcgacatcctcgtcgactgctccgggggccagcagcacttcctgaaggacaacctgatcgacctggggtgccccagcatccccctgctgggcaagatggccatttacatctgccggatgtccaatcacccgaagacaacgatggccttcctcttctggttctcgttcggctacgtgataacgtgcatcctgtgcaaggccatcttctatctgctcatcatcgtggggaccctgggcaagcgcttcaagcagtaccgtgagctgaagccccagacctgcacaatctgcgagaccacgcccgccaacgcgatcgacgccgagatgcatgacctcaactgctcctacaacatctgcccctattgcgccagccgcctgacctccgacgggctggcccggcacgtcacgcaatgcccgaagcgcaaggagaaggtggaggagaccgagctctacctgaaccttgagcggatcccgtgggtggtccgcaagctcctccaggtaagcgagagcaccggcgtggcgctgaagcggtccagctggctcatcgtcctgctggtcctcttcgccatctccctgagccccgtgcagtccgcccccatcggtcacggaaagaccatcgagacataccaggcccgcgaggagtacaccagcatctgcctgttcgtcctcggttccatcctattcatcgtgagctgcctgatgaaggggctcgtggactccatcggaaacatcttcttcccggggctgagcatctgcaagacctgttccatcggcagcatcaacggctttgagatcgagtcccacaagtgctactgcagcctgctctgctgcccctactgccggcactgctccgccgaccgcgaaatccaccagctgcacctgagcatctgtaagaagcgtaagaccggctccaacgtcatgctcgcggtgtgcaagcgcatgtgcttccgggccacgatggaggtgagcaacaaggccctgctgatccgctccatcatcaacaccaccttcgtcgtatgcatcctcatcctggccgtctgcgtggtgtcaaccagcgccgtcgagatggagtccctgcccgcgggcacgtgggagcgcgaagaggacctcaccaacttctgccaccaggagtgccaggtgaccgagaccgagtgcctgtgcccctacgaggccctggtgctgcggcgccccctcttcctggacagcatcgtccgggggatgaagaaccagctgaactccacgagcctcgagacctccctgagcatcgaggccccctggggcgcaatcaacgtgcagtccacctacaagcccaccgtgagcacggctaacatcgcgctgtcctggagctccgttgagcaccgcgggaacaagatcctcgtgagcggccggtccgagagcatcatgaagctggaggagcgcaccgggatctcctgggacctgggggtggaggacgccagcgagtccaagctcctgaccgtcagcgtgatggacctgagccagatgtactcccccgtgttcgagtacctcagcggcgacagacaggtcgaggagtggccgaaggcgacctgcaccggggactgccccgagcggtgcggctgcacgacctccacgtgcctgcacaaggagtggccccacagccggaactggcgctgcaacccaacctggtgctggggcgtggggaccggctgcacgtgctgcggtctggacgtgaaggacctcttcaccgactacatgatcgtcaagtggaaggtggagtatatcaagactgaggccatcgtgtgcgtcgaactgacctcccaggagcggcagtgcagcctgatcgaggccggcacccgctttaacctcgggtccgtgaccatcacccttagcgagccgcggaacatccagcagaagctgccacccgagataatcacgctccacccccgcatcgaggagggcttcttcgacctgatgcacgtgcagaaggtcctgtccgccagcaccgtatgcaagctccaatcctgcacccacggggtgccgggggatctgcaggtctaccatgtgggcaacctgctcaagggggacaaggtgaacggccacctgatccacaagatcgagccccacctgaacaccagctggatgtcctgggacgggtgcgacctcgactactactgcaacatgggcgactggcccagctgcacgtacaccggggtcacccagcacaaccacgcctccttcgtgaacctgctgaacatcgagaccgactacaccaagagcttccacttccactccaagagggtaaccgcccacggcgacaccccgcagctcgacctgaaggcccgccccacctacggcgcgggggagatcacggtcctggtggaggtggccgacatggagttcacccccaagaagatcgagatcagcggcctcaagttcgcctccctgacctgcaccgggtgctacgcctgcagcagcggcatctcctgcaaggtccggatccacgtggacgagcccgatgagttgacggtgcacgtcaagagcgacgacccggacgtggtggccgcgtccagctccctcatggcccgcaagctggagttcgggaccgacagcaccttcaaggcgttctccgccatgcccaagaccagcctgtgcttctacatcgtcgagcgggagtactgcaagtcctgctcgaaggaggacacgcagaagtgcgtgaacaccaagctcgagcagccccagtccatcctgatcgagcacaagggcacgatcatcggcaagcagaacaacacgtgcaccgccaaggcgtcatgctggctggagtccgtcaagagcttcttctacgggctcaagaacatgctgtccggcatcttcgggaacctgttcatgggcatcttcctcttcctggcccccttcatactgctcatcctgttcttcatgttcgggtggcgcatcctcttctgcttcaagtgctgccgccgaacccgcggcctcttcaagtaccggcacctgaaggacgacgaggagaccggataccgccggatcatcgagcgcctgaacaacaaaaaggggaagaacaagctcctggacggcgagcggctggccgaccgccggatcgccgagctgttcagcaccaagacccacatcggg

SEQ ID NO: 15372 - RNA, 3495 nt, synthetic construct
  misc_feature 1..3495: note = derived and/or modified CDS sequence (opt11) from CCHVF(CCHVF 7803)__AB069672.1__Gn-NSm-Gc
  source 1..3495: mol_type = other RNA
agcgaggagtccggtgacgactgcatcagccgaacccagctgctccggaccgaaactgccgagatccacggggacaactacggcgggcccggagacaaaatcacgatatgcaacgggtccaccatcgtggaccagcgcctgggcagcgagatgggctgctacaccatcaaccgggttaagtccttcaagctgtgcgagaacagcgccaccgggaagtcctgcgagatagacagcatcccggtgaaatgtcgccagggctactgcctcaagatcacccaggaggggcggggccacgtgaagctctcccgtggttcagaggtcatcctggacgcgtgcgactcctcttgcgaggtgatgatccctaagggcaccggcgacatcctcgtggactgctccgggggccagcagcacttcctgaaggacaacctgatcgacttagggtgccccagcatccccctgctgggcaagatggccatctacatctgccggatgtccaaccaccctaagaccacgatggcattcctcttctggttcagcttcggttacgtcatcacgtgcatcctctgcaaggccatcttctatctgctcatcatcgtggggaccctgggcaagcgcttcaagcaataccgggagctgaagccccagacctgcacaatctgcgagaccacccccgccaacgcgatcgacgctgagatgcacgacctcaactgctcctacaacatctgcccctattgcgccagccgcctgacgtccgacgggctggcccggcacgtgactcagtgcccgaagcgcaaagagaaggtcgaggagaccgagctctacctcaacctggagcggatcccctgggtggtgcgcaagctcctgcaggtcagcgagagcaccggggtggcgctgaagcggtcctcatggctcatagttctgctggtcctcttcgctatctccctgagccctgtgcagtccgcccccatcagccacgggaagaccatcgagacgtaccaggcccgtgaagagtacacctctatctgcctgttcgtgctcggcagcatcctgttcatcgtctcctgcctgatgaagggcctcgtcgacagcatcgggaacatcttcttcccgggcttatccatctgcaagacctgcagcatcgggtccatcaacggcttcgagatcgagagccataagtgctactgttccctgctctgctgcccctactgccggcactgcagcgccgaccgcgagatccatcagttgcacctgtccatatgcaagaagcggaagacggggagtaacgtgatgctggcggcgtgcaaacgcatgtgcttccgggccacgatggaggtctccaacaaggccctgctgatccgcagcatcatcaacaccaccttcgtggtgtatattctcatcctggccgtctgcgtggtcagcacatccgcggtggagatggagagcctgcccgccgggacgtgggaacgtgaggaggacctcactaacttctgccaccaggagtgccaggtgaccgagaccgagtgcctgtgcccctacgaggccctggtcctgcggcggcccctcttcttggactcaatcgtgcggggcatgaagaacccactgaacagcacgtctctcgagaccagcttatccatcgaggccccctggggcgccatcaacgtacagagcacctacaagcccaccgtctccacggcaaacatcgccctgtcgtggtccagcgtggagcacagagggaacaagatcctcgtgtccgggcggagcgaatccatcatgaagctggaggagcgcaccggcatcagctgggacctgggggtcgaggacgcctccgagagcaaattactgaccgtgagcgtaatggacctgtcccaaatgtacagcccggtcttcgagtacctctctggcgaccgccaggttgaggagtggcccaaggctacctgcaccggcgattgccccgagcggtgcgggtgcacgaccagcacgtgcctgcacaaggagtggccccactcccggaactggcgctgcaacccgacctggtgctggggcgtggggaccggctgcacctgttgtggtctagacgtcaaggacctcttcaccgactacatgatcgtgaagtggaaggtggagtacatcaagacccgggggatcgtctgcgtcgagctgaccagccaagagcgccagtgctccttgatcgaggccggcacccggttcaaccttgggagcgtaactatcaccctgtccgagccacgcaacatccagcagaagctgccgcccgagatcatcacgttgcacccgcggatcgaggagggattcttcgacctgatgcacgtccagaaggtgctgagcgcctccaccgtttgcaagctccagagctgcacccacggggtccccggcgacctccaggtctaccacgtgggcaatctgttgaaaggggacaaggtcaacggccacctgatccacaagatcgagccccacctgaacacctcctggatgagctgggacgggtgcgacctcgactactactgcaacatgggcgactggccgtcctgcacgtacaccggggtgacccagcacaaccacgccagcttcgtgaacctgctgaacatagagaccgactacacgaagtccttccacttccacagcaagagagtcaccgcccacggcgacacgccccagctcgacctaaaggcgcggcccacctacggcgcgggggagatcacggtgctggtggaggtggccgacatggagttcacccccaagaagatcgagatctccggcctaaagttcgccagtctgacctgcaccgggtgctacgcctgcagctccggcatctcctgcaaggtacgcattcacgtggacgagccggacgagctgacggtccacgtgaagtccgatgaccctgacgtggtcgccgcgagctccagcctaatggcccggaagctggagtttgggaccgactccacgttcaaggctttttctgccatgcccaaaacctccctgtgcttctacatcgtggagcgcgagtactgcaagagctgctccaaagaggacacgcagaagtgcgtgaacaccaagctcgagcaaccccagagcatcctgattgagcacaagggcaccatcatcggcaagcagaacaatacgtgcacggccaaggcgtcctgctggctggagtctgtcaagtccttcttctatgggctcaagaacatgctgagcggcatcttcgggaacttcttcatgggcatattcctgttcctcgccccgttcatcctgctgatcctcttcttcatgttcgggtggcgcatcttgttctgcttcaagtgctgtaggcgcacccggggcctcttcaagtaccgccacctcaaggacgacgaggagaccggctaccggcgcatcatcgagcggctcaacaacaagaagggaaagaacaagctcctcgacggcgagcgccttgccgaccgccgcatcgccgagctgttttccaccaagacccacatcggg

SEQ ID NO: 15373 - RNA, 3495 nt, synthetic construct
  misc_feature 1..3495: note = derived and/or modified CDS sequence (opt11) from CCHVF(CCHVF 79121)__AB069673.1__Gn-NSm-Gc
  source 1..3495: mol_type = other RNA
gctgagggcggtagctccgattgtatctcccgcacccaactcgtgaagacagaagtcgccgagatccatgaggactcctacggcgggcccggcgagaagatcacgatctgcaacgggagtacaatcgtggatcagggcctcggctccgagctggggtgctacaccatcaatcgggtgcgcagctacaaactgtgcgagaactccgcgagcggcaagtcgtgcgagatcgactcaatcccggtcaagtgcaagcaggggttctgcctcaaaatcacccaagaggggcgggggcacgttaagctgtccagaggcacggaaatcgtgctggacgtgtgcgatagctcctgcgagctcatgattcccaagggcaccggggacattttggtggactgctcgggcgggcaacagcatttcctgcagaacaacttgatcgacctgggctgccccaatgtgcccctgcttggcaagatggccatttacgtctgccggatgtcaaaccacccgaaaaccaccatggccttcctgttctggttcagcttcgggtacgtaatcacgtgcatcgcctgccgagtgctgttctacctcctcatcgctatcgggaccgttgggaagaagctcaagcagtatagggagttgaagccccaaacctgtatcgtttgcgagtcagtgccagtcaacgcgatcgacgccgagatgcacgagctgaactgcagctacaacatctgcccctattgcgcgtcccgtttgagcacggacggactcatccggcacgtgacgcagtgccctaagcgccgggagaaggtggaggaaaccgagttattcctgaacctcgagaggataccctggctagtccggaagctgctccaggtgagcgagtccactggaatggccctgaagcgctcttgctggatgatcaccctgctcatactgctgctcgtatccatcagccccgttcagtccgcgcccgtaggcaaggagcgggccatcgagacgtaccaggcccgcgaaacctacaccggcatctgccttttcgtgctggggagcgtcctcttcgcagtgtcctggctgactaaggccctgatcgacggcatcgggaacagcttctccccgggcctctccgtatgcaagacgtgctccatcgggagtatcaacggcttcgagatcgagtcccacaagtgctattgtagcttgttctgttgcccctactgcagggcgtgctccagcgacaaaaacacccacagaatgcacctgaatgtgtgcaagaagcgaaagatgggctccaacgtcatgctcgcagtctgcaagcgcatgtgcttccgcgccaccatcgaggctagcaacaaggccctactgatcaggtccatcatcaatagcaccttcgtgatctgcatactcatcctgacgatctgcgtggtgtcaacctccgcggtggacatggagaacctgcccgccggaatctgggaaaaggaggaagacctcaccaatttctgccatcaggagtgccaggtcaccgagacggagtgcctttgcccatacgaggccatggtcttgcgcaagccgctgttcctagacagcaccgcgaagggcatgaaatccctgcttaacagcacctccctcgagaccagcctgtccatcgaggcgccgtggggcgcgatcaacgtccagagcacgttcaagcccacggtgtccgccgccaacatcgccctgagctggtcctcagtggagcaccgggggaacaagatccttgtgtccgggcgtagcgagtcaatcatgaaattagaggaacgtaccggcgtgagctggaacctgggcgtagaggacgcctccgagagcaagaccttaacggtgtcggtgatggacctgtctcagatgtacagccccgtctttgagtacctctccggtgaccgccaggtggaggagtggccaaaggcgacctgtaccggcgactgccccgagcggtgcgggtgcacgtcctccacgtgcctccataaagagtggcctcatagccgcaactggcgttgcaacccgacctggtgctggggtgtggggaccgggtgcacttgctgcggcctggacgtaaaggacttcttcaccgactacatgctagtgaagtggaaggtagagtacatcaagaccgaggcgattgtctgcgtagaactcacctcacaggagcgccagtgcagcctgatcgaagcaggcacccggttcaacctgggcccggtgaccatcacgctctccgaaccccgcaacgtccagcaacggctaccgcccgagatcgtgaccctgcaccccaagatcgaggaggggtttttcgatctcatgcacgtgcagaagatcctgagcgcctccaccgtatgcaagctgcagagctgtacccacggcgtccccggcgacttccagatctaccatgtggggaacctcctgagaggcgacaaggtgaacgggcactccatccacaaaattgaaccccacttcaacactagctggatgtcctgggacggctgcgatctggattacttctgcaacatgggggactggccgagctgcacctacaccggcgtgacccagcacaatcgggcggcctttattaatatgctcaacatcgaaacggactacaccaaaacgttccatttccactccaagcgcgtaaccgcccacggagacacgccgcaattagacctgaaggcacgtcccgcctacggggcaggagaggttaccgtcttggtggaggtagccgacctcgagctccataccaagaacctcgaggtgtcagggctgaagatcgcctccctgacctgtagcggctgttatgcctgtagttccggtatctcgtgcaaggtgcgcatccacgtcaacgagcccgacgagttcactgtgcacgtgcggtcctcagaccctgacgtcgtagccgccggctccagccttatggctcgcaagatcgagttcggcgccgactccaccttcaaggccttcagctccatgcccaaagacagcctgtgcttctacatcgtggagaaggattactgctccagctgcacggacgacgacacccagaaatgcgtcaacacgaagctggaccacccccaatccatactcatcgaacacaaggggaccattatcggcaagcagaacgacacgtgtagcaccaagacatcatgctggctggagagcgtgaaggggttcttctacggcctgaagaatatgctctccgggatcttcggcaacgtgttcctgggcatcttcctgttccttgccccctttgtcctgctgatcttcttcttcttctttggatggcgcctcctgttttgccttaagtgctgccgccgcacccggggcctcttaaaatacaaacacttgaaggacgaagaagaggcggggtacaagaagatcatcgagcgactcaacggcaaaaagggaaagagccaattattcgacggggagcgcctggccgaccgcaagatagctgagttattctccacgaagattcacatcggc

SEQ ID NO: 15374 - RNA, 3495 nt, synthetic construct
  misc_feature 1..3495: note = derived and/or modified CDS sequence (opt11) from CCHVF(CCHVF 8402)__AB069674.1__Gn-NSm-Gc
  source 1..3495: mol_type = other RNA
agcgaagaatccggcgacgattgcatctccagaacccaattactcaggaccgagacagcggaaatacacaatgacaactacggcggacccggcgacaagataacgatatgcaatggaagcacagtcgtcgaccagcgcctggggtccgaattagggtgctacacaataaaccgggttaagagcttcaaactgtgtgaaaacagcgcaaccggcaaaagctgcgaaatagacagcaccccagttaaatgccgccagggcttctgtctaaaaatcacgcaagaaggccgcggtcacgtaaaactttcccgcggctcagaagtcgtcctcgacgcatgcgacagctcctgcgagataatgatccctaagggaaccggcgatatcctcgtggactgcagcggcggtcaacaacactttctcaaggacaacctcatcgaccttggctgtcccaacatcccccttctcggcaagatggcaatctatatatgccgcatgtcaaaccacccgaaaacaacaatggcttttctcttctggttctccttcggctacgtcgtaacttgcattttatgcaaagtaatattctatttactcatagttgtcggaacactaggcaagaaatttaaacaataccgtgaactaaaaccgcaaacgtgcacgatatgcgaaacgacaccagtgaacgccatcgacgcagaaatgcacgatctaaactgctcctacaacatctgtccatattgcgccagccgcctgacgtctgatggtctcgccaggcacgttatgcaatgcccaaaaaggaaagagaaaatcgaagaaaccgaactctacctcaacctagaacgaatcccgtgggtcgtccgaaagctcctacaagtatcggaatcgacaggagtagccctcaaacgctcatcttggctcgtagttctcctagtactcctaacagtctccctaagccccgtgcaatcagcacccataggacacgggaaaacagtcgagacctatcaaacccgagaaggatacacatcgatttgcctcttcgtcctcggcagtatcttattcatcgtcagctgcctgatgaagggcctggtcgactccgttggaaacagcttctttccgggattaagcatctgcaaaacatgctccatcggctcagtgaacggattcgagatagaatctcataaatgctactgctctctattctgctgcccgtactgccgacactgctcagcagacagagaaattcaccgcctccacctctccatctgcaagaagcgcaaaacggggtcaaacgtcatgctagccgtttgcaaacggatgtgctttcgggcaacagtagaagtatccaacaaagccctactgatccgaaacatcatcaataccacattcgtgctctgcatcctaatactagcagtctgtgtcgtgagcacctcagcggtagaaatggaaagcctgcccgccggaacctgggaacgagaggaggatctcacgaacttttgccaccaggaatgccaagtaacagaaaccgaatgcctctgcccctacgaagcgctagtattaagaaagcccctcttctccgactcaatcgttaaaggaatgaaaaatctgttaaattccacatccctggaaacctcgctcagtatagaggctccgtggggagccatcaacgtgcaatccaccttcaaacccaccgtttcagcagccaacatcgccctaagctggtcaagcgtagaacacagaggtaacaagatcctcgtctctgggcgctcggaatccattatgaaactggaggaacgaaccggcatcagctgggacctcggggtcgaagatgcaagcgaatcaaagctactcacagtgagtgttatggacctgtcacaaatgtacagtcctgtgttcgagtacctctcaggcgaccgacaagtcgaagagtggccaaaagccacatgtacaggcgactgccctgagcggtgcggctgcaccagttctacctgcctccataaagaatggccacacagccgtaactggcggtgcaaccccacgtggtgctggggcgtaggtaccggctgcacatgctgcgggctagacgtcaaggacctattcaccgactacatgttcatcaaatggaaagtcgaatacattaaaactgaagccatagtctgcgtagagctcacctcccaagagcgccaatgcaccctgatcgaggcaggcacacgcttcaacctgggcccagtaaccataacactctccgaaccccgaaacatccaacaaaaactaccacccgaaatcgtaaccctacacccccgcatagaagaaggcttcttcgacctaatgcacgtgcaaaaagtcctaagcgcatctaccgtgtgcaaactgcaatcatgcacacacggagttcccggagacctgcaggtataccacataggaaatctccttaaaggagataaagtcaacggccacctcatacacaaaattgaaccccacttcaacacctcgtggatgtcttgggacggatgcgatctagactactactgcaacatgggagactggcccagctgcacatacacaggcgtaacccaacataaccacgccgcattcgtaaacatgctaaacatcgaaaccgactacaccaagaacttccacttccacagcaaacgcgtgaccgctcacggggacacaccccaactggacctaaaagcccgacccacctacggagctggcgaaataaccgtgctcgtcgaggtcgccgacatggagctgcatacaaagaaaatagaaatctcaggcctcaaattcgccagcttgacttgcacgggctgctacgcatgctcctccggaatctcctgcaaagtaagaatccacgtcgacgaacccgacgaactgacagtgcacgtcaaaagtgaggatcctgacatcgtagcagcctcctcttcgctcatggcacgaaaactggaatttggtacagactcgacgttcaaagccttctcagccatgcctaaaacatccctatgcttttatatagtggaacgcgaatactgcaaaagctgctccaaagaagacacccaaaaatgcgtaaacacgaaactggaacaaccccaaagtatactgatcgaacacaaaggaacaataataggcaaacagtccaacacttgcaccgcaaaggcctcctgctggctagaaagtgtaaaatcgtttttctatggcctcaaaaacatgctatccggcatctttggaaacgtcttcatcggcgtcttcctcttctttgccccctttatccttctcatcctattcttcatgttcggatggcgcatactcttttgcttcaaatgctgccgcagaaccagaggcttattcaaataccgccatctcaaagacgacgaagaaacaggttaccgcaagatcatcgagagattaaacaataagaagggcaaaaacaaactactcgacggcgaacgactcgccgaccggaaaattgcagagctgttctcaactaaaacacacataggg

SEQ ID NO: 15375 - RNA, 3495 nt, synthetic construct
  misc_feature 1..3495: note = derived and/or modified CDS sequence (opt11) from CCHVF(CCHVF 88166)__AB069675.1__Gn-NSm-Gc
  source 1..3495: mol_type = other RNA
tcggaggagtccggcgacgactgcatcagccgcacacagctgctccggaccgagacggccgagatccactccgacaactacgggggccctggggacaagatcaccatatgcaacggcagcacggtggtcgaccagcgcctcggatccgagctgggctgctacaccattaaccgggtcaagagcttcaagctctgtgagaactcggctacgggcaagagctgcgagatcgactcaaccccggtgaagtgcagacaggggttctgcctgaagatcacccaggagggccgggggcacgtgaagctgagccgcggttccgaagtggtgctcgacgcgtgcgacagctcctgcgagatcatgatccccaaggggaccggagacatcctggtcgactgcagcggcgggcagcagcacttcctgaaggacaacctcatcgaccttggatgccccaatatccccctactcgggaagatggccatctacatctgccggatgtccaatcacccgaagacgaccatgggcttcctgttctggttcagcttcggctacgtagtcacgtgcatcctgtgcaaagtcatcttctacctcctgatcgtggtggggaccctgggcaagaaattcaagcagtaccgcgagctcaaaccccagacgtgcaccatatgcgagaccacccccgtcaacgccatcgacgccgaaatgcacgacctgaactgttcctataacatatgtccctactgcgccagccggttaacgtccgacgggctcgctcgccacgtgatgcagtgtccgaagcggaaggagaagatcgaggagaccgagctgtacctgaacctcgagcggatcccctgggtggtccggaaacttctccaggtgagcgagagcaccggcgtggccctcaagcgctccagctggctggtcgtgctgctcgtgctcctgacggtctccctcagccccgtgcagtccgcccccatagggcacggcaagacggtggagacctaccagacccgggagggctacactagcatctgcctgttcgtcctggggtccatcctcttcatcgtgagctgcctcatgaagggcctggtcgactccgtggggaactctttcttcccgggcctctccatctgcaagacgtgtagcatcgggtccgtgaacggctttgagatcgagagccacaagtgctactgcagtctgttctgctgcccctactgccgccactgcagcgccgaccgggagatccaccgcctgcacctctccatctgcaagaagcggaagacctggagcaacgtcatgctggcggtgtgtaagcgcatgtgcttccgggctaccgtggaggtttccaacaaggcactgctcatccgcaacataatcaacaccacgttcgtactgtgtatcctgatactcgcggtgtgcgtcgtcagtaccagcgccgtggagatggagtccctgcccgccggcacctgggagcgcgaagaggacctgaccaacttctgccaccaggagtgccaggtcacagagaccgagtgtctgtgcccctacgaggccctcgtgttgagaaagccgctgttcagcgactccatcgtcaaaggaatgaagaacctcctgaacagcacctccctggagaccagcctctccatcgaggccccctggggcgccatcaacgtccagagcacgttcaagccaaccatgtcggccgcgaacattgccctgagctggtccagcgtggagcatcgcgggaacaagatcctggtgtccggccgaagcgagtccatcatgaaactcgaggaacgcaccgggatcagctggaacctgggcgtcgaggacgcctccgaaagcaagctgctcaccgtgagcgtgatggacctgtcccagatgtacagccccgtcttcgagtacctgtccggcgaccgccaggttgaggagtggccgaaagcgacctgcacgggcgattgccccgagcggtgcggctgcaccagctccacatgtttgcacaaggagtggccccacagccggaactggcgctgcaaccccacctggtgctggggcgtcggtacgggctgcacgtgctgcgggcttgacgtcaaggacctgttcaccgactacatgtttatcaagtggaaggtggagtacatcaagaccgaggccatcgtgtgcgtcgagctcacgagccaagagcggcagtgcaccctgatcgaggccggcacccgctttaacctggggccggtgaccataacgctcagcgagccccggaacatccagcagaagctgccgcccgagatcgtgaccttacacccccgcatcgaggagggcttcttcgacctcatgcacgtgcagaaggtgctgtccgcctcgaccgtgtgcaagctgcagtcctgcacccacggggtccccggcgacctccaggtgtaccacattggcaacctgctgaagggggacaaggtgaacggccacctcatccataagatcgagccccacttcaacacgagctggatgtcctgggacgggtgcgacctggactactactgcaacatgggcgactggccgagctgcacctacaccggggtcacccagcataaccacgccgccttcgtgaacatgctaaacatcgaaacagactacaccaaaaacttccacttccactccaagcgggtgaccgcacacggcgacacgccccagttagacctgaaggcgcgccccacctacggcgccggcgagatcaccgtcctggtcgaggtggccgacatggagctccacaccaagaagatcgagatcagcggcctcaagttcgcctccctgacctgcacggggtgctatgcgtgcagctccggcatcagctgcaaggtcagaatccacgtggatgagccagacgagctgaccgtgcacgttaagagcgaggacccggacctggtggccgcctccagctccctgatggcccgcaagctcgagttcggcaccgacagcaccttcaaggccttctccgccatgcccaaaacgagcctgtgcttctacatcgtggaacgggagtattgcaagagctgcagcaaggaggacacccagaagtgcgtcaacaccaagctggagcagccccagtccatcctcatcgagcacaagggcaccatcatcggcaagcagaacaacacgtgcaccgccaaggccagctgctggctggaatccgtcaagagcttcttctacgggctaaagaacatgctctccggcatcttcgggaacgttttcatcggcgtgttcctgttcttcgcccccttcatcctgctcatcctgttcttcatgttcgggtggcgcatcttattctgcttcaagtgctgccggcgcactcgcggcctcttcaagtaccggcacctcaaggacgacgaggagaccggctaccgcaagatcatcgagcggctgaacaacaagaagggcaagaacaagctcttagacggagagcggctggccgaccggaagatcgcggagctgttcagcactaagacgcacatcgga

SEQ ID NO: 15376 - RNA, 3495 nt, synthetic construct
  misc_feature 1..3495: note = derived and/or modified CDS sequence (opt11) from CCHVF(CCHVF BA88166)__AF338470.1__Gn-NSm-Gc
  source 1..3495: mol_type = other RNA
agcgaggagtccggcgacgactgtatcagccgcacacagctcctccggaccgagacggcagagatccactccgacaactacggcgggcccggggataagatcaccatctgcaacgggagtaccgtggtcgatcagcgcctggggtccgagctcggctgctacaccatcaaccgggttaagagtttcaagctctgcgagaactccgccacgggcaagagctgtgaaatcgattccaccccggtgaagtgccgccaggggttctgcttgaagatcacccaggagggtcggggacacgtaaagctgagccgcggcagtgaagtggtgctcgacgcgtgcgacagctcatgcgagatcatgatccccaaggggaccggcgacatcctggtcgactgcagcggcgggcagcagcacttcctgaaggacaacctcatcgacctgggctgtccaaacatccccctactcgggaagatggccatctacatctgccggatgagcaaccaccccaagacgaccatgggattcctgttctggttcagcttcggctatgtggtgacctgcatcctgtgcaaggggatcttctacctcttgatcgtcgtgggtaccctagggaagaagttcaagcagtaccgcgaactcaagccccagacgtgcaccatctgcgagacaacccccgtgaatgccatcgacgccgagatgcacgacctcaactgctcttacaacatctgcccttactgcgccagccggttgacgtccgacggcctcgcgcgccacgtcatgcagtgcccgaagcggaaggagaagatcgaagagaccgagctgtatctcaacctcgagcgcatcccttgggtggtgcggaagctgctgcaagtcagcgagtcgacgggggtggctctcaagcgctcctcatggctcgtggtcctactggttcttctgaccgtctcgttgagccccgtccagtccgcccccatcggccacggcaagacggtagagacctaccagacccgggagggctacaccagcatctgtttattcgtgttgggcagtattctcttcatcgtcagctgtctgatgaaggggctggtggactccgtcggcaacagcttcttcccggggctctcaatctgcaagacgtgtagcatcggctccgtgaacggcttcgagatcgagagccacaagtgctactgcagtctgttctgctgcccctactgtcgccactgtagcgccgaccgggaaatccaccgcttacacctgtccatctgcaagaaacgtaagacctggtcaaacgtgatgttggcagtctgcaagcgcatgtgcttccgggccaccgtggaagtgtccaacaaggccctgctgatccgcaacatcatcaacaccacgttcgtcctgtgcattctgatcctcgccgtgtgcgtggtcagcacgagcgccgtggagatggagtccctgcccgcggggacgtgggagcgcgaggaggacctgaccaacttttgtcaccaggaatgccaagtgacggaaaccgagtgcctgtgcccctacgaggccctcgtgctgagaaagccgctgtaccttgacagcatcgtgaagggcatgaaaaacctgttgaactccacaagcctcgagacctcattaagcatcgaggccccctggggcgccatcaacgtgcagtccacgttcaagccgacaatgagcgccgctaatatagccctgtcctggagctccgtcgagcaccgcgggaacaagatcctcgtcagcgggcggtccgagagcatcatgaagctggaggagcgcaccggcatttcctggaacctgggcgtagaggacgccagtgagtcaaagctcctgaccgtcagcgtgatggacctgagccagatgtattcccccgtgttcgagtacctcagcggggaccggcaggttgaggagtggccgaaggcgacatgcacgggcgactgtcccgagcgctgcggatgcacctcctccacgtgcttgcacaaggagtggccgcacagccggaactggcgctgcaaccccacttggtgctggggtgtgggcaccgggtgtacctgctgcggcctggacgtgaaggaccttttcaccgactatatgttcatcaagtggaaggtcgaatacatcaagaccgaggccatagtctgcgtggagctgacaagccaggagcggcagtgcaccctgatcgaggccgggacccgcttcaacctcggaccggtcataatcaccctgtccgagccccggaacatccagcagaaacttccgcccgagatcgtgacgctccaccccaggatcgaagagggtttcttcgacctgatgcacgtgcagaaggtcctgagcgcctccaccgtgtgcaagctccagagctgcacgcacggcgtgccaggcgacctgcaggtctaccacatcgggaacctgttaaagggcgacaaagtgaacggtcacctgatccacaagatcgagccccacttcaacacgtcctggatgagctgggacggctgcgacctggactactattgcaacatgggggactggccttcctgcacgtacaccggcgtgacccagcacaaccacgctgccttcgtgaacatgctcaatatcgagaccgactacacgaaaaattttcacttccacagcaaaagggtgaccgcccacggcgacacgccccagctggacctgaaggcgcgccccacctacggggcgggcgagatcaccgtactcgtcgaggtggccgacatggagttacacacgaagaagatcgagatatccggcctgaaattcgccagcctgacctgcaccggctgctacgcgtgcagtagcgggatctcctgcaaggtgcggatacacgtcgatgagcccgatgagctgacggtgcacgttaagagcgaggacccggatatagtggccgccagctccagcctgatggcacgcaagctcgagttcggcaccgactccacattcaaggccttttccgcgatgcccaagacatccctgtgcttctacatcgtggaacgggagtattgcaagagctgctccaaggaggacacgcagaagtgcgtgaacaccaagttggagcagccacagtctatactcatcgagcacaagggcaccataatcgggaagcagaacaacacgtgcaccgccaaggcctcctgctggctggagagcgtaaagtccttcttctacggcctgaagaacatgctcagcgggatcttcggtaacgtgtttatcggggtgttcctgttcttcgcccccttcatactgctcatcctgttcttcatgttcggctggcgcatcctgttttgcttcaagtgctgccgccgcacccgcggcttgttcaagtaccggcacctaaaggacgacgaggaaacaggataccgcaagatcatcgagcggctgaacaataagaagggcaagaacaagctcctggacggagagcgcctggccgaccggaagattgccgagctcttttccaccaagacccacatcggc

SEQ ID NO: 15377 - RNA, 3495 nt, synthetic construct
  misc_feature 1..3495: note = derived and/or modified CDS sequence (opt11) from CCHVF(CCHVF BA66019)__AF350448.1__Gn-NSm-Gc
  source 1..3495: mol_type = other RNA
tctgaggagtccggcgatgactgcatcagccgcacccaactgctccggaccgagacggccgaggtgcacggggataactacggcgggccgggcgacaagatcaccatctgcaacgggtctacgatcgtcgaccagcgcctgggcagcgaactgggctgctacaccatcaaccgggtgaagtccttcaagctatgcgaaaacagcgggactggcaagtcctgcaagatcgacaagcacccggtgaagtgccgccagggattctgcctgaagatcacccaggagggccgggggcacgtcaaactgagccgcggctcggaggtggtgctcgacgcctgcgacagctcctgcgaaatcatgatccccaagggaaccggggatatcctggtcgactgtagcggcgggcagcagcacttcctaaaggacaacctcgtggatctcggctgcccaaacatccccctgctcggcaagatggctatctacatctgcagaatgtccaatcacccgaagaccacaatggccttcctgttctggttcagcttcgggtacgtgatcacgtgcatcttctgcaaaatcatattctacctgctcattgtcgtgggcaccctggggaagaagttcaagcagtaccgagagctgaagccccaaacctgcaccatctgcgagaccacccccacaaacgccatcgacgctgagatgcacgacctcaagtgctcctacaacatctgcccctattgtgccagcagattaacgtcggacggcttggcgcgccacgtgacccagtgcccgaagcgcaaggagaaagtcgaggagaccgagctctacctgaacctggagcgcatcccctggatcgtgcggaagctcctccaggtgagcgagtccaccggggtcgccctgaagagaagcagctggctcatcgtgctgttagtgctcctgacggtctccctgagccccgtacagtccgccccgatcggccacggcaagaccatcgaggcctaccaaacccgggaggggtacaccagcgtgtgcctcttcatgcttggagggatcttgttcgtcgtgtcctgcttgatgaagggcctggtggacagcgtctccaacagcttcttcccggggctaagtatctgcaagacgtgcagcatcggatccgtgaacggcttcgagatcgagtcgcacaagtgctattgctccctcctgtgctgcctgtactgcaggcactgcagcgcggatcgggagatccaccagctccatctgtccatctgcaagaagcgccgggccgggggcaatgtcatgctggccgtgtgcaagcgcatgtgcttacgggccaccatggaggtgagtaacaaggtcctgttcatccgctccatcatcaacaccaccttcgtcatctgcatcctcgtgctcgccgtgtgcatagtcagcacgtccgcggtggagatggagagcctacccgccgggacatgggaacgtgaggaagacctgaccaacttctgccaccaggagtgccaggtcaccgagacggagtgcctgtgcccctacgaggccctcgtgctgcggaagcccctgttcagcgactccattgttaagggcatgaagaacctcctgaacagtacctccctggagaccagcctctccatcgaggccccgtggggcgccatcaacgtccagagcaccttcaagcccacggtgtccaccgcgaacatcgccctgagctggtccagcgtggagcacagggggaacaaaatcctggtctccggccggagcgagtcaataatgaagctcgaggagcgcaccgggataagctgggacctgggcgtggaggacgcgagcgagagcaagctgctcaccgtgtccgtcatggacctgagccagatgtactcccccgtgttcgagtacctgtccggggaccgccaagtggaggagtggcccaaggcgacctgcaccggcgactgcccggaccggtgcggctgcaccagctccacgtgcctccataaagagtggccccactcgcggaactggcgctgcaatcccacctggtgctggggcgtcgggaccgggtgcacgtgctgcggcctggacgtgaaggatctgttcaccgactacatgttcgtgaagtggaaggtcgagtacatcaagaccgaggccatcgtgtgcgtggagctcaattcccaggagcggcagtgtagcctgatcgaggcggggacccgcttcaacctgggccccgtcaccatcaccctatccgagccgcgcaacatccagcaaaagctgccgcccgagatcatcaccctgcacccccgcatcgaggagggcttcttcgacctcatgcacgtgcagaaggtgctgagcgcctccacggtctgtaagctgcagagctgcacccacggggtgcctggcgacctccagatctaccacatcggcaacctgctgaagggcgaccgggtgaacggacacctcatccacaagatagagccccatttcaacacctcttggatgagctgggacggctgcgacctggactactactgcaacatgggcgactggccctcctgcacctacacaggggtcacccagcacaatcacgccgccttcgtgaacctgctaaacatcgagaccgactacaccaagaacttccacttccacagcaagcgcgttacggctcacggcgacacgccgcagctggacctgaaggcgcgacccacctacggggctggcgagatcaccgtcctagtggaggtggccgacatggagctgcacacgaagaagatcgccatttccgggctgaagttcgctagcctgacctgcaccggctgctacgcctgctccagcggcatatcctgcaaggtccgcatccacgttgatgagccagacgagttaaccgtgcacgtcaagagcgaggaccccgatattgtggcggccagctccagcctcatggccagaaaactcgagttcgggacggactccaccttcaaggcgttcagcgccatgccgaaaacttccctctgcttctacatcgtggagcgcgagtactgcgagagctgttccaaggaggacacccagaagtgcgttaacacgaagctggagcagccccagagcatcctcatcgagcacaaaggcaccattatcgggaaacagaacgatacgtgcaccgccaaggcctcctgctggctggagagcgtgaagtccttcttctacggcctgaagaacatgctctctgggatcttcggaaacgtgttcatcggcatcttcctgttcctggcccccttcatcctcctgatcctgttcttcatgttcgggtggcggatcctattctgtttcaagtgctgccgccgcacccggggcctgtttaagtaccgctacctgaaggacgacgaggagtccgggtaccggcgcattatcgagaggctcaacaacaagaagggcaagaacaagctgctggacggcgagcgcctcgcggaccggcgcatcgccgagctgttcagcactaagacccacatcggg

SEQ ID NO: 15378 - RNA, 3495 nt, synthetic construct; identical to SEQ ID NO: 12092
  misc_feature 1..3495: note = derived and/or modified CDS sequence (opt11) from CCHVF(CCHVF BA8402)__AF350449.1__Gn-NSm-Gc
  source 1..3495: mol_type = other RNA

SEQ ID NO: 15379 - RNA, 3495 nt, synthetic construct
  misc_feature 1..3495: note = derived and/or modified CDS sequence (opt11) from CCHVF(CCHVF Matin)__AF467769.2__Gn-NSm-Gc
  source 1..3495: mol_type = other RNA
agcgaggagtccggcgacgactgcatcagccgcacccagctgctccggaccgagacggccgagatccactccgacagctacggcggccccggagacaagatcaccatctgcaacggctcgaccgtggtcgaccagcgcctggggagcgagctaggctgctacaccatcaacagagtgaagtccttcaagctctgcgagaacagcgccacgggtaagtcctgcgagatcgactccaccccggtgaagtgtcgccaggggttctgcctgaagatcacccaggagggccggggccacgtcaagctgtcccgcggcagcgaggtggtacttgacgcgtgcgactcctcatgcgagatcatgatccccaaggggaccggcgacatcctggtcgactgctccggcgggcaacagcacttcctgaaggacaacctcatcgacctcggctgcccaaacattcccctgctcgggaagatggccatctacatctgccggatgagcaaccatccgaagacgaccatggtgttcctgttttggttctccttcggctacgtgatcacgtgcatactgtgcaaggtcatcttctatctcttaatagtggtgggcaccctggggaagaagttcaaacagtaccgcgagctcaagccacagacttgcaccatatgcgagaccaccccggtcaacgccatcgacgccgagatgcacgacctgaactgcagctacaacatctgcccttactgcgcctcccggctgacgagcgacggcctagcacgccacgtgatgcagtgcccgaagcggaaggagaagatcgaagagaccgaactgtacctgaacctcgagcgcatcccctgggtggtccggaagttgctccaggtgtctgaatccaccggcgtcgcgctcaagcgcagcagctggttagtcgtgctgttggtgctgctgaccgtcagcctctcgcccgtgcagagcgcccccatcggccacgggaagacggtggagacctaccagatccgggagggctacacctccgtctgcctgttcgttctgggcagcatcctcttcatcgtgtcctgcctgatgaaggggctggtggacagcgacggcaactccttctttccggggttaagcatctgcaagacatgctccatcggcagcatcaacgggttcgagatcgaatcccacaagtgctattgcagcctgttctgctgcccctattgccgccactgctccacggaccgagagatccacaagctgcacctcagcatctgcaagaagcgcaagaccggcagcaacgtcatgttggccgtctgcaagcggatgtgtttccgcgcgaccgtggaagtgtcaaacaaggccctgctaatccggtctatcatcaacaccacgttcgtcgtgtgcatccttattctggccgtgtgcgtcgtgtccacctcggccgttgagatggagtccctccccgccggcacctgggagagagaagaggaccttataaacttctgtcaccaggagtgccaggtcaccgagaccgagtgcctgtgcccctacgaggcgctggtgctccgtaagccgcttttcctggacagcatcatcaaggggatgaagaacctcctgaactccaccagcctggagacgtccctcagcatcgaggccccctggggcgccataaacgtgcagtccaccttcaagcccacgatgagcgccgccaacatcgcgctgtcctggagctccgtcgagcaccgggggaacaagatcctggtgagcggccgctccgagagtatcatgaagctcgaggagcgcacagggatatcctgggacttaggcgtggaggacgccagcgaaagcaagctgctcaccgtctccgtgatggacctgagccagatgtactcccctgtgttcgaatatctgagcggcgaccgccaggtcgaggagtggccgaaggccacttgtaccggggactgccccgagcggtgcggctgtacgtccagcacctgtctccacaaggagtggccccactcccgtaactggcggtgcaaccccacctggtgctggggcgtggggaccggctgcacgtgctgcgggctggacgtgaaggacctgtttaccgattacatgttcgtcaagtggaaggtggagtacatcaaaaccgaggtgatcgtctgcgtggaactcaccagccaggagcgccagtgctccctgatcgaggccggcacgcggttcaacctggggccggtcaccatcaccctcagcgagccccgcaacatccagcagaagctgccgcccgagatcgtcactctgcacccccgtatcgaggagggcttcttcgacctcatgcacgtgcagaaggtgctgtccgccagcacggtctgcaaactgcagtcctgcacccatggggtgcccggcgatctccaggtgtaccacatcggcaaccttctgaagggggacaaggtcaacggccacctcatccataagatcgagccccacttcaataccagctggatgtcctgggacgggtgcgacctggactactactgcaacatgggcgactggccgagctgctcctacaccggggtgacgcaacacaatcacgcggcgttcgtcaacatgttgagcattgagaccgactacaccaagaacttccacttccactccaagcgcgtcaccgcccacggcgacacgccccagctcgacctgaaggcccggcccacctacggtgccggcgagatcaccgtgctggtggaggtcgcggacatggagctccataccaagaagatcgagattagcggcctgaagttcgccagcctcacgtgcaccgggtgctacgcctgctccagcggcatctcctgcaaagtgcgcatccacgtggacgaacccgacgagctcaccgtccacgtaaagagtgaggatccggatatcgtggccgcgtcgagctccctgatggcccggaagctggagttcgggaccgacagcacgttcaaggccttctccgccatgcccaagaccagcctctgcttctacatagtcgagcgcgagtactgcaaatcctgcagcaaggaagacacccaaaaatgcgtgaacaccaagctggagcagccccaatccatcctgatcgagcacaagggcacgatcatcggcaaacagaacgatacctgcaccgccaaggcgtcttgctggctcgagtcagtcaagagcttcttctacggcctaaagaacatgttgtccggcatcttcgggaacgtgtttatcggcatcttcctcttcttagccccattcgccctgctcatcctgttcttcatgttcgggtggcggatcctgttctgctttaagtgctgccgccgcacccgcggcctctttaagtaccgccacctgaaggacgacgaggagaccggctaccggaagatcatcgagcgcttaaacaacaagaagggcaagaacaagctcctggacggcgagcgcctggccgaccgcaagatcgccgagctgttcagcacgaagacccacgtgggg

SEQ ID NO: 15380 - RNA, 3495 nt, synthetic construct
  misc_feature 1..3495: note = derived and/or modified CDS sequence (opt11) from CCHVF(CCHVF Baghdad 12)__AJ538197.2__Gn-NSm-Gc
  source 1..3495: mol_type = other RNA
tcggaggagtccggcgacgactgcatcagccgcacccggctgctccgcaccgaaacggccgagatccacggggactcttacggcggacccggagacaagatcactatctgcaacgggagcacgatcgtagatcagcggctgggctccgagatgggctgctataccatcaaccgagttaagagcttcaaactttgcgagaactccgccacagggaaaagttgcaaaatcgactccatcccggtgaagtgtcggcagggctactgcctcaagatcacccaggaggggcgcggccacgtcaaactgagccggggttccgaggtcgtcctggacgcgtgcgacagcagttgcgaagtgatgatccccaagggcaccggcgacatcttggtcgactgcagcggaggccagcagcacttcctgaaggacaatcttatcgacctcgggtgccccaacataccactgctcggcaagatggccatctacatctgccgcatgtccaaccacccgaaaaccacgatggccttcctcttctggttcagcttcggctacgtgataacctgcatcctgtgcaaggccatcttctaccttctcataatcgtgggcaccctgggcaagcgcttcaagcagtaccgcgagttgaagccccagacctgcacgatatgcgagacaacccccgtcaacgccatcgacgcggagatgcatgacctcaactgctcctacaacatctgcccctactgcgcctcaagactgacctccgatgggctggcccggcacgtgacgcagtgcccgaagcggaaggagaaggtggaggagaccgagttatacctcaacctggagcgcatcccgtgggtcgtgcggaagctcctccaagtgagtgaaagcaccggtgtcgccctgaagcgctccagctggctcatcgtgctgctggtgctcctagcagtctcctcgtcccccgtgcagagcgcccccatcgggtacggcaagaccatcgagacgtaccaggcccgggagggctacacctcaatctgcctgttcgtgctcgggagcatcctgttcatcgtctcctgcctgaccaagggcctcgtcgacagcatagggaacatcttctttccgggactgtccatctgtaagacctgcagcatcgggtccataaacgggttcgaggtggaaagccacaagtgctactgctccctgctctgctgcccctactgccgccactgcagcgcagatcgggagatccaccagctgcatctgtccatctgcaagaagcgcaagacgggaagctccgtcatgctcgccgtgtgcaagcggatgtgcttccgcgcgacaatggaggtcagcaacaaggccctgctgatccgcagcatcatcaacacaaccttcgtggtttgtatcctcacgctagccgtctgcgtggtgtccactagcgccgtcgagatggagagtctgcccgccgggacctgggagcgggaggaggacctcaccaacttctgccaccaagaatgccaggtgacggagaccgagtgcctgtgcccctacgaggcgctggtgctgcgcaagccactcttcctggacagtattgtcaagggcacaaagaatctgcttaactccaccagccttgagacgtccctaagcatcgaagccccctggggcgcaatcaatgtccagtccacctacaagcccaccgtgagcaccgccaatatcgctttgtcttggagctccgtcgagcaccgggggaacaagatcctggttagcgggcgctccgagagcatcatgaagctggaggagcggaccggtatctcctgggaccttggggtggaggatgcgagcgagagcaagctgctgacggtctccgtgatggacctcagccaaatgtactccccggtgttcgagtacttgagcggggatcgccaggttgaggagtggccgaaggccacttgcaccggcgactgccccgagcggtgcgggtgcaccacgtccacttgcctgcacaaggagtggccccatagcaggaactggcggtgcaacccgacctggtgctggggcgtgggaaccgggtgcacttgttgcggcctcgacgtcaaggacctgttcaccgactacatgttcgtcaagtggaaagtggagtacatcaagactgacgccatcgtgtgtgtcgagctgacctcccaggagcgccagtgcagcctcatcgaggccgggacgcggttcaacctgggctccgtgaccatcacgctgagcgagccgcgtaacatccagcagaagctcccgcccgaaataataaccctgcacccccggatcgaggaggggttctttgatctgatgcacgtgcagaaagtcctctccgccagcacggtgtgcaagctacagtcctgcacccacggcgtgcccggcgacctgcaagtctaccacatcgggaacttactgaagggcgacaaggtgaacggacacctcatccacaagatcgagccgcacttcaacaccagctggatgtcctgggacggctgtgacctcgactattactgcaacatgggggactggcccagctgcacctatacgggcgtgacacagcacaaccatgcgtccttcgtcaacctgctgaacatcgagaccgactacaccaagagcttccacttccactccaagcgcgtgacggcccacggcgacaccccacagctcgacctgaaggtgcggccaacctacggggccggtgagatcaccgtcctggtagaggtggccgacatggagctccacacgaagaagatcgagatcagcgggcttaagttcgcgagcttaacctgcaccggctgctacgcctgctccagcgggatctcctgcaaggtgcgcatccacgttgacgagccagacgagctcaccgtgcacgttaagagcgatgatcccgacgttgtggccgcctcaagctcactgatggcccgaaagctggagttcggcacggacagcaccttcaaggccttcagcgccatgccgaagaccagcctctgtttctacatcgtcgaacgcgagtactgcaagtcctgtagcaaggaggacacccagaagtgcgtcaatacgaagctggagcagcctcagtccatcctgatagagcacaagggcaccatcatcgggaagcagaacaatacctgcaccgccaagaccagctgctggctcgagtccgtaaagagcttcttctacggcctgaagaacatgctgtccgggatttttggcaacttcttcatggggatcttccttttcctggctcccttcatcctgctcatcctgttcttcatgtttggctggaggatcctgttctgtttcaagtgctgccgccgcactcggggccttttcaagtacagacacctgaaggacgacgaggagaccgggtatcggcggatcatagagcggctgaacaacaagaagggcaagaacaagctcctagacggtgagcgcctagccgaccggcgcatcgcggaactcttcagcaccaaaacccacatcggg

SEQ ID NO: 15381 - RNA, 3495 nt, synthetic construct
  misc_feature 1..3495: note = derived and/or modified CDS sequence (opt11) from CCHVF(CCHVF VLG/TI29414)__AY179961.1__Gn-NSm-Gc
  source 1..3495: mol_type = other RNA
agcgaggagcccggcgacgactgtatctcccgtacccaacttctcagagccgagccggccgagatccacgacgacaactacgggggtccaggggacaagatcacaatttgtaacggcagtaccatagtggaccagcgcctcgggtccgagctgggatgctacaccatcaatcgggtcaagagcttcaagctgtgcgaaaactctgcgaccggcaagacctgcgagatagacagcacgcccgtgaagtgtcgccaggggttttgtctgaagatcacccaagagggccgggggcatgtaaaactgtctcgcggcagcgaggtcgtgctcgacgcctgcgattcgagctgcgaggtcatgatacccaaagggaccggcgacatcctggtggactgctccggcgggcaacagcacttcctaaaggacaacctcatcgacctgggctgcccccatatcccactgttaggcaagatggcgatctacatttgccggatgagcaaccacccacgcacaacgatggccttcctgttctggttctccttcggctacgttatcacgtgcatattctgtaaggccctgttctacagcctcattatcatcggcaccctggggaagaaaatcaagcagtaccgtgagctgaagccccaaacatgcaccatctgcgagaccgcgccggtaaacgccatagatgccgaaatgcacgacctcaactgctcctacaacatatgcccctattgcgcctcacgcctcacgtccgacggcctggcgcggcatgtcccccaatgccccaagcgcaaggagaaggtggaagagaccgagctatacctgaacctggagcggatcccctggaacgtgcgcaagctcttgcaggtcagcgagtccacgggtgtggccctaaagcgcagtagctggctcatcgtgctgctggtcctcctgaccgtgtccctgtcccccgtgcagtccgccccagtcggccacgggaagaccatcgagacctaccaaacacgcgagggtttcaccagcatctgtctctttatgctgggatcaatcctgttcctcgtgagctgcctggtgaaggggctggtcgactcagtatccgattcctttttccccggactcagtgtatgcaagacctgtagcatcgggtcaatcaacggcttcgagatcgagtcccacaaatgctactgtagccttttctgttgcccgtactgcagacactgttcggccgaccgcgagatccatcagttgcatctttcgatctgcaagaaacggaagatggggagcaacgtcatgctggccgtgtgcaagaggatgtgtttccgtgcgaccatcgaggcaagccgccgcgccctgctcattcggtccatcatcaacacgaccttcgtcatctgcatcctaaccctgaccatctgcgttgtgagcaccagcgcggtcgagatggagaacctcccctccggcacatgggagcgcgaggaagacctcacgaacttttgccaccaggagtgccaggtgaccgagacagagtgcctgtgtccctacgaggccttggtcttgcgcaagccgcttttcctggatagcattgtcaagggcatgaagaacctcctaaactctacaaacctagagaccagcctcagcatcgaggcgccgtggggcgctatcaacgtgcagagcaccttcaagccgacagtttccaccgcaaacatcgcgctttcatggtccagcgtcgagcacagagggaacaaaatcctggtgaccggaaggagcgagagcatcatgaagttggaagaacgtactggcgtttcctgggacctgggtgttgaagacgccagcgagagcaagctcctcactgtgagcattatggatctgtcgcagatgtacagccccgtgttcgagtacctgagcggagaccggcaagtggaggaatggcccaaggcgacttgtaccggagactgcccggaacgctgcgggtgtacctctagcacgtgcttacacaaagaatggcctcattctcggaactggcgctgcaacccgacctggtgctgggaggtgggcacagggtgcacgtgctgcggctggaacgtaaaagatctgttcaccgaccacatgtttgtcaagtggaaggttgagtacattaagaccgaggctatagtgtgtgttgagctgaccagccaagagcgacagtgttccttgatcgaagcagggacccgcttcaacctggggcccgtgaccatcacgctgagcgaaccgcggaacatccagcagaagctcccgccagagatcataacccttcacccaaaggtggaggaaggctttttcgacttgatgcacgtccagaaggtgttgtcagctagcaccgtgtgcaagctgcagtcttgcacccacggtatccccggcgacctgcaagtctaccacatagggaacctcctgaagggtgacagggtgaacggccacctgatccataagatcgagccccacttcaacacgagctggatgtcctgggatggctgcgatctcgactactactgcaacatgggggactggccgtcgtgcacttacaccggtatgacccagcacaatcacgccgcgttcgtcaatctgcttaacatcgagaccgactacaccaagaccttccacttccattccaagcgggtcaccgcccatggcgacacgccgcaactcgatctgaaggcccgcccgacctacggtgccggggagatcactgtgctcgtcgaagtcgcggacatggagctccataccaagaaggtggaaatcagtggtcttaaattcgcctccctggcttgcacggggtgctacgcctgtagctctggtataagctgtaaggtgcggattcacgtcgacgagcccgacgagctcactgtacacgtaaagtccaacgaccccgacgtcatcgccgccagcacctcgctgatggctaggaaactggagttcgggaccgactccacgttcaaagccttcagcgccatgccgaaaacctccctatgcttttacatagccgagagagagtactgtaaatcctgctccgaagaagacacccagaagtgcgtggacaccaagctggagcagccccagagcatcctcatagaacacaaagggacgatcatcggcaagcagaatgatacctgcacggcgaaggcctcctgctggttagaatctgtgaagagtttcttctacggcctgaagaacatgctgggcagcgtgttcgggaacttctttataggaattttgcttttcctagccccctttgtactcctggtgctgttcttcatgttcgggtggaagatcctcttctgcttcaagtgctgtcgccgtacccgcggcctattgaagtaccgcctcttaaaggacgacgaggagaccgggtaccggcgcatcatcgaacgccttaacaacaaaaagggcaagaaccgcttgctggacggcgagcggctggccgaccgcaagatcgccgagctgttttctaccaagacgcacatagga

SEQ ID NO: 15382 - RNA, 3495 nt, synthetic construct
  misc_feature 1..3495: note = derived and/or modified CDS sequence (opt11) from CCHVF(CCHVF TADJ/HU8966)__AY179962.1__Gn-NSm-Gc
  source 1..3495: mol_type = other RNA
agcgaggagtccggcgacgactgcatcagccgcacccagctactgcggaccgagacggccgagatccacggggatgactacggaggacccggggacaagatcaccatatgcaacggatccaccatagtggaccagcgcctgggcagcgagctgggctgctacaccatcaacagagtgaagtccttcaagctctgcgagaacagcgcaacggggaagaactgcgagatcgattccgtgccggtgaagtgcaggcagggttactgcctgaagatcacccaggaggggcggggccacgtcaagctcagccgcgggtccgaggtggttctggacgcgtgtgactcatcctgcgaagtcatgatcccgaagggcaccggcgatatcagcgtagattgcagcgggggccagcagcacttcttgaaggacaatttgatcgaccttggctgccccaagatacccctactggggaaaatggccatctacatctgccggatgtcgaaccacccgaagaccacgatggcgttcctattctggttctccttcggatacgtgatcacccgcatcctgtgcaaggccatcttttatctgctcatcatcgtcgggaccctgggcaagcggttcaaacagtaccgggagctgaagccccagacctgcaccatctgcgaaaccaccccggccaatgcgatcgacgccgagatgcacgatctcaactgcagctacaatatctgcccctactgcgcctcccggctgaccagcgacgggctggcccgccacgttacacagtgcccgaagcggaaagagagggtggaggagaccgagctatacctgaatctggaacggatcccctggatcgtccgcaagttgctccaggtgtccgagagcacgggcgtcgcgctgaagcggagctcctggctcatcgtcctgcttgtactattcaccgttagcctgtcgcccgtgcagagcgcccccatcggatatggcaacacgatcgaaacctaccaggcccgcgaggagtacacctccatctgtcttttcgtgttaggcagcatcctgtttatcgtgtcctgcctgatgaaggggctcgtcgacagcatcggcaacatcttcttcccggggctgactatatgcaagacgtgctccatcggcagcatcaatggcttcgagatcgaatcccataaatgctactgcagcctgctctgctgtccctattgtcggcactgctccgccgaccgcgagatccaccagctgcacttaagcatctgcaagaagcgtaagaccggctccaacgtgatgctcgcggtgtgcaagcgcatgtgcttccgcgcgaccatggaggtcagcaacaaggccctgctgatccgttccatcattaacaccacgttcgtagtgtgcatcctcatcctggctgtgtgcatcgtgagcactagcgccgtcgagatggagagcctgcccgccggcacctgggaacgcgaggaggacctcactaacttctgccaccaggagtgccaggtgacggagaccgagtgcctgtgcccttacgaggcactggtgctgcggcgccccctcttcctggacagcatagtcaagggaatgaagaaccccctgaactccaccagcctcgagacctccctgagcatcgaggccccctggggcgccatcaacgtgcagtccacgtacaagcccaccgtaagcaccgctaacatcgccctgtcctggagctccatcgagcaccgtggtaacaatatcctcgtcagcggccgctccgagagcatcatgaagctggaggagcggaccggtatctcgggagacctgggcgttgaagacgcgagcgagtcaaagctactgaccgtgagcgtcatggacctgtcccagatgtactcaccggtcttcgagtacctcagcggggaccgccaggtggaggagtggcccaaagcaacctgcaccggcgactgccccgagcgatgcggttgcacctccagcacgtgcctgcacaaagagtggccccactcccgcaactggcggtgcaatccgacgtggtgttggggagtgggcaccgggtgcacgtgctgcggcctcgacgtgaaagacctgttcatcgactacatgttcgtaaagtggaaagtcgactacatcaagaccgaagcaatcgtgtgcgtggagctgaccagccaggaacggcagtgctcccttgtcgaagccgggacacggttcaacctcggccccgtgaccattacccttagcgagccccgcaacatccagcagaagctgcctccggaaatcatcacgctccaccctcggatcgaagagggtttcttcgacctgatgcacgtgcagaaagttctgtccgccagcaccgtgtgtaagctccaatcctgcacccacggcgttcccggcgacctgcaggtctaccacattggtaacctcctcaagggcgataaggagaacgggcatcttatccacaagatcgaaccgcattttaacacaagttggatgtcctgggacggctgcgacctcgactactactgcaacatgggggactggcccagctgcacgtacaccggcgttacgcagcacaaccacgccagcttcgtgaacctcctgaacatcgagaccgactacactaagagcttccacttccactccaagcgcgtaaccgcccacggggacacgccccagctggacctcaaggcccggcccacctacggggccggggaaatcaccgtgcttgtggaggtcgcggacatggagctgcacaccaagaagatcgagataaccggtctcaagtttgccagcctgacctgcaccggctgctacgcctgctccagcgggatatcctgcaaggtgcgcattcacgtagacgagccggacgagctcaccgtccacgttaagagcgacgaccccgacgtggtggccgctagctccagcctcatggcgaggaagctggagttcggcaccgattccaccttcaaggccttctcagccatgcccaagacgagtctgtgcttctacatcgtggagagggagtaccgcaaaagctgttccaaggaggacacccagaagtgcgtgaacactaagctcgagcagccccagagcatactgattgagcacaagggcaccattatcgggaagcagaacaatacgtgcaccgccaaggcctcctgctggctggagagcgtcaagtccttcttctacggcctcaagaacatgttaagcggtatcttcggaaacgtgtttgtggggatctttctgttcctcgcgccgttcatcctgctgatcctcttcttcatgttcggctggagaatcctgtcctgcttcaagtgctgccgccggacccgcggactgttaaagcaccgacatctgaaggacgacgaggaaaccgggtaccgccggatcatcgagcgcctgaacaacaagaagggcaagaacaagctcctggacggggagcggctggccgatcgcaggattgccgagctgttttctaccaagacgcacatcggc

SEQ ID NO: 15383 - RNA, 3495 nt, synthetic construct
  misc_feature 1..3495: note = derived and/or modified CDS sequence (opt11) from CCHVF(CCHVF Hodzha)__AY223476.1__Gn-NSm-Gc
  source 1..3495: mol_type = other RNA
agcgaagagagcggggacgactgcatatcccgtacccaactgctacggacagagacagctgaaatacatggcgatgactacggcggacctggcgacaaaatcacaatctgcaacggatcaacaatcgtcgaccagcgcctaggttcagaactcggatgctatacaatcaaccgcgtaaaatctttcaaactctgcaaaaactccgccacaggcaagtcatgcgaaatcgattcaacacccgtaaaatgccgccaaggttactgcctgaaaataacgcaggagggacgagggcacgttaagctctcccgcggctctgaggtagtcctagatgcgtgcgactcgtcctgcgaggtaatgataccgaaaggaaccggggacatcctcgtggactgctcgggagggcaacaacacttcctcaaggacaacctgatagacctcggttgtccccgcatacccttactaggcaagatggccatctacatatgtcgaatgtctaatcaccccaaaacaacaatggccttcctcttctggttctcttttggatacgtaatcacatgcatactctgcaaagctatcttctacctcctcatcatcgtagggacactaggtaaacgcttcaaacagtatcgcgaactaaagccgcagacctgcaccatctgcgagaccaccccagccaacgcaatcgacgccgaaatgcacgacctcaactgcagctacaatatttgcccctactgcgcctcccgcctcacgagcgacggcctcgcccggcacgtcacacaatgccccaaaagaaaagaaaaagtcgaagaaaccgaactgtacctcaacctagagcgaatcccctggatcgttcgcaaactcctacaagtatcagaaagcaccggcgtagctctaaaaagatcctcctggcttatagtactactcgttctcttcgcggtatctctatccccagtccaatccgccccaatcggccatggcaaaacgatcgagacctaccaggccagagaagattacacctctatttgtcttttcgtcctaggctccatacttttcatcgtttcctgcctgatgaaaggactcgttgactcaatcggcaatattttcttccccggactaacaatctgtaaaacttgctccataggatcgataaacggatttgagatcgagagccacaaatgttactgcagcctcctctgctgcccttactgccgccactgctcagcggacagagaaatccaccaactccacctatcgatctgcaagaaacgtaaaaccggttcaaacgtcatgttagcagtctgcaaacggatgtgcttccgcgccaccatggaagtctccaacaaagctctcctaatccgtagcatcataaacaccacattcgtcgtctgtatactcatcctcgccgtctgcgtcgtctctacatccgccgtggaaatggagagccttcccgcaggcacctgggaacgagaggaagacctcaccaacttttgtcaccaagaatgccaggtaaccgaaacagaatgcctatgtccgtacgaagcactcgtcctcagacgccccctcttcctcgacagcatcgttaaaggaactaaaaacctacttaactcgacctcgttagaaaccagtctaagcattgaggccccatggggcgccattaacgtccaatcaacctacaaacccacagtcagcacagcaaacatcgcactcagttggagctccgtcgaacacagaggtaacaagattctcgtcagcggaagatcagagtcgattatgaaactggaggagcgcaccggtatctcatgggacttaggtgtcgaggacgcctccgaatcaaaactgctaactgtctcagtaatggacctctcccaaatgtacagcccagtcttcgaatatctcagcggagaccgccaggtagaagaatggcccaaggcaacctgcacaggcgactgccccgaacgttgcggctgtacctcaagcacttgcctccataaggaatggccccactctcgaaactggcgatgcaatcccacatggtgctggggcgtaggcactgggtgcacatgctgcggactcgacgtcaaggacctattcactgactacatgttcgtaaaatggaaggtggactacatcaaaacagaggccatagtgtgcgtagaactgaccagccaagaacgccagtgctcccttgtcgaagccggaacacggttcaacctcggacccgtcacaatcaccctgtcggagcccagaaacatccaacaaaaactcccacccgagatcatcaccctccacccccgcatagaagaagggtttttcgacctaatgcatgtacagaaggtcctctccgcctcaacagtgtgtaaactgcaatcctgcacacacggcgtacccggcgacttacaagtctaccatatcggaaacctcctgaaaggcgacaaggtcaacggacacctcattcacaaaatagaaccccacttcaacacgagctggatgtcctgggatggctgcgatctggactactactgcaatatgggagattggccttcctgtacctacactggtgtgacccaacacaaccacgcctcattcgtgaaccttcttaacatagaaaccgactacaccaagtcgttccacttccacagtaaacgggttacagcacacggagacaccccacaactagacctaaaagcgcgccccacttacggagccggagaaatcaccgtcctagtagaagtagccgacatggaattacacactaagaaaatcgaaataaccggactcaaattcgccagcctaacctgcaccggctgctacgcctgctccagcggcataagctgcaaagtgcgcatccacgtagatgaaccggacgagctaacagtccacgtcaaatcagacgatcccgacgttgtcgctgcgtcatcctccctgatggcacgaaaactcgaatttggaactgattccacctttaaagccttcagtgccatgcccaaaacctccctctgcttctacattgtggaacgggaatactgcaaatcgtgtagcaaagaagacacgcaaaagtgtgttaacaccaagctagaacagccccagtcaatactcatcgagcgaaagggcaccattatcggaaaacaaaacaatacatgcacggccaaagcctcatgctggctagaaagtgtaaaatccttcttttatggcctcaagaacatgctctccggcattttcggaaatgtcttcgtcggcatcttccttttcctcgcccccttcattttactaatcctcttctttatgttcgggtggcgaatactattctgcttcaaatgctgccggcgcacgcggggactcttcaagtacaagcacctaaaagacgatgaggaaacagggtaccgccggatcatagagcgactcaacaacaagaaaggcaaaaacaaactactcgacggagaacgactagcggaccggcgcatagcagaactattctcaactaagactcacatcggt

SEQ ID NO: 15384 - RNA, 3495 nt, synthetic construct
  misc_feature 1..3495: note = derived and/or modified CDS sequence (opt11) from CCHVF(CCHVF Kosovo/9553/2001)__AY675511.1__Gn-NSm-Gc
  source 1..3495: mol_type = other RNA
agcgaggagcccggcgacgactgcatctcccgcacccagctgctccggactgagacggccgagatccacgacgacaactacgggggcccgggggataagatcaccatctgcaacggcagcaccatcgtagaccagcgcctggggtccgagttaggctgctacaccatcaaccgggtcaagagcttcaagctctgcgagaactccgccacgggcaagacctgcgagatcgacagcacacccgtgaagtgccgccaaggcttctgcctgaagatcacacaggagggccgggggcacgtcaagctgtcccgcggcagcgaggtcgtgctcgacgcgtgcgactccagctgcgaggtgatgatccccaaggggacgggcgacatcctggtggactgctccggcgggcagcagcacttcctgaaggacaacctcattgacctcggctgcccccacatcccgctgctcgggaagatggccatctacatcgcccggatgagcaaccaccccaagaccaccatggcgttcctgttctggttctccctgggctacgtgatcacgtgcatcctctgcaaagccctgttctacagcttgatcatcatcggcaccctcgggaagaagatcaagcagtaccgcgagctgaagccccagacctgcaccatctgcgaaaccgcgcccgtgaacgccatcgacgccgagatgcacgacctgaactgctcctacaacatctgcccgtactgcgccagccggctcacgtccgacggcctggcgcgccacgtcaagcagtgccccaagcggaaggagaaagtggaggagaccgagttgtacctcaacctggagcgcatcccctgggtggtccggaagctgctccaggtgagcgagtccaccggggtggccctgaagcgcagcagctggctgatcgtcctcctggtgctgctcaccgtgagcctgagccccgtccagtccgccccggtgggccacgggaagacgattgagacctaccagacccgggagggcttcaccagcatctgcctgttcatgctcggctccatcctgttcatcgtgagctgccttgtcaaggggctcgtggactccgtgagcgactccttctttcccggcctgagcgtctgcaagacgtgctctatcgggagcatcaacggcttcgagatcgagtcccacaagtgctactgcagcctgttctgctgcccctactgccgccactgctccgccgaccgggagatccaccagctccaccttagcatatgcaagaagcgcaagaccggatccaatgtgatgctggccgtctgcaagcggatgtgcttccgcgcgaccatcgaggccagccggcgcgccctcctgatccgctccatcatcaacaccacgttcgtgatctgcatcctgaccctcaccatctgcgtggccagcaccagcgccgtcgagatggagacgctgcccgcggccacctgggagcgggaggaggacctgaccaacttctgccaccaggagtgccaggtgccggagaccgagtgcctgtgcccctacgaggcgctcgtgctgcgcaagcccctgttcctcgattccatcgtcaagggcatgaagaacctactgaacagcacgtctttggagacctctctgtccatcgaggccccctggggcgccatcaacgtgcagagcaccttcaaaccgaccgtgtccaccgcgaacatcgccctgagctggtccagcgtcgagcaccgggggaacaagatcctcgtgacgggccgctccgagagcatcatgaagctggaggagcggaccggggtgagctgggacctgggcgtcgaggacgccagcgagtccaagctcctgaccgtgagcataatggacctgtcccagatgtacagccccgtgttcgagtacctcagcggggaccgccaggtcgaggagtggccgaaggcgacctgcacgggcgactgccccgagcggtgcggttgcacctccagcacgtgcctgcacaaggagtggccgcactcccgcaactggcggtgcaaccccacctggtgctggggcgtggggaccgggtgcacgtgctgcggcgtggacgttaaagacctgttcaccgaccacatgttcgtgaagtggaaggtggagtacatcaagaccgaggccatcgtctgcgtggagctcaccagccaggagcgccagtgctcgctgatcgaggccggcacccggttcaacctgggacccgtgaccatcaccctcagcgagccccgcaacatccagcagaagctgccgcccgagattatcacgctgcaccccaagatagaggagggcttcttcgacctcatgcacgtccagaaggtgctgtccgcaagcaccgtgtgcaagctgcagtcctgcacccacgggatcccgggcgacctccaggtctaccacatcgggaaccttctgaagggcgaccgcgtgaacggccacctcatccacaagattgagccccacttcaacaccagctggatgagttgggacgggtgcgacctggactactactgcaacatgggcgactggcccagctgcacgtacaccggggtgacccagcacaaccacgccgccttcgtcaacctgctcaacatcgagaccgactacacgaagaccttccacttccactccaagcgcgtgaccgcgcacggcgacacgccccagctggacctgaaggcccggccgacctacggggccggggagatcaccgtgctcgtcgaggtagccgacatggagctgcacaccaagaaggtcgagatcagcggcctgaagttcgcctccctcgcgtgcaccgggtgctacgcctgcagctccggcataagctgcaaggtccgcatccacgtggacgagcccgacgagctgacggtgcacgtcaaatccagcgaccccgacgtggtggccgccagcacctccctgatggcccggaagctcgagtttgggaccgacagcaccttcaaggcgttttccgctatgcccaagacgagcctgtgcttctacatcgtcgagaaggagtactgcaagtcctgcagcgaggacgacaccaagaagtgcgtggacaccaagctggagcagccgcaatccatcctcatcgagcaccgcgggaccatcatcgggaaacccaacgacacgtgccccgccaagaccagctgctggctggagtccgtcaagagcttcttctacggcctgaagaacatgctcggctccgtcttcgggaacttcttcatcggcatcctgctgttcctcgcccccttcttcctctggatgctgagcttcatgttcgggtggaagatcctcttctgcttcaagtgctgccggcgcacccgcggcctgttcaagtaccggcacctgaaggacgacgaggagaccgggtaccgccggatcatcgagcgcctcaacaacaagaagggcaagaaccggctgctggacggcgagcgcctcgccgaccggaagatcgcggagctgttctccaccaagacccacatcggg

SEQ ID NO: 15385 - RNA, 3495 nt, synthetic construct
  misc_feature 1..3495: note = derived and/or modified CDS sequence (opt11) from CCHVF(CCHVF SPU41/84)__AY900142.1__Gn-NSm-Gc
  source 1..3495: mol_type = other RNA
agcgaagagtcaagcgacgactgcatctcccgaacccagctcctccggaccgagacggccgagatccacggcgataactatgggggccccggcgacaagattaccatttgcaacggcagcaccgtggtcgaccagcgcctggggagcgagctgggctgctacaccatcaaccgggttaagacgttcaagctctgcgagaacagcgccaccggcaagtcctgcgagatcgacagcgtaccggtcaagtgccgccaggggtactgcctgaagattacccaggagggccgggggcacgtgaagctgtccaggggcagcgaggtggtcctcgatgcgtgcgacacctcctgtgaggtgatgatcccaaaggggacaggcgacatcctggtggactgttccggcgggcaacagcatttccttaaggacaacctcatcgacctgggctgtcccaagatccccctgctgggcaagatggccatttacatctgccggatgtccaaccacccgaaaaccaccatggcctttttattctggttcagcttcggctacgtcatcacatgcatcatttgcaaggtgatcttctatctgctcatcatcgtgggcaccctaggcaagcgcttcaaacaataccgggagctgaagccccagacttgcaccatctgcgagaccacacccgtcaacgccatcgacgccgagatgcacgacctcaactgcagctacaacatctgcccctactgcgcgagccgcctgacctccgatggcctggcccggcacgtgactcagtgtccgaagcgcaaggagaaagtggaggagaccgaactctacctgaacctggagagaatcccatgggtcgtgcgcaagctcttacaggtgagcgaatccacgggggtcgccttgaagcggagcagctggctcgtggttctgctggtcctcctgaccgtgtcacttagcccggtgcaatccgcccccatcagccacggcaagaccgtcgaagcgtaccgcgcccgggaggggtacaccagcatgtgcctcttcgtgctgggaagcgttctcttcctcgtgtcttgcctgatgaagggcctggtggacagcgtcgggaacacgttcttcccgggcttgtccatctgcaaaacctgcagcatcagctcgattaacgggttcgagattgagtcgcaccgctgctactgcagcctgttctgctgcccttactgccggcactgctccgccaacaaggagatccaccagctgcacctcagcatctgcaagaagcgcaaggccggctccaacgtaatgctcgccgtgtgcaagcggatgtgcttccgcgcgacaatggaggtcagcaaccgcgccttattcatccggtccatcatcaacaccaccttcgtcctctgcatcctgatcctggccgcctgcgtggtcagcaccagcgccgtggaaatggagagcctccccgcggggacgtgggagcgcgaggaggatctgaccaacttctgccaccaggagtgccaggtagctgacacggaatgtctatgcccttacgaggccctagtcctccgccgcccgctgttcctggacagcatcgtgaagggcatgaagaatctcctgaactccaccagcctggagacctccctcagcatcgaggctccctggggcgccattaacgtgcagtccacctacaaacccaccgtctctaccgcgaatatcgccctgtcctggagctccgtggagcaccgggggaacaagatcttagtgagcggccgctccgagagcatcatgaagctagaggaacggactgggatctcctgggatctgggcgtcgaggacgccagcgagagtaaattactcacggtgtccgtgatggacctatctcagatgtactcccccgtcttcgagtacctgagcggggaccgccaggtggaagagtggccaaaagcgacttgcacgggcgactgccccgagcggtgcggctgcacctcctcaacgtgtctccacaaggagtggccccactcccgcaattggcgatgcaaccccacctggtgctggggcgtggggactgggtgcacttgctgcggcctcgacgtcaaggacctgttcacagactacatgtttgtgaagtggaaggtggagtacatcaagaccgaggccattgtctgcgtggagttaacgagtcaggagcgccaatgctccctgatcgaggccggcactcggttcaacctgggcccggtgaccatcacgctcagcgaaccccgcaacatccagcagaagctgccacccgaaatcattacgctgcacccgcggatcgaggagggcttctttgacctcatgcacgtccagaaggtgctgtccgcctctaccgtgtgcaagctgcaatcctgcacccacggcgtccccggcgacctccaggtataccacatcgggaacttactgaagggcgataaagtgaacggccacttggtccataagatcgagccccatttcaacacctcatggatgtcctgggacgggtgtgacctggactactactgcaacatgggcgactggcctagctgcacctacaccggggtgacccagcacaaccacgcctccttcgtgaacatgctgaacatcgagaccgactacacgaagaacttccacttccacagcaaacgcgtcacggcccacggcgacacgccccagctcgacctgaaggctcggccaacctacggtgccggcgagatcaccgtgctggtggaggttgccgacatggagctccacaccaagaagatcgagatctccggcttaaagttcaccagcctgacctgcacgggatgctacgcctgcagcagcggcatctcttgcaaggtgagaatccacgtggacgagcccgacgagctcaccgtccacgtgaagtccgaagacccggacgtggtcgcggcgagctccagcttaatggcccggaaactggagttcgggaccgactccaccttcaaggccttcagcgccatgcccaagacgtccctctgcttctacatcgtggaacgcgaatactgcaagagctgttccgaggaagacacccagaagtgcgtgaacaccaaactggagcaaccacagagcatcctaatcgaacgcaagggcaccatcattgggaagcagaacaatacctgcaaggccaaggcgggctgctggctcgaatccgtcaagagcttcttctacggcctgaaaaacatgctgtccgggatctttgggaacgtgttcatcgggatcttccttttcctggccccattcatactgttaatcctgttcttcatgtttgggtggcggatcctgttctgttttaagtgctgccgccggacacgcggcctcttcaagtaccggcacctgaaggacgacgaggagaccgggtaccgcaagatcatcgagcggctcaacaacaagaaggggaaaaacaagctcctggacggcgagcgcctggccgacagacggatcgccgagctgttctctaccaagacgcacatcggc

SEQ ID NO: 15386 - RNA, 3495 nt, synthetic construct; identical to SEQ ID NO: 12100
  misc_feature 1..3495: note = derived and/or modified CDS sequence (opt11) from CCHVF(CCHVF UG3010)__AY900143.1__Gn-NSm-Gc
  source 1..3495: mol_type = other RNA

SEQ ID NO: 15387 - RNA, 3495 nt, synthetic construct
  misc_feature 1..3495: note = derived and/or modified CDS sequence (opt11) from CCHVF(CCHVF Hy13)__AY900145.1__Gn-NSm-Gc
  source 1..3495: mol_type = other RNA
tctgaggagtccggcgacgactgcataagccgcacccagctgtcccggaccgagacggccgagatccacagcgacaactacgggggccccggggacaagatcaccatctgcaacggctccactatagtggaccagcgcctcgggagcgagctgggctgttacaccatcaaccgggtcaagtccttcaaactgtgcgagaactctgccacgggcaagtcctgcgagatcgacagcaccccgatcaagtgccgccaggggttctgcctcaagatcacccaggagggccgtgggcacgtgaagctgtcccgcggcagcgaggtggtcctggacgcgtgcgactcaagctgcgagatcatgatccccaaggggaccggcgacatcctcgtggactgcagcggcgggcagcagcacttccttaaggacaacctgatcgacctcggctgccccaacatccccctgctggggaagatggccatctacatctgccggatgagcaaccacccgaagacgaccatggccttcctcttctggttctccttcgggtacgtgatcacgtgcatcctgtgcaaggtcatcttctacctgctcatcgtggtgggcaccctggggaagaagttcaagcagtaccgcgagcttaagccccagacctgcacgatctgcgagaccacccccgtcaacgccatcgacgccgagatgcacgacctcaactgcagctacaacatctgcccctactgtgcgtcccggctgacgagcgacggcctggcccgccacgtgatgcagtgcccgaagagaaaggagaaggtggaggagaccgagctctacctgaatctagagcgcatcccctgggtcgtgcggaagctcctccaggtgagcgagtccactggggtcgccctgaagcgcagctcctggctggtagtgctgctggtcctcctgaccgtgagcctgagccccgtgcagagcgcccccatcggtcacgggaagacggtcgagacctaccagacccgggagggctacacctccatctgtctcttcgtgctgggcagcatccttttcatcgtgtcctgcctcatgaaggggctggtcgacagcgtgggcaactccttcttcccggggagctccatctgcaagacgtgcagcatcggctccatcaacgggttcgaaatcgagagccacaagtgctactgctccctgttctgctgcccctactgccgccactgcagcgccgaccgggagatccacaagctccacctgtccatctgcaagaagcgcaagaccggctcaaacgtcatgctggccgtgtgcaagcggatgtgcttccgagccaccgtggaggtcagcaacaaggccctcctgatccggaacatcataaacaccacgtttgtggtgtgcatcctgatcctcgctgtctgcgtggtgtccaccagcgcggtcgagatggagtccctgcccgccggcacctgggagcgcgaggaggacctgactaacttctgccaccaggagtgccaggccaccgagaccgagtgcctctgcccctacgaagccttggtgctgcgcaagccgctgttcagcgactccatcgtgaaggggatgaagaacctccttaacagcacctccctggagaccagcctctccatcgaagccccctggggcgcgatcaacgtccagagcactttcaagcccaccgtgtccgccgccaacatcgccctgagctggtccagcgtggaacaccgggggaacaagatcctggtctcgggcagaagcgagtccatcatgaagctcgaggagcggaccgggatcagctgggacctgggcgtggaggacgccagcgagtccaagctgctcaccgtgagcatcatggacctgtcccagatgtacagccccgtcttcgagtacctgtccggcgaccgccaggtggaggagtggccgaaggcgacctgcacgggggactgtcccgagcggtgcggctgcaccagctccacgtgtctccacaaggagtggccccacagccgcaactggcgatgcaaccccacctggtgctggggcgtggggactggctgcacgtgctgcgggctggacgtcaaggacctgttcaccgaccacatgttcgtgaagtggaaggtggagtacatcaagaccgaggccatcgtctgcgtggagctcacctcccaggagcgccagtgcagcctgatcgaggccggcacccggttcaacctggggccggtgaccatcaccctcagcgagccccgtaacatccagcagaagctcccgcccgaaatcgtcacgctgcacccccggatcgaggagggcttcttcgatctcatgcacgtgaagaaggtgctgagcgcctccaccgtctgcaagctgcagagctgcacccacggggtgcccggcgacctccaggtgtaccacattggcaacctgctgaagggggacaaggtcaatggccacctcatccacaagatcgagccccacttcaacacctcatggatgagctgggacgggtgcgacctggactactactgcaacatgggcgactggccgtcctgcagctacacgggggtgacccagcacaaccacgccgcgttcgtaaacatgctgaacatcgagaccgactacaccaagatcttccacttccactccaagcgcgtcacggcccacggtgacacaccgcagctcgacctgaaggcccggcccacctacggcgccggggagatcaccgtgctggtggaggtcgcggacatggagctccacaccaagaagatcgagatcagcggcctgaaattcgccagcctgacctgcaccgggtgctacgcctgctccagcggcatctcctgcaaggtgcgcatccacgtggacgagcccgacgagctcaccgtccacgtcaagagcgaggacccggacatcgtggccgccagcagctccctgatggcgcggaagctggagttcgggacggacagcaccttcaaggccttcagtgccatgcccaagaccagcctctgcttctacatcgtggagcgcgagtactgcaagtcctgtagcaaggaggacacccagaagtgcgtgaacacgaaattagagcagccccagtccatcctgatcgagcacaagggcaccatcattggcaagcagaacgacacgtgcaccagcaaggccgggtgctggctcgagtccgtcaagagcttcttctacggcctgaagaacatgctgtccgggatcttcggcaacgtgttcatcgggatcttcctcttcctggcccctttcatcctgctcatcctgttcttcatgttcgggtggcggatcctgttctgctttaagtgctgccgccggacccgcggcctctttaagtaccgccacctgaaggacgacgaggagaccgggtaccggaagatcatcgagcgcctgaataacaagaagggcaagaacaagctcctggacggggagcggctggcggacagaaagatcgccgagctgttcagcaccaagacccacatcggc

SEQ ID NO: 15388 - RNA, 3495 nt, synthetic construct
  misc_feature 1..3495: note = derived and/or modified CDS sequence (opt11) from CCHVF(CCHVF Semunya)__DQ094832.1__Gn-NSm-Gc
  source 1..3495: mol_type = other RNA
gccgagggcgtgtcgaacgattgcgtgagccgcacgcagctgatcaaaaccgaagtggctgagatccacgaggacagctatggcgggcccggggaaaagatcacgatctgcaacgggtccaccatcgtggaccagcggctgggtagcgagctgggctgctacacaatcaaccgagtcaagacgtacaaactttgcgagaactccgcgacggaaaaggggtgcgagatcgacagcgtgccggtgaagtgcaagcaggggttctgcctcaaggttacccaagagggtcgggggcatgtaaagttatcccgcggcaccgagatcgtgttggacgtctgcgacaccagctgcgagctcatgattccaaagggaacgggcgacatccttgtggattgtagtggcgggcagcagcacttcctgcaggacaacctcatcgacctgggctgccccaacgtccccctgttagggaagatggccatctacatatgcagaatgtccaaccaccccaagaccactatggccttcctcttctggttctcctttggctacgtcatcacgtgcgtggtgtgcaaggtcctgttctatttactgatcgtgatcggcacactggggaagaagctcaagcagtaccgcgagctgaagccccagacctgcatagtgtgcgagtctatccctgtcaacgccatcgatgcagagatgcacgagctgaactgcaactacaacatctgtccctactgcgcgtcccgtctcacgtcggacggcctggtgcgccacgtaacacagtgcccgaagcggaaggagaaggtcgaggagaccgaactgtacttgaacctggaacgcatcccctggctggtgaggcgcctcctccaggtatccgagtccaccgggatggccctgaaacggtcctgctggatgaccaccctcctgattttgttggtcgtgagcctttcacccgtccaaagcgccccagtgggccaggaaaaggccatcgaggtctaccaggtccgcgagagctacacgtccatctgcctgtttgtcctcgggagcgtgctgttcgcggtatcctggctggtgaagggcctcatcgatggcatcgggaactcgtttttcccgggcctgtcggtgtgcaagacctgcagcatcgggtcaatcaacggcttcgagatcgagtctcacaagtgctactgcagcctgttctgctgcccctactgccgtgcctgtagctccgacaaaatcacccaccgcatgcacctcaacatctgcaagcggcgcaaggtcgggagcaatgtgatgctggccgtgtgcaaacggatgtgcttcaaggccaccgtcgaggcctccaacagcgcgctgctcatccggagtatcatcaatagcacgttcgtgatctgtgtgctgatcctggtcatctgcgtggtatccaccagcgccgtcgacatggagaacctccccgcaggcatctgggagcgggaggaggacctgactaacttctgccaccaggagtgccaggtgaccgaaacggagtgcctgtgcccctacgaggccctgatcctccgcaagcccctgttcctggactccatcgccaagggcaagaagtccttactgaacagtacgaacctggagacatcgctcagcatcgaggctccctggggcgccataaacgtgcagtccaccttcaaacccacggttagcgccgccaacatcgctttgtcctggagcagtgtggagcaccgcgggaacaagatcctggtaagcgggcggtctgagtcaatcatgaagctcgaggagcgcactggcatctcctggagcctgggcgtcgaggacgcgtcggaaagcaagaccctgacggtgtccgtgatggacctcagccagatgtactcacccgtctttgagtacctgagcggtgaccgccaggtagaggagtggccgaaggctacatgcaccggcgactgccccgagcggtgcgggtgcaccagctccacgtgcctgcacaaggagtggccccatagccggaactggcgctgcaaccccacctggtgctggggagtgggtaccggctgtacgtgctgcggcctcgacgtcagggacctcttcaccgactacatgatggtgaagtggaaggtggagtacgtcaagacggaggccataatgtgcgtggagctcacctcccaggagcgccagtgcagcctcatcgaggccgggacacggtttaatctgggccccgtgaccatcaccctgtccgagccccgcaatgtacagcagcggctccccagcgagatcgtgacactgcaccccaagatcgaggaggggtttttcgacctgatgcacgtgcagaaggtactattctgcaagtattctctgcaagccaccagctgcacccacggcgtgccgggggacctacaagtctaccacgtcggcaacctgctgaagggcgacaaagtgaacgggcactccattcacaagatcgagagtcacttcaacaccagctggatgagctgggacggttgcgacctcgactacttctgcaacatgggggactggccctcctgcacgtacaccggcgtgacccagcacaatcgcgcagccttcgtcaacatgctcaacatcgaaaccgattacacgaaaaccttccacttccacagcaagcgggtgaccgcccacggggacactccccaactggacctgaaggctcgcccgacctacggcgcgggcgaggtgaccgtcttggtggaggtggccgacctggagctgcacaccaagaagatcgaggtctccgggctcaagttcgccagcctgacatgctcgggctgctatgcctgcagctccgggatcagctgtaaggtgcggatccacgtcaacgagcccgacgagttcacggtgcacgtcaagagcaacgaccccgacgtggtggccgcgggctcctcgctgatggccaggaagatcgagttcggggccgactccaccttcaaggccttctcgtccatgcctaagaactcattatgcttctacatcgtcgagcgggactactgctcgagctgcaccgacgacgatacccagaaatgcgtgaacatcaagctggaacacccgcagtcaatcctgatcgaacacaagggcaccatcatcggcaagcagaacgacacgtgccccaccaagaccagctgctggctcgagtccgtcaagagcttcttctacggactgaagaacatgttaggcggaatcttcggcaacgtgtttctcgggatcttcctgttcctggcccccttcgcgctcctgatcctgttcttcttcttcggctggcgcctcctgttttgtctgaagtgctgccggcgcacgcgaggcctcctgaagtacaagcagctgaaggatgaggaggaggctgggtacaagaagatcatcgagcggctgaatgacaagaagggcaaatcacgcctgtttgatggggagcggctggcagaccgcaagatcgccaagctgttcagcaccaagacccacatcggc

SEQ ID NO: 15389 - RNA, 3495 nt, synthetic construct
  misc_feature 1..3495: note = derived and/or modified CDS sequence (opt11) from CCHVF(CCHVF SPU128/81/7)__DQ157174.1__Gn-NSm-Gc
  source 1..3495: mol_type = other RNA
agcgaggagccctccgacgactgcatcagccgcacccagctgctgcggaccgagacagccgagatccacggtgacaactacggtggcccgggggacaagatcaccatctgcaacggctccaccatcgtggaccagcgcctggggagcgagctgggctgctacaccatcaaccgggtcaagtccttcaagctctgcgagaacagcgccacgggcaaatcctgcgagatcgagagcgtgcccgtgaagtgccgtcaggggtactgcctgcggatcacccaagagggccgcggtcacgtcaagctgtcccggggaagcgaggtggtgctcgacgcttgcgacacctcatgcgagatcatgatccccaaggggaccggcgacatcctggtcgattgcagcggcgggcaacagcacttcctgaaggacaacctcatcgacctgggctgccctaagatcccgctgctagggaagatggccatctacatctgccgcatgtccaaccatcccaagacgacgatggccttcctgttctggttcagcttcggctacgttattacgtgcatcctgtgcaaggccatcttctacctcctgatcatcatcggcaccctggggaagcggttcaagcagtaccgcgagctcaagccccagacctgtaccatctgcgagaccacccccgtgaacgccatcgacgcagagatgcacgacctaaattgctcctacaacatctgcccgtactgcgccagccggctgacgtctgacggcctcgcccgccacgtgacccagtgccccaagcggaaggagaaggtggaggagaccgagctgtacctgaacctcgagcgcatcccctgggtcgtccgtaaactgctccaggtgagcgagtccaccggggtggcgctcaagagaagcagctggttaatcgtccttctcgtgctgttcacggtgtctctaagccccgtacagtccgcgccgatcggccacgggaagaccattgaggcctaccgggctcgcgagggctacacaagcatctgcctcttcgtgctgggctccatcctgttcatcgtaagctgcctcatgaaggggctggtcgactccgtgggcaacagctttttccccgggttgtccatctgcaagacctgtagcatctccagcatcaacggcttcgagattgagtcccataagtgctactgcagcctcttctgttgcccctactgccggcactgttccgcggacaaagagatccacaagctgcacctgagcatatgcaagaagcgcaagacggggtccaacgtaatgctcgccgtctgcaagcggatgtgcttccgcgcgaccatggaggtgagcaaccgcgccctgttcattagatccatcatcaacaccaccttcgtcctgtgcatcctcatcctggccgtgtgcgttgtctctacgagcgcggtggagatggagaacctgcccgccggcacatgggagcgcgaagaggacctcaccaacttctgccaccaggagtgccaggtgaccgagaccgagtgtctgtgcccgtacgaggcgctggtcttacggaagcccctcttcctggactccatcgtgaagggcatgaagaacctgctcaacagcacctccctggagaccagcctgtccatcgaggccccctggggcgccattaacgtgcagagcacctacaagcccacggtctccacagccaacatcgccctcagctggtccagcgtggagcaccgcgggaacaagatcctggtgtccgggaggagcgaatccatcatgaagttggaggagcgcaccggcatcagctgggacctcggggtcgaagacgcgtccgagagcaagctgttgaccgtgtccgtgatggacctttcacagatgtacagcccggtcttcgagtacctgtccggcgaccgccaggtggaggagtggcccaaggcgacctgcacgggcgactgccccgagcggtgcggatgcaccagctccacgtgcctgcacaaggagtggccccactctcggaactggagatgcaacccgacctggtgctggggcgtggggaccggctgcacgtgctgcgggctcgatgtcaaggacctgtttaccgactacatgttcgtgaagtggaaggtggaatacatcaagactgaggcaatcgtctgcgtggagctgacctcccaggagcggcaatgcagcctcatcgaggccggaacccgcttcaacctgggccccgtgactatcaccctgtccgagccccggaacatccaacagaagctgcccccggagatcatcacgctgcacccccgcatcgaggaggggtttttcgacctgatgcacgtccaaaaggttctcagcgcatccaccgtgtgcaagctgcagagctgcacccacggcgtccccggggacctccaggtgtaccacatcggcaacctactaaagggcgacaaggtgaacgggcacctgatccacaagatcgagccacactttaacacctcctggatgtcgtgggacggctgcgacctcgactactactgcaatatgggggactggccctcctgcacctacactggcgtcactcagcacaaccacgccagcttcgtgaacctgctgaacatcgagaccgactacacaaagaacttccacttccactccaagcgggtgaccgcccatggggacacgccccagctcgacctgaaggcccgccctacctacggcgccggcgagatcaccgtcctggtggaggtggcggacatggagctccacaccaagaagatcgaaatcagcgggctgaagttcgcctccctgacctgcaccggctgctacgcctgcagctccggtatcagctgcaaggtccggatccacgtggacgagccggacgagctcacggtgcacgtcaagagcgacgaccccgacgtggtggccgcctccagctccctgatggcgcgcaaactggagttcggcaccgacagcaccttcaaggcgttctccgccatgcccaagactagcctctgcttctacatcgtcgagagggagcactgcaagtcctgcagcgaggaggacacgaagaagtgcgtgaacaccaagctggagcagccccagtccatcctgatcgagcacaaggggaccattatcggcaaacagaacagcacgtgcaccgccaaggcctcctgctggctcgagagcgtgaagtccttcttctacggcctgaagaacatgctgagcgggatattcggcaacgtcttcatcgggatctttctcttcctgggcccgttcatcctgctaatcctattctttatgttcgggtggcgaatcctgttctgcttcaagtgctgtcgacggacccgcggcctactgaagtaccgccacctgaaggaggacgaggagaccggctatcgccggatcattgagcgcctcaacaacaagaaggggaaaaacaagctgttagacggcgagcggctcgcggaccgccggatcgcggagctgttctctactaaaacgcacatcggg

SEQ ID NO: 15390 - RNA, 3495 nt, synthetic construct
  misc_feature 1..3495: note = derived and/or modified CDS sequence (opt11) from CCHVF(CCHVF ROS/HUVLV-100)__DQ206448.1__Gn-NSm-Gc
  source 1..3495: mol_type = other RNA
agcgaggaacccggcgacgactgcatctcacgcacccagctgctccggaccgagacggccgagatacacgacgacaactacggtggcccgggggacaagatcaccatctgcaacggcagcaccatcgtggaccagcgcctggggtccgagctgggctgctacaccatcaaccgggtcaagtcattcaagttatgcgaaaactccgccaccggcaagacctgcgagatcgactcaaccccggtgaagtgccgccaggggttctgcctgaagatcacccaggagggccgggggcacgtgaagctgtcgcgcgggagcgaggtcgttctcgacgcgtgcgactccagctgcgaggtgatgatcccgaaggggacgggcgacatcctggtcgactgctccggcggccagcagcacttcctgaaggacaaccttatcgacctgggctgtccccacatcccattgttagggaagatggccatctacatctgccggatgtcgaaccacccccgcaccaccatggccttcctgttctggttctccttcggctacgtgatcacgtgcatcttctgcaaggccctgttctactccctcataatcatcggaaccctggggaagaagatcaaacagtaccgggagctgaagccccagacctgcaccatctgcgagaccgcccccgtgaacgcgatcgacgccgagatgcacgacctcaactgttcctacaacatatgcccgtactgcgccagcaggctgacgtccgatggcctggcccggcacgtcccccagtgccccaagcgcaaggagaaggtggaggaaaccgagctctacctgaaccttgagcggatcccctggatcgtgcgcaaactcctgcaggtcagcgaaagcaccggggtggcgctgaagcggagcagctggctcatcgtactgctggtactcctgaccgtgtccctaagcccggtgcagtccgcccccgtgggccacggtaagacgatagagacctaccagacccgcgagggtttcaccagcatctgcctcttcatgctgggctccattctgttcctcgtgagctgcctggtgaaagggctggtcgactccgtgagcgactccttcttccccggcctcagcgtgtgcaagacgtgctccatcgggtcaatcaacggcttcgagattgagtcccacaagtgttactgcagcctgttctgctgcccctactgccggcactgctccgccgaccgggagatccaccagctgcacctcagcatctgcaagaagcggaagaccgggtccaacgtcatgctggccgtgtgcaagcgaatgtgcttccgggccaccatcgaagcgagccgccgcgccctgctcatccggtccatcatcaataccacgtttgtcatctgtatcctgaccctgaccatctgcgtagtgagcaccagcgccgtcgagatggagaacctcccgtccggcacgtgggaacgcgaagaggacctgaccaacttctgccatcaggaatgccaggtgaccgagacggagtgcctgtgcccctacgaagccctggtactccggaagcccctgttcctggatagcatcgtcaagggcatgaagaacctcctgaactccacgagcctggaaacctccctctccatcgaggccccctggggcgcgatcaacgtgcagtccacattcaagccgaccgtgagcaccgccaacatcgccctgtcttggagctccgtcgagcaccgcgggaataagatactggtgacggggcggagcgaaagcatcatgaagctcgaggagcgcaccggcgtgagctgggatctgggggtcgaggacgcctccgagagcaagctcctcaccgtgtccatcatggacctgagccagatgtacagccccgtgttcgaatacctgtcgggcgacaggcaggtcgaggagtggcccaaggcaacctgcacgggcgattgtcccgagcgctgcgggtgcaccagctccacgtgcctccacaaggaatggccgcatagccggaactggcgctgtaaccccacctggtgctggggcgtggggaccggctgcacgtgctgcggcgtggacgtcaaggacctgttcaccgaccacatgttcgtgaagtggaaggtggagtacatcaagaccgaggccatcgtatgcgtggagttaacctcccaggagcggcagtgcagcctcatcgaggccgggacccgcttcaacctggggcccgtgaccatcactctgtccgagcctcgcaacatccagcagaagctaccgcccgagatcatcacgctgcaccccaaggtcgaggaggggttcttcgacctgatgcacgtgcagaaggtactcagcgcctctacagtctgcaagctgcagagctgcacccacggcattccaggggacctccaggtgtaccacatcgggaacctcctgaagggcgaccgcgtgaacgggcacctgatccacaagatcgagccccacttcaacacctcctggatgtcctgggacgggtgtgacttggactactactgcaacatgggggactggcccagctgcacgtacaccggcgtcacccagcacaaccacgccgccttcgttaacctgctgaacatcgagacggactacacgaaaacattccacttccacagcaagcgggtgaccgcgcacggggacacgccccagctcgacctgaaggcccgcccgacctacggcgccggcgagatcaccgtcctggtggaggtggccgacatggagctccacaccaagaaggtcgagatctctgggctgaagttcgcgagcctggcctgtaccggctgctacgcctgctccagcgggatttcctgtaaggtgcggatccacgtggacgagcccgacgagctcacggtccacgtcaaaagcagcgaccccgacgtcgtggccgcctccaccagcctgatggcgcggaagctggagttcggcaccgactccaccttcaaggccttcagcgccatgcccaagacgtcgctctgcttttacatcgtggagagagaatactgcaagagctgctccgaggaagacacccagaaatgcgtggacaccaagttggagcagccgcagagcatcctgatcgaacataaggggaccatcatcggaaagcaaaacgacacttgtaccgccaaggctagttgttggctcgagagcgtcaagtcctttttctacggcctgaagaacatgctggggagcgtgttcggcaacttcttcatcgggatcctcctgttcctggcgcctttcgtgctcctggtcctgttcttcatgttcggttggaaaatcctcttctgcttcaagtgctgccgccgcacccgggggctgctgaagtaccgcctcctgaaggacgatgaggagaccggctaccggaggatcatcgagcggctgaacaacaagaagggcaagaaccgcctcctggacggggagcggctggccgaccgcaagatcgcagagctgttctcaaccaagacgcatatcgga

SEQ ID NO: 15391 - RNA, 3495 nt, synthetic construct
  misc_feature 1..3495: note = derived and/or modified CDS sequence (opt11) from CCHVF(CCHVF AP92)__DQ211625.1__Gn-NSm-Gc
  source 1..3495: mol_type = other RNA
agcgaaggcggcgacggaggctgcatctcccgaacacaactaatcaaaaccgaaactgctgaagtacacggagacgactacggaggacccggtgagaaaatcacaatctgcaacggctcgaccattgtcgatcaacgactagggagcgaactcggatgttacaccatcaacagaataaaatccttcaaactatgtgaaaactcagcccaggggaaaaactgcgaaatagactcagcccccgttcaatgccggcaaggatactgccttaagatcagccaagaaggaagaggccacgtcaaactcagccgtggctccgaaatcgtacttgacgtctgcgatacatcctgcgagatcatgatcccgaaaggcacaggagacatcctggtcgactgttcaggaggacagcaacactttctacaatccaaccttgtagacctcggctgccccaacatacctctactaggcaaaatggcaatctacatttgccgaatgtcgaatcaccccaaaacaaccatggcgttcctcttctggtttagcttcggatatgtcataacctgcatcctgtgcaagaccctcttctacatactcattataatcggcactctaggcaagaaactcaagcaataccgcgaactcaaaccgcaaacgtgcaccatctgcgagtcagtccccgtcaacgcaattgatgccgaaatgcacgacctaaactgttcatacaacatatgcccctactgtgcctcccgactcacatccgaagggctaacccgtcacgtcaaccaatgcccaaaaagaaaagagaaggtggaggagacagaactatacctaaacctcgagcgcatcccctggattgtccgaaagttactccaagtatcagaatccaccggcgtagcactgaaacgctcctcctggatgattgtcctcctaatcctgctaatagtaagcatgtcacccgtccagtccgcaccaatatcacaggagcgcacggttgccctctaccagagccgcgaagactacatgggcatttgcctggtcataatgggctcagtattactcgccgtatcacttctcgtcagaggcttaatcgactcaatatcgagcaccttctttcccggactctcggtatgccgaacctgccacataggatccataaacggcttcgaaatagaatcccacaaatgctactgcggcctactttgctgcccatactgtcgagcctgctccaccgaccaagacgcacaccagttccaccttagcgtatgcaagaaacgaaaagcaggctccaacgtcatgctggccgtatgcaaacgcatgtgtttcaaagcaatcattgaagccagtaacaaggttctcttcatacggaacgtaatcaacacaacattcgtcgtttgcatcctcgtcatggttgcatgcatagcatctagcgccgccgtcgaaatggaaaatctccctgccggtacatgggaaagagaagaggaactaaccaacttctgccaccaagaatgccaagtaaccgagacagagtgtttatgcccctatgagagcttcatcctacgcaaacctctgttccttgactcgattgccaaaggagtcaagaatctccttaactctaccagccttgaaacctcgttgtctatagaagccccctggggagccataaatgcgcaatcaacttataagcccacagccagctccgcaaatatcgccctaacatggagcagcgtagaacataggggcaacaaaatccttgtcagcggacgatccgaatcaataatgaaactcgaagaacgcacaggaatatcatggaacctcggagtcgaagacgccagcgaaagccggaccctcaccatatcagtcatggatctgtcccaaatgtactcccccgtattcgaatatctcagcggggaccgtcaagtagaggaatggccaaaggctacttgcaccggaaactgcccagaaaggtgcggatgcacctccagtacttgcctctacaaagaatggccccactcacgaaactggcgatgcaaccccacctggtgctggggcgtaggaacaggatgcacttgctgcgggcttgacgtaaaagagctattcacagaccacatgctcgtcaaatggaaagtcgaatacatcaaaaccgaagctatcgtctgcgtcgaactcacatcccaagaacggcaatgtagcctaatagaagccggtacgcgtttctcgctaggccccgtcaccatcacactcagcgaaccccgaaacatacaacagaaactcccgcccgagctaataaccctccaccccaaaatcgaagacggctacttcgacctcatgcacgtacaaaaagtcatgtcagccagcaccgtctgcaaacttcaatcctgcacgcacggggtccccggcgacctccaaatctaccatgtcggcaacttactgaaaggggaccgagtcaacggccacctcatccacaaagtagaaccccatctaaacacgtcatggatgtcatgggacggctgcgacctagactacttctgcaacatgggggattggccaagctgcacatatacgggagtcacacagcacaaccacgctgcattcgcgaacctactaaacatcgaaaccgattacacaaaaacgttccacttccactctaaacgagtaactgcacatggcgatacaccacaactggatctaaaagcccgaccccgatacggagcgggcgaaattaccgttctagtcgaggtcgcggatatggaacttcacaccaagaaagtcgaggtcacaggactgaaattcgcaagcctgacctgcagcggctgctatgcctgctcgtccggcataagctgcaaggtacgcatccacgtcgacgaaccggatgaactaacagtccacgtaaaaagcagtgaccccgatatcgtcgccgcctcctcctccctaatggcccgtaagatcgagttcggagtagactccacgttcaaagcgttttcatcaatgcccaaagactccctctgcttctacatagtagaacgcgactattgcaactcctgcaaaaacgaagagacccaaagatgcgtcaacgccaagctagaacaaccacaatccatcctcatcgaacatacaggcacaatcatcggaaaacaaaacgatacctgcggctccagaaccagctgctggctcgacagcttcaagagcttcttctacggcctaaaaagcatgctatccggcatattcggtaacgtcttcctgggaatattcctcttcctcgccccctttgcactgctcctcttcttcttctttttcggttggcgaatcttgttttgcttcaaatgctgcaggcgaacccgcgggcttttcaaatatcggcacataaaagacgacgaggaggtcggatacaagaaaataatagaacgtctgaacaataaaaagggaaaacatcgccttcttgacggagaacgcctagccgacagaaaaatcgcagagctcttttcgacgaaaacacacattggc

SEQ ID NO: 15392 - RNA, 3495 nt, synthetic construct
  misc_feature 1..3495: note = derived and/or modified CDS sequence (opt11) from CCHVF(CCHVF ArD8194)__DQ211626.1__Gn-NSm-Gc
  source 1..3495: mol_type = other RNA
gcggagggcgggagcaacgactgcgtgtcccgcacccagctggtcaagaccgaggtagccgagatccatgaggacagctacggcgggcctggcgagaagatcacgatctgcaatgggtccaccatcgtggaccagcggctcgggagcgagctgggctgctacaccatcaaccgcgtccggacatacaagctgtgcgagaactccgcgacggagaagtcctgcgagatcgacagcgtgccggtgaagtgcaagcaggggttctgcctcaagatcacccaggagggacgcgggcacgtcaagctgagccggggcaccgaaatcgtgctggacgtgtgcgacacctcctgcgagctcatgatccccaagggcacgggcgacattcttgtcgactgcagcggcgggcagcagcacttcctgcaggacaacctcatcgacctgggatgccccaacatccccctgctcgggcgcacggctatctacgtgtgccggatgtccaaccatccgaagaccacaatggccttcctattctggttcagcttcggctacgtgatcacgtgcgtcgtgtgtaaggtgctgttctacttgctgatcgtaatcggcaccctggggaagcgcctgaagcagtaccgggagttgaagccccagacctgcatcgtgtgcgagtccatccccgtgaacgccatcgacgccgagatgcatgacctgaactgcaattacaacatctgcccctactgcgcgagccgcttgacctccgacggcctggtccggcacgtgacgcagtgcccgaagcgcaaggaaaaggtggaggagaccgagctgtacctcaacctggagcggatcccctggctggtccgcaagctcctccaggtgagcgagtccacaggggtggccctaaagcggagctgctggatgatcaccctcctgatactgctcacggtctccatgtcgcccgttcagagcgcccccgtcggtcacaaaagggccgtggaggtataccagatgcgggaatcctacacagggatctgcctcttcgtcctgggcagcgtgctgttcgcggtgagctggctggtcaaggccctgatcgactctatcggcaactcattcttcccagggttaagcatatgcaagacctgctccattggcagcatcaacgggttcgagatcgagtcccacaagtgctactgcagcttgttctgctgcccctactgccgcgcctgctctagcgacaagatcacccaccgcatgcacctgaacgtatgcaagaagcgcaaggtgggctccaacgtcatgctcgccgtgtgtaagcggatgtgctttaaggccactatcgaggccagcaaccgcgccaccttcatccgcaacatcattaactcgaccttcgtgatatgcatcctgatcctggtcatctgcgtggtgtctacctccgccgtcgacatggagaacctccccgccgggatctgggagaaggaggaggacttgacgaacttttgccaccaggagtgccaggtgaccgagaccgagtgcctgtgcccctacgaagctctcatgctgcggaagccgctgttcctggaccgcattgcgaagggcatgaagtccctcctcaacagcaccagcctggagacgagcctctccatcgaggccccctggggcgccatcaacgtccaaagcaccttcaagcccaccgtctccgccgccaacattgcgctgagctggtccagcgtcgaacacaaggggaacaagatactggtgtccgggcgtagcgagtccatcatgaagctagaggagcgcaccgggatcagctggtgtctgggcgtcgaggacgcctccgagtctaagactctgaccgtgtccgtaatggacctcagccagatgtattcccccgtcttcgaatacctgagcggggaccgccaggtagaggagtggccgaaggcgacatgcaccggcgactgccccgagcggtgcggctgcacctccagcacgtgcctgcacaaggagtggccccacagccggaactggcgctgcaaccccacctggtgctggggcgtgggtaccgggtgcacgtgctgcgggctcgacgtcaaggacctgttcactgactatatgctggtgaagtggaaggtggagtacatcaagaccgaggccatcatctgcgtcgagctcacctcccaggagagacagtgcagcctgatcgaggctggcacccgctttaacctggggcccgtgacgatcaccctcagcgagccccggaacgtgcaacagcgcctgccgcccgagatcatcacccttcaccccaagatcgaggagggctttttcgacctcatgcacgttcagaaggtgatgagcgcctccaccgtgtgcaagctgcagagctgcacgcacggggtccccggcgacctccaggtgtaccacgtagggaacctcctgaaaggcgacaaggtcaacggccactccatccacaaaatcgagtcccacctgaacacctcctggatgagctgggatgggtgcgacctcgactacttctgcaacatgggcgactggccctcctgcacctacaccggggtgacgcaacacaaccacgcagcctttatcaacatgctgaacatcgagaccgactacaccaagaccttccacttccacagcaagcgggtcacggcccacggcgataccccgcagctggacctcaaggcgcgccccgcctacggggccggcgagatcacagtactggtggaggtggccgacctggagctccacaccaagaagatcgaggtcagtggcctgaaatttgccagcctgtcatgcagcgggtgctacgcgtgcagctctggcatctcgtgcaaggtgcggatccacgtgaacgagcccgacgagttcactgtccacgttaagagcaacgaccccgatgtggtggccgcagggagctccctcatggcccgcaagattgagagcggagccgactccaccttcaaggcgttcagctctatgccgaaaaacagcctttgtttctacatcgtggagcgggactactgctccagctgcaccgacgacgacacccagaagtgtgtcgacatcaagctggagcacccccagtccatcctcatcgagcacaagggtacgatcatcggcaagcaaaacgacacgtgcccaaccaagaccagctgctggctggagtccatcaagagcttcttctacggcctgaagaacatgctctcagggatcttcggcaacgtgttcctggggatgctgctgttcctggcccccttcatcctgctcatcctgttcttcttcttcggttggaggttactgttctgcctgaagtgctgccggcgcacccgcaagctgctcaagtacaagcacctccgggacgaggaagagtcggggtacaagaagatcatcgagcgcctgaatgacaagaagggcaagagccgcctctttgacggcgagcggctggccgacaggaagatcgccgagctgttcagcaccaagacacacatcggg

SEQ ID NO: 15393 - RNA, 3495 nt, synthetic construct
  misc_feature 1..3495: note = derived and/or modified CDS sequence (opt11) from CCHVF(CCHVF ArD15786)__DQ211627.1__Gn-NSm-Gc
  source 1..3495: mol_type = other RNA
gccgagggcggcagcaacgattgcgtctcccgcacccagctggtcaagaccgaggtgacagaaatccacgaggatagctatggcgggccgggagagaagatcaccatctgcaacgggagtaccatcgtggaccagcgactcggcagcgagttgggctgctacaccatcaaccgcgtccggacgtataagttgtgcgagaactccgccaccgagaaatcatgcgagatagactcggtgccggtgaaatgcaagcaaggtttctgcctcaagatcacccaggagggccgcgggcacgtcaaacttagccgggggaccgagatcgtgctggacgtgtgcgacacgtcctgcgagctcatgatacccaaggggaccggcgacatcctggtcgactgcagcggcgggcagcagcactttctgcaggacaacctcatcgatctcggctgccccaacatccccctgctcgggcaaaccgcgatctacgtgtgccgaatgagtaaccacccgaagaccacgatggcctttctgttctggttctcattcggctacgtgatcacatgcgtcgtgtgcaaggtgttattctacttactgatcgtcatcggcaccctgggtaagcggctcaagcagtaccgcgagctgaagccccagacttgcatagtgtgcgagtccatccccgtgaacgcaatcgacgccgaaatgcacgacctgaactgtaactacaacatctgcccctactgcgctagcaggctcacgtccgacggcttagtccgccacgtgacccagtgcccgaagcggaaggagaaggtagaggagaccgagctgtacctcaacctcgagcgcatcccctggctggtcagaaagctcctacaggtgagcgagtccaccggcgtcgcgctcaagagaagctgctggatcatcacgctcctgatcctgctgaccgtctccatgagccccgtgcagagcgcccccgtcggccacaagcgggcggtggaggtttaccaaatccgcgagtcttacaccggaatctgtctgttcgtcctgggcggcgtcctcttcgctgtgagctggctggtgaaggcgctaatagactccatcgggaactccttcttcccgggactctccatctgcaaaacctgcagcatcgggagcataaacggcttcgagattgagagtcacaagtgctactgctccctgctgtgttgcccctattgccgggcctgtagctctgacaagatcacgcaccgcatgcatctgaacgtgtgcaagaagcggaaggtggggagcaacgtgatgctggccgtgtgcaaacgcatgtgctttaaggccaccatcgaagccaacaaccgggcgaccttcatccgcaacatcatcaactccaccttcgtgatctgcatcctgatcctcgtgatatgcgtggtgtcgacgtccgccgtggacatggagaacctgcccgccggcatctgggagaaggaggaggacctgaccaacttctgccatcaggagtgccaagtgacagagaccgagtgtctctgcccctacgaggcccttatgctgcgcaagccgctgagcctggactctatcgccaaaggtatgaaaagcctcctgaactccacgagcctcgagaccagcctgtcgatagaggccccgtggggtgcaatcaacgtccaaagcaccttcaagcccaccatctccgcggccaacatcgccctgagctggtccagtgtcgagcataaggggaacaagattttggtatcagggcgaagcgagtccatcatgaagctggaggagcgcacgggcatctcctggtgcctgggggtggaggatgcgtccgagtcaaagaccctcaccgtttccgtaatggacttgagtcagatgtactcccccgtgttcgagtacctgagcggcgaccggcaggtcgaggagtggccgaaggcgacctgcaccggcgactgccccgaacgctgcgggtgcacgtccagcacatgcctccacaaggagtggccccacagccggaactggcgctgcaaccccacctggtgctggggcgtggggaccgggtgtacgtgctgcggactggacgtgaaggacctgttcactgactacatgctcgtcaagtggaaggttgagtacatcaagaccgaggccatcatctgcgtggagctgacttcccaggagcggcagtgcagcctgatcgaggccgggacacgcttcaacctcggcccggtcaccattacgctgtccgagccacggaacgttcagcagcgcctgccgcccgagatcatcaccctccatcccaagatcgaggaggggttcttcgacctgatgcacgtacagaaggtcatgtccgcctctacggtgtgcaagctgcaaagctgcactcacggcgtgcccggggacctccaggtctaccacgtgggcaacctcctgaagggcgacaaggtgaacggacactccatccacaagatcgagtcacacctcaatacctcctggatgagttgggatgggtgcgacctggactacttctgcaacatgggggactggccttcctgcacctacacgggcgtcacccagcacaaccgggcggcattcatcaacatgctaaacatcgaaaccgactacaccaagacgttccatttccacagcaagcgcgtgaccgcccacggggacaccccacagctcgacctgaaggcccgtcccacctacggcgcgggcgagatcacggtgctggtcgaggtggccgaccttgagctgcataccaagaagatcgaggtgtccgggctgaaattcgccagcctgacctgctccggttgctacgcctgcagctccggcataagctgcaaggtccgcatccacgtcaacgagcccgacgagttcaccgtacacgtcaagtccaacgaccccgacgtggtggccgcgggcagctccctcatggcccggaaaatcgagtccggggccgacagcacgttcaaagccttctccagcatgccgaagaactccctgtgtttctacatcgtcgagcgcgattactgcagctcctgcacagacgacgacacccagaagtgcgtggacataaagctcgagcacccgcaaagcatcctgatcgaacacaaaggcaccattatcggcaagcagaacgacacgtgccccacaaaaacctcctgctggctggagagcatcaagtccttcttctacggactcaagaacatgctgagcgggatcttcggcaacatcttcttaggcatgcttctgttcctggcccccttcgtcctcctgatcctgttcttcttcttcgggtggcggctcctgttctgcctgaagtgctgtcgccggacccgcaagctcctaaagtataagcacctgagagacgaggaagagtcaggctataagaaaatcatcgagcggctcaacgataagaagggaaagagccgcctgttcgacggagagcggttggcggaccgcaagatcgccgaactcttctccacgaagacccacgtgggc

SEQ ID NO: 15394 - RNA, 3495 nt, synthetic construct
  misc_feature 1..3495: note = derived and/or modified CDS sequence (opt11) from CCHVF(CCHVF ArD39554)__DQ211628.1__Gn-NSm-Gc
  source 1..3495: mol_type = other RNA
agcgagtccaacaataacgactgcgtgagccgcacccagctgatcaagaccgagaacgccgagatccacggcgacgactacgggggccccggggagaagatcacgatctgcaacggctccaccatcgtcgagcagcggctcgggagtgagctgggctgctacaccatcaaccgcatcaagtccttcaagctgtgcgagaacagcgcctccggcaaggggtgcgagatcgactctaccccggtgaagtgcaagcagggcttctgcctcaagatcacgcaggaggggcggggccacgtgaagctgtcccgcgggagcgagatcatcctggacgtctgcgactccagctgcgagatgatgatccccaagggctccggcgacatcctcgtggactgcagcgggggccagcagcacttcctgcaggacaacctggtggacctcgggtgccccaacgtccccctgctgggcaagatggcgatctacatctgccggatgtcaaaccacccgaagaccaccatggccttccttttctggttcagcttcggctacgtgataacctgcatcttctgcaaggtgatcttctacgtcctgatcatcatcgggaccctgggcaaacgcatcaagcagtaccgggagctcaagccccagacctgcacaatctgcgaggccacccccgtgaacgccatcgacgccgagatgcacgacctgaactgctcctacaacatctgcccctactgcgcgtcgcgcctgacgtccgaggggctcgtgagacacgtcacccagtgtccgaagcgcaaggagaagatcgaggagaccgagctgtaccttaacctcgagcggatcccctggttcgtgcgcaagctgctccaggtgagcgagagcaccggcgtcgccctcaagcggtcaagctggctggtgacgctgctcgtgctgctgaccgtctccctcagccccgtgcagtccgcccccatcgggcaggagcgcaccgtggtaacctaccaggtgcgggagagctacacgggcatgtgcctgttcatcctgggctccgtgctgttcgccatcagctggctgaccaagggcctggtcgactccgtgggcaacatcttcttcccggggctcagcgtctgcaagacctgctccatcggaagcatcaacgggtttgagatcgagtcccacaagtgctactgcagcctgttctgctgcccctactgccggtactgctccgcggaccggggcgcccaccagagccacctgtccgtgtgcaagaagcgcaagaccggcagcaacgtaatgctcgccgtctgcaagcggatgtgcttccgcgccacgctgaaggtgtccagcgaggccctgatcatcagaagcatcatcaacaccacctttgtggtctgcatcctcatcctggtggtgtgcgtcgtgtccaccagcgcggtagagatggagaacctgccagccgggacctgggagaaggaggaggacttaaccaacttctgccaccaagagtgccaggtcaccgagaccgagtgcctgtgtccctacgaagccttcgtgctgcgcaagccgcttttcctggactccacggccaagagcatgaagtccctgctgaactctacctccctggagaccagcctgtccatcgaggccccctggggcgcgatcaacgtgcagagcaccttcaagcccacggcctctaccgccaacatcgccctgagctggtccagcgtcgagcaccgcgggaacaagatcctcgtgacaggccggtccgagagcatcatgaagctggaggagcgcaccgggatctcctggaacctgggcgtggaggacgccagcgagagcaagaccctcacggtctccgtgatggacctgagccagatgtactccaccgtgttcgagtacctgagcggcgaccggcaagtcgaggagtggcccaaggcgacctgcaccggggactgcccggagcgctgcggctgcacgtcctctacctgcctccacaaggcctggccgcacagccggaactggcgctgcaaccccacctggtgctggggcgtggggaccggctgcacgtgctgcgggctggacgtgaaaaacctgttcaccgactacatgctcatcaagtggaaggtcgagttcatcaagaccgaggccatcgtgtgcgtggagctgaccagccaggagcggcagtgctccctgatcgaggccggcacgcgcttcaacctcggtcccgtcaccatcaccctgagcgagccccggaacatccagcagaagctgccgcccgagcttgtgaccctgcacccccgcgtggaggagggtttcttcgacctgatgcacgtccagaaggtgctctccgccagtacggtgtgcaagctgcagtcctgcacccacggggtccccggcgacctccaggtgtaccacgtgggcaacctgctgaagggggacaagatcaacggcaacagcttccacaagatcgagcctaacctgaacacctcctggatgagctgggacgggtgcgacctcgactactactgcaacatgggcgactggccatcctgtacctatacgggggtcacccagcacaaccacgcggccttcgtgaacctgcttaacatcgagaccgactacaccaagaacttccacttccacagcaagcgggtgacggcccacggcgagaccccgcaactcgacctgaaggcccgccccaagtacggcgcgggggaggtcaccgtcctggtggaggtcgccgacatggagctacacaccaagaagatcgagatctccggcctgaagttcgccagcctgacgtgcaccgggtgctacgcctgtagctccggcatcagctgcaaggtgcgactccacgtggacgagcctgacgagctgaccgtccacgtgaagtccgacgaccccgacgtggtcgccgcgagctccagcctgatggcccgcaaaatcgagttcgggaccgactccaccttcaaggccttcagctccatgccgaaggacaagctctgcttctacatcgtggaacgggactactgcagctcctgcagcaaggaggacacccagaagtgcgtgaacgccaagctggagcagccccagtccatcctgatcgagcacaagggcaccatcatcggcaagcagaacgatacctgcacggtcaaggccagctgctggctcgagtctgtcaagagcttcttctacgggctgaagaatatgctgggagggatcttcggcaacgtgatcctcgggatcatcatgttcctggcgcccttcgccctactcctgctgttcttcctcttcggctggcgcatcctgttctgcctgcggtgctgccgccggacccgcggcctattcaagtacaagcacatcaaggacgacgaggagtccgggtacaagcgcatcatcgagcggctgaacaacaagaagggcaagaacaaactgtttgacggggagcgcttggcagacaagaagatcgcagagctgttcagcaccaagacccacatcggc

SEQ ID NO: 15395 - RNA, 3495 nt, synthetic construct
  misc_feature 1..3495: note = derived and/or modified CDS sequence (opt11) from CCHVF(CCHVF C-68031)__DQ211629.1__Gn-NSm-Gc
  source 1..3495: mol_type = other RNA
agcgaggaatccggcgacgactgcatcagccgcacccagctctcccggactgagacggccgagatccactcggacaactacgggggccccggtgacaagatcaccatctgcaatggctccaccatcgtggatcagcgcctcgggagcgagctgggctgctacaccatcaaccgggtcaagtctttcaagctgtgcgagaacagcgccacgggcaagtcctgcgagatcgacagcaccccgatcaagtgccgccaagggttctgcctcaagatcacccaggagggcagggggcacgtgaagctgtcccgcggcagcgaggtagtcctggacgcttgcgactccagctgcgagatcatgatccccaaggggaccggcgacatcctcgtggactgctccggcgggcagcagcacttcctgaaggacaacctgatcgacctcggctgccccaacatccccctgctggggaagatggccatctacatctgccgaatgagcaaccacccgaagacaaccatggccttcctcttctggttctccttcggctacgtgatcacgtgcattttatgcaaggtcatcttctacctgctcatcgtggttggcaccctggggaagaagttcaaacagtaccgcgagctgaaaccccagacctgcactatctgcgagaccacccccgtcaacgccatcgacgccgagatgcacgacctcaattgcagctacaacatatgcccctactgcgcgtcccggctgacgagcgacggcctggcccgccacgtgatgcagtgcccgaagcggaaggagaaggtggaggagaccgagctctacctgaacctggagcgcatcccctgggtcgtgcggaagctcctccaggtgagcgagtccaccggggtcgccctgaagcgcagctcctggctcgtggtgctgctggtcctcctgaccgtgagcctgtcccccgtgcaaagcgcccccatcggccacgggaagacggtcgagacctaccagacccgggagggctacacctccatctgtctcttcgtgctgggcagcatcctgtttatcgtgtcctgcctcatgaaggggcttgtcgacagcgtgggcaactccttcttcccggggctgtccatctgcaagacgtgctccatcggcagcatcaacgggttcgagaccgagtcccacaagtgctactgcagcctcttctgctgcccctactgccgccactgctccgcggaccgggagatccacaagctgcacctgagcatctgcaagaagcgcaagacaggctccaacgtcatgctcgccgtgtgcaagcggatgtgctttcgcgccaccgtggaggtcagcaacaaggccctgctgatacggaacatcatcaacacgaccttcgtggtgtgcatcctcatcctggccgtctgcgtggtgagcacctccgcggtcgagatggagagcctgcccgccggcacctgggagcgcgaggaggacctcacgaacttttgccaccaggagtgccaggtgaccgagaccgagtgcctgtgtccctacgaggccctggtgctgcgcaagcccctcttctcagacagcatcgtcaaggggatgaagaacctactgaactccacctcgctcgagacgtccctgagcattgaggccccctggggcgccatcaacgtgcagtccaccttcaagcccaccgtgagcgcggccaacatcgccctgtcctggagctccgtcgagcaccgggggaacaagatcctcgtgagcggccgttccgagagcatcatgaagctggaggaacggaccgggatctcctgggacctgggcgtggaggacgcctcggagagcaagctcctgaccgtctccatcatggacctgagccagatgtactcccccgtctttgagtacctcagcggggaccgccaggtcgaggagtggccgaaggccacgtgcaccggggactgccccgagcgctgcggctgcacctccagcacgtgcctgcacaaggagtggccccactcccgcaactggcggtgcaaccccacctggtgctggggcgtcggcaccggctgcacatgctgcgggctggacgtgaaggacctcttcaccgactatatgttcgtgaagtggaaggtcgagtacatcaagaccgaggcgatcgtgtgcgtggagctgaccagccaggagcgtcagtgctccctgatcgaagccggcacccggttcaacctcgggccggtcaccatcacgctgagcgagccccgcaacatccagcagaagctgccgcccgagatcgtgacccttcacccgcggatcgaggaggggttcttcgacctgatgcacgtgaagaaggtcctgtccgcctccaccgtgtgcaagctccagtcctgcacccacggggtgcccggcgacctgcaggtctaccacatcggcaacctgctgaagggggacaaggtgaacggccacctaatccacaagatcgagccccacttcaacacgagctggatgtcctgggacgggtgcgacctggactactactgcaacatgggcgactggccgagctgctcctacaccggggtgacccagcataaccacgccgcctttgtcaacatgctcaacatagagaccgactacacgaagatcttccacttccacagcaagcgcgtgaccgcgcacggcgacacgccccagctggacctgaaggcccggcccacctacggcgcaggggagatcaccgtgctcgtcgaggtggccgacatggagctgcacaccaagaaaatcgagatctccggcctgaaattcgcgagcctgacctgcaccgggtgctacgcctgcagctccggcatcagctgcaaggtgcggatccacgtcgacgaacccgacgaactgacagtgcacgtgaagtccgaggacccggacatcgtcgccgccagctccagcctgatggcccggaagctcgagttcgggaccgactccaccttcaaggcgttcagcgccatgcccaagacgtccctgtgcttctacatcgtggagcgcgagtactgtaagagctgctccaaggaggacacgcagaagtgcgtgaacaccaagctggagcagccccagagcatcctcatcgagcacaagggcaccatcatcggcaagcagaacgacacgtgcacctccaaggccgggtgctggctggagagcgtcaagtccttcttctacggcctgaagaacatgctcagcgggatcttcggcaacgtgttcatcgggatcttcctgttcctggcccccttcattctcctgatccttttctttatgttcggctggcggatcctcttctgcttcaagtgctgccgtcggaccagaggactgttcaagtaccgccacctgaaagacgacgaggagaccgggtaccggaagatcatcgagcgcctcaacaacaagaagggcaagaacaagctgctagacggggagcgcctcgccgaccgcaagatcgcggagctgttctccaccaagacccacatcggc

SEQ ID NO: 15396 - RNA, 3495 nt, synthetic construct
  misc_feature 1..3495: note = derived and/or modified CDS sequence (opt11) from CCHVF(CCHVF Drosdov)__DQ211630.1__Gn-NSm-Gc
  source 1..3495: mol_type = other RNA
tctgaggagcccggggacgactgcatatcccgcactcagctgctcaaaaccgaaacagcggagattcatgacgacaactacgggggtccgggggacaaaatcaccatctgcaacggatccactatcgtagaccagcggctggggtccgagctgggttgctacactatcaaccgcgttaagtccttcaagctctgcgaaaattccgccacgggcaaaacctgtgagattgactcgacccccgtaaagtgccgccaggggttctgtttaaaaatcactcaggagggacgcgggcatgtgaaattatccagaggctcagaggtcgtactcgacgcgtgcgactccagctgcgaggtcatgatccccaagggcacgggcgacatactggtcgattgctccggcgggcagcaacactttctgaaagacaacttaatcgacctgggttgcccccatatcccgctgctcggtaagatggccatttacatctgccggatgagcaaccacccgcggaccaccatggcctttttattctggttttccttcggctacgtgataacctgcatcttctgtaaggctctgttctacagcctcatcatcatcggtaccctcgggaagaaaatcaagcagtaccgcgagctgaagccccagacatgcaccatatgcgagaccgcccccgtgaacgccatcgacgcagagatgcacgacctcaagtgcagctacaacatatgtccctactgcgcatcacggctgacgtccgacggcctggccaggcacgtcacacagtgtcccaaacggaaggagaaggtggaggagaccgagctctacctgaatctggagcgcatcccctggatcgtacggaagctcctccaggtgagtgagtccacgggggtagctctgaagcgtagcagctggctgatagtgcttctggtacttctgacggtgtcgcttagccctgtccagtccgcgccggtcggccacggtaagaccatcgagacttaccagaccagggaggggttcacgtctatttgtctcttcatgctggggtccatcctgttcattgtgtcttgcctcgtgaaagggctggtcgactccgtgagcgacagtttcttcccaggactgagcgtgtgcaagacctgctccatcgggagcatcaacggattcgagatcgagtcccacaaatgctactgctcgctgttctgctgcccctactgccgccactattcagccgaccgtgagatccaccagctccatctgagcatctgcaagaagcgcaagaccgggtccaacgtaatgctcgctgtgtgtaagcggatgtgtttcaaggcgaccatcgaggccagccgccgggccctgctgatccgtagtatcattaacacgaccttcgtcatctgcatacttatcctagccatctgcgtggttagcacctccgccgtggagatggaaaatctgccggccggcacctgggagcgcgaagaggatctcacgaacttttgccaccaggagtgccaggtgaccgagaccgaatgcctgtgtccgtacgaggctctggtactacggaagcccttatttctggattccaccgtaaaagggatgaaaaacctgctaaactcgacgtccctggaaacctcactctctatcgaggccccttggggcgccatcaacgtccagagcaccttcaagccaacagtgagcacagccaacatcgcactgagctggtcgagcgtcgaacaccgcgggaacaagatcctggtaacgggccggtccgagagcatcatgaagctagaggagcgtacaggcgtgtcctgggacctcggggtcgaggacgcatcggagtccaagctgctgaccgtgagcatcatggacctctcccagatgtacagcccggtgtttgagtatctgagtggcgacagacaggtcgaggagtggcccaaggcgacctgcacaggcgactgccctgagcgctgtgggtgcaccagtagcacttgcctgcataaagaatggccccactcccggaactggcgctgcaacccgacctggtgctggggcgtggggaccgggtgcacttgctgtggcgtggacgtcaaggacctcttcactgaccatatgttcgtgaagtggaaggtggagtacatgaagaccgaggccattgtctgcgtggagctgaccagccaggagcgtcagtgctccctgatcgaagccggcacccgcttcaatctcgggccagtgacaatcaccctgtcggagccccggaacatacagcaaaagctgcccccggagatcataaccctccaccctaagatcgaggagggattcttcgatctgatgcacgtccagaaggtgctttccgccagcacagtgtgtaagctccagtcctgcacccacggcatccccggggacctgcagatctaccatatcggcaacctgctcaagggcgaccgcgtcaacgggcacctgatccacaagatcgagccccacttcaacacctcatggatgtcttgggatggctgcgacctggactactactgcaacatggggaactggccctcatgcacgtacaccggcgttacccagcataaccacgcggctttcgtgaacctcctgaacatcgagaccgactatacgaagaccttccactttcactccaaacgagtcaccgcccacggtgatacgccccagctggatctcaaggcgcgccccacctacggtgcaggcgagattaccgtactggtagaggtggcggacatggaactgcacacgaagaaggtggagatcagcgggctgaagttcgcttcgctcgtctgcacaggctgctacgcctgcagctccgggatcagctgcaaggttcgcatacatgtggacgagcccgacgagctgacggtgcacgtcaagtccagcgatcccgacgtagtggcggcgagcacctccctcatggcccgcaagctcgagtttggtaccgacagcatcttcaaggccttctccgcaatgcccaagacctcgctgtgtttctacatcgtcgagcgtgagtactgcaagtcctgcagcgaggatgacacgaagaagtgcgtggacactaagctcgaacagccccaaagtatcctgatcgaacacaaggggaccataatcggcaagcaaaacgacacatgcaccgccaaggcgtcgtgctggctggagtccgtcaagagcttcttctacggcctcaagaacatgctagggtccgtgtttggcaacttcttcgtggggatcctcctcttcctggcccctttcgtgctgctagtcctgttcttcatgttcggctggaaaatcctattctgtttcaagtgctgccgccgaactcgcggtctcttcaagtaccgccatctgaaggacgacgaagagaccgggtacaggcggatcatcgagcggctgaacagcaaaaagggcaagaaccggctcctggacggggagcggttagccgaccgtaagatcgccgagcttttctccaccaagacccacatcggc

SEQ ID NO: 15397 - RNA, 3495 nt, synthetic construct
  misc_feature 1..3495: note = derived and/or modified CDS sequence (opt11) from CCHVF(CCHVF Kashmanov)__DQ211631.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagttaggctgctacaccatcaaccgggtcaagagcttcaagttatgcgagaactccgccacgggcaagacctgcgagatcgatagcacccccgtgaagtgccggcaggggttctgcctgaagatcacccaggagggccgcgggcacgtgaagctgtcccggggcagcgaggtcgtgctcgacgcgtgcgactccagctgcgaggtgatgatccccaaggggacgggcgacatcctggtcgactgctccggcggacagcagcacttcctgaaggacaacctcatcgacctgggctgcccccacatcccgctgctcgggaagatggccatctacatctgccggatgagcaatcacccccgcaccaccatggccttcctgttctggttctccttcggctacgtgatcacgtgcatcttctgcaaggccctgttctacagcctcatcatcatcggcaccctggggaagaagatcaagcagtaccgggagctgaagccccagacctgcaccatctgcgagaccgctcccgtgaacgcgatcgacgccgagatgcacgacctcaactgctcctacaacatctgcccgtactgcgcgagccgcctgacgtccgatggcctggcccggcacgtcccccagtgccccaagcgcaaggagaaggtggaggagaccgagctctacctgaacctggagcggatcccctggatcgtgcggaagctcctgcaggtcagcgaatccaccggggtggcgctgaaacggagcagctggctcatcgtgctgctggtcctcctgaccgtgtccctgagcccggtccagtccgcccccgtcggccacgggaagacgatcgagacctaccaaacccgcgagggcttcaccagcatctgcctcttcatgctgggctccatcctgttcctcgtgagctgcctggtgaaggggctggtcgatagtgtgagcgactccttcttccccggcctcagcgtgtgcaagacgtgcaccatcgggtccatcaacggcttcgagatcgagagccacaagtgctactgctccctgttctgctgcccctattgccggcactgcagcgccgaccgcgagatccaccagctgcacctctccatttgcaagaagcggaagaccgggagcaacgtcatgctggccgtatgcaagcgcatgtgcttccgtgccaccatcgaggcgtcccgccgcgccctgctcatacggtcaatcatcaacacgaccttcgtcatctgcatcctgactctgacgatctgcgtggtatccaccagcgccgtcgagatggagaacctcccgagcggcacctgggagcgcgaggaggacctgaccaatttctgccaccaggagtgccaggtgaccgagacggagtgcctgtgcccctacgaggccctggtgctccggaagcccctgtttctggactccatcgtcaagggcatgaagaacagcctaaactccaccagcctggagaccagtctgagcatcgaggccccctggggcgcgatcaacgtgcagtccaccttcaagccgaccgtgagcacggccaacatcgccctctcctggagctccgtcgagcatcgcgggaacaagatcctggtgaccgggcggagcgagtccatcatgaaactggaggagcgtaccggcgtgtcgtgggacctcggggtcgaggacgcctccgagagcaagctgctgaccgtgtccatcatggacctcagccagatgtacagccccgtgtttgagtacctgtccggcgaccggcaagtcgaggagtggcccaaggccacgtgcaccggcgactgccccgagcggtgcgggtgcaccagctccacgtgcctgcacaaagagtggccacacagccggaactggcgctgtaaccccacctggtgctggggcgtggggaccggctgcacttgctgcggcgtggacgtcaaggacctcttcaccgaccacatgttcgtgaagtggaaggtggagtacatcaagacagaggcgatcgtctgcgtggagctgacctcccaggaacggcagtgcagcctgatcgaggccggcacccgcttcaacctcggccccgtgaccatcaccctgtccgagccccggaacatccagcagaagctgccgcccgagatcatcacccttcacccgaaggtagaggaagggttcttcgacctgatgcacgtgcagaaagtgctgagcgcttccaccgtctgcaagctccagagctgcacccacggcatcccgggggacctccaggtgtaccacatcggcaacctgctcaagggcgaccgcatcaacgggcacctgatccacaagattgagccgcacttcaacacttcctggatgagctgggacggctgcgacctggactactactgcaacatgggggactggccttcctgcacctacaccggcgtgacccagcacaaccacgccgccttcgtcaacctactgaacatcgagaccgattacaccaagaccttccacttccacagcaagcgggtgaccgcgcacggggacacgccccagctggacctcaaggcccgcccgacctacggcgccggcgagatcaccgtgctagtcgaggtggccgacatggagctgcacaccaagaaggtggagatctccgggttaaagttcgcgagcctggcatgcacgggctgctacgcctgctccagcgggatctcctgcaaggtccggatccacgtggacgagcccgacgagctgacggtacacgtcaagagcagcgaccccgatgtggtggccgcctccaccagcctcatggcgcgcaagctggagttcggcaccgactccacgttcaaggcattcagcgccatgcccaagacctcactgtgcttctacatcgtcgagcgggagtactgcaagagctgctccgaggaggacacccagaagtgcgtggacaccaagctcgagcagccgcagagcatcctgatcgagcacaaggggaccatcatcggcaagcagaacgacacgtgcaccgccaaggcctcctgctggctggagagcgtgaagtccttcttctacggcctcaagaacatgctggggagcgtcttcggcaacttcttcatcgggatcctgctgttcctggcgcccttcgtgctgctcgtgctattcttcatgttcggctggaagatcctgttctgcttcaagtgctgcaggcgcacccgggggctcctgaagtatcgccacctgaaggacgacgaggagaccggctaccggcgcatcatcgagcggctcaacaacaagaagggcaaaaaccgactgctggacggggagcggctcgccgaccgcaagatcgccgagctgttctccacgaagacacacatcggc

SEQ ID NO: 15398 - RNA, 3495 nt, synthetic construct
  misc_feature 1..3495: note = derived and/or modified CDS sequence (opt11) from CCHVF(CCHVF Oman)__DQ211632.1__Gn-NSm-Gc
  source 1..3495: mol_type = other RNA
agcgaggagagcggggaggattgcatcagccgcacccagctgctccggaccgagacagccgagattcatggggacaactacggcgggcccggcgacaagatcaccatctgcaacgggtccaccatcgtggaccagcgcctgggcagcgagctgggctgctacaccatcaaccgggtcaagtccttcaagctatgcgagaacagcgccacgggcaagagctgcgagatcgacaacaccccggtgaagtgcaagcaggggttctgcctgaagattacccaggaggggcggggccacgtgaagctgagccgggactccgaggtcgtgttggacgcgtgcgacagctcctgcgagatcatgatccccaaggggacgggcgacatacttgtggattgcagcggcgggcagcagcacttcctcaaggacaacctcatcgacctgggctgccccaacatccccttactcgggaagatggccatctacatctgccgcatgtcaaaccacccgaagacgaccatggccttcctgttctggttcagcttcggctacgtcatcacctgtattctgtgcaaggtgatcttctacctcctgatcgtggtcggcacgctggggaagaagtttaagcagtaccgggagctcaagccccagacctgcaccatctgcgagaccacccccgtgaacgccatcgacgccgagatgcacgacctgaactgctcatacaacatctgcccctactgcgcgtctcgcctgacgtccgacggcctcgcccggcacgtgatgcagtgtccgaagagaaaggagaaaatcgaggagaccgagctgtacctgaacttggagcggatcccctgggtcgtgcggaagctgttacaggtgagcgagtccaccggggtcgccctcaagcgcagcagctggctgatcgtgctgctcgtgctgctgaccgtctccctcagccccgtgcagtccgcccccatcggccacgggaagaccatcgagacctatcagacccgcgaagggtacaccagcatctgcctgttcgtgctgggctccatcctcttcatcgtcagccacctgatgaaggggctggtggactcagtgggcaactctttcttcccggggctctccatctgcaagacgtgcagcatcggctccatcaacgggttcgagatcgaaagccacaagtgcttctgctctctgttctgttgcccatactgccggcactgcagtgcggacaaagagatccacaagctgcacctctccatttgcaagaagcgcaaggccggcagcaacgtcatgctggccgtgtgtaagagaatgtgcttccgcgccacgatggaggtctccaataaggccctactcatacggagcgtcatcaacaccaccttcgtggtctgcatcttaatcctggcggtgtgcgtggtctccacgagcgccgtagagatggaaagcctcccggcgggcacctgggagcgggaggaggacctgaccaacttctgccaccaggagtgtcaggtgaccgaaaccgagtgcctgtgcccctacgaggccctggtcctccggaagccgctgttcttggatagtatcgccaaggggatgaagaacctcctgaacagcacctccctggagacctcactctccatcgaagcgccctggggcgccatcaacgtccagagcaccttcaagcccacggtgtccaccgctaacatcgccctgagctggtccagcgtggagcacagggggaacaagatcctggtgtccggccgcagcgagtcaatcatgaagctcgaggagcggaccggaatctcgtgggacctgggcgtggaggacgcctccgaaagcaagctgttaaccgtctccgtgatggacctgagccagatgtactcacccgtgtttgagtacctgtccggcgacagacaggtcgaggagtggccgaaggcgacctgcacgggggactgccccgaacggtgcggctgcaccagctccacgtgccttcacaaggagtggccccacagccgcaactggcggtgcaaccccacctggtgctggggcgtcgggaccggctgcacatgctgcgggctggacgtgaaggacctgttcaccgactacatgttcgtcaagtggaaggtggagtacataaagaccgaggccatcgtgtgcgtcgagctcacgtcccaggagcgccagtgcagcctgatcgaggcgggcaccagattcaacctggggccggtgactatcaccctctccgagcccagaaacatccagcaaaaactaccacccgagatcgtgacgctgcacccccggatcgaggagggcttcttcgacctcatgcacgtccagaaggttctgagcgcctccaccgtgtgcaagctacagagctgcacccacggagtccccggcgacctccaggtgtaccacatcggcaatctgctgaagggggacaaggtgaacggccacctcatccacaaggtcgagccccatttcaacacctcctggatgagctgggacgggtgcgacttggactactactgcaacatgggcgactggccgtcctgcacgtacaccggggtgacccagcacaaccacgccgcgttcgtgaacctgctcaacatcgagaccgactacacgaagaactttcacttccacagcaagagggtcaccgcccacggcgacacaccccagctagacctgaaggcccgccccaattacggcgccggcgaggtgaccgtgctcgtagaggtggcggacatggaattgcacaccaagaagattgagatttcaggcctgaagttcgccagcctgacctgcaccgggtgctacgcctgctcaagcgggatctcctgcaaggtgcgcatccacgtcgatgagcctgacgagctgaccgtgcacgtcaagtcggaggacccggacattgtggccgcctcttcctcgctgatggcgcggaagttagagttcgggaccgactccaccttcaaggccttcagcgccatgcccaagacctccctgtgcttttacatcgtggagcgcgagtactgcaagagctgctctaaggaggacacccagaagtgcgtgaacgccaagctggagaggccccagagcatcctcatcgaacacaaaggcacgatcatcggcaagcagaatgacacgtgcaccgccaaggcgagttgctggctcgagagcgtcaagtccttcttctacgggctgaagaacatgctcagcggcatcttcgggaatgtgttcatcggcatcttcctgttcctggcccccttcatcctactgatcctgttcttcatgttcgggtggcgcatcctcttctgcttcaagtgctgccggcgcacccggggcctcttcaagtaccgccacctgaaggacgacgaggagaccggctaccgcaagatcatcgagagactcaacaacaagaaggggaagaacaagctgctggacggcgagcgcctagccgaccgaaagatcgccgagctgttctccaccaagacccacatcggg

SEQ ID NO: 15399 - RNA, 3495 nt, synthetic construct
  misc_feature 1..3495: note = derived and/or modified CDS sequence (opt11) from CCHVF(CCHVF SPU97/85)__DQ211633.1__Gn-NSm-Gc
  source 1..3495: mol_type = other RNA
agcgaggagtccgacggcgactgcatcagccgcacccagctgctccggactgagacggccgagatccactccgacaactacgggggccccggggacaagatcaccatctgcaacggctctaccatcgtggaccagcgcctggggtccgagctgggctgctacaccatcaaccgggtcaagagcttcaaactctgcgagaactccgccacgggcaagagctgcgaaatcgactccaccccggtgaagtgccgccagggcttttgcctgaagatcacccaagagggacgggggcacgtgaagctgagtcgcggctccgagatcgtcctcgacgcgtgcgacagctcctgcgagatcatgatacccaaggggaccggcgacatattagtggactgtagcggcgggcagcagcacttcctgaaggataacctcatcgacctgggctgccccaacatccccctgctcgggcggatggccatctacatctgccgcatgtccaaccacccgaagacgaccatggccttcctgttctggttcagcttcggctacgtgatcacgtgcatcctgtgcaaggtcatcttctacctcctgatcgtggccggcaccgtggggaagaagttcaagcagtaccgggagctgcgcccccagacctgcaccatctgcgagaccacccccgtcaacgccattgacgcggagatgcacgacctcaactgctcctacaacatctgcccctactgcgccagccggctcacgtccgacggcctggcccgccacgtgatgcagtgcccgaagcggaaggagaagatcgaggagaccgagctatatctgaacctggagcgcatcccctgggtggtccggaagctcctccaggtgagcgagagcaccggggtggccctgaaacgctccagctggctgacagtcctgctggtgttactgatcgtgtccctgagccccgtccagtccgcgcccatcggccacgggaagacgatcgagacctaccaggcccgcgagggttacaccagcttctgtctcttcatcctgggcagtatcctgttcatcgtgagctgcctcgtgaaggggctgatcgactccgtcggcaacagtttcttcccgggcctgtccatctgcaagacctgcagcatcggctccgtgaacgggttcgagatcgagagccacaagtgctactgctccttattctgctgcccctactgccgccactgcagcgccgaccgggagatccacaagctgcacctgtccatctgcaagaagcgcaaaacgggcagcaacgtgatgctcgccgtctgcaagcggatgtgcttccgcgccaccatcgaggtgtccaaccgcgcgctgctgatccggagcatcatcaacaccaccttcgccgtctgcatcctcacgctggccgtgtgcgtggtctctacctccgccgtggagatggaaagcctgcccgccggcacctgggaacgcgaggaggacctcaccaacttctgccatcaggagtgccaggtaacggagaccgagtgcctgtgcccctacgaggcgctggtcctgcggaagcccctcttcctggactccattgtgaaggggaagaagaacctgctcaacagcacctccctggagaccagcctgtccatcgaggccccctggggcgcaatcaacgtgcagtcgacgttcaagcccaccgtctccgccgccaacatcgcgctcagctggtccagcgtggagcatcgcgggaacaagatcctggtgtccggccggagcgagtccatcatgaagctggaggagagaaccgggatcagctgggacctcggcgtcgaggacgcctccgagagcaagctgctgaccgtgagcgtgatggacctctcccagatgtacagccccgtcttcgagtacctgtccggcgaccgccaggtggaggagtggccgaaggcgacctgcacgggggactgcccagagcggtgcggctgcaccagttccacgtgcctgcacaaggagtggccccacagccggaactggcgctgcaaccccacctggtgctggggcgtggggaccggctgcacgtgctgcgggctcgatgtcaaggacctgttcaccgactacatgttcgtgaagtggaaggtggagtacatcaagaccgaggccattgtctgcgtggagctgacttcccaggagcggcagtgcagcctgatcgaggccggcacccgcttcaacctggggccggttaccatcaccctgtccgagccccggaacatccagcaaaagctcccgcccgagatcatcacgctgcacccgcgcatcgaggagggcttcttcgacctgatgcacgtccagaaagtgttgagcgcctccaccgtgtgcaagctgcagagctgcacccacggggtccccggcgacctccaggtgtaccacatcggcaacctgctgaagggcgacaaggtgaacggccacctgatccacaagatcgagccccacttcaacacctcctggatgagctgggacgggtgcgacctcgactactactgcaacatgggcgactggccgtcctgcacgtacaccggggtcacccagcacaaccacgccgccttcgtgaacctgctgaacattgagaccgactacacgaagaacttccacttccacagcaaacgggtcaccgcccacggtgacacgccccagctcgacctgaaggcgcgccccacctacggcgccggggaggtcaccgtgctggtggaggtcgccgacatggagctccacaccaagaagatcgaaatctccggcctgaagttcgccagcctgtcctgcactggatgctacgcctgcagcagcggcatcagttgcaaggtgcggatccacgtggacgagcccgatgagctcaccgtccacgtcaagagcgaggacccggacatcgtggcggccgggtccagcctgatggcccgcaagctcgagttcggcgccgactccacgttcaaggccttcagcgcgatgccaaagacctctctctgcttctacatcgtggaacgggaatactgcaagtcgtgctcccgcgaggacacccagaagtgcgtgaacaccaagctggagcgcccccagagcatcctgatcgagcataagggcacgatcatcgggaagcagaacgacacgtgcaccgccaaggcctcctgctggctcgagagcgtgaagtccttcttctacggcctcaagagcatgctgtctgggatcttcggcaacgtcttcatcgggatcttcctgttcatcgccccgttcgtgctgctgatcctcttcttcatgttcggctggcggatcctgttctgcttcaagtgctgccgccggacccgcggcctgttcaagtaccggcacctcaaggacgacgaggagaccgggtaccgcaagatcatcgagcggctgaacaacaagaagggcaaaaacaagctgctcgacggggagcgcctggccgaccgcaagatcgcggagctgttctcgaccaagtcccacattggc

SEQ ID NO: 15400 - RNA, 3495 nt, synthetic construct
  misc_feature 1..3495: note = derived and/or modified CDS sequence (opt11) from CCHVF(CCHVF SPU103/87)__DQ211634.1__Gn-NSm-Gc
  source 1..3495: mol_type = other RNA
agcgaggagtccagcgatgactgcatttctcgcacccagctgctccggacagagacggccgagatccacggcgacaactacgggggccccggggacaagatcaccatttgcaacggcagcaccatcgtggaccagcgcctggggtccgagctgggctgctacaccatcaaccgggtcaagacgtttaaattatgcgagaacagcgccaccggcaagtcctgcgagatcgatagcgtgccggtgaagtgccgccaggggtactgcctgaagatcacccaggagggccggggtcacgtcaagctgtcccgcggcagcgaggtggttctcgacgcgtgcgacacctcctgtgaggtaatgatccccaaggggactggcgacatactggtggactgcagcggcgggcagcagcattttctgaaggacaacctcatcgacctgggctgcccgaagatccccctgctaggaaagatggccatctacatctgtcggatgtcgaaccacccgaagaccaccatggccttcctgttctggttcagctttggctacgtgatcacgtgcgtcctgtgcaaagccatcttctacctcctgataatcgtgggcacgctggggaagcgcctcaagcagtaccgggagctgaagccccagacctgtaccatctgcgaaaccacgcccgttaacgccatcgacgcggagatgcacgacctgaattgctcttacaacatctgcccctattgcgccagccgcctcacctccgacggcctggcccggcacgtcactcagtgcccgaagcgcaaggagaaggtggaagagaccgaactgtacctcaacctggaacggatcccctgggtggtaagacggctgctccaggttagcgagtccacgggggtggccctaaaacgcagcagctggctgatcgtcctgctggtgctgttcaccgtgtccctaagccccgtccagtccgcgcccatcagccacggcaagaccgtggaggcctaccaggccagggaggggtacaccggcatgtgcctgttcgtgctgggctccatcctcttcctggtcagctgcctgatgaagggcctcgtggactccgtcggcaacacgttcttcccggggctgagtatctgcaaaacctgctccatcagctccatcaacgggttcgagatcgagagccacagatgctactgctccctgttctgctgcccctactgtcggcactgcagcgccaataaggagatccaccagctccacctgtccatctgcaagaagcgcaagaccgggagcaacgtgatgctggccgtctgcaagcggatgtgcttccgcgcgaccatggaggtctccaaccgcgccctcttcatccggagcatcatcaacaccaccttcgtgctgtgtatcctgatcctcgccgtgtgcgtcgtctccaccagcgccgtggagatggaaagcctgcccgcgggcacctgggagcgcgaggaggacttgacaaacttctgccaccaggagtgccaggtcacagacaccgagtgcctatgtccctatgaagcgctcgtgctgcgccggccgctgttcctcgacaacatcgtgaagggcatgaagaacctgctgaactcaaccagcctagaaacgtcccttagcatcgaggcgccctggggcgccataaacgtccagagtacctacaagccgaccgtgtcaaccgccaacatcgcgctttcctggagctccgtggagcacagggggaacaagatcctcgtcagcgggcgctccgagagcatcatgaagctggaggagcgtaccggcatctcctgggacctgggggtggaggacgcgagcgagtccaaactcctgacggtgtcggtcatggacctgtcccagatgtactctcctgtcttcgagtacctcagcggcgaccgccaggtggaggagtggccgaaggcgacatgcaccggcgactgccccgagcggtgcgggtgcaccagtagcacgtgcctgcacaaggagtggcctcactcccgcaactggcggtgcaaccctacctggtgctggggcgtcgggaccggctgcacgtgttgcggcctggacgtgaaggacctcttcaccgactacatgttcgtgaagtggaagatcgagtacattaaaaccgaggccattgtctgcgtcgagctgaccagccaggagcgccagtgctcgctgatcgaggccgggacccggttcaacctaggccccgtgacgatcaccttgagcgagccccgcaacatccaacaaaagctgccctccgagatcataaccctccacccccggatcgaggaggggttcttcgacctgatgcatgtccagaaggtgctgagcgcatccaccgtgtgcaagttgcagagctgcacgcacggcgtaccgggggaccttcaggtgtaccacatcggcaacctgctgaagggcgacaaggtgaacgggcacctggtccacaagatcgaaccccacttcaacacctcctggatgagctgggacggatgcgacctggactactactgcaacatgggagactggccctcctgcacctacactggcgtcacgcagcacaaccacgccagcttcgtgaacctcctaaacatcgagacggattacaccaagaacttccacttccattccaagcgcgtcaccgcccacggggacacgccgcagctggacctcaaggcacggcccacctatggcgccggtgagatcaccgtgctggtggaggtcgcggacatggagctgcacaccaagaaaatcgagatcagcgggctcaaattcacgtccctgacttgcactggctgttacgcctgcagctccgggatcagctgcaaggtgagaatccacgtggacgagcccgacgagctgaccgtccacgtcaagagcgacgaccccgacgtagtggctgccagtagctcccttatggccaggaagctggagttcggaacggacagcacctttaaggcgttttccgccatgccgaagaccagcctgtgtttctacatcgtggaacgcgagtactgcaagtcctgtagcgaggaggacacccagaagtgcgtgaacacgaagctcgagcagccccagagtatcctgatcgagcataaagggaccatcatcggcaagcagaacaatacgtgcaaggcccgcgccggctgctggttggagagcgtcaagtccttcttctacgggctcaagaacatgcttagcggtatcttcgggaacgtgttcatcggcatcttcctgttccttgcccccttcatcctgctgatcctcttcttcatgttcgggtggcggatcctgttctgcttcaagtgctgccgccggacccgcggcctgttcaagtaccggcacctcaaggacgacgaggagaccggctaccgcaagatcatcgagcggctgaacaacaagaaggggaagaacaagctgttggacggcgagcgcctggcggaccggcgcatcgccgagctgttctctaccaagacccacatcggg

SEQ ID NO: 15401 - RNA, 3495 nt, synthetic construct
  misc_feature 1..3495: note = derived and/or modified CDS sequence (opt11) from CCHVF(CCHVF SPU415/85)__DQ211635.1__Gn-NSm-Gc
  source 1..3495: mol_type = other RNA
agcgaggagtccgacggcgactgtatcagccggacccaactgctccggactgagacgaccgagattcactccgacaactacgggggccccggggacaagatcaccatttgcaacggcagcaccatcgtggaccagcgcttggggtccgagctgggctgctacacgatcaaccgggtcaagagcttcaagttgtgcgagaactccgccaccggcaagagctgcgagatcgactccaccccggtgaagtgccgccaggggttctgcctgaagatcacccaggagggccgggggcacgtgaagctgagccgcggctccgagatcgtcctcgacgcctgcgatagcaactgcgagatcatgatccccaaggggacgggcgacatcctggtggattgctccggcgggcaacagcacttcctgaaggacaacctcatcgacctgggctgccccaacatcccgctgctcgggaagatggcgatctacatctgccggatgagcaaccacccgaagaccaccatggccttcctgttctggttctccttcggctacgtgatcacgtgcatcctgtgcaaggtcatcttctacctcctgatcgtggccggcaccgtggggaagaagttcaagcaataccgcgagctgcggccccagacctgcaccatctgcgagaccatccccgtcaacgccatcgacgccgagatgcacgacttgaactgcagctacaacatctgcccctactgcgcgtcccgcctgacgagcgacggcctggcccggcacgtgatgcagtgcccgaagcgcaaggagaaggtggaagagacggagctctacctgaacctggagcggatcccctgggtcgtgcgcaagctcctccaggtgtccgagagcaccggggtcgccctaaagcggagctcctggctgactgtgctgctggtactcctgatcgtcagcctgtcccccgtgcagagcgcccccatcggccacggtaagacgatcgagacctaccaggcccgcgagggctacacctccttctgcctcttcatcctgggcagcatcctgttcgtggtgtcctgcctcgtgaaggggctgatcgacagcgtgggcaactccttctttccggggctaagcatctgcaagacctgctccatcggcagcatcaacgggttcgagattgagtcccacaagtgctactgcagcctcttctgctgcccctactgccggcactgctccgcggaccgcgagattcacaagttacacctctcaatctgcaagaagcggaagacgggctccaacgtcatgctcgccgtgtgtaagcgcatgtgtttccgggccacaatcgaggtcagcaaccgcgccctgctgatccgcaacatcatcaacaccaccttcgtggtttgcatcctcacgctcgcggtctgcgtggtgtccaccagcgccgtcgagatggagagcctgcccgccggcacctgggagaaggaggaggacctcaccaacttctgccaccaggagtgccaggtgacggagaccgagtgcctctgcccctacgaggcgctggtgctgcggaagcccctcttcctggactccatcgtcaaggggatgaagaacctgctcaacagcacctccctggagaccagcctgtccatcgaggccccctggggcgccatcaacgtgcagagcacgtttaagcccaccgtgtccgccgccaacattgccctcagctggtccagcgtcgagcaccgcgggaacaagatcctggtgtccggccggagcgagtccatcatgaagctggaggagcgcaccgggatcagctgggacctcggcgtggaggacgcctccgagtccaagctgctgaccgtctccgtgatggacctcagccagatgtacagccccgtgttcgagtacctgtccggcgacagacaggtcgaagagtggccgaaggcgacctgcacgggggactgccccgagcgctgcggctgcaccagctccacctgtctgcacaaggagtggccccacagccggaactggcgctgcaaccccacctggtgctggggcgtggggaccggatgcacgtgctgcgggctcgacgtgaaggacctgttcaccgactacatgttcgtcaagtggaaggtggagtacatcaagaccgaggccattgtgtgcgtcgagctgacctcccaggagcggcagtgcagcctcatcgaggccggcacccggttcaacctggggccggtgaccatcaccctttccgagccccggaacatccagcagaagctcccgcccgagatcatcacgctgcacccgcgcatcgaggaaggcttcttcgacctgatgcacgtgcagcgggtcctcagcgcctccaccgtgtgcaagctgcagagctgcacccacggggtgcccggcgaccttcaggtctaccacatcggcaacctcctgaagggggacaaagtgaatggccacctgatccacaaaattgagccccacttcaacacgtcctggatgagctgggacgggtgcgacctcgactactactgcaacatgggcgactggccgtcctgcacgtacaccggggtcacccagcacaaccacgccgcgttcgtcaacctgctgaacatcgagaccgactacacgaagaacttccacttccacagcaagcgcgtgaccgcccacggcgacacgccccagctcgacctgaaggcccggcccacctacggagccggggaagtgaccgtcctggtggaggtggcggacatggagctccacaccaagaagatcgagatctccggcctgaagttcgccagcctgacctgcaccgggtgctacgcctgctccagcggcatctcctgcaaggtcaagatccacgtggacgagcccgacgagcttacggtgcacgtcaagagcgaggacccggacatcgtggccgccgggagctccctgatggcgcgcaagctggagttcggcgccgacagcaccttcaaggccttctccgccatgcccaagaccagcctctgcttctacatcgttgagcgggagtactgcaagtcctgtagccgcgaggacacccggaagtgcgtcaacacgaagctggaccgcccccagtccatcctgatcgagcacaagggcaccatcatcgggaagcagaacaacacgtgcaccgccaaggcgagctgctggctcgagtccgtcaagagcttcttttacggcctgaagaacatgctgtcagggatcttcggcaatgtgttcatcgggatcttcctctttatcgcccccttcgtgctgctgatcctcttcttcatgttcggctggcgcatcctgttctgctttaaatgctgccggcgcaccagaggcctgttcaagtaccgtcatctcaaggacgacgaggagaccgggtaccggaagatcatcgagagactgaacaacaagaagggcaagaacaagctgctcgacggggagcggctggccgaccgcaagatagccgagctgttcagcaccaagtcccacatcggc

SEQ ID NO: 15402 - RNA, 3495 nt, synthetic construct
  misc_feature 1..3495: note = derived and/or modified CDS sequence (opt11) from CCHVF(CCHVF Turkey200310849)__DQ211636.1__Gn-NSm-Gc
  source 1..3495: mol_type = other RNA
agcgaagaacccggcgacgactgcatctctcgcacccagctgttgcggactgagacggccgaaatccacgatgacaattacggtggcccgggggacaagatcaccatatgcaacggcagcaccatcgtggaccagaggctgggctccgagttaggctgctacaccattaaccgagtcaagagcttcaagctgtgcgagaactccgccacgggaaagacctgcgaggtggacagtacgcccgtgaagtgccgtcagggtttctgtctgaagatcacccaggagggccggggtcacgtgaagttatccagaggcagcgaggtggtgctcgacgcgtgcgactccagctgcgaggtaatgatccccaaggggacgggggacatcctggtagactgttccggtgggcagcagcacttcctaaaggacaacctcatcgacctgggctgcccccacatcccgctcctcgggaagatggccatctacatctgccggatgagcaaccacccacgcacaaccatggccttcttattctggttttcctttggctacgtgatcacgtgcatcagctgcaaggccctgttctacagtctcatcatcattggcaccctagggaagaagatcaagcagtaccgggagctaaagccgcagacctgcaccatctgcgagaccgcgcccgtcaacgcgatagacgccgagatgcacgacctcaactgcagctacaacatctgcccgtattgcgcctcgcgcctgacgagcgacggcctggcccggcacgtgacccaatgccccaagagaaaggagaaggtggaagagaccgagctctacctgaacctcgagcggatcccatggatcgtccgcaagctccttcaggtgagcgagagcaccggggtggcgctgaagcggagctcctggctgatcgtcctgctggtactcctgacagtgagcctgagtcccgttcagagcgccccggtgggccacggaaagaccatcgagatctaccagacccgcgagggattcgcctccatctgcctctttatgctgggcagtatcctgttcatcgtatcgtgcctcgtcaagggtctggtggacagcgtgtctgacagcttcttccctggcttgtccgtctgtaagacctgcagcatcgggtccgtgaacggcttcgagatcgaatcccacaagtgttactgttcactcttctgctgcccctactgcaggcattgcagtgccgaccgcgaaatccaccaactgcacttgagcatctgcaagaagcggaagacggggtcaaatgttatgttagccgtatgcaagcgtatgtgcttccgggcgaccatcgaggcctctcgccgagccctgctcatccgttcaatcatcaacacaaccttcgtgatctgcatcctcacgttgaccatctgcgtcgtgtcaacctccgcggtggagatggagaacctgcccgccggcacctgggagcgcgaggaggacctcacaaacttctgtcaccaggagtgccaggtcaccgaaaccgagtgcctgtgcccgtacgaagcgctggtgcttcggaagcccctcttcctcgacagcatcgtgaagggcatgaagaacctgttaaactccaccagcctggagacatccctgagcatcgaggccccctggggcgccatcaacgtccagtcgaccttcaagcctgccgtcagcaccgctaatatcgcgctatcatggagctcagtggagcaccgcggcaacaagatactggtcaccgggcggagcgagtccatcatgaagctggaagaacgcaccggcgttagctgggacctgggggtcgaagacgcctccgagagcaaacttcttacggtctccatcatggacttgagccagatgtacagcccggtgtttgagtacctgtccggcgaccgccaggtggaggagtggcccaaggcgacctgcaccggcgactgcccggaacggtgtgggtgcacaagctccacgtgtctgcacaaggagtggccccattctcggaactggcgatgtaacccgacctggtgctggggtgtggggaccggctgcacgtgctgcggcgtcgacgtgaaggacctcttcaccgaccacatgttcgtcaagtggaaggtggagtacatcaagacagaggcgatcgtgtgcgtggagctgacatcccaagagcggcaatgcagcctgatcgaggccgggacccgcttcaacctcggccccgtgacgattactctctccgagccccggaacatccagcagaagctgcccccagagatcattaccctccaccccaaaatcgaggaggggttcttcgacctcatgcacgtgcagaaggtcctgagcgcatccacagtgtgcaagctccagtcgtgtacgcacggcatccccggggacctccaggtgtatcatatcggcaacctgctgaagggcgaccgcgtcaacggacacctgatccacaagatcgagtcccacttcaacaccagctggatgagttgggacggctgcgacctggactactactgcaatatgggggactggcctagctgcacgtacaccggagtgacgcagcacaaccacgccgccttcgtgaacctcctgaacatcgagacggactacactaagacgttccacttccactccaagcgggtcactgcccacggggacacgccacagctagacctcaaagcccgccccacgtacggcgccggcgagatcaccgtgctggtggaggtagccgacatggagctgcacaccaagaaggtcgagatcagcgggcttaagttcgcctccttagcctgcaccggctgctatgcgtgcagcagtgggatcagctgtaaggtgcggatccacgtcgacgagccagacgagttgaccgtgcacgtcaagagctccgatccggacgtggtagctgccagtacatccctcatggctcgcaaactggagttcggcacggactccaccttcaaggccttctccgcgatgcctaagaccagcctgtgcttctacattgttgagagggagtactgtaagtcctgctcagaggacgacacccagaagtgcgtagacacgcgcctcgagcagccccagtccatcctgattgagcacaaagggaccataataggcaaacagaacgacacttgcaccgccaaagcgtcgtgctggttagagtccgtaaagagctttttctatggcctcaagaacatgctggggtccgtgtttgggaacctgttcatcggtatactcctcttcctggcccctttcgtgctcttagtgctgttcttcatgttcggctggaagatattgttctgcttcaagtgttgccgccggacacgcggactgttcaagtatcggcatctgaaggacgacgaggagaccggctaccgccggatcatcgagcgcctcaattccaagaaaggcaagaaccgcctactggacggggaccgcctcgccgaccggaagatcgcggagctgttctccaccaagacccacatcggc

SEQ ID NO: 15403 - RNA, 3495 nt, synthetic construct
  misc_feature 1..3495: note = derived and/or modified CDS sequence (opt11) from CCHVF(CCHVF Iran-52)__DQ446215.1__Gn-NSm-Gc
  source 1..3495: mol_type = other RNA
tccgaggagtccggcgacgactgcatcagtcgcacccagctgctccgcaccgagacggctgaggtgcacggggacaactacggcgggcccggcgacaagatcaccatctgcaacgggtccaccgtcgtggaccagcgcctgggcagcgagctgggctgctacaccataaaccgggtgcgctccttcaagctctgcgagaacagcgctacggggaagtcctgcgagatcgacagcatcccggtcaagtgcaagcagggctattgtctgaagatcacccaggaggggcggggccacgtgaagctgtcccgcggcagcgaggtggtcctcgacgtgtgcgactccagctgcgaggtgatgatccccaagggcaccggcgacatcctggtcgactgctcagggggccagcagcacttcctgaaggacaacctcgtggatctggggtgccccaagatccccctgctcggcaagatggcgatctacatctgtcggatgagcaaccacccgaaaaccactatggctttcctgttctggttctccttcggctacgtcatcacatgcatcctgtgcaaggccatcttctttctcctgatcatcttcgggaccctaggcaagcgcttcaagcagtaccgggagctgaagccccagacctgcacaatctgcgagaccacccccgtcaacgccatcgacgccgagatgcacgacctgaactgcagctacaacatatgcccctactgcgcgtcccgcctgaccagcgacgggctcgcacggcatgtgacgcagtgcccgagacggaaggagaaggtggaggagaccgagctgtacctgaatctggagcgcatcccctgggtcgtgcggaagctgcttcaagtgtccgagagcaccggcaccgtcttgaagcgcagctcctggctgatcgtgctgctcgtgctgtttacggtcagcctgtcccccgtgcagtcggcccccatcgggcatggcaagacgatcgagacctaccgggtgcgcgaggagtatacctccatctgcttgttcgtcctgggcagcatcctgttcatcgtgtccttcctcatgaaggggctggtcgacggcgttgggaacatcttcttcccgggtctgagcgtgtgcaagacgtgctccatcgggagcatcaacggcttcgagatcgagtcccacaagtgttactgcagcctcttctgctgcccctattgcaggcactgctccgccgacggcgagatccatcagctgcacctgtcgatctgcaagaagcgcaagacggggtccaacgtcatgctcgcggtgtgcaagcggatgtgcttcagagccaccatggaggtgagcaacaaggccctgttcatccgctcaatcattaataccacgttcgttgtgtgtatcctgatcttagccgtgtgcgtcgtgagcacctccgcggtggagatggagagcctgcccgcgggcacctgggagcgggaggaggatctgaccaacttctgccaccaggagtgccaggtcacggagaccgagtgcctctgcccctacgaggccctggtgctgcgacggccgctgttcctcgacagcatcgtgaaggggatgaagaacctgctgaactccaccagccttgagacctccctgagcatcgaggccccctggggcgccatcaacgtccagtccacgtacaagcccaccgtgagcaccgccaacatagcgctgtcctggtcgtctgtggagcaccgcgggaacaaggtcctcgtgtctggccggtccgagtctatcatgaagctggaggagcgcaccggcatctcctgggacctgggggtggaggatgccagcgagtccaagctcctgaccgtcagcgtgatggatctctcccagatgtacagccccgtgttcgagtacctcagcggcgaccggcaggtcgaggagtggccgaaggccacgtgcaccggggactgtcccgaacggtgcggctgcacctccagcacgtgcctacacaaggagtggccccactccaggaactggcgctgcaaccccacctggtgctggggcgtggggaccggctgcacgtgttgtgggctggatgtaaaggacctcttcaccgattacatgttcgtcaagtggaaggtcgaatacatcaagaccgaggccatcgtctgcgtcgagctgaccagccaggagcggcagtgctccctgatcgaggccggcacccgcttcaacctggggagtgtgaccatcacactgtccgagccgcggaacatccagcagaaactaccgccagagatcatcaccctccatcctaagatcgaggagggctttttcgacctcatgcacgtgcaaaaggtcctgtctgcgtccaccgtgtgcaagctccagagctgcacccacggcgtgcccggggacctgcaggtctaccacatcggcaatctgttgaaaggggaccgcgtgaacggccacctgatccacaagatcgagcagcacttcaacacttcatggatgtcctgggacggatgcgacctggactactactgcaacatgggcgactggcccagttgcacatacaccggcgtgacccagcacaaccacgccagcttcgtcaacctcttaaacatcgagaccgactacaccaagactttccacttccactccaagcgcgtgaccgcacacggggacacgccccagctggacctcaaggcccgcccgacctacggcgccggggagatcaccgtgttggtagaggtagcggacatggagctgcacactaagaagatcgagataagcggcctcaagttcgccggtcttacgtgcaccggctgctacgcctgctccagcggcatctcctgcaaggtgcggatccacgtcgaggagcccgacgagttaaccgtgcacgtcaaaagcgacgaccccgacgtcgtggccgcgagctccagcctcatggcccgaaagctcgagttcgggaccgattccactttcaaggccttctccgccatgcccaagacctccctgtgcttctacatagtggagcgggagtactgcaaaagctgctccaaggaggacacccagaagtgcgttaacaccaagctcgagcagccgcagagcatcctcatcgagcacaagggcacaatcatcggcaaacagaacaacacgtgcacagccaaggcaagttgttggttagagagcgtgaagtccttcttctacggcctgaagaacatgctcgggggcatcttcggcaacgtcttcatcgggatctttaccttcctgaccccattcatcctgctgatcctgtttttcatgttcggctggcggatcctcttctgcttcaagtgctgccgccggacccgcgggctgttcaaataccgtcacctaaaagacgacgaggaaaccggctaccgcaagataatcgagcggctaaacaacaagaagggcaagaaccgcctgttggacggggagcggctcgccgaccgcaagatcgcagagctgttcagcaccaaaacccacatcggc

SEQ ID NO: 15404 - RNA, 3495 nt, synthetic construct
  misc_feature 1..3495: note = derived and/or modified CDS sequence (opt11) from CCHVF(CCHVF Iran-53)__DQ446216.1__Gn-NSm-Gc
  source 1..3495: mol_type = other RNA
agcgaagagtccggcgatgactgcatcagccgcacccagctgctccggaccgaaacggccgaggtgcacggagacaactatggcgggcccggtgacaagatcaccatctgcaacggttctaccgtcgtggaccagcgcctcggaagcgagctgggctgctacaccatcaaccgggtgcgttccttcaagctctgcgagaacagcgccacggggaagtcctgcgagatcgacagcatcccggtcaagtgcaagcagggatactgcttaaagatcacccaggaggggcggggacacgtgaagctgtcacgagggagcgaggtggtactcgacgtgtgcgactccagctgcgaggtgatgatccccaagggcaccggcgacatcctggtcgactgctccgggggccagcagcacttcctgaaggacaacctcgtggacctggggtgccccaaaatccccctgctcggcaagatggcgatctatatctgtcggatgagcaaccacccgaagacaacgatggccttcctgttctggttctccttcggctacgtgatcacgtgcatcctgtgcaaggccatattctttttactcatcatcttcggaaccctgggcaagcgcttcaagcagtaccgggagctcaagccccagacctgcacgatctgcgagaccacccccgtcaacgccattgacgccgagatgcacgacctgaattgcagctacaacatctgcccctattgcgcttcccgactgaccagcgacgggctcgcccggcatgtgacgcaatgcccgcgccggaaggagaaggtggaggagaccgagctgtacctgaacctcgagcgcatcccctgggtggtgcggaagttactgcaagtgtccgagagcactggcaccgtcttgaagcgcagctcctggctaatcgtgctgttagtgttgttcacggtcagcctgtcccccgtgcagagcgcgcccatcgggcacggcaagaccatcgagacctaccgggtgcgcgaagagtacacctccatctgcctcttcgtcctgggcagcatcctgttcatcgtgtccttcctcatgaaggggctggtcgacggcgtagggaacatcttcttcccgggcctgagcgtatgcaagacgtgctccattgggagcatcaacggcttcgagatcgagtcccacaagtgctattgcagcctcttctgctgcccctactgccggcactgtagcgccgacggcgagattcaccagctgcacctgagcatctgcaagaagcgcaagaccggttccaacgtcatgctcgccgtttgcaagcggatgtgcttccgcgccaccatggaggtgagcaacaaggccctgttcatccgctcaatcattaacaccactttcgtcgtgtgtatcctgatcctcgccgtgtgcgtcgtgagcacctccgccgtggagatggagagcctgcccgcggggacctgggagcgggaggaggacctgaccaacttctgccatcaggagtgccaagtcacggagaccgagtgcctctgcccttacgaggccttggtgctgcgccggccgctgttcctcgacagcatagtgaaggggatgaaaaaccttctgaactccaccagcctcgagacctccctgagcattgaggccccttggggcgccatcaacgtccagtccacgtataagccgaccgtgagcaccgccaacatcgcgctgtcctggagctccgtggagcaccgcgggaataaagtcctcgtgtcaggccgctccgagagcatcatgaagctggaggaacgcacaggcatctcctgggacctgggggttgaggacgccagcgagtcaaagctcctgacggtcagcgtgatggacctctcccagatgtacagccccgttttcgagtacctcagcggcgaccggcaggtcgaggagtggccgaaggccacgtgcactggtgactgccccgagcgctgcggctgcacgtccagcacgtgcctgcacaaggagtggccccactcccggaactggcgctgcaaccccacgtggtgctggggcgtggggaccggctgtacatgctgcgggctggacgtgaaggatctcttcacagactacatgttcgtcaagtggaaggtggagtacatcaagaccgaggccatcgtgtgcgtcgagctgaccagccaggagcggcagtgctccctaatcgaggccggcactcgcttcaacctcgggagcgtcaccatcacgctgtccgagccgcggaacatccagcagaagctgccgcccgagatcatcaccctccatcccaagatcgaggagggcttcttcgacctgatgcatgtgcagaaagtcctgagcgcgtccaccgtgtgtaagctccagagctgcacccacggcgtgcccggggatctgcaggtctaccacatcggcaacctgcttaagggggaccgcgtgaacggccacctcatccacaagatcgaacagcacttcaacacgtcctggatgagctgggacgggtgcgacctggactactactgcaacatgggcgactggccctcctgcacctacacaggcgtgacccaacacaaccatgccagcttcgtcaacctccttaacatcgagacggattacaccaagaccttccactttcattccaagcgggttaccgcccacggggacacgccccagctggacttaaaggcccgcccgacatacggcgccggggaggtgaccgtcctggtcgaggtggcggacatggagctgcacaccaagaagattgagataagcggcctcaagttcgccgggctgacgtgcacaggctgctacgcctgctccagcggcatctcctgcaaggtccggatccacgtggacgagcctgacgaactgacagtgcacgtcaagagcgacgaccccgacgtggtggccgcgagctccagcctcatggcccgcaagctggagttcgggaccgactccacgttcaaggcattctcagccatgcccaagacatccctgtgtttctacatcgtcgagcgggagtactgcaaatcttgctcgaaggaggacacccagaagtgcgtgaacaccaagctcgagcaaccgcagagcatcctgatcgaacacaagggcacgatcatcgggaagcagaacaacacgtgcaccgctaaggcgtcctgctggctggaaagcgtcaagtccttcttctacggcctcaagaacatgctcgggggcatcttcggcaacgtgttcatcgggatcttcaccttcctgacccccttcattctgctgatcctgttcttcatgttcggctggcgcatcctcttttgcttcaaatgctgccgccggacccgcgggctgttcaagtaccgccacctgaaggacgacgaggagaccggctaccgcaagatcatcgagcggctcaacaataagaagggcaagaaccgcctgctggacggggaacggctcgccgaccgcaagatcgcggagttgttcagcaccaagacccacatcggc

SEQ ID NO: 15405 - RNA, 3495 nt, synthetic construct
  misc_feature 1..3495: note = derived and/or modified CDS sequence (opt11) from CCHVF(CCHVF Kosova Hoti)__EU037902.1__Gn-NSm-Gc
  source 1..3495: mol_type = other RNA
agcgaggaacccggcgacgactgcatctcccgcacccagctgctccggaccgagacggccgagattcacgacgacaactacgggggcccgggggacaagatcaccatctgcaacggcagcaccatcgtggaccagcgcctggggtccgagctgggctgctacaccatcaaccgggtcaagagcttcaaactctgcgagaactccgccacgggcaagacctgcgagatcgacagcacccccgtgaagtgccgccaggggttctgcctgaagatcacccagaagggccgggggcacgtgaagctgtcccgcggcagcgaggtcgtgctcgacgcgtgcgactccaactgcgaggtgatgatccccaaggggacgggcgacatcctggtcgattgcagcggcgggcagcagcacttcctgaaggacaacctcattgacctgggctgcccccacatcccgctgctcgggaagatggccatctacatctgccggatgtccaaccaccccaaaaccaccatggccttcctgttctggttcagcttcggctacgtgatcacgtgcatcttctgcaaggccctgttctactccctcatcatcatcggcaccctgggcaagaaaatcaagcagtaccgcgagctgaagccccagacctgcaccatctgcgagaccgcccccgtgaacgcgatcgacgccgagatgcacgacctcaactgtagctacaacatctgcccatactgcgcctcccggctgacgagcgacggcctggcccgccacgtcaagcagtgccccaagcggaaggagaaggtggaggagaccgagctctacctgaaccttgagcgcatcccctgggtggtccggaagctcctccaggtgtccgagagcaccggggttgcgctgaaacgctccagctggctcatcgtcctgctggtgctcctgaccgtgagcctgtcccccgtccagagcgccccggtaggccacgggaagacgatcgagacctaccagacccgggagggcttcacctccatctgcctcttcatgctgggcagcatcctgtttatcgtgtcctgcctcgtcaaggggctggtggatagcgtgtccgacagcttcttccccggcctgtccgtctgcaagacgtgcagcatcgggtccatcaacggcttcgagatcgagagccacaagtgctactgctccctcttctgctgcccctactgccgccactgcagcgccgaccgggagatccaccagctgcacctgaacatctgcaagaagagaaagaccgggtccaacgtgatgctcgccgtctgcaagcggatgtgcttccgcgccaccatcgaggcgagccggcgcgccctgctgatccgctccatcatcaataccacgttcgtgatctgcatcctcaccctgaccatctgcgtggtcagcacttccgccgtggagatggagaacctgcccgccggcacgtgggagcgtgaggaggacctcaccaacttctgtcaccaggagtgccaagtgaccgagaccgagtgcctgtgcccgtacgaggccctggtcctgcgcaagcccctcttcctggacagcatcgttaagggcatgaagaacctgctcaacagcacgtccctggagaccagcctgagcatcgaagcgccctggggcgccatcaacgtgcagtccacgttcaagcccaccgtctccaccgccaacatcgccctcagctggtcctcggtggagcaccgggggaacaagatcctggtgacggggcgctccgaaagcatcatgaagctggaggagcggaccggcatctcctgggacctcggggtcgaggacgcctccgagtccaagctgctgaccgtaagcatcatggacctctcccagatgtacagcccggtgttcgagtacctgtccggcgaccgccaggtcgaggagtggcccaaggcgacctgcacgggcgattgcccccagcggtgcgggtgcaccagcagcacgtgcctacacaaggagtggccccactcccgcaattggcggtgcaacccgacctggtgctggggcgtggggaccggctgcacgtgctgcggcgtggacgtcaaggacctcttcaccgaccacatgttcgtgaagtggaaggtggagtacatcaagacagaggccatcgtctgcgtggagctgaccagtcaggagcgtcagtgctccctgatcgaggccgggacccggttcaacctcggccccgttaccatcaccctgagcgagccccgcaacatccagcagaagctgcccccggagatcatcacgctccaccccaagatcgaggaggggttcttcgacctgatgcacgtccagaaggtgctgtccgccagcaccgtgtgcaagctccagtcctgcacccacggcatccccggggacctgcaggtctaccacatcggcaatctgctcaagggcgaccgggtgaacgggcacctaatccacaagatcgagccgcacttcaacaccagctggatgtcctgggacggctgcgacctggactactactgcaatatgggggactggcccagctgcacgtataccggcgtgacccagcacaaccacgccgcgttcgtcaacctcctgaacatcgagaccgactacacgaagaccttccacttccactccaagcgcgtgaccgcgcacggggacacaccgcagctggacctcaaggcccggcccacctacggcgccggcgagatcaccgtgctggtcgaggtggcggatatggagctgcacaccaagaaggtggagatcagcgggctcaagttcgcctccctggcctgcaccggctgctacgcctgcagctccgggatcagctgcaaggtccgcatccacgtggacgagcccgacgagctgacggtgcacgtcaagtccagcgaccccgacgtggtggccgcgggcacctccctcatggcccggaagctggagttcgggaccgacagcaccttcaaggccttcagcgccatgcccaagacgtccctgtgcttctacatcgtcgagaaggagtactgtaagagttgttccgaggacgacaccaagaagtgcgtagacaccaagctcgagcagccccagagcatcctgatcgagcaccgcggcaccatcatcggcaagcagaacgacacgtgcaccgccaaggcgtcctgctggctggagagcgtgaagtccttcttctacgggctcaagaacatgctgggctccgtcttcgggaatttcttcatcggcatcctcctgttcctggcgccgtttgtcctgttagtgctgttcttcatgtttgggtggaagatcctgttctgcttcaagtgctgccggcgcacccgcggcctcttcaagtaccgacatctgaaggacgacgaggagaccggctaccgccggatcatcgagcgcctgaacaacaagaaggggaagaaccggctcctggatggcgagcgcctggccgaccggaagatcgccgagctgttctccaccaagacgcacatcggg

SEQ ID NO: 15406 - RNA, 3495 nt, synthetic construct
  misc_feature 1..3495: note = derived and/or modified CDS sequence (opt11) from CCHVF(CCHVF YL04057)__FJ562094.1__Gn-NSm-Gc
  source 1..3495: mol_type = other RNA
gccgagggcgggagctccgactgcatcagccgcacccagctggtgaagaccgaggtcgcagagatccacgaagactcctacggcgggcccggcgagaagatcacgatctgcaacggcagcaccatcgtggaccagcggctcggtcgcgagctgggctgctacaccatcaaccgggtgcgctcctacaagctgtgcgagaacagcgcgtccggaaagagctgcgagatcgactccatcccggtcaagtgcaagcaggggttctgcctcaagatcacccaggaggggcggggccacgtgaaactgagccgcgggacggagatcgtgctggatgtctgcgactccagctgcgagctcatgatccccaagggtaccggcgacatcctggtggactgctccgggggccagcagcacttcctgcagaacaacctcatcgacctggggtgccccaacgtgcccctgctcggcaagatggcgatctacgtctgccggatgagcaaccacccgaagaccaccatggccttcctgttctggttctccttcggctacgtgatcacgtgcatcgcctgccgcgtgctgttctacctcctgatcgcaatcgggaccgtcggcaagaagctgaagcagtaccgggagctcaagccccagacctgcatcgtgtgcgagagcgtgcccgtcaacgccattgacgccgagatgcacgagctgaactgctcctacaacatctgcccctactgcgccagccgcctgtccaccgacgggctcatccggcacgtgacgcagtgcccgaagcgccgggagaaggtggaggagaccgagctattccttaacctcgagcgcattccgtggctggtccggaagctgctccaggtgagcgagagcaccggcatggccctgaagcgctcctgttggatgatcacactgctcatcctgctgcttgtgagcatctcccccgtccagagcgcgcccgtggggaaggagcgggccatagagacgtaccaggcccgcgagacctacacaggcatctgcctgttcgttctgggctccgtcctcttcgccgtgagctggctgaccaaggccctgattgacgggatcggcaactccttctttccggggctcagcgtctgcaagacgtgctccatcggcagcatcaatgggttcgagatcgagtcccacaagtgctactgcagcctgttctgctgcccctattgccgtgcgtgctccagcgacaaaaacacccaccgcatgcaccttaacgtgtgcaagaagcggaagatgggctccaacgtgatgctcgccgtctgcaagcgcatgtgcttccgcgccaccatcgaggctagcaacaaggccctgctgatccggtccatcatcaacagcaccttcgtgatctgcatcctcatcctgacgatctgcgtggtctcgaccagcgcggtggacatggagaacctgcccgccggcatctgggagaaagaggaggacctcaccaacttctgccaccaggagtgccaggtgaccgagacggagtgcctctgcccctacgaggccatggtcctgcgcaagccgctgtttctcgacagcatcgccaaggggaagaagtccctgctgaactccacctccctcgagacgagcctgtccattgaggccccctggggcgcgatcaacgtgcagagcaccttcaagcccacggtgtccgccgccaacatcgccctaagctggtccagcgtggagcaccgggggaacaagatcctcgtgtccggccgcagcgagtccatcatgaagctggaggagcggaccggggtgagctggaacctgggcgtcgaggacgcctccgagagcaagacactcaccgtgtccgtgatggacctgtcccagatgtacagccccgtcttcgagtacctgtccggcgaccgccaggtagaggagtggccgaaggcgacgtgcaccggggactgccccgagcggtgcggctgcaccagctccacgtgcctccacaaggagtggccccactcccgcaactggcggtgctcccccacctggtgctggggcgtggggaccggctgcacgtgctgcgggctggacgtcaaggacttcttcaccgactacatgctggtgaagtggaaggtggagtacatcaagaccgaggccatcgtctgcgtggagttgaccagccaggaacgccagtgctccctgatcgaggccggcacccggttcaacctggggccggtgaccatcaccctcagcgagccccgcaacgtccagcagcggctgccgcccgagatcgtgacgctgcaccccaagatcgaggagggcttcttcgacctcatgcacgtgcagaagatcctgtccgccagcaccgtctgcaagctgcagtcctgcacccacggggtgcccggcgacttccaggtgtaccacgtcggcaacctccttcgcggggacaaggtgaacggccacagcatccacaagatcgagccccacttcaacacgtcctggatgagctgggacgggtgcgacctggactatttctgcaacatgggcgactggccgtcctgcacgtacaccggggtgactcagcacaaccgggcggccttcatcaacatgctcaacatagagaccgactacacgaagaccttccacttccacagcaagcgcgtcaccgcccacggcgacacgccccagctggatctgaaggcccggcccgcctacggcgcgggggaggtgaccgtgctcgtcgaggtggccgacctggagctgcacaccaagaagctcgaggtgtccggcctgaaaatcgccagcctgacctgctccgggtgctatgcctgcagcagcggaatctcctgcaaggtccgcatccatgtgaacgagcccgacgagttcaccgtgcacgtccggagctccgacccggacgtggtggccgcagggagctccctcatggcccgcaagatcgagttcggcgccgacagcacgtttaaggccttttccagcatgccgaaggactccctgtgcttctacatcgtcgagaaggactactgcagctcctgcaccgacgacgacacccagaagtgcgtgaacaccaaacttgaccacccccagagcatcctcatcgagcacaagggcacgatcatcgggaagcaaaacgacacgtgctccaccaagaccagctgctggctggagtccgtgaagggcttcttctacgggctgaagaacatgctcagcggcatcttcgggaacgtcttcctgggcatcctcctgttcctggcccccttcgtgctgcttattttcttcttcttcttcggctggcgcctgctgttctgcctcaagtgctgccggcgcacccgggggctgctcaagtacaagcacctcaaggacgaggaggaggcgggctacaagaagatcatcgagcgccttaacgggaagaagggcaagtcccagttattcgacggcgagcggctcgccgaccgcaagatcgcagagctgttcagcaccaagatccacatcggg

SEQ ID NO: 15407 - RNA, 3495 nt, synthetic construct
  misc_feature 1..3495: note = derived and/or modified CDS sequence (opt11) from CCHVF(CCHVF V42/81)__GU477490.1__Gn-NSm-Gc
  source 1..3495: mol_type = other RNA
tcgaaggaacccggcgacgactgcatcagtcggacacagctgatgcggacagaaacggccgagatccacgacgacaactacggcggcccgggggacaagatcacgatctgtaatggcagcaccatcgtagaccagcggctcgggtctgagctgggttgctacaccataaaccgagtcaagagcttcaagctctgcgagaactccgcaaccgggaaagcatgcgaagtggactcaaccccggtgaagtgccgccagggcttttgcctcaagatcacccaagagggacggggtcacgtcaaactgtctcgcggcagcgaggtagtgctggatgcctgcgactccagctgcgaggtcatgatccccaaggggaccggagacatcctcgtggactgctccggcgggcagcagcacttccttaaggacaacctaatagacctcgagtgtccccacatcccgttactgggtaagttggccatctacatctgccggatgtcgaaccacccccgcactaccatggccttcctgttttggttcgggtttggctatgtgatcacgtgtatcctgtgcaaggccctcttctactctctgatcatcattgggaccttaggtaagaagatcaaacagtaccgcgagctcaagccccaaacctgcacaatctgcgagacggcgcccgtcaacgccatcgacgccgaaatgcatgacctgaactgtagctacaacatctgcccgtactgcgcctcccgcctgaccagcgacggtctcgcccgtcacgtgacacagtgccccaagcgcaaggagaaggtggaagagaccgaattgtaccttaatttagagcggatcccctggatcgtccgcaaactcctacaggtgtccgagagcaccggcgtggtcctgaagagaagctcgtggttgatcgtgctgctcgtgctcctgaccgtcagcctctccccggttcaaagcgccccggtcggccacgggaagacgatagaaacataccagacccgcgagggatttacctcgatttgtctgttcatgctgggcagcatcctcttcattgtatcctgtatcgtgaaggggctggtagacagcgtttccgactcgttcttccccggactgtcggtgtgcaagacatgctcgatctccagcatcaacgggtttgagatcgaaagtcacaagtgctattgcagcttattctgctgtccgtactgccggcactgctccgccgaccgagagatccatcaactgcacctgagcatctgccggaagcgtcggaccggctccaacgtcatgctcgccgtctgcaagcgcatgtgtttccgcgcaaccatcgaagtgagccgacgtgccctgctgatacggtccatcatcaacacgacgttcgtcatctgcatcttgacccttaccatatgtgtggtgtcgaccagcgccgtcgagatggagaatttgcctgccgggacgtgggagcgggaggaggacctcaccaacttctgccaccaggagtgccaggtgaccgagaccgagtgcctgtgcccgtatgaggcgctggttttacgcaaacccttgttcctagactcgatcgtcaagggcaagaagaacctgctgaacagcacgtcactcgagaccagcctgtccatcgaggctccctggggcgcgatcaacatccagtcgaccttcaagcccaccgtatcggccgccaacatcgccctcagctggtccagtgttgagcaccgcggtaacaagatcctggtttccggccggagcgagagcatcatgaagctggaggagcgcaccggcgtgagctggaaccttggggtggaggatgcgtcagagtcaaagctcttaacagtctccatcatggacctcagccagatgtacagcccggtgttcgaatacctgtcgggcgaccgccaggtcgaggagtggcccaaggcgacctgcaccggcgattgccccgagcggtgcggctgcaccagctccacgtgcctgcacaaggagtggccccacagccggaactggcggtgcaaccctacctggtgctggggcgtcggcacagggtgcacgtgctgcggagttgacgtgaaggacctcttcatcgaccacatgttcgtcaagtggaaggtagagtacatcaaaaccgaggccatcgtctgcgtcgagcttacctcccaggagcggcagtgcagcctcatagaggccggcactcgtttcaacctcgggcccgtcactattacgctgagcgagccccggaacatccagcagaagttgcccccggagattattaccctccatcccaagatcgaggagggcttcttcgacttgatgcatgtgcaaaaggtcctgagcgcctccaccgtgtgcaagctccagagctgcacgcacgggatccccggcgacctccaggtctaccacatagggaacctgctcaagggcgaccgcgtcaacggccatctgatccataagatcgaacctcattttaacacgagctggatgagctgggacgggtgtgacctggattactactgcaatatgggtgactggccctcctgtacctataccggggtgacccagcataaccacgccgcgttcgtaaacctcctgaacatcgaaacggattacaccaaaacgttccacttccacagcaagcgggtcaccgcccacggggagacgccccagctggacctcaaggccagacccgcctacggcgcgggggagattaccgtgctggtggaggtcgccgacatggagttgcataccaagaaagtagagatatccggcctaaaattcgcatcgctggcctgcaccgggtgctacgcctgctcctctggcatatcctgcaaggtgagaatccacgtcgacgagccggacgagctgaccgtgcacgtcaagagcaacgaccccgacgtggttgcggctagcacatccctaatggcccgaaagctcgagagcgggaccgactccaccttcaaggccttcagcgccatgcccaagacgtccctctgtttttatatcgtagagcgtgagtactgcaagagctgctccgaggacgatacgcagaagtgcgtcgagaccaagctcgaacagccccagtcgatcctgatcgagcacaaggggacgattatcgggaagcagaacgacacgtgcaccgcgaaggcctcctgctggctggaaagcgtgaagtccttcttctatggcctcaaaaacatgctgggatccgtgttcggaaacttcttcatcggcatcctgctgttcctggcgcctttcgtcctgctcgtgctgttcttcatgttcgggtggaagatcttgttctgcttcaagtgttgcagacgcacccggggcctctttaagtaccgccacctgaaggaggacgaggaaaccggctaccggcgcataatcgagcggctgaatagtaagaagggcaaaaatcgtctcctagacggggagcggctggcagaccgtaagatcgcagaactcttcagcaccaagacgcacattggg

SEQ ID NO: 15408 - RNA, 3495 nt, synthetic construct
  misc_feature 1..3495: note = derived and/or modified CDS sequence (opt11) from CCHVF(CCHVF 79121M18)__GU477493.1__Gn-NSm-Gc
  source 1..3495: mol_type = other RNA
gccgagggcggtagctccgactgcattagccgcacccaactggtgaagaccgaggtcgcagagatccacgaggactcctacggcggtcctggtgagaaaatcacgatctgcaacgggtccacgattgtggaccagggactcggcagtgagctggggtgctacaccatcaaccgggtccgcagctacaagctgtgcgagaactccgcgagcggcaagtcctgcgagatcgatagcatccccgtcaagtgcaagcaggggttctgcctgaagatcacccaggagggccgggggcacgtgaagctgtcacgcggcacggagatcgtgctggacgtgtgcgactcttcctgcgagctgatgatccccaagggcaccggggatatcctggtggattgcagcggcgggcagcagcactttctgcaaaacaacctcatcgatctgggctgccccaacgtgccgctactcggcaagatggccatctacgtatgccggatgtcaaaccaccctaaaactaccatggccttcctcttctggtttagctttgggtacgtgatcacttgcatcgcttgccgcgtgctgttctacctcttaatcgctatcggaacagtgggaaagaagctgaagcagtaccgagagctcaagccccagacctgcatcgtgtgcgagtccgtgcccgtcaacgcgatcgacgccgagatgcacgagctgaactgttcgtacaacatttgcccctactgcgcctcccgcctgagcactgacggcctcatacggcacgtgacgcagtgcccgaagcgccgggagaaagtggaggagacggaactgttcctgaacctcgagcgcattccctggctggtacgaaagctgctccaggtgagtgagtccacagggatggcactgaaacgcagctgctggatgatcaccctcctcattctgctgctcgtgtccatcagccccgtccagtcagctcccgtgggcaaggagcgggccatcgagacgtaccaggcccgagagacctacaccggcatctgcctgttcgtgctggggtctgtcctcttcgccgtgtcgtggctgacgaaggccctgatcgacggcatcggcaacagcttctcccctggcctcagcgtctgcaagacgtgttccattgggagtataaatggtttcgagatcgagtcccacaagtgctattgctcactgttctgctgcccctactgccgggcgtgttccagcgacaagaacacccaccgcatgcacctgaatgtgtgtaaaaagcggaagatgggctcaaacgtgatgctcgccgtctgtaagcgcatgtgcttccgggccaccatcgaggccagtaacaaagccctgctgatccgctccatcatcaacagcaccttcgtgatctgcatcctcatcctgacgatatgcgtggtcagcaccagtgcggtggacatggagaatctgcccgcagggatatgggagaaggaggaggacctcaccaacttctgtcaccaggagtgccaggtgaccgagacggaatgcctgtgcccctacgaggccatggtccttcgcaagccgctgtttctagactcaaccgccaagggcatgaagtccctgctgaacagcacctccctcgaaacatcgctatccatcgaggccccctggggcgcgattaacgtgcagagcacgtttaaacccaccgtgtccgccgccaacatcgcgctgtcatggtccagcgtggagcaccggggaaacaagatcctcgtgtccgggcgcagcgagagcatcatgaagctagaggagcggaccggcgtaagctggaacctgggcgtcgaggacgctagtgagagcaagaccctcacggtaagcgtgatggacctgtcccagatgtacagccccgtcttcgagtacctgtccggggaccgccaagtggaggagtggccgaaagcgacctgcaccggcgactgtcccgagcggtgcgggtgcaccagctccacgtgcttgcacaaggagtggccccacagccggaactggcgatgcaaccccacctggtgctggggcgtgggcaccgggtgcacgtgctgcggcctggacgtcaaggatttcttcaccgactacatgctggtgaagtggaaggtggagtacataaagaccgaggccatcgtctgcgtggaactcacgtcccaggaacgccagtgttcgctgatcgaggccgggacgcgcttcaacctgggcccggtgaccatcacgctctccgagccccgcaacgtccagcagcgactgccgcccgagatagtgaccctgcaccccaagatcgaggaggggttcttcgacctgatgcacgtgcagaagattctgagcgccagcaccgtctgcaagctgcagagctgtacccatggtgtgcccggcgacttccaaatctaccacgtcgggaaccttctccgcggcgataaggtcaacgggcactccatccacaagatcgagccccacttcaacactagctggatgtcctgggatggctgcgacttggactacttctgcaacatgggggactggccgagctgcacgtacaccggcgtgacccagcacaacagggcggccttcatcaacatgctcaacatcgagacggactacacaaaaaccttccacttccactccaagcgtgtgaccgcccatggcgacacgcctcagctggacctgaaggcccggcccgcctacggggcaggcgaagtcactgtgctcgtggaggtcgccgatctggagctgcacaccaaaaagctcgaagttagcgggttgaagatcgcctccctgacctgcagcggctgctatgcctgcagcagcggcatcagctgtaaggtgcgcatacacgtaaacgagcccgacgagttcacggtacacgtgcggagcagcgaccctgacgtcgtggcagcgggctccagcctcatggcccgcaagatcgagttcggcgccgactccaccttcaaggcgttcagctccatgcccaaggacagcctgtgcttctacatcgtggaaaaggattactgctcgagctgcactgacgacgacacacagaagtgcgtcaacactaaacttgaccacccccagtccatcctcatcgagcacaaggggaccatcatcggcaagcagaacgacacgtgcagcaccaagacctcctgctggctggagagcgttaagggtttcttctatggtctgaagaatatgctctccgggatcttcggcaacgttttcctgggcatcttcctgttcctcgcccccttcgtactgctgatcttcttcttcttcttcgggtggcggctcctgttctgcctgaagtgttgccgccgcacccggggcctcctgaaatacaaacacctgaaggacgaagaggaggcggggtacaaaaagattatcgagcgactcaacggcaagaagggcaagagccagctgttcgacggggagcggctggccgaccgcaaaatcgcagagctgttctccaccaagatccacatcggc

SEQ ID NO: 15409 - RNA, 3495 nt, synthetic construct
  misc_feature 1..3495: note = derived and/or modified CDS sequence (opt11) from CCHVF(CCHVF Afg09-2990)__HM452306.1__Gn-NSm-Gc
  source 1..3495: mol_type = other RNA
agcgaggagtccggcgacgactgcatcagccgcacccagctgctccggaccgagacggccgaggtgcacggggacaactacggcggtcccggcgacaagatcaccatctgcaacgggtccaccgtcgtggaccagcgcctgggctcagagctgggctgctataccatcaatcgggtgcgctccttcaagctctgcgagaacagcgccacggggaagtcttgcgagatcgacagcatccccgtaaagtgcaagcagggctattgcctgaagatcacccaggaggggcggggccacgtgaagttgtcccgcgggagcgaagtggtcctggacgtgtgcgactccagctgcgaggtgatgatccccaagggcaccggcgacatcctggtcgactgttccggaggccagcagcactacctgaaggacaacctcgtggacctggggtgccccaagatccccctgctcggcaagatggcgatctacatctgtcggatgagcaaccacccgaagaccacgatggccttcctgttctggttcagtttcggttacgtgattacgtgcatcctgtgcaaggccatcttcttcctcctgatcatcttcgggaccctgggcaagcgcttcaagcagtaccgggagctcaaaccccaaacctgcaccatctgcgagaccacccccgtcaacgccatcgacgccgagatgcacgacctgaactgcagctacaacatatgcccctactgcgcgtcccgcctgaccagcgacgggctcgcccggcacgtgacgcagtgcccgcgccggaaggagaaggtggaggagaccgagctgtacctgaacctcgagcgcattccctgggtcgtgcggaagctgctccaggtgtccgagagcaccggcaccgtcctgaagcgcagctcctggctgatcgtgctgctcgtgctgttcacggtcagcctgtcccccgtgcagagcgcccccatcgggcacggcaagaccatcgagacctaccgggtgcgcgaggagtacacctccatctgcctcttcgtcctgggcagcatcctgttcatcgtgtccttcctcatgaaggggctggtcgacggcgtggggaacatcttcttcccgggcctcagcgtgtgcaagacgtgctccatcggcagcatcaacggcttcgagatcgagtcccacaagtgctactgcagcctcttctgctgcccctactgccggcactgctccgccgacggcgaaatccaccagctccacctgagcatctgcaagaagcgcaagaccgggtccaacgtcatgctcgcggtgtgcaagcggatgtgcttccgcgccaccatggaggtgagcaacaaggccctgttcatccgctccataatcaacaccacgttcgtcgtgtgcattctgatcctcgccgtgtgcgtcgtgagcacctccgccgtggagatggagagcctgcccgcgggcacgtgggagcgggaggaggacctgaccaacttctgccatcaggagtgccaggtcacggagaccgagtgcctctgcccctacgaggccctggtgctgcgccggccgctgttcctcgacagcatcgtgaaggggatgaagaacctgctgaactccaccagcctcgagacctccctaagcattgaggccccctggggcgcaatcaacgtccagtccacgtataagcccaccgtgagcaccgccaacatcgcgctgtcctggagctccgtggagcaccgcgggaacaaggttctcgtgagcggccggtccgagagcatcatgaagctggaggagcgcaccggcatctcctgggacctgggggtggaagatgccagcgagtccaagctcctgaccgtcagcgtgatggacctgtcccagatgtacagccccgtgttcgagtacctcagcggcgaccggcaggtcgaggagtggccgaaagccacgtgcaccggggactgccccgagcgctgtggctgcacctccagcacatgcctgcacaaggagtggccacactccaggaattggcgctgcaaccccacctggtgctggggcgtggggaccggctgcacgtgctgcgggctggacgtgaaggacctcttcaccgactacatgttcgtcaagtggaaggtcgagtacatcaagaccgaggccatcgtgtgcgtcgagctgacctcccaggagcggcagtgctccctgatcgaggccggcacccgcttcaacctcgggagcgtgaccatcacgctgtccgagccgcggaacatccagcagaagctgccgcccgagatcatcaccctccaccccaaaatcgaggagggatttttcgacctgatgcacgtgcagaaggtccttagcgcgtccaccgtgtgcaagctccagtcatgcacccacggagtgcccggggacctgcaggtctaccacatcggcaacctgctcaagggggatcgtgtgaacggccacctgatccacaagatcgagcagcacttcaacacgtcctggatgagctgggacgggtgcgacctggactactactgcaacatgggcgactggccctcctgcacctacaccggcgtgacccagcacaatcacgccagcttcgtcaacctcctgaacatcgagacggactacaccaagaccttccacttccacagcaagcgggtgaccgcccacggggacacaccccagctggacctcaaggcccgaccaacctacggcgccggcgagatcaccgtgctggtcgaggtggcggacatggagctgcacaccaagaagatcgagatcagcggcctcaagttcgccgggctgacctgcaccggttgctacgcctgctccagcggcatctcctgcaaggtgcggatccacgtcgacgagcccgacgaactgaccgtgcacgtcaagagcgacgaccccgacgtggtggccgcgagctccagcttgatggcccgcaagctggagttcgggaccgactccacgttcaaggccttcagcgccatgcctaagacctccctgtgcttctacatcgtggagcgggagtactgcaagtcatgctccaaggaggacacccagaagtgcgtcaacaccaagctcgagcagccgcaaagcatcctgatcgagcacaagggcacgatcatcggcaagcagaacaacacgtgcaccgccaaggcgtcctgctggctggagagcgtgaagtccttcttctacggactcaagaacatgctcgggggcatcttcggcaacgtcttcatcgggatcttcaccttcctgacccccttcatcctgctgatcctgttcttcatgttcggctggcgcatcctcttctgcttcaagtgttgccgccggacccgcgggctgttcaagtaccggcacctgaaggacgacgaggagaccggctaccgcaagatcatcgagcggctcaacaacaagaaaggcaaaaaccgcctgctggacggggagcggctcgccgaccgcaagatagccgagctgttcagcaccaagacccacatcggc

SEQ ID NO: 15410 - RNA, 3495 nt, synthetic construct
  misc_feature 1..3495: note = derived and/or modified CDS sequence (opt11) from CCHVF(CCHVF Sudan Al-Fulah 3-2008)__HQ378184.1__Gn-NSm-Gc
  source 1..3495: mol_type = other RNA
agcgaggagccatccgacgactgcatcagccgcacccagctgctccggaccgagacggccgagatccacggtgacaactacgggggcccgggggacaagatcaccatctgcaacggctccaccatcgtggaccagcgcctggggagcgagctgggctgctacaccatcaaccgggtcaaatccttcaagctctgcgagaacagcgccacgggcaagtcctgcgtaatcgacagcgtgccggtcaagtgccgccaagggtactgcctgcggatcacccaggagggccgcgggcacgtgaagttatcccggggcagcgaagtggtcctcgacgcgtgcgacacctcttgcgaaatcatgatcccgaaggggaccggcgacatcctggtggactgcagcggcggccagcagcacttcctgaaggacaacctcgtggacctgggctgccccaagatcccgctgctcgggaagatggccatctacatctgccgcatgtccaaccaccccaaaaccaccatggcctttctgttctggttcagcttcggctacgtcatcacgtgcatcctgtgcaaggccatcttctacctcctgatcatcataggcaccctggggaagcggttccgccaataccgggagctcaagccccagacctgcaccatctgcgagacgacccccgtgaacgccatagacgccgagatgcacgacctgaactgcagttacaacatctgcccgtactgtgccagccggctgacgtccgacggcctcgcccggcacgtgacacagtgccccaagcgcaaggagaaggtggaggagaccgagctgtacctgaatctcgagcggatcccctgggtggtgcgcaagctgctgcaagtcagcgagtccaccggggtggccctcaagcggagcagctggctaatcgttctgctagtcctgttcacggtgtcgctgagccccgtgcaatccgcgcctatcggccacggaaagaccatcgaggcctaccgcgctcgggagggctacaccagcatctgcctcttcgtcctgggatccatcctgttcatcgtgagctgcctcatgaagggtctggttgactccgtcggcaacagcttcttcccagggctgtccatatgcaagacctgcagcatctcgagcatcaacgggttcgagatcgagtcacacaaatgctactgcagtctcttctgctgcccctactgccgccactgttccgcagacaaggagatccacaagctgcatctgagcatctgcaagaaacgaaagacggggtccaacgtgatgctcgccgtctgcaagcgcatgtgcttccgcgctaccatggaggtaagcaaccgggcactgttcatacgatccatcatcaacaccaccttcgtgctgtgcatcctcatcctggccgtgtgcgtggtgagcacgagcgccgtcgagatggagaaccttcccgccggcacctgggagcgggaggaggacctcaccaacttctgccaccaggagtgccaggtgaccgagacggagtgcttatgcccatacgaggcgctggtgctgcgccggcccctcttcctagactccatcgtgaagggcatgaagaacctgctcaacagcacctccctggaaaccagcctgtccatcgaggccccgtggggcgctattaatgtgcagagcacctacaagcccacggtgtccaccgcaaacatcgccctcagctggtccagcgtcgagcaccgcgggaacaagatcctggtgtccgggcggagcgagtccatcatgaagctggaggagcgcaccggcatcagctgggacctcggggtggaggacgcgtccgagtcaaagctgctgaccgtctccgtgatggacctcagccagatgtacagcccggtgttcgagtacctgtccggcgatcggcaggtcgaggaatggcccaaggcaacctgcacgggcgactgccccgaacgctgtgggtgcaccagctcgacgtgcctgcacaaagagtggccccacagccggaactggcgctgcaatcctacctggtgctggggcgtagggaccggctgcacgtgctgcggcctcgacgtgaaggacctgttcaccgactacatgttcgtcaagtggaaggtggagtacatcaagaccgaggccatcgtgtgcgtcgagctgacctcacaggagcggcagtgcagcctcatcgaggccgggacccgcttcaacctgggccccgtgactatcaccctgtccgagccccggaacatccagcagaaactgcccccagagatcatcacgctccacccccgcatcgaggaggggttcttcgacctgatgcacgtgcagaaggtcctcagcgcctcaaccgtgtgcaagctgcagtcctgcacccacggggtgccaggggacctgcaggtctaccacatcggcaacctcctgaagggcgacaaggtgaacggacacctgattcacaagatcgagccgcatttcaacacctcctggatgagctgggacggctgcgacctcgactactactgcaacatgggggactggccctcctgcacgtacaccggcgtgacccagcacaaccatgccagcttcgtcaacctactgaacatcgagaccgactacacgaagaatttccacttccattcaaagcgggtgaccgcccacggggacacgccccagctcgacctgaaggcccgccccacgtacggagccggcgagatcaccgtgctggtcgaggtggcggacatggagctccacaccaagaagatcgagatcagcgggctgaagttcgcctccctgacctgcaccggctgctacgcctgcagctccggtatcagctgcaaggtgcgaatccacgtcgacgagccggacgagctcacggtccacgtcaagagcgacgacccggacgtggtggctgcgtccagctccctgatggcccgcaagctggagttcggcaccgacagcacgttcaaggccttctccgccatgcccaagacaagcctctgcttctacatcgtggaaaaggagtactgtaagtcctgcagcgaggaagatacgaagaagtgcgtcaacaccaagctggagcagcctcagtccatcctgatcgaacacaagggtaccatcatcggcaagcagaactctacgtgcaccgccaaggtgtcctgctggctggagagcgccaagtcctttttctatggcctgaaggacatgctgagcgggatctttggcaacgtgttcatcgggatcttcctcttcctcgcgccgttcgtcctgctcgtgctgttcttcatgttcggctggcgcatcctgctctgcttccggtgctgccgccggacccgcggactgttcaaataccggcacctgaaggacgacgaggagaccggctaccgccggatcatcgagcgcctcaacaacaagaagggcaagaacaagctgctggacggtgagcggctcgccgaccgcaagatcgctgagctgttctccaccaagacccacatcggc

SEQ ID NO: 15411 - RNA, 3495 nt, synthetic construct
  misc_feature 1..3495: note = derived and/or modified CDS sequence (opt11) from CCHVF(CCHVF Sudan AB1-2009)__HQ378187.1__Gn-NSm-Gc
  source 1..3495: mol_type = other RNA
agcgaggagccttccgacgactgcatcagccgcacccagctgctccgcaccgagacggccgagatccacggcgacaactacggcggcccgggggacaagatcaccatctgcaacggctctaccatcgtggaccagaggctggggagcgagctgggctgttacaccatcaaccgggtaaagagtttcaagctctgcgagaacagcgccacgggcaagaactgcgagatcgactccgtgcctgtgaagtgtcgccaggggtactgcctgcggatcacccaggagggccgcgggcacgtcaagctgagccggggctccgaggtcgtgctcgacgcgtgcgacacctcatgcgagatcatgatccccaagggtaccggcgacatcttagtcgactgctccggcgggcagcaacacttcctgaaggacaacttaatcgacctggggtgccccaagatcccgctgctcgggaagatggccatctacatctgccgcatgagcaatcaccccaagacgaccatggccttcctgttctggttctccttcggctacctgatcacgtgcatcctctgcaaggccatcttctacctgctgatcatcatcggcaccctcggtaagcggctgaagcagtaccgcgagctgaaaccccagacctgcaccatctgcgagaccacccctgtgaacgccatcgacgcggagatgcacgacctcaactgcagctacaacatctgcccgtactgcgcctccaggctgacgagcgacggcctggcccgccacgtgatccagtgccccaagcggaaggagaaggtcgaggagaccgagctctacctgaacctggagcgcatcccctgggtggtgcggaagctcctgcaagtctccgagagcaccggggtggccctgaagcgctccagctggctcatcgtgctgctggtcctcttcaccgtgagcctgtcccccgtgcagagcgcgccgatcggccaggggaagaccatcgaggcctaccgggcccgcgagggctacacctccatctgcctgttcgtcctcggcagcattctgttcatcgtgtcctgcctgatgaaggggctcgtggacagcgtcggcaactccttcttccccgggctgagcatctgcaagacctgctccataagctcgatcaacggcttcgagatcgagagccacaagtgctactgctccctgttctgctgcccctactgccggcattgcagcaccgacaaggagatccacaagctccacctgtccatctgcaagaagcgcaagacggggagcaacgtgatgctggccgtgtgcaagcggatgtgcttccgtgccaccatggaggtatccaaccgcgccctcttcatccggagcatcatcaacaccaccttcgtcctgtgcatcctgatcctcgccgtctgcgtggtgtccacgagcgccgtcgagatggagaacctgcccgcgggcacctgggagcgcgaggaagacctgaccaacttctgccaccaggagtgccaggtgaccgagacggagtgcctgtgcccgtacgaggccctcgtgctgcggaagcccctgttcctcgacagcattgcgaagggcatgaagaaccttctgaactccaccagcctcgagacctccctgagcattgaggccccctggggcgccatcaacgtccagtccacctacaagcccacggtgagcaccgccaacatcgccctgtcgtggagctccgtggagcaccgcgggaacaaaatcctcgtcagcggccggtccgagagcatcatgaagctggaggagcgcaccggcatctcctgggacctgggggtggaggacgcgagcgaatccaagctcctgaccgtgagcgtcatggacctgtcccagatgtacagcccggtgttcgagtacctcagcggcgaccgccaggtggaggagtggcccaaggcgacctgcacgggcgactgccccgagcggtgcgggtgcacctccagcacgtgcctgcacaaggagtggccccactcccggaactggcgctgcaacccgacctggtgctggggcgtcgggaccggctgcacgtgctgcggcctggacgtgaaggacctcttcaccgactacatgttcgtgaagtggaaggtcgagtacatcaagaccgaggccatcgtgtgcgtggagctgaccagccaggagcggcagtgctccctgatcgaggccggtacccgcttcaaccttggccccgtcaccatcaccctgagcgagccccggaacatccagcagaagctgcccccggagatcatcacccttcacccccgcatcgaagaggggttcttcgacctgatgcacgtgcagaaggtgttatccgccagcaccgtctgcaagctgcagtcctgcacccacggcgtgcccggggacctccaggtgtaccacatcggaaatctgctgaagggcgacaaggtcaacgggcacctgatccacaagatcgagccgcacttcaacactagctggatgtcctgggacggctgcgacctggactactactgcaacatgggggactggcccagctgcacgtacaccggcgtgacccagcacaaccacgcgtccttcgtgaaccttctgaacatcgagaccgactacacgaagaacttccacttccacagcaagcgcgtcaccgcccacggggacacgccccagctggacctcaaggcgcgccccacctacggcgccggcgagatcaccgtgctggtggaggtcgcggatatggagctacacaccaagaagatcgagatctccgggctcaagttcgccagcctgacctgcaccggctgctacgcctgctccagcgggatctcctgcaaggtgcggatccacgtggacgagccggacgagctaacggtccacgtcaagagcgacgaccctgacgttgtggccgccagctccagcctcatggcgcgcaagctggagttcggcaccgactccacgttcaaggccttcagcgccatgcccaagacctccttatgcttttacatcgtggagcgggagcactgtaagagctgcaacgaggaggacacgaagaagtgcgtgaacaccaagctcgagcagccacagtccatcctgatagagcacaagggaaccatcatcggcaagcagaacagcacgtgcaccgcccgcgcctcctgctggctggagagcgtcaagtccttcttctacggcctcaagaacatgctgagcgggatctttggcaacgtgttcatggggatcttcctgttcctcgcgccgtttatcctgctgatcctcttcttcatgttcggctggcgcatcctgttttgcttcaagtgctgccggcgcacccgggggctgttcaaataccgccacctcaaggatgacgaggagaccggctaccggcgcatcatcgagcggctgaacaacaagaaggggaagaacaagttgctcgacggggagcgcctggccgaccggcgcatcgccgagctgttctccaccaaaacccacatcggc

SEQ ID NO: 15412 - RNA, 3495 nt, synthetic construct
  misc_feature 1..3495: note = derived and/or modified CDS sequence (opt11) from CCHVF(CCHVF NIVA 118595)__JN572083.1__Gn-NSm-Gc
  source 1..3495: mol_type = other RNA
tccgaggaatctggcgacgactgcatctccagaacgcaactcctacgcacagaaaccgcggaggtccacggcgacaactacggaggaccaggggataaaataaccatctgcaacggctccactgtggtcgaccaaagactaggcagcgaactaggctgctacacgatcaacagggttaaatccttcaaactctgcgaaaactcagcaaccggaaagagctgcgaaatagattcgatccccgtcaagtgcaggcaaggctactgcctaaaaatcacacaagaaggacgtggccacgtcaaactctcccgcggcagcgaagtcgtcctagacgcctgcgacagcagttgcgaagtcatgatacctaagggtaccggcgacatcctagtcgactgctccgggggtcagcagcacttcctaaaagacaacctaatcgacctgggctgcccaaagattcctctactcggaaaaatggccatctacatctgccgcatgagcaaccaccccaaaaccactatggcattcctattctggttcagctttggctacgtgattacctgcatcctctgcaaggtgatcttctacctccttatcatttttggtaccctcggaaagcggttcaagcaataccgagaactcaaaccccaaacatgcacaatctgcgaaactactcccgtgaacgccatagacgccgaaatgcacgacttaaactgctcctacaacatttgcccctactgcgcgtccaggctaactagcgacggactcgcacgccacgtcacccaatgccctaaacgaaaagaaaaagtcgaggaaaccgagctgtacctcaacctagaacgcataccatgggtcgtacgcaaactcctgcaggtcagtgaaagcaccggaatcgccctaaaacggagttcgtggctcattgttttactcgtactattcacggtcagcataacccccgtacagtcagcaccaatcggccacggcaagacgatcgaagcataccgagcacgagaagaatacacatccatctgcctcttcgtcctcggctccgtacttttcgtcgtcagctgccttatgaaaggcctggtagactcagtcggcaacatattcttccccggactcttcatctgcaaaacttgcagcatcggatccattaacggttttgaaatagaaagccacaagtgctactgctccctcttttgctgcccctactgtcgccactgctccgccgaccgggaaatccatcagctccacctgtccatctgcaagaaacgaaagacagggtccaacgtgatgctagcagtttgtaaacgtatgtgctttcggactaccatggaggtctcaaacaaagctcttttcgtcagaagcatcataaacacgactttcgtagtatgtatactaatccttgcagtatgcgtggtatcgaccagtgccgtggagatggagagcttgcccgccggaacctgggaacgcgaagaggatctaaccaacttctgccaccaagaatgccaagtgactgagaccgagtgcctatgcccatacgaggccctcgttctacgaagaccactgttcctagatagcattgtcaaaggcatgaaaaacctcctaaactctacctccctcgaaacatcgctctcaatagaggccccgtggggtgccatcaacgtacaatccacttataaaccaaccgtctccgcagccaacatagccctctcatggtcttccgtcgaacaccgggggaacaaaatactggtctcgggcaggtccgagagcataatgaaactggaagaacgcaccgggatctcatgggatctcggcgttgaggacgcgagcgaatcaaagctactcaccgtatcagtaatggatctatcacaaatgtactcgcccgtcttcgaatacctctctggcgaccgccaagtcgaagaatggcctaaggcaacttgcacgggcgactgccccgaacgctgcgggtgcacctcgagcacgtgcctccacaaagaatggccccactcacgcaactggcgttgcaatcccacctggtgctggggagtcgggacaggctgcacatgttgcgggctcgacgtgaaggacctctttaccgactacatgttcgtgaaatggaaagtcgagtacataaaaaccgaagcgatcgtatgcgtagaactaacatcgcaggagagacaatgctccctgatcgaagctggaacacgtttcaacctcgggtccgtcacaataacactctctgagcctcgcaacattcaacaaaaactgcccccagaaataatcaccctacacccacgaatagaagaagggttcttcgacctgatgcacgtacaaaaggtattgagcgcctctactgtatgcaaactacaatcgtgcacccatggagtcccaggcgacctccaagtctaccacatcggcaaccttcttaaaggcgaccgggtaaacggccacctcatccacaaaatcgaacaacacctgaacacatcatggatgagctgggacggctgtgacctagactactattgcaacatgggtgactggccatcgtgcacctacacaggcgtcacacaacacaatcacgcatcttttgtaaacttactcaacatcgaaacagactatacgaagaccttccacttccactccaagcgggtcacagcccacggagacacaccccagctcgaccttaaagccaggccaacctacggagccggcgagatcaccgtactcgtcgaagtcgcggacatggaactccacaccaaaaagatagaaataagcggacttaaattcgcctcactctcatgcacaggctgctacgcatgcagctcaggcatatcctgcaaggtacggatccacgtcgatgagccagacgaactaaccgtccacgtgaagtccgacgaccccgatgtcgtcgcagcaagcagctcgctaatggcccggaagttagaatccggcacagactccacattcaaagcattctcggccatgccaaagacatccctatgtttctacatagtagagcgcgaatactgcaaaggttgcagcaaagaagatacccaaaaatgcgtcaacaccaaacttgaacagccccagagcatcctgatcgaacacaagggcacaataataggaaaacaaaacaatacctgcacagccaaagcctcctgctggctagaatcggtcaaatctttcttctacggcctcaagaacatgctctccggaatcttcggaaacgtctttctcggtatcttcagcttcctggcaccattcgtactactgatactcttctttatgttcggatggcgaatactcttctgctttaagtgctgtcgcagaactagaggcctattcaaataccgccacttaaaggacgacgaagaaacaggataccgaaagatcatcgagcgcctgaacaacaagaaagggaaaaacaaactgctcgatggcgaacgccttgccgaccgaaaaatagccgagctgtttagcacaaaaacccatattgga

SEQ ID NO: 15413 - RNA, 3495 nt, synthetic construct
  misc_feature 1..3495: note = derived and/or modified CDS sequence (opt11) from CCHVF(CCHVF NIV 112143)__JN572085.1__Gn-NSm-Gc
  source 1..3495: mol_type = other RNA
agcgaggagtccggcgacgactgcatcagccgcacccagctgctccggaccgagacggccgaggtgcacggggacaactacggcgggcccggcgacaagatcaccatctgcaacgggtccaccgtcgtagaccagcgcctgggcagcgagctgggctgctacaccatcaaccgggtgaagtccttcaagctctgcgagaacagcgccacggggaagtcctgcgagatcgacagcatcccggtcaagtgccgccagggctactgcctgaagatcacgcaggaggggcggggccacgtgaagctatcccgcggaagtgaggtggtcctcgacgcgtgtgacagtagctgcgaggtgatgatccccaagggcaccggcgacatcctggtggactgcagcgggggtcagcagcacttcctgaaggacaacctcatcgacctggggtgccccaagatccccctgctcggcaagatggcgatctacatctgccggatgtcgaaccacccgaagaccacgatggccttcctgttctggttctccttcggctacgtcattacctgcatcctgtgcaaggtgatcttctacctcctgatcatcttcgggaccctgggcaagcgtttcaagcagtaccgggagctcaagccccagacctgcacgatctgcgagaccacccccgtgaacgccatcgacgccgagatgcacgacctgaactgcagctacaacatctgcccctactgcgcgtcccgcctgactagcgacgggctcgcccggcacgtcacgcagtgcccgaagcgcaaggagaaggtggaggagaccgagctgtacctgaacctcgagcggatcccctgggtggtacgcaagctgctacaggtgtccgagagtaccgggatcgccctcaagcggagctcctggctgatcgtgctgctagttctgttcacggtgagcatcacgcccgtgcagtccgcccccatcgggcacggcaagaccatcgaggcgtaccgcgcccgggaggagtacaccagcatctgcctgtttgtcctcgggtccgtgctgttcgtggtcagctgcctgatgaaggggctcgtggactccgttggcaacatcttctttccggggctgttcatctgcaagacctgcagcatcggctccatcaacgggttcgagatcgagagccacaagtgctactgctcccttttctgctgcccctactgccgccactgcagcgccgaccgggagatccatcagctccacctgtccatctgcaagaagcgcaagacgggcagcaacgtcatgctggccgtgtgcaagcggatgtgcttccgcgccaccatggaggtctccaacaaggcgctctttgtgcgcagcatcatcaacaccaccttcgtggtctgcatcctgatcctggccatctgcgtggtgtccacgagcgccgtcgagatggagtccctccccgccggcacctgggagcgggaggaggacctgaccaacttctgtcaccaggagtgccaggtgacagagacggagtgcctgtgcccttacgaggccctcgtgctgcgccggccgctgttcctggactcgatcgtcaaggggatgaagaacctcctgaacagcacctccctggagaccagcctctccatcgaggcgccctggggcgccatcaacgtgcagagcacctacaagcccacagtgtccgccgccaacatcgctctgagctggtccagcgtcgagcaccgcgggaacaagatcctggtgtccggccggagcgagtccatcatgaagctcgaggagcggaccgggatcagctgggacctgggcgtggaggacgcgtccgagagcaagctgctcaccgtctccgtgatggacctgagccagatgtactcccccgtgtttgagtacctgagcggcgaccggcaggtcgaggagtggccgaaggctacctgcaccggggactgccccgagcgctgcggctgcacgagctccacttgcctccacaaggagtggccccacagccggaactggaggtgcaaccccacctggtgctggggagtggggaccggctgcacgtgctgcgggctggacgtgaaggacctgttcaccgactacatgttcgtcaagtggaaggtggagtacatcaagaccgaggccatcgtgtgcgtcgagctcacctcccaggagcggcagtgcagcctgatcgaggccggcacgcgcttcaacctggggtccgtgaccatcaccctcagcgagccgcggaacatccagcagaagctgccgcccgagattatcaccctgcacccccgcatcgaagagggcttcttcgacctcatgcacgtgcagaaggttctgtccgccagcacggtgtgcaagctgcagagttgcacccacggggtgcccggcgacctccaggtctaccacatcggcaacctgctgaagggggaccgggtgaacggccacctcatccacaagatcgagcagcacctgaatacctcttggatgtcctgggacgggtgcgacctggactactactgcaacatgggagactggcccagctgcacctacacgggggtgacccagcacaaccacgcgtccttcgtcaacctcctgaacatcgagaccgactacaccaagacgttccacttccacagcaagcgcgtgaccgcccacggcgacacgccccagctggacctcaaggcccggcccacctacggcgccggggagatcaccgtgctggtcgaggtggcggacatggagctacacaccaagaaaatcgagatctccggcctcaagttcgccagcctgtcctgcaccgggtgctacgcctgcagctccggcatcagctgcaaggtgcgcatccacgtcgacgagcccgacgagctgaccgtgcacgtcaagagcgacgaccccgacgtggtagccgcctccagctccctcatggcgcggaagctggagttcgggacggactcaacattcaaggccttctccgccatgcccaagaccagcttatgcttctacatcgtggagcgcgagtactgcaagggctgctccaaagaggacacccagaagtgcgtcaacacgaagctcgagcagccgcagagcatcctgatcgagcacaagggcaccatcatcggcaagcaaaacaatacctgcacagccaaggccagctgctggctggagtcagtgaagtccttcttctacggcctcaagaacatgttaagcgggatcttcggcaacgtgttcctggggatcttctccttcctcgcgcccttcgtcctgctgatcctcttcttcatgttcggctggcgcatcctgttctgcttcaagtgctgccggcgcacgcggggccttttcaaatatcgccacctcaaggacgacgaggagaccgggtaccggaagatcattgagcgcctcaacaacaagaagggcaagaacaagctgctcgacggggagcggctggccgaccgcaagatcgccgagctgttcagcaccaagacccacatcggc

SEQ ID NO: 15414 - RNA, 3495 nt, synthetic construct
  misc_feature 1..3495: note = derived and/or modified CDS sequence (opt11) from CCHVF(CCHVF SCT ex Afghanistan)__KC344856.1__Gn-NSm-Gc
  source 1..3495: mol_type = other RNA
tcagaagagagcggcgacgactgcatctcccgaacccaactcctacggacagaaacagccgaggtacacaacgacaactacggcggtccaggggacaaaataaccatctgtaacggaagcactatagtggaccaacgcctcggcagcgaacttggctgttatactataaatcgcgtcaagagcttcaaactctgcgaaaacagcgccacggggaagagttgcaaaatcgacagcacgcccgtcaaatgccgacaaggattctgcctcaaaataacacaagaaggacgggggcatgtaaagctatcacgcggttccgaagtagtgttggacgcgtgcgattcaagctgcgaaataatgataccaaagggcaccggagacattctcgtcgattgctctggaggacaacaacacttcctcaaagacaacctaatcgacctaggctgtcccaacattccgctactaggcaaaatggcgatatacatatgccgcatgtcaaaccaccccaaaaccacaatggcattcctattctggttcagcttcggttacgtcatcacttgcattttctgcaaagtcatattctacctgctcatagtagtcggcaccctaggcaagaaattcaagcaatacagagaactcaaaccacagacgtgtaccatctgcgaaactactccaacaaacgccatcgacgccgaaatgcatgacctaaactgtagttacaacatatgcccctattgcgcatctcgtttaacctccgacggcctggcgcgacatgtaacccaatgtcctaaaagaaaagaaaaggtcgaagagacagaactatacctgaatctcgaacgtatcccttggattgtccgcaaacttctccaagtctcagaatcaacaggagtagcactaaaacgcagcagctggttaatagtcctcttagttctcttgacagtatccctaagtcccgtacaatcagcacccatcgggcacggcaaaactatagagacataccagacgcgggagggatacatatccgtatgcctattcgtactcggcggaatcctattcgttgttagttgcctgatcaaagggctggtagattctgtgggaaactcctttttccccggactcagcatatgcaaaacctgctctataggatccgtcaacggcttcgagatagagtcacataagtgctactgctctctactatgctgcccgtactgccgtcactgctccaccgaccgggagatccaccaactacacctatcgatatgcaaaaagcgcagaacaggaggaaacgtgatgctcgccgtgtgcaagcgaatgtgcttccgcgccaccatggaggtaagcaacaaggtcctattcataaggaacataataaacaccacattcgttatctgcattctcatcctagcagtatgcgtcgtatcaacaagcgccgtcgaaatggaaagcctcccggccgggacttgggaaagggaagaagaccttacaaacttctgccaccaggagtgtcaagtgaccgagaccgaatgcctatgcccctacgaagccctagtcctccgcaagcccctatttctaaattcaatagtcaaaggtatgaagaacctcctaaacagcaccaacctcgaaacaagcctctcaatagaagcaccctggggagctattaacgtacaaagcacctttaaacccaccgtttcgacagccaacatcgccctgtcctggagctcggtagaacaccggggtaacaaaatcctcgtctcaggacgctcggaatccatcatgaaactagaggaaagaaccggaataagctgggatctcggcgtcgaggacgcgagcgaatcgaaatcactcaccgtatccgtgatggacctaagtcaaatgtactcacccgtcttcgaatatctaagcggcgacagacaggtcgaagagtggcccaaagccacatgcaccggagactgcccggaaagatgcggatgcacctcgtccacatgcctacataaagagtggccgcactcccgcaactggcggtgcaacccgacctggtgttggggcgtcggaacgggatgtacctgctgcggtctagacgtaaaagacctgtttaccgactacatgttcgtaaaatggaaggtagaatacatcaaaaccgaagccatcgtctgcgtcgaactcacaagtcaagaacgacaatgctcgctcatcgaagcaggcacccgattcaatctgggacccgtcaccatcaccctaagcgaacccagaaacatacaacaaaaactcccaccagaaataataacgctacacccaagaatagaggaaggattctttgacctcatgcacgtacaaaaagtcctatcggcctccacggtctgcaagctccaaagctgcacacacggagtccccggcgacctccaagtctaccacatcggaaacctcctcaaaggtgacaaactgaacggacacatgatccacaagatcgaacctcacttcaacacctcatggatgtcatgggacggctgcgacctagactactactgcaacatgggagactggccctcatgcacatacaccggcgtgacacaacacaaccacgcagccttcgtaaatctcctcaacatcgaaaccgactataccaaaaactttcacttccactccaaacgagttacagcccacggagacacaccccaacttgacctcaaggcccggccaacttatggagccggcgagatcacagttctagtcgaggtagccgacatggaactccataccaagaaaatagacatttccggtctcaaattcgcgtccctcacatgtgccggctgctacgcctgcagctctggaatatcatgcaaagtaaggatacacgtcgacgaacccgacgagctgaccgtacacgtcaagtcagaagatccagacatcgtagccgctagcacatcactgatagcccgcaaactcgaactcggcaccgacagcaccttcaaggctttctccgccatgcccaagaccagcctctgcttctacatagtcgaacgagaatactgtaagtcctgctccaaagaggacacccaaaaatgcgttaacacgaagctcgagcacccccagggaatactcattgaacacaaaggaacgatcatcggaaaacaaaacgatacctgcactgctaaagctggctgctggctcgagtcagtaaaatcattcttttacggcctgaaaaacatgttaagcggaattttcggcaacgtattcatcggtatatttttattcctcgcccccttcgtcctactcatcctcttcttcatgttcggctggcgtctcctattctgcttcaaatgctgccgccgcaccagaggcctattcaaataccggcaccttaaagaggacgaagagagcggttacagacgaatcattgaacgcctaaacaacaagaaaggcaaaaacaaacttctcgacggagaacgcctagcagaccgccgaattgctgaactattctcgaccaaaacccacatcggc

SEQ ID NO: 15415 - RNA, 3495 nt, synthetic construct
  misc_feature 1..3495: note = derived and/or modified CDS sequence (opt11) from CCHVF(CCHVF Zahedan 2007)__KC867273.1__Gn-NSm-Gc
  source 1..3495: mol_type = other RNA
agcgaggagtccggcgacgactgcatcagccgcacccagctgctccggaccgagacggccgaggtgcacggcgacaactacggcgggcccggcgacaagatcaccatctgcaacgggtccaccgtagtggaccagcgcctcggcagcgagctgggctgctacaccatcaaccgggtgcgctccttcaagctctgcgagaacagcgccacggggaagtcctgcgagatcgacagcatcccggtcaagtgcaaacagggcttctgcctcaagataacccaggaggggcggggccacgtgaaactgtccagggggagcgaggtggtcctcgacgtgtgcgactccagctgtgaggtgatgatccccaagggcacaggcgacatcttggtcgactgctccgggggccagcagcacttcttaaaggacaatctcgtggacctggggtgccccaagatccccctgctcggcaaaatggcgatctacatctgccggatgagcaaccacccgaagaccaccatggccttcctgttttggttctccttcggatacgtgatcacgtgcatcctgtgcaaggcaatctttttcctcctgattatcttcggaaccctgggcaagcgcttcaagcagtaccgggagctcaagccccagacctgcactatatgcgagactacccccgtcaacgccatcgacgccgagatgcacgacctgaattgtagctacaacatctgcccctactgcgcgtcccgcctgacaagcgacgggctcgcccggcatgtgacgcaatgcccgcgccggaaggagaaagtggaggagaccgagctctacctgaacctcgagcgcatcccctgggtcgtgcggaagctgctccaggtctccgagtcaaccggcaccgtactcaagcgcagttcctggctgatcgtgcttctcgtgctgttcacggtcagcctgtcccccgtgcagtcggcccccatcgggcacggcaaaaccatcgagacctaccgggtgcgcgaagagtacacctccatctgcctcttcgtcctgggcagcatcctgttcatcgtgtccttcctcatgaagggactggtcgacggcgtagggaacatcttcttcccgggcctgagcgtgtgcaagacgtgctccatcgggagcatcaacggcttcgagatcgagtcccaccggtgctactgcagcctcttctgctgcccctactgcaggcactgttccgccgacggagagatacaccagctgcacctgagcatatgcaagaagcggaagaccggtagtaacgtcatgctcgcggtgtgcaagcgcatgtgcttccgcgccaccatggaggtgagcaataaggtactgttcatccggtccatcatcaacaccacgttcgtggtgtgcatcctgatcctcgccgtctgcgtggtgagcacttccgccgtcgagatggagagcctgcccgccggcacctgggagcgggaggaggacctgaccaacttctgccaccaggagtgccaggtcacggagactgagtgcctctgcccctatgaggcgctggtgctgcggcgccccctctttctcgacagcatagtcaaggacatgaagaacctgctgaactccaccagcctcgagacctccctgagcatcgaggccccctggggcgccatcaacgtgcagtccacgtacaagcccacagtgagcaccgccaacatcgccctgtcctggagctccgtcgagcatcggggaaacaaagtgctagtgagcgggcgctccgagagcatcatgaagctggaggagcggaccggcatctcctgggacctgggcgtcgaggacgcgagcgagtccaaactcctgaccgtgtcagtgatggacctttcccaaatgtacagccccgtcttcgagtacctcagcggggaccgccaggtggaggagtggccgaaggccacgtgcaccggcgactgccccgagcggtgcgggtgcacctccagtacgtgtctgcacaaggagtggccccactcacgcaactggcgctgcaaccccacctggtgctggggcgtggggaccgggtgtacctgctgcggcctggacgtcaaggacctcttcacggactacatgttcgtaaagtggaaggtggagtatatcaagaccgaggccatcgtctgcgtggagctgaccagccaggagcgccagtgctccctaatcgaggccggaacccgcttcaacctcggcagcgttaccatcacgctgtccgagccgcgcaacattcagcagaagctgccgcccgagattatcaccctccaccctaagatcgaggaggggttcttcgacttgatgcacgtccagaaggtgctgagcgcctccaccgtgtgcaagctccagagctgcacccacggggtccccggtgacctccaggtgtaccacatcggcaacctcctgaaaggcgaccgggtgaatgggcacctgatccacaagatcgagcagcacttcaacacctcctggatgtcgtgggatggctgcgacctggactactactgcaatatgggggactggccctcctgcacctacaccggcgtcacccagcacaaccacgcgagcttcgtaaacctcttaaacatcgagacggactacaccaagaccttccacttccactccaagcgcgtgaccgcccacggcgacacgccccagttagacctcaaggcccggccgacctacggggccggggagatcaccgtcttagtggaagtggccgacatggagctccacaccaagaagatcgagatcagcgggctcaagttcgcgggcctgacgtgtaccgggtgctacgcctgcagctcgggcatctcgtgcaaggtccgcatccacgtggacgagcccgacgagctgaccgtccacgtcaagagcgacgaccccgacgtggtggcagccagctccagcctcatggcgcggaagctcgagttcggcaccgactccacgttcaaggcattcagcgccatgcccaagacctccctctgcttctacatagtcgagcgcgagtactgcaagagttgctccaaggaagacacccagaagtgcgttaacaccaagctcgagcagccgcagagcatcctgatagagcacaaggggacgatcatcggcaagcagaacaacacgtgcaccgccaaggcctcctgctggctggagagcgtcaagtccttcttctacgggctcaagaacatgctgggcgggatcttcggcaacgtgttcatcggcatcttcaccttcctgacccccttcattctcctgattttcttcttcatgttcgggtggcgcatcctgttctgcttcaagtgctgccggcgcacccggggcctcttcaagtaccgccacctgaaggacgacgaggagaccgggtaccggaagatcatcgaacgtctgaacaacaagaagggcaagaaccggcttctggacggcgagcgcctggcggaccgaaagatcgccgagctgttttcaacgaagacccacatcggg

SEQ ID NO: 15416 - RNA, 3495 nt, synthetic construct
  misc_feature 1..3495: note = derived and/or modified CDS sequence (opt11) from CCHVF(CCHVF SPU 44/08)__KJ682805.1__Gn-NSm-Gc
  source 1..3495: mol_type = other RNA
agcgaggagtccaacgacgactgcctgagccgcacacagctccttcggaccgagaacgccgagatccattccgacaactacggcgggcctggcgacaagatcacgatctgcaacgggagcaccatcgtggaccagcgcctgggctccgagctcgggtgctacacgatcaaccgggtaaagagcttcaagctgtgcgagaacagtgccaccggcaagagctgcgagatcgactccacgccggtgcgctgccggcagggcttctgcctgaagatcacccaggaggggcgcggccacgtgaagctcagccgggggagcgaggtcgtgctggacgcgtgcgacagctcctgcgagatcatgatccccaagggcaccggggacatcctggtggactgcagcggcggccagcagcacttcctcaaggacaacctggtcgacttagggtgccccaacatcccgctcctgggcaagatggccatctacatttgccgcatgtccaaccacccgaagacgaccatggccttcctgttctggttcagctttgggtacgtgataacgtgcatcctctgcaaggccatcttctacctgctaatagtggtcggcaccctcggcaagaagttcaagcagtaccgggagctgaagccacagacctgcaccatctgcgagaccaaccccgtgaacgccatcgacgcggagatgcacgacctgaactgctcctacaacatctgcccctactgcgccagccgcctcacctccgatgggctggcccggcacgtgatgcagtgtccgaagcgcaaggagaagatagaggaaaccgagctgtacctcaacctggagcggataccctgggtcgtgcgcaagctactccaggtgagcgagagcactggcgtcgccctgaagaggtccagctggctggtgatcctcctggtgctgctcaccgtctccctgagccccgtgcagtccgcgcccatcagccacggggagaccgtcgaggtctaccagacccgcgagggctacacgtccatctgcctgttcgtgctcgggagcatcctgttcctggtgtcctgcctcatgcggggcctggtcgacagcgtgtccaactccttcttcccgggcctgagtatctgcaagacctgctcaatcgggtccatcaacggcttcgagatcgagagccacaagtgctactgctccctattctgctgcccctactgccgccactgcagcgccgacatcgagatccacaagctgcacctgtccatttgcaagaagcggaagaccgggagcaatgtcatgttagccgtgtgcaagcgcatgtgcttccgggccaccgtggaggtcagcaacaaggccctgctgatccgcaatatcatcaacacaaccttcgtggtgtgcatcctcatcctggcggtctgcgtggtgtccaccagcgccgtcgagatggagaacctgcccgccggcacctgggagaaggaggaggacctgacgaacttctgccaccaggagtgccaggtgaccgagaccgagtgcctctgcccctacgaggccctggtgctgcgcaagcccctcttcctggactccatcgtcaaggggatgaagaacctgctcaacagcacctccctggagacgagcctgtccatcgaggccccatggggtgcgatcaatgtgcagagcaccttcaagcccaccgtgtccgccgccaacatcgccctcagctggtccagcgtcgagcaccggggcaacaagatcctggtctccgggcgcagcgagtccatcatgaagctggaggagcggaccggtatcagctgggacctcggggtggaggacgcctccgagagcaagctgctgactgtcagcgtgatggacctctcccagatgtacagccccgtgttcgagtacctgtccggcgaccgccaggtcgaggagtggccgaaggcgacctgcaccggggattgccccgagcggtgcggctgcaccagctccacgtgcctgcacaaggagtggccccacagccgcaactggcggtgcaaccccacctggtgttggggcgtggggaccggctgcacttgctgcgggctcgacgtgaaggacctgttcactgactacatgtttgtcaagtggaaggtggactacatcaagaccgaggccatcgtgtgtgtcgagctgacctcccaggagcgccagtgcagccttatcgaggccggcacccgtttcaacctgggcccggtgaccatcacgctgtccgagccccgcaacatccagcagaagctcccgcccgagatcgtgaccctgcacccgcggatcgaggaagggttcttcgacctgatgcacatccagaaggtcctcagcgcctccaccgtatgcaagctgcagagctgcacccacggcgtgcccggggacctgcagatctaccacatcggcaacctcctgaagggggacaaggtcaacggccacttaatccacaagatcgagccccacttcaacacgtcctggatgagctgggacggctgcgacctcgactactactgcaacatgggggactggccgtcctgcagctacaccggcgtaacccagcacaaccacgccgcgttcgtgaacatgctgaacatcgagaccgactacactaagaacttccacttccactccaagcgcgtcaccgctcacggggacacgccccagctggacctcaaggcccggcccacctacggcgccggggagatcaccgtgctggtggaggtcgcggacatggagctgcacaccaagaagatcgagatcagcggcctcaagttcgcctccctgacctgcaccggctgctacgcctgcagctcggggatctcctgcaaggtgcgcatccacgtagacgagcccgacgagctgaccgtccacgtcaagagcgaggacccggacatcgtggccgcctccagctccctcatggcgcggaagctagagttcggcaccgactcaacctttaaggccttctccgccatgcccaagacctctctgtgcttctacatcgtggagcgcgagtactgcaagtcctgcagcaaggaggacacgcagaagtgcgtgaacaccaagctcgagcagccccagtccatcctgatcgagcacaaggggaccatcatcggcaagcagaacgacacgtgcaccgccaaggccagctgctggctggaatccatcaagagcttcttttacgggctcaagaacatgctgtccggcatctttggcaacgtgttcatcggtatcttcctgttcctcgcgccattcatcatgctgatcctgttcttcatgttcggctggcggatcctcttctgcttcaagtgctgccgccggacccgcgggctgttcaagtaccgccacctgaaggacgacgaggagatcggctaccggaagatcatcgagcgcttgaacaacaagaaggggaagaacaagctgctggacggcgagcggctcgccgaccgcaagatcgccgagctgttcagcaccaagacccacataggc

SEQ ID NO: 15417 - RNA, 3495 nt, synthetic construct
  misc_feature 1..3495: note = derived and/or modified CDS sequence (opt11) from CCHVF(CCHVF SPU 383/87)__KJ682806.1__Gn-NSm-Gc
  source 1..3495: mol_type = other RNA
tccgaggagtccaacgacgactgcctcagccgcacccagctcctgcggaccgagaacgccgagatccactccgacaactacggcgggcccggcgacaagatcacgatctgcaatgggagcaccatcgtggaccagcgcctgggctccgagctcgggtgttatactattaaccgggtcaagagcttcaaactgtgcgagaactccgccacaggcaagagctgcgagatagactccacaccggtgcgctgccggcagggcttctgcctgaagatcacccaggagggtcgcggccacgtgaagctcagccgggggtccgaggtcgtgctggacgcgtgcgacagctcctgcgagatcatgatccccaaaggcaccggcgacatcctggtggactgcagcggcggccagcagcacttcctcaaggacaacctggtggacctggggtgccccaacatccccctcctgggcaagatggccatctacatctgccgcatgtccaaccacccgaagaccacgatggcctttctgttctggttcagcttcggttacgtgatcacgtgcatcctctgcaaggtgatcttctacctgttggtcgtagtgggcaccctcggcaagaagttcaagcagtaccgcgagttaaagccccagacctgcaccatctgcgagaccaaccccgtcaacgccatcgacgccgagatgcacgacctaaactgctcctacaacatctgcccctactgcgcgagccgcttaacctccgacggtctggcccggcacgtgatccagtgcccgaagcgcaaggagaagatcgaggagaccgagctgtacctcaacctggagcggatcccctgggtggtccgcaagctgctccaggtgagcgagagcacgggcgtggccctgaagcggtcctcatggctggtcatcctcctggtgctgctcaccgtgtccctgagccccgtccagtccgcccccatcagccacggggagaccgtggaggtgtaccagacccgggagggctacacgtccatctgcctgttcgtcttagggagcatcctgttcctggtgtcctgcctcatgaagggcctggtcgacagcgtgggcaactccttcttcccggggctgagcatctgcaagacctgctccatcggcagcatcaacgggttcgagatcgagtcccacaagtgctactgtagcctcttctgctgcccctactgccggcactgctccgcggacatcgagatccatcgcctgcacctgagcatctgcaagaagcggaagaccggctctaacgtgatgctcgccgtctgcaagcgcatgtgcttccgggccaccgtggaggtgagcaacaaggccctgctgatccgcaacatcatcaacacgaccttcgtcgtgtgcatcctcatcctggccgtgtgcgtcgtgagcacctccgcggtggagatggagaacctgcccgccgggacctgggagaaggaggaggacctgacgaacttctgccaccaggagtgccaggtgaccgagacggagtgcctctgcccctacgaagccctggtgctgcgcaagcccctattcctggacagcatcgtgaagggcatgaagaacctgctcaattccaccagcctggagacgtccctgagcatcgaggccccctggggcgccatcaacgtccagtccaccttcaagcccaccgtgagcgcggccaacatcgccctctcctggagctccgtggagcaccgggggaacaagatcctggtcagcggccgctccgagagcatcatgaaactggaggagcggaccgggatatcctgggacctcggcgtggaggacgccagcgagtccaagctgctgacggtgagcgtaatggacctcagccagatgtactcccccgtgttcgagtacttaagcggggaccgccaggtggaggagtggccgaaggcgacctgcaccggcgactgccccgagagatgcggctgcacctccagcacgtgccttcacaaggagtggccccactcccggaactggcggtgcaaccccacctggtgctggggcgtcgggaccgggtgcacgtgctgcggcctcgacgtgaaggacctgttcaccgattacatgttcgtgaagtggaaggtcgactacatcaagaccgaggccatcgtgtgcgtggagctgacctcccaggagcgccagtgttccctcatcgaggccggcacccggttcaacttagggccggtcaccatcacacttagcgagccccgcaacatccagcagaagctcccgcccgagatcgtgaccctgcacccgcggatcgaggagggcttcttcgatctgatgcacatccagaaggtgctctccgccagcaccgtctgcaaactgcagtcctgcacccacggggtgcccggcgacctgcagatctaccacatcgggaacctccttaagggcgacaaggtgaacggccacctgatccacaagatcgagccccatttcaacacgagctggatgtcatgggacgggtgcgacttagactactactgtaacatgggcgactggccgagctgctcctacaccggggtcacccagcacaaccacgctgccttcgtgaacatgctgaacatcgagacagactacacgaagaacttccacttccacagcaagcgcgtcaccgcgcacggcgatactccccagctggatctcaaggcccggcctacctacggggccggcgagatcaccgtcctggtggaggtggccgatatggagctgcacaccaagaagatcgagatctccggcctgaagttcgcgagcctgacctgcaccgggtgctacgcctgctccagcggcatctcctgcaaggtccgcatccacgtggacgagcccgacgagctgacggtgcacgtcaagtccgaggacccggacatcgtggccgccagctcctccctcatggcccggaagctggagttcgggacggattccacgttcaaggcgttcagcgccatgcccaagacctccctgtgcttctacatcgtggagcgcgagtactgtaagagctgctccaaggaggacacgcagaagtgcgtcaacaccaagctcgagcagccccagtctatcctgatcgagcacaagggcaccatcttcgggaagcagaacgacacgtgcaccgccaaggcctcctgctggctggagagcgtgaagtccttcttctacggcctcaagaacatgctgagcggcatcttcgggaacgtgttcatcggcgtcttcctgttcctcgcccccttcatcatgctgatcctgttcttcatgttcggctggcggatcctcttctgcttcaaatgttgccgccggacccgcggcctgttcaagtaccgccacctgaaggacgacgaggagatcgggtaccggaagatcatcgagcgcctcaacaacaagaagggcaagaacaagctgctggacggcgagcggctcgccgaccgcaagatcgccgagctgttttccaccaagacccacatcggg

SEQ ID NO: 15418 - RNA, 3495 nt, synthetic construct
  misc_feature 1..3495: note = derived and/or modified CDS sequence (opt11) from CCHVF(CCHVF SPU 130/89)__KJ682807.1__Gn-NSm-Gc
  source 1..3495: mol_type = other RNA
agcgaggagcccaactacgactgccttagtcgcacccagctcctgcggaccgaaaacgcggagatccacagcgacaactacggcgggccgggcgacaagatcacgatctgtaacggctccaccatcgtggaccagcgcctgggcagcgagttagggtgctacaccatcaaccgggtaaagtccttcaagctgtgcgagaacagcgccaccggcaagagctgcgagatcgactcgacccccgtgcgctgccggcaagggttctgcctgaagatcacccaggaggggcgcggccacgtgaagctctccagagggagcgaggtcgtgttggacgcgtgcgactctagctgcgagatcatgatccccaagggcaccggggacatcctggtggactgctccggcggccagcagcacttcctcaaggacaacctggtcgacctggggtgccccaacatcccgctcctggggaagatggccatctacatctgccgtatgagcaaccaccccaagacgacgatggccttcctgttctggttctccttcgggtacgtgatcacgtgcatcctctgcaaagttatcttctacctgttaattgtcgttggcaccctcggcaagaagttcaagcaataccgggagctaaagccccagacctgcaccatctgcgagaccaaccccgtgaacgccatcgacgccgagatgcacgaccttaactgcagctacaacatctgcccgtactgcgcgtcccgcctcaccagcgacgggctggcccggcacgtcatgcagtgccccaagcgtaaggagaagatcgaagagaccgagctgtacttgaatctggagcggattccctgggtggtgcgcaagctgctccaggtctccgagagcacgggcgtggccctgaagcggagctcctggctggtggtcctcctggtgctgctcaccgtgtcattatcccccgtacagagcgccccgatctcccacggcgagaccgtggaggtgtaccagacccgcgagggctacacgagcatctgcctgttcgtcctcgggtccatccttttcctggtgagctgcctcatgaagggcctggtcgactccgtgggcaacagcttcttccccgggctgtccatctgtaagacctgcagcatcggctccatcaatgggttcgagatcgagagccacaagtgctactgttccctcttctgctgcccgtactgccggcactgcagcgcggacatagagatccacaaactgcacctgtccatctgcaagaagcgaaaaaccggctcaaacgtaatgctcgccgtctgcaagcggatgtgcttccgcgccaccgtggaggtctccaacaaggccctgctgatccgaaatatcatcaacacgaccttcgtcgtgtgtattctaatcctggccgtgtgcgtcgtgagcaccagcgcggtggaaatggagaatctacccgccgggacctgggagaaggaggaggacctgacgaacttctgccaccaggagtgtcaggtcaccgaaaccgagtgcctgtgcccgtacgaggccctggtcctgcgcaagcccctctccctggacagcatcgtgaaaggcatgaagaacctgctcaactccaccagcctggagacgtccttaagcatcgaggccccctggggcgccatcaacgtccagtccaccttcaagcccaccgtgtctgcggccaacatcgccctgtcctggagctccgttgagcaccgcgggaacaagatcctggtcagcggccggagtgagagcatcatgaagctggaggagcgcaccgggatctcctgggacctgggcgtggaggacgcaagcgagtccaaacttctgacggtgagcgtgatggacctcagccagatgtactcaccggtgttcgagtacctgagtggggaccgccaagtggaggagtggcccaaggcgacctgcaccggcgactgccccgagcggtgtggctgcacctccagcacgtgcctgcacaaggagtggccccactcccggaattggcgctgtaacccgacctggtgctggggtgtcgggaccggatgtacgtgctgcggcctcgacgtaaaggacctgttcaccgactacatgttcgtgaagtggaaggtcgattatatcaagaccgaggccatcgtgtgcgtcgagctgaccagccaggagcggcagtgcagcctaatcgaggccggcacccgcttcaacctggggcccgtcaccattacgctgagcgagccccggaacatccagcagaagctgcccccggagattgtgaccctccacccccgcatcgaggaggggtttttcgacctgatgcacatccagaaggtcctcagcgccagcaccgtctgcaagctgcagtcctgcacccatggggtgcccggcgacctgcagatctaccacatcggaaacctgttgaagggcgacaaggtgaacggccacctgattcacaagatcgagccgcacttcaatacgagctggatgtcctgggacgggtgcgacctggactactactgcaacatgggcgattggcccagctgttcctacaccggggtcacccagcacaaccacgccgccttcgtgaacatgctgaacatcgagaccgactacacgaagaacttccacttccactctaagcgggtgaccgcgcacggcgacacgccccagctggacctcaaggcccgccccacctacggggccggcgagattaccgtcctggtggaggtggctgacatggagcttcacaccaagaaggtcgagatctccggcctcaagttcgcgagcctgacttgcaccgggtgctacgcctgctccagcggcatcagctgcaaggtgagaatccacgtggacgagccggacgagctgacggtccacgtgaagtccgaggaccccgacatcgtggccgccagctccagcctcatggcccgcaagctggagttcgggaccgattccaccttcaaggcgttcagcgccatgcccaagacctccctgtgcttctacatcgtagagcgggagcactgcaagagctgctccaaggaagacacgcagcgctgcgtgaacaccaagctcgagcagccccagtcaatactgatcgagcacaagggcaccatcatcgggaagcagaacgacacgtgcaccgccaaagcatcctgctggctggagagcattaagtccttcttctacggcctcaagaacatgttaagcggaatctttgggaacgtgttcatcggcgtcttcctgttcctcgccccgttcatcatcctgatcctgttcttcatgtttgggtggcggatcctcttctgcttcaagtgctgccggcggacccgcggtctgctgaaataccgccacctcaaagacgacgaagagatcgggtaccggaagatcatcgagcgccttaacaacaagaaaggcaagaacaaactactcgacggcgagcgactggcggaccgcaagatcgccgagttattttccaccaagacccacatcggg

SEQ ID NO: 15419 - RNA, 3495 nt, synthetic construct; identical to SEQ ID NO: 12133
  misc_feature 1..3495: note = derived and/or modified CDS sequence (opt11) from CCHVF(CCHVF SPU 497/88)__KJ682808.1__Gn-NSm-Gc
  source 1..3495: mol_type = other RNA

SEQ ID NO: 15420 - RNA, 3495 nt, synthetic construct
  misc_feature 1..3495: note = derived and/or modified CDS sequence (opt11) from CCHVF(CCHVF SPU 18/88)__KJ682810.1__Gn-NSm-Gc
  source 1..3495: mol_type = other RNA
agcgaggagtccaacgacgactgtctgagccgcacccagctcctgcggaccgagaacgcggagattcactccgacaactacggcgggcccggcgacaagataacaatatgcaacgggagcaccatcgtggaccaacgcctgggatccgagctcgggtgctacaccatcaaccgggtcaagagcttcaagctgtgcgagaacagtgccacgggcaagagctgcgagatcgactccacgccggtgcgatgccgccaggggttctgcctgaagatcacccaggaggggcgcggccacgtgaagttgagccggggctccgaggtcgtactagacgcgtgcgacagctcctgcgaaatcatgatccccaagggcaccggggacatcctggtggactgcagcggcggccagcagcacttcctcaaggacaacctggtcgacctggggtgccctaacatccccctcctgggcaagatggccatctacatctgccggatgtccaaccatccaaaaaccacaatggggtttctgttctggttcagcttcggctacgtaatcacgtgcatcctgtgcaaggtgatcttctatctgctgatcgtggtaggcaccctcgggaagaagttcaagcagtaccgggagcttaagccccagacctgcactatctgcgagacgaaccccgtgaacgctattgacgccgaaatgcacgacctgaattgctcctacaacatctgcccttactgcgccagccgcctcacctccgacggcctggcccggcacgtcatgcagtgcccaaagcgcaaggagaaaatagaggagaccgagctgtacttaaatctggagcggatcccctgggtagtgcgcaagctgctccaggtgtcggagagcacgggggtggccctgaagcggtccagctggctggtgattctcctggtcctgctcaccgtgtccctgtcgcccgtgcagtctgcccccatcagccacggcgagaccgtcgaggtatatcaaacccgcgaggggtatacctccatctgcctgttcgtgctcggcagcatcctgttcctggtctcctgtcttatgaagggcctggtggacagcgtggggaactcctttagcccgggcctgtcgatatgcaagacctgcagcatcgggtccatcaatggcttcgagatcgagagtcacaagtgctactgttccctcttctgctgtccctactgccgtcactgcagcgccgacatcgagatccacaagctgcatctgtccatctgcaagaaacgcaagacaggaagtaacgtgatgctagcagtgtgcaagcggatgtgcttcagagccaccgtcgaggtgagcaacaaggccctgctgatccggaacatcattaacaccaccttcgtagtctgcatcctcatccttgcggtctgcgtggtctccaccagcgccgtggagatggagaacctgcccgcagggacctgggagaaggaggaagacctgacgaacttctgccatcaagagtgccaggtgaccgagaccgagtgcctctgcccctacgaggccctggtcctgcgcaaacccttgttcctggactccatcgtgaagggcaagaagaaccttctcaacagcacgtccctggagacgagcctgtccatcgaggccccctggggcgccatcaacgtgcaaagcaccttcaagccaaccgtcagtgccgcgaacatcgccctcagctggtccagcgtggagcaccgcgggaacaagattctagtgtcggggcggtctgagtccataatgaagctggaggagcgcaccggcatttcatgggatctcggggtcgaggacgcctctgagagcaagctgctgacggtcagcgtgatggacctctcccaaatgtacagccccgtcttcgagtacctgtccggcgataggcaggtcgaggagtggccgaaggcgacctgcaccggcgactgccccgagcggtgcggttgcaccagctccacgtgcctgcacaaggagtggccccacagcaggaactggcgctgcaaccccacctggtgctggggcgtggggaccgggtgcacatgctgcggcctcgacgtcaaggatttattcaccgactacatgttcgtgaagtggaaggtggactacatcaagacggaggcgatagtctgcgtggagctgacctcccaagagcggcagtgcagcctaatcgaggccgggactcgcttcaatctgggcccggtgacaataaccctgtccgaaccccggaacatccagcagaagctcccgcccgagatcgtcaccctgcatccgcgtatcgaggaggggttcttcgacctgatgcacatccagaaggtgctcagcgcctccacggtgtgcaagctgcagagctgtacccacggggtacccggggacctgcaaatctaccacatcggaaacttgctgaagggcgacaaggtgaacgggcacctgatacacaagatcgagcctcacttcaacacgtcctggatgagctgggatggctgcgatctcgattactactgcaacatgggggactggccttcctgcagctacacgggcgtgacccagcacaaccacgccgccttcgtcaacatgctgaatatcgagaccgactacacgaagaacttccacttccactccaagcgggttactgctcacggggacacgcctcagttggacctcaaggcgcgcccaacatacggcgccggagaaatcaccgtgctggtcgaggtggccgacatggagctgcacacgaagaaaatagagatcagcgggctcaagttcgcctccctgacatgcaccggctgctacgcgtgctctagcgggatctcctgcaaagtgaggatccacgtcgacgaacccgacgaactgacggtgcacgtcaagagtgaggacccggatatcgtggccgcgtccagctccctcatggcccgcaaactcgagttcggcaccgacagcaccttcaaggccttctccgcgatgccgaagacgagcctgtgcttctacatagtggaacgggagtactgcaagtcctgcagcaaggaggacacgcagaagtgcgtgaacaccaaactcgagcaacctcagtccatccttatcgagcacaaagggaccatcatcggcaagcagaacgacacgtgcaccggcaaggcagggtgctggctggagagcatcaagtctttcttctacggcctcaagaacatgctgagcgggatattcggcaacgtcttcatcgggatcttcctgttcctcgcccccttcatcatgttgatcttgtttttcatgttcggatggcgcatcctcttctgttttaagtgctgtcgacggacccggggcctgttcaagtaccgccacctgaaggacgacgaggagatcgggtacagaaagatcatcgagcggctcaaaaacaaaaagggcaagaacaagctgctggacggggagcgcctcgctgaccgaaagatcgccgaactgttctccacaaagacccacatcggc

SEQ ID NO: 15421 - RNA, 3495 nt, synthetic construct
  misc_feature 1..3495: note = derived and/or modified CDS sequence (opt11) from CCHVF(CCHVF SPU 556/87)__KJ682811.1__Gn-NSm-Gc
  source 1..3495: mol_type = other RNA
tccgaggagtccgacggcgactgtatcagccgcacacagttactccgtaccgagacggccgagatccactccgacaactacgggggccccggggacaagatcaccatctgcaacggcagcaccatcgtggaccagcgcctggggtccgagctgggctgctacaccatcaaccgggtcaagagcttcaagctctgcgagaactccgccacgggcaagagctgcgagatcgactccacgccggtgaagtgccgccaggggttctgcctgaagatcacccaggagggccggggtcacgtgaagctgagccgcggctccgaaatcgtcctcgacgcgtgcgacagctcctgcgagatcatgatccccaaggggaccggcgacatcctggtggactgcagcggcgggcagcagcacttcctgaaggacaacctcatcgacctgggctgccccaacatccccctgctcgggcggatggccatctacatctgccgcatgtccaaccacccgaagacgaccatggccttcctgttctggttcagcttcggctacgtgatcacgtgcatcctgtgcaaggttatcttctacctcctgattgtggccggcaccgtggggaagaagttcaagcagtaccgggagctgcgcccccagacctgcaccatctgcgagaccacccccgtcaacgccatcgacgcggagatgcacgacctcaactgcagttacaacatctgcccctactgcgccagccggctgacgtccgacggcctggcccgccacgtgatgcagtgccccaagcggaaggagaagatcgaggagaccgagctctacctgaacctggagcgcatcccctgggtggtccggaagctcctccaggtgagcgagagcaccggggtggccctgaagcgctccagctggctgaccgtcttactggtgctcctgatcgtgtccctgagccccgtccagagcgcccccatcggccacgggaagacgatcgagacctaccaggcccgagagggctataccagcttctgcctcttcatcctgggctccatcctgttcatcgtgagctgcctcgtgaaggggctgatcgactccgtcggcaacagcttcttcccggggctgtccatctgcaagacctgcagcatcggctccgtgaacgggttcgagatcgagagtcacaagtgctactgctccctcttctgctgcccctactgccgccactgcagcgccgaccgggagatacacaagctgcacctgtccatctgcaagaagcgcaagacgggcagcaacgtgatgtccgcggtctgcaagcggatgtgcttccgtgccaccatcgaggtaagcaaccgcgcgctcctgatccggagcatcatcaataccaccttcgccgtctgcatcctgacgctcgccgtgtgcgtggtctccaccagcgccgtggaaatggagtccctgcccgccggcacctgggaacgcgaggaggacctgaccaacttctgccaccaggagtgccaggtgacggagaccgagtgcctctgcccctacgaggcgctggtcctgcggaagccgctgttcctcgacagcatcgtgaaggggaagaagaacctgctgaactccacctcactcgagacctccctgagcatcgaggccccctggggcgccatcaacgtgcagtccacgttcaagcccaccgtcagcgccgccaacatcgcgctgtcctggagctcggtggagcaccgcgggaacaagatcctcgtgagcggccggtccgagagcatcatgaagctggaggagcgaaccggcatttcctgggacctgggggttgaggacgccagcgagtcgaagctcctgaccgtgtccgtgatggacctgagccagatgtactcccccgtctttgagtacctctcaggcgaccgccaggtggaggagtggccgaaggcgacctgcacgggggactgccccgagcggtgcggctgcacctccagcacgtgcctgcataaagagtggccccactcccggaactggcgctgtaaccccacctggtgctggggcgtggggaccggctgcacgtgctgcgggctggacgtaaaggacctcttcaccgactacatgttcgtgaagtggaaggtggagtacatcaagacggaggccatagtctgcgtggagttgaccagccaggaacggcagtgctccctgatcgaggccggcacccgcttcaacctagggccggtgaccatcaccctgagcgagccccggaacatccagcagaagctgccgcccgagatcatcacgctccacccccgcattgaggagggcttcttcgacctgatgcacgtccagaaggttctgtccgccagcactgtctgcaaactccagtcctgcacccacggggtccccggcgacctgcaggtttaccacatcggcaacctgctgaagggggacaaggtgaacggacacttgatccataagatcgagccccacttcaacaccagctggatgtcctgggacgggtgcgacctggactactattgcaacatgggcgactggccgagctgcacgtacaccggggtcacccagcacaaccacgccgccttcgttaacctcctgaacatcgagaccgactacacgaagaacttccacttccactccaagcgggtgaccgcccacggcgacacgccccagctggaccttaaggcgcgccccacctacggcgccggggaggtcaccgtgttagtggaggtcgccgacatggagctgcacaccaagaaaatcgagatcagcggcctcaagttcgcctccctgagctgcaccgggtgctatgcctgcagctccggcatcagctgcaaggtgcggatccacgtggacgagcccgacgagctgaccgtccacgtcaagagcgaggacccggacattgtggcggccgggagctccctcatggcccgcaagctggagttcggcgccgacagcacgttcaaggccttctccgcgatgcccaagaccagcctgtgcttctacatcgtggagcgggagtactgcaaatcctgcagccgcgaggacacccagaagtgcgtgaacaccaagctcgaacgcccccagtccatcctgatcgagcacaagggcacgatcatcgggaagcagaacgacacgtgcaccgccaaggccagctgctggttggagtccgtcaagagctttttctacggcctcaagtccatgctgagcgggatcttcggcaacgtattcatcgggatctttctgttcatcgccccgttcgttctcctgatcctgttcttcatgttcggctggcggatcctgttctgcttcaagtgctgccgccggacccgcggcctgttcaagtaccggcacctgaaggacgacgaggagaccgggtaccgcaagatcatcgagcggctcaataacaagaagggcaagaacaagctgctggacggggagcgcctcgcggaccggaagatcgcggagctgttctccaccaagtctcacattggc

SEQ ID NO: 15422 - RNA, 3495 nt, synthetic construct
  misc_feature 1..3495: note = derived and/or modified CDS sequence (opt11) from CCHVF(CCHVF SPU 431/85)__KJ682812.1__Gn-NSm-Gc
  source 1..3495: mol_type = other RNA
agcgaggagtccgacggagactgcatcagccgcacccagctgctccggaccgaaacgaccgagatccactccgataactacgggggccccggggacaagatcaccatctgcaacggcagcaccatcgtggaccagcgcttagggtccgagctgggatgttacacgatcaaccgggtcaagagcttcaagctctgcgagaactccgccaccgggaaaagctgcgagatcgactccaccccggtgaagtgccgccaggggttctgcctgaagatcacccaggaaggccgggggcacgttaagctgagccgcggctccgagatcgtcctcgacgcctgcgacagcaactgcgagatcatgatccccaaggggacgggcgacatcctggtggactgctcaggcgggcagcagcactttctgaaggacaatctcatcgacctgggctgccccaacatcccgctgctcgggaagatggcgatctacatctgccggatgtcaaaccacccgaagaccaccatggccttcctgttctggttctccttcggctacgtgatcacgtgcatcctgtgcaaggtcatcttctacctcctgatcgtggccggtacagtggggaagaagttcaaacagtaccgcgagctgcggccccagacctgcaccatatgcgagaccatccccgtcaacgccatagacgccgagatgcacgacctcaactgcagctacaacatctgcccatattgcgcgtcccgcctgacgagtgacggcctggcccggcacgtgatgcagtgcccgaagcgcaaggagaaggtggaggagaccgagctctacctgaacctggagcggattccctgggtagtgagaaagctcctccaggtgtccgagagcacgggggtcgccctgaagcggagctcctggctcaccgtgcttctggtgctcctgatcgtcagcctgtcccccgtgcagagcgcccccatcggacacgggaagacgatcgagacctaccaggcgcgcgaggggtacacctccttctgcctcttcatcctgggcagcattctgtttgttgtctcgtgcctcgtgaaggggctgatcgacagcgtgggcaactccttcttcccggggctgagcatctgcaagacctgcagtatcggctccatcaacgggttcgagatcgagtcccacaagtgctactgcagcctcttctgttgtccctactgccggcactgccctgccgaccgcgagatccacaagctgcacctgtcaatctgcaagaagcggaagacgggcagcaacgtcatgctcgccgtctgcaaacgcatgtgcttccgggccaccatcgaagtctccaatcgcgccctgctgatccgcaacatcatcaataccaccttcgtggtgtgcatccttacgctggcggtctgcgtggtgagcacctccgccgtcgagatggagagcctacccgcaggcacctgggagaaggaggaggacctcaccaacttctgccaccaggagtgccaagtgaccgagaccgagtgcctgtgcccgtacgaggccctggtgctgcggaagcccctcttcctggacagcatcgtcaagggtcgcaagaacctgctcaactccaccagcttggagacctccctgagcatcgaggccccctggggcgcgatcaatgtgcagtccacgttcaaacccaccgtgagcgccgccaacatcgccctcagttggtcatccgtcgagcaccgggggaacaaaatactggtgagcggccgctccgagagcatcatgaagctggaggaacggaccggaatctcctgggacctcggggtggaggacgccagcgagtccaagctgctgaccgtcagcgtgatggacctctcccagatgtactcacctgtgttcgagtacctgagcggcgacaggcaggtcgaggagtggcccaaggcgacctgcacgggggactgcccagaacggtgtggctgcacctccagcacgtgcctgcataaggagtggccccactcccgcaactggcggtgcaaccctacctggtgctggggcgtggggaccggctgcacgtgctgtgggctcgacgtgaaggacctgttcaccgactacatgttcgtgaagtggaaggtggagtacatcaagaccgaggctatcgtgtgcgtcgagttaaccagccaggagcgccagtgctccctcatcgaagccggcaccaggttcaacctggggcccgtgaccattaccctgagcgagccccgcaatatccagcagaagctgcccccggagatcatcacgctgcacccccggatcgaggaaggctttttcgacctgatgcacgtgcaacgcgtcctctccgccagcaccgtgtgcaagctgcagtcctgcacccacggggtgcccggcgacctgcaggtctaccacatcggcaacctccttaagggcgacaaggtgaacggccacctgatccacaagatcgagccgcacttcaacaccagctggatgtcctgggacgggtgcgacctcgactactactgcaacatgggcgactggcccagctgtacgtacaccggtgtgacccagcataaccacgccgcgttcgtcaacctgctgaacatcgagaccgactacaccaagaacttccattttcactccaagcgtgttaccgcgcacggcgacacgccccagctcgatctgaaggcccgccccacctacggagccggggaagtgaccgtgctggtggaggtggcggacatggagctccacaccaagaagatcgagataagcggcctgaagttcgcctccctaacctgcaccgggtgctacgcctgcagctccggcatcagctgcaaggtcaaaatccacgtagacgagccggatgagctcacggtgcacgtcaagtccgaggaccccgacatcgtggcggccgggagctctctgatggcgcggaaacttgagttcggcgccgactccaccttcaaggccttcagcgccatgcctaagacctccctctgtttctacatcgtggagcgcgagtactgtaagagctgctcccgggaggacacccgcaagtgcgtcaacacgaagctcgaccgcccccagagcatcctcatcgagcacaagggcaccatcatcgggaagcagaacaacacgtgcaccgccaaagcgtcctgctggctcgagagcgtgaagtccttcttctacggcctgaagaacatgctgagcgggatcttcggcaacgttttcatcgggatcttcctcttcatcgccccgttcgtgctgctgatcctcttctttatgttcggctggcggatcctgttctgctttaagtgctgccgccggaccagaggcctcttcaagtaccggcatctcaaagacgacgaggagaccggttacagaaagattatcgagcggctgaacaacaaaaagggcaagaacaagctgctcgacggggagcgcctggccgaccggaagatcgccgaactgttctccaccaagagccacatcggc

SEQ ID NO: 15423 - RNA, 3495 nt, synthetic construct
  misc_feature 1..3495: note = derived and/or modified CDS sequence (opt11) from CCHVF(CCHVF SPU 48/90)__KJ682813.1__Gn-NSm-Gc
  source 1..3495: mol_type = other RNA
agcgaggagccaagcgacgactgcataagccgcacacagctcctacgaaccgaaacagccgaaatacacggcgacaattacggagggccaggtgacaaaatcaccatctgcaacggatcaactattgtagaccaacggctaggctcagaactaggatgctacacaatcaaccgtgtcaagtcattcaaactctgcgagaacagtgccaccggaaaatcctgcgtaatagactcggtaccagtcaaatgccgacaaggttactgcctccgcatcacccaagaaggccgcggccacgtaaaactatctcgtggttctgaagtggtcctggacgcctgtgacacgagttgcgaaataatgatccccaaagggacaggcgacatcctagtagactgcagcggcggtcaacagcacttcctcaaggacaacctcatcgacttaggctgccccaaaataccactccttggcaagatggccatatacatatgccgaatgagcaaccaccccaccaccaccatggcatttctcttctggtttagcttcggatacgtcataacctgcatactgtgtaaagcaatattctacctactcataattataggcaccctaggcaagcgcttccgacaataccgagaactcaaacctcaaacctgcacaatctgcgagaccactcctgtcaacgccatagacgccgaaatgcacgacctcaactgctcctataacatctgcccatactgcgcgtcgagactaaccagcgacggccttgcccgccacgtcacgcaatgccccaaaagaaaagaaaaagtcgaagaaaccgaattatacctcaacctcgaacgcatcccatgggtagtccgaaagctactacaggtcagtgaatccacaggtgtggctttgaaacgctcctcatggcttattgtactactcgtcctctttacggtgtccctctcccccgtccagtccgcccccatcggccacggcaaaaccatagaggcctacagagcccgcgaaggatacacatccatctgcttatttgtactagggtcaatactattcgttgtctcctgcctcatgaaacgcctcgtcgactctgtaggcaactcattcttccccggcctaagcatttgcaaaacctgcagcataagctccataaacggattcgagattgaaagccacaagtgctactgctccctattctgctgcccatactgccgtcactgcagcgcagacaaagaaatccacaagctccacctctccatctgcaagaagcgaaaaaccggctctaatgtaatgctcgcagtctgcaagcgaatgtgtttccgggctaccatggaagtcagcgaccgcgccctcttcatacgaagcatcataaacacaacattcgtcctctgcatccttatcctagcagtctgcgtagtctccactagcgcggtcgaaatggaaaacctccccgcgggcacctgggaacgcgaagaagacctaactaacttctgccaccaagagtgtcaggtcacagaaaccgaatgtctctgcccctacgaagccctagtactacggaaaccccttttccgcgacagcatagtaaagggcatgaaaaacctcctcaactccaccagcctggaaacaagcctctccatagaagccccttggggcgccatcaacgtacaatctacctataaaccaacagtctctaccgcaaacatagcactctcctggtcctccgtagagcatcgcggaaacaaaatcctcgtctccggccgaagcgaatcaatcatgaaactggaagagaggaccgggatatcctgggacctcggagttgaagacgcctcggaaagcaaacttctcacagtctcggtcatggacctttcgcaaatgtattcaccagtcttcgagtacctctccggtgacaggcaagttgaagaatggcccaaagcaacctgcaccggggactgccccgagcgctgcggctgcacatcgagcacatgccttcacaaagaatggcctcattcccggaactggcgatgtaacccaacttggtgttggggagtgggaacaggctgtacctgctgcggccttgacgtgaaagacctgttcacggactacatgttcgtcaagtggaaagtagagtacatcaaaacagaagcaatcgtctgcgtggaactcacctcgcaggaacggcaatgctccctaatagaagccggcacccgcttcaacctgggtcctgtcacaatcaccctcagcgaaccccgcaacatacagcagaaattacccccagagataatcactctccatcccaggatagaagaggggttcttcgaccttatgcacgtccaaaaggtattatctgcatcaaccgtgtgcaagctccaatcgtgcacacacggagtacccggcgatctccaagtataccacatagggaacctactcaaaggggacaaggtaaacggacacctcatccacaaaatcgaaccgcacttcaacacctcctggatgtcatgggacgggtgtgatctggactactactgcaacatgggagactggccgtcgtgcacctacaccggcgtaacccagcacaacagagccagcttcgtaaatctattaaacatcgagactgactataccaaaaacttccattttcacagtaaacgagttaccgcccatggcgacaccccacaactcgacctgaaagcacgtccaacgtatggagctggtgagatcaccgtcctagtcgaagttgcagatatggagctacacacaaagaaaatcgagattagcggcctcaaattcgcctccctgacctgcaccgggtgctacgcatgcagtagcggcataagctgcaaagtccgcatacacgtagatgaacccgacgaactcaccgttcatgtaaaatcagacgaccccgacgttgtcgccgcgtcgtcctccctaatggcccgaaagctcgagttcggcacggactccacgttcaaagcgttctcagctatgccgaaaacatccctatgcttctacatcgttgaaaaagagtactgcaaaagctgtagcgaagaagacaccaagaaatgcgtgaacacaaaactagagcaaccgcaatcgatcctgatcgagcacaaaggcaccattattggaaagcagaactcaacgtgcactgcgaaagtctcctgttggctcgaaagcgctaaatccttcttctacgggctcaaagacatgctctcagggatcttcggcaacgtcttcatcggaatcttcctattcctcgcgccctttatattgctaatactcttcttcatgttcggctggcgaatactactctgcttcaaatgctgtcgccgaacccggggactattcaaataccgacacctcaaggacgacgaagaaaccggatatcgtcgaatcattgaacgacttaacaataagaaagggaaaaacaagctacttgacggtgaacgactagccgaccggcgtatagccgaactcttcagcaccaaaacccatatcgga

SEQ ID NO: 15424 - RNA, 3495 nt, synthetic construct
  misc_feature 1..3495: note = derived and/or modified CDS sequence (opt11) from CCHVF(CCHVF SPU 187/90)__KJ682814.1__Gn-NSm-Gc
  source 1..3495: mol_type = other RNA
agcgaggaaccctccgacgattgtatcagccgcactcagctcctccggaccgagacagccgagatccacggcgacaactacgggggcccgggggataagatcaccatctgcaacggctcaaccatagtggatcagcgcctggggagtgaactgggctgctacaccatcaaccgggtcaagtccttcaagctctgcgagaacagcgccacggggaagtcctgcgagatcgacagcgttcccgtgaagtgccgccaggggtactgcctgcggatcactcaggagggccgcgggcacgtcaagctgtcccggggaagcgaggtggtgctagacgcgtgcgacacctcctgcgagatcatgatccccaaggggaccggcgacatcctggtcgactgcagtggcgggcagcagcactttctgaaggacaacctcatcgacctagggtgcccaaagatcccgctgctcggcaagatggccatctacatctgccgcatgtccaatcatcccaagacgaccatggccttcctgttctggttctccttcggctacgtgatcacgtgtattctgtgcaaggccatcttctacctcctaattatcatcggcaccctgggaaagcggttcaagcagtaccgcgagctcaagccccagacctgcacaatctgtgagaccacccccgtgaacgccatcgacgcggagatgcacgatctgaactgctcctacaacatctgcccttactgcgcaagccggctgacgtccgacggcctcgcccgccacgtcacccagtgccccaagcggaaggagaaggtggaggagaccgagttatatctgaacctcgagaggataccctgggtggtccggaagctgctccaggtgagcgagtccaccggggtggccctcaagagaagctcgtggctgatcgtcctgctagtactgttcacggtgtccctgtctccggtccagtccgcgcctattggccacgggaagaccatcgaagcctaccgggcccgcgagggctacacaagcatctgcctcttcgtgctaggctccatcctgttcgtggtcagctgcctcatgaaggggctggtagactccgtgggcaacagcttcttccccgggctgtccatatgcaagacctgcagcatcggctccataaacgggttcgagattgaatctcacaagtgctactgttccctcttctgctgcccatactgccggcactgcagcgccgacaaggagatccacaagctgcacttgtccatctgcaagaagcgcaagacgggcagcaacgtcatgctcgccgtgtgcaagcgtatgtgcttccgcgcgaccatggaggtctccaacagagccctgttcattcggagcatcatcaacaccaccttcgtgctgtgcatcctcatactggccgtgtgcgtcgtatccacgagcgcagtcgagatggagaacctgcccgccggcacctgggagcgcgaggaggacctcaccaacttctgccaccaggagtgccaggtcaccgagacggagtgcctgtgcccgtacgaggcgctggtactgcgccgccccctcttcctggacagcatcgtaaaggggatgaagaacctgctcaactccaccagcctggagacctccttaagcatcgaggccccctggggcgccatcaacgtccagtccacctacaagcccacggtaagcaccgccaacatcgccctctcatggagctccgtggagcaccgggggaacaaaatcctggttagcggccgctccgaaagcattatgaagctggaggagcggacggggatctcctgggacctcggagtggaggacgcgagcgagtccaagctgctgactgtgtcagtcatggacctcagccagatgtactcgccggtattcgagtacctgagcggcgaccgccaggtggaggagtggcccaaggcgacctgcactggggactgccccgagcggtgcggctgcacgtccagcacgtgcctgcacaaggaatggccccactcccgcaactggcggtgcaacccgacctggtgctggggtgtcgggaccggctgcacgtgctgcgggctcgacgtgaaggacctgttcaccgactatatgttcgtgaagtggaaggtcgaatacattaagaccgaggccatcgtgtgcgtggagctgacaagccaggagcgccagtgttccctcatcgaagccggcacccggttcaacctgggtcccgtcaccatcaccctgagcgagccacgcaatatccagcagaagttgcccccggagatcatcacgctgcacccccggatcgaggaaggcttcttcgacctgatgcacgtgcagaaggtgctctccgcctcaaccgtctgcaaacttcagtcctgcacccacggggtgcccggcgacctccaagtataccacatcggcaacctcctgaagggggataaggtcaacggccacctgatccacaagatcgagccgcacttcaacaccagctggatgtcctgggacggttgcgacctcgactactactgcaacatgggcgactggcccagctgcacgtacaccggggtgacccaacacaaccacgcctcctttgtgaacctgctgaacatcgagaccgactacaccaagaacttccacttccacagcaagcgcgttaccgcccacggcgacacgccccagctcgacttgaaggcccggcccacctacggcgccggagaaatcaccgtgctggtggaggtcgcggacatggagctccacacaaagaagatcgagatctccggcctgaagttcgccagcctaacctgcaccgggtgctacgcctgctccagcggcatatcctgcaaggtgcgcatccacgtcgacgagccggacgagctcacggtccatgtcaagtcagacgaccccgacgtagtggccgccagctctagcctgatggcgcggaagctggagttcgggaccgactccattttcaaggccttcagcgccatgcccaagacctccctctgcttctacatcgtggagcgcgagcactgcaagagctgctccgaggaggacaccaagaagtgcgtgaacacgaagctggagcagccgcagagcatcctgatcgagcacaagggcaccatcatcggcaagcagaactccacgtgcaccgccaagaccagttgttggctcgagtccgtcaagagcttcttctacgggctgaagaatatgctctccggcatctttgggaacgtgttcatcggcatcttcctgttcctggccccgttcatcctgctcatcctgttcttcatgttcgggtggcgcatcctgttctgcttcaaatgctgccggcgcacacggggcctcttcaagtaccgccatttaaaggacgacgaggaaaccggctaccggcgcatcatcgagcggctgaacaacaagaaggggaagaacaagctcctggacggcgagcgcctggcggaccggcgcatcgcggagctgttcagcaccaagacccacatcggg

SEQ ID NO: 15425 - RNA, 3495 nt, synthetic construct
  misc_feature 1..3495: note = derived and/or modified CDS sequence (opt11) from CCHVF(CCHVF Haskovo-V46/13)__KR092379.1__Gn-NSm-Gc
  source 1..3495: mol_type = other RNA
agcgaggaactgggcgatgactgcatctcccgcacccagctcctgcggaccgagacggccgagatccacgacgacaactacggtggccccggggacaagatcaccatctgcaacggcagcaccatcgtagaccagcgcctggggtccgagctcggctgctataccatcaaccggggcaagagcttcaagctgtgcgaaaactccgcaacggggaagacctgcgagatcgacagcaccccggtcaagtgccgccagggcttctgcctgaaaatcacccaggaggggcggggccatgtgaagctctcccgcgggagcgaggtggtcctggacgcctgcgactccagctgcgaggtgatgatacccaagggcacgggcgacatcctggtggactgctccgggggccagcagcacttcctcaaggacaacctgattgacctggggtgcccccacatccccctcctgggcaagatggccatctacatctgccggatgagcaaccacccgcgcaccaccatggccttcctgttctggttctccttcggctacgtcatcacgtgcatcttctgcaaggccctattctacagcctgattattatcgggaccctgggcaagaagatcaagcagtaccgggagctcaagccccagacctgcaccatctgcgagaccacgcccgtaaacgccatcgacgcggagatgcacgacctgaactgctcctacaacatctgcccctactgcgccagccgcctgacctccgacgggctcgcccggcacgtgactcaatgcccgaagcgcaaggagaaggtcgaggagaccgagctgtacctgaacctcgagcggatcccctggatcgtgcgcaagctgttacaggtgagcgagtccacgggcgtcgccctcaagaggagcagctggctgatcgtgctgctcgtgctgctgcccgtctccctcagccccgtgcagtccgcgccggtgggacacggaaagaccatcgagacctaccagacccgcgagggctttacgagcatctgcctgttcatgctggggtccatcctcttcatcgtcagctgcctggtgaagggcctggtggactccgtgggggacagcttcttccccggcctctccgtgtgcaagacctgcagcatcggaagtatcaacggattcgagatcgagagccacaagtgctattgctccctgttctgctgcccctactgtcggcactgtagcgccgaccgcgagatccaccagctgcacctgtccatctgcaagaagcggaagaccggcagcaacgtgatgctggccgtctgcaaacgcatgtgcttccgcgccaccatcgaggcctcccgccgcgcgctgctcatccggagcatcatcaacacgaccttcgccatgtgcatcctgaccctgaccatctgcgtggtctcaacgagcgccgtggagatggagaacctccccgccgggacctgggagcgcgaggaggacctgaccaacttctgccaccaggagtgccaggtgaccgaaacggagtgcctgtgcccgtacgaggccctggtcctccggaagcccctgttcctggacagcatcgtcaaaggcatgaagaacctccttaactccaccagcctggagacctccctcagcatcgaggcgccctggggcgccatcaacgtgcagtccaccttcaagcccactgtcagcacggccaacatcgccctgtcctggagctccgtggagcacagagggaacaaaatcctggtgaccgggcggagcgagtccatcatgaagctcgaggagcgcaccggggtcagctgggacctgggcgtggaggacgcctccgagagcaagctgctcaccgtgtccatcatggacttatcccagatgtactcccccgtcttcgagtacctgtctggggaccgccaggttgaggagtggcccaaggcgacgtgcaccggcgactgccccgagcggtgcgggtgcaccagctccacgtgcttgcacaaggagtggccccacagccggaactggcgctgcaacccgacctggtgctggggcgtgggcaccggatgcacgtgctgcggcgtcgacgtgaaggacctgttcaccgaccacatgttcgtgaagtggaaggtcgagtacatcaagaccgaggccatcgtgtgcgtggagctgacctcccaggagcggcagtgtagcctcatcgaggccgggacccggttcaacctgggccccgtcaccatcacgctgtccgagccccggaacatccagcagaagctgcccccggagatcatcaccctgcaccccaagatcgaggaggggttcttcgacctgatgcacgtgcagaaggtgctcagcgcctccaccgtctgcaagctgcagtcctgcacgcacggcatccccggcgacctccaggtctaccacatcgggaatctgctaaagggcgaccgcgtgaacgggcacctcatccacaagatcgagccgcacttcaacacgtcctggatgagctgggacggctgcgacctcgactactactgcaacatgggggattggccctcctgcacctacaccggcgtcacccagcacaaccacgccgcgttcgtgaacctgctgaacatcgaaacggactacacgaagaccttccacttccacagcaagcgggtgaccgctcacggcgatacgccccagctcgacctgaaggcccgccccacctacggggccggagagatcaccgttctggtcgaggtggcggacatggagctccacaccaagaaggtcgagatctccgggctgaaattcgccagcctgacgtgcaccggctgctacgcctgctccagcgggatatcctgcaaggtgcggatccacgtggacgagccggacgagctgaccgtccacgtcaagagctccgaccccgacgtggttgccgccggcaccagcctgatggcgcgcaagctcgagttcggcacggacagcacctttaaggccttctccgccatgcccaagaccagcctctgcttctacatcgtggagcgggagtactgcaagtcctgtagcgaggacgacacccagaagtgcgtggacaccaagctggaacagccccagtccatcctgatcgagcacaaggggacgatcatcggcaagcagaacgacacgtgcaccgcccgcgctagctgctggctcgagtccgtcaagagcttcttctacgggctgaagaacatgctgggctccgtgttcggcaacttcctcatcggcatcctgctgttcctcgcgccattcgtgctgctggtgcttttcttcatgttcggctggaagatcctgttttgcttcaagtgctgccgccggacccgcgggctattcaagtaccggcacctcaaggacgacgaggagacaggctaccgccggatcatagagcgcctgaacagcaagaaggggaagaaccggctcctcgacggcgagcgcctggccgaccggaagatcgccgagcttttctccaccaagacccacatcggc

SEQ ID NO: 15426 - RNA, 3495 nt, synthetic construct
  misc_feature 1..3495: note = derived and/or modified CDS sequence (opt11) from CCHVF(CCHVF 24-R-2012)__KR814856.1__Gn-NSm-Gc
  source 1..3495: mol_type = other RNA
tcagaggaacccggcgacgactgcatctctcgcacccaactgctcaggaccgagacggcggagattcacgatgacaactacgggggcccgggggacaaaatcaccatatgcaacggcagcaccatcgtggatcagcgcctggggtccgagctgggctgctacaccatcaaccgggtcaagagcttcaagttgtgcgagaactccgccacgggcaagacctgcgagatcgatagcacccccgtgaagtgccgccaggggttctgcctgaagatcacccaggagggccgggggcacgtgaagctctcccgcggcagcgaggtcgtgctagacgcgtgcgacacgtcctgtgaggtgatgatccccaaagggacaggcgacatcctggtcgactgcagtggcgggcagcaacacttcctgaaggacaacctcatcgacctggggtgcccccacatcccgctattgggaaagatggccatctacatctgccggatgtccaaccacccccgcacgaccatggccttcctgttctggttcagcttcggctacgtgatcacatgcatcttctgcaaggccctgttctactcgctcatcatcatcggcaccctggggaagaagatcaagcagtatcgggaactgaagccccagacctgcaccatctgcgagacggcccccgtgaacgcgatcgacgcggagatgcacgacctcaattgcagctacaatatctgtccgtactgcgcctcccgcctgaccagcgacggcctggcacggcatgtcccccagtgccccaagcgcaaagagaaggtggaggagaccgagctctacctgaacctcgagcggatcccctggatcgtgcgtaagctcctgcaggtctccgagagcaccggggtggccctgaaacggtccagctggctcatcgtgttactcgtcctcctgacggtgagcctgtccccggtgcaaagcgcccccgtcggccacgggaagaccatcgagacctaccagacccgcgaaggcttcacgagtgtctgcctctttatgctgggcagcatcctgttcttagtgtcctgcctagtcaaggggctggtggacagcgtgtcagacagcttcttccccggcttatcagtctgcaagacctgcagcattgggtccatcaacggcttcgagatcgagagccacaagtgctactgctcactgttctgctgtccctactgtcggcactgtagcgccgacagggagatccaccagctgcacctctcgatctgcaagaagcggaagatggggagcaacgtgatgctggccgtctgcaagcgcatgtgcttccgggctaccatcgaggcgtcccgacgcgccctgctcatccggagcataatcaacaccacgttcgtgatctgcatcctgacactgacgatttgtgtagtctccaccagcgccgtggagatggagaacctgccgtcgggcacgtgggagcgcgaggaggacctgaccaacttctgccaccaggagtgccaagtaaccgagaccgagtgcctgtgcccctacgaggccttagtcctccggaaaccactgttcctggactccatagtgaagggcatgaagaacctcctgaacagcacgtctctggagaccagcctctcgatcgaggccccctggggcgcgatcaacgtgcagagcaccttcaagccgaccgtttccaccgccaacatcgccctgagctggtccagtgtggagcaccgcgggaacaagatcctggtgacggggagatccgagagcatcatgaagctcgaggagcgcacaggagtatcctgggacctgggtgtggaggacgccagcgagtccaagctgcttacagtgtccatcatggacctgtcccagatgtacagccccgtcttcgaatacctgagcggcgaccgccaggtggaagagtggcccaaggcgacctgtacgggcgactgccccgagcggtgtgggtgcacctcctccacgtgcctccacaaggaatggccgcactcccggaactggcgctgcaaccccacctggtgctggggcgttgggaccggctgcacgtgctgcggcgtcgacgtgaaggacctgttcaccgaccacatgttcgtaaagtggaaggtcgagtacatcaagacagaagccatcgtgtgcgtggagctgacctcacaggagcggcagtgctccctcattgaggcgggaacacgcttcaacctgggcccggtaaccatcaccctgtctgagccccggaacatccagcagaagctaccgcccgagatcatcacgctgcaccccaaggtggaggaggggttctttgacctaatgcacgtgcaaaaggtcctctccgcaagcacagtgtgcaagctgcaatcctgcactcacggtatcccgggggacctccaggtctaccacattggcaatctcctgaagggcgaccgcgtcaacggacatctgatccacaagatcgaaccccacttcaacacctcttggatgtcctgggacggctgcgacctcgactactattgcaacatgggggactggccaagctgcacgtacactggcgtgacccagcacaaccacgcggccttcgtaaacctgctcaacatcgagaccgactacacgaagaccttccacttccactcaaaacgggtcaccgcacacggggatacgccccagctcgacctgaaggcccgcccgacctacggcgccggcgagatcaccgtgctggtggaggtcgccgacatggaactacacaccaagaaggtggaaatcagcgggctgaagttcgcgtcgctggcctgcaccggctgctacgcctgcagctccgggatcagctgcaaggtgcggatccacgtcgacgagcccgacgagctcacggtgcatgtgaagtccaacgaccccgatgtggtggccgcatcgaccagcctgatggcacgcaagctggagtttggcaccgactccaccttcaaggcgttcagcgccatgcccaagacgagcctctgcttctacatcgtggagagagagtactgcaagagctgctccgaagaggacactcagaaatgcgtcgataccaagctcgagcaaccgcagagcatccttatcgagcacaaggggactataatcggcaagcagaacgacacgtgcacagcgaaggcctcctgttggctcgagtccgtgaagtccttcttctatggcctgaagaacatgctcgggagcgtgttcggcaatttcttcatcgggatcctcctgttcctggcacccttcgtcctcctggtgctgttcttcatgtttggctggaagatcctgttctgctttaagtgctgccgccgcacccgggggctgctgaagtaccgcctcctaaaggacgacgaggagaccggctaccgcagaatcatcgagcgcctgaacaacaaaaagggcaagaacagactgctggacggcgagcggcttgccgaccgcaagatcgccgagctgttctccacaaagacgcacatcggc

SEQ ID NO: 15427 - RNA, 3495 nt, synthetic construct
  misc_feature 1..3495: note = derived and/or modified CDS sequence (opt11) from CCHVF(CCHVF 36-ST-2014)__KR814857.1__Gn-NSm-Gc
  source 1..3495: mol_type = other RNA
agcgaggagcccggcgacgactgcatttcccgcacccagctgttaaagaccgagacggccgagatccacgacgataactacggtggtccgggggacaagatcacgatctgcaacggctcaaccatcgtagaccaacggctggggagcgagctcggctgctacaccatcaatcgcgtcaagtccttcaaactctgcgagaactccgccacgggcaagacctgcgagatcgacagcacacctgtgaagtgtcggcaggggttctgcctcaagattacccaggagggcagagggcacgtgaaactttcccggggcagcgaggtcgtgctcgacgcgtgtgactctagctgcgagatcatgatccctaaggggacgggggacatcctagtggactgctccggcgggcagcaacacttcctgaaggacaacctcatcgaccttggctgccctcacatccctctgctcggcaagatggccatctacatctgccgcatgagcaaccatccccggacgaccatggccttcctgttctggttctccttcggctacgtcattacctgcatcttctgcaaggccctgttttacagcctcatcatcatcggcacgctagggaagaagatcaagcagtaccgcgagctgaagccccagacgtgcacaatctgcgagacggcccccgtgaacgccatcgacgccgagatgcacgatctcaactgctcctacaacatctgtccgtattgtgccagccggttaacgtccgacggcctggctcgccacgtgacccagtgccccaagcggaaggagaaggtcgaggagaccgagctctacttaaacctggagcgcatcccgtggatcgtgcgcaagctccttcaggtgagcgagagtacaggggtcgcgctgaagcgttcgagctggctcatcgtgctgctggtcctgctgacggtctccctgagccccgtgcagtccgccccggtgggccacgggaagaccatcgagacataccagacccgggagggcttcacgaacatctgccttttcatgctgggcagcatcctgttcattgtctcctgccttgtgaaagggctagtggacagcgtctccgatagcttcttcccgggcctgtccgtgtgcaagacctgctccattggttccatcaacggcttcgagatcgagagccacaaatgctactgctccctcttctgctgcccctactgtcgccactgcagcgccgaccgggagatccaccagctgcacctggggatatgcaagaagcgcaagaccggttccaacgtaatgctcgccgtctgcaagagaatgtgcttcaaggccactatcgaggcaagccgccgggccctgttgatccgctccatcatcaacacgaccttcgtgatctgcattctcacactggccatctgcgtcgtgagcacctccgccgtcgagatggaaaacctgcccgcgggcacgtgggagcgcgaggaggacctcacaaacttttgccaccaggagtgccaggtatcagagacagagtgcctgtgcccgtacgaggctctggtgctgcgtaagcccctcttcttggacagcatcgtgaaaggcatgaagaacctgctcaactccaccagcctggagacgagtctgagcatcgaggcgccctggggcgccatcaacgtccagtccacgttcaagcccaccgttagcaccgctaacatcgccctcagctggagctccgtggagcaccgcgggaacaagatcctggtgaccggccggtcagagagtatcatgaagctggaggagcgcacgggggttagctgggacctaggcgtggaggacgcctcggagagcaagctgctgactgtctccataatggacctctcccagatgtactccccggtgttcgagtacctaagcggagaccgtcaggtggaagagtggccaaaggcgacctgcacaggggactgccccgagcgctgcggctgcacgtcatctacctgcctgcacaaggagtggccccactcccggaactggcgctgcaacccgacctggtgttggggtgtcgggactggctgcacgtgctgtggcgtggacgtgaaggacctcttcaccgaccatatgttcatcaagtggaaggtcgagtatatcaagaccgaggccatcgtgtgcgtcgagttaacatcgcaggagcggcagtgcagcctgatcgaggccggcacgcgcttcaacttagggcccgtcaccatcacactatccgagccccggaacatccagcagaagctgcccccggagatcatcaccctccaccccaagatcgaagagggctttttcgacctgatgcacgtgcagaaggtgctgagcgcctccacggtctgcaaacttcaatcgtgcacccacgggatccccggcgacctgcagatctaccacatcggaaacctgctcaagggggaccgccttaacggccacctgatccacaagatcgagccgcacttcaacacctcctggatgtcgtgggacgggtgcgatctcgattactactgtaacatgggcgattggccctcctgcacctacacgggggtgacccagcacaaccacgccgcctttgtaaacctgctgaacatcgagaccgattacaccaagacgttccacttccacagtaagcgagtcacggcccacggcgacacgccccagttagacctgaaggcgcgccccacctacggcgcgggggagatcaccgtgctggtggaagtcgcagacatggagctccacaccaagaaggttgagatctccgggctgaagtttgctagcctggcctgcaccgggtgttacgcctgctccagcggcatcagttgcaaggtgcggatccacgtcgacgaacctgacgagctcaccgtgcacgtaaagagctccgaccccgacgtcgtggcggccagcacgagcctgatggcccgcaaactggagttcggaaccgactctaccttcaaggccttctcagccatgcccaagacctccctctgcttctacatcgtggaacgggagtactgcaagagctgctccgaggacgacacgaagaagtgcgtcgacaccaagctggaccagccccagagcatcctgatcgagcacaagggcaccatcatcggaaagcagaatgatacctgcactgcgaaggcctcctgctggctcgagagcgtgaagtccttcttttacgggctgaagaatatgctgggcagcgtgttcggcaacttcttcgtcggaatactcctgttcctggccccgttcgtcctcctggtgctgtttttcatgtgcgggtggaaattcctcttctgctttaagtgctgccgccggacgcgaggcctgttcaagtaccgccacctgaaggacgacgaggagaccggttaccggcgcatcatagagcggctaaactccaagaagggaaagaaccgcctgctggacggcgaacggctcgccgaccgcaaaatcgccgagctgttcagcaccaagtcccacatcggc

SEQ ID NO: 15428 - RNA, 3495 nt, synthetic construct
  misc_feature 1..3495: note = derived and/or modified CDS sequence (opt11) from CCHVF(CCHVF 37-R-2013)__KR814858.1__Gn-NSm-Gc
  source 1..3495: mol_type = other RNA
agcgaggaacccggcgacgactgcatttcccgcacccagctgctccgcaccgagacggccgagatccacgacgacaactacgggggcccgggggacaagatcaccatctgcaacggcagcaccatcgtggaccagcgcctggggtccgagctaggctgctacactatcaaccgggtcaagagcttcaagctctgcgagaactccgccacgggcaagacgtgcgagatcgatagcacccccgtgaagtgccgccaggggttctgcctgaagatcacccaggaaggccgggggcacgtgaagctgtcccgcggcagcgaggtcgtgctcgacgcgtgcgacacgtcctgcgaggtgatgatccccaaggggacgggcgacatcctggtcgactgcagcggcgggcagcagcacttcctgaaggacaacctcatcgacttaggctgcccccacatcccgctgctcgggaagatggccatctacatctgccggatgtccaaccacccccgcaccaccatggccttcctgttctggttcagcttcggctacgtgatcacgtgcatcttctgcaaggccctgttctactccctcatcatcatcggcaccctggggaagaagatcaagcagtaccgggagctgaaaccccagacctgcaccatctgcgagacggcccccgtgaacgcgatcgacgccgagatgcacgacctgaactgcagctacaacatctgcccgtattgcgcctcccgcctgaccagcgacggcctggcccggcacgtcccccagtgccccaagcgcaaggagaaggtggaggagaccgagctctacctgaacttagagcggatcccctggatcgtgcgcaagctcctccaggtgtccgagagcaccggggtggcgctgaagcggtccagctggctgatcgtgctgctggtcctcctgaccgtgagcctgtccccggtgcagagcgcccccgtcggccacgggaagaccatcgagacctaccagacccgcgagggcttcacgtccgtgtgcctcttcatgctgggcagcatcctgttcctcgtgtcctgcctggtcaagggactggtggacagcgtgtccgacagcttcttccccggcctctccgtctgcaagacctgcagcatcgggtccatcaacggcttcgagatcgagagccacaagtgttactgctccctgttctgctgcccctactgccgacactgcagcgccgaccgcgagatccaccagctgcacctctccatctgcaagaagcggaagatggggagcaatgtgatgctggccgtctgcaagcgcatgtgcttccgggccaccatcgaggcgtcacgccgcgccttactcatccggagcataatcaataccacgtttgtgatctgcatactaaccctgaccatctgcgtggtctccaccagcgccgtggagatggagaatctcccgagcggcacgtgggagcgcgaggaggacctgaccaacttctgccaccaggagtgccaggtgaccgagaccgagtgcctgtgcccctacgaggccctggtcctccggaagcccctcttcctggactccatcgtgaagggcatgaagaacctcctgaactcaacgtccctggagaccagcctctccatcgaggccccctggggcgcgatcaatgtgcagagcaccttcaagccgaccgtctccaccgccaacatcgccctgagctggtccagcgtggagcaccgcgggaacaagatcctggtgacggggcgctccgagagcatcatgaagctcgaggagcgcaccggcgtctcctgggacctgggggtggacgacgccagcgagtccaagctgctcaccgtgagcatcatggacctgtcccagatgtacagccccgtcttcgagtacctgagcggcgatcgccaggtggaggagtggcccaaggcgacctgcacgggcgactgccccgagcggtgcgggtgcacctccagcacgtgcctccacaaggagtggccgcactcccggaactggcgctgcaaccccacctggtgctggggcgtcgggaccggctgtacctgctgcggcgtcgacgtgaaggacctgttcaccgaccacatgttcgtgaagtggaaggtcgagtacatcaagaccgaggccatcgtgtgcgtcgagctgaccagccaggagcggcagtgctccctcatcgaggccgggacccgcttcaacctgggccccgtcaccatcactctgagcgagccccggaacatccagcagaagctcccgcctgagatcatcacgctgcaccccaaggtggaggaggggttcttcgacctgatgcacgtgcaaaaggtcctctccgcctcaaccgtgtgcaagttgcagtcctgcacccacggcatcccgggggacctccaggtgtaccacatcggcaatctcctgaagggcgaccgcgtcaacgggcacctgatccacaagatcgagccccacttcaacaccagctggatgtcctgggacggctgcgacctcgactactactgcaacatgggggactggcccagctgcacgtatactggcgtgacccagcacaaccatgccgccttcgtgaacctgctgaacatcgagaccgactacacgaaaaccttccacttccactccaagcgggtcaccgcgcacggggacacgccccagctcgacctgaaagcccgcccgacctacggcgccggcgaaatcaccgtgctggtggaggtcgccgacatggagctccacaccaagaaggtggagatcagcgggctgaagttcgcgtccctagcctgcaccggctgctacgcctgcagctccgggatcagctgcaaagtgcggatccacgtcgatgagcccgacgagctcaccgtgcacgtgaagtccaacgaccccgacgtcgtggccgccagcacctcgctgatggcgcgcaagctggagttcggtaccgactccaccttcaaagccttctcagccatgcccaagacgagtctctgcttctatatcgtggagcgggagtactgcaagagctgctccgaagaggacacccaaaagtgcgtcgacaccaagctggagcagccgcagagcatcctgatcgagcacaaggggaccatcatcggcaagcagaacgtgacctgcacggccaaggcctcttgctggctcgagagcgtgaagtccttcttctacggcctgaagaacatgctggggagcgtcttcggcaactttttcatcgggatcctcctgttcctggcgcccttcgtcctactggtgctgttctttatgttcggctggaaaatcctcttctgcttcaagtgctgccgccgcacccgggggctgctgaagtaccgactcctcaaggatgacgaggagaccggctaccggcgcatcatcgagcggctgaacaacaagaagggcaagaaccgcctcctggacggggagcggctggccgacaggaagatcgccgagctgttctccaccaagacgcacatcggc

SEQ ID NO: 15429 - RNA, 3495 nt, synthetic construct
  misc_feature 1..3495: note = derived and/or modified CDS sequence (opt11) from CCHVF(CCHVF 44-ST-2010)__KR814859.1__Gn-NSm-Gc
  source 1..3495: mol_type = other RNA
agcgaggagcccggcgacgactgcatctcccgcacccaactgctcaagaccgagacggcggagattcacgacgataactacggcggcccgggggacaaaatcaccatctgcaacggcagcaccatcgtggaccagcggctggggtccgaactgggctgctacactataaaccgcgtcaagagcttcaagctctgcgagaactccgccacgggaaagacctgcgagatagacagcacccccgtgaagtgccggcaggggttctgtctgaagatcacccaggagggccgcgggcacgtgaagctgtcccggggcagcgaggtcgtgctagacgcgtgcgattccagctgcgagatcatgatccccaaggggacgggcgacatcctcgtggactgctccggcgggcaacagcacttcctgaaggataatctcatcgacctggggtgccctcacatcccgctgctagggaagatggccatctatatctgccgcatgagcaaccacccccggaccaccatggccttcctgctgtggttctccttcggctacgtcattacctgcattttctgcaaggccctcttctacagcctgattatcattggcacgctggggaagaaaatcaagcagtacagggagctcaagccccagacgtgcaccatctgcgagaccgcccccgtgaacgcgatcgacgccgagatgcacgacctgaattgctcctacaacatctgcccgtactgcgccagccggctgacgtccgacggcctcgcccgccatgtgacccagtgccccaagcggaaggagaaggtcgaggagaccgagctgtacctgaacctagagcgcatcccctggatagtgcggaagctgctccaggtgagcgagtccaccggggtcgcgctcaagcgcagcagctggctgatcgtactgctcgtcctgctgactgtctctctgagccccgtgcaatccgccccggtgggccacgggaagaccatcgagacctaccagacccgggagggcttcacgaacatctgcctgttcatgttaggcagcatccttttcatcgtgtcatgcctggtgaaagggctggtggacagcgtctccgacagctttttccccggcctctccgtgtgtaagacctgtagcttcgggtccatcaacgggttcgagatcgagagccacaagtgctactgctccttgttctgttgcccctattgccgccactgcagcgccgaccgggagatccaccagctgcacctcgggatctgtaagaaaagaaaaaccggctccaacgtgatgctggccgtctgcaagcggatgtgcttcaaggccaccatcgaagcaagtcgccgggccctgctcatccgctccatcatcaacacgacattcgtgatttgcatcctcaccctggccatctgcgtcgtgagcacctccgccgtggagatggagaacctccccgccggcacgtgggagcgcgaggaggacctgaccaacttttgccaccaggagtgccaggtcagcgagaccgagtgcctgtgcccgtacgaggcgctggttctccggaagcccctgttcctggacagtatcgtgaagggtatgaaaaacctcctcaattccaccagtctggagacgtccctcagcatcgaggccccctggggcgccataaacgtccagtccaccttcaagcccaccgtgagcacggccaacatcgccctgtcctggagcagtgtggagcaccgtggaaacaagatcctggtcaccggccggagcgagtccatcatgaagctcgaggagcgcacgggggtgagctgggatttaggcgtggaggacgcgtccgagtctaagctcctcaccgtctccatcatggacttaagccagatgtacagtccagtgtttgagtacctgagcggcgaccgccaggtggaggagtggcccaaggctacctgcaccggggattgcccagagcggtgcggctgcacgtcatccacgtgcttacacaaggagtggccccacagccggaactggcgctgcaacccgacctggtgctggggagtcggcaccggctgcacctgttgcggggtggacgtgaaggaccttttcacagaccacatgttcatcaagtggaaagtcgaatacatcaagaccgaggcaatcgtgtgcgtggagctgacatctcaggagcggcagtgcagtctcatcgaggccggcacgcgcttcaatctggggcccgtgacaatcaccctgtccgagccccggaacatccaacagaaactgcccccggagatcatcaccctgcacccaaaaatcgaggagggcttcttcgacctgatgcacgtgcagaaggtgctcagcgcctccacagtatgcaagttgcagagctgcacccacggaatccccggcgacctgcagatctaccacatcgggaacctcctgaagggggaccgactgaacgggcacttaatccacaagatcgagccgcacttcaacacctcttggatgagttgggacgggtgcgacctggactactactgcaacatgggcgactggccctcctgcacctacacgggggtgacccagcataaccacgcggcctttgtgaacctgctcaacatcgagaccgactacaccaagacgttccacttccacagcaagcgggtcaccgcccacggcgacacgccccagctggacctgaaagcccgccccacctacggcgcgggggagatcaccgtgctagtggaggtcgccgacatggagctgcacacgaagaaagtggagatatccggcctgaagttcgccagcctagcctgcaccgggtgctatgcctgctccagcggcatctcctgcaaggtgcggatccacgtcgacgagccggacgagctgaccgtgcacgtcaagagctccgaccccgacgtggtggcggccagcacgagcctgatggcccgcaagctcgagttcgggaccgattccaccttcaaggccttcagcgccatgccaaagacgtccctgtgcttttacatcgtggagcgggagtactgcaagagctgctccgaggacgacacgaagaagtgcgtcgacaccaagttggaccagccccagtctatacttatcgagcacaagggcaccataatcggcaagcagaacgatacctgcaccgctaaagcctcttgctggctggagagcgtgaagtccttcttctacgggctgaagaacatgctcggctctgtgttcgggaacttcttcgtcggaatcctgttattcctcgccccgttcgttctgctggttctgttcttcatgtgcgggtggaagatcctgttctgcttcaagtgctgccgcaggacgcgcggcctattcaagtaccgccacctcaaggacgacgaggagaccggctaccggcgcatcatcgagcggctgaactccaagaaggggaaaaaccgcctgctcgacggcgagcggctggcggaccgcaagatcgccgagctgttcagcacgaagtcccacatcggg

SEQ ID NO: 15430 - RNA, 3495 nt, synthetic construct
  misc_feature 1..3495: note = derived and/or modified CDS sequence (opt11) from CCHVF(CCHVF 46-ST-2012)__KR814860.1__Gn-NSm-Gc
  source 1..3495: mol_type = other RNA
agcgaggagcccggcgacgactgcatctcccgcacccagctgctccggaccgagacggccgagatccacgacgacaactacgggggcccgggggacaagatcaccatctgcaacggcagcaccatcgtggaccagcgcctggggtccgagctgggctgctacaccatcaaccgggtcaagagcttcaagctctgcgagaactccgccacgggcaagacctgcgagatcgacagcacccccgtgaagtgccgccaggggttctgcctgaagatcacccaggagggccggggccacgtgaagctatcccgcggcagcgaggtcgtgttggacgcatgcgactcgagctgcgaggtgatgatccccaaggggacgggcgacatcctggtggactgctctggcggtcagcagcacttcctgaaggacaatctcatcgacctgggctgcccccacatccctctgctcgggaagatggccatctacatctgccggatgagcaaccacccccgcaccaccatggccttcctgttctggttctccttcggctacgtgataacctgcatcttctgcaaggcactgttctacagcctcatcatcatcggcacgctggggaagaagatcaagcagtaccgggaactgaagccccagacctgcaccatctgcgagaccgcccccgtgaacgcgatcgacgccgagatgcacgacctcaactgttcctacaacatctgcccgtattgcgccagccgcctgacgtccgacggcctcgcccggcacgtcccccagtgccccaagcgcaaggagaaggtggaggagaccgagctctacctgaacctcgagcggatcccctggatcgtgcgcaagctcctgcaggtctcagagtccaccggggtggcgctgaagcggagcagctggctcattgtgctgctggtcctcctgaccgtgtccctgtctccggtgcagtccgcccccgtcggccacgggaagactatcgagacctaccagacacgcgagggcttcaccagcatctgcctcttcatgctgggctccatcctgttcctcgtgagctgcctggtgaaggggctggtcgacagcgtgagcgactccttcttccccggcctctcggtgtgcaagacgtgctccatcggcagcatcaacggcttcgagatcgagtcccacaagtgttactgcagcctgttctgctgcccctactgccggcactgctcagccgacagggagatccaccagctgcacctctccatctgcaagaagcggaagaccgggagtaacgtcatgctggccgtgtgcaagcgcatgtgcttccgggccaccatcgaggcgagccgtcgcgccctgctcatccggtccatcatcaacgccaccttcgtcatctgcatcctgacgctgaccatctgtgtggtgagcaccagcgccgtcgagatggagtccctcccggccggcacctgggagcgcgaggaggacctgacgaacttctgccaccaggagtgtcaggtgacagagaccgagtgcctgtgcccctacgaggcgctggtgctccggaagcccctattcctggacagcatcgtcaagggcatgaagaacctcctgaactccaccagcctggagacgtccctcagcatcgaggccccctggggagccatcaacgtgcagtccaccttcaagccgaccgtgagcaccgccaacatcgccctgtcctggagctccgtcgagcaccgcgggaacaagatcctggtgaccgggcggagcgagtccatcatgaagctggaggagcgcacgggcgtgagctgggacctgggggtcgaggacgcatccgagagcaagctgttgaccgtgtccatcatggacctgagccagatgtacagccccgtgttcgagtacctgtccggcgaccggcaggtcgaggagtggcccaaggcgacctgcaccggcgactgccccgagcgatgcgggtgcacgagctccacgtgcctccacaaggagtggccgcacagccggaactggcgctgcaaccccacctggtgctggggcgtggggaccggctgtacctgctgcggggtggacgtcaaggacctgttcaccgaccacatgttcgtgaagtggaaggtggagtacatcaagaccgaggccatcgtctgcgtggagctgacctcccaggagcggcagtgcagcctcatcgaggccgggacccgcttcaacctgggccccgtgaccatcaccctgtccgagccccggaacatccagcagaagctcccgcccgaaatcatcaccctgcaccccaaggtcgaggaggggttcttcgacctgatgcacgttcagaaggtgctcagcgcctccacggtctgcaagctgcagagctgcacccacggcatcccgggggacctccaggtgtaccacatcggcaacctgctgaagggcgacagaatcaacgggcaccttatccacaaaattgagccccacttcaacacctcctggatgagctgggacggctgcgacctagactactactgcaatatgggggactggccctcctgcacctacacgggcgtgacccagcacaaccacgccgccttcgtcaacctgctaaacatcgagaccgactacaccaagacgttccacttccacagcaagcgggtgaccgcccacggggacacgccccaactcgacctgaaggcccgcccgacctacggcgcgggcgagatcaccgtgttagtcgaggtggccgacatggagctccacaccaagaaggtggagatctccgggctgaaattcgccagcctggcctgcaccggctgctacgcatgctccagcgggatctcatgcaaggtgcggatccacgtggatgagcccgacgagttgaccgtgcacgtcaagagcagcgaccccgacgtggtggcggcctccacgagcctgatggcccgcaagctggagttcggcaccgacagtaccttcaaggccttcagcgccatgcccaagacctccctctgcttctacatcgtcgagcgggagtactgcaagagctgctccgaggaggacacgcagaagtgcgtggacacccgcctggagcagccccagagcatcttaatcgagcacaaggggaccatcatcggcaagcaaaacgatacctgcaccgcgaaggcctcctgctggctcgagagcgtgaagtccttcttctacggcctgaagaacatgctggggagcgtgttcggcaacttcttcatcgggatcctcctgttcctggcccccttcgtgctcctggtgctgttcttcatgttcggctggaagatcctgttctgctttaagtgctgccgccggacgcgcgggctgctgaagtaccggcacctcaaggacgacgaggagaccggctaccgccggatcatcgagcgcctgaacaacaagaagggcaagaaccggctgctcgacggggagcgcctggccgaccggaagatcgccgagctgttctccaccaagacccacataggc

SEQ ID NO: 15431 - RNA, 3495 nt, synthetic construct
  misc_feature 1..3495: note = derived and/or modified CDS sequence (opt11) from CCHVF(CCHVF 47-ST-2013)__KR814861.1__Gn-NSm-Gc
  source 1..3495: mol_type = other RNA
agcgaggagcccggcgacgactgcatcagccgcacccagctgctcaagaccgagacggccgagatccacgacgacaactacggaggccctggagataagatcaccatctgcaacggcagcacaatcgtggaccaacggctgggctccgagctgggctgctacaccatcaaccgcgtaaagtcatttaaactctgcaagaactccgccacgggcaagacttgcgagatcgacagcaccccggtgaagtgccggcaggggttctgcctgaagatcacccaagagggacgcgggcacgtgaagctctcccggggctccgaggtcgttctcgatgcgtgcgattcctcctgtgaaatcatgatacccaaaggaacgggcgatatactggtcgactgctccggcgggcaacaacacttcctgaaggacaacctcatcgacctcggctgcccccacatcccgcttctcgggaagatggcaatctacatctgccgcatgagcaaccaccctcgtaccaccatggccttcctgttttggttttcgtttggctacgtcattacgtgtatcttctgcaaagcgctgttttacagcttaatcatcattggaaccctggggaaaaagatcaagcagtaccgagagctgaagccccagacctgcaccatctgcgaaaccgcacccgtgaacgcgatcgacgccgaaatgcacgatctaaactgctcgtacaacatctgcccgtactgcgccagccggctgacgtcagacggcctggcccgccatgtgacccagtgccccaagcgcaaggagaaagtcgaggagacagagctctacctgaacctcgagcgcatcccctggatcgtgcggaagttactccaggttagcgagtccaccggggtcgcgctgaaacgcagcagctggctcatcgtgctgctggtgctcttaaccgtctccctaagccccgtgcagtctgcgccggttggccacggtaagacaatagagacataccaaacccgggagggattcacgagcatctgcctctttatgctagggtccatcctgttcattgtgagttgcctcgtgaaagggctggtcgactccgtcagcgactccttcttccccggcctgagcgtgtgccggacctgttctatcgggagtattaacgggtttgaaatcgaatcccacaagtgttactgcagcctcttctgttgcccctactgccgccactgctccgccgaccgagagatccaccagctgcacctgagcatctgcaagaaacggaaaaccgggtccaatgtgatgctcgccgtctgcaagcgaatgtgcttcaaggcgaccatcgaggcaagccggcgcgcactgtttatccgctccatcatcaacacgaccttcgtaacctgcatcctgaccctcgccatctgcgtcgtctcaacgagtgccgtcgaaatggaagatctgcctgccggcacatgggagcgggaggaggacttgacaaatttctgccaccaggaatgccaggtcaccgagacggagtgtctctgcccgtacgaggcactggtcctgcgcaaacccctgttcctcgactcgatcgtgaagggcatgaagaacctcctaaacagcacctccctcgaaacctcccttagtattgaggccccatggggcgccatcaacgtccagagcaccttcaagcccaccgtgtccacggccaacatcgctctgagctggtcaagcgtagagcaccgggggaataagatattagtcaccgggcgctccgaaagcatcatgaagctggaggagcggacgggggtgtcctgggacctgggggtggaggacgcgagcgagtccaaacttctcacagttagcatcatggacctgtcccagatgtacagcccggtgttcgagtacctcagcggtgaccgccaggtggaggagtggcccaaggccacgtgcaccggagagtgccccgagcggtgcgggtgcacctccagcacgtgcctgcataaggagtggccccactcccgcaactggcggtgcaacccgacctggtgctggggcgtgggtactggctgcacgtgctgcggcgtggatgtgaaggacctgttcaccgaccacatgttcatcaagtggaaggtcgagtacatcaaaaccgaggccatcgtgtgcgtggagctcaccagccaggagcggcagtgctccctcatcgaggccgggacccggtttaatctaggaccggtgaccatcacgctttccgagccccgcaacatacagcagaagctgcccccggagatcataaccctgcaccccaaaatcgaagaggggttcttcgacctcatgcacgtccagaaggtgctatccgcaagcaccgtctgcaagctacagtcttgcacccacggcatacccggggaccttcagatctatcatattggcaacctgctgaagggcgaccgtgtgaacggtcacctcatccacaaaatcgaaccccacttcaacacgagctggatgagttgggacggctgcgacctagactactactgcaacatgggggattggccaagctgcacctacaccggtgtgacccaacacaatcacgcagccttcgtcaacctgctcaacatcgagacggactataccaaaacgttccacttccactccaagcgggtcaccgctcacggtgacacgccacagctggacctcaaagcccggcccacctatggggcaggagagatcaccgtgctcgtcgaggttgccgacatggagctgcacaccaagaaagtggaggtaagcgggctgaagttcgcctccctcgcctgcactggctgctacgcctgtagttccgggatcagctgtaaagtgcgcatccacgtggacgagccagacgagttaaccgttcacgtgaagtccagcgaccccgatgtggtagctgccagcacaagtctgatggccagaaagctcgagttcggcaccgacagcacgttcaaggccttcagcgccatgccaaagacctcgctgtgtttttacatcgtggagcgagagtactgcaaatcctgcagcgaggacgacaccaagaagtgcgtggacaccaagttggagcagccccagtccatcctcatcgagcataaggggaccataatcggtaagcagaacgacacatgtaccgcaaaagcctcatgctggctggagagtgtaaagagcttcttctacggcctgaagaacatgctcgggtccgtgttcggcaactttttcgtggggattctgctgttcctcgcccccttcgtcctgctggtgcttttcttcatgttcggttggaagatcctcttctgtttcaagtgctgccggcgaacccgggggctattcaagtataggcacctcaaggacgacgaagagaccggatatcgtcggatcatcgagcgtctgaacagcaagaagggcaagaaccggctgctcgacggggagcgcctggctgaccggaagatcgccgagctgttctccacgaaaacccatatcggc

SEQ ID NO: 15432 - RNA, 3495 nt, synthetic construct
  misc_feature 1..3495: note = derived and/or modified CDS sequence (opt11) from CCHVF(CCHVF 52-R-2014)__KR814862.1__Gn-NSm-Gc
  source 1..3495: mol_type = other RNA
agcgaggaacccggagacgactgcatcagccggacccaactactacgcaccgagaccgccgaaatccacgacgacaattacggcgggcccggggacaaaataacaatctgcaacggttccaccatcgtagaccaacgcctcggcagcgagctaggctgctacacaatcaaccgcgtcaaatcgttcaaactgtgtgaaaattcagcaaccggcaaaacgtgcgagatcgactccacaccggtaaaatgccgccaaggcttctgcctaaaaataacccaggaaggacgcggccacgtcaaactaagtcgaggctccgaggtagtcctagacgcctgcgacacttcatgcgaagtcatgatacccaagggaacgggagacatcctagtagactgctccggcgggcaacaacacttcctgaaggacaatctcatcgacctcggatgcccacacgtccccctcttaggcaaaatggccatatacatctgcaggatgtcgaatcatccgagaacgaccatggcattcctcttctggttcagcttcgggtacgtcataacctgcatcttctgcaaggcactattctactcactcataatcatcggcaccctgggaaagaaaataaaacagtaccgcgaattaaaaccccaaacgtgcaccatctgcgaaacggcaccagtcaacgccatagacgccgaaatgcatgacctaaactgctcgtacaacatttgcccctactgtgcctcacgactcacctccgacggcctcgcacggcacgtaccacaatgccccaaacgcaaggaaaaagtagaggaaacagaactttacctcaacctcgagcggatcccatggatcgtccgcaaacttctccaggtgagcgaatcaaccggcgtcgcattaaaacggagctcctggcttatagtattgctagtactgctaaccgtaagcctctcgccagtacaatccgcccccgtcggccacggcaaaacaatcgaaacctaccaaacgcgcgaggggttcacctcagtctgcctttttatgctcggatcgatactcttcctcgtaagctgcctcgtaaaaggactcgtcgattccgtctccgacagcttcttccccggcctctcagtatgcaaaacgtgctcaatcgggtcgataaatgggttcgagattgagagccacaagtgctactgctcactattctgctgtccttactgccgacactgctcagcagaccgcgagattcaccagctacacctttccatctgcaaaaagaggaaaatgggctcaaacgtcatgcttgccgtatgcaaacgaatgtgcttccgggccacgattgaagcctcacgccgagcactcctcatccgaagcatcattaacaccacctttgtcatttgtatactcaccctaacaatatgtgtcgtcagcacctccgcagtagagatggaaaacctcccatcaggaacatgggagagggaagaagacctcaccaacttctgccaccaagaatgtcaagtaacagaaacagaatgcctctgcccctacgaagcgctcgtactccgcaaaccactctttctcgactcaatcgtcaaaggcatgaaaaacctcctgaacagcaccagcctcgaaacctccctcagcatagaagccccttggggagcaatcaacgtccagtcgacgttcaaacccaccgtcagcaccgcaaacatagcactctcttggtcgtccgtagagcaccgtggaaataaaatcctagtaactgggcgctccgaatcaattatgaaactagaggaacgaaccggagtgagttgggacctaggcgtcgacgacgcctctgaaagcaaacttcttaccgtcagtataatggacttgtcgcaaatgtactcgccagtattcgaatacctctcaggcgaccgacaagtagaagagtggccgaaggcaacgtgcacgggagactgtcccgaacgatgcggttgcacaagctccacctgtctacacaaggaatggccccacagccggaactggaggtgcaaccccacttggtgctggggcgtaggaaccgggtgtacctgctgcggcgttgatgtaaaagaccttttcaccgatcacatgttcgtaaaatggaaggtcgaatacataaaaaccgaagccatagtttgtgtcgagctcacatcccaagaacgccaatgctcactcatagaagccggcacccgattcaatctcggccccgtcaccataacactgtcagagccacgcaatatccaacaaaaactcccaccagaaatcatcactcttcaccccaaagtagaagaaggctttttcgacctcatgcacgtccaaaaagtgctctcggcgtccacagtgtgcaaactccaatcatgcacacacgggattcccggcgatctccaagtctatcacataggaaacctcctaaaaggagacagggtcaacggtcatctcatccataaaatcgaaccacacttcaacacctcctggatgtcatgggacggctgcgacctcgattactactgtaacatgggggactggccttcatgcacctacaccggggtgacccaacacaatcacgcagccttcgttaatctactaaacatcgaaacagactataccaaaaccttccacttccactcaaaaagagtcacagcccacggcgacacaccacagctcgacctaaaggcaagacccacctacggcgcaggagagataacagtgctcgtggaggtagcagacatggaactccacacgaagaaagtagaaatcagtggactaaaattcgcgtccttggcctgcacgggatgctacgcctgttcttctggaatctcctgcaaagtccgcatccacgtagacgaaccagacgaacttacggtccatgtaaaatccaatgacccagacgtcgtcgccgcctcgacatcactaatggctcgaaaactagagtttgggaccgattccacatttaaagcattctccgccatgcccaaaacctctctttgcttctacatcgtcgaacgcgaatactgcaagtcctgctcagaagaagacacgcaaaagtgcgtcgacaccaaactagagcaaccgcaaagcatcctcattgaacacaagggcacgataataggaaaacagaacgatacctgcacagccaaagcaggctgctggttagaatccgtgaaatcattcttctacggcttgaaaaatatgctaggttcggtattcggcaacttctttatcggcatactactcttcctagcccccttcgtgctcctcgtactattcttcatgttcggctggaaaatcctgttctgctttaaatgctgccgtcgaaccaggggcctactaaaataccgcctactcaaagacgacgaagagaccggctaccgtcgaatcatcgaacgcctgaacaacaagaaagggaaaaaccggctactcgacggagaacgccttgccgaccgaaaaattgcagaactcttctccaccaaaacacacatcggc

SEQ ID NO: 15433 - RNA, 3495 nt, synthetic construct
  misc_feature 1..3495: note = derived and/or modified CDS sequence (opt11) from CCHVF(CCHVF 75-R-2012)__KR814863.1__Gn-NSm-Gc
  source 1..3495: mol_type = other RNA
agcgaggaacccggcgacgactgcatctcgcgcacacagttgctccgcaccgagacagccgagatccacgacgacaactacgggggcccgggagacaagataaccatctgcaacggcagcactatcgtagaccaacgactggggtccgagctgggctgctacaccatcaaccgagtcaagagcttcaagctctgcgagaactccgccacgggcaagacctgcgaaatcgacagcgcgccagtgaaatgccgccaggggttctgcctgaagatcacacaggagggacggggacacgtgaagctgtcgcgcggtagcgaggtcgtgctcgacgcctgcgactccagttgtgaggtgatgatccccaaggggacgggcgacatcctggtcgactgctccggagggcagcagcacttcctgaaggacaacctcatcgacctgggctgcccccacatcccgctgcttggaaagatggccatctacatctgcaggatgagcaaccacccccgcacgacaatggccttcttgttctggttctccttcggttacgtgattacctgcatcttctgcaaggccctgttctatagcctcatcatcatcggcacattagggaagaaaatcaagcagtacagagagctgaagccccagacgtgcacgatctgcgagaccgcgccggtgaacgcaatagatgccgagatgcacgacttgaactgctcctacaacatatgtccgtactgcgccagccgccttacctccgacggcctggcgcggcacgtcccccagtgccccaagcgcaaggagaaggtggaggagacggagctctatctgaacctggagcggatcccctggatcgtgcgtaagctcctgcaagtcagcgagtctaccggggtggccctgaagcgtagcagctggctcatcgtcctgttggtcctcctgaccgtgtccctgagcccggtgcagtccgcccctgtgggccacgggaagactatcgagacgtaccaaacccgcgagggcttcactagcatttgcctcttcatgctgggctccatcttattcctcgttagctgcctggtgaaggggctggtcaactccgtgagcgactccttcttcccaggtctcagcgtgtgcaagacgtgctccatcggaagcatcaacggcttcgagatagagtcccacaagtgctactgcagccttttctgctgcccctactgccggcactgttccgccgacagggagatacaccagctgcacctcagcatctgcaagaagcggaagactgggtccaacgtcatgctggctgtgtgcaagcgcatgtgctttagagcgaccatcgaggcgagccgccgcgcgctgctcatccggtccatcatcaacaccaccttcgtcatctgcatcctcacgctgaccatctgcgtggtgagcacctctgcggttgagatggagaacctcccgtccggcacctgggagcgcgaggaggacctgacgaacttctgccaccaggagtgccaggtgaccgagaccgagtgcctgtgcccctatgaggccctggtgctccggaaacccttgttcctggacagcatcgtcaagggcatgaagaacctgctgaactccaccagcctggagacttccctctccatcgaggcgccctggggcgccatcaacgtgcagagcaccttcaagccgacagtgtctaccgccaacatagcgctgtcctggtcgtcggtcgagcaccgtgggaacaagatcctggtgaccgggcggagcgaatccatcatgaagctcgaggagcgcacgggcgtgtcatgggacctaggggtggaggacgcgtccgagagcaagctgttgaccgtgtccatcatggacctgagccaaatgtacagccccgtgttcgagtatctgtccggcgacaggcaggtcgaggagtggcccaaagcgacgtgcaccggcgactgccccgagcgatgcgggtgcacgtcctccacatgcctccacaaggagtggccgcatagccggaactggcgctgcaacccaacctggtgctggggcgtggggaccggctgcacgtgctgcggcgtggacgtaaaggatctgttcaccgaccacatgtttgtgaagtggaaggtggagtatatcaagacagaggccatcgtctgcgtggagcttacaagtcaggagcggcagtgcagcctcatcgaggccgggactcgcttcaatctgggccccgtgaccatcaccttatccgaaccccggaatattcagcagaagctccctcccgagatcatcacactacaccccaaggtggaggaggggttcttcgacctgatgcacgtgcagaaggtcctctccgcctccacggtctgcaaactacagagctgcacccacggcataccgggcgacctccaggtgtatcatattggtaacctcctgaagggcgaccgagtgaacggtcacctgatccacaagatagagccccacttcaacacctcctggatgagctgggacggctgcgacctcgactactactgcaacatgggggactggccatcctgtacctacacaggcgtcactcagcacaaccacgccgcgttcgtgaacctgctgaacatcgagaccgactacaccaaaacgttccattttcacagcaagcgggtgacggcgcacggggacacgccccagctcgacctgaaggcccgcccgacctacggcgccggcgagatcaccgtcctggtggaggtggcggacatggagctccacaccaagaaagtggagatctccgggctgaagtttgccagcctggcctgcaccggctgctacgcgtgctccagcgggatatcctgcaaggtgcggatccacgtggacgagcccgacgagctcaccgtccacgtcaagagctctgaccccgacgtggtcgccgcgtccactagcctcatggcccgcaagctggagttcgggaccgactccacctttaaggccttcagcgccatgcccaaaacctcactctgcttctacatcgtggagcgggagtactgcaagagctgcagtgaggaggacacgcaaaagtgcgtggacaccaagctggaacagccgcagagcatcctgatcgagcacaaggggaccatcatcggcaagcagaacgatacctgcacggccaaagcgtcctgctggctcgaaagcgtcaagtccttcttatacggcctgaagaacatgctcgggagcgtgttcggcaatttcttcatcgggatcttgttgttcctcgcccccttcgtgctgctggtcctcttcttcatgttcggctggaagatactgttctgcttcaaatgctgccgccgcacgcggggtctgctcaagtaccgtctgctgaaggacgacgaggagaccggctaccggcgcatcatcgagcggctaaacaacaagaagggcaagaaccgccttctggacggggaacggctcgccgaccgcaagattgccgagctgttctcaaccaaaacccacatcggc

SEQ ID NO: 15434 - RNA, 3495 nt, synthetic construct
  misc_feature 1..3495: note = derived and/or modified CDS sequence (opt11) from CCHVF(CCHVF 75-ST-2010)__KR814864.1__Gn-NSm-Gc
  source 1..3495: mol_type = other RNA
tctgaagagtccggtgacgactgcatcagccgtacccaactgctccggaccgagacggccgagatccatgacgacaactacgggggccccggggacaagatcacaatctgcaacggctccaccatcgtggaccagcgcctggggagcgagctgggctgctataccatcaaccgggtcaagtccttcaagctctgcgagaacagcgccacgggcaagacctgcgagatcgactccaccccggtgaagtgccgccaggggttctgcctgaagatcacccaggagggcagggggcatgtgaagctgagccgcggctccgaggtcgtgctcgacgcctgcgacagctcctgcgaggtgatgatccccaaggggacgggcgacatcctggtggactgcagcggcgggcagcagcacttcctgaaggacaaccttatcgatctgggatgcccccacatccccctgctcgggaagatggccatctacatctgccggatgtccaaccacccgcgcaccaccatggccttcctgttctggttcagcttcggctacgtgattacgtgtctattctgcaaggccctcttctactccctgatcatcatcggaaccctggggaagaagatcaagcaataccgggagctccgaccccagacctgtacaatctgtgagaccgcccccgtgaacgcgatcgacgccgagatgcacgacctgaactgctcatacaacatctgcccctactgcgcctcccggctgacgagcgacggcctcgctcgtcacgtcccgcagtgccccaagcgcaaggagaaggtggaggagaccgagctatacctgaacctcgagcgtataccctggatcgtgcggaaactgctgcaggtctccgagagcaccggggttgcgctcaagcgcagctcctggctgatcgttctgctcgtcctcctgaccgtgagcctctcccccgttcagagcgcaccggtcggccacgggaagacgatcgaaacctaccagacccgggagggcttcacctccatctgcctgttcatgctgggcagcatcctcttcctggtgtcctgcctggttaaggggctcgtcgacagcgttagtgacagctttttccccggcctgtccgtgtgtaagacgtgcagtatcgggtccatcaatggcttcgagatcgagagtcataaatgctactgctccctgctttgctgcccctactgccgccactgcagcgccgaccgggagatccaccagctccacctgtccatctgcaagaagcgcaagaccgggagcaacgtgatgctcgccgtgtgcaagaggatgtgcttccgcgccaccatagaagcgtcccgccgggcacttctgatccgctcgatcatcaacaccacgttcgtcatctgcatcctcaccctgaccatctgcgtggtgagcacctccgctgtcgagatggagaacctgcccagtggcacgtgggagaaggaggaagacctgaccaacttctgccaccaggagtgccaggtgaccgagaccgaatgcctgtgtccgtacgaggccctagtgcttcggaagcccctctttctggactctatcgtcaaaggcatgaagaacctgctcaacagcacgtccctggagaccagcctgtccatcgaggccccctggggcgcaatcaacgtgcagagcaccttcaagcccaccgtgtccactgccaacatcgccctatcatggtccagcgtcgagcaccgcgggaacaagatcctggtgacggggcggtccgagagcattatgaagctggaggaacgcaccggcgtgtcatgggacctcggggtcgaagatgccagcgagtccaagctgctgaccgtgagcatcatggaccttagccagatgtactccccggtgttcgagtacctgagcggcgaccggcaggtcgaggagtggcccaaggcgacctgcacgggcgactgccccgaaagatgcgggtgcacctcctccacgtgtctgcacaaggagtggccccactcccgaaactggcggtgcaacccgacctggtgctggggcgtgggtaccggctgcacgtgctgcggcgtggacgtcaaggacctcttcacggatcacatgttcgtaaagtggaaggtggagtacatcaagacggaagccatcgtctgcgtggagctgaccagccaggagcggcagtgctccctgatcgaggccgggacccgcttcaacctcggccccgtgaccatcacactgagcgagccccgtaacatccaacagaagctgcccccagagatcatcacgctccaccccaaggtagaggaggggtttttcgacctgatgcacgtgcagaaggtgctgtccgccagcaccgtctgcaagctccagtcctgcacccacgggatccccggggacctccaggtgtaccacattggcaacctgctcaagggcgaccgcgtgaacgggcatctgatccacaagatcgaaccccacttcaacaccagctggatgtcctgggacggctgcgacctggactactactgcaacatgggggactggccctcgtgcacgtacaccggcgttacccagcacaaccacgccgcctttgtgaacctcctgaacatcgagaccgactacacgaagacatttcacttccactccaagcgggtgaccgcgcacggggacactccccagctggatctcaaggcccgccccacctacggcgccggcgagatcaccgtcctggtggaggtggccgacatggagctgcacaccaagaaagtcgagatcagcgggctcaagttcgcttccctggcctgcaccggctgctacgcctgcagctccgggatcagctgcaaggtgcggatccacgtagacgagccggacgagctgacggtccacgtcaagtcgtccgaccccgacgtagtggccgccagcacctccctcatggcgcgcaagctggagttcggtaccgacagcaccttcaaggctttctccgccatgcccaagacgagtctctgcttctacatcgtggagcgagaatactgcaagtcctgcagtgaggaggacacccagaagtgcgtggacaccaagctcgagcagccccagtccatcctgatcgagcacaaggggactatcatcggtaagcagaatgacacgtgcaccgccaaggcaagctgctggctggagtccgtcaagagcttcttctacggcctcaagaacatgctgggatccgtgttcggcaacttcttcatcgggatcctgttattcctggcgccgttcgtgctgctcgtactgttcttcatgtttggatggaagatcctgttctgcttcaagtgctgccgccgcgcccgggggctcctgaagtaccgccacctgaaggacgacgaggaaaccggttaccggaagatcatcgagcgcctcaacaataagaagggcaagaatcggctgctggacggggagcgtctcgcggaccggaagatcgcagagctgttcagcacaaagacccacatcggc

SEQ ID NO: 15435 - RNA, 3495 nt, synthetic construct
  misc_feature 1..3495: note = derived and/or modified CDS sequence (opt11) from CCHVF(CCHVF 81-R-2014)__KR814865.1__Gn-NSm-Gc
  source 1..3495: mol_type = other RNA
agcgaggagcccggcgacgactgcatctcccgcacccagctgctcagaaccgagacggccgagatccacgacgacaattacggcggcccgggggacaagattaccatatgcaatggctctaccatcgtggaccagcgcttaggtagcgagctgggctgctataccatcaaccgagtaaagagcttcaagctctgcgagaactccgccacgggcaagacctgcgagatcgacagcacccccgtgaagtgccgccaggggttctgcttgaagatcacccaggagggccgggggcatgtgaagctgtcccgcgggagcgaggtcgtgctcgacgcgtgcgactccagctgcgaggtgatgatccctaaggggacaggcgatatcctggtcgactgctccggcgggcagcagcacttcctcaaggacaacctcattgacctgggctgcccccatatcccgctgctcgggaagatggccatctacatctgccggatgagcaaccaccctcgcaccacgatggcattcctgttctggttttccttcggctacgtgatcacatgcatcttttgcaaagccttgttctacagcctcatcataatcggcaccctgggaaagaagatcaagcagtaccgggagctcaagccgcagacctgcacgatctgcgagaccgcgcctgtgaacgcgatcgacgccgagatgcacgacctcaactgctcttacaatatctgcccttactgcgccagccgcctgacgtccgacggcctggcccgccacgtcccacagtgccccaagaggaaggaaaaggtggaggaaaccgagctctacctgaacctggagagaatcccctggatcgtgcgcaagctcctgcaggtcagcgagtccaccggggtggcgctgaagcggagcagctggctcatcgtgctgctggtcctcttgaccgtgtccctgagcccggtgcagtccgccccagtcggccacgggaagacgatcgagacgtaccagaccagagagggcttcactagcatctgcctcttcatgctgggctcaatcctgtttctcgtgagctgcctggtgaaggggctcgtcgactccgtgagcgactccttcttccccggcctctcagtgtgtaagacgtgctccatcggttccattaacggcttcgagatcgaatcgcacaagtgctactgcagcctgttctgctgcccctactgccggcattgctccgccgaccgcgagatccaccagctccacctcagcatctgcaagaagcggaagaccggctctaacgtcatgctggccgtgtgcaaacgcatgtgcttccgcgccaccatcgaggcgagcaggcgcgccctgcttatccggtctatcataaacaccacgttcgtcatctgcatcctaaccctgaccatctgcgtggtgagcaccagcgccgtcgagatggagaacctcccggccggcacgtgggagcgcgaggaggaccttaccaacttttgccaccaggagtgccaggtgaccgagaccgagtgcctgtgcccatacgaggctctggtgctccggaagccactgttcttggactccatcgtcaagggcatgaagaatctcttgaacagcacgtcactggagacctccctctccatcgaggcgccctggggcgccatcaacgtgcagagcaccttcaaaccgacagtgtccaccgccaacatcgccctgagctggtccagcgtcgagcatcgcgggaacaagatcctggtgacaggcagatccgaaagcataatgaagctcgaggagcgcaccggcgtgagttgggacctgggggtcgaggatgcgagcgagtccaaacttctcacagtgtctatcatggacctgtcccagatgtacagccccgtgttcgagtacctcagcggcgacaggcaggttgaggaatggcctaaggcgacctgcacaggcgactgtcccgagcgctgcggctgcacctccagcacgtgcctccacaaggagtggccccactctcggaactggaggtgcaaccccacctggtgttggggcgtggggacgggctgcacgtgctgcggcgtggatgtcaaggaccttttcacagatcacatgttcgtgaagtggaaggtggagtacatcaagacagaggccatcgtctgcgtggaactgacaagccaggagagacagtgctccttgatcgaggccgggacccgcttcaacctgggccccgtgaccatcaccctgagcgagccccggaacatacagcagaagctcccgcccgagataataacgctacaccccaaggtcgaggaaggcttctttgacctgatgcacgttcagaaggttctctccgccagcaccgtctgcaagttgcagtcctgcacccacggaatcccgggggacctccaggtataccacatcggcaacctgctaaagggagaccgcatcaacgggcacctgatccacaagatcgagccccacttcaacaccagctggatgtcctgggacggttgcgacctcgactactactgtaatatgggggactggcccagctgcacgtacaccggcgtgacccagcataaccacgccgcgttcgtcaacctgctgaacatcgagaccgattacacgaagaccttccacttccactctaagcgggtgaccgcccatggggacacgccccagttggacctgaaggcacgcccgacctacggcgccggcgagataaccgtgctggtggaagtggcggacatggagttgcacaccaagaaggtggagatcagcgggctcaagttcgcctcgctggcttgcaccggttgctacgcctgcagctccgggatcagctgcaaggtacggatccatgtcgacgagcccgacgagctaacggtgcacgtcaagtccagcgaccccgacgtggtggccgcgagcacctcgctgatggcccgcaaactggagttcggcaccgacagcacattcaaggccttctccgccatgcccaagacgtctctctgcttctacatcgtcgaacgggagtactgcaagtcctgcagcgaggaagacacccagaagtgcgtggacacccgtctggagcagccacagtccatcctgatcgaacacaaggggacaatcatcggcaaacagaatgacacatgcaccgccaaggcgagctgttggctcgagtccgtcaagagcttcttctatggcctgaagaacatgctggggtccgtgtttggcaactttttcatcggtatcctactgttcctggcccccttcgtgctcctggtgctgttcttcatgttcggctggaagatcctcttctgtttcaagtgctgcagacggaccagggggctactgaagtacagacacctcaaggatgacgaagagaccgggtaccgcagaatcatagagagactgaacaataagaagggcaagaaccggctgctcgacggggagcgcctggccgacaggaagatcgccgagctattcagcaccaagacgcatatcgga

SEQ ID NO: 15436 - RNA, 3495 nt, synthetic construct
  misc_feature 1..3495: note = derived and/or modified CDS sequence (opt11) from CCHVF(CCHVF 3756-ST-2007)__KR814866.1__Gn-NSm-Gc
  source 1..3495: mol_type = other RNA
agcgaggagcccggcgacgactgcatctcccggacccagcttctcaagaccgagacggccgagatacacgacgacaactacgggggcccgggggacaaaatcaccatctgcaacggcagcaccatcgtggaccagcggctggggtccgaactgggatgctacaccatcaaccgcgttaagagcttcaagctctgcgaaaattccgccacgggcaagacctgcgagatcgactcgaccccagtgaagtgccggcaggggttttgcctgaagatcacccaggagggccgcgggcacgtgaagctgtcccggggcagtgaggtcgtgctcgacgcctgtgattccagctgcgagatcatgatccccaagggtacaggcgacatcctggtggattgctccggcgggcagcagcactttctgaaggacaacctcatcgacctgggctgcccccacatcccactgctcgggaagatggccatctacatttgtcggatgagcaaccacccccggaccacgatggccttcctgttctggttttccttcggctacgtcatcacgtgcatcttttgcaaggccctgttctacagcctcattatcatcggcaccctggggaagaagatcaagcagtaccgcgagctgaagccccagacctgcacaatctgcgagaccgccccagtgaacgcgatcgacgccgagatgcacgacctgaactgttcctacaacatctgcccgtactgcgccagccggctgacgtcggacggcctggcccgccacgtcacccagtgcccgaaacggaaggagaaggtcgaggagaccgagctctacctgaacctggagcgcatcccctggatcgtgcggaagctcctccaggtgagcgagtccaccggggtcgcgctgaagaggagcagctggctcatcgtgctgctggtactcctgacggtgtccctgagccccgtgcagtccgccccggtgggccacggtaagaccatcgagacctaccagacccgggagggctttacgtcaatctgcctcttcatgctgggctctatcctgttcatcgtcagctgcctcgtgaaggggctcgtggactccgtcagcgactccttcttccccggcctgtcggtgtgcaaaacctgctccatcgggagcatcaacggcttcgagatcgagtcccacaagtgctactgcagcctcttctgctgcccatactgccggcactgctccgccgaccgggagatccaccagctgcacttgagcatctgcaaaaagcgcaagaccgggtccaacgtgatgctcgccgtctgcaagcggatgtgctttaaggccaccatcgaggcgagccgccgggccctcctgatccgcagtatcatcaacacgaccttcgtcatctgcatcctcacgctggccatatgcgtcgtgagcaccagcgccgtggagatggaggacctgcccgctggcacgtgggagcgcgaggaagacctcaccaacttctgccaccaggagtgccaggtcaccgagaccgagtgcctgtgcccgtacgaggcgctggtgctacggaagcccctcttcctggactccatcgtaaagggcatgaagaacctgctcaacagcacgtccctggagaccagcctgtccattgaagccccctggggcgcaatcaacgtccaaagcaccttcaaacccaccgtgtccaccgccaacatcgccctcagctggtccagcgtggagcaccgcgggaacaagatcctggtcaccgggcgctccgaaagcatcatgaagctggaggagcgcaccggcgtgtcctgggacctcggggttgaggacgcgagcgagtccaaacttctgaccgtcagcatcatggacctcagtcagatgtacagcccggtgttcgagtacctgagcggcgaccgccaagtggaggagtggccaaaggcgacctgcacgggcgactgccccgagcggtgtgggtgcacctcctccacttgcctgcacaaggagtggccccactcccggaattggcgctgcaacccgacctggtgctggggagtcgggaccggctgcacgtgctgcggggtggacgtgaaggacctcttcaccgaccacatgttcatcaagtggaaggtcgagtacatcaagaccgaggccatcgtgtgcgtggaactgaccagccaggagcggcagtgttcactgatcgaggccgggacccgcttcaacctcggccccgtcaccatcaccctgagcgagccacggaacattcagcagaaactgcccccggagatcatcacgctacaccccaagatcgaggaggggttcttcgatctgatgcacgtgcagaaggtgctatccgccagcaccgtctgcaagctccaatcctgcacccacggcatacccggggacctgcagatctaccacatcggcaatctgctcaagggcgatcgcgtgaacgggcacctgatccacaagatcgagccgcactttaacaccagttggatgtcctgggacggctgcgacctggactactattgcaacatgggggactggcccagctgcacatacaccggcgtgacccagcataaccacgccgctttcgtcaacctcctgaacatcgaaaccgactacacgaagacgttccacttccactccaagcgggttaccgcacacggagacacgccccagctggacctcaaggcccgccccacctacggcgcgggcgagatcaccgtgctggtcgaggtggccgacatggagctgcacaccaagaaggtggagatttccgggctcaagttcgcctccctgacctgcacgggctgctacgcctgcagctccgggatcagctgcaaggttcggatccacgtggatgagccggacgagctgaccgtgcacgtcaagtccagcgaccccgacgtggtggccgcgtccacctccctcatggcccgtaagctggagttcggcaccgatagcacgttcaaggccttctccgccatgcccaagaccagcctgtgcttctacatagttgagcgggagtactgcaagtcctgcagcgaagacgacaccaagaagtgcgtggacaccaaactcgagcagccccagtccatcctgatcgagcacaaggggaccatcatcggcaagcagaacgacacttgcaccgccaaggcgagctgctggctggagtccgtcaagagcttcttctacggcttgaagaacatgttagggtccgtgttcggcagcttcttcgtggggatcctcctcttcctgaccccgtttgtgctgctcgtcctgttcttcatgttcggctggaagatcctgttctgcttcaagtgctgccgccggacccgggggttgttcaagtaccgccacctgaaggacgacgaggaaacgggctaccggcgcatcatcgaacgactgaactccaagaaaggcaagaaccgcctcctggatggggagcggcttgccgaccgcaagatcgccgagctattcagcaccaagacccacatcggc

SEQ ID NO: 15437 - RNA, 3495 nt, synthetic construct
  misc_feature 1..3495: note = derived and/or modified CDS sequence (opt11) from CCHVF(CCHVF 3809-ST-2007)__KR814867.1__Gn-NSm-Gc
  source 1..3495: mol_type = other RNA
agcgaggaacccggcgacgactgcatctcccgcacccagttactccgaaccgagacagccgagatccacgacgacaactacggaggcccgggggacaagatcaccatatgcaacggcagcaccatcgtggatcagcgcctggggagtgagctaggctgttacaccattaaccgggtcaagtcgttcaagctctgcgagaacagtgccacgggcaagacctgcgagatcgacagcactcccgtgaagtgccgccaggggttctgtcttaagatcacccaggagggccgggggcacgtgaagctgagtcgcggatcagaagtcgtactcgacgcgtgcgactccagttgcgaggtgatgatcccaaaggggacgggcgacatcttggttgactgctccggcggtcagcagcacttcctgaaagataacctaatcgacctaggttgtccccatatccccctgctcgggaagatggccatctacatctgccgcatgagcaaccacccccgaaccaccatggcctttcttttctggttctccttcggctacgtaatcacgtgcatcttctgcaaggcgctgttctatagccttataatcatcggcactctggggaagaaaataaagcagtaccgggagctgaagccccaaacatgcaccatctgcgagaccgccccagtgaacgcgatcgatgcggagatgcacgacctcaattgctcctacaacatctgcccgtactgcgcgagcagactgacgtcggacggcctggccagacacgtccctcagtgccccaagcgcaaagagaaggtcgaggagaccgagctctatttgaacttggaacggattccctggattgtgcgcaagctattgcaggtcagcgagtccaccggggtggccctgaaacggagcagctggctcatcgtgctgctggtcctcttgacagtaagtctgtcgcctgtgcaatccgcccccgtcggccacgggaagacgatcgagacctatcaaacccgcgagggcttcacctcgatctgcctcttcatgctggggtccatcctgttcctcgtgagctgtctggtgaaggggctggtcgactccgttagcgactccttcttccccggcctgagcgtctgcaagacctgcagcatcgggagcgtgaacggcttcgagatcgagtcccacaaatgctactgcagcctattctgctgcccttattgccggcactgctccgccgaccgcgagatccaccaactgcacctatcggtgtgcaagaaacggaagacggggtccaacgtgatgctggccgtctgcaagagaatgtgcttcagggccaccatagaggcgagccgccgcgccctactcatccggtccatcattaacacgacgtttgtgatctgcatcctgacccttaccatctgcgtcgtgagcaccagcgcggtggaaatggagaacttaccggccggcacatgggagcgcgaagaggaccttaccaacttctgccaccaggagtgccaggtcaccgagaccgagtgcctgtgcccttacgaggccctggtgctccggaagccgctgttcctggattccatcgtcaaaggcatgaagaacctcctgaacagcacgtccctcgagacaagcctctctattgaagccccctggggcgccatcaacgtccagtcgaccttcaaaccaaccgtgtccaccgcgaacatcgctctgagctggtccagcgtggagcaccgcgggaacaagattctggtcacggggcggtctgagagcatcatgaagctcgaggaacggacgggcgtgtcctgggacctgggggtggaggacgccagcgagtccaagctgctcaccgtcagcatcatggacctgtcgcagatgtactctcctgtgttcgagtacctgagcggcgacagacaagtagaggagtggccaaaggctacctgcacgggagactgtcccgagaggtgcgggtgcacctcgtcaacgtgtctccacaaggagtggccgcactcccggaactggcgctgcaaccccacatggtgctggggcgtagggaccgggtgcacatgctgcggcgtagatgtcaaggacctgttcacggatcacatgttcgtcaagtggaaggtggagtacatcaagactgaggcaatcgtttgcgtcgagctgacctcgcaggagaggcaatgctccctcatcgaagccgggaccagattcaacttgggccccgtgactatcaccttatctgagccccggaacatccagcaaaagctccctcccgagataatcacgctgcaccccaaggtagaggagggctttttcgacctaatgcacgttcagaaggtgctctccgccagcaccgtgtgcaagctgcagtcctgcacccacggcatcccaggggacctgcaggtctaccacatcggcaacctcctgaagggcgaccgcgtgaacgggcacctgatccataagatcgagccccatttcaacaccagctggatgtcctgggacggctgcgacctcgactactactgcaatatgggggactggcccagttgcacgtacaccggcgtaacccagcacaaccacgccgcgttcgttaacctgttgaacatcgagaccgactacacgaagaccttccacttccactccaaacgggtgactgcccacggggacacgccccaactggacctgaaggcccgccctacctacggcgccggcgagatcacggtgctagtcgaggtagcggacatggagttgcacacaaagaaggtggagatcagcgggcttaagttcgcctctctggcctgcaccggttgctacgcttgcagctcagggataagctgtaaggtccggatccacgtggacgagcccgacgagctcactgtacacgtcaagagctcggaccccgatgtggtggcagcgtcaaccagtctgatggcccgcaagctggagttcggcaccgacagcacattcaaggccttcagcgccatgccaaagaccagcctgtgcttctacattgtcgaaaaggaatactgccggtcctgcagcgaggaggacacccagaagtgcgtggacaccaagctggagcagccgcagtccatcctgatcgagcacaaggggaccatcatcggcaagcagaacgacacgtgcaccgccaaagcgagctgctggctcgagtccgtcaagagctttttctacggactgaagaacatgctcgggtccgtgttcggcaatttcttcatcggcatcctcctgttcctgacccccttcgttctcctggtgctgttcttcatgttcggatggaagatcctcttctgcttcaagtgttgtcgccgcacccgggggctgctgaagtaccgccacctaaaggacgacgaggagactgggtaccgccgcatcatcgaacggctaaacaacaagaagggcaagaaccgcttgctcgacggggagcgactggccgaccgcaagattgccgaactgttctcgacaaagacccatatcggc

SEQ ID NO: 15438 - RNA, 3495 nt, synthetic construct
  misc_feature 1..3495: note = derived and/or modified CDS sequence (opt11) from CCHVF(CCHVF 3820-ST-2007)__KR814868.1__Gn-NSm-Gc
  source 1..3495: mol_type = other RNA
agcgaggagcccggcgacgactgcatctcccgcacccagctgctcaagaccgagacggccgagatccacgacgacaactacgggagccccggcgacaagatcactatctgcaacgggtccaccatcgtggaccagcgtctgggcagcgagctggggtgctacaccatcaaccgcgtcaagtccttcaaactctgcgagaacagcgcaacgggcaagacgtgcgagatcgactccacccccgtgaagtgccggcagggcttctgcctgaagataacccaggaggggcgcggccacgttaagctgagccgggggtccgaggtcgtgctcgacgcgtgcgacagctcctgcgagatcatgatccccaagggcacgggggacatcctggtggactgcagcggcggccagcagcacttcctgaaggacaacctcatcgacctggggtgcccccacatcccgctgctcggtaagatggccatctacatctgccgcatgtccaaccacccccggacaaccatggccttcctgttctggttcagctttgggtacgtcataacctgcatcttctgcaaggccctgttctactctctcatcatcatcggcaccctgggcaagaagatcaagcagtaccgcgagctgaagccccagacctgcaccatctgcgagaccgcccccgtgaacgcgatcgacgcagagatgcacgacctcaactgcagctacaacatctgcccgtactgcgcctcccggctgacgagcgacgggctggcccgccacgtgacccagtgccccaagcggaaggagaaggtcgaggagaccgagctctacctgaacctggagcgcatcccctggatcgtgcggaagctcctccaggtgtccgagtcgaccggcgtcgcgctgaagcgcagctcctggctcatcgtgctgctggtgctcctggccgtaagcctgtcccccgtgcagtcagccccggtggggcacggcaagacgatcgagacctatcagacccgggaggggttcacctccatctgcctcttcatgctgggctcgatcctgttcatcgtctcctgcctcgtgaagggcctggtggacagcgtctccgacagcttcttccccgggctgtccgtgtgcaagacgtgcagcatcggctccatcaacgggttcgagatcgagagccacaagtgctactgctccctcttctgctgcccctattgccgccactgcagcgccgaccgggagatccaccagctgcacttatccatctgcaagaagcgcaagacaggcagcaacgtgatgctcgccgtctgcaagcggatgtgcttcaaggcgaccatcgaggccagtcgccgggccctgctgatccgcagcatcatcaacaccacgttcgtgatgtgcatcctcaccctggccatctgcgtcgtgagcacgtccgccgtggagatggaggacctgcccgcggggacctgggagcgcgaggaggacctcacgaacttctgccaccaggagtgccaggtcaccgagaccgagtgcctgtgcccgtacgaggccctggtgctgcggaaacccctcttcctggactctatcgttaagggcatgaagaacctgctcaactccaccagcctggagacttcccttagcatcgaggccccctggggcgccatcaacgtccagtccaccttcaagcccaccgtgagcaccgccaacatcgcgctctcctggagctccgtagagcaccgcgggaacaagatcctggtcaccggccggagcgagtctatcatgaagctggaggaacgcacgggggtatcctgggacctcggcgtggaggacgcctccgagagcaagctgctgaccgtctccatcatggacctctcgcagatgtactctccggtgttcgagtacctgtccggggaccgccaggtggaggagtggcccaaggcgacctgcaccggcgactgccccgagcggtgcggctgcacgagctccacctgtctgcacaaggagtggccccacagccggaactggcgctgcaacccgacctggtgctggggcgtcgggaccgggtgcacgtgctgcggcgtagacgtgaaggacctcttcacggaccacatgttcatcaagtggaaggtcgagtacatcaagacggaggccatcgtgtgcgtggagttgacctcccaagagcggcagtgcagcctgatcgaggccggcacgcgcttcaacctcggtcccgtcaccatcaccctgtccgagccccgaaacatccagcagaagctgcccccggagatcatcaccctccaccccaagatcgaggagggcttcttcgacctgatgcacgtgcagaaggtgctgagtgcctccacggtctgcaagttacagagctgcacccacgggatccccggcgacctgcagatctaccacatcgggaacctcctcaagggcgaccgcgtaaacggccacctgatacacaagatcgagccacacttcaacacctcctggatgtcgtgggacgggtgcgacctggactactactgcaacatgggcgactggccctcctgcacctatacgggggtgacccagcacaaccacgcggccttcgtcaacctcctgaacatagagaccgactacaccaagacgttccacttccacagcaagcgggtgaccgcccacggcgatacgccccagctggacctcaaggcgcgtcccacctacggggccggcgagatcaccgtgctggtcgaggtggccgacatggagctgcacaccaagaaggtggagatctccggcctcaagttcgccagcctgacctgcaccgggtgctacgcctgctcctctggcatctcctgcaaggtccggatccacgtggacgagccggacgagctgacggtgcacgtcaaaagctcggaccccgacgtggtggcggcctccaccagcctcatggcccgcaagctggagttcgggaccgattccaccttcaaggccttcagcgccatgcccaagacgtcactgtgcttctacatcgtcgagcgggagtactgcaagagctgctccgaggacgacaccaagaagtgcgtggacaccaagctcgagcagccccagagcatcctgatcgagcacaagggcaccatcatcgggaagcagaacgatacctgcactgcgaaggcctcctgctggctggagagcgtgaagtccttcttctacggtctcaagaacatgctgggcagcgtcttcgggtccttcttcgtgggcatcctgctgttcctggccccgtttgtgctgcttgtcctgttcttcatgttcgggtggaagatcctgttctgcttcaagtgctgccgtaggacccgcggcctcttcaagtaccgccatctgaaggacgacgaggagaccgggtaccggcgcatcatcgagcggctgaacagcaagaagggcaagaatcgcctcctggacggcgagcggctggcagaccgcaagattgcggaactcttctcgacaaagacgcacatcggg

SEQ ID NO: 15439 - RNA, 3495 nt, synthetic construct
  misc_feature 1..3495: note = derived and/or modified CDS sequence (opt11) from CCHVF(CCHVF 4495-ST-2008)__KR814869.1__Gn-NSm-Gc
  source 1..3495: mol_type = other RNA
agcgaagagtccggcgacgactgcatcagccgcacccagctgctccggaccgagacggccgagatccacgacgacaactacgggggccccggggacaagatcaccatctgcaacggctccaccatcgtggaccagcgcctggggagcgagctgggctgctacaccatcaaccgggtcaagtccttcaagctctgcgagaacagcgccacgggcaagacgtgcgagatcgactccaccccggtgaagtgccgccaggggttctgccttaagatcacccaggagggccgggggcacgtgaagctgagccgcggctccgaggtagtgctcgacgcgtgcgacagctcgtgcgaggtgatgattcccaaggggacaggcgacatcctggtcgattgcagcggcgggcagcagcacttcctgaaggacaacctcatcgacctgggctgcccccatatcccgctgctcgggaagatggctatctacatctgccggatgtccaaccacccgcgcaccaccatggccttcctgttctggttcagcttcgggtacgtgatcacatgcctgttctgcaaggccttattctactccctgatcatcatcggcaccttggggaagaagatcaaacagtaccgggagctccgtccccagacctgtaccatctgcgagaccgcccccgtaaacgcaatagacgccgagatgcacgacctgaattgcagctacaacatctgcccctactgtgcctcccggctgacgagtgacggcttggcccgccacgtcccgcagtgtcccaaacggaaggagaaggtggaggagaccgaactgtacttaaacctcgagcgcatcccctggatcgtgcggaaactgctgcaagtctccgagagcaccggggtggcactcaagcgcagctcatggcttatcgtgctcctcgtcctgctaaccgtgagcctcagcccagtgcagagcgccccagtcggccacgggaagacgatcgagacctaccagacccgggaaggcttcaccagtatctgcctgttcatgctgggcagcatcttattcctggtgtcctgcctggtgaaggggctcgtcgattccgtgtccgacagcttcttcccgggcctgtcagtatgcaagacgtgcagcatcgggtccatcaacggcttcgagatcgagagccacaagtgctactgctccctgctctgttgcccctactgtcgccactgtagcgccgaccgggagatccatcagctgcacctgtccatatgtaagaagcgcaagaccgggagcaacgtcatgctggccgtgtgcaagcggatgtgcttccgcgccaccatagaggcgtcccgccgggcgctgctgatccgcagcataatcaacaccacgttcgtcatctgcatcctcaccctgaccatctgcgttgtgagcacctccgccgtcgagatggagaacctgccctcgggtacgtgggagaaggaggaggatctgaccaacttctgccaccaggagtgccaggtgactgaaaccgagtgcctctgcccgtacgaggccctggtgctgcggaagcccctctttctggactccatcgtcaaggggatgaagaaccttctcaacagcacgtcccttgaaaccagcctgtccatcgaggccccctggggcgcgatcaacgtgcagagcaccttcaagcccaccgtgtcgaccgcaaacatcgccctcagctggtccagcgtcgagcaccgcgggaacaagatcctggtgacggggcggtccgagagcatcatgaagctggaggagcgcaccggcatctcttgggacctcggggtggaggacgccagcgagtccaagttactgaccgtcagcatcatggacctcagccagatgtactcccctgtgttcgagtacctcagcggcgaccgccaggtggaggagtggccgaaagcgacctgtacgggcgactgcccggagcggtgcggttgcacctccagcacgtgcctgcacaaggagtggccccactcccggaactggcggtgcaacccgacctggtgctggggcgtcggcaccggctgcacatgctgtggcgtggacgtgaaggacctctttaccgaccatatgttcgtcaagtggaaggtggagtacattaagaccgaggcaatcgtgtgcgtagagctgaccagccaggagcggcagtgctcactgatcgaggccgggacccgcttcaacctcggccccgtgaccatcaccctgagcgagccccggaacatccagcagaaactgcccccggagatcatcacgctccaccccaaggtagaggaggggttctttgacctgatgcatgtccaaaaagtgctgtcagccagcaccgtgtgcaagctccagtcctgcacccacggcatccccggggacctgcaagtctaccacatcggcaacctgctgaagggcgaccgcgtgaacgggcacctgatccacaagatagagccgcacttcaacaccagctggatgtcctgggacggttgcgacctggactactactgtaacatgggggactggcccagctgcacgtacaccggcgtgacccagcacaaccacgccgctttcgtcaacctcctgaacatcgagaccgactacacgaagaccttccactttcattccaaacgtgtgaccgcgcacggggatacgcctcagctggacctcaaggcccgccccacctacggcgccggcgagatcaccgtgctggtcgaggtcgccgacatggagctgcacaccaagaaggtggagatcagcgggctcaagttcgcgtccctggcctgcaccggctgctacgcctgcagctccgggatcagctgcaaggtccggatccacgtggacgagccggacgagctgacggtccacgtcaagagctccgaccccgacgtggtggctgcgagcacctccctcatggctcgaaagctggagttcgggaccgatagcaccttcaaggcattctccgccatgccaaagacgagcctgtgcttctatatcgtcgagcgggagtactgcaagtcctgcagcgaggaggacacccagcggtgcgtggacaccaagctcgagcagccccagtccatcctgatcgagcacaaggggaccatcatcggcaagcagaacgacacatgcaccgcaaaagccagctgctggctggagtccgtcaagtctttcttctacggcctcaagaacatgctggggtccgtgttcggcaacttcttcattgggatcctcttgttcctggcgccgttcgtgctgctcgtgcttttcttcatgttcggttggaaaatccttttctgctttaagtgctgccgccgggcccgcggactccttaagtaccggcacctgaaggacgacgaagagaccggctaccgcaagatcatcgagcggctcaacaacaagaagggaaagaaccgcctgctggacggggagcggctcgccgaccgcaagatcgccgagctgttcagcaccaagacccacatcggc

SEQ ID NO: 15440 - RNA, 3495 nt, synthetic construct
  misc_feature 1..3495: note = derived and/or modified CDS sequence (opt11) from CCHVF(CCHVF 4691-ST-2009)__KR814871.1__Gn-NSm-Gc
  source 1..3495: mol_type = other RNA
agcgaggagcccggtgacgactgcatctcccgcacgcagctgttgaaaaccgagacggccgagatccacgacgacaactacggaggcccgggggacaagatcaccatctgcaacggcagcaccatcgtggaccagcggctggggtccgagctgggctgctacaccatcaaccgcgtcaagagcttcaagctctgcgagaactctgccacgggcaagacctgcgagatcgacagcaccccggtgaagtgccggcaggggttctgcctgaagatcacccaggagggccgcgggcacgtgaagctgtcccggggcagcgaggtcgtgctcgacgcgtgcgactccagctgcgagatcatgatccccaaggggacgggcgacatcctggtggactgctcaggcgggcaacagcacttcctgaaggacaacctcatcgacctgggctgcccccacatcccgctgctcgggaagatggccatctacatctgccgcatgagcaaccacccccggaccaccatggccttcctgttctggttctcctttggctacgtcatcacatgcatcttctgcaaggccctattctacagcctcatcatcatcggcaccctggggaagaagatcaaacagtaccgcgagctgaagccccagacctgcaccatctgcgagaccgcccccgtgaacgcgatcgacgccgagatgcacgacctcaactgctcctacaacatctgcccgtactgcgccagccggctgacgagtgacggcctggcccgccacgtgacacagtgccccaaacggaaggaaaaggtcgaggagaccgagctctacctgaacctggagcgcatcccctggatcgtgcggaagctcctccaggtgagcgagtccacgggggtcgcgctgaaacgcagcagctggctcatcgtgctgctggtgctcctgacggtctccctgagccccgtgcagtccgccccggtgggccacgggaagaccatcgagacctaccaggcccgggagggcttcaccagcatctgcctcttcatgcttggctccatcctgttcatcgtaagctgcctcgtgaaggggctggtggactccgtcagcgactccttcttccccggcctgagcgtgtgcaagacgtgctccatcgggtccatcaacggcttcgagatcgagtcccacaagtgctactgcagcctcttctgctgcccgtactgccgccactgctccgccgaccgggagatccaccagctgcacctgagcatctgcaagaagcgccggaccgggtccaacgtgatgctcgcagtctgcaagcgcatgtgcttcaaggcgaccatcgaggccagccggcgtgccctgctgatccgctccatcatcaacaccacgttcgtaatctgtatcctcaccctggccatctgcgttgtgagcaccagcgccgtggagatggagaacctgcccgcgggcacctgggagcgggaggaggacctcacgaacttctgccaccaggagtgccaggtcaccgagaccgagtgcctgtgcccgtacgaggccctggtgctgcgcaagcccctcttcctggactccatcgtgaagggcatgaagaacctgctcaacagcacctccctggagacgtcactgtccatcgaggccccctggggcgccatcaacgttcagagcaccttcaagcccgccgtgtccaccgcgaacatcgccctcagctggtccagcgtggagcaccgggggaacaagatcctggtcaccgggcgctccgagagcatcatgaaactggaggagcggaccggtgtgtcttgggacctcggggtggaggacgccagcgagtccaagctgctgacggtcagcatcatggacctctcccagatgtacagcccggtgtttgagtacctgagcggcgaccgccaggtggaggagtggcccaaggcaacctgcaccggcgactgccccgagcggtgcgggtgcacctccagcacgtgcctgcacaaggagtggccccactcccgcaactggcggtgcaacccgacctggtgctggggcgtcgggaccggctgcacgtgctgcggcgtggacgtgaaggacctctttaccgaccacatgttcatcaagtggaaggtcgaatacatcaagaccgaggccatcgtgtgcgtggagttaaccagccaggagcgccagtgctccctgatcgaggccgggacccggtttaacctcggcccagttacgatcaccctgagcgagccccgcaacatccagcagaagctgcccccggagatcatcaccctccaccccaagatcgaggaggggttcttcgacctgatgcacgtgcagaaggtgctgtccgccagcaccgtctgcaagctccagtcctgcacgcacggcatccccggggacttacagatctaccacatcggcaacctgctcaagggggaccgggtgaacgggcacctgatccacaagatcgagccgcacttcaacacaagctggatgagttgggacggctgcgacctggactactattgcaacatgggggactggcccagctgcacctacaccggcgtgacgcagcacaaccacgccgccttcgtcaacctcctgaacatcgagaccgactacaccaagaccttccacttccactcaaagcgcgtcacggcgcacggggacacgccccagctggacctcaaggcccggcccacctacggcgccggcgagatcaccgtgctggtcgaggtggccgatatggagctgcataccaagaaggtggagattagcgggctcaagttcgcctccctggcgtgcaccggctgctacgcctgcagctccgggatcagctgcaaggtccgcatccacgtggacgagccggacgagctgactgttcacgtcaagtccagcgaccccgacgtggtggccgccagcaccagtctcatggcccggaagctggagtttggcacggacagcaccttcaaggcgttctccgccatgcccaagaccagcctgtgcttctacatcgtcgaacgcgagtactgcaagtcctgcagcgaggacgacaccaagaagtgcgtggacacgaagctcgagcagccccagtccatcctgattgagcacaaggggaccatcatcggcaagcagaacgacacgtgcaccgccaaggccagctgctggctggagtccgtcaagagcttcttctacggcctcaagaacatgctggggtccgtgttcggcaatttcttcgttgggatcctcctcttcctggccccgttcgtgctgctcgtcctgttcttcatgttcggctggaagatcctgttctgcttcaagtgctgccggcgcacccgcgggctgttcaaataccggcacctgaaggacgacgaggagaccggctaccgccggatcatcgaacgcctgaacagcaaaaagggcaagaaccggctcctggacggggagcgcctggcggacagaaagatcgccgagctgttctccaccaagacacacataggc

SEQ ID NO: 15441 - RNA, 3495 nt, synthetic construct
  misc_feature 1..3495: note = derived and/or modified CDS sequence (opt11) from CCHVF(CCHVF 4701-ST-2009)__KR814872.1__Gn-NSm-Gc
  source 1..3495: mol_type = other RNA
agcgaggagccgggcgacgactgcatctcccgcacgcagctacttaagaccgagacggccgagatccacgacgacaactacgggggcccgggggataagattaccatctgcaacggatctacggtggtcgaccagcggctcggatccgagctgggctgctacaccattaaccgcgtcaagagcttcaaactatgcgagaactccgccacgggcaagacatgtgagatcgacagcacccccgtgaagtgccggcaggggttctgtctgaagatcacccaggagggccgggggcacgtaaagctgtccaggggaagcgaggtggtgctcgacgcgtgcgactccagctgcgagatcatgatcccaaaagggacgggcgacatcctggtcgactgctccggcggacagcagcatttcttgaaggacaacctcatcgacctgggctgcccccacatcccactgctcgggaagatggccatctacatctgccgtatgagcaaccacccccggaccaccatggcattcctgttctggttctcctttggctatgtgatcacgtgcatcttctgtaaggccctcttctacagcctcatcatcatcggtacgctgggtaaaaagatcaagcagtatcgcgagctgaagccccagacctgtaccatctgcgagaccgccccagtgaacgcgatcgacgccgagatgcacgacttaaactgctcctacaacatctgcccgtactgcgccagccgcctgacgtccgacggcctggcccgccacgtcacccagtgccccaagcggaaagagaaggtggaggagaccgagctctacctgaacctggagcgcatcccctggatagtgcggaagttactgcaagtcagcgagtccaccggggtggcgctgaagcggagcagctggctcatcgtgctgctggtcctcttgacggtttccctcagccccgtgcagtccgcgccggtaggccacgggaagactatcgagacctaccagacccgggaaggcttcacgtccatatgcctctttatgttaggctccatcctcttcatcgttagctgcctcgtgaagggcctggtagactccgtgagcgactccttcttccccggcctgagcgtgtgcaagacctgctccatcgggtcgatcaacggtttcgagatcgagtcccataagtgttactgcagcctcttctgctgtccctactgccgccactgctccgccgaccgggagatccaccagctgcaccttagcatctgcaagaaacgcaagaccgggtccaacgtcatgctcgccgtttgcaagagaatgtgcttcaaggccacaatcgaggctagccgccgggcccttctgatccgctccatcatcaacacgaccttcgtcatgtgcatccttaccctggccatctgcgtggtgagcactagcgccgtcgagatggaggacctgcccgccggcacgtgggagcgcgaggaggacctcaccaacttttgccaccaggagtgccaggtgaccgagaccgagtgcttatgtccctacgaagcgttggtgctgagaaagcccctcttcctggactccatcgtcaagggcatgaagaacctgctcaactctacgtccctggagaccagcctgtccatcgaggccccttggggcgccatcaacgtgcaaagcaccttcaagcccaccgtgtccaccgccaacatcgccctcagctggtccagcgtcgaacaccgagggaacaagatcttagtgacggggcgatccgagagcatcatgaagttagaggagcgcaccggcgtgtcctgggacctcggggtcgaggacgcaagcgagtccaagctgctgaccgtgagcatcatggacctctcccagatgtactctccggtgttcgagtaccttagtggcgaccggcaggtcgaagagtggccaaaggcgacatgcacgggcgactgccccgagcgctgcggatgcacctctagcacatgtctgcacaaggagtggccccactcccggaactggcgctgcaacccgacctggtgttggggcgtagggaccggctgcacgtgctgcggcgtcgacgtcaaggacctgttcaccgaccacatgttcatcaagtggaaggtggagtacattaagaccgaagccatcgtgtgcgtcgagctgactagccaggagcggcagtgctccctgatcgaggccggaacccgcttcaacctcggccccgtgaccatcaccctgagtgagccccggaacatacagcagaagctgcccccggagatcatcacgctccaccctaagattgaggaggggttcttcgatctgatgcacgtgcagaaggtcctgtctgccagcactgtgtgcaagctccaatcctgcacccacggcatccccggggacctgcagatctaccacatcggcaatctgctcaagggggaccgtgtgaacgggcacctgatccacaagatcgagccgcacttcaacaccagctggatgtcatgggacggctgcgacctggactactactgcaacatgggggactggcccagctgcacgtacaccggggtaactcagcacaaccatgcagcgttcgtgaacctcttaaacatcgagaccgactacacgaagaccttccacttccactcgaagcgagtgaccgcccacggggacacgccccagctggacctcaaggcccgccccacctacggcgcgggcgagatcacagtcttggtcgaggtggccgacatggagctgcacaccaagaaggtcgagatctctgggctgaagttcgcctcccttacgtgcacgggctgctacgcctgcagctccggcatcagctgcaaggtgcggatccacgtggacgaaccggacgagctgaccgtccacgtgaaatccagcgaccccgacgtggtcgccgcgagcacgtccctcatggcccgcaagctggagtttggcaccgatagcacgttcaaagccttcagtgccatgcctaaaacatcgctgtgcttctatatcgtggagagagagtattgcaagtcctgctcagaagacgacaccaagaagtgcgtggacaccaagctcgagcaaccccagagtatcctgatcgaacataagggtaccatcataggcaagcaaaacgacacgtgcacagccaaggcgagctgttggttggaatccgtcaagagtttcttctacgggctcaagaacatgctcgggtccgtgttcggcgggttcttcgtgggcatcctcctcttcctcgccccgttcgttttattggttctcttcttcatgttcggctggaagatcttattctgtttcaagtgctgccgccgaaccagaggcctcttcaaataccgccacctgaaagacgacgaggagacaggctaccggcggatcatcgagcggctgaactcgaagaaggggaagaaccgactcctggacggcgaacggctggccgaccgcaagatcgccgaactcttctccacgaagacccacatcggg

SEQ ID NO: 15442 - RNA, 3495 nt, synthetic construct
  misc_feature 1..3495: note = derived and/or modified CDS sequence (opt11) from CCHVF(CCHVF 5170-R-2011)__KR814873.1__Gn-NSm-Gc
  source 1..3495: mol_type = other RNA
tcagaggagcctggcgacgactgcatatcgaggacccaactcctcaagaccgaaactgccgagatccacgacgacaactacggaggacccggcgacaagataacgatctgcaacggctccaccatcgtggaccaacgcctaggatccgagctgggctgctacaccatcaaccgtgtcaagagcttcaaattatgcgaaaactcagccaccggaaaaacgtgtgaaatagactccacacccgtcaaatgcagacaaggcttctgcctcaagatcacacaggaaggacgcggacatgttaaactttcccgaggaagcgaagtagtccttgacgtatgcgactcctcctgcgaaatcatgatacccaaggggacaggcgacatcctcgtcgactgctccggcggccaacaacatttcctcaaagacaacctcatagatttgggttgtcctcacatccccctactcggcaaaatggccatatacatatgcaggatgtccaaccaccctcgaaccacgatggcctttctattttggtttagcttcgggtacgtcatcacatgcatcttttgcaaagccctcttctacagtctcatcatcatcggcaccctaggaaagaaaatcaaacaataccgagaactcaaaccacaaacctgcacaatatgcgaaaccgcacccgtcaacgcaatcgacgccgaaatgcacgaccttaactgctcctacaacatatgcccctactgcgcttcccgcctaacctccgagggcttggcgagacacgttacccaatgcccaaaacgcaaagaaaaagtcgaagaaacggaactctacctgaatctggaaagaatcccgtggatagtgcgcaaactactgcaggtctcagaaagcaccggtgtcgccctcaaacgatccagctggctaatcgtattacttgtcctacttaccgtatccctatcccccgtccagtcggctcccgtcggccacggcaaaaccatcgaaacttaccaaacccgagaaggcttcaccagcatatgcctctttatgctgggctctatactgttcatcgtttcgtgcctagttaaaggcctagtagactccgtatccgactccttcttccccggattatcggtatgcaaaacctgctcgatcggaagcataaatggcttcgaaatcgaatcacacaaatgctactgcagcctcttttgctgcccatactgcagacactgcagcgccgacagagaaatccatcaactacacctaagtatatgcaagaaacgcaaaaccggctccaacgttatgctcgccgtatgtaaaagaatgtgcttcaaagcaacaatagaagccagccgccgcgcgctcctaatccgctccatcatcaacaccaccttcgtcatatgtatcttaacgcttgctatatgcgtcgtatcgacaagcgctgtagagatggaagaccttccagcaggaacttgggaacgcgaagaagaccttaccaacttctgccaccaagaatgccaggtcaccgaaactgaatgcctttgcccatacgaagccctcgtgctacgcaaacccctttttctagacagcatcgtcaaaggcatgaagaatctcctcaactccacatccctagaaacttccctttcgatagaagcgccgtggggcgccatcaacgtccaatcgacgtttaaaccaacagtatccaccgccaacatcgccttatcatggtcatccgtagaacaccgaggcaacaaaattcttgtaacaggccgctccgagtcaatcatgaagctcgaggaaagaaccggcgtttcctgggatctcggcgtcgaagacgcatcggaatctaagctactcacggtaagcataatggacctatcacagatgtactccccagtcttcgagtacctatcaggagaccgacaagtcgaagaatggcccaaagctacatgcaccggggattgcccagaacgatgcgggtgcacttcctctacatgcctacacaaagaatggccccactcccgcaactggagatgcaatcctacctggtgttggggcgtcggaacaggatgtacatgctgcggcgtcgacgtcaaagacctgttcacggaccacatgttcataaaatggaaagtagagtacatcaaaactgaggcaatagtatgcgtagagctcacaagccaggagcgccagtgctcacttattgaggccggcacgcgattcaatctaggacccgtcaccattacacttagcgaaccacggaacattcagcaaaaactcccacccgaaatcatcaccctccaccccaaaatcgaggaaggcttcttcgacctcatgcatgtccaaaaagtactatcagcatccaccgtgtgcaagctgcaaagctgcacacatggaatccccggagacctccaaatttatcatatcggcaatctactcaaaggagaccgagtaaacggtcacctcattcacaaaatagaaccacactttaacaccagctggatgtcctgggacggctgtgacctagactactactgcaacatgggagactggccctcgtgcacatacaccggcgtcacccaacacaaccacgctgctttcgtcaatcttctcaacatcgagaccgactacaccaaaacattccacttccactccaaaagggtcaccgcacacggcgacacaccccagctcgacctgaaggcacggcccacatacggtgccggcgagataaccgtcctagtagaggtggccgacatggaactacacaccaagaaagtcgaaatctccggactaaaattcgcatcactaacctgcactggctgctacgcctgctcaagcggcatttcctgcaaagtccgcatccacgtagacgaaccggacgaattaacagtacacgttaaaagctcagatcccgacgttgttgccgcttccacttcccttatggcaaggaagctagagttcggcaccgatagcacattcaaggccttcagcgcaatgccgaaaacatccctatgcttctacattgtggaacgcgaatactgcaaatcttgctccgaggacgacaccaaaaagtgcgtcgacacaaagctagaacagccccaatccatcctcatcgaacataaaggaaccataatcggaaagcaaaatgacacatgcaccgcaaaagcatcatgctggctcgagagcgtcaaatccttcttctacgggctcaaaaacatgctagggagcgttttcggatcgttcttcgtggggattctactattcctcgcacccttcgtactgctagttctattcttcatgttcggatggaagatcctattctgcttcaaatgctgtcgccgtactcgcggactattcaaataccgccatctcaaagacgatgaggaaacgggatatcgccgtattatcgaacgactgaactccaagaaaggcaaaaatagactactcgacggcgagcgcctcgcagaccgcaagatagcagaactcttctctacgaagacgcacatagga

SEQ ID NO: 15443 - RNA, 3495 nt, synthetic construct
  misc_feature 1..3495: note = derived and/or modified CDS sequence (opt11) from CCHVF(CCHVF Oman-199809166)__KR864901.1__Gn-NSm-Gc
  source 1..3495: mol_type = other RNA
agcgaggagtccggcgaggactgtatcagccgcacccaactgctccggaccgagacagccgagatccacggtgacaactacggcgggcccggcgacaagatcaccatctgcaacgggtccactatcgtggaccagcgcctgggcagcgagctgggctgctacaccatcaaccgggtcaagtccttcaagctctgcgagaacagcgccacggggaagtcctgcgagatcgacaacaccccggtgaagtgcaagcagggcttctgcctgaagatcacccaggaggggcgcggccacgtgaagctgagccgggactccgaggtcgtgctcgacgcgtgcgactcgtcctgcgagatcatgatccccaaggggaccggtgacatcctggtggactgcagcggcgggcagcagcacttcctgaaggacaacctcatcgacttgggctgccccaacatccccctgctcgggaagatggccatctacatctgccgcatgtccaaccacccgaagacgaccatggccttcctgttctggttcagcttcggctacgtcatcacgtgcatcctgtgcaaggtgatcttctacctcctgatcgtggtgggcaccctggggaagaagttcaagcagtaccgggagctcaagccccagacctgcaccatctgcgagaccacccccgtgaacgccattgacgccgagatgcacgacctgaactgctcctacaacatctgcccctactgcgcgagccgcctgacgtccgacggcctcgcccggcacgtgatgcagtgcccgaagcgcaaggagaagatcgaggagaccgagctgtacctgaacctcgagcggatcccctgggtcgtgcgcaagctgctccaggtatcagagtccaccggggtcgcgctcaagcggagcagctggctgatcgtgctgctcgtgctgctgaccgtatccctcagccccgtgcagtccgcccccatcggccacgggaagacgatcgagacctatcagacccgcgagggctacacctccatctgcctgttcgtgctgggctccatcctcttcatcgtcagccacctgatgaaggggctggtggactcggtgggcaacagcttcttcccggggctctccatctgcaagacgtgcagcatcggctccataaacgggttcgagatcgagagccacaagtgctactgctccctgttctgctgcccctactgccggcactgcagcgcggacaaggagatacacaaactgcacctctccatctgcaagaagcgcaaggccggcagcaacgtcatgctggccgtgtgcaagcggatgtgcttccgtgccaccatggaggtctccaacaaggccctgctcatccggagtgtgatcaacaccaccttcgtggtctgcatcctgatcctggcggtgtgcgtggtctccacgagcgccgtggagatggagagcctccccgccggcacctgggagcgcgaggaggacctgaccaacttctgccaccaggagtgccaggtgaccgagacagagtgcctgtgcccctacgaggccctggtcctccggaagccgctgttcctggactccatcgccaaggggatgaagaacctcctgaacagcacctccctagagacaagcctctccatcgaagcgccctggggcgccatcaacgtgcagagcaccttcaagcccacggtgtccaccgccaacatcgccctgagctggtccagcgtcgagcaccgcgggaacaagatcctggtgtccggccgcagcgagtccatcatgaaactggaggagcggaccgggatcagctgggacctgggcgtggaggacgcctccgagagcaagctgctcaccgtctccgtgatggacctgagccagatgtacagccccgtgttcgagtacctgtccggcgaccgccaggtcgaggagtggccgaaggcgacctgcacgggggactgccccgagcggtgcggctgcaccagctccacgtgcctccacaaggagtggccccacagccgcaactggcggtgcaaccccacctggtgctggggcgtggggaccggctgcacgtgctgcgggctagacgtgaaggacctgttcaccgactacatgttcgtcaagtggaaggtggagtacatcaagaccgaggcaatcgtgtgcgtcgagctcacctcccaggagcgccagtgcagcctgatcgaggccggcacccggttcaacctggggccggtgaccatcaccctctccgagccccgcaacatccagcaaaagctgccgcccgagatcgtgacgctgcacccccggatcgaggaggggttcttcgacctcatgcacgtccagaaggtgctgagcgcatccaccgtgtgcaagctgcagagctgcacccacggggtccccggcgacctccaggtgtaccacatcggcaacctgctgaagggggacaaggtgaacggccatctcatccacaaggtcgagccccacttcaacacctcctggatgagctgggacgggtgcgacctggactactactgcaacatgggcgactggccgtcctgcacttacaccggggtgacccagcacaaccacgccgcgttcgtgaacctgctcaacatcgagaccgactacacaaagaacttccacttccacagcaagcgcgtcaccgcccacggcgacacgccccagctggacctgaaggcccggcccaactacggcgccggcgagatcaccgtgctcgtggaggtcgcagacatggagctgcacaccaagaagatcgaaatctccggcctgaagttcgccagcctgacctgcaccgggtgctacgcctgctccagcggcatctcctgcaaggtgcgcatccacgtggacgagcccgatgagctgaccgtccacgtcaagagcgaggacccggacatcgtggccgcaagctccagcctgatggcgcggaagctcgagttcgggacggactcaaccttcaaggccttcagcgccatgcccaagacctccctgtgcttctacatcgtggagcgcgagtattgcaagagctgctccaaggaggacacccagaaatgcgtgaacgccaagctcgaacggccacagagcatcttaatcgagcacaagggcacgatcatcggcaagcagaacgacacgtgcaccgccaaggcgtcctgctggctggaaagcgtgaagtccttcttctacgggctgaagaacatgctcagcggcatcttcgggaacgtcttcatcggcatcttccttttcctggcccccttcatcctcctgatcctgttcttcatgttcgggtggcgcatcctcttctgcttcaagtgctgccggcgcacccggggtctgttcaagtaccgccacctgaaggacgacgaggagaccggctaccgcaagatcatcgagcggctcaacaacaaaaagggaaagaacaagctgctggacggcgagcgcctcgccgaccggaagattgccgagctgttctccaccaagacccacatcgga

SEQ ID NO: 15444 - RNA, 3495 nt, synthetic construct
  misc_feature 1..3495: note = derived and/or modified CDS sequence (opt11) from CCHVF(CCHVF 200406546-Turkey)__KR864902.1__Gn-NSm-Gc
  source 1..3495: mol_type = other RNA
agcgaggaacccggagacgactgtatctcccgcacccagctgctccggaccgagactgctgagatccatgacgacaactacgggggtccgggggacaagatcaccatctgcaacgggagcaccatcgtggaccagcgcctggggtccgagctgggctgctacaccatcaacagggtcaagagcttcaagctctgcgagaactccgccacgggcaagacatgtgagatcgacagcacccccgtgaagtgccgccaggggttctgcctgaagatcacccaggagggcagggggcatgtgaagctgtcccgcggaagcgaggtcgtgctcgacgtatgcgactccagctgtgaggtcatgatccccaaggggacgggcgacatcctagtggactgcagcggcggtcagcaacacttcctgaaagacaacctcatcgatctgggctgcccccacgtgccgctgctcgggcggatggcgatctacatctgccgaatgagcaatcacccccggaccaccatggccttcctattctggttctccttcggctatgtcatcacgtgcatcttctgcaaggccctgttctacagcctcatcatcatcggtaccctggggaaaaagttcaagcagtaccgcgagctgaaaccccagacctgcaccatctgcgagactgcccccgtgaacgccatcgacgcggagatgcacgacctcaactgctcctacaacatctgcccgtactgcgccagccggctgacgtcagatggtctggcccgccacgtgccccagtgccccaagcggaaggagaaggtagaggagaccgagctctacctgaacctggagcgcatcccctggatcgttaggaagctcctccaggtgagcgagtcaaccggggtcgcgctgaagcgcagcagctggctcatcgtgctgctggtgctgctgaccgtctccttgagcccggtgcagtccgcgcccgtgggccacgggaagacgatcgagacctaccagaccagagagggcttcaccagcatctgcctcttcatgctgggctccatcttgttcatcgtcagctgcctcgtgaaggggctggtggactccgtcagcgattccttcttccccggcctgagcgtgtgcaagacgtgctccatcgggtccatcaacggtttcgagatcgaatcccacaaatgctactgcagtttgttctgctgcccctactgccgccactgctccgccgaccgggagatccaccagctgcacctgagcatatgcaagaagcgcaagaccgggagtaacgtcatgcttgccgtgtgcaagcggatgtgcttccgcgccaccattgaggccagccgccgtgcgctgctgatccgctccatcatcaacaccacgttcgtgatctgcatccttaccttaaccatctgcgtcgtgtcgaccagcgccgtggagatggaaaacctgccggccggcacgtgggagcgagaagaggacctcaccaacttctgccaccaagagtgccaggtcaccgagaccgagtgcctgtgcccctacgaggccctggtgctgcgcaagcccctcttcctggactccatcgtgaagggcatgaagaacctgctcaacagcacgtccctggagaccagcctgtccatcgaggccccctggggcgcgatcaacgtacagagtaccttcaagccgaccgtgtccaccgccaacatcgccctctcgtggtcgagcatcgagcaccgggggaacaagatcctggtgacggggcgctccgagagcatcatgaagctggaggagcggaccggcgtctcctgggacctcggggtggaggacgccagcgagtccaagctgctgaccgtgagtatcatggacctctcccagatgtacagccccgtcttcgagtacctgagcggcgaccgccaggtggaggagtggcccaaggcgacctgcacgggcgactgccccgagaggtgcggatgcacctcctcgacgtgcctgcacaaggaatggccgcacagtcgcaactggcggtgcaaccccacctggtgctggggcgtggggaccggctgcacgtgctgcggcgtcgacgtgaaggacctcttcaccgaccacatgttcgttaaatggaaggtcgagtacatcaagaccgaggcaatcgtgtgcgtggagctgaccagccaggagcgccagtgctccctgatcgaggccgggaccaggttcaacctcggtcccgtcacgatcaccctgagcgagccccgcaatatccagcagaagctgccgcccgagatcatcacactccaccccaaggtggaggaggggttcttcgacttgatgcacgtgcagaaggttctgagcgcctcaaccgtgtgcaagctccagtcctgcacccacggcatccctggggacttacaggtgtaccacatcggcaacctgctcaagggcgaccgggtcaacgggcatctgattcacaagatcgagccccacttcaacaccagctggatgagttgggacggctgcgacctggattactactgcaacatgggggactggccttcatgcacgtacaccggcgtgacccagcacaaccacgccgccttcgtaaacctcctgaacatcgagaccgactacacgaagaccttccacttccattccaagcgcgtcaccgcccacggggacacgccccagcttgacctcaaggcgcgtccgacgtacggcgccggcgagatcaccgtgttagtagaggtcgccgacatggagctgcacaccaagaaggtggaaatcagcgggctcaagttcgcgtcgctggcctgcaccggctgctacgcgtgtagctccgggatcagctgcaaagtgcgcatccatgtcgacgagcccgacgagctgaccgtgcacgtaaagtccagcgaccccgacgtcgtggcagccagcacctccctcactgcgcggaagctggagttcggcaccgacagcacgttcaaggcattctccgccatgcccaagaccagcctgtgcttctacatcgtcgagaaggagtactgcaagagctgcaacgaggacgacacacagaagtgcgtcgacaccaagctcgagcagccgcaaagcatcctgatcgagcacaaagggaccatcatcggcaagcagaacgacacgtgcaccgccaaggccagttgctggctggagtccgtgaagagtttcttctacggcctcaaaaacatgctggggagcgtgttcggcaactttttcatcggtatcctgctgttcctggcgcccttcgtcctgctagtgcttttcttcatgttcggctggaagatcctgttctgcttcaagtgctgccgccgcacccggggcctcttcaagtaccgccacctgaaggacgatgaggagacagggtacaagcggatcatcgagcgcctgaacaacaagaagggcaagaaccggctcctggacggggagcgccttgccgaccggaagatcgccgagctgttctccactaagacccatatcggc

SEQ ID NO: 15445 - RNA, 3495 nt, synthetic construct
  misc_feature 1..3495: note = derived and/or modified CDS sequence (opt11) from CCHVF(CCHVF 1-CR/HU-2015)__KU161584.1__Gn-NSm-Gc
  source 1..3495: mol_type = other RNA
tccgaggagcccggcgacgactgtatttcccgcacccagctgctacggacggagacggccgagatccacgacgacaattacgggggaccgggggacaagatcacaatctgcaacggtagcaccatcgtggaccaacgcctggggtccgagctggggtgctatactatcaaccgggttaagtcgttcaagctctgtgaaaattccgccacagggaaaacctgcgagatcgacagtaccccggtaaagtgtcgccaggggttctgcctgaagatcacccaggagggccgggggcatgttaagctgtcccgcggctccgaggtcgtgcttgacgcgtgtgactccagctgcgaggtgatgatccccaaggggacgggtgacatcctggtcgactgctccggcgggcagcagcacttcctcaaggataatttaatcgacctgggctgtccccacatcccgttgctcggaaaaatggctatatacatctgccggatgagcaaccacccacgtaccaccatggccttcctgttctggttctccttcggctacgttatcacgtgcatcttttgcaaggccctgttttacagcttaatcatcatcggcaccttagggaagaagattaagcagtatcgggaactcaagccgcagacctgcacaatctgcgagaccgcccccgtgaacgctatcgacgccgagatgcacgacctcaactgctcctacaacatttgcccatactgcgccagcagacttacgagtgacggccttgcccgtcacgtcacccagtgcccgaagcgtaaagagaaggtggaggagaccgagttatacctaaacctggaacggatcccctggatcgtacgcaagctcctccaggtcagcgagtccacaggggtggcgcttaaacggtcaagctggctcatcgttctgctggtcctccttacggtttctctgtcgcccgttcagtccgccccggtcggccacggaaagactatcgaaacctaccagacccgtgaaggctttacgagcatctgcctcttcatgctgggctccatcctgttcattgtgagctgtctcgtgaagggtctggtcgactccgtgtcagatagcttcttccccggcctgagcgtgtgccgaacctgctccatcgggagcatcaacggcttcgagatcgagtcacacaagtgttactgcagcctgttctgttgcccctactgccgccactgctccgcggaccgagagatccaccagttgcacctgagcatctgcaaaaagcgcaaaaccgggtcaaacgtcatgttagccgtgtgcaagcggatgtgctttcgcgccaccatggaggcgagccgacgggcactgctgatccggtccatcatcaacacgaccttcgtcatctgcatcctcaccctgaccatctgtgtggtaagcacgagcgccgtcgaaatggaaaaccttcctgcaggcacctgggagcgagaggaggacctcaccaacttctgccaccaagagtgccaggtgaccgagacggagtgcctgtgcccgtacgaggccttggtactgcgcaagcccctgttcctggactccatcgtcaagggcatgaagaaccttctcaacagcacctccctggagaccagcctctccattgaggcgccctggggcgccatcaacgtgcaatccacctttaagcccacggtgtccacggccaacatcgccttgagctggtccagcgtcgagcaccgggggaacaagatcctggtgactggacgctccgagagcatcatgaagctggaggagcggaccggagtgtcatgggacctcggggtcgaggacgccagcgagtccaagctactgaccgtgagcatcatggacctgtcccaaatgtacagcccggtgttcgagtacctgtccggcgaccgccaggtcgaggaatggcccaaggcaacgtgcaccggcgactgccccgagaggtgtgggtgcacctccagtacgtgcctgcacaaggagtggccacatagcaggaactggaggtgcaatccgacctggtgttggggagtgggcaccggctgcacatgctgcggcgtggacgttaaggacctcttcaccgaccacatgttcgtgaagtggaaggtggagtatatcaaaaccgaagccatcgtttgcgtggaactgacaagccaggagcgccagtgctctctgatcgaagccgggacccggttcaacctcggccccgtgaccatcacgctgtctgagccccggaacattcagcagaagctacccccggaaataataaccctgcaccccaaaatcgaggaggggttcttcgacctgatgcatgtccagaaggtgctgtccgcgagtaccgtgtgcaaacttcagtcctgcacccacggcatccccggcgacctgcaggtctaccacatcgggaacctgctcaagggggaccgggtgaacgggcatctgatccataagatcgagccacatttcaacacgagctggatgtcctgggatggctgcgacctggactactactgcaatatgggggactggcccagctgcacctacaccggcgttacccagcacaaccacgccgccttcgtcaacttactgaacatcgagacggattacaccaagacgttccacttccattccaagcgcgtgacagcccacggagacacgccccagctggacctcaaggcccggccaacctacggcgccggcgaaatcaccgtgctggtggaggtagcggacatggagctacacaccaagaaggtcgagattagcgggctcaagtttgcctccctggcctgcactggctgctatgcctgctcctccgggattagctgtaaggtccggattcacgttgatgagcctgacgagctgaccgtgcacgtcaagtccagcgaccccgatgtggtggccgcaagcacctcccttatggctcggaagctggagttcggcaccgacagcacgttcaaggccttctccgccatgcccaagacgagtctgtgcttctacatcgtcgagcgcgagtactgcaagtcctgcagcgaggatgacactaagaagtgcgtggacaccaagctcgagcagccccagtccatcctgatagagcataaggggaccattatcggcaagcagaacgatacctgcaccgccaaggcatcctgttggctggagtccgtcaagtcgttcttctacggcctcaaaaacatgctggggtccgtgttcggcaactttttcatcgggatactcctcttcctggccccgttcgtgttgttggtgctgtttttcatgttcggatggaaaatcctgttctgcttcaaatgttgccggagaacccgcggcctcttcaagtaccggcacctgaaggacgacgaggagaccgggtatcgccggatcattgagcgcttaaacaacaagaagggcaagaaccggctcctggacggcgaaaggctggccgacagaaagatcgccgagctgttctctactaagacacacatcggc

SEQ ID NO: 15446 - RNA, 3495 nt, synthetic construct
  misc_feature 1..3495: note = derived and/or modified CDS sequence (opt11) from CCHVF(CCHVF 1231-CR/TI-2015)__KU161585.1__Gn-NSm-Gc
  source 1..3495: mol_type = other RNA
agcgaggagcccggcgacgactgcatctcccgcacccagctgctcagaacagagacggccgagatccacgacgacaattatgggggcccgggggacaagatcaccatctgcaacggttcgacgatcgtcgaccagcgccttgggtccgaactgggctgctacaccatcaaccgggtcaagtccttcaagctctgtgagaactccgccacgggcaagacctgcgagatagacagcacccccgtgaagtgccgccaggggttctgcctgaagatcacccaggaaggtcgggggcatgtcaagctgtctcgcggctccgaggtcgtgctcgacgcgtgcgactcaagctgcgaggtgatgatccccaaggggacgggcgatatcctggtcgactgcagcggcggccagcaacacttcctgaaggacaacctcatcgaccttggctgcccccacatcccgctgctcgggaaaatggccatctacatatgccggatgagcaaccacccccgcacgaccatggcgttcctgttctggttcagtttcggctacgtgatcacgtgtatcttctgcaaggccctgttctatagcctcatcatcatcggcaccctggggaagaagatcaagcagtaccgggagctgaagcctcagacctgcaccatctgcgagacggcccccgtgaacgccatcgacgccgagatgcacgacctgaactgctcctacaacatctgtccgtactgcgccagcagactgacgtccgacggcctggcccggcacgtcacccagtgcccaaagcgcaaggaaaaagtggaggagaccgagctctacctgaacctcgagcggatcccctggatcgtgcgcaaactcctacaggtcagtgagtcgaccggcgtggcgctgaagcgatctagttggctcatcgtgctgctagtcctcctaactgtcagtctgtctcccgtacagtccgcccctgtcggccacgggaagactatcgagacgtaccagacccgcgagggctttacaagcatctgcctcttcatgctgggctccatcctgttcatcgtgagctgtctcgtgaaagggctggtcgagtcggtgagcgactcgttcttccccggcctgagcgtgtgccggacctgctccatcgggagcatcaacggcttcgagatcgagtcccacaagtgctactgcagcctcttctgctgcccctactgccgacactgctctgccgaccgggagatccaccagctgcacctgagcatctgcaagaagcgcaagacgggatctaacgtcatgctcgccgtgtgcaagcggatgtgcttccgcgcaaccatggaagcgagccgccgggccctgctaatccgctccatcatcaatacgaccttcgtcatctgcatcctgaccctgaccatctgcgtcgtgtctacgtccgccgtcgagatggagaacctgcccgccggaacatgggagagagaggaggacctcaccaatttctgccaccaggagtgccaggtgaccgaaacggagtgcctatgcccttacgaagcccttgtgctgaggaagcccctcttcctggattccatcgtcaagggcatgaagaacctgcttaacagcacctccctggagaccagcctatccatcgaggccccctggggtgccatcaacgttcagagcaccttcaagcccaccgtgtctacagccaacatcgccctcagctggagtagtgtcgagcaccggggtaataagatcttggtgaccgggcgctccgagagcatcatgaagctggaggaaagaaccggcgtgtcctgggacctcggggtggaggacgccagcgaaagtaagctgctgaccgtgagcatcatggacctctcgcaaatgtacagcccggtattcgagtatttgagcggcgaccgtcaggtcgaggagtggcccaaggcgacgtgcaccggcgactgccccgagcggtgcgggtgcaccagtagcacgtgcctgcacaaggagtggccccactccagaaactggcggtgcaacccgacttggtgctggggcgtggggaccggctgcacgtgctgcggcgttgacgtcaaggacctcttcaccgaccatatgttcgtgaagtggaaggttgagtacatcaagaccgaggccatcgtctgcgtggagctgaccagccaggagcgccagtgctccctgattgaggccgggacgcggttcaacctcggccccgtgaccatcacgctgagcgagccccgcaacatacagcagaagttacccccggaaatcatcaccctccaccccaagatcgaggaggggttcttcgacttgatgcacgtacagaaagtgctctccgccagcaccgtgtgcaagctccagtcctgcacccacggcatccccggggacctgcaggtttaccacataggcaacctgctcaagggcgaccgggtgaacgggcacctgatccacaagatcgagccacacttcaacacgagctggatgtcctgggacggctgcgacctggactactactgtaacatgggggactggccctcatgcacctacaccggcgtgacccagcacaaccacgccgcgttcgtcaacttgctgaacatcgagaccgactacaccaagaccttccacttccactcaaagcgcgtcaccgcccatggggacacgccccagttagacctcaaggcccggcccacctacggcgccggcgagatcacagtgttagtcgaagtagccgacatggagctgcacaccaagaaggtggagatcagcggcctcaagttcgcgtcccttgcctgcacgggctgctacgcctgcagcagtgggatctcatgcaaagtccgcatccacgtggacgaaccggacgagctgaccgtgcacgtcaagtccagcgacccagacgtggtggccgcgagcacctccctcatggccaggaagttggagttcggcaccgacagcaccttcaaggcattttccgccatgcccaagaccagcctgtgcttctacatcgtagaacgcgagtactgcaagtcctgcagcgaggacgataccaagaagtgtgtggacaccaaactcgagcagccccagtccatcctgatcgagcataagggaacgattatcggcaaacagaacgacacttgcaccgccaaggcgagctgctggttagaatccgtcaagagctttttctacggcctcaagaacatgctggggtccgttttcggcaacttcttcatcgggatcctcctatttctggccccgttcgtgctgctcgttctgttcttcatgttcggttggaagattctgttctgcttcaagtgctgccgccggaccagaggcctcttcaagtaccggcacctgaaggacgacgaggaaaccgggtaccgccggatcatagaacgcctgaacaataagaaggggaagaaccggctcctggacggggagcgccttgccgaccggaagatcgccgaactgtttagcacgaagacccatattggc

SEQ ID NO: 15447 - RNA, 3495 nt, synthetic construct; identical to SEQ ID NO: 12161
  misc_feature 1..3495: note = derived and/or modified CDS sequence (opt11) from CCHVF(CCHVF Gaib)__KX013445.1__Gn-NSm-Gc
  source 1..3495: mol_type = other RNA

SEQ ID NO: 15448 - RNA, 3495 nt, synthetic construct
  misc_feature 1..3495: note = derived and/or modified CDS sequence (opt11) from CCHVF(CCHVF Hodzha)__KX013448.1__Gn-NSm-Gc
  source 1..3495: mol_type = other RNA
agcgaggagtccggcgacgactgtatcagccgcacccagctgctccggaccgagacggccgagatccacggggatgactatggcgggcccggcgacaagatcacgatctgcaacgggtccaccatcgtggaccaacgcctgggaagcgagctgggctgctacaccatcaaccgggtcaagagcttcaagctctgcgagaactccgccacggggaagtcctgcgagatcgacagcactccggtgaagtgccgccagggatactgcctgaagatcacccaggaggggcggggccatgtgaagctgtcccgcgggagcgaggtcgtgctcgacgcgtgcgactccagctgcgaggtgatgatccccaagggcaccggcgacatcctggtcgactgctccgggggccagcagcacttcctgaaagacaacctcatcgacctggggtgcccccggatccccctgctaggcaagatggccatctacatctgccgcatgagcaaccacccggagacaaccatggccttcctgttctggttctccttcggctatgtgatcacatgcatcttatgcaaggccatcttctacctcctgatcatcgtggggaccctgggcaagcggttcaagcagtacagggaactcaagccgcagacctgcacgatctgcgagaccacccccgccaacgcgatcgacgccgagatgcacgacctcaattgcagctacaacatctgcccctactgcgcctccagactgacgagcgacgggctcgctcgccacgtaacccagtgtccgaagcggaaggagaaggtcgaggagaccgagctgtacctgaacctcgagcgcatcccctggatcgtgcggaagctgctgcaggtctccgagagcaccggcgttgcgctcaagcgcagctcctggctgatcgtgctgctcgtcctgttcgccgtgagcctgtcccccgtgcagagcgctcccattggtcatggcaagacgatcgaaacctaccaggcccgggaggagtacacctccatttgcctcttcgtgctgggcagcatactgttcatcgtgtcctgcctcatgaaggggctggtggacagcatcgggaacatattcttcccggggctaaccatctgcaagacgtgctccataggcagcatcaacggtttcgaaatcgagtcccacaagtgctactgcagcttactgtgctgcccctactgccgccactgccccgccgaccgggaaatccatcagctgcatctctccatctgcaagaagcgcaagaccggcagcaacgtcatgctggcggtgtgcaagcggatgtgcttccgcgccacgatggaggtgtccaacaaggcgcttctcatccgcagcatcatcaacaccactttcgtcgtgtgcatcctgatcctggccgtctgtgtggtgtccactagcgccgtcgagatggaatccctccccgcgggcacctgggagcgtgaggaggacctaaccaacttctgccaccaggagtgccaggtaacggagaccgagtgcctctgcccgtacgaggccctggtgctccgccgacccctgttcctggacagcatcgtcaaggggaagaagaacctcctgaacagcacctccctggaaacctcgctctccatcgaggccccctggggcgccatcaacgtgcagagcacgtacaagcccaccgtgtccaccgccaacatcgcgctgtcgtggagtagcgtcgagcaccgcggtaacaagatcctggtgtccggacggtcggagtccatcatgaaactcgaggagcgcaccgggataagctgggacctgggcgtggaggatgcatccgagagtaagctgctcaccgtgtcggtcatggacctgagccagatgtactccccggtgttcgagtacctgagcggcgaccggcaggtcgaagagtggcccaaggccacgtgcactggggattgcagcgagcgctgcggctgcacctccagcacgtgcctccacaaggagtggccccactcccggaactggcgctgcaaccccacctggtgctggggcgtagggaccggctgcacgtgctgcgggctggacgtgaaggaccttttcaccgactacatgttcgtcaagtggaaggttgactacatcaagaccgaggccatcgtgtgcgtcgagctcaccagtcaggagcggcagtgctcattggtggaggccggcacccggttcaacctggggccggtaacgatcacgctcagcgagccgcggaacatccagcagaagctgccgccggagatcatcaccctgcacccccgcatcgaagaaggcttcttcgacttaatgcacgtccagaaggttttaagtgctagcaccgtgtgcaagctgcagtcctgcacccacggggtccccggcgacctccaggtctaccacatcggcaacctgctgaagggggacaaggtgaacggccacctcatccacaagatcgagccccacttcaacacaagctggatgtcctgggacgggtgcgacttagactactactgcaacatgggcgactggccgtcctgcacctacaccggggtcacccagcacaaccacgcctccttcgtgaacctgctcaacatcgagacggactacaccaagtcgttccactttcactccaagcgggtgaccgcacatggcgacacgccccagctggacctgaaggcccgccccacctacggcgcgggggagatcacagtcctcgtggaggtggccgacatggaactgcataccaagaagatcgagattaccggcctgaagttcgccagcctcacgtgcaccgggtgctacgcctgctccagcggcatctcctgcaaggtcagaatccacgttgacgagccagatgagctgaccgtgcacgtcaagagcgacgacccggatgtggtcgccgcgagctccagcctgatggcgaggaagttagagttcgggaccgactcaacgttcaaggccttctccgccatgcccaagacctctctgtgcttctacatcgtagagcgggagtactgcaagagctgctccaaggaggacacccagaagtgcgtgaacaccaagctggaacaaccccagagcatcctcatcgagcagaagggcacgatcatcggcaagcagaacaacacgtgcaccgccaaggcgtcctgctggctggagagcgtgaagtccttcttctacggcctgaagaacatgctcagcggcatctttggaaacgtgtttgtggggatcttcctgttcctggcccccttcatcctcctgatcctgttcttcatgttcggatggcgcatcctcttctgcttcaagtgctgtcgccggacccgcggccttttcaagtacaagcacctgaaggacgacgaggagaccggttaccggcgcatcatcgagcggctcaacaacaagaaggggaagaataagctgctggacggcgagcgtctggccgaccggcgcatcgccgagctgttctccaccaagactcacatcggg

SEQ ID NO: 15449 - RNA, 3495 nt, synthetic construct
  misc_feature 1..3495: note = derived and/or modified CDS sequence (opt11) from CCHVF(CCHVF IbAn7620)__KX013451.1__Gn-NSm-Gc
  source 1..3495: mol_type = other RNA
agcgaggagccctccgacgactgcataagccgcacccaactgctccggaccgagacggccgagatccacggcgacaactacgggggccctggggacaagatcaccatctgcaacggctccaccatcgtcgaccagcgcctggggagcgagctgggctgctacacgatcaaccgggtcaaatcctttaagctctgcgagaacagcgccacgggcaagaactgtgagatcgactctgtgcccgtgaagtgtcgccagggctactgcctgcggatcacccaggagggccgagggcacgtcaagctgtcgcggggctccgagatcgtgctcgacgcgtgcgacacctcatgcgagatcatgatccccaagggtaccggcgatatcctggtggactgctccggcgggcagcaacacttcctgaaggacaacctcatcgacctgggttgccccaagatcccgctgctcggcaagatggccatctacatctgccgcatgagcaaccaccccaagacgaccatggccttcctgttctggttctccttcggctacgtcatcacctgtatcctgtgcaaggccatcttctacctcctgatcatcatcggcaccctggggaagcggctaaagcagtacagggagctgaagccccagacctgcaccatatgcgaaaccacccccgtgaatgccatcgacgcggaaatgcatgacttgaactgcagctacaacatatgcccgtactgtgcctcacggctcacgagcgacggcctggcccgacacgtgatccagtgtcccaagcgaaaggagaaggttgaggagaccgagctgtacctcaacctggagcgcatcccctgggtcgtgcggaagctgctccaggtttcagagagcaccggggtggctctgaagcgctcctcatggctgatcgtgctcctggtcctgttcacagtgagcttgtcccccgtgcagagcgcgcccatcggccaggggaagacgaccgaggcttaccgggcccgcgagggctacacctccatctgcctgttcgtcctgggcagcatcctctttatcgtgtcctgcctgatgaaggggctggtggacagcgtcggcaactccttcttccccgggctcagcatctgcaaaacctgctccatcagctccatcaacggcttcgagatcgaaagccacaagtgctactgctccctgttctgctgcccgtactgccggcactgcagcacggacaaggagatccacaagctacacctctccatctgcaagaagcgcaaaaccgggagcaacgtaatgctggccgtgtgcaagcggatgtgcttccgcgcgacgatggaggtctcgaaccgcgcactgttcatacggagcatcatcaacaccacgttcgtgctctgtatcctgatcctggccgtctgcgtggtgtccaccagcgccgtcgagatggagaacctcccggccggcacctgggagcgcgaggaagacctgaccaacttctgccaccaggagtgccaggtgacggagaccgagtgcctgtgcccgtacgaggccctggtgctccggaagccactattcctggactcaatcgcgaagggcatgaagaaccccctcaacagtaccagcctggagacctccctgagcatcgaagccccctggggcgccatcgacgtccagtccacgtacaagccgaccgtcagcacggccaatatcgccctcagttggtcgtccgtggagcaccgcgggaacaagatcctggttagcgggcggtccgagagcatcatgaagctagaggagcgcaccggcatctcctgggatctcggggtggaggacgcgagcgagtccaagctgctgaccgtgagcgtcatggacctgtcccaaatgtacagccccgtattcgagtacctgagcggcgaccgacaggtggaggagtggcccaaggccacgtgcaccggcgactgccccgagcggtgcgggtgcacctcctctacgtgcctgcacaaggagtggccgcactccagaaactggcgctgcaatcccacttggtgctggggcgtcgggaccgggtgcacgtgctgtgggctcgacgtgaaggacctgtttaccgactatatgttcgtgaagtggaaggtcgagtacatcaagaccgaggccatcgtgtgcgtagagctgaccagccaggagcggcagtgctccctcatcgaggccgggacccgcttcaacctgggccccgtcaccatcacgctgagcgagccccggaacatccagcagaagctcccgcccgagatcatcaccctgcacccccgcatcgaggaggggttcttcgacctgatgcacgttcagaaagtgctctccgcctcaaccgtgtgcaagctgcagtcctgcacccacggcgtgccgggggacctccaggtgtaccacatcggcaatctcctcaagggcgacaaggtcaacgggcatctgatccacaagatcgagccccacttcaacacgagctggatgtcctgggacggctgcgatcttgactactactgcaacatgggggactggcccagctgcacctacaccggcgtgactcagcacaaccacgcgtccttcgtgaacctgctgaacatcgagacagactacactaagaacttccacttccacagcaagcgggtcaccgcccacggggacacaccccagctcgacctgaaggcccgtcctacctacggcgccggcgagatcaccgtgttagtagaggtagcgaacatggagctccacacaaagaagatcgagatctccgggctgaagttcgccagcctgacctgcacgggctgctacgcatgctccagcgggatctcctgcaaggtgagaatccacgtggacgagcccgacgagctcacggtccacgtcaagagcgacgaccccgacgtagtggctgcctcctccagcctgatggcgcgcaagctggagttcggcaccgatagtaccttcaaggccttcagcgccatgcccaagacgtccctctgtttctacatcgtggagcgggagcactgcaagagctgctccgaggaggacaccaagaagtgcgtgaacaccaagctggagcagccgcagagcatcctgatcgagcacaaggggaccattatcggcaagcagaactccacgtgcaccgctaaagccagctgctggctcgagtccgtcaagagcttcttctacggcctgaagaacatgctgtccggtattttcggcaacgtgtttatggggatcttcctcttcctggcgcccttcatcctgctcatcttattctttatgttcggctggcgcattctgttctgcttcaagtgctgccgtcggacccgcggcctcttcaagtaccggcacttgaaagacgacgaagagaccgggtaccgccggatcatcgagcgcctgaacaacaagaagggcaagaacaagctcctggacggggagagactagccgaccgacggatcgccgagttattcagcaccaagacgcacattggc

SEQ ID NO: 15450 - RNA, 3495 nt, synthetic construct; identical to SEQ ID NO: 12164
  misc_feature 1..3495: note = derived and/or modified CDS sequence (opt11) from CCHVF(CCHVF K128_76)__KX013454.1__Gn-NSm-Gc
  source 1..3495: mol_type = other RNA

SEQ ID NO: 15451 - RNA, 3495 nt, synthetic construct
  misc_feature 1..3495: note = derived and/or modified CDS sequence (opt11) from CCHVF(CCHVF K168_40)__KX013457.1__Gn-NSm-Gc
  source 1..3495: mol_type = other RNA
agcgacgagtccggcgacgactgcatcagtcgcacccagctgctccggacagagacggccgaaatccacggggacaactatggcgggccgggcgacaaaatcaccatatgcaatgggtccacaattgtggaccagcgcctgggatctgagctcgggtgctacaccatcaatcgggtcaagtcattcaaactctgcgagaatagcgctacggggaaatcctgcgaggtggacagcataccggtcaagtgccgtcagggctactgcttgaagatcacccaggaggggcggggccacgtcaagctctcccgcgggagcgaggtggtgcttgacgcgtgcgactccagctgcgaggtcatgatccccaagggtaccggcgacatcctggtggactgctccgggggccagcagcacttcctgaaggacaacctcatcgacctggggtgccccaagattcccctgctcggcaagatggccatctacatctgccggatgagcaaccacccgaagactactatggcctttctgttctggttctccttcggctacgtcatcacgtgcatcgtctgcaaggccatcttctacctgctgatcatcgtggggaccctgggcaagcgctttaaacagtaccgggaattaaagccccagacctgcactatttgcgagaccacccccaccaacgctatcgacgcggagatgcacgatctcaactgcagctataacatctgcccctactgcgcctcccgcttgacgtcggacgggctggcccggcacgtgacccactgcccgaaacgcaaggagaaggtcgaggagaccgagctctacctgaacctcgagcggataccctgggtggtacgcaagctactgcaggtcagcgagtcgaccggcgtggccctgaaacgaagttcctggctcatcgtgctgctggttctcttcgcggtgagcctgtcccctgtgcagagcgcccccatcgggcacggaaaaacaatcgagacctaccaggtcagggaggagtacacctccatctgcctgttcgtgctcggcagcatcctgttcatcgtgtcctgtctcatgaaggggctcgtcaacagcgtgggcaacatcttctttccggggctgtccatctgtaaaacctgcagcatcggctccattaacggcttcgagatcgagagccacaagtgctactgctcactgctctgctgcccttactgtcggcactgcagcgccgatcgcgagatccaccagctgcacctgagcatttgcaagaagcggaagacgggtagcaacgtcatgctggccgtgtgcaagcgcatgtgcttccgggccaccgtagaagtctccaacaaggcgctgagcatccgctccatcatcaacaccaccttcgtggtgtgcatcctgatcctcgccgtttgcgtagtgagcacgagcgcagtcgagatggaatccctccccgcaggcacctgggagcgcgaggaggacctgaccaacttctgccaccaggagtgccaggtgaccgagacggagtgcctctgcccctacgaggctctggtgctgcggcgcccattgttcctcgatgggatagtcaagggcatgaagaacctgctcaacagcacttccctcgagaccagcctgtccatcgaagcgccatggggcgccatcaacgtgcagagcacctacaagcccacggtgtccgccgccaacatcgcccttagctggtcttccgtcgagcaccgggggaacaagatcctcgtgtccgggcgcagcgagtccatcatgaagctggaggagcggaccgggatcagctgggacctgggcgtagaagacgcgtcggagagcaagctgctcaccgtctccgtgatggacctgtcacagatgtacagccccgtgttcgagtacctctccggggaccgccaagtcgaggagtggccgaaggcgacctgcactggtgactgccccgaacggtgcgggtgcacgagttctacctgcctgcacaaggagtggccgcacagccgcaattggcggtgcaaccccacctggtgttggggcgtgggcaccgggtgcacttgctgcggcctggacgtgaaggacctcttcaccgactacatgttcgtcaagtggaaagtcgagtatatcaaaaccgaggccatagtgtgtgtcgagctgacctctcaagagcgccagtgcagcctgatcgaagccggaacgcggttcaacctcgggcccgttacaatcaccctgtcagagccccgcaacatccagcagaagctgccgcccgagatcatcaccctccacccccggatcgaggagggtttcttcgaccttatgcacgtgcagaaggtcctgagcgcctccacggtgtgcaagctccagagctgcacccacggcgtgcccggcgatctgcaggtctaccacatcgggaatctgctcaagggcgataaagtgaacgggcacctgatccacaaaatcgagccccacttcaacacttcctggatgagctgggacggctgcgacctggactactactgcaacatgggggactggccctcctgcacttacacgggagtgacccagcacaatcacgcgagtttcatcaacctcctgaacatcgagaccgactacactaaatccttccacttccacagcaagcgcgtcacggcccacggcgacacgccccagctggatctcaaggcccggcccaactacggggccggcgagattaccgttctggtggaggtcgcggacatggagctccacaccaagaagatcgagatcagcggcctcaagttcgccagcctgacctgcacgggctgctacgcctgcagtagcgggatcagctgcaaggtgcgtatccacgttgacgaacccgacgagctgaccgtccatgtgaagtccgacgaccctgacgtggtcgccgccagctcctcgcttatggcgcgcaagctggagtttggcaccgactccacgttcaaggccttcagcgcgatgcccaaaacctccctgtgcttctacatcgtggagcgcgagtattgtaagagctgctccaaggaggacactcagaagtgcgtgaacaccaagctcgaacacccccagagtattctgatcgagcataagggcacgatcatcgggaagcagaacaatacctgtaccgccaagacatcgtgctggctggagtctgtgaaatcctttttctacggcctcaagaacatgctgagtgggatcttcggcaacgtattcgtggggatcttcctgttcctcgcccccttcatcctgctgatcctattcttcatgttcggatggagaatcctgttctgtttcaagtgttgccgccgcacgaggggcctgttccgctacaagcacctcgaggacgacgaggagaccgggtaccggcgtatcatcgagcggctgaataacaagaagggcaagaacaagctactcgacggcgagcgcctggcggaccggcgcatcgccgagctgttctccaccaagacacacataggc

SEQ ID NO: 15452 - RNA, 3495 nt, synthetic construct
  misc_feature 1..3495: note = derived and/or modified CDS sequence (opt11) from CCHVF(CCHVF K168_125)__KX013460.1__Gn-NSm-Gc
  source 1..3495: mol_type = other RNA
agcgacgagtccggcgacgactgcattagccgcacccagctgctccggaccgagacggcagagatacatggggacaattacggcgggcccggtgacaagatcaccatctgcaacgggtccaccatagtggatcagcgcctgggctccgagctgggctgctacaccatcaaccgggtcaagtccttcaagttgtgcgagaacagcgctacggggaagtcctgcgaggtggacagcatcccggtgaagtgccgccagggttactgcttgaagatcacccaggaggggcggggccacgtgaagctgtcccgcgggagcgaggtggtgctcgacgcgtgcgactccagctgcgaggtcatgatccccaagggcaccggcgacatcctggtggactgctccgggggccagcagcactttctgaaggacaacctaatcgatctagggtgccccaaggtgcccctgctcggcaaaatggctatctacatctgccggatgagcaaccacccgaagaccacgatggcattcctgttctggttctccttcggctacgtcattacctgcatcgtgtgcaaggccatcttctacctgctcatcatcgtggggaccctgggcaagcgcttcaagcagtaccgtgagctaaagccccagacctgcacaatctgcgagaccacccccaccaacgccatcgacgcggagatgcacgacttgaactgcagctacaacatctgcccctactgcgcctcccgcctgacgagtgacgggctggcccggcacgtcacgcactgcccgaagcgcaaggagaaggtggaggagaccgagctctacctgaacctggagcggatcccctgggtggtccgcaaactcctccaggtgtccgagagcaccggcgtcgccctgaagcggagctcctggctcatcgtcctgctggtgctgttcgctgtaagcctgtcccccgtccaaagcgcccccatcgggcacggcaagacaatcgaaacctaccaggtgcgcgaggagtatacctccatctgcctgttcgttctcggcagcatcctattcatcgtgtcctgccttatgaaggggctcgtgaacagcgtcggcaacatcttcttcccggggctgtccatatgcaagacctgctctatcggctccatcaacggtttcgagatcgaaagccacaagtgctactgttccctgctctgctgcccgtactgccggcactgcagcgccgaccgggagatccaccagctgcacctatccatctgcaagaagcggaagacgggcagcaacgtgatgctcgccgtgtgcaagcgcatgtgcttccgggccaccgtcgaggtgtccaacaaggcgctgagcatccgctccatcatcaataccaccttcgtggtctgcatcctgatcctcgccgtgtgcgtggtcagcacgtccgccgtggagatggaatccctgcccgccggcacctgggagcgcgaggaggatctgaccaacttctgccaccaggagtgtcaggtaaccgagacggagtgcctctgcccgtacgaggccctcgtgctgcgacgcccgctgttcctcgactccatcgtgaagggcaagaagaacctgctgaactccacctcactcgagacctccttgtcaatcgaggcgccctggggcgcgatcaacgtgcagtccacctacaagcccacggtcagcgcagccaacatcgccctgtcctggagctccgtcgagcacagggggaacaaaatcctcgtgagcgggcgctccgagagtatcatgaagctggaggagcggaccgggatcagctgggacctaggcgtcgaggatgcgagcgagtccaagctcctgaccgtgagcgtgatggacctgagccagatgtactcccccgtcttcgagtacctcagcggcgaccgccaggtggaggaatggccgaaggcgacctgcaccggggactgccccgagcggtgcggttgcacgtccagcacctgtctgcacaaggagtggccccactcccgcaactggagatgcaaccccacctggtgctggggtgtgggcaccggctgcacgtgctgcgggctggacgtcaaggacctgttcaccgactacatgttcgtgaagtggaaagtggagtacatcaagaccgaagccatcgtctgcgtcgagctgaccagccaggagcgccagtgctccctgatcgaggccggcacgcgcttcaacctcgggccggtgaccatcaccctgtcggagccccgcaacatccagcagaagctgccgcccgagattatcacgctccaccccagaatcgaggagggcttcttcgacctgatgcacgtccagaaggtgctgtccgccagcacggtgtgcaagctccagtcctgcacccacggggtccccggggacttacaggtgtaccatatcggtaacctgctcaagggggacaaggtgaacggccacctgatccacaagatcgaaccccacttcaacaccagctggatgtcctgggatgggtgcgacttagattactactgcaacatgggcgactggccgagctgcacctacacgggggttacccagcataaccacgcctccttcatcaacctcttgaacatcgagaccgactacaccaagagcttccacttccactcaaagcgcgtgactgcacacggcgacacgccccagttagacctcaaggcccggcccaactacggcgccggggagatcaccgtgctggtcgaggtggcagacatggagctgcacaccaagaagatagagatcagcggcctcaagttcgcctcgctgacctgcactggctgctacgcttgcagcagcggcatctcctgcaaggtgcgcatacacgtcgacgagcccgacgagctgaccgtgcacgtcaagagcgacgacccggacgtggtggcggcctccagctccctcatggcgcggaaactggagttcgggaccgacagcacgttcaaggccttctccgctatgcccaagaccagtctgtgcttctacatcgtggagcgcgagtactgtaaatcctgcagcaaggaggacactcagaagtgtgtcaacaccaagctcgagcacccgcagtccatcctgatcgagcacaagggcacgataatcggcaagcagaacaacacctgtaccgccaagaccagctgttggctggaatccgtcaagagcttcttctacgggctcaagaacatgctgtccggcatcttcggtaacgtgttcgtgggaattttcttgttcctggcccccttcatcctgctgatcctcttcttcatgttcgggtggcggatcctgttctgtttcaagtgctgccgccgcactcgggggctgttccgctacaaacacctcgaggacgacgaggagaccggctatcggcgcatcatcgagcgcctgaacaacaagaaggggaaaaacaagttactcgacggcgaacgcctggcggaccggagaatcgccgagctgttcagcaccaagacccacatcggg

SEQ ID NO: 15453 - RNA, 3495 nt, synthetic construct
  misc_feature 1..3495: note = derived and/or modified CDS sequence (opt11) from CCHVF(CCHVF K229_194)__KX013463.1__Gn-NSm-Gc
  source 1..3495: mol_type = other RNA
agcgaggagccaggcgacgactgcatctcccgcacccagctgctcaagaccgagacggccgagatccacgacgacaactacgggggcccgggggacaagatcaccatctgcaacggcagcacgatcgtggaccagcggctggggtccgagctaggctgctacaccatcaatcgcgtcaagagcttcaagctctgcgagaactccgccacgggcaagacctgcgagatcgatagcacccccgtgaagtgccggcaggggttctgcctgaagatcacccaggagggccgcgggcacgtgaaactctcccggggcagcgaggtcgtgctcgacgcgtgtgactccagctgcgagatcatgatccccaaggggacgggcgacatcctggtggattgctccggcgggcagcagcacttcctgaagggcaacctcatcgacctggggtgcccccacatcccgctgctcggcaagatggcgatctacatctgccgcatgagcaaccacccccggaccaccatggcatttctgttctggttctccttcggctacgtcatcacgtgcatcttctgcaaggccctgttctatagcctcatcataatcgggaccctgggcaagaagatcaaacagtaccgcgagctgaaaccgcaaacctgcaccatctgcgagaccgcgcccgtgaacgcgatagacgctgagatgcacgacttaaactgctcctacaacatctgcccgtactgcgccagccggctgacgtccgatggactggcccgccacgtgacccagtgccccaagcgcaaggagaaggtcgaggagaccgaactctatctgaacctggagcgcatcccttggatcgtgcggaagctcctccaggtgagcgaaagcaccggtgtcgcgctgaagcgcagcagctggctgatcgtcctgttagtgttattaacggtctccctgagccccgtgcagtccgcaccggtggggcacggcaagaccatcgagacataccagacacgggagggcttcacgaacatctgcctcttcatgctggggagcatcctgttcatcgtctcctgcctcgtaaagggcctggtggacagcgtctccgacagctttttccccgggctatccgtgtgcaaaacttgcagcatcgggagcatcaacgggtttgagatcgagagccacaagtgctattgctccttattctgctgcccttactgccgccactgcagcgcagaccgggagattcaccagctgcacctgggtatctgcaagaagcgcaagaccggatccaacgtgatgctcgccgtttgcaagcggatgtgttttaaagccaccatcgaggcgagccgccgggccctgctgatccgctccatcatcaacacgacattcgtgatctgcatcctcacactggccatctgcgtcgtgagcacatccgccgtggagatggagaatctgcccgccgggacgtgggagcgcgaggaggacctcaccagcttctgccaccaggagtgccaggtaaccgagacggagtgcttatgcccgtacgaggcgctggtgctgcgaaaaccccttttcctggacagcatcgtgaagggcaagaagaacctgctcaattccacaagcctggagacctccctgagcatcgaggccccctggggcgccatcaacgtccaatcgaccttcaagccgaccgtgagcaccgccaacattgccctctcctggagctccgtggagcaccgcgggaacaagatcctagttacggggcggagcgagtccatcatgaagctggaggagcggaccggcgtgagctgggacctcggcgtggaggacgcctccgagagcaaactgctgaccgtctccatcatggacctctcgcaaatgtactccccggtgttcgagtacctcagcggggaccgccaggtggaggagtggcccaaggcgacctgcacgggcgactgccccgagcggtgcgggtgcacctcttccacatgcctgcacaaggagtggccccatagccggaactggcgctgcaacccgacatggtgctggggcgtcgggaccgggtgcacgtgctgcggcgtggatgtgaaggacctcttcaccgaccacatgtttatcaagtggaaggtcgagtacatcaagaccgaggccatcgtgtgcgtggagcttacgtcccaagagcggcagtgcagcctgatcgaggccgggacccgcttcaacctcggccccgtcaccatcactctgtccgagccccgcaacattcagcagaagctgccaccggagatcatcactctgcaccccaagatcgaggaggggttcttcgacctgatgcacgtgcagaaggtactgagcgcctccaccgtctgcaagctccagagctgcacccacggtatccccggcgacttgcagatctaccacatcgggaacttactcaagggcgaccgcctgaacgggcacctgatacataaaatcgagccgcacttcaacacctcctggatgagctgggacggctgcgacctcgactactactgcaacatgggggactggccctcctgcacttacaccggcgtgacccagcacaaccacgccgccttcgtgaacctgctgaacatcgagaccgactatacgaagaccttccacttccacagcaagcgggtcaccgcccacggcgacacgccccagctcgacctgaaggcccgccccacctatggggccggcgagatcaccgtgctggtggaggtcgccgacatggagctccacaccaagaaggtggagatctccgggctgaagttcgccagcctggcctgcactggctgctactcctgcagctccgggatctcttgcaaagtgcggatccacgtcgacgagccggacgagctcacggtgcatgtgaagtccagtgaccccgacgtcgtggccgcgagcacctccctgatggcacgcaaactggagttcggcaccgacagcaccttcaaggccttctccgccatgcccaagacgagcctctgcttctacatcgtggaacgggagtactgcaagtcctgcagcgaggacgacaccaagaagtgcgtcgacaccaagctggagcagccccagagtatcctgatcgagcacaaggggaccatcatcgggaagcagaacgatacgtgcaccgctaaggcgagctgctggctcgagtccgtcaagagcttcttctacggcctgaagaacatgctcggttccgtgttcggcaatttcttcgtggggatactcctgttcctggcccccttcgtgctcctggtgctgttcttcatgtttggttggaagatcctcttctgtttcaagtgctgccgccggacccgcggcctgttcaagtaccgccacctgaaggacgacgaggagaccgggtaccggaagatcatcgagcgcctcaacagcaagaagggcaagaaccggctgctggacggggaacgcctcgccgaccggaagatcgccgagctgttttccaccaagacgcacatcggc

SEQ ID NO: 15454 - RNA, 3495 nt, synthetic construct
  misc_feature 1..3495: note = derived and/or modified CDS sequence (opt11) from CCHVF(CCHVF K229_243)__KX013466.1__Gn-NSm-Gc
  source 1..3495: mol_type = other RNA
agcgaggagcccggcgacgactgcatctcccgtacccagctgctccggacggaaacggccgagatccacgatgacaattacgggggcccgggggacaagatcaccatctgcaacgggagcacaatcgtggaccagcgcttggggtccgagctgggatgttacacgatcaaccgggtcaagtctttcaagttatgcgagaactccgccacgggcaagacctgcgagatcgacagcacccccgtgaagtgccgacaggggttctgcctaaagatcacccaggagggccggggtcacgtgaagctgagccgcggcagcgaggtcgtgctcgacgcgtgcgactccagctgcgaggtgatgatcccaaaggggacgggcgacatactggtcgactgctccggcgggcagcaacacttcttaaaggacaatttgatcgacttagggtgcccccatatcccgctgcttgggaagatggccatctacatttgccgtatgagcaaccacccccgcaccaccatggccttcctgttctggttctccttcggctacgtcatcacgtgtatcttctgcaaggccctgttctactccctcatcatcatcggcacccttgggaagaagatcaagcagtaccgggaactgaagccccagacctgtaccatctgcgagaccgcccccgtgaacgctatcgacgccgaaatgcacgacctcaactgctcctacaacatctgcccttactgcgccagccgcttaacgtccgatggcctggcccggcacgtcccccagtgcccaaagcggaaagagaaagtggaggagaccgagctctacttgaaccttgagcgaatcccctggattgtgcgcaagttactgcaggttagcgagtccaccggggtggcgctgaagcggagcagctggctcatagtgctgctggtcctcctgaccgtttcgctgagccccgtgcagtccgcccccgtcggccacgggaaaacgatcgagacctaccagacccgcgagggcttcaccagcatctgcctcttcatgctggggagcatactgttcctcgtgagctgtctggtgaaggggctggtggactccgtgtccgactccttcttccccggcctcagcgtgtgcaagacgtgctcaatcgggagcattaatggattcgagatcgagtcccacaagtgctattgcagcctgttctgctgcccgtattgccggcactgctccgccgaccgcgagatacaccagcttcacctaagcatatgcaagaagcggaagaccgggtccaatgtcatgctagccgtgtgcaagcgcatgtgtttccgggccaccatcgaggcgagccgcagagccctgctcatccggtccatcatcaacaccacgttcgtcatctgcatcctaaccctgaccatctgcgtggtgagcactagcgccgtggagatggagaacctaccggccggaacgtgggagcgcgaagaggacctgaccaacttttgccaccaggagtgccaggtgaccgagaccgagtgcctgtgtccctacgaggccctggtgctccggaagcccctgttcttagactccatcgtcaagggcatgaagaacctgttaaacagcacgtccctggagacctcactcagcatcgaagcgccctggggagccatcaacgtgcagagcaccttcaaaccgaccgtgtccaccgccaacatcgccctgagctggtccagcgtcgagcaccgcgggaacaagattctggtgacggggcggtccgagagcatcatgaagctcgaggaacgcaccggcgtgtcctgggacctgggggtcgaggacgccagcgagtcaaagctgctcaccgtaagcatcatggacctgtcccagatgtacagccccgtcttcgagtacctgtccggcgaccggcaggtcgaggagtggcccaaagcgacctgcacgggcgactgtcccgagcgctgcggctgcacctcgagcacgtgcctgcacaaggagtggccgcactcccgaaactggcgttgcaaccccacctggtgctggggcgtagggaccggctgcacgtgctgcggcgtggacgtgaaggatctgttcaccgaccatatgtttgtgaagtggaaggtagaatacataaaaaccgaagccatcgtctgcgtggagctgacctcgcaggaacggcagtgctccttgatcgaggccgggactcgcttcaatctgggcccagtgaccatcacgctgagcgagccccggaacattcagcagaagctcccgcccgagatcatcacgctgcaccccaaggtcgaggagggattcttcgacctgatgcacgtgcagaaagtgctctccgccagcaccgtctgcaaattacaatcctgcacccacggcatcccgggggacctacaggtgtaccacattggtaacttgctgaagggcgaccgcgtgaatgggcaccttatccacaagatcgagcctcactttaacaccagctggatgtcctgggacggctgcgacctcgactactactgcaacatgggggactggcccagctgcacttacaccggcgtcacccagcacaaccacgccgcattcgtgaacctgctgaacatcgagaccgactacacaaagaccttccatttccactccaaacgggtgaccgcacacggggatacgccgcagctcgacctgaaggcccgcccgacctatggcgccggggagatcaccgtcctcgtggaggtggcggatatggagctccacaccaagaaggtcgagatcagcgggctgaagttcgcctccctggcgtgcaccggctgctacgcgtgcagctccgggatcagctgcaaggtgagaatccacgtggacgagcccgacgaactcacggtccacgtgaagtcctctgacccggacgttgtcgccgctagcacctccttgatggcccgcaagctggagttcggcacggacagcaccttcaaggccttctccgctatgcctaagacgagcctctgcttctacatcgtggagaaggaatactgcaagtcctgcagcgaggaggacacccaaaagtgcgtagacaccaagctggaacagccgcagagtatcctgattgagcacaaggggaccatcatcggcaaacagaacgacacgtgcactgccaaggcgagctgctggctcgagtccgtcaagagcttcttctacggcctgaagaacatgctggggtccgtgtttggcaactttttcatcgggatcctcctgttcctgacccccttcgtgctcctggtcctgttcttcatgttcgggtggaagatcctattctgcttcaagtgctgccggcgcacccgcggactgctgaagtaccgccacctcaaggacgacgaggagaccggctatcgccggatcatcgagcgcctgaacaacaagaaggggaagaaccggctgctcgacggggaacgtctcgccgaccggaagatcgccgagctgttcagcacgaaaacccacatcggc

SEQ ID NO: 15455 - RNA, 3495 nt, synthetic construct
  misc_feature 1..3495: note = derived and/or modified CDS sequence (opt11) from CCHVF(CCHVF K315_14)__KX013469.1__Gn-NSm-Gc
  source 1..3495: mol_type = other RNA
agcgaggagcccggggacgactgcatctcccgcacacaactgctcaagaccgagacggccgagatccacgacgataactacgggggcccgggggataagatcaccatttgtaacggcagcaccgtggtcgaccagcgtttagggtccgagctgggctgttacaccatcaaccgcgtcaagagctttaaactctgcaagaacagcgccaccggcaagacctgcgaaatcgattctacccccgtgaaatgccggcaggggttttgcctgaagatcacccaggagggccgcggacacgtgaaactgtcccggggcagcgaggtagtgttagacgtctgcgactccagctgcgagatcatgatccccaaagggactggcgacatcttagtggactgctccggcgggcagcagcactttctgaaggacaacctcatcgacctgggctgtccccatatcccgctgctcgggaagatggcgatctacatttgccgcatgagcaaccacccccggaccacaatggccttcctgttctggttctcgttcggctacgtgattacttgcatcttctgcaaggcgctgttttacagcctcatcatcatcggcaccctggggaagaagatcaagcagtaccgcgagctgaagccccagacctgcaccatctgcgagaccgcccctgtcaacgccattgacgccgagatgcacgacctcaactgctcctacaacatctgcccgtattgcgccagccggctgacgtccgagggcctggccaggcacgtaacccagtgccctaagcggaaggagaaggtggaggagaccgaactttacttgaacctggagcgcatcccctggatcgtccgtaaattgctccaggtgtccgagtctaccggggtggccctgaagcgcagcagctggctcatcgttcttctagtgctgctcacggtgtccctgagccccgtccagtccgcgccggtgggccacgggaagaccatagagacttatcagactcgggaaggcttcacgagcatctgtctcttcatgctgggctccatcctgttcatcgtgagctgcctcgtgaagggcctggtgtattccgtgagcgattccttctttcccggcctgagcgtctgcaagacctgctccatcgggagcataaacggcttcgagatcgagtcccacaagtgctattgctctctcttctgctgcccctactgccgccactgcagtgccgaccgggagattcaccagctgcatctcagcatctgtaagaagagaaaaaccgggtccaacgtaatgctcgccgtctgcaaacgtatgtgctttaaggccacaattgaggccagcagacgggcgctgctgatccgatccatcatcaacacgaccttcgtgatctgcatcctcaccctggccatctgcgtggtcagcaccagcgccgtggagatggaagaccttcccgccggcacctgggagcgcgaggaggacctaaccaatttttgccaccaggagtgccaggtgacggagaccgagtgcttatgcccgtacgaggccctggtcctgcggaagcccctcttcctggattccatagtgaagggtatgaagaagctgctcaacagcacgtccctggagaccagcctgtccattgaggcgccctggggcgcaatcaacgtgcagagcaccttcaagcccaccgtctcaaccgccaatatcgccctcagctggtccagcgtggaacaccgcgggaacaagatcctagtgactgggcggtccgagagcataatgaagctggaggagcgcaccggcgtctcctgggacctcggggtggaggacgctagcgaatccaaactgcttaccgtgagcatcatggacctctcccagatgtacagcccggtattcgagtatctgagcggcgaccgccaggtcgaggagtggcctaaggcgacctgcacgggcgactgccccgaacggtgcggatgcacctcctcgacgtgcctgcacaaggagtggccccactcccggaactggcgctgcaacccgacgtggtgttggggcgttgggaccggctgcacgtgttgcggcgtcgatgtaaaagacctcttcaccgaccacatgttcataaagtggaaggtggaatacatcaagaccgaggccatcgtctgcgtggagctgacaagccaagagaggcagtgctccctgatcgaggcagggacccgattcaacctcggccccgtgaccatcaccctgagcgaaccccggaacatccagcagaagctgccgccggagatcatcacgctccaccccaagattgaggaagggttcttcgaccttatgcatgtccagaaggtgctgtccgccagcaccgtgtgtaagctccagtcctgcacccacggcataccaggtgacctgcagatataccacatcggcaacctgctcaagggcgatcgcgtcaacgggcacctgatacacaagatcgagcctcacttcaacaccagctggatgtcctgggacggctgcgatctggactactactgcaacatgggagattggccgagttgcacgtacaccggcgtgacccagcataaccatgccgctttcgtgaacttactgaacatagagaccgactacacgaagaccttccacttccactccaagcgagtcacggcccacggagacacgcctcagctggatctcaaggcccgccctacctacggcgccggcgagatcaccgtgctagtggaggtcgcggacatggagctgcacaccaagaaggttgagatcagcgggctcaagttcgcttccctgacctgtacgggctgctacgcctgcagctctgggatcagttgcaaggtgcggattcacgtcgacgagccggacgagctgaccgtgcacgtaaagtcaagcgaccccgacgtcgttgccgccagcacaagcctcatggcgcgcaagctcgagttcggcactgactccacgttcaaggccttctcagccatgcccaagacaagcctgtgcttctacatcgtggagagggagtactgcaagtcctgttccgaggacgacaccaagaagtgtgttgacaccaagctcgagcagccccagtccatcctcatcgagcacaagggtacaatcatcggtaagcagaacgatacgtgcaccgctaaggccagctgttggcttgagtccgtcaagagcttcttctacggcctgaaaaacatgctgggatccgtgttcggcagcttcttcgtggggatcctcctgttccttgcacctttcgtgctgctcgtactgttcttcatgttcggttggaaaatcttgttctgcttcaagtgctgccgccggacccgcgggctgttcaagtatcgccacctaaaagacgacgaggagaccggttacaggcgcatcatcgagcggctgaatagcaaaaagggcaagaacaggctcctggacggcgagcgactggccgaccgcaagatcgccgagctgtttagcacgaagacccacatcggc

SEQ ID NO: 15456 - RNA, 3495 nt, synthetic construct
  misc_feature 1..3495: note = derived and/or modified CDS sequence (opt11) from CCHVF(CCHVF K323_27)__KX013472.1__Gn-NSm-Gc
  source 1..3495: mol_type = other RNA
tccgaggaaccgggcgatgactgcatatcacgaacccaactactaaaaaccgaaactgccgagattcacgacgataactacggagggcccggggacaaaatcacaatctgcaacggatccaccatcgtggaccaaaggctgggatcggagttgggatgttataccattaacagagttaaatcgtttaagctgtgcgaaaactccgccaccggaaaaacctgcgaaattgactcaacccccgtaaagtgccgacaaggcttctgccttaaaataacccaagaaggccgcggccacgtgaaactcagccgaggttccgaagtcgtcctcgacgcatgtgacagctcatgcgaaatcatgatccccaaggggaccggtgacatcctagtagactgctccggcggtcaacagcacttcctcaaagacaacctaatcgacctcggatgccctcatatccccctccttgggaaaatggcaatctacatctgccgaatgtcaaatcacccccgtacaacaatggctttcctcttctggttctccttcggatacgtcatcacatgcatattctgtaaagcgctcttttacctcctaataatcatcggaaccctcggcaaaaagataaaacaataccgggagctcaaaccgcagacctgtaccatatgcgagaccgcaccagtcaacgcaatagacgcggagatgcatgacctcaattgcagctacaacatttgcccctactgcgcgagccgactaacttctgatggcctcgcacgacacgtcacccaatgcccaaaacggaaggaaaaagtagaggaaaccgaactgtacttgaacttagagcgtattccatggatcgtgcgaaagctactccaggtatccgaatccacaggtgtcgccctaaaacgaagcagctggctcaccgtactacttgtactcctaacagtcagcctttcccccgttcaatcagccccagttggtcacggcaacacgatagagacctaccaaacacgcgaaggattcacctctatctgcctcttcatgctaggctccattctcttcatagtctcgtgtctggtaaaaggcctcgtagactcagtcagcgactcattcttccccggtctctccgtctgcaaaacctgctccatcggaagcataaatggcttcgagatagaaagccacaaatgttactgttccctcttctgctgcccccactgccgccaccgctccgcggatagagaaatccaccaacttcacttatccatctgcaaaaagcggaaaaccggctcaaacgttatgctcgccgtctgcaagcgcatgtgccctaaagcaaccatcgaagccagtcgccgagcactacccatccgcagcatcatcaacaccacgctggtgatgtgcatactcacactagccatctgcgtggtatcaaccagcgcggtagaaatggaggaccttccggcagggacatgggaaagagaagaagacctgacaaacttctgccaccaagagtgccaagtcaccgaaactgagtgcctctgcccgtacgaggccctggtgttgcggaaacctctcttcctcgacagcatcgcaaaaggaatgaagaacctactaaactcaacaagtctggaaacatcactgtcgatcgaagccccctggggcgccatcaacgtccaaagcaccttcaagccaaccgtatcgaccgccaacatcgccctatcctggagctccgtggagcaccgcggcaacaagattctcgttaccggacgctctgaatcgatcatgaagttagaagaacgcaccggagtctcatgggacctaggggtggaagatgcctccgagtccaagctcctaaccgtaagcataatggatctatcacaaatgtacagccccgtcttcgaatacctgagcggagacagacaagtagaagaatggcccaaggctacctgcacaggtgactgccccgaacgctgcggctgcaccagcagcacatgtctccacaaagagtggccccacagccgcaattggcgttgcaaccccacttggtgctggggagtcggcaccggctgcacatgctgtggtgtggacgtcaaagatctattcacagaccacatgtttataaagtggaaagtagaatacatcaagactgaagctatagtttgtgtcgaactaacaggacaagaacgccaatgttcccttatcgaggctggcacccgattcaacctaggaccagtgactatcaccctctccgaaccccgaaacatacaacaaaaattaccacctgaaatcataacccttcatccaaaaattgaagaaggatttttcgacctcatgcacgtccagaaagtactctcggctagcacggtctgtaaactgcaatcctgcacacacggcataccaggcgacctccaaatataccacatcggaaaccttctaaaaggcgaccgtgtcaacggacacctaatccacaaaatcgagccccacttcaacacatcctggatgtcatgggacggatgcgacctggattactattgcaacatgggcgactggccctcctgcacctacaccggcgtcacacaacacaaccacgcagccttcgtcaacctcctcaacatcgaaacggactacacaaagaccttccacttccactccaagagagtaacagctcatggagacacaccccaactcgacctcaaagcccgccccacctacggcgccggcgaaatcacagtcctggtagaggtggccgacatggaactccatacgaagaaagtagaaattagcggattgaaattcgcatcactaacatgtactggatgttacgcctgcagctcaggcatatcttgcaaagttcgcattcacgttgatgaaccagacgagctaactgtccacgtcaaatcgtccgacccagacgttgtcgccgcatccacttcgctaatggcccgcaaactcgagttcgggaccgactcgacattcaaagccttctccgcaatgcccaagacttccctctgcttttacatagtcgaacgggaatactgtaaaagctgctcagaagacgataccaagaaatgcgtagacaccaaactagaacaaccccagtccattcttatagaacacaaaggaaccatcatcgggaaacaaaacgacacatgcacagccaaagcctcctgctggctcgaatccgtcaaatccttcttctacggcctgaaaaacatgcttggttccgtctttggctcgttcttcgtcggcatactactcttcctcgcaccattcgtcctcctcgtcctcttctttatgttcggatggaagatcctcttctgcttcaagtgctgccgacggactcgaggcctcttcaaataccgacatctcaacgacgacgaggaaaccggctaccgtcgaatcatagaacggctaaacagtaagaaaggtaaaaaccgactattagacggagagcgcctagcggaccgcaaaatcgcagaactattctcaaccaaaacgcacatcggg

SEQ ID NO: 15457 - RNA, 3495 nt, synthetic construct
  misc_feature 1..3495: note = derived and/or modified CDS sequence (opt11) from CCHVF(CCHVF K340_6)__KX013475.1__Gn-NSm-Gc
  source 1..3495: mol_type = other RNA
tccgaggaaccaggagacgactgcatcagccgcacccaactactcaagacagaaacagcggaaatccacgacgacaactacgggggaccaggcgacaaaatcaccatatgcaatggctccacaatcgtcgaccaacgccttggttccgagctcggctgctacacgatcaaccgtgttaagagcttcaaactttgcgaaaacagcactaccggtaaaacgtgtgaaatcgactccacacccgtgaaatgccgccaaggcttctgcctcaaaatcacacaagagggacgcggacatgtgaagctcagtaggggcagtgaagtcgtactcgacgcctgcgactcctcctgcgaaataatgataccaaaaggtacgggcgacatcctcgtcgactgttccggcggccaacaacacttcctcaaagacaacctcatcgacctcgggtgcccacatatcccgccccttggcaaaatggccatctacatatgtagaatgtccaaccacccccgcacaacgatggcatttctcttttggttctcattcggatacgttattacctgcatcttctgcaaggcactattttactcattgataataatcggcacactgggaaagaaaatcaaacaataccgtgaactcaaaccccaaacctgcaccatctgcgaaacagcccccgtaaatgcaatagacgccgagatgcatgacctcaattgtagctacaatatctgcccttactgcgcatcccgcctcacgagtgacggactcgccagacacgtcactcaatgcccaaaacgaaaagaaaaggtcgaagagacagagctctacctcaacctagaaagaataccatggattgtcagaaaactgctacaagtaagcgaatcgacaggagtcgcccttaaacggtcctcgtggctgatagtactcctagtactcctcacagtaagcctgagcccagtccaaagcgccccagtaggccatgggaagaccatagaaacctatcagaccagagaaggcttcacaagcatatgcctattcatgctaggctctatcctattcatagtatcctgcctagtcaaaggcctcgtggactccgtctctgactcgttcttcccgggcctcagcgtctgcaaaacctgcagcataggatccatcaatggattcgaaatagaatcacacaaatgctactgctccctattctgctgcccatactgccgccattgcagcgccgaccgagaaatccatcaactacacctaagcatctgcaagaaacgaaaaacaggctccaacgtcatgctcgctgtatgtaaacgcatgtgtttcaaagcaacaatagaagcctcccgccgagcactactaatccgttccatcatcaacaccaccttcgtcatgtgcatccttaccctcgccatatgcgtcgtctcaactagcgccgtcgagatggaggacctccccgcaggaacctgggaacgggaagaagacctaacaaacttctgccatcaggaatgtcaagtcaccgaaacagagtgcctttgcccatacgaggccttggtcctccggaaaccactgtccctagacagcatagttaagggaatgaaaaacctactcaactccacttccctcgaaacctcattatccattgaggcaccctggggagctatcaatgtccaatcgacattcaaaccaacagtcagcacagcaaacatagcattgagctggtcttccgtagaacatcgcggaaacaagatactcgtcacaggacgaagtgaatccatcatgaagctcgaggaacgcaccggcgtctcctgggacctcggggtagaagacgcctccgaaagcaaactcctaacagtatccataatggacctcagccagatgtactcgcccgtcttcgagtacctcagtggagacagacaggtcgaagaatggccgaaagccacttgtacgggcgactgcccagagagatgcggctgcacgagctccacttgcctccacaaagaatggccccactcccgcaactggcgatgcaatccaacctggtgctggggcgtcggcacaggttgtacttgctgcggcgtcgacgtaaaagaccttttcacggaccacatgttcatcaaatggaaggtagagtacatcaaaacggaggccattgtatgcgtcgaactgacctcccaggaacgccaatgctcactcatcgaagccggcaccagattcaaccttggccccgtcaccatcacgctctcagagcccagaaacatacaacaaaaactccctccagaaatcataaccctacatcctaaaatcgaagaaggcttcttcgacctgatgcacgtacaaaaagtcttaagcgccagcaccgtctgcaaactacaaagctgtacgcacggcatcccaggcgacttgcaaatataccacataggaaacctactgaagggagacagagtaaatggacacctaatccacaaaatagagccccacttcaatacatcatggatgtcttgggacggctgcgacctcgactactactgcaacatgggtgactggccaagctgcacatacaccggagtcacacaacacaaccacgcagcattcgtcaacctactaaacatagagacggactacacaaagacatttcatttccactccaaaagagtgaccgcccacggcgatacgccccaactagacctaaaagcgaggcccacgtacggcgcaggagaaatcacggtgctcgtagaagtcaccgatatggagctccacaccaagaaagtagaaataagcggccttaaattcgcctccttgacatgcaccggatgctatgcatgctcctccggaatatcctgcaaagtacgtatccacgtcgacgaacccgacgaactcacagtccacgtcaaatcgtccgaccccgacgtcgtcgccgcaagcactagcctgatggcaagaaaactagagtttggaaccgactcgacgttcaaggcattttccgcgatgcccaagacatcactatgcttctacatcgtcgaacgggaatactgcaaaagctgctcagaagacgataccaagaaatgtgtagacaccaaactagaacaacctcaatccatactcatcgaacacaaagggactattataggaaaacaaaacgatacctgcacagccaaagccagctgttggcttgaatcagtcaaatccttcttttacggcctcaaaaacatgctaggctcagtattcggctcattcttcgttggaatcctcctcttcctagcgcctttcgtgctactcgtcctcttctttatgttcggctggaaaatcctattctgcttcaaatgctgccgacgaacccgaggcctattcaaataccgccacttcaaagacgacgaagagacaggctaccgacgaataattgaacgactcaactcgaagaaaggcaaaaaccgactactcgacggagaacgccttgccgacagaaaaatagcagaactcttctccaccaaaacccacatcggc

SEQ ID NO: 15458 - RNA, 3495 nt, synthetic construct
  misc_feature 1..3495: note = derived and/or modified CDS sequence (opt11) from CCHVF(CCHVF Mamon)__KX013478.1__Gn-NSm-Gc
  source 1..3495: mol_type = other RNA
agcgaggagcccggcgacgactgcatcagtcgcacccaactgctccggaccgagacagccgagatccacgacgacaactacgggggcccgggggacaaaatcaccatctgtaacggctccaccatcgtagaccaacgactcgggtcggagctgggttgctacaccatcaaccgggtcaagagcttcaaactctgtgagaactccgctacaggcaagacctgcgaaatcgacagcacgcccgtgaagtgccgccaggggttttgtctgaagatcacccaggagggccgggggcacgtgaagctgtcccgcgggagcgaggtcgtgtccgacgcatgcgacagctcctgcgaggtgatgatccccaaggggacgggcgacatcctcgtcgactgcagcggcgggcagcagcacttccttaaagacaacctgatcgacctcggctgcccccacatcccgctgctggggaagatggccatctacatctgtcggatgtccaaccacccccgcaccaccgtagccttcctcttctggttcagcttcggctacgtgatcacgtgcatattctgcaaagccctgttttactcgctgatcatcatcggcaccctcgggaagaaaatcaagcagtatcgggagctgaagccccagacctgcaccatctgcgagactgcccccgttaacgcgatcgacgccgagatgcacgacctgaactgcagctacaacatctgcccgtactgcgcctcccgcctcacgagcgatggcctggcccgacatgtaccccagtgccccaaacgcaaggagaaagtggaggagaccgagctgtacctcaacctggagcggatcccctggatcgtccgcaagctgctccaggtatccgagagcaccggggtggcgctgaagcggtcgtcctggctgatcgtacttctggttctgctcaccgtgagcctgagccctgtccagtcggcccccgtgggccacgggaagactatcgagacctaccagacccgcgagggctttacctccatctgcctgtttatgttgggcagcattcttttcctggtttcctgccttgtcaaggggctggtggacagcgtgtccgacagcttcttccccggcctgtccgtctgcaagacgtgcagcatcgggtccatcaacggcttcgagatcgagagccacaagtgctactgctccctcttctgttgcccctactgccggcactgcagcgccgaccgcgagatccaccagctacacctgtccatctgcaagaagcggaagaccgggagcaacgtgatgctcgccgtctgtaagcgaatgtgcttccgggccaccatcgaggcgtcccgccgcgccctgctgatccgcagcatcatcaacaccacgttcgtgatctgcatactcaccctgaccatctgcgtggtcagcacctctgccgtggaaatggagaacctgccgagcggcacttgggagcgcgaggaagacctcaccaacttctgccaccaggagtgtcaggtgaccgagaccgagtgcctgtgcccctacgaggccctggtcctgcggaagcccctcttcctggacagcattgtgaagggcatgaagaacctgctcaacagcacgtccctggagaccagcctgtccatcgaggccccctggggcgcgatcaacgtacagagcaccttcaagccgaccgtctccacagccaacatcgccttgtcttggtccagcgtggagcaccgcgggaataagatcctggtgacggggcggtccgagagcatcatgaagctggaggagcgcaccggggtctcctgggacctcggggtggaggatgccagcgagagcaagctgctgaccgtgagcatcatggacctcagtcagatgtactcccccgtcttcgagtacctgagcggagaccgccaggttgaggagtggcccaaggcgacctgcacgggcgactgcccagagcggtgcgggtgcaccagtagcacatgcctgcacaaggagtggccgcactcccggaactggcgctgcaaccccacctggtgctggggcgttgggaccggctgtacgtgctgcggcgtcgacgtgaaggacctcttcaccgaccacatgttcgtgaagtggaaagtcgagtacatcaagaccgaggccatcgtgtgcgtggagctgaccagtcaggagcggcagtgctccctgatcgaggctggaactcgcttcaacctcggccctgtcaccatcaccctgagcgagccccgcaacatacagcagaagctgcctcccgagatcattactctccaccccaaggtggaggaggggttcttcgacctgatgcacgtgcagaaggtcctgtccgccagcaccgtttgcaagctccagtcctgtacccacgggatcccgggggacctccaggtgtaccacatcggaaacttactcaagggcgatcgcgtcaacgggcacctgatccacaaaatcgagccccacttcaacaccagctggatgtcctgggacggctgcgacctggactactactgcaacatgggggactggcccagctgcacgtataccggcgtgacccaacacaaccacgccgccttcgtgaacctcctgaacatcgagaccgactatacgaagaccttccacttccactccaagcgggtcacagcgcacggcgacacgccccagctggacctcaaggcccgcccgacctacggcgccggcgagatcaccgtgctggtggaggtcgccgatatggagctgcacaccaagaaggtggagatatctgggctcaagttcgcgtccctggcctgcaccggctgctacgcctgcagctcagggatcagctgcaaggtgcggatccacgtggacgaacccgacgagctgacggtgcacgtaaagagctccgacccagacgtggtggccgccagcacctccctgatggcgcgcaagctggagttcggcacggacagcaccttcaaggcattctccgccatgcccaaaacgagcctgtgcttctacatcgtggagcgggagtactgcaagtcctgctcagaggaagacacccagaagtgcgtcgacaccaagctcgagcagccgcagtccatcttgatcgaacacaaggggaccatcatcggcaagcagaacgacacgtgcaccgccaagaccagttgctggctagagtccgtcaagagcttcttctacggcctcaagaacatgctagggtccgtgttcggcaacttcttcattgggatcctcctgttcctggccccattcgtgctgcttgtgctgttcttcatgttcggctggaagatcctcttctgcttcaagtgctgccgccgcacccgggggctcttaaaataccgccatttaaaggacgacgaggagacaggctaccggcgcataatcgagcggctcaacaacaagaagggcaaaaaccgcctgttagacggggagcggctcgcggaccgcaagatcgccgagctgttcagcacgaagacccacatcggc

SEQ ID NO: 15459 - RNA, 3495 nt, synthetic construct
  misc_feature 1..3495: note = derived and/or modified CDS sequence (opt11) from CCHVF(CCHVF Min)__KX013481.1__Gn-NSm-Gc
  source 1..3495: mol_type = other RNA
agcgaggaacccggcgacgactgcatctcccgcacccagctccttcgcaccgagacggcggagatccatgatgacaactacgggggcccgggggacaaaatcaccatttgcaatggtagcaccatcgtggaccaacgcctggggtccgaactgggctgctacactatcaaccgggtcaagagctttaagctctgcgagaactccgccacgggcaagacctgcgaaatcgacagcacccccgtgaaatgccgccaggggttctgcctgaagatcacccaggagggccgggggcacgtgaaactgagccgcggcagcgaggtggtgcttgatgcatgcgactcctcctgcgaggtgatgatccctaaggggactggcgacatcctagtcgactgctccggtggtcagcagcacttcctgaaagataacctcatcgacctgggctgcccccacatcccgttgctcgggaagatggccatctacatctgccggatgagcaaccacccccgcaccacgatggccttcctgttttggttctccttcggctacgtgatcacgtgcatcttctgcaaagccttattttactcgctcatcatcatcggcaccttggggaagaagatcaagcagtaccgggagctgaagccccagacctgcacgatatgcgagactgcccccgtgaatgcgatcgacgccgagatgcacgacctcaactgctcctataacatctgtccgtattgcgcgagccgcctgacgtcagacggactggcccggcacgtcccccagtgccccaagagaaaggagaaggtggaagagaccgagctctatctgaatctggagcggatcccatggatcgtccgcaagctcctgcaggtcagcgagtccaccggggtggcgctcaaacgtagctcctggctcatcgtgctgctggtcctccttaccgtgtccctgagcccggtgcaatccgcccccgtcggacacgggaagactatagagacctaccagacccgcgagggcttcaccagcatctgcttattcatgcttggttccatcctgtttctcgtaagctgcctggtgaaggggctcgttgactccgtgtccgactcctttttcccaggcctcagcgtgtgcaaaacgtgcactatcgggtccatcaacggcttcgagatcgaaagtcacaagtgctactgctccctgttctgctgcccgtactgcaggcactgcagcgccgatcgcgagatacaccagctgcacctctcgatctgcaaaaagcggaaaactgggagcaacgtcatgctggccgtgtgcaagcgcatgtgcttccgggcaaccatcgaagcgtcccgcagagccttattgatccgcagcataatcaacacgaccttcgtcatctgcatcctgaccctgactatatgcgtagtatccacgagcgccgtagagatggagaatctcccgagcggcacctgggagcgcgaggaggacctgaccaacttttgtcaccaggagtgccaagtgaccgagacggagtgcttatgtccttacgaggccctggtgctccggaagcccctgttcctggatagcattgtcaaaggcaccaaaaatctcctgaacagcactagcctggagaccagcctctcaatcgaggccccctggggtgcgattaacgtgcagagcaccttcaagccgacagtgtccaccgccaatatcgccctgtcctggtccagcgtcgagcaccgcggaaacaagatcctcgttacagggcggtccgagagcatcatgaagctcgaagaacgcaccggtgtgtcctgggacctgggggtcgaggacgccagcgaatccaagctgctcactgttagcatcatggacttgtctcaaatgtacagccccgtgttcgagtacctgagtggtgaccggcaagtcgaagaatggcccaaggcgacctgcaccggtgactgccccgagcgctgcggctgcacctccagcacgtgcctccacaaggagtggccgcactcccggaactggcgttgtaaccccacatggtgctggggcgtggggaccggctgcacgtgctgtggagtggacgtcaaagacctgttcaccgatcatatgttcgtgaagtggaaggtcgagtacatcaagaccgaggccatcgtctgcgtagagctgaccagccaggaacggcagtgctcgctcatcgaggccgggacccgctttaacctaggccccgtgacgatcaccctgagcgagccccgcaacatccagcaaaagctcccgcccgagatcatcaccctgcaccccaaagtcgaggaggggttctttgacctcatgcacgtgcagaaggtgctgagtgcaagcaccgtttgcaagctccagtcctgtacgcacggcatcccgggggaccttcaggtataccatatcggcaacttgttaaagggcgaccgcataaacgggcacctgatccacaagatagagccccacttcaataccagctggatgtcctgggacggctgcgacctcgactactactgcaacatgggagattggcccagctgtacctacaccggcgtgacgcaacacaaccacgccgccttcgtcaacttactgaacatcgagaccgactacaccaaaactttccactttcactccaagcgtgtgacggcgcacggggatactccccagctcgacctgaaggcccgccctacatacggcgccggcgaaatcacggtgctggtcgaggttgccgacatggagctccacacaaagaaggtagagatcagcgggctgaagttcgcatctctggcgtgcacaggctgctacgcctgcagctcggggatcagctgcaaggtccggattcacgttgacgagccagacgagctcaccgtgcacgtcaagtctagcgaccctgacgtggtggcagccagcacgtccctgatggccagaaaacttgagttcggcacggatagcactttcaaagccttctccgccatgcccaagacgagcctctgcttctacatcgtcgaacgtgagtactgcaagtcctgcagtgaggaagacacccagaagtgcgttgacaccaagctggagcagccacaatcgatcctgatcgagcacaaagggacgattatcggcaaacagaacgacacgtgcacagcgaaggccagctgctggttggagtccgtaaagagcttcttctacggactcaagaacatgctgggttccgtgttcggaaatttcttcatagggatcctcctcttcctggcgccgttcgttctcctggtgctgttcttcatgttcggatggaagatcctcttctgcttcaagtgctgccgccgaactcgggggctgctgaagtacaggcacctcaaagacgacgaggagaccggctaccgccgcatcatcgagcgcctgaacaacaaaaagggcaagaaccgcctgctcgatggggaacgtctcgccgaccgcaagatagccgagctgttcagcaccaagactcacatcggc

SEQ ID NO: 15460 - RNA, 3495 nt, synthetic construct
  misc_feature 1..3495: note = derived and/or modified CDS sequence (opt11) from CCHVF(CCHVF Nakiwogo)__KX013484.1__Gn-NSm-Gc
  source 1..3495: mol_type = other RNA
gcagagggcgtgagcaacgactgcgtctcccgcacccagttaatcaagaccgaggtggccgagatccacgaggacagctacgggggcccaggcgagaagatcacgatctgcaacggctccaccatcgtggaccagcggctcgggagcgagctgggctgctacaccattaaccgcgtcaagacctacaagctgtgcgagaactccgcgactgagaagggctgcgagatcgacagcgtgccggtgaagtgcaagcaggggttctgcctcaaggtcacgcaggagggccgggggcacgtgaagctgtcccgcggcaccgagatcgtgctggacgtctgcgacaccagctgcgagctcatgatcccaaaggggacgggcgacatcctggtggactgctccggcgggcagcagcacttcctgcaggacaacctcatcgacctgggctgccccaacgtgcccctgctcgggaagatggccatctacatctgccggatgtcaaaccacccgaagaccaccatggccttcctgttctggttctccttcggctacgtcatcacgtgcgtggtgtgcaaggtcctgttctacctcctgatcgtgatcggcaccctggggaagaagctcaaacagtaccgcgagctgaagccccagacctgcatcgtgtgcgaaagcatacccgtcaacgtgatcgacgccgagatgcacgagctgaactgcaactataacatctgcccctactgcgcctcccggctcaccagcgacggcctggtgcgccacgtcacccagtgcccgaagcggaaggagaaggtggaggagactgagctgtacctcaacctggagcgcatcccctggctggtgcggcgcctcctgcaggtctccgagagcaccggaatggcgctgaagcggtcctgctggatgaccaccctcctgatcctgctcgtggtcagcctctcccccgtgcagagcgcccccgtgggccaggagaaggccatcgaggtataccaggtgcgcgagagctacacgtccatgtgcctcttcgtgctcgggagcgtcctgttcgccgtgtcttggctggtgaagggcctcatcgacgggatcgggaactctttctttccaggcctgtccgtctgcaagacctgcagcatcgggtcaatcaacggcttcgagatcgagagccacaagtgctactgcagcctgttctgctgtccctactgccgagcctgcagctccgacaagatcacccaccgcatgcacctcaacatctgcaagcggcgcaaggtggggagcaacgtaatgctggccgtctgcaagcgtatgtgcttcaaggccaccgtggaggcctccaacagcgccctgctcatccgctccatcatcaacagcacgttcgtgatctgtgtcctgatcctggtgatctgcgtggtatctaccagcgcggtggacatggaaaacctccccgccggcatctgggagcgggaggaggacctgaccaacttctgccaccaggagtgccaggtgaccgagacagagtgcctgtgcccctacgaggcattgatcctccgcaagcccctgtacctggactcgatcgccaaggggatgaagtccctcctgaacagcaccaacctggagacctccctcagcatcgaggccccctggggcgcgatcaacgtccagtccaccttcaagcccacggtgagcgccgccaatatcgccctgtcctggagctccgtggagcaccgcgggaacaagatcctggtcagcgggcggtccgagtctatcatgaagctcgaggagcgcaccggcatctcctggagcctgggggtggaggacgcctccgagagcaagaccctgaccgtgtccgtcatggacttgagccagatgtactcccccgtgttcgagtacctgagcggcgaccgccaggtggaggagtggccgaaggcgacgtgcaccggcgactgccccgagagatgcggttgcaccagctccacctgtctgcacaaggagtggccccacagccggaattggcgctgcaaccccacctggtgctggggcgtcgggaccggctgcacgtgctgcggcctcgacgtgcgggacctgttcaccgactacatgatggtgaagtggaaggtcgagtacgtgaagaccgaggccatcatgtgcgtggagctgacctcccaggagcgccaatgcagcctcatcgaggccgggacccggttcaacctgggcccggtcaccatcaccctgtccgagccccgcaacgtgcagcagcggctccccagcgagatcgtaacgctgcaccccaagatcgaggaggggttcttcgacctgatgcatgtccagaaggtgctattctgcaagcactccctccaggccaccagctgcacccacggcgtgccgggggacctgcaggtctaccacgtgggcaacctcctgaagggcgacaaggtgaacgggcactccatccacaagatcgagagccacttcaacacctcctggatgagctgggacggctgcgacctggactacttctgcaacatgggggactggccctcctgcacgtacaccggcgtcacccagcacaaccgcgccgcgttcgtgaacatgctcaacatcgagaccgactacacgaagaccttccacttccacagcaagcgggtgaccgcccacggggacacgccccagctggacctgaaggcccgcccgacctacggcgccggcgaggtcacggtgctcgtggaggtagcggacctggagctgcacacaaagaagatcgaggtgtccgggctcaagttcgccagcctgacctgctccggctgctacgcctgcagctccgggatcagctgcaaggtccggatccacgtgaacgagcccgacgagttcacagtgcacgtcaagtcgaacgaccccgacgtggtggccgccggctccagcctgatggcgcgcaagatcgagctcggggccgactccaccttcaaggccttcagctccatgcccaagaacagcctgtgcttctacatcgtcgagcgggactactgctccagctgcacagacgacgacacccagaagtgcgtgaacacgaagctggagcaccctcaatccatcctcatcgagcacaagggcaccatcatcggcaagcagaacgacacgtgccccaccaagaccagctgctggctggagtccgtcaagagcttcttctacgggctgaagaacatgctcggcgggatcttcggcaatgtgttcctggggatcttcctgtttctcgcccccttcgccctgctgatcctcttcttcttcttcggctggcgcctgctgttctgcctcaagtgctgccggcgcacccggggcctgctgaagtacaagcagctcaaggacgaggaggaggcggggtacaagaagattatcgagcggctgaacgacaagaagggcaagtcccgcctgttcgacggggagcgactcgccgaccgcaagatcgccgagctgttcagcaccaagacccacatcggc

SEQ ID NO: 15461 - RNA, 3495 nt, synthetic construct
  misc_feature 1..3495: note = derived and/or modified CDS sequence (opt11) from CCHVF(CCHVF Saf)__KX013487.1__Gn-NSm-Gc
  source 1..3495: mol_type = other RNA
agcgaggagcccggcgacgactgcatctcccgcacgcagctgctccggaccgagacggccgagatccacgacgacaactacgggggcccgggggacaagatcaccatctgcaacggctctaccatcgtggaccagcgcttggggtccgagctgggctgctacaccatcaaccgggtcaagagcttcaagctctgcgagaactccgccacgggcaagacctgcgagatcgactccacccccgtgaagtgccgccaggggttctgcctgaagatcacccaggagggccgggggcacgtgaagctgtcccgcggcagtgaggtcgtgctcgacgcgtgtgactccagctgcgaggtgatgatccccaaagggacgggcgacatcctagtcgactgctccggcgggcagcagcactatctgaaggacaacctcatagacctgggctgcccccacatcccgcttctcgggaagatggccatctacatctgccggatgagcaaccacccccgcaccaccatggccttcctgttttggttctcattcgggtacgtgatcacgtgcatcttctgcaaagccctgttctacagcctcatcatcatcgggaccctggggaagaagataaagcagtaccgggagctgaagccccagacctgcaccatctgcgagaccgccccagtaaacgcgatcgacgccgagatgcacgaccttaactgctcctacaacatctgcccgtactgcgccagccgcctgacgtccgacggcctggcccggcacgtcccccagtgccccaagcgcaaggagaaggtggaggagaccgagctctacctgaacctggagcggatcccctggatcgtgcgcaagctcctgcaggtcagcgagtccaccggggtggcgctgaagcggagcagctggctcatcgtgctgctggtactcctgaccgtgtccctgagcccggtgcagtccgcccccgtcggccacggaaagacgatcgagacctaccagacccgcgagggcttcaccagcatctgcctcttcatgctgggctccatcctgttcctcgtgagctgcctggtgaaggggctggtcgactccgtgagcgactcgttcttccccggcctcagcgtgtgcaagacgtgctccatcgggagcatcaacggcttcgaaatcgagtctcataaatgctactgcagcctgttctgctgcccctactgccggcactgctccgccgaccgcgagatccaccagttgcacctcagcatttgcaagaagcggaagaccgggtccaacgtcatgctggccgtgtgcaagcgcatgtgcttccgggccaccatcgaggcgagccgccgcgccctgttaatcaggtccatcattaacaccaccttcgtcatctgcatcctgaccctgaccatctgtgtggtgagcaccagcgccgtcgagatggaaaacctcccgtccggaacgtgggagcgcgaggaggacctgaccaacttctgccaccaggagtgccaggtgaccgagaccgagtgcctgtgcccctacgaggccctggtgctccggaaacccctgttcagcgactccatcgtcaagggcatgaagaacctgctcaacagcacgtccctggagaccagcctgtctatcgaggccccgtggggcgcgatcaatgtgcagagcaccttcaagcctaccgtgtccaccgccaacatcgccctcagctggtccagcgtagagcaccgcgggaacaagatcctggtgacggggcggtccgagagcatcatgaaacttgaggagcgcaccggcgtgtcctgggacctcggggtcgaggacgccagcgagtccaagctgctgaccgtgtctatcatggacctcagccagatgtacagtcccgttttcgagtacctgagcggcgaccggcaggtcgaggagtggcccaaggcgacctgcacgggcgactgccccgagcgctgcgggtgcacctccagcacgtgcctgcacaaggagtggccgcactcccggaactggcgctgcaaccccacctggtgctggggcgtggggaccggctgcacgtgctgcggcgtggacgtcaaggacctcttcaccgaccacatgttcgtgaagtggaaggtggagtacatcaagaccgaggccatcgtctgcgtcgagctcaccagccaggagcggcagtgcagcctgatcgaggccgggacccgcttcaacctcggccccgtgaccatcaccctgagcgagccccggaacatccagcagaagctgccgcccgagatcatcacgctccaccccaaggtcgaggaggggttcttcgacctgatgcacgtgcagaaggtgctgtccgccagcaccgtctgcaagctccagtcctgcacccacggcatcccgggggacctccaggtgtaccacatcggcaacctgctgaagggcgaccgcgtgaatgggcatctgatccacaagatcgagccccacttcaacaccagctggatgtcctgggacggctgcgacctggactactattgcaacatgggagactggcccagctgcacgtacaccggcgtcacccagcataaccacgccgccttcgtgaacctcctgaacatcgagaccgactacatgaagacgttccacttccactccaagcgggtcaccgcgcacggggatacgccccagctggacctcaaggcccgcccgacctacggtgccggcgagatcaccgtcctggtggaggtcgccgacatggagctgcacaccaagaaggtcgagataagcgggctcaagttcgtgtccctggcgtgcaccggctgctacgcctgcagctccgggatcagctgcaaggtgcggatccacgtcgacgagcccgacgagctgaccgtgcacgtcaagagctccgaccccgacgtcgtggccgccagcacgtccttaatggcccgcaagctggagttcggcaccgacagcaccttcaaggcgttctccgccatgcccaaaaccagcctgtgcttctacatcgtggagcgggagtactgcaagtcctgtagtgaggaggacacgcagaagtgcgtcgacaccaagctcgagcagccgcagtccatcctgatcgagcacaaggggaccatcatcggcaagcagaacgacacgtgcaccgccaaggccagctgctggctggagtccgtcaagagcttcttctacggcctcaagaacatgctggggtccgtgttcggcaacttcttcatcgggatcctgctgtttctggcacccttcgtgctgctcgtgctgttcttcatgttcggatggaagatcctgttctgctttaagtgctgccgccgcacccgggggctcctgaagtaccgccacctgaaggacgacgaggagaccggataccggcgcattattgagcggctcaacaataagaagggcaagaacagactgctggacggggagcggctcgcggaccgcaagatcgccgagctgttcagcaccaagacccacatcggc

SEQ ID NO: 15462 - RNA, 3495 nt, synthetic construct
  misc_feature 1..3495: note = derived and/or modified CDS sequence (opt11) from CCHVF(CCHVF Ast199)__KX056051.1__Gn-NSm-Gc
  source 1..3495: mol_type = other RNA
agcgaggagcccggcgacgactgcatctcccgcacccagctgctaaaaaccgagacggccgaaatccacgacgacaattacgggggcccgggggacaaaatcaccatctgcaacggctcaaccatcgttgaccagcggctcggatccgagctgggctgctacaccataaaccgcgtcaagagctttaaactctgcgaaaactccgccacgggaaagacgtgcgagatcgactccacccccgtgaagtgccggcaggggttctgcctgaaaatcacgcaggaaggccgcgggcacgtgaagctgtcccgaggctccgaggtcgtgctcgacgcgtgcgactccagctgcgagatcatgatccccaaggggacgggcgacatcctggtggattgctccggcgggcagcagcactttctgaaagacaatctcatagacctgggctgcccccatatcccgctgctcgggaaaatggcgatctacatctgccgcatgagcaaccacccccgcaccaccatggccttcttattttggttctccttcggctacgtcattacctgcatcttctgcaaggccctgttctatagcctgatcatcatcggcactctagggaagaagatcaagcagtaccgcgagctaaaaccccagacctgcaccatctgcgaaaccgcgcccgtgaacgcgatcgacgccgagatgcacgacctcaactgctcctacaacatctgcccgtactgcgcaagccggcttacgtccgacggcctggccagacacgtgactcagtgccccaagcggaaggaaaaggtcgaggaaaccgagctctacctgaacctggagcgaatcccctggatcgtgcggaagctcctccaggtgagtgagtccaccggggttgctctaaagcgctgtagctggctgatcgtgctgttggtgctactgacagtcagcctgtcccccgtgcagagcgccccggttggccacgggaaaaccatcgagacctaccagacccgggagggattcacgaacatctgtctcttcatgctgggatccatcctgttcatcgtctcgtgcctcgtgaaggggctggtggactccgtcagcgactccttcttccccggcctgagtgtttgcaagacctgcagtatcggatcgatcaacggcttcgagatcgaatcgcacaagtgctactgcagcctcttctgctgcccgtactgtcgccactgctccgccgaccgggagatccaccagctgcacctggggatctgcaagaagcgcaagaccggctctaacgtgatgctcgccgtctgcaagcggatgtgcttcaaggccaccatcgaggcgtcgcgccgggccctcctgatccgctctatcatcaatacgaccttcgtgatctgcatcctcaccctggcaatctgcgtcgtatccacaagtgccgtggagatggagaacctgcccgccggcacgtgggagcgcgaggaggacctcaccaacttctgccatcaggaatgccaggtaactgagaccgagtgcctctgcccgtatgaggcgctggtgctgcggaagcccctcttcctggactccatcgtgaaagggatgaagaacttactaaacagcacgagcctggagacctccctgagcatcgaggccccttggggagccatcaacgtccagtctaccttcaagcccaccgttagcaccgccaacatcgccctctcctggagctccgtggagcaccgcgggaacaagatcctggtcacgggccggagcgagtccatcatgaagctggaggaacgcaccggggtgagctgggacctcggcgtggaggacgcgtccgagagcaagctgctgaccgtctcaatcatggatctcagccagatgtactccccggtgtttgagtacctaagcggcgaccgccaggtggaggagtggcccaaggctacctgcacaggggactgccccgagcggtgcggctgtacctccagcacgtgcctgcacaaggagtggccccacagtcggaactggcgctgcaacccgacctggtgctggggcgtcgggaccggctgtacgtgctgtggcgtggacgtgaaggacctcttcaccgaccacatgtttatcaagtggaaagtcgagtacataaagaccgaggccattgtgtgcgtggaactgacctcccaggagcgacagtgtagcctgatcgaagccggcacccggttcaacctcgggcctgtaaccatcaccctgtccgagccccggaacatccaacagaagctgccgccggagattataacgcttcaccccaagatcgaggagggcttcttcgatctgatgcacgtgcagaaggtgctgtctgcctccaccgtctgcaagctccaaagctgcacccacgggatccccggcgacctccagatctaccatatcggcaatctgctcaaaggggacaggctgaacggtcacctgatccacaagatcgagcctcattttaacacctcctggatgagctgggacgggtgcgacctcgactactactgcaatatgggcgactggccatcttgtacgtatacaggggtgacccagcacaaccacgcagccttcgtgaacctgctgaacatagagaccgactacacgaaaaccttccacttccacagcaagcgggtaaccgctcacggcgacacgccccagctcgacctgaaggcccgccccacctacggcgcgggggagataacggtgctggtggaagtcgccgacatggagctccacaccaagaaggtggaggtgtccggcctgaagttcgccagcctggcctgcaccgggtgctacgcctgctccagcggcatctcctgcaaggtcagaatccatgtggatgagccggacgagctcacggtgcacgtgaaaagctccgaccccgacgtggtggcggcatcaacctccctgatggcccgcaagctggagttcggaaccgacagcaccttcaaagccttcagcgccatgcccaagacttccctatgcttctacatagtggagcgggagtactgcaagagctgctcagaggacgataccaagaagtgcgtagacaccaaactggagcaaccccagagcattctgatcgagcacaagggcaccatcatcggcaagcagaacgatacgtgtaccgctaaggcttcctgctggctcgaaagcgtgaagtctttcttctacggcctaaagaacatgctgggcagcgttttcgggaacttcttcgtgggcattctcctgttcctggccccattcgtgcttctggtcctgttcttcatctttgggtggaagatcctcttctgcttcaagtgctgccggcggacccgcggcttgttcaagtaccgccacctgaaggacgacgaagagaccggctaccgcaagataatcgagaggttgaatagtaagaaggggaagaaccggctgctggacggcgagcgcctcgccgaccggaagatcgctgagctgttctcgaccaagacgcacatcggg

SEQ ID NO: 15463 - RNA, 3495 nt, synthetic construct
  misc_feature 1..3495: note = derived and/or modified CDS sequence (opt11) from CCHVF(CCHVF Ast149)__KX056054.1__Gn-NSm-Gc
  source 1..3495: mol_type = other RNA
agcgaggaaccaggcgatgactgcatatcccgcacccagctgctgaagaccgagacggcagagatccacgacgacaactacggtggaccgggggacaagatcaccatctgcaacggcagcaccatcgtggatcagagattagggtccgagttgggctgctacaccatcaaccgcgtcaagagcttcaagctctgtgaaaactccgccacgggcaagacctgcgagatcgacagcacccccgtgaagtgtcggcagggcttctgcttaaagatcacccaggagggacgcggacacgtgaaactttcgcggggcagcgaggtcgtgctcgacgcttgcgacagttcttgtgagatcatgatccccaaggggacgggcgacatccttgtggactgcagcggagggcagcagcacttcctgaaagacaacctgatcgacctgggctgcccgcacatcccacttctgggaaagatggcaatctacatctgccgcatgagcaaccacccccggaccaccatggccttcctgttctggttctccttcggctacgtcatcacgtgcatcttctgcaaagccctgttctatagcctcatcattatcggcaccctggggaagaagataaagcagtaccgcgagctgaagccccagacatgcactatctgcgagaccgcgcccgtgaacgcgatcgacgccgagatgcacgacctcaactgctcctacaacatctgcccgtattgcgcaagccggctgacgagcgacggcctggcgaggcacgtcacgcagtgccccaaacgaaaggagaaggtcgaggagaccgagctctacctgaacctggagcgcataccttggatcgtgcggaagctgctccaggtgagcgaatccacaggagtcgcgctgaagcgcagcagctggctcatcgtgttgctggtgctcctgacggtctccctgtcccccgtccagtccgctccggtaggccacgggaagaccatcgagacctaccagactcgggagggatttacgaacatttgcctgttcatgttgggctcgatcctgttcatcgtctcctgtctcgtgaagggcctggttgacagcgtctctgacagcttcttccccggtttgtccgtgtgcaagacctgctctatcggtagcatcaacggcttcgaaatagaaagccacaaatgctactgctccttgttctgctgtccctactgtcgccactgctctgcagacagagagatccaccagctgcacctggggatctgcaagaagcgaaagaccggctccaacgtgatgcttgccgtgtgcaagcggatgtgctttaaggcgaccattgaggctagccgccgggccctgcccatcagaagtatcattaacacgacttttgtgatttgcatccttaccctcgccatatgcgtcgtgagcacctccgcagtggagatggagaatctgccggccggtacgtgggagcgcgaggaagacctgaccaacttctgtcaccaggagtgccaggtgaccgagaccgagtgtctctgcccctacgaggcactggtgctgagaaagcccctgttcctcgacagcatcgtgaaggggatgaaaaacctcctgaacagcacgtccctcgaaacgtcgctgagtatagaagccccctggggcgccattaacgtccaaagcaccttcaagccgaccgtgtccaccgccaacatcgccctgagttggtccagcgtggagcaccgcgggaacaagatcctcgtcacgggccggtctgagagcatcatgaagttggaggagcgcaccggtgtgagttgggatctgggtgtcgaggacgcttctgaatccaagctgctgaccgtcagtatcatggacctgtcccagatgtacagccccgtgttcgagtacctctccggtgacaggcaagtggaggaatggcccaaggcgacctgcacgggggactgtcccgaaaggtgcggctgcaccagcagcacgtgtctgcacaaggagtggccgcattcccggaactggcgctgcaacccgacctggtgctggggcgtcgggaccgggtgcacatgctgtggggtggacgtgaaggatctgttcaccgaccacatgttcatcaagtggaaggtcgaatacataaagaccgaagcgatagtgtgcgtagagctcaccagtcaggaacggcagtgctccctgatcgaggccggcacccgcttcaacctggggcctgtcaccataaccctcagcgagccccggaatatccagcagaagttaccgcccgagatcataacactgcacccaaagatcgaggagggattcttcgacctcatgcacgtgcaaaaagtgttgtcggcatcaaccgtgtgcaagctgcaaagttgcacccacgggatccccggcgacctccagatctatcacatcggcaacctgcttaaaggcgaccgcctcaacggccatctgatccacaagatcgagccccatttcaacaccagctggatgtcctgggacgggtgcgacctggactattactgcaacatgggcgactggcccagctgcacgtatactggggtgacgcagcacaaccacgccgccttcgtgaacctcctaaacatcgagaccgactacaccaagaccttccacttccacagtaagcgagtcaccgcccacggggacacgccccagctggacctcaaggcccgcccaacctatggcgcgggggagatcacggtgctggttgaggtcgcagacatggagctgcataccaagaaagtggaggtgagcggacttaagttcgcctccctggcgtgcacggggtgttacgcttgcagctccggcatcagctgcaaagtccgaatccacgtggacgagcccgacgaactgaccgttcacgtcaaatctagcgaccccgatgtggtggcggcctccaccagcctcatggcacggaagctggagttcgggaccgacagcaccttcaaggccttctccgctatgcccaagacgagcctgtgcttctacatcgtcgagcgggagtactgcaagtcctgcagcgaagatgacactaagaagtgcgtggacaccaagctcgaacagccgcaatctatcctgatcgagcacaagggcaccatcatcggcaaacagaacgacacgtgtaccgcgaaggccagctgctggctggagtccgttaagagcttcttttacgggctcaaaaacatgctgggcagcgtgttcgggaacttcttcgtggggatcctcctgttcctggccccgttcgtgctgctcgccctgttcttcatattcgggtggaagatcctgttctgcttcaagtgctgccggcgcacccgcggcctcttcaagtataggcacctgaaggacgacgaggagaccggctacaggaagatcatcgagcgcctgaacagcaagaaggggaagaaccggctcctggacggcgagcgcctggccgaccggaagatagcggagttgttctccactaagacgcatatcgga

SEQ ID NO: 15464 - RNA, 3495 nt, synthetic construct
  misc_feature 1..3495: note = derived and/or modified CDS sequence (opt11) from CCHVF(CCHVF Ast137)__KX056057.1__Gn-NSm-Gc
  source 1..3495: mol_type = other RNA
agcgaggagcccggcgacgactgcatctcccgcacgcagctgctcaagaccgagacggccgagatccacgatgacaactacgggggcccgggggacaagatcaccatctgcaacggcagcaccatcgtggaccagcggctggggtccgagctgggctgctacaccatcaaccgcgtcaagagcttcaagctctgcgagaactccgccacgggcaagacctgcgagatcgacagcacccccgtgaagtgccggcaggggttctgcctgaagatcacccaggagggccgcgggcacgtgaagctgtcccggggcagcgaggtcgtactcgacgcgtgcgactccagctgcgagatcatgatccccaaggggacgggcgacatcctggtggactgctccggcgggcaacagcacttcctgaaggacaacctcatcgacctgggctgcccacacatcccgctgctcgggaagatggccatccacatctgccgcatgagcaaccacccccggactaccatggccttcctgttctggttctccttcggctatgtcatcacgtgcatcttttgcaaggccctgttctacagcctcatcatcatcggcaccctgggcaagaagatcaagcagtaccgcgagctgaagccccagacctgcaccatctgcgagaccgcacccgtgaacgcgatagacgccgagatgcacgacctcaactgctcgtacaacatctgcccgtactgcgccagccggttgacgtccgacggcctggcccgccacgtgacccagtgccccaagcggaaggagaaagtcgaggagaccgagctctacctgaacctggagcgcatcccctggattgtgcggaagctcctccaggtgtcagagtccaccggggtcgcgcttaagcgcagcagctggctgatcgtgctgctggtgctgctgacggtctccctgagccccgtgcagtccgccccggtgggccacgggaagaccatcgagacctaccagacacgggaaggcttcacgaacatctgcctctttatgctgggcagcatcctcttcatcgtctcctacctcgtgaaggggctggtggacagcgtctccgacagcttcttccccggcctgtccgtgtgcaagacctgcagtatcgggtccatcaacggcttcgagatcgagagccacaagtgctactgctccctcttctgctgcccctactgccgccactgcagcgccgaccgggagatccaccagctgcatctggggatctgtaagaaacgcaagactggctccaacgtgatgctcgccgtctgcaagcggatgtgcttcaaggcaaccatcgaggcgagccgccgggccctgctgatccgctccataatcaacacgaccttcgtgatctgcatcctcacactggccatctgcgtcgtgtcaacctccgccgtggagatggagaacctgcccgccggcacgtgggagcgcgaggaggacctcaccaacttctgccaccaggagtgccaggtcaccgagaccgagtgtctgtgcccgtacgaggcgctggtgctgcggaagcccctcttcctggacagcatagtcaaggggacgaagaatctgctcaacagcacctccctggagaccagcctgtccatcgaggccccctggggcgccatcaacgtccagagcaccttcaagcccaccgtgtccacggccaacatcgcactcagctggtccagtgtggagcaccgcgggaacaagatcctggtcaccggccggtccgagagcatcatgaagctggaggaacgtaccggggtaagttgggacctcggcgtggaggacgcgagcgagtccaagctgctgaccgtcagcatcatggacctctcccagatgtacagcccggtgttcgagtacctgtccggtgaccggcaggtagaggagtggcccaaggccacgtgtaccggggattgcccagaacggtgcggctgcaccagcagcacttgcctgcacaaggagtggccccactcccggaactggcgctgcaacccgacctggtgctggggagtcgggaccggctgcacgtgctgcggggtggacgtgaaggacctcttcaccgaccacatgttcatcaagtggaaggtcgagtacatcaagaccgaggccatcgtgtgcgtggagctgaccagccaggagcggcagtgctccctgatcgaggccggcacccgcttcaacctcgggcccgtcaccatcacgctgagcgagccccggaacatccagcagaagctgcccccggagataatcaccctccaccccaagatcgaggagggcttcttcgaccttatgcacgtgcagaaggtgctgtccgccagcaccgtctgcaagctccagtcctgcacccacgggatccccggcgacctgcagatttaccatatcggcaacctgctcaagggggaccgcctgaacggccacctgatccacaagatcgagccgcacttcaacacgagctggatgtcctgggacgggtgcgacctcgactactactgtaacatgggcgactggccaagctgcacatacaccggggtgacccagcacaaccacgcggccttcgttaacctgctgaacatcgagacggactacaccaagaccttccacttccactccaagcgggtcaccgcccacggcgacacgccccagctcgacctgaaggcccgccccacctacggcgcgggtgagatcaccgtgctggtggaggtcgccgacatggagttacataccaagaaggtggaggtgagcggcctgaagttcgcctcactggcctgcacggggtgctacgcctgcagctccggcatcagctgcaaggtccggattcacgtcgacgagccggacgagctcaccgtgcacgtcaagtccagcgacccagacgtggtggctgcctccaccagcctgatggcccgcaagctggagttcgggaccgacagcacgttcaaggccttctccgccatgcccaaaacctccctctgcttctacatcgtcgagcgggagtactgcaagtcctgcagcgaggacgacaccaagaaatgcgtggacaccaagctggagcagccccagtccatcctgatcgagcacaagggcaccataatcggcaagcagaacgacacgtgcaccgcgaaggccagctgctggctcgagtccgtcaagagcttcttctacgggctgaagaacatgctgggctccgtgttcgggaatttcttcgtgggcatcctactgtttctagccccgttcgtgctcctggtcctgttcttcatcttcgggtggaagatcctcttctgcttcaagtgctgccgccggacccgcggcctgttcaagtacaggcacctgaaggacgacgaggagaccggctaccggaagatcatcgagcgcctcaacagcaaaaaggggaagaaccgcctgctggacggcgagcgcctcgccgaccggaagatcgccgagctgttctccacgaagacccacataggg

SEQ ID NO: 15465 - RNA, 3495 nt, synthetic construct
  misc_feature 1..3495: note = derived and/or modified CDS sequence (opt11) from CCHVF(CCHVF Ast133)__KX056060.1__Gn-NSm-Gc
  source 1..3495: mol_type = other RNA
agcgaggagccagacgacgattgcatttcccgcacccagctgctcaaaaccgagacggccgaaatccacgacgacaactacggcgggccgggcgacaagatcaccatctgcaacgggagcaccatcgtggaccagagactgggctcggagctcgggtgctacaccatcaaccgcgtcaagagcttcaagctctgcgagaactccgccacgggcaagacctgcgagatcgacagcaccccagtgaaatgccggcagggcttctgcctgaagatcacccaggaggggcgtggtcacgtgaagctctcccggggtagcgaggtcgtgctcgatgcgtgcgattccagctgcgagatcatgatcccgaagggcacgggggacatcctggtggactgctccggcggccagcagcatttcctgaaggacaacctcatcgacctggggtgcccccacatcccgctgcttggcaagatggccatctacatctgtcgcatgagcaaccacccccggacaaccatggccttcctgttctggttctccttcgggtatgtcatcacgtgcatcttctgcaaggcccttttctacctcctgatcatcatcggcaccctgggcaagaagattaaacagtaccgcgagctcaagccccagacctgtaccatctgcgagaccgcccccgtgaacgccatcgacgccgagatgcacgacctgaactgcagctataacatctgcccgtactgcgcctcccggctgacgagcgacgggctggcaaggcacgtgacccagtgccctaagcggaaggagaaggtcgaggaaaccgagctctacctgaacctcgagcgcattccctggatcgtgagaaagctgctccaggtgtccgagagcaccggcgtcgcgctcaagcgctccagctggctgatcgtgctgttggtgctgctgacggtctctctctccccagtgcagagcgccccggtggggcacggcaagaccattgagacctaccagacccgggaggggttcacgtccatctgcctgttcatgctgggatccatcctcttcatcgtctcctgcctggtcaagggcctggtggactcagtctccgactctttcttccccgggctctccgtgtgcaagacttgcagcatcggttccatcaacgggttcgagatcgaaagccacaagtgctactgctccctgttctgttgtccctactgccgccattgttctgccgaccgggagattcaccagctgcacctctccatctgcaagaagaggaagaccggctctaacgtgatgctggccgtctgcaaacggatgtgcttcaaggccaccatcgaggcgtcccgccgcgccctgctcatccgcagcatcatcaacacgaccttcgtgatgtgcatcctgaccctggctatctgcgtcgtgtccaccagcgccgtggagatggaggaccttccggccgggacgtgggagcgcgaggaggacctgaccaacttctgccaccaagagtgccaggtcaccgagaccgagtgtctgtgcccgtacgaggcgctggtgctacgcaagcccctgttcagcgactccatcgtgaagggcatgaagaacctgctcaatagcacgtccctggagaccagcctgtccatcgaggccccctggggagccatcaacgtacagtcaaccttcaagcccaccgtgtccaccgccaacatcgctctcagctggtccagcgtggagcaccgcgggaacaagatcctggtgacgggccggtccgagagcatcatgaagctcgaggagcgcaccggtgtgtcctgggacctcggggtggaggacgcaagcgagtccaaactgctgaccgtcagcatcatggacctctctcagatgtacagcccggtgttcgagtacctgagcggggaccgccaggtggaggagtggcccaaggcgacctgcacgggggactgccccgagcgatgcgggtgcacctccagcacgtgcctgcacaaggagtggccccactctcggaactggcgctgcaacccgacctggtgctggggcgtcgggaccggatgcacgtgttgcggcgtggacgtgaaggacttgttcaccgaccacatgttcatcaagtggaaggtcgagtacatcaagacagaggccatcgtgtgcgtggagctgacatcccaagaacgccagtgttccctgatcgaggccggcacgcgcttcaacctcgggcccgtcaccatcacgctgagcgagcctcggaatatccagcagaagctgcccccggaaatcatcacgctacacccgaagatcgaggaggggttcttcgacctcatgcacgtacagaaggtgctgtccgccagcacagtctgcaagctccagtcctgcacccatgggatccccggcgacctgcagatctaccacatcgggaacctgctcaagggcgaccgcgtgaacggccacctgatccacaagatcgagccgcacttcaacaccagctggatgtcctgggacgggtgcgacctggactactactgcaatatgggcgactggcccagctgtacgtacaccggggtgacccagcataaccacgccgccttcgtaaacctcctgaacatcgagaccgactacaccaagaccttccacttccactccaagagggtgaccgcccacggcgacacgccccagctggacctcaaagcccgccccacctacggggcgggcgagataaccgtgcttgtcgaggtggccgacatggagttgcacaccaagaaggtggagatcagcggcctcaagttcgcctccctgacctgcacggggtgctacgcctgcagctccggcatcagctgcaaggtccggatccacgtggacgagccggacgagctaaccgtgcacgtcaagtccagcgaccccgacgtcgtggccgcgagcacatctctcatggcccggaaactggagttcgggaccgacagcacgttcaaggccttctccgccatgcccaagaccagcctgtgcttctatatcgtcgagcgggagtactgcaaatcctgcagcgaagacgacaccaagaagtgcgttgacaccaagctcgagcagccccagtccatcctgatagagcacaagggcaccatcatcgggaagcagaacgacacgtgcaccgccaaggcgagctgttggctggagtccgtcaagagcttcttctacggcctcaaaaacatgctgggctccgtgttcgggagcttcttcgtgggcatcctcctgttcctggccccgtttgtgttgctcgtccttttcttcatgttcgggtggaagatcctgttctgcttcaagtgctgccgcaggacccgcggcctctttaagtaccgccacctgaaggacgacgaggagaccggttaccggcgcatcatcgagcggctgaactccaagaagggcaaaaaccgcctcctggacggggagcggctggccgaccgcaagatcgccgaactgttcagctccaagacccacatcggg

SEQ ID NO: 15466 - RNA, 3495 nt, synthetic construct; identical to SEQ ID NO: 12180
  misc_feature 1..3495: note = derived and/or modified CDS sequence (opt11) from CCHVF(CCHVF SK/2015/human)__KX458183.1__Gn-NSm-Gc
  source 1..3495: mol_type = other RNA

SEQ ID NO: 15467 - RNA, 3495 nt, synthetic construct
  misc_feature 1..3495: note = derived and/or modified CDS sequence (opt11) from CCHVF(CCHVF YL16070)__KY354081.1__Gn-NSm-Gc
  source 1..3495: mol_type = other RNA
gctgagggtgggagctccgactgcatcagccgcacccagctggtgaagaccgaggtcgccgagatccacgaggactcctacggcgggcccggggagaagatcacgatctgcaacgggagcaccatcgtggaccagcggctcggctccgagctgggctgctacaccatcaaccgcgtcaagagctacaagctgtgcgagaactccgcgagcgggaagtcctgcgagatcgacagcatcccggtgaagtgcaagcagggcttctgcctcaagatcacccaggaggggcggggccacgtgaagctgtcccgcgggacggagatcgtcctggacgtctgcgacagctcctgcgagctcatgattcccaagggcaccggcgacatcctggtggactgcagcgggggccagcagcacttcctgcagaacaatctcatcgacctggggtgccccaacgtgcccctgctcggcaagatggccatctacgtctgccggatgtccaaccacccgaagaccaccatggccttcctgttctggttcagcttcgggtacgtgatcacgtgcatcgtctgccgcgtcctgttctatctcctgatcgccatcgggaccgtgggcaagaagctgaagcagtaccgggagcttaagccccagacctgcatcgtgtgcgagtccgtacccgtgaatgccatcgacgcggagatgcacgagttgaactgcagctacaacatctgcccctactgcgcctcccgcctaagcaccgacgggctcatccggcacgtgacgcagtgccctaagcgccgggagaaggtcgaggagaccgagctgttcctgaacctcgagcgcatcccctggctggttcggaagctgctccaggtgagcgagtccaccggcatggccctgaagcgcagctgctggatgatcaccctgctcatcctgctgctcgtctcaatgagccccgtgcagtccgcccccgtggggaaggagagagcgatcgaaacgtaccaggcccgcgaggcctacaccggcatctgcctgttcgtcctgggcagcgtactcttcgccgtgtcctggctcaccaaggccctgatcgacgggatcggcaacagcttcttcccggggctctccgtgtgcaagacctgcagcatcggctccatcaacgggttcgagatcgagagccacaagtgctactgctccctgttctgctgcccctactgccgggcgtgcagctccgacaagaacacgcaccgcatgcacctgaacgtgtgcaagaagcggaagatgggtagcaacgtcatgctcgcggtgtgcaagcgcatgtgcttccgggccaccatcgaggcctccaacaaggccctgctgatccgcagcatcatcaactccaccttcgtgatatgcatccttatcctgaccatctgcgtcgtgagcacgagcgcggtggacatggagaacctgcctgccggcatctgggagaaggaggaggacctcaccaatttctgccaccaggagtgccaggtaaccgagaccgagtgcctgtgcccctacgaggccatggtgctgcgaaagccgcttttcctcgactccatcgccaaggggatgaaaagcctgctgaactccacgagcctcgagacctccctgagcatcgaggccccctggggcgcgatcaacgtgcagagtaccttcaagcccaccgtctccgccgccaacatcgccctgtcctggagctccgtggagcaccgggggaacaagatcctcgtgagcggccgctccgagagcatcatgaagctggaggaacggactggggtctcctggaacctgggcgtggaggacgccagcgagtccaagaccctcaccgtgagcgtcatggacctgagccagatgtactccccagtgttcgagtacctgagcggcgaccgccaggtggaggagtggccgaaggcgacctgcacgggggactgccccgagcggtgcggctgcacctcaagcacgtgcctccacaaggagtggccccacagccgcaactggcggtgcaacccaacctggtgctggggcgtcgggaccggctgcacgtgctgcgggctggacgtgaaggacttcttcaccgactacatgctggtgaagtggaaggtcgagtacatcaagaccgaggccatcgtctgcgtggagctcaccagccaggagcgccagtgctccctgatcgaggcaggcacgcggttcaacctggggccggtcaccatcaccctctccgagccccgcaacgtgcagcagcggctgccgcccgagatcgtgaccctgcaccccaagatcgaggagggcttcttcgacctcatgcacgtccagaagatcctgtccgccagcacggtgtgcaagctgcagtcctgcacccacggggttcccggcgactttcaggtctaccacgtgggcaatctcctgcgcggggacaaggtgaacggccacagcatccacaagatcgaaccacacttcaacacctcctggatgagctgggacgggtgcgacttggactacttctgcaacatgggcgactggccgtcctgcacctacacgggtgtcacccagcacaaccgggcggccttcatcaacatgctcaacatcgagaccgactacaccaagacgttccacttccacagcaagcgcgtgaccgcccacggcgacacgccccagctggacctgaaggcccggcccgcctacggcgcgggggaggtgaccgtattagtggaggtggccgacctggagctgcacaccaagaagctcgaggtctccggcctgaagatcgccagcctgacctgctccgggtgttacgcctgcagcagcggcatctcctgtaaggtgcgcatccacgtgaacgagcccgacgagttcaccgtccacgtgcggagctccgacccggacgtggtcgccgcggggagctccctcatggcccgcaagatcgagttcggcgccgacagtaccttcaaggccttctccagcatgcccaaggacagcctgtgcttctacatcgtggagaaggactactgcagctcatgcacggacgacgacacccaaaagtgcgtgaacaccaagctggaccacccccagagcatcctcatcgagcacaagggcaccataatcgggaagcagaacgacacgtgctccaccaagaccagctgctggctgaagtccttcaagggcttcttctacgggctgaagaacatgctcagcggcattttcgggaacgtcttcctgggcatcctcctgttcttagcccccttcgtgctgctcatcttcttcttcttcttcggctggcggctgctgttctgcctcaagtgctgcaagaagaccaaggggctgctgaagtacaagcacctcaaggacaaggaggaggcgggctacaagaagatcatcgagcgcctgaacgggaagaagggcaagtcccagctgttcgacggcgagcgcctcgccaaccggaagatcgccgagctgttcagcacgaagatccacatcggg

SEQ ID NO: 15468 - RNA, 3495 nt, synthetic construct
  misc_feature 1..3495: note = derived and/or modified CDS sequence (opt11) from CCHVF(CCHVF Oman_812956)__KY362518.1__Gn-NSm-Gc
  source 1..3495: mol_type = other RNA
agcgaggagtccggcgaggactgtatcagccgcacccagctgctccggaccgagacggcagagatccacggggacaactacggcgggcccggtgacaagatcaccatctgcaacggttccaccatcgtggaccagcgcctgggcagcgagctgggctgctacaccatcaaccgggtcaagtcattcaagctctgcgagaacagcgccacggggaagtcctgcgagatcgacaacaccccggtgaagtgcaagcagggcttctgcctgaagatcacccaggaggggcgtggccacgtgaagctgagccgggactccgaggtagttctcgatgcgtgcgacagctcctgcgagatcatgatccccaaggggaccggcgacatcctggtggactgcagcggcgggcagcagcacttcctgaaggacaacctcatcgacctaggctgccccaacatccccctgctcgggaagatggccatctacatctgccgcatgtccaaccacccgaagacgaccatggccttcctgttctggttcagcttcggctacgtcatcacgtgcatcctgtgcaaggtgatcttctacctcctgatcgtggtcggcaccctggggaagaagttcaagcagtaccgggagctcaagccccaaacctgcaccatctgcgagaccacccccgtgaacgccatcgacgccgagatgcacgacctgaactgctcctacaacatctgcccctactgcgcgagccgcctgacgtccgacggcctcgcccggcacgtgatgcagtgccccaagaggaaggagaagatcgaggagaccgagctgtacctgaatctcgagcggatcccctgggtcgtgcgcaagctgctccaggtgagcgagtccaccggggtcgccctcaagcggagcagctggctgatcgtgctgctcgtgctgctgaccgtctccctcagccccgtgcaatccgcccccatcggccacgggaagacgattgagacctaccagacccgcgagggctacaccagcatctgcctgttcgtgctgggctccatcctcttcatcgtcagccacctgatgaaggggctggtggactccgtgggcaatagcttcttcccagggctctccatctgcaagacgtgcagcataggctccatcaacgggttcgagatcgagagccacaagtgctattgctccctgttctgctgcccctactgccggcactgcagcgcggacaaggagatccacaagctgcacctctccatctgcaagaagcgcaaggccggaagcaacgtcatgctggccgtgtgcaagcggatgtgtttccgcgccaccatggaggtctccaacaaggccctgctcatacgcagcgtgatcaacaccaccttcgtggtctgcatcctgatcctggctgtgtgcgtggtctccaccagcgccgtggagatggagagcctccccgccggcacctgggagcgcgaggaggacctgacgaacttctgccaccaggagtgccaggtgaccgagacggagtgcctgtgcccctacgaggccctagtcctccggaagccgttgttcttcgactccatcgccaaggggatgaagaacctgctcaacagcacatccctggagaccagcctgtccatcgaggcgccctggggagccatcaacgtgcagagcaccttcaagcccacggtgtccaccgccaatatagccctcagctggtccagcgtcgagcaccgcgggaacaagatcctggtgtccggccgcagcgagtccatcatgaagctggaggagcggaccgggatcagctgggacctcggcgtggaggatgcctccgagagcaagctgctgaccgtctccgtaatggacctcagccagatgtacagccccgtgttcgagtacctgtccggcgaccgccaggtcgaggagtggccgaaggcgacctgcacgggggactgcccggagcggtgcggctgcaccagctccacgtgcctgcacaaagagtggccccacagccgcaactggcggtgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgttgagctgacctcccaggagcgccagtgcagcctcatcgaggccggcacccggttcaacctcgggcccgtaaccatcaccctgtccgagccccgcaacatccagcagaagctaccgcccgagatcgtgacgctgcacccccggatcgaggagggcttcttcgacctgatgcacgtccagaaggtgctcagcgcctccaccgtgtgcaagctgcagagctgcacccacggggtccccggcgacttacaggtgtaccacatcggcaacctgctgaagggggacaaggtgaacggccacctgatccataaggtcgagccccacttcaatacctcctggatgagctgggacgggtgcgacctcgactactactgcaacatgggcgattggccgtcttgcacgtacaccggggtgacccagcacaaccacgccgcgttcgtgaacttactgaacattgagaccgactacacgaagaacttccacttccacagcaagcgagtcaccgcccacggcgacacgccccagctcgacctgaaggcccggcccaactacggcgccggggaaatcaccgtgctggtggaggtcgcggacatggagctccacaccaagaaaatcgagatctccggcctgaagttcgccagcctgacctgcaccgggtgctacgcctgttccagcggcatctcctgcaaggtgcgcatccacgtcgacgagcccgatgagctcaccgtccacgtcaagagcgaggacccggacatcgtggccgcgagctccagcctgatggcgcggaagctggagttcgggacggactccaccttcaaggccttcagcgccatgcccaagacctccctctgcttctacatcgtggagcgcgagtactgcaagagctgctccaaagaggacacccagaagtgcgtgaacgccaagctggagagaccccagagcatcctgatcgagcacaagggcacgatcatcggcaagcagaacgacacgtgcaccgccaaggcgtcctgttggctcgagagcgtgaagtccttcttctacggcctgaagaacatgctgagcggcatcttcgggaacgtcttcatcggcatcttcctcttcctggcgcccttcatcctgctcatcttgttcttcatgttcgggtggcgcatcctgttctgcttcaagtgctgccggcgcacccggggcctcttcaagtaccgccacctgaaggacgacgaggagaccggctaccgcaagataatcgagcggctgaacaacaagaaggggaagaacaagctcctggacggcgagcgcctggccgaccggaagatcgccgagctgttctccaccaagacccacatcggg

SEQ ID NO: 15469 - RNA, 3495 nt, synthetic construct
  misc_feature 1..3495: note = derived and/or modified CDS sequence (opt11) from CCHVF(CCHVF UCCR4405)__KY484029.1__Gn-NSm-Gc
  source 1..3495: mol_type = other RNA
tccgaagaacccggcgacgactgcatatctcgcacccaactcctgaaaaccgaaaccgctgaaatacatgacgacaactacggagggccaggagataaaattactatctgcaacggaagcacaattgtggaccaacgcctaggctcggaactcggctgctacacaataaaccgcgtaaaatccttcaaactctgcgaaaactccgcaacaggcaaaacatgcgaaatcgactccacgccggttaagtgccggcaaggcttttgtctcaaaatcacccaggagggccgcggccatgtaaaactatcccgtggcagcgaagtcgtcctagacgcttgtgactctagctgcgaggtgatgattcctaaagggacaggagatatcctagtggactgctccggcgggcaacaacacttcctcaaagacaaccttatagacctagggtgcccgcacataccactcctgggcaaaatggcaatctacatctgccgaatgagcaaccaccctcgcactaccatggccttcctattctggttcagcttcggatacgtaatcacctgtatcttttgcaaagcccttttctacagcctaatcataataggcaccctaggaaagaaaatcaaacaatacagggaactaaaaccccaaacatgcaccatctgcgaaacagcaccagtgaatgccatagatgccgaaatgcacgatctgaaatgctcctacaacatctgcccatactgcgcttcccgactcacgagtgacggacttgcacgccacgtcacacaatgcccaaaacgaaaagagaaagtagaagaaacagaattatatctaaatctagaacgaataccctggatagtccgaaaactactccaagtatcagaatccacgggcgtagccctcaagcgatccagctggctcatcgtcctcctcgtcctgcttaccgtctccctgagccctgtgcagtccgcccccgtgggacacggaaaaacaatcgagacttaccaaacaagagaaggctttacctcgatatgcctcttcatgctcggtagcatcctcttcatcgtatcctgcctagtaaagggactggtcgactccgtctctgactctttcttccccggtctatccgtatgcaaaacttgctctataggatcgatcaacggatttgaaattgaatcccacaagtgctactgtagccttttctgctgcccctactgccgtcactactccgcagaccgggaaatccaccaactccacctttcaatctgtaagaaacgaaaaactgggtccaacgtcatgctagccgtgtgcaaaaggatgtgcttcaaagcgaccatagaagcatccagacgagccctactaataagatccataataaacacaaccttcgtcatctgcatcctgatactcgccatctgcgttgtctccacctcagcagtcgaaatggaaaacctccccgcgggcacctgggagagagaagaagatctcacgaatttctgccaccaagagtgtcaagtcaccgaaaccgaatgtctatgcccatacgaagcactcgtgctccgaaaacctctcttccttgactctaccgttaaaggcatgaaaaatctactcaactctacctccctcgagacttcgctatccattgaagcaccctggggcgcaatcaacgtccaatcgaccttcaagccaacagtctccacagctaatatcgcactatcctggtcatcggtcgaacaccgaggcaacaagatcctagtaacaggccggagcgaatccatcatgaaactcgaagaacggactggcgtgtcatgggacctaggagtggaagacgcatcggaaagtaaactcctcaccgtgtccataatggacctgtcccagatgtattcacccgtattcgaatacctcagcggcgaccggcaagtcgaagaatggccgaaagcaacatgcacaggagactgccccgaaagatgcggatgcaccagctcgacctgcctccacaaagaatggccgcactcccgcaactggcgatgcaatccaacctggtgctggggagtaggcactggctgcacttgctgcggcgtcgacgtaaaggacctattcaccgaccacatgttcgttaaatggaaagtcgaatacatcaaaaccgaagccatagtttgtgtcgaactgacctcccaagaacgacaatgctccctcatcgaagctggcacgagattcaaccttgggcccgtaacaattaccttatccgaaccacgcaacatacaacaaaaactaccacccgaaatcataaccctacaccccaaaatagaagaaggcttcttcgacctaatgcacgtacagaaggtgctcagcgcctccaccgtctgcaaactccaaagctgcactcacggcatccccggcgacctccagatataccacataggtaacctgttaaaaggggacagagtaaacggccatcttattcacaagatcgaaccccattttaacacaagctggatgagctgggacgggtgcgacctcgattactactgcaacatgggaaattggccctcgtgcacctatacaggagtaacccaacacaaccacgctgcattcgtcaacttactcaacatagaaacagactacacaaaaacctttcactttcacagcaaacgcgtcaccgcacatggcgacacaccccagctcgacctaaaagctcggccgacctacggagccggggaaatcaccgtcctcgtagaagtcgccgacatggaactgcacaccaagaaagtcgaaatatcggggctgaaattcgcctccctggtatgtactggctgctacgcatgctcatctgggatcagctgcaaagtccgaatccacgtcgacgaaccagacgaactcacggtccacgtcaaaagctccgaccccgacgtcgtcgcagcatccacgagcctcatggcccgcaaactagagttcggcacggacagtatcttcaaagcattttccgcaatgccaaaaacaagcctctgcttctacattgtggaacgcgaatactgcaaatcctgctcagaagacgacacaaagaaatgcgtcgacaccaaactagaacaaccacaatccatcctaatcgaacataagggaaccatcataggcaaacaaaatgacacctgtacagccaaggcctcatgctggctagaatccgtaaaatctttcttctacggtctcaaaaacatgctcggatcagtattcggcaacttctttgtcggcatcctcctattcctggctccattcgtccttctcgttctcttctttatgtttggctggaaaatcctcttctgcttcaaatgctgccgtcgaacacgcggactattcaagtacagacacctcaaagacgacgaagagactggctaccgccggattatagaacgccttaactccaagaaaggcaaaaacaggctactcgacggcgagcggctggccgacaggaaaatcgccgaacttttcagcaccaaaacacatatcggt

SEQ ID NO: 15470 - RNA, 3495 nt, synthetic construct
  misc_feature 1..3495: note = derived and/or modified CDS sequence (opt11) from CCHVF(CCHVF UCCR4459)__KY484032.1__Gn-NSm-Gc
  source 1..3495: mol_type = other RNA
agcgaggagagcggcgacgactgcatcagccgcacccagctgtcccggaccgagacggccgaaatccacagcgacaactacgggggacccggggacaagatcaccatctgcaacggctccactatcgtggaccagcggcttggaagcgagctgggctgctacaccatcaaccgggtaaaatctttcaagctgtgcgagaacagcgccacgggcaagtcctgcgagatcgacagcaccccgataaagtgtcgccaggggttctgcctcaaaatcacccaggagggccgggggcacgtgaagttgtcccggggcagcgaggtggtcctggacgcgtgcgactccagctgtgagatcatgatccccaagggaaccggcgacatcctcgtagactgctccggcgggcagcagcacttcctgaaggacaacctgatcgacctcggctgtcccaacatccccctgctggggaagatggccatctacatttgccgcatgagcaaccacccgaagacgaccatggccttcctcttctggttctccttcggctacgtgatcacgtgcatcctgtgcaaggtcatcttctatctgctcatcgtggtgggcactctggggaagaaattcaagcagtacagggagctgaagccccagacctgcaccatctgcgagaccacccccgtcaacgccatcgacgccgaaatgcacgacctcaactgcagctacaacatctgcccctactgcgcctcccggctgacgtcggacggcctggcccgccacgtgatgcagtgcccgaagcgtaaggagaaggtggaggagaccgagctctacctgaacctggagcgcatcccctgggttgtgcggaagttactccaggtgtccgagtccaccggggtcgccctgaagcgcagttcctggcttgtggtgctgctggtactcctgaccgtgagcctgtcccccgtgcagagcgcgcccatcggccacgggaagacggtcgagacctaccagaccagggagggctacacctccatctgcctcttcgtgctgggcagcatcctgttcatcgtgtcctgccttatgaaggggctggtcgacagcgtgggcaactcattcttcccggggctgagcatatgcaagacgtgctcaatcggcagcatcaacgggttcgagatcgagtcccacaagtgctactgtagcctattctgctgcccctactgccggcactgctccgcggaccgggagatccacaagctgcacctgagcatctgcaaaaagcgcaagaccggctccaacgtaatgctcgcagtttgtaagcgcatgtgcttccgcgccaccgtggaggttagcaacaaggccctgcttatccggaacatcatcaacaccacgttcgtggtatgcatcctcatcctagccgtctgtgtggtgagcacctccgcggtcgagatggagagcctgcccgccggcacctgggaacgcgaggaagacctcaccaacttctgccaccaggagtgccaggtgacggagaccgagtgcctgtgcccctatgaggccctggtactgcgcaagcccctcttctccgactctatcgtcaaggggatgaagaacctgctcaattccaccagcctggagacatccctgagcatcgaggccccctggggcgccatcaacgtgcagtcaacgttcaagcccaccgtgagcgcggccaacatcgccctgtcctggagctccgtcgagcaccgggggaacaagatcctcgtgagcggtcgctccgagtcgatcatgaagctggaggagcggaccgggatctcctgggacctgggcgtggaggacgcgagcgagagcaagctcctgaccgtctccatcatggacctgagccagatgtacagccccgtgttcgagtacctcagcggcgaccgccaggtggaagagtggccgaaggcgacctgcacgggggactgccccgagcggtgcggctgcacctccagcacgtgcctgcacaaggagtggccccactcccgcaactggcggtgcaaccccacatggtgctggggcgtcgggaccggctgcacgtgctgcggactggacgtgaaggacctcttcaccgactacatgttcgtgaagtggaaggtcgagtacatcaaaaccgaggccatcgtgtgcgtagagctgaccagccaggagcgtcaatgctcccttatcgaggccggcactcggttcaacctcgggccggtcacaatcaccctgagcgagcccagaaacatccaacagaaactgccgcccgagatagtgacgctccaccctcggattgaggagggcttcttcgacctgatgcacgtgaagaaggtcctgtccgcaagcaccgtatgcaagctccaatcctgcacccatggggtgcccggcgatctgcaggtctatcacattggcaaccttttgaagggagacaaggtgaacggccacctgatccacaagatcgagccccacttcaacaccagctggatgtcctgggacggctgcgacctggactactactgcaacatgggtgactggccgagctgctcctacacgggggtgacccaacacaaccacgcggccttcgtaaacatgctaaacatcgagaccgactacaccaagatcttccacttccacagcaagcgcgtgacggcgcacggcgacacgccccagctggacctgaaggcccggcccacctacggcgccggagagatcaccgtactcgtcgaggtggccgatatggagctgcacaccaagaagatagagatctccggcctgaagttcgcgagcctgacctgcaccgggtgttacgcctgctcatcaggcatcagctgcaaggtgcgcatacacgtcgacgagcccgacgagctgaccgtgcacgtgaagtccgaagacccggacatcgtcgccgccagctccagcctgatggctcggaagctcgagttcgggacggacagtaccttcaaggcgttcagcgccatgcccaagacctccctgtgcttctacatcgtggagcgcgagtactgtaagagctgctccaaggaggacacccagaagtgcgtgaacacgaagctggaacagccccagagcattctcatcgagcacaagggcaccatcatcggcaagcagaacgacacgtgcacctccaaggccgggtgctggctggagagcgtcaagtctttcttctatgggctgaagaacatgttgtctgggattttcggcaacgtgttcattgggatcttcctgttcctagcccccttcatactcctgatcctgtttttcatgttcggctggagaatcctcttttgcttcaagtgctgccgccggacgcgtggcctgttcaagtatcgccacctgaaggacgacgaggagaccgggtaccggaagatcatcgagcgcctcaacaacaagaagggcaagaacaagctgctggacggggagcggctcgccgaccgcaagatcgcagaattgttctccaccaagacccacatcggc

SEQ ID NO: 15471 - RNA, 3495 nt, synthetic construct
  misc_feature 1..3495: note = derived and/or modified CDS sequence (opt11) from CCHVF(CCHVF UCCR4401)__KY484035.1__Gn-NSm-Gc
  source 1..3495: mol_type = other RNA
agcgaggagccctccgacgactgcatcagccgcacccagctgctccggaccgagacggccgagatccacggcgacaactacgggggcccaggggacaagatcactatctgcaatggctccaccatcgtggaccagcgcctgggtagcgagctgggctgctacaccatcaaccgggtccgctccttcaagctctgcgagaacagcgccacgggcaagaactgcgagatcgactccgtgcccgtgaagtgccggcaagggtactgcctgcgcatcacccaggagggccgggggcacgtaaagctgagcaggggctccgaggtggtgctcgacgcatgcgacaccagctgcgaaatcatgataccgaagggaaccggcgacatcctggtcgactgctcgggcgggcagcaacacttcctgaaggacaacctcatcgacctgggctgccccaagatcccgctgctcgggaagatggccatctacatctgccggatgagcaaccacccgaaaacgaccatggccttcctgttctggttctccttcggctacgtgatcacgtgtatcttgtgcaaggccatcttctacctcctgatcatcgtgggcaccctggggaagcgcctcaagcagtatcgggagctgaaacctcagacctgcaccatctgcgagaccacccctgtcaacgccattgacgctgaaatgcacgatctgaactgtagctacaacatctgcccgtactgcgcctcccgcctcaccagcgacggcctggcccggcacgtgatccagtgccccaagcgcaaggagaaagtggaggagacggagctgtacctcaaccttgagcggatcccatgggtcgtgcgcaagctgctccaggtgtccgagagcaccggggtcgccctgaaacggtcgagctggctgatcgtgctcctggtactgttcaccgtcagcctctcccccgtgcagtcggcgccgatcggccaggggaagacgatcgaggcctaccgcgcccgcgagggctacacctccatctgcctgttcgtgctgggcagcatcctcttcatcgtctcctgcctgatgaaagggctggtagacagcgtgggcaactccttcttccctgggctcagcatctgcaagacctgctccataagctccatcaacggcttcgagatagagagccacaagtgctactgctccctgttttgttgcccctactgccgccactgcagcaccgacaaggagatccacaagctgcacctctccatctgcaagaagagaaagacggggagcaacgtcatgttagccgtgtgcaagctgatgtgcttccgcgccaccatggaagtctcgaaccgcgcgctgtttatccggagcatcataaacaccaccttcgtcctgtgcatcctgatcctcgccgtgtgcgttgtgtctacgagcgccgttgagatggagaacctgcccgccggcacctgggagcgcgaggaggacctgacaaacttctgccaccaggagtgccaggtcacagagacggagtgcctgtgcccatacgaggccctcgtactgcggaagcccctgttcctcgacagcaccgcgaagggaatgaagaacctgctgaactccaccagcctcgagacctccctgagtatcgaggccccctggggcgccatcaacgtgcagtccacgtacaagcccaccgtcagcaccgccaacatcgccctgtcctggagctccgtggagcaccgcggcaacaagatcctcgtgagcgggcggtccgagagcatcatgaagctggaggagcgcaccggcatctcctgggatcttggggtcgaggacgcgagcgagtccaagctactgacagtgagcgtgatggacctgtcccagatgtactcaccggtattcgagtacctcagcggtgaccgccaggtggaagagtggcccaaggctacgtgcacgggcgactgccccgagcggtgcgggtgcacctccagcacgtgcctgcataaggagtggcctcattcccggaactggcgctgcaacccgacctggtgctggggcgtggggaccggctgcacgtgctgcggcctggacgtcaaggacctcttcaccgactacatgttcgtgaagtggaaggtggagtacatcaagaccgaggccatcgtctgcgtggagctaaccagccaggagcggcagtgcagtctgattgaggccggaacccgcttcaacctcggcccagtgaccattacgctgagcgagccccggaacatccagcagaagctacccccggagatcatcaccctccaccctcgcatcgaagaggggttcttcgaccttatgcacgtccagaaggtgctgtccgccagcaccgtgtgcaagctccaatcctgcacccacggcgtccccggtgacctccaggtgtaccacatcggcaacctgctcaagggcgataaggtgaacgggcacctgatccacaagatcgaaccgcacttcaacacgagctggatgtcctgggacgggtgcgacctggactactactgcaacatgggggattggccgagctgcacctacaccggcgtcacccagcacaaccacgcgagttttgtgaacctcctgaacatcgagacggactacaccaagaacttccacttccacagcaagcgagtgaccgcccacggggacacgccccaactggacctcaaggcccgccccacatatggcgccggcgagatcaccgtcctggtggaggtcgcggacatggaactgcacacgaagaagatcgagatcagtgggctcaagttcgccagcctggcctgcaccggctgttacgcctgctccagcgggatctcctgcaaggtccggatccacgtggacgagccggatgagctcacggtgcacgtcaagagcgatgaccccgacgtggtggccgcgagctccagcctcatggcccgcaagctggagttcggcaccgactccacgttcaaggcattcagcgccatgcccaaaacctccctgtgcttttacatcgtcgagcgggagcactgcaagagctgctcggaggaggacacaaagaagtgcgtcaacaccaagctcgagcagccccagagcatcttgatcgagcacaaggggaccattatcggcaagcaaaatagcacgtgcacagccaaggcgagctgctggctggagtccgtcaagagcttcttctacggcctcaagaacatgctgagcgggatcttcggcaacgtgttcatggggattttcctgttcctcgcaccgttcatcctgctgatcctcttcttcatgttcggctggcgcatcctgttctgcttcaagtgttgccgccgaacccgcgggctgttcaagtaccgccacctcaaggacgacgaggagaccggctaccgccggatcatcgagaagctgaacaataagaagggcaagaacaagctgctcgacggggagcgcctggcagaccggagaatcgccgaattatttagcaccaagacccacatcggc

SEQ ID NO: 15472 - RNA, 3495 nt, synthetic construct
  misc_feature 1..3495: note = derived and/or modified CDS sequence (opt11) from CCHVF(CCHVF UCCR4448)__KY484042.1__Gn-NSm-Gc
  source 1..3495: mol_type = other RNA
agcgaggagacttccgatgactgcatcagccgcacccagctgctccggacggagaccgccgagatccacggcgataactacgggggccccggggacaagatcaccatctgcaacggctccaccatcgtggaccagcgcctggggagcgagctgggctgctacacgatcaaccgggtgaagtccttcaagctctgcgagaacagcgccaccggcaagtcctgcgagatcgacagcgtgccggtgaagtgccgccaggggtactgcctgcggatcacccaggaggggcgcgggcacgtcaagctgtcccggggcagcgaggttgtgctcgacgcgtgcgatacctcctgcgagatcatgatccccaaggggacgggcgacatcctggtcgactgcagcggcgggcagcagcactttctaaaggacaacctcatcgacctgggctgccccaagatccccctgctcgggaaaatggccatctacatctgccgcatgtccaaccacccgaagaccaccatggccttcctgttctggttcagcttcggctacgtgatcacgtgcatcctgtgcaaggccatcttctacctcctgatcatcattggcaccctggggaagcggttcaagcagtaccgcgagctcaagccccagacctgcaccatctgcgagaccacgcccgtgaacgccatcgacgcggagatgcacgacctgaactgctcctacaacatctgcccctactgcgccagccggctgacctccgacggcctcgcccgccacgtcacccagtgcccgaagcgcaaggagaaggtggaggagaccgagctgtacctgaacctcgagcgcatcccctgggtggtccggaagctgctccaggtgagcgagtccacgggggtggccctcaagcgcagcagctggctgatcgtccttctcgtgctgttcaccatctccctgagccccgtgcagtccgcgcccatcagccacggcaagaccatcgaggcctaccgggcccgcgaggggtacacctccatctgcttgtttgtcctgggcagcatcctgttcatcgtgtcctacctcatgaagggcctggtggacagcgtcgggaactccttcttcccgggcctgagcatctgcaagacgtgctccaccagctccatcaacgggttcgagatcgagagccacaagtgctactgctctctcttttgctgcccctactgccggcactgcagcgcggacaaggagatccacaagctgcacctgtccatctgcaagaagcgcaagaccggcagcaacgtgatgctcgccgtgtgcaagcggatgtgcttccgcgcgaccatggaggtctccaaccgcgccctgttcatccggagcatcatcaacacgaccttcgtgttatgcatcctcatcctggccgtctgcgtggtgagcacctccgccgtcgagatggagaacctgcccgccgggacctgggagcgcgaggaagacctcacgaacttctgtcaccaggagtgccaggtgaccgagaccgagtgcctgtgcccctacgaggcgctggtgctgcggaagcccctcttcctggacagcatcgtcaaaggcatgaagaacctgctcaactccaccagcctggagacctccctgagcatcgaggcaccctggggcgctatcaacgtacagtccacctacaagcccaccgtctccaccgccaacatcgccctctcctggagctccgtcgaacaccgcggaaacaagatcctggtgagcggccggtccgagagcatcatgaagctggaggagaagaccgggatctcctgggacctcggcgtggaggacgcgagcgagtccaagctgctgacggtcagcgtgatggacctcagccagatgtactcccccgtgttcgagtacctgtccggcgaccgccaggtcgaagagtggccgaaggcgacctgcaccggtgactgccccgagcggtgcggctgcacctcctccacgtgccttcacaaggagtggccccacagccgcaactggcggtgcaaccccacctggtgctggggcgtggggaccgggtgcacgtgctgcggcctcgacgtgaaggacctgttcaccgactacatgttcgtgaagtggaaggtggagtacattaaaaccgaggcaatcgtgtgcgtcgagctgaccagtcaggagcgccagtgctccctcatcgaggccgggacccggttcaacctggggccggtgacgatcaccctgagcgagccccgcaacatccagcagaagctcccgcccgagatcatcaccctgcacccgcggatcgaggaaggcttcttcgacctgatgcacgtgcagaaggtcctctccgccagcaccgtgtgcaagctgcagtcctgcacgcacggggtgcccggcgacctgcaggtctaccacatcgggaatctactgaagggcgacaaggtgaacggccacctgatccacaagatcgaaccccacttcaacaccagctggatgtcctgggacggctgcgacctcgattactattgcaacatgggcgactggccgtcgtgcacctacaccggggtgacgcagcacaaccacgcttccttcgtcaacctgctgaacatcgagaccgactacaccaagaacttccacttccacagcaagcgcgtgaccgcccacggcgacacgccccaactcgacctgaaggccaggcccacctacggggcaggcgagatcaccgtgctggtcgaggtggcggacatggagctccacaccaagaagatcgagatctccggcctgaagttcgccagcctaacgtgcactgggtgttacgcgtgctccagcggcatcagctgcaaggtgcgcatccacgtcgacgagcccgacgagctcaccgtgcacgtgaagtccgacgatccagacgtcgtggccgccagctccagcctgatggcgcggaagctggagttcgggaccgactccacgttcaaggccttcagcgccatgcccaagacctccctctgcttctacatcgtggagcgagagcactgcaagagctgctccgaggaggacaccaagaagtgcgtcaacaccaaactggagcagccccagagcatactgatcgagcataagggcacgatcatcgggaagcagaactccacgtgcaccgccaaggccagctgctggctcgagtccgtcaagagcttcttctacggcctgaagaacatgctgtccggcatcttcgggaacgtgttcatcggaatcttcctcttcctggcgcccttcatcctgctcatcctgttcttcatgttcgggtggaagatcctgttctgcttcaagtgctgccggcgcacccgcggcctcttcaagtaccggcacctgaaggacgacgaggagaccgggtaccgccggatcatcgagcgcctgaacaacaagaagggcaagaacaagctcctggacggggagatcctggccgaccggcgcatcgccgagctgttctccaccaagacccacatcggg

SEQ ID NO: 15473 - RNA, 3495 nt, synthetic construct
  misc_feature 1..3495: note = derived and/or modified CDS sequence (opt11) from CCHVF(CCHVF SPU4/81 )__DQ157175.1__Gn-NSm-Gc
  source 1..3495: mol_type = other RNA
agcgaagaaccctctgatgactgtatcagtcgaacacaactcctacgcacagaaaccgcagaaatacacggcgacaactacggagggcccggcgacaaaataacaatatgcaacgggtccaccatagttgaccaacgcctgggtagcgaactagggtgctacacgataaaccgcgtcaaatcattcaagctatgcgaaaactcagccactggtaaatcctgcgaaatagagtcagtacccgtcaaatgtcgacaaggctattgcctgcgcataacacaagaaggtcgaggacacgtcaaactatcacgcggatccgaagtcgtactcgacgcatgcgacaccagctgcgaaatcatgatacccaaaggcaccggagacatcttggtagactgcagcggcggccaacaacacttcctaaaagacaacctaatcgacctcggttgccccaaaatccccctcctcggcaagatggcaatttacatctgtagaatgtccaatcatcctaaaaccaccatggcgttcttgttctggttcagctttggctacgtcatcacatgcatcctctgcaaagccatcttctacctactaataataataggcaccctgggcaagcgcttcaaacagtatcgtgagctaaaaccacaaacctgcaccatttgtgaaaccaccccagttaacgccatagacgctgaaatgcacgacctgaactgctcatacaacatctgcccatactgcgcatctcgccttacatctgacggcctggcccggcacgtaactcagtgccccaaacgcaaagaaaaagtagaagaaacagaactataccttaacctggaaagaataccctgggtcgtccgaaaattgctgcaagtgagcgaatccaccggcgtcgccctcaaacgcagcagctggctaatcgtcctcctcgtcctcttcacagtgtctctctcaccagtgcaatccgccccgatcggccacggcaaaacaatcgaagcataccgtgcgcgcgaaggctatacttccatctgcctgttcgtcctcggctcaattctcttcatcgtatcgtgcttaatgaaaggactcgtcgatagcgtaggtaactccttctttccagggctcagcatctgcaagacctgcagcatctcttccataaacggattcgaaatcgaatcccataagtgttactgctcactgttttgttgcccatactgccgacactgctccgccgacaaagagatccacaaactccacctgtcaatatgtaagaaacgaaaaacaggaagtaacgtaatgttagccgtctgcaaacgaatgtgcttccgcgcaaccatggaggtatccaaccgcgcactattcataagatcaatcataaacaccaccttcgtactctgcatactcatcctagccgtctgcgtcgtgagcaccagcgccgtcgagatggaaaacctgcccgccgggacctgggaacgggaagaagacttaaccaacttctgccaccaggaatgtcaagtaactgaaaccgaatgcctctgcccctacgaagctcttgtcctccgaaaaccactattcctagacagcatcgtcaaaggcatgaaaaacctcctcaactcgacttcactcgaaacgagcttatccatcgaagccccgtggggagccataaatgtgcaatccacttacaaacccacagtttccacagcaaatatcgccttgtcatggagctccgtagaacaccgcgggaacaagatactcgtctccggccgcagtgagagcataatgaagctcgaagaacgcaccggaatatcgtgggacctaggagtagaagacgcatccgagagcaaactactcaccgtctcagtaatggacctctcacagatgtactcgcccgtgttcgaatacctctcgggggaccgccaggtggaggagtggcccaaagccacttgcaccggcgactgcccagaaaggtgcggctgcacctcaagcacgtgtctacacaaagaatggccgcacagcagaaattggcgatgcaaccccacatggtgttggggagtcggtacaggctgcacatgctgcggactcgacgtcaaggatttattcacagactacatgttcgtcaaatggaaagtcgaatacatcaaaaccgaggccatagtctgcgtcgaattaacaagccaagagcgccagtgcagcctcatcgaagccggtacacgcttcaacctcggccccgtcacgatcacgttatccgagcctcgtaacatccaacaaaagctacccccagagatcataacactccacccccgaatcgaagaagggttctttgacctcatgcacgtccaaaaggtattgtccgcaagcacggtatgcaaactccagtcctgcacccacggagttcccggagacttacaagtgtaccatatcggcaaccttctaaaaggagacaaagtcaacggccacctcatacacaaaatcgaaccccacttcaatacttcctggatgtcctgggacggctgtgatctggattactactgcaacatgggagactggccttcctgcacctacacaggcgtcactcaacacaaccatgcctcttttgtgaacctgctcaacatagaaacagactacaccaaaaacttccacttccacagcaagcgagtgaccgcccacggcgacacaccacaactagatttaaaggcccgccccacctatggagcaggcgagatcacagtcctagtcgaagtagcagacatggagcttcataccaagaaaatcgaaatctccggcttaaaattcgcatcactcacatgtaccggctgctacgcatgctcatccgggatctcctgcaaagtacgaatccatgtcgacgaaccagacgaactcacagttcacgttaaaagcgacgacccggacgtcgtcgccgccagtagctcattgatggcacgaaagctcgagttcggaacagactccaccttcaaagcgttttcggcgatgcccaaaacctcactatgcttctacatcgtagaacgcgagcactgcaaatcctgctcagaagaagacacaaagaaatgcgtaaacacgaaattagaacaaccccagagcatcctcatcgaacataaaggaacgatcatcggaaaacaaaactcaacctgtactgcgaaagcctcatgctggcttgaatccgtcaaatcctttttctacggcctcaaaaacatgctttcaggtatattcggcaacgtgttcatcggaatcttcctcttcctaggccccttcatacttctaatcttgttcttcatgtttggctggcgcatattattctgcttcaagtgctgccgacgaacacgagggctgctaaaatacagacacctaaaagaggacgaagagacaggataccgccgaataatcgaacgactcaacaacaagaaaggcaaaaacaaattactagatggcgagcgcctcgcagatcgccgcatagccgaactattcagcaccaagacgcacatcggc

SEQ ID NO: 15474 - RNA, 3495 nt, synthetic construct
  misc_feature 1..3495: note = derived and/or modified CDS sequence (opt11) from CCHVF(CCHVF Sudan Al-Fulah 9-2008)__HQ378185.1__Gn-NSm-Gc
  source 1..3495: mol_type = other RNA
tcagaggaaccctccgacgactgcatctcaaggacccagctgctccggaccgagacggccgagatccatggcgacaactacggcggcccaggggacaagatcaccatctgcaacggctccaccatcgtggaccagaggttgggcagcgagctgggctgctataccatcaaccgggtcaagagtttcaagctctgcgagaatagcgccacgggcaagtcctgcgtaattgacagtgtgcccgtcaagtgtcgccaggggtactgcctgcggatcactcaggagggccgcgggcacgtgaagctgtcccggggcagcgaagtggtgctcgacgcgtgcgatacctcctgcgagatcatgatccccaagggtaccggcgacatcctggtggactgcagcggcggacaacaacacttcctgaaggacaacctcgtggacctgggctgccccaagatcccgctgctcggtaagatggccatctacatctgccgcatgtcgaaccaccccaagacgaccatggccttcttattctggttcagcttcggctacgtcatcacgtgcatcctgtgcaaggccatcttctaccttctaatcataatcggcaccctggggaagcgatttcgccagtaccgggagcttaagccccaaacctgcacaatctgtgagacaacccccgtgaatgccatcgatgcggagatgcacgacttgaattgctcctacaacatctgcccgtattgcgcctctcgcctgacgtccgatggcctcgcgcggcacgtaacccagtgccccaagcgcaaggagaaggtggaagagaccgaactgtacctgaacctcgagcggatcccctgggtggtgcgcaagctgctgcaggtcagcgagtccaccggggtggcgctcaagagaagcagctggctgatcgtgctccttgtcctattcacggtgtctctgagtcccgtgcagtccgcgccgatcggccacgggaagaccatcgaggcctaccgcgcccgggagggctacaccagcatctgcctctttgtattaggctccatactgttcatcgtgtcctgcctgatgaaggggctggtggactccgtcgggaacagcttcttcccagggctgtctatctgcaagacctgctcaatctccagcatcaacgggtttgagatcgagagccacaagtgctattgcagcctcttctgttgcccctactgccgccactgctccgccgacaaggaaatccacaagctgcacctaagcatctgcaagaaacgtaagacggggagcaacgtgatgctcgccgtctgcaagcgcatgtgcttccgcgcgactatggaagtgagcaaccgggccttgttcatccgctccatcatcaacaccaccttcgtgctgtgcatcctcatcctggccgtctgtgtggtaagcacgagcgccgtcgagatggagaaccttcccgctggcacctgggagcgggaggaggacctcaccaacttctgccaccaagagtgtcaggtgactgagaccgagtgcctgtgcccgtacgaggcgctggtgctgaggcggcccctcttcctggactccatcgtcaagggcatgaagaacctgctcaacagtacttccctggagaccagcctgtccatcgaggccccctggggcgccatcaacgtgcagagcacctacaagcccacggtgagcacggccaacatcgcactcagctggtcgagcgtcgagcaccgcgggaacaagatcctggtttccgggcggagcgagtccatcatgaagctggaggagcgcaccggcatcagctgggacctcggggtggaggacgcgtccgagagcaagctgctgaccgtctccgtgatggacctctcccagatgtacagcccggtattcgagtacctttcaggtgaccggcaggtcgaggagtggcccaaggcgacctgcacaggcgactgccccgagcgctgcgggtgcaccagctccacgtgcttgcacaaggagtggccccacagccgtaactggcgctgtaacccgacctggtgctggggcgttgggaccggatgcacttgctgcggtctcgacgtgaaggacctattcacagactacatgttcgtgaagtggaaggtagagtacatcaagaccgaggccatcgtgtgcgtcgagctgacaagccaggagcggcagtgcagcctcatcgaagccgggacccgcttcaacctgggccccgtgaccatcaccctgagtgagccccggaacatccagcagaaattacccccggagatcatcaccctccaccctcgcatagaggaggggttcttcgacctgatgcacgtgcaaaaggtcctcagcgcgtccaccgtgtgcaagctgcagagctgcacccacggcgtgcccggggacctgcaggtctaccacatcggtaacttactgaagggcgacaaggtgaacgggcacctgatccataagatcgagccgcacttcaacacctcctggatgagctgggatggctgcgaccttgattactactgcaatatgggggactggccatcatgcacgtacaccggcgtaacccagcacaaccacgccagcttcgtcaacctgctgaacatcgagaccgactacacgaagaacttccacttccactccaaacgggtgaccgcccacggggacacgccccagctagacctgaaggcccgccctacctacggcgccggcgagatcaccgtgctggtcgaggtggctgatatggaactccacaccaagaaaatcgagatcagcgggctgaagttcgcctccctgacatgtacgggctgttacgcgtgcagctccgggatcagctgcaaggtgcggatccacgtcgacgagccggacgagctcacggttcacgtcaagagcgacgaccccgacgtggtggccgcctccagctccctgatggcgcgcaagctggagttcggcaccgacagcaccttcaaggccttttccgccatgcctaagaccagtctctgcttctacatcgtggagaaggaatactgcaagtcctgctccgaggaggacacgaagaagtgcgttaacaccaagctggagcagccgcagtccatcctgatcgagcacaagggcaccataattgggaagcagaacagcacatgcaccgccaaggtttcctgctggctcgagagcgctaagtccttcttctacggcctgaaagacatgctgagcgggatctttggcaacgtgttcatcgggatattcctcttcctggcgccgttcgtcctgctcgtgttatttttcatgttcggctggcgcatcctgttatgctttagatgctgccgacgaaccagggggctgtttaagtaccggcacttaaaggatgatgaggagaccggctaccgccggatcatcgagcgcctcaacaacaaaaagggcaagaacaagctgctggacggggagcggctcgccgaccgcaaaatcgctgagctgttctccaccaagacccacatcggt

SEQ ID NO: 15475 - RNA, 3495 nt, synthetic construct
  misc_feature 1..3495: note = derived and/or modified CDS sequence (opt11) from CCHVF(CCHVF NIV161064)__KY213713.1__Gn-NSm-Gc
  source 1..3495: mol_type = other RNA
agcgaggagtccggcgacgactgcatcagccgcacgcaactgctccggacggagacggcggaagttcatggggacaactacggcgggcccggcgacaagatcactatctgcaatgggtccaccgtcgtggatcagcgcctgggcagcgagctgggctgttacaccattaaccgggtgcgttccttcaagctctgcgagaacagcgccacagggaagtcctgcgagattgacagcatccccgtcaagtgcaagcagggctactgcctgaagatcacccaggaggggcggggccacgtgaagctgtcccgcgggagcgaggtagtcctagacgtttgcgactccagctgcgaggtaatgatccccaagggcaccggcgacatcctggtcgactgctccgggggacagcaacacttcctgaaagacaacctggtggatctggggtgccccaagatccccctgctcggcaagatggcgatctacatctgccggatgtccaatcacccgaagacgacgatggccttcctcttctggttctcattcgggtatgtgatcacgtgcatactgtgcaaggccatctttttcctactgatcatcttcggtaccctgggaaaacgattcaaacagtatcgggagctcaagccgcagacctgcaccatctgcgaaacaaccccagtcaacgccatcgacgccgagatgcatgacctgaactgcagctacaacatctgcccctattgcgcgtcccgcctcaccagcgacggcctcgcaagacacgtgacgcagtgccctcgccggaaggagaaggtagaggaaaccgagctctacctgaacctcgagcgcataccttgggtcgtgcggaagctgctccaggtgtccgagagcaccggcaccgtcctgaaacgcagctcctggctgatcgtactgctcgtgctgttcacggtctctctgtcccccgtgcagtctgcccccatcgggcacggcaagactatcgagacctaccgggtgcgcgaggagtacacctccatctgcctcttcgtcctgggctcaatcctgttcatcgtgtccttcctcatgaaagggctggtcgacggcgtcgggaatatctttttcccgggcctgagcgtgtgcaagacatgctccataggcagcatcaacggcttcgagatcgagtcccataagtgctactgcagcctattctgctgcccctactgccggcactgctccgccgatggcgagattcaccagctacacctgagcatctgtaagaagcgcaaaaccgggtcaaacgttatgctcgcggtatgcaagcgaatgtgcttccgcgccaccatggaggtgagcaacaaggccctattcatccgctccataatcaacactacgttcgtcgtgtgcatcctgatcctcgccgtgtgcgtcgttagcacgtccgcggtggaaatggagtcccttcccgcgggcacctgggagagagaggaggacttgaccaacttctgccaccaggagtgccaggtcacggagaccgagtgcctatgcccctacgaggccctggtgctgcgccggcctcttttcctcgacagcatcgtgaaggggatgaagaacctgctgaactccaccagtctcgagacctccctgtcaattgaggccccctggggcgccatcaacgtccaatccacgtacaagcccaccgtgagcacggccaacatcgcgctgtcctggagctccgtggagcaccgcgggaacaaggtcctcgttagcggccgctccgagagcatcatgaagctggaggaacgcaccggcatctcctgggacctgggggtggaggacgcctctgagtccaagctcctgaccgttagcgtgatggacctgtcccagatgtactcccccgtgttcgagtacctcagcggcgaccggcaggtcgaggagtggccgaaggccacgtgcaccggagactgccccgagcgctgcggatgcacctcctccacgtgcctgcacaaggagtggccccactcccggaactggaggtgcaaccccacctggtgttggggcgtggggaccggctgcacttgctgtgggctggacgtgaaggacctcttcacagactacatgttcgtcaaatggaaggtggagtacatcaagacagaggccatcgtgtgtgtcgagctgacctcccaggagcggcagtgctccctgatcgaggccggcacccgcttcaacctcgggagcgtgaccatcactctgagcgagccgcggaacatccagcagaagctgcctcccgagataatcactctccaccccaagatcgaggagggcttcttcgacctcatgcacgtgcagaaggtcctaagcgcgtccaccgtgtgcaagctccagagctgcacccacggtgtgcccggggacctgcaagtataccacatcggcaacttactcaagggggaccgcgtgaacggacacctgatccacaagatcgagcagcattttaacacttcctggatgagctgggacgggtgcgacctggactactactgcaacatgggcgactggccctcctgcacctacaccggcgtgacccaacacaaccacgccagcttcgtcaacctcctgaacatcgaaacggactacaccaagacctttcactttcactccaagcgggtgaccgcccacggggacacgccccagctggacctcaaagcccgaccgacctacggtgccggggaggtgaccgtcctggtagaggtggcggacatggagcttcacaccaagaaaatcgaaatcagcggcctcaagttcgccgggttaacgtgtaccggctgctacgcctgctccagtggcatcagctgcaaagtccggatccacgtggacgagcccgacgagctgaccgtgcatgtcaaaagcgatgaccctgacgtggtggccgcgagctccagcctcatggcccgcaaactggagttcgggaccgactccacgttcaaagccttcagcgcaatgcccaagacctccctatgcttctacatcgtcgagagagagtactgcaagtcatgctccaaggaggacacccagaagtgcgtgaataccaagctcgagcaaccgcagtccattctgatcgagcacaagggcacgatcatcgggaagcagaacaacacgtgcaccgccaaagcgtcctgctggctggagagcgttaagtcgtttttctacggcctcaagaacatgctcgggggaatctttggcaacgtgttcatagggatcttcaccttcctgacccccttcatcctgctgatcttattcttcatgttcggttggaggatcctattctgcttcaagtgctgccgccggaccagggggctgttcaagtaccggcacctgaaggacgacgaagagaccggctacaggaagattattgagaggctcaacaacaagaaaggcaagaaccgcctgctggacggggagcggctcgccgaccgcaagatcgccgaactgttcagcaccaagacccacatcggc

SEQ ID NO: 15476 - RNA, 3495 nt, synthetic construct
  misc_feature 1..3495: note = derived and/or modified CDS sequence (opt11) from CCHVF(CCHVF 5180-R-2011)__KR814874.1__Gn-NSm-Gc
  source 1..3495: mol_type = other RNA
tccgaagaaccaggggatgactgcataagtcgcacacaactccttcgcacagaaacagccgaaatccacgacgacaactacgggggacctggcgacaaaataacgatatgcaacggctcaacaatagtagatcagaggctgggatcagaactcgggtgctacacaataaaccgcgttaaatccttcaaactctgcgaaaactcagctaccggaaagacatgcgaaatagactcgacccccgtcaaatgtaggcaaggcttctgcctaaaaataacccaggaaggccgcgggcacgtaaaactcagccgcggatcagaagttgtcctagacgcttgtgataccagctgcgaagtaatgataccgaaggggaccggtgatattctagtcgactgcagcggaggccaacagcacttcctcaaagacaacctcatcgacctaggatgcccgcacatacccctactcggcaaaatggctatctatatatgccgaatgagcaaccatccccgcacgaccatggccttcctcttctggttcagcttcggctacgtaataacctgcatcttctgcaaagcactcttctactccctcataatcatcggcaccctcgggaaaaagataaaacaataccgggaactcaagccccagacatgcacgatctgcgagacagcccccgtcaacgcgatcgacgcagaaatgcacgacctcaactgctcttacaacatatgcccctactgtgcctcacgtctcacctctgacggactcgcccggcacgtcccccaatgtcctaaacgcaaagaaaaagtagaagaaacagagctctacctcaacctcgaaagaataccctggatagtaagaaaacttcttcaggtttccgaatcgacaggagttgccctcaaacgcagcagttggttaatcgtgctcctagtcctactaacagtaagtctctcccccgtccaatcggcccccgtcggacacggcaaaacaatcgaaacttaccaaacccgggaaggcttcacgtcagtctgcctctttatgctcggatcaatcctatttttagtatcttgcctcgtgaaaggcctggtggactcggtctcagactctttcttcccggggctaagcgtatgcaaaacctgctcaatcggcagtatcaatggtttcgaaatagaatctcacaaatgctattgctcactcttctgctgcccctactgccgccactgctcagccgaccgtgaaatacatcaactccacctatcaatatgcaagaaacgcaaaatgggctcaaatgtaatgctggctgtctgcaaacgcatgtgcttccgagccaccatagaagcatcacgccgggcacttttgatccgctcgataatcaacactaccttcgtcatatgcatcctcacactcaccatctgcgtagtatcaacctctgctgtcgagatggaaaatctcccaagcggcacctgggaaagggaagaagacctcactaacttctgccatcaagaatgccaagtaaccgagaccgaatgcctctgcccttacgaagcactcgtactacgcaaacctctatttttagacagcatcgtcaaaggcatgaaaaacttactaaacagcacaagccttgagacatccctctccatagaagcgccctggggcgccataaacgtgcagtccacatttaaacctacagtttctaccgccaatatcgccctttcctggtcctcggtagaacacagaggaaacaagatcctagtcaccggcaggagcgaaagcataatgaagctagaagagagaacgggtgtatcatgggacctcggagtagaggacgccagcgaatccaaactccttacagtaagtataatggacctcagccaaatgtactcccccgtattcgaatacctgtccggcgaccgtcaagtcgaagaatggcccaaagcaacctgcacaggagactgtcccgaacgatgcggatgtacatcctcaacctgcctccacaaagagtggccccacagccgcaactggagatgcaaccctacctggtgctggggtgtcggaaccggatgcacatgctgcggagtcgacgtcaaagatttattcaccgaccacatgttcgtcaaatggaaagtagaatacatcaaaaccgaagccatagtttgcgtggagctcaccagccaggagagacagtgcagtcttattgaagccggaaccaggttcaacctaggaccggtcactataaccctgtcggagcctagaaacatccaacagaaactgcctcccgagatcataacgttacaccccaaagtcgaagaaggattcttcgacctaatgcacgtccagaaggtactgtccgcctccacagtatgcaaactacaatcctgtacccacgggatacccggcgacctccaagtatatcacatcggcaatctcctaaagggcgaccgcgtcaacggccacctcatccacaaaatagagccccacttcaacaccagctggatgtcatgggacggatgtgacctcgactattactgcaacatgggtgactggccttcttgcacctacaccggagtcacccaacataaccacgccgccttcgtcaacctactaaacatcgaaaccgactataccaaaaccttccacttccactcgaaacgagttacggcccacggcgacacgccccaactcgacctgaaagcgcggccaacctacggagcgggggagatcaccgtattagtagaagtagcggatatggagctgcacaccaagaaagtcgaaatctcaggactgaaattcgcaagcctcgcctgcaccgggtgctacgcctgctccagcggcatctcctgcaaagtccgaatccatgtcgacgaacctgacgagctcacagtacacgttaaaagcaacgacccggatgtagtagccgcttccacgtcactcatggccaggaagctcgagttcggaaccgacagcaccttcaaagccttctcagcgatgccaaaaacatcactctgcttctacatagtcgaaagagaatactgcaaatcctgttccgaagaagatacccagaaatgtgtagacacaaaactagaacaaccacaaagcatcctaatagaacacaaaggcacgatcataggcaaacaaaacgacacatgtaccgccaaagccagttgttggctcgaatcggtgaaatcgttcttctacggactcaagaacatgctaggcagcgtcttcggcaactttttcattggtatcctgctatttcttgcacccttcgtgttgctcgtcctattcttcatgttcggctggaaaattctcttctgtttcaaatgctgccgccgcacccgcggtctgctgaagtaccgcctgcttaaagacgacgaagaaacagggtacagacgaataatcgagagacttaataataagaaaggcaaaaaccggctactggacggagaaagactagcagaccgcaaaatcgcagaactgtttagcacaaagacccacatcgga

SEQ ID NO: 15477 - RNA, 3495 nt, synthetic construct
  misc_feature 1..3495: note = derived and/or modified CDS sequence (opt11) from CCHVF(CCHVF 4574-ST-2008)__KR814870.1__Gn-NSm-Gc
  source 1..3495: mol_type = other RNA
agcgaggaatcgggcgacgattgcatcagccgcacccagcttctccggaccgagacagccgaaatccacgacgacaactacgggggccccggggacaagatcaccatctgcaacggctccaccatcgtggaccagagactggggagcgagctgggctgctacaccatcaaccgggtcaagtccttcaaactctgcgagaacagcgctacgggcaaaacctgcgagatcgactccaccccggtgaaatgccgccaggggttttgcctgaagatcacccaggagggccgggggcacgtgaagctgtcacgcggctccgaggtcgtactcgacgcgtgcgactcaagctgcgaagtgatgatccccaaggggacgggcgacatcctcgtcgactgctcaggcgggcagcagcacttcctgaaggacaacctcatcgacctgggatgcccacacatccctctactcgggaagatggccatatacatctgccgaatgtccaaccaccctcgaaccaccatggcgttcctgttctggttcagcttcggctacgtgataacgtgcctgttctgcaaggcactcttctactccttaatcatcatcggcaccctggggaagaagatcaaacagtaccgggagctccgcccccaaacctgcaccatctgcgagaccgcccccgtgaacgcgatcgacgccgagatgcacgacctgaactgctcgtacaacatctgcccctactgtgcatcgcggctgacaagcgacggcctcgcccgccacgtcccccagtgccccaagaggaaggagaaggtcgaggagaccgagctgtacctgaaccttgaacgcatcccgtggatcgtgcggaagttgttacaggtctccgagagcactggggtggcgctcaagcgcagctcctggttgatcgtgctgctcgtcctgctgacggtgtcgctctcccccgtgcagagcgccccggtcggccacgggaagacgatcgagacctaccagacccgggagggctttacctccatctgcttgttcatgctgggcagcatcctcttcctggtgtcctgtctggtgaaagggctcgtcgactctgtgtccgacagctttttccccggcctgtcggtatgcaaaacatgctctatcgggtccataaatggatttgagatcgagagccacaagtgctactgctccctgctctgttgcccctactgccgccactgcagcgccgaccgggagatccaccaactgcacctgagtatctgcaagaagcgcaagactgggagcaacgtcatgctcgccgtgtgcaagcggatgtgcttccgcgcaactatcgaggcgtcccgccgagccctgctgatccgctctatcatcaacaccacgttcgtcatttgcatactcaccctgaccatatgcgtggttagcacctccgccgtcgagatggaaaatctgcccagcggcacgtgggagaaggaggaggacctgaccaacttctgccaccaggagtgtcaggtgaccgagaccgagtgtctctgcccgtacgaggccctggtgctgcgaaagcccctcttcctggactccatcgtcaagggcatgaagaacctgctcaacagcacgtccctggagaccagcctgtccattgaggccccgtggggcgcgatcaacgtgcagagcaccttcaaacccactgtgtccaccgcaaatatcgccctcagctggtccagcgtcgagcaccgcggcaacaagatcctggtcacgggccgctccgagagcattatgaagctggaggagcgcaccggggtatcctgggacctcggtgtcgaggatgccagcgagagcaaactgctgaccgtgagcatcatggacctcagccagatgtactccccggttttcgagtacctgagcggcgaccggcaggtagaagagtggcctaaagcgacctgcactggagactgccccgagcgctgcggatgcacctccagcacgtgccttcacaaggagtggccccattcccggaactggcgctgcaatcccacctggtgttggggcgtggggaccggctgtacgtgctgcggcgtggacgtcaaggacctgttcaccgaccacatgtttgttaaatggaaggtggagtacatcaagactgaggccatcgtctgcgtggaactgacaagccaggaacgccagtgttccctgatcgaagccgggacccgcttcaacctcggcccagtgacgatcaccctgagcgagccccggaacatccaacagaagctgcccccggagatcatcacgctccaccccaaggtcgaggagggcttcttcgacctgatgcacgtgcagaaggtgctgagtgccagcactgtctgcaagctccagtcctgtacccacggcatccccggcgacctccaggtgtaccacataggcaacctgttaaagggcgaccgcgtgaacggtcacttaatccacaagatcgagccgcacttcaataccagctggatgtcctgggacggctgcgacctggactactactgtaacatgggggactggcccagctgtacgtataccggagtcacccaacacaaccacgccgccttcgtgaacctccttaatatcgagaccgactacaccaagactttccacttccattccaagcgggtgaccgcgcacggggatactccccagctggacctcaaggccaggcccacctacggcgccggcgagatcacggtcctggtggaggttgccgatatggagctgcacaccaaaaaggtcgaaatctctgggctcaagttcgcgagcctggcatgcaccggctgctacgcctgcagctccggtatcagctgcaaggtgcggatccacgtggacgagccggacgagctcacggtccacgtaaaaagctcagaccccgacgtggtggccgcgagcacctctctcatggcgcgcaagctggagttcggtaccgactctaccttcaaggctttctccgccatgccgaaaacgagcctgtgcttctacatcgtggagcgggagtactgcaagtcctgcagcgaagaggacactcagaagtgcgttgacaccaagctcgagcagccccagtccattctgatcgagcacaagggtaccataatcggcaagcagaacgacacgtgcactgctaaggcgagttgctggcttgagtccgtcaagtcgttcttctacgggctcaagaacatgctggggtccgtcttcggcaacttcttcatcgggatcctgctgttcctggcgccgttcgtgctgctcgtcctcttcttcatgttcggctggaagatcctgttctgcttcaagtgctgccgccgcgcccggggactcctgaagtaccgccacctgaaggatgacgaagagaccggctaccggaaaatcatagaacgcctcaacaacaagaagggcaaaaaccggctgctggacggtgagcgcctcgcggaccggaagatcgccgagctattctcgaccaaaacccacatcggc

SEQ ID NO: 15478 - RNA, 3495 nt, synthetic construct
  misc_feature 1..3495: note = derived and/or modified CDS sequence (opt11) from CCHVF(CCHVF 3010)__DQ019222.1__Gn-NSm-Gc
  source 1..3495: mol_type = other RNA
gctgagggcgtgagcaacgactgcgtctcccgcacccagctgatcaagactgaggtggccgagatccacgaggacagctacgggggccccggggagaagatcacgatctgcaacggctccaccattgtggaccagcggttggggagcgaactaggctgctacaccatcaaccgcgtcaagacctacaagctgtgcgagaactcagcgacagagaagggctgcgagatagacagcgtgccggtgaaatgcaagcaggggttctgtctcaaggtcacccaggagggccgggggcacgtgaagttgtcccgcggcaccgagatcgtgctggacgtctgcgacaccagctgcgagctcatgatccccaaggggacgggcgacatcttggtggattgttccggcgggcaacagcacttcctgcaggacaacctcatcgacctgggctgccccaacgtgcccctgctcgggaagatggcaatctatatctgccggatgagcaaccacccgaagaccaccatggccttcctgttctggttctccttcggctacgtcatcacgtgcatcgtgtgcaaggtgctgttctacctcctgatcgtcatcggcacgctgagcaagaagctcaaacagtaccgcgagctgaagcctcagacatgcatcgtgtgcgagtccacccccgtgaacgccatcgacgccgagatgcacgaactgaactgcaactacaacatctgcccgtactgcgctagccggctcacgtcagacgggctggttcgccatgtgaaccaatgcccgaagcggaaggagaaggtggaggagacggagctgtacctcaacttagagagaatcccctggctggtccggcgcctcctccaagtaagcgaatccaccggcatggccctgaagcggagctgctggatgaccaccctcctgatcctgttagttgtttcactgagccccgtgcagagcgcccccgtcggtcagggcaaagccgtggaggtgtaccgcgtccgggagtcttacacgagcatctgcctgttcgtcctcgggtccgtgctgtttgcggtctcatggctaatcaagggcctcatcgacggcatcggcaactccttcttcccgggcctgagcgtgtgtaaaacctgctccataggctcgatcaacggcttcgagatcgagtcccataaatgctactgcagcctgttctgctgcccctactgccgcgcctgctcgtcggacaagataacccaccggatgcaccttaacgtgtgcaaaaagcgcaaggccgggtccaatgtaatgctagctgtatgcaagaggatgtgcttcaaagccactgtggaggcgtcaaacacggccctgctcatccgcggcattatcaactccaccttcgtcatctgcgtgctgatcctggtaatctgcgtcgtgagtacctccgccgtggacatggagaacctcccggcaggcatctgggagcgggaagaggatttaaccaacttctgccaccaggagtgccaggtcacagagaccgagtgcctgtgcccctatgaggccctgatcctccgcaagccactgtatctggatagcatcgcgaagggtatgaagtccctcctgaactcgacgaacctggagaccagcctctccatcgaggccccgtggggcgccatcaacgtgcagagcacattcaagcccaccgtgagcgccgccaacatcgcgctgagctggtccagcgtcgagcaccgagggaacaagatcttggtgtccggccggagcgagtccattatgaagctcgaggagcgcaccgggatcagctggtccctgggcgtggaggacgccagcgagtcaaagaccctgacggtcagcgtgatggacctctcccaaatgtacagcccagtcttcgagtacctgagcggcgaccggcaggtcgaggagtggccgaaggcgacctgcaccggggactgccaggagcgctgcgggtgcaccagcagcacctgtctgcacaaggagtggccccactcccggaattggaggtgcaatcccacctggtgctggggcgtggggaccggctgcacgtgctgcgggctcgacgtgcgggacctcttcaccgactacatgatggtcaagtggaaggttgagtacgtgaagaccgaggccatcatgtgcgttgagctgaccagccaggagcgccaatgctccctcatcgaggccgggacccggtttaacctggggccggtgaccatcacgctgagcgagccgcgcaacatccagcagaggctcccatccgagatcgtcaccttacaccccaagatcgaggaaggtttcttcgatctgatgcatgtccagaaggtgctctcagcctccaccgtgtgcaaactgcagtcctgtacccacggggtccccggcgacctccaggtgtaccatgtgggcaatctcctgaagggggacaaggtcaacggccattcaatccataagatcgagagccacttcaacacttcctggatgagctgggacgggtgcgacctggactacttctgtaacatgggcgactggccgtcctgcacttacactggggtgacacagcacaatcgggccgccttcatcaacatgctcaacatagaaacggactacaccaagaccttccacttccactcaaagcgggtgaccgcccacggcgacactccccagctggacctaaaggcgcgccccacctatggagccggggaggtcaccgtactcgtggaagtagccgacctggagctgcacaccaagaaaatcgaggtgtccgggctcaagttcgccagcctaacatgctccgggtgctacgcatgcagctccggcatttcctgcaaagtgcggatccacgtcaacgaaccggacgagttcaccgtgcacgtcaagtcttccgaccccgacgtggtggcagccgggagcagcctgatggcgcgcaagatagagttcggcgccgacagtaccttcaaagccttctccagcatgcccaagaactccctctgcttctacatagtcgagcgggactactgcagctcctgcactaacgacgatacgcagaagtgcgtggacaccaagctggagcacccccagagcatcctgatcgagcacaaaggcaccattatcgggaagcagaacgacacgtgctccaccaagaccagctgttggctcgagtccgttaagagcttcttctatggcctgaagaacatgctcgggggcattttcgggaacgtcttcctgggcatcttcctgttcctggctccgttcgcgctcctgatcttcttcttcttcttcggctggcgcctgctgttttgcctgaagtgctgtcggcgcacccgcggactgctcaagtacaagcagcttaaggacgaggaggaggccggctacaagaagatcatcgagcggctgaacgacaaaaagggaaagtcccgcctgttcgacggcgagcggttggccgaccgcaagatcgccgagctgttcagcaccaaaacacacatcggc

SEQ ID NO: 15479 - RNA, 3495 nt, synthetic construct
  misc_feature 1..3495: note = derived and/or modified CDS sequence (opt11) from CCHVF(CCHVF UG3010)__DQ211637.1__Gn-NSm-Gc
  source 1..3495: mol_type = other RNA
gccgaaggcgtgagcaacgactgcgtcagtcgcacccagctgatcaagaccgaggtggccgagatccacgaggacagctacggtggccccggggagaagatcacgatctgcaacggctccaccatcgtggaccagcggctcgggagcgagctgggttgctacaccatcaaccgcgtcaagacctacaagctgtgcgagaactccgcgacggagaagggctgtgaaatcgacagcgtgccggtgaagtgcaagcaggggttctgcctcaaggtcacccaggagggccgggggcacgtgaaactgtcccgcggcaccgagatcgttctggacgtctgcgacaccagctgcgagcttatgatccccaaggggacgggtgacatcctggtggactgctccggagggcagcagcacttcctgcaggacaacctcatcgacctgggctgccccaacgtgcccctgctcggtaagatggccatctacatctgccggatgagcaaccacccgaagaccaccatggccttcctgttctggttctccttcggctacgtcatcacgtgcatcgtctgcaaggtgctgttctacctcctgatcgtcatcggcaccctgagcaagaaacttaagcagtaccgcgagctgaagccccagacctgcatcgtgtgcgagtccacccccgtgaacgccatcgacgccgagatgcacgagctgaactgcaattacaacatctgtccctactgcgcgagccggctcacctccgacgggctggtccgccacgtgaaccagtgcccgaagcggaaagagaaggttgaggagacggagctgtacctcaacctggagcgcatcccctggctggtccggcgcctgctccaggtgagcgagtccaccgggatggccctgaagcggagctgctggatgaccaccctcctgatcctgctcgtggtctcacttagcccggtgcagagcgcccccgtcgggcagggaaaggccgtggaggtgtaccgcgtccgggagtcctacacgagcatctgcctgttcgttctcgggtccgtgctgttcgcggtcagctggctgatcaagggcctcatcgacggcatcgggaactccttcttcccgggcctgagcgtgtgcaagacctgctccatcgggagcatcaacggcttcgagatcgagtcccacaagtgctactgcagcctgttctgctgcccctactgccgcgcctgcagcagcgacaagatcacccaccggatgcacctcaacgtgtgcaagaagcgcaaggccgggtccaacgtcatgctggccgtgtgcaagcggatgtgcttcaaggccaccgtggaggcgagcaacacggctctgttaatccgcggcatcatcaactccaccttcgtcatctgcgtgctgatcctggtcatctgcgtcgtgagcacctccgcggtggacatggagaacctccccgccggcatctgggaacgagaggaggacctgaccaacttctgccaccaggagtgccaggtcacggagaccgagtgcctgtgcccctacgaggccctgatcctccgcaagccgctgtacctggacagcatcgcaaaggggatgaagtccctcctgaacagcaccaacctggagaccagcctctcaatcgaggccccctggggcgccatcaacgttcagagcacgttcaagcccaccgtgtccgccgccaacatcgcgttgagctggtccagtgtcgagcaccgcgggaacaagatcctggtgtccggtcggagcgagtccataatgaagctcgaggagcgcaccgggatcagctggtccctgggcgtggaggacgccagcgagtccaagaccctgacggtcagcgtgatggacctctcccagatgtacagccccgtgttcgagtacctgtccggcgaccggcaggtcgaggagtggccgaaggcgacctgcaccggggactgccaggagcgctgcggctgcactagcagcacgtgcctgcacaaggagtggccccactcccggaactggcgctgcaaccccacctggtgctggggcgtggggaccggctgcacgtgctgcgggctcgacgtgcgggatctgttcaccgactacatgatggtcaagtggaaggtggaatacgtgaagaccgaggccatcatgtgcgttgagctgaccagccaagagcgccaatgctccctcatcgaggccggcacccggttcaacctggggcccgtgaccatcacgctgagcgagccgcgcaacatccagcagcggctcccctccgagatcgtgaccctgcacccaaaaatcgaggagggcttcttcgacctgatgcacgtacagaaggtgctcagcgcctccaccgtgtgcaagctgcagagctgcacccacggggtgcccggcgacctccaggtgtaccacgtgggcaacctgctgaagggggacaaggtcaacggccactccatccacaagatcgagagccacttcaacacgtcctggatgtcatgggacgggtgcgacctggactacttctgtaacatgggcgactggccgtcctgtacctacaccggggtaacccagcacaaccgcgccgccttcatcaacatgctcaacatcgagacggactacaccaagactttccatttccacagcaagcgggtgaccgcacacggcgacacgccccagctggacctgaaggcgcgccctacctacggcgccggggaggtcaccgtgctcgtggaggtcgctgacctggagctgcacaccaagaagatcgaggtgtccggcctcaagttcgccagcctgacgtgctccgggtgctacgcgtgcagctccggcatcagctgcaaggtgcggatccacgtcaacgagccggacgagttcaccgttcacgtcaagagctccgaccccgacgtggtggcggccgggagctccctcatggcccgcaagatcgagtttggcgccgacagcaccttcaaggccttctccagcatgcccaagaactccctctgtttctacatcgtcgagcgggactactgcagcagttgcaccaacgacgacacgcagaagtgcgtggacaccaagctggagcacccccagagcatcctgatcgagcacaagggtaccatcatcgggaagcagaacgacacgtgctccaccaagaccagctgctggctcgagtccgtcaagagcttcttctacggcctgaagaacatgcttgggggcatcttcgggaacgtgttcctgggcatcttcctgttcctggcgccgttcgccctcctgatcttcttcttcttcttcggctggcgcctgctgttctgcctgaagtgctgccggcgcacccgcgggctgctcaagtacaagcaactgaaggacgaggaggaggccggctacaagaagatcatcgagcggctgaacgacaagaaggggaagtcccgcctcttcgacggcgagcggctggccgaccgcaagatcgccgagctgttcagcaccaagacgcacatcggc

SEQ ID NO: 15480 - RNA, 2916 nt, synthetic construct
  misc_feature 1..2916: note = derived and/or modified CDS sequence (opt11) from CCHFV(10200, Artificial)__U39455.2__Gn-4aa-Gc
  source 1..2916: mol_type = other RNA
agcgaagaaccatccgacgactgcgtctcccgaacacagcttctccgaactgaaacagcggagatccacggcgacaactacggcggccccggagacaaaataaccatatgcaatggatccactatcgtggaccaacgcctaggctccgaactcggatgctacaccatcaacagagtccgctctttcaaactgtgcgaaaacagcgccacaggcaaaaactgcgaaatagactcggtcccggtaaaatgccgacaaggatactgcctacgcataacacaagaaggacgcggccacgttaagctgagtagaggctcagaagttgtcctagacgcctgcgatacctcctgcgaaatcatgataccgaaagggaccggagacatcctcgtagactgctccggcggacaacaacacttcctcaaagacaacctcatcgacctcggatgcccgaaaatccccttgctgggcaaaatggccatctacatttgccgaatgtcgaaccacccaaaaacaacaatggcattcttattctggttctcattcggatacgtgatcacatgcatcctctgcaaagccatcttctacctgctaatcattgtgggtaccttaggccgccggctcaaacaataccgagaactaaaaccccagacctgcaccatctgcgagactacacccgtgaacgcgatcgatgccgagatgcacgacctaaactgctcatacaatatatgcccctactgtgcctcccggctcacctcagacgggctcgcccgccatgttatacaatgcccaaagagaaaggaaaaagtcgaagaaaccgaactctacctcaaccttgaacgcatcccctgggtcgtccgtaaactactccaagtatcagagagcaccggagtcgctctaaaacggtcgtcctggctaatcgtactgctggtactcttcaccgtgagtctatccccagtccagagcgccccgattgggcgaaaaccactattcctcgactcaaccgcgaaaggtatgaagaacctcttaaacagcacgtcactcgaaacatccctatccattgaagccccgtggggagccatcaacgtgcaatcgacctataaacccaccgtcagcacagccaacatagctctcagctggtcttcggtggaacaccgagggaacaaaatactggtcagcggcaggtccgaatcaatcatgaagctagaagaacgaaccggaatctcatgggatctcggagtcgaagacgccagcgagtccaaactcctaactgtctccgtcatggatctctcgcaaatgtactcaccagtcttcgaatacctctccggagacagacaagtagaagaatggccaaaagcaacatgcaccggagactgccccgagcgctgcggctgcacctcatcgacctgcctacacaaggagtggcctcatagccggaactggaggtgcaacccaacatggtgctggggcgtcggcacaggatgcacatgctgtggcctagacgtcaaagacctattcaccgactacatgttcgtgaaatggaaagtagaatatataaaaacagaagccatcgtatgtgtagaactaacaagccaagagcgccaatgctccctaatcgaagcaggcacccgattcaacctaggcccagtcaccatcaccctcagcgagccgcgcaacatccagcagaaattacccccagagataataaccctccacccccgaatcgaggagggattcttcgacctaatgcatgtacaaaaggtgctaagcgccagcaccgtctgtaaactccaatcatgcacccacggcgtcccaggcgacctccaagtatatcacataggaaacctattaaaaggagacaaagtcaacggacacctcatccacaaaatcgagccacacttcaacactagctggatgtcctgggacggctgcgacctcgattactactgcaatatgggtgactggcccagctgcacgtacactggagtaacccaacacaatcacgccagcttcgtcaacctgctcaacatcgaaaccgactacaccaaaaacttccacttccactccaagagggtaacagcgcatggagacacgccccagctggacctgaaagcccgcccgacatacggcgcgggagagatcacagtcctggttgaggtagcagacatggaactccacacaaagaaaatcgagatttccggcctcaaattcgcctcactagcctgcaccggatgctacgcatgctcgagctccatctcatgcaaagtccgcatccacgtagacgaacccgacgagctcacggtacacgtcaaaagcgacgacccggacgtagtcgcagcctcttcctccctgatggctcgcaagctggagttcggcactgactctaccttcaaggctttctccgcaatgcccaaaacctccctctgcttctacatagtcgaacgagaacactgcaagagttgctccgaagaagataccaagaagtgcgtgaacacaaagctagaacaaccccagtctatactaatcgaacacaaaggcacaataatcgggaagcaaaactccacatgcaccgccaaggcaagctgctggctcgaatccgttaaatccttcttttacggcctcaaaaacatgctgtccggcatattcggcaacgtcttcatgggaatcttcctcttcctagcgccgttcatcctcctaatattattcttcatgttcggctggcgaatcctcttttgcttcaaatgctgccgaagaacccgtggactattcaaataccgacacctcaaggacgatgaggaaacgggataccgccggatcatcgaaaagctcaataataaaaagggcaaaaacaaactcctcgacggagaacggctcgcagacggccgaatcgccgaactcttctccaccaaaacccacataggt

SEQ ID NO: 15481 - RNA, 2916 nt, synthetic construct
  misc_feature 1..2916: note = derived and/or modified CDS sequence (opt11) from CCHFV(IbAr10200, Artificial)__AF467768.2__Gn-4aa-Gc
  source 1..2916: mol_type = other RNA
agcgaggagccctccgatgactgcatcagccgcacccagctcctccggaccgagacggccgagatccatggcgacaactacgggggcccgggggacaagatcaccatctgcaacggatccaccatcgtggaccagcgcctggggtcggaactgggctgctacaccatcaaccgggtcagatccttcaagctctgcgagaacagcgcgacgggcaagaactgcgagatcgactccgtgccggtgaagtgccggcaggggtactgtctgcgcatcactcaggagggccgggggcacgtcaagctgagccgcggctccgaggtggtgctcgacgcgtgcgacaccagttgcgagatcatgatcccgaaggggacgggcgacatcctggtcgattgttccggcgggcagcagcacttcctgaaggacaatctcatcgaccttgggtgccccaagatcccgctgctcgggaagatggccatctacatctgccggatgagcaaccacccaaagacgaccatggccttcctgttctggttctcctttggctacgtgatcacgtgcatcttatgcaaggccatattctacctcctgatcatcgtggggaccctggggaagcgcctcaaacagtaccgggaactgaagccccagacatgtaccatctgcgagaccactcccgtcaacgccatcgacgccgaaatgcacgacctgaactgcagctacaacatctgcccgtactgcgcctccagactcacgtcagacggtctggcccggcatgtgatccagtgccccaagcgcaaggagaaggtcgaggagactgagctttacctcaatctggagcggattccctgggtcgtgcgcaagctgctccaggtgtccgagagcaccggggtcgccctgaagcggtccagctggctgatcgttctcctggtgctgttcaccgtttcactctcccccgtgcagagcgcaccgatcggccgcaagcccctgttcctggactccacggccaaggggatgaagaacctactgaacagcacctccctggagaccagcctctctatcgaggccccatggggtgccatcaacgtgcagagcacctacaagcccacggtctccaccgccaacatcgcgctgagctggtccagcgtggagcaccgggggaacaaaatccttgtttccgggcgcagcgagtccatcatgaagctcgaggagcggaccggcatcagctgggacctgggggtggaggacgcctccgagagcaagctgcttaccgtgtctgtcatggacctgagccagatgtactctccggtgttcgaatacctgagcggcgaccgccaggtgggggagtggcccaaagccacttgcaccggcgactgccccgagcgctgcggttgcacgagctcaacatgcctccacaaggagtggccccattcgcggaactggcgctgcaaccctacctggtgctggggagtcgggaccgggtgcacgtgctgcggcctggacgtgaaggacctgttcaccgattacatgttcgtgaaatggaaggtcgagtatatcaagaccgaggccatcgtgtgcgtggaactgacctcccaagaacggcagtgcagcctcatcgaggccgggacgcgctttaacctgggccccgtcaccatcaccctgtccgagccccggaacatccagcagaaactgcccccggagatcataacgctgcacccccgcatcgaggagggcttcttcgacctgatgcacgtgcaaaaggtgctcagcgcgtccaccgtctgcaagctgcaaagctgcacccatggggtgcccggcgacctccaggtgtaccacatcgggaacctcttgaagggcgataaggtcaacggccacctgatccacaagatcgaaccccacttcaacacctcctggatgagctgggacggctgcgacctcgactactactgcaacatgggcgactggccgtcctgcacgtacaccggagtgacccaacacaaccacgccagctttgtgaacctgctgaacatcgaaaccgactatacgaagaacttccacttccacagtaaacgggtcaccgcccacggcgacacgccccagctcgatctgaaggcccgccccacctacggtgccggcgaaatcaccgtcctggtggaagtcgccgacatggagctccacaccaagaagatcgagataagcggcctgaagttcgcctccctggcctgcaccgggtgctacgcctgcagcagcggcatctcctgcaaggtgcggatccacgtggacgagcctgacgagttaacggtgcacgtcaagagcgacgaccccgacgtggtggccgcgtccagctccctgatggcccgcaaattagagttcgggacggacagcaccttcaaggcattctccgccatgcccaagaccagcctctgcttctatatcgtggaacgggagcactgcaaatcctgctccgaggaggacaccaagaagtgcgtaaacacgaagctagagcagccccagtccatcctgattgaacacaagggcaccatcatcgggaagcagaacagcacttgcaccgcgaaggcctcctgctggctcgaaagcgtcaagtccttcttctacggactgaagaacatgctgagcggcatcttcgggaacgtgttcatgggcatcttcctcttcctggccccgttcatcctgctcatcctgttcttcatgttcgggtggcgcatcctgttctgcttcaaatgctgccggcgcacccggggcctcttcaagtaccgccacttgaaggacgacgaggagaccgggtaccggcggatcatcgagaagctgaacaacaagaagggaaagaacaagctccttgacggcgagcggctggcggaccgccgcatcgccgagctgttctccaccaagacccacatcggg

SEQ ID NO: 15482 - RNA, 2916 nt, synthetic construct
  misc_feature 1..2916: note = derived and/or modified CDS sequence (opt11) from CCHFV(Turkey-Kelkit06, Artificial)__GQ337054.1__Gn-4aa-Gc
  source 1..2916: mol_type = other RNA
agcgaagaacccggcgacgactgcatttcccgcacacaactgctccgcaccgagacggcggagatccacgacgacaactacgggggcccgggggacaaaatcaccatctgcaacggcagcaccatagtggaccaacgcctgggatctgagctgggctgctacacgatcaacagagtcaagagctttaagctctgcaaaaattccgccacgggcaagacctgcgaagtggacagcactcccgtgaagtgccgccaggggttctgcctgaagatcacccaagagggccgggggcacgtcaagctgtcccgcgggagcgaggtggttctggacgcgtgcgacagttcatgcgaggtcatgatccccaagggtacgggcgacatcttagtggactgctccggcgggcagcagcactttctgaaggacaacctgatagacctgggctgcccccacatcccgctgctcgggcggatggccatatacatctgcaggatgagcaaccacccccggaccaccatggccttcctgttctggttctccttcgggtacgtgatcacgtgcatcttctgcaaggccctgttctacagcctcatcatcatcggcaccctgggaaagaagatcaagcagtaccgcgagctgaagccgcagacctgcaccatctgtgagaccgccccggtcaacgctatcgacgccgagatgcacgacctcaactgctcctacaacatctgcccgtattgcgcaagccggctgacgtccgatggcctggcccgccacgtgacccagtgcccgaagcggaaggagaaggtggaggaaaccgagctctacctgaatctggagcgcatcccctggatagtccggaagctcctccaggtaagcgagtccaccggggtggcgctgaagcgcagcagctggctcatcgtcctgctagttctgctgacggtgtccctgtctcccgtccagtccgccccggtgggccggaagcccctcttcttggattcaatcgtcaaggggatgaagaatttacttaactccacaagcctggagacctccttgagcatcgaggccccgtggggcgccatcaacgtccagtccacctttaagcctacggttagcaccgccaacatcgcgctctcctggtcatccgtagtgcaccgagggaacaagatcctggtgaccgggcggagcgagagtatcatgaagctggaggagcgcaccggcgtcagctgggacctcggggtggaggacgcctccgaaagcaagctgctgaccgtgtccatcatggacctctcccagatgtacagcccggtctttgaatacctgtccggggaccgccaggtggaggagtggcccaaggcgacctgcaccggggactgccccgagagatgcggctgcacctcctccacttgcctgcacaaggagtggagccactcccgcaactggcggtgcaatcccacctggtgctggggtgtggggaccggctgcacatgctgcggggtcgacgtgaaagacctcttcaccgaccacatgttcgtgaagtggaaggtcgagtacatcaagaccgaggccatcgtgtgcgtggccctgaccagccaggagcgccagtgctccctgatcgaagcaggcacacggtttaatctgggtccagtcaccatcacgctctcagagccacgcaacatccagcagaagctgccgcccgagatcatcaccctgcatccaaaaatcgaggagggcttcttcgaccttatgcacgtgcagaaggtcctgagcgcgagcaccgtctgcaagctgcagtcctgcactcacggcatccccggtgacctccaggtgtaccacatcggcaacctgctgaagggggatcgggtgaacggccacctcatacacaagatcgagagccacttcaacacgtcctggatgagctgggacggctgcgacctggattactactgtaacatgggggactggccttcctgcacctacaccggcgtcacccagcacaaccacgctgccttcgtaaatttgctcaacatcgagacggactacaccaagaccttccacttccacagcaagcgcgtaacggcccacggggacacgccccagctggacctgaaggcgagaccgacctacggcgccggtggcatcaccgtccttgtggaagtggccgacatggagcttcacacgaagaaggtcgaaatctccggcctcaagtttgccagcctcgcatgcacggggtgctacgcgtgttcttccggcatctcatgcaaggtgcgcatccacgtggacgagcccgacgaactgaccgtccacgtcaagagcagcgaccccgacgtggtggccgcctccaccagcttaatggcccggaagctcgaatttgggaccgactccacgttcaaggcgtttagcgccatgccgaagacctccctctgcttctacatcgtggagcgggagtactgcaagagctgcagcgaggacgacacccagaagtgcgtggacacacgcctggagcagccacagagcatactcattgagcacaagggcacgatcatcgggaagcagaacgacacgtgtaccgccaaggcctcctgttggctggagagcgtcaagtccttcttctacggcctgaagaacatgcttggcagcgttttcgggaatttattcatcggcatcctcctgttcctggcccccttcgtgctgctcgtcctgttcttcatgttcggttggaagatcctgttctgtttcaaatgctgccgccggacccgcggcctctttaagtaccggcacctgaaagacgacgaggagaccgggtacagacggatcatcgagcgcctgaactctaagaagggcaagaaccggctactagatggcgaccgcctggcagaccgcaagatcgccgagctgttcagtactaagactcacatcggg

SEQ ID NO: 15483 - RNA, 2919 nt, synthetic construct
  misc_feature 1..2919: note = derived and/or modified CDS sequence (opt11) from CCHFV(SR3, Artificial)__AJ538199.1__Gn-4aa-Gc
  source 1..2919: mol_type = other RNA
agcgaggagtccggagacgactgcatcagccgcacccagctgcttcgtaccgagaccgccgaagtgcacggggacaactacggcgggccgggcgacaagatcaccatctgcaacgggtccaccgtggtggaccagcgcttaggcagcgagctcggatgctacaccatcaaccgggtgcgctccttcaagctctgcgagaacagcgccacggggaagtcctgcgagatcgacagcatcccggtgaagtgcaagcagggctactgcctgaagatcacgcaggaggggagaggccacgtgaaactgtctcgcgggagcgaggtggtactcgatgtgtgtgactccagttgcgaggtcatgatacccaagggcactggcgatatcctggtcgactgctccgggggccagcagcacttccttaaggacaacttagtggacctggggtgtcccaagatccccctgctcggcaaaatggcgatctacatctgccgaatgagcaaccacccgaagaccacgatggcgttcctgttctggttctccttcggctacgtgataacctgcatactgtgcaaagcaatcttctttctcctgatcatcttcggtaccctgggcaagcgcttcaagcagtaccgggagctcaagccccagacctgcaccatctgcgagaccacccccgtcaacgccatcgacgccgagatgcacgatctgaactgcagctacaacatctgtccctattgcgcgtcccggctgaccagcgacgggctcgcccggcatgtgactcagtgcccacgccggaaggagaaggtggaggagaccgagctctacctgaacctcgagcgcattccgtgggtagtgcggaagctgctccaggtctccgagagcacgggcaccgtccttaagcgcagctcctggctgatcgtcctgctcgtgctgttcacggtcagcttaagtcccgtgcagagcgcgcccatcgggctccggagaccgctgtttctggacagtatcgtaaaggggatgaaaaacctgctgaacagtacctccctggagacaagcctctctatcgaggccccctggggcgcgatcaatgtccagagcacctacaagcccacggtgtccacggccaacatagcactgagctggtccagcgtcgagcacagaggcaacaaggtgctggtgtccggccgcagcgagtccatcatgaagctcgaggagcggaccgggatcagctgggacttgggcgtcgaggacgcctccgagagcaagttgctgaccgtgagcgtgatggacctgagtcagatgtatagccccgtcttcgagtacctgtccggggaccgccaggtggaggagtggccgaaggccacgtgcacaggcgactgccccgagcgctgtggctgcaccagcagtacgtgcctccacaaagagtggccccacagtcggaactggcgctgcaaccccacctggtgctggggcgtggggaccgggtgtacgtgctgcggcctggacgtcaaggacctgttcaccgactacatgttcgtgaagtggaaggtggagtacataaagaccgaggctatcgtctgcgtggagctgacatcccaggagagacaatgcagcctcatcgaggccgggacccgctttaatctgggctccgttacaatcaccctgtccgaaccgcgtaacatccagcagaaactcccgcccgagatcattacgctgcacccaaagatcgaggagggattcttcgacctgatgcacgtccaaaaagtgctctcagccagcaccgtttgtaagctgcagtcctgcacccacggggtcccaggcgacctccaagtgtaccatatcgggaatctgctgaagggcgatcgcgtgaacggccacctgatccacaagattgagcaacactttaacacctcgtggatgtcctgggacgggtgtgacctcgactactactgcaatatgggtgactggccgagctgcacgtacaccggcgtcacccagcacaaccacgcctccttcgtgaacctgctgaacatcgagaccgactacacgaagaccttccacttccacagcaagagggtgaccgcccacggcgatacgccccagctcgacctcaaagcacgccccacctacggggccggcgagatcactgtcctggtcgaggtagccgacatggagcttcacaccaagaaaatcgagatctccggcttgaaattcgctgggctgacctgcacgggatgctacgcctgttccagcgggatttcttgcaaggtgcggatccacgtcgacgagccggacgagctcacggtgcacgtgaagtcagacgaccccgacgtggtggcggcctccagctccctgatggcgcgcaagctggagtttggcaccgacagcaccttcaaggccttctccgccatgcccaaaacgagcctctgcttctacatcgtcgagcgggagtactgcaagtcctgcaacaaagaggacacccagaagtgcgtgaacaccaagctggagcagccgcagagcatcctcatagaacacaaggggaccataatcggcaagcagaacaatacgtgtacggcgaaggcttcctgctggctcgagagcgtaaagtccttcttctacggactgaagaacatgctcgggggtatcttcggtaacgtcttcatcggcatatttacctttctgacccccttcatcctgctgatcctcttcttcatgttcgggtggcgaatcctgttctgcttcaagtgctgccggagaacgcggggcctgttcaagtaccgccatttaaaggacgacgaggaaaccggctaccggaagatcattgaaaggctgaacaacaagaaggggaagaaccggctgttagacggcgagcgcctggcagaccgcaagatagccgagctgttcagcaccaagacccacatcggc

SEQ ID NO: 15484 - RNA, 2919 nt, synthetic construct
  misc_feature 1..2919: note = derived and/or modified CDS sequence (opt11) from CCHFV(UCCR4413, Artificial)__KY484038.1__Gn-4aa-Gc
  source 1..2919: mol_type = other RNA
agcgagtccagcgccagcggctgcatcagcagaacccaaatgatcaagtcggagaccgccgaaatccacgacgacatctacgggggccccggggagaagctgacgatctgcaacggcacgaccgtcgtagaccagcggctcgggtcagagctgggctgctacaccatcaaccgcatcaagacgtacaagctgtgtgaaaattccgtgaaggagaagacctgcgagatcgactccgtgcccgtcaagtgccggcagggcctctgcctgaagatcacccaggaggggcgcggacacgtgaagctgtcccgggggagcgagatcgtgctcgacatctgcgactccagctgcgagctgatgatccccaaggggaccggggatatattggtcgactgctccggcggccaacagcacttcctccaggacaatctggtagacctggggtgccccaatatccccctcctgggcaaggtggcgatctacatctgccgcatgagcaaccacccgaagacgaccatggccttcctgttctggttctccttcgggtacgtcattacctgcatcctctgcaagatccttttctacctgctcatcatcaccgggacgctgggcaagaagctgaagcaataccgggagttaaagccccagacctgcaccatctgcgagagcacccccgtgaacgccatcgacgccgagatgcacgacctgaactgctcctacaacatctgcccttactgcgccagccgcctgacgtccgacgggttgatccgtcacgtgaacctgtgccccaagcgcaaggagaaggtggaggagaccgagctgtacctcaacctggagcgaatcccctggtttgtgcgcaagctgctccaggtcagcgagagcaccggcgtcgcgctgaagcggtcctcttggctgctgatcctggtgatcctgctcaccgtgtccatgagccccgttcagtccgcccccatcaaccgcaagccgctgttcctgagctccatcgtgaagggtaagaagaacctcctgaacagcgcctccttagagacgagcctctccatcgaggccccctggggcgcgatcaacgcccagagcaccttcaagcccaccatctccaccgccaacatcgctctgagctggtccagcgtggagcaccgggggaacaaggtcctggtctccggccgcagcgagtccatcatgaagctcgaggagcggacgggcatctcttggaacctgggggtggaggacgccagcgaatcccgcatgcttaccgtcagcgtgatggacctctcccagatgtacctgcccgttttcgagtacctgagcggcgaccggcaagtggaggagtggcccaaggctacctgcaccggggactgccccgagagatgcggctgcacgtccagcacctgtcttcacaaggagtggccccactcccggaactggcgctgcaaccccacctggtgctggggcgtcgggaccggctgtacctgctgcgggctggacgtcaaggacctgttcaccgactacatgttcgtgaagtggaaggtggagtacatcaagactgaggccatcgtctgcgtagaactgacctctcaggagcgccagtgctccctcatcgaggccgggacgcggttcaacttggggccggtgaccatcaccctgagcgagccccgcaacatccagcagaagctcccctccgagatcgtcacactgcaccccaagatcgaggaaggcttcttcgacctgatgcacgtgcagaaggtgctcagcgcctccaccgtctgcaagctgcagagctgcacgcacggggtggccggggacctgcaagtgtatcacgtcggaaacctcttgaagggggacaagatcaacggccactccatccacaagatcgagccgcacctgaacaccagctggatgtcctgggacgggtgcgacctcgactactactgcaacatgggcgactggcccagctgcacctacaccggcgtgacgcagcacaaccacgcggccttcgtaaacctgctgaacatcgagaccgactacaccaagagcttccacttccactccaagcgggtcaccgcccatggggacacgccccaactggacctgaaggcccgccccatgtacggcgctggagagatcaccgtgctggtggaggtcgcagacatggagctccacagcaagaacatcgagatatccggcctgaagttcgccagcttgacctgttccggttgctacgcctgcagctccggcatcagctgcaaggtgagaatccacgtggacgagccggacgagctcgccgtccacgtgaagtccgacgacctggacgtggtcgccgcgagctcctcactgatggcccgcaagatagagttcggcaccgactccacgttcaaagccttcagctccatgcctaaagagtccctctgcttctacatcgtggagcgggacttctgtaagtcctgcgccgcggaggacactcagaagtgcgtgaaggccaagttagagcagccccagagcatcttaatcgagcacaaggggaccatcatcggcaagcagaacgatacctgctccaccaagaccagctgctggctcgagagctttaagtccttcttctacggactgaagaacatgctgagcggcgtcttcgggtccgccatcatgggcatcctcctgttcttagccccgtttattctcctgatcctgttcttcttcttcggctggcgaatcctcttctgcctgcggtgctgccgccgaaccagggggctgtttaagtacaaacacatcaaggacgacgaggaggccggctacaagaagatcatcgagaagctcaacaacaagaagggtggcaccagcaagctgctggacggggagcggctcgcggaccgcaagatcgccgagctgttctccacgaaggctcacatcggc

SEQ ID NO: 15485 - RNA, 2916 nt, synthetic construct
  misc_feature 1..2916: note = derived and/or modified CDS sequence (opt11) from CCHFV(66019, Artificial)__AB069669.1__Gn-4aa-Gc
  source 1..2916: mol_type = other RNA
agcgaagagtcgggagacgactgcatatccagaacccaattgctgcgcaccgaaacagcagaggtccacggagacaactacggaggaccaggcgacaaaataaccatctgtaacggctcgaccatagttgaccagcggctaggatccgaactcggatgttacaccatcaatcgggtgaaatcatttaagctctgcgaaaactcaggaaccgggaaaagctgcaagatagataatacccccgtaaaatgcaggcaaggtttctgccttaagatcacacaagaaggccgcggccacgtaaaactaagccgcggatcagaggtggtcctcgacgcctgtgacagctcatgcgaaatcatgatccccaaaggcacaggagacatactcgtcgactgcagcgggggccagcaacactttctaaaagacaatctcgtcgacctcggctgcccaaacatacccctcttaggcaagatggcgatctacatctgccgtatgagcaaccatcccaagacgaccatggcctttctcttctggttctcattcggctacgttatcacatgtatcttctgcaaaataatcttctacctactgatcgtagtaggcaccctaggcaaaaagttcaaacaataccgagaactcaaaccacaaacatgcacaatttgcgaaaccacacccacaaatgccatcgatgcggaaatgcacgacctaaaatgctcatacaacatatgcccctactgcgcgtcccgtctgacatctgatgggctcgcacgccacgtaacgcaatgccccaaacgaaaagaaaaggtcgaagaaacagaactctacctcaacctcgaacgcatcccatggatcgttcgaaaactcctccaagtatcggaatccaccggagtcgccctaaaacgtagcagctggctaatcgtactcctcgtcttgctaaccgtatcactatctcccgttcagagcgcccccataggacgaaaaccactattctcggactcaattgttaaaggcatgaagaacctgttgaactcaaccagtctcgaaacttcactaagcatagaagccccatggggcgccatcaacgtccaatcaacattcaaaccaaccgtctcaacggcaaacatagcactatcctggagctcagtagaacacagaggcaacaaaatcctcgtctcgggacgatccgaatccataatgaaactcgaggaacgcacgggcatctcctgggacctaggggtcgaggacgcttccgaatcgaaactcttaacagtgagcgtcatggacttatcccagatgtactccccagtatttgaatacctatcgggagaccggcaagtagaagaatggccaaaagcaacctgcacgggaaactgccccgacagatgcggctgcacctccagcacatgcttacataaggaatggccacacagcagaaactggcgatgcaatccaacctggtgctggggcgtcggcaccggatgcacatgctgcggcctcgacgtgaaagacctcttcaccgactacatgttcgtcaagtggaaagtcgaatatatcaaaacagaggccatcgtgtgcgtagagctaaacagccaagaaagacaatgctcccttatcgaggccggaacccgcttcaacctaggcccagtaactatcacccttagcgaaccccgcaacatacaacagaaactaccctccgaaataatcaccctgcaccccagaatcgaagagggattcttcgacctcatgcacgtccaaaaagtgctctcagcctcaacggtctgtaaactccaatcctgtacacacggcgtccccggagacctacaaatctaccacatcggaaacctcctcaagggcgaccgagtcaacggccacctaatccataaaattgaaccacacttcaacacctcctggatgtcatgggacggctgcgacctagactactactgcaacatgggcgactggccctcctgcacctacaccggcgtaacacaacacaaccacgccgccttcgtcaacttactaaacattgagacggactacacgaaaaacttccacttccacagcaagcgtgtgacggcgcacggagacacaccccaacttgacctgaaggcacgacccacctacggagcgggcgagataaccgtcctcgtagaagtcgctgatatggaactccacacgaagaagatcgccataagcggcttaaaattcgccagcctaacatgcaccggctgttacgcctgctcctctgggatctcctgcaaagtccgaatccacgtagacgaaccagatgagctcaccgtacacgtaaaatcagaagacccagacatcgtagccgcctcatcctcgctgatggccagaaagctagagttcggcaccgattcaaccttcaaagccttctcagcaatgccgaaaacttcactctgcttttacatcgtggaaagagaatactgcgaatcctgttcaaaagaggacacacaaaaatgcgtaaacaccaagctcgagcaacctcaaagcatactaatagaacacaagggtacgataatcggaaaacagaacgacacatgcacggccaaagcgagctgctggcttgaaagcgttaagtccttcttttacggcctgaagaatatgctctcaggcatcttcggaaacgtcttcattggcatcttcctcttcctagccccattcatactcctcatactattcttcatgttcggctggagaatcctattctgcttcaagtgctgcagaagaacgaggggattattcaaatatcgatacctcaaggacgacgaagaatccggctaccgcagaataatagagaggctaaataacaagaaaggtaaaaacaagctcttagacggagaacgcctcgccgacagaaggattgccgaactcttcagcaccaaaacccacatcgga

SEQ ID NO: 15486 - RNA, 2916 nt, synthetic construct
  misc_feature 1..2916: note = derived and/or modified CDS sequence (opt11) from CCHFV(7001, Artificial)__AB069670.1__Gn-4aa-Gc
  source 1..2916: mol_type = other RNA
gccgagggcggatcatcggactgcatatcccgcacacagctagtaaaaacggaagtcgccgaaatacacgaagatagctacggcggaccaggcgagaaaattacaatctgcaacggctcaaccatcgtagatcaacgcctgggttcagagttaggctgctacactataaacagagtgcgaagctacaaactctgcgagaacagtgccagcggcaaatcatgcgagatagactcaatcccagtgaaatgcaaacaaggcttctgtcttaaaataacccaggaaggacgtggccacgtcaaactgagccggggcacggaaatagtcctggacgtctgcgactcgagctgcgaactcatgatacccaaagggaccggcgacatactcgtggactgcagcggaggccaacaacacttcctacaaaacaacctcatagacctcggttgcccaaacgtccctctactaggaaagatggcaatctacgtatgtagaatgtccaatcacccaaaaaccaccatggcgttcctattctggttctcattcggatacgtaataacatgcatcgcctgccgagtcctgttttacctactaatcgctatcggcaccgttggcaaaaagctgaagcaataccgcgaactgaaaccccaaacctgcatagtatgcgagagcgttccagtcaacgcgatcgacgccgagatgcacgaactaaactgcagctacaacatttgcccatattgcgcgtcccgcctcagcaccgacgggctcatcagacacgtcacccaatgccccaaaagacgagaaaaggtcgaagaaaccgaacttttcctaaacctcgaaagaataccctggctcgtacgcaaactcctccaagtatcggaatccaccggcatggcactcaagcgctcctgctggatgataaccctgctaatcctactcctggtcagcatctcacccgtccaatccgccccagtgggaagaaaaccgctattcctagataacatagcaaagggcatgaaaagcctgcttaactctacctcgctcgagacatccctgtcgatcgaagcgccatggggagcaatcaacgtacaatctactttcaaaccaactgtctccgccgccaacatcgccctttcctggtcaagcgtggaacaccgcggaaacaaaatcctagtcagcggacgcagcgagagtataatgaaactagaagaacgcaccggagtcagctggaacctaggagttgaggacgccagcgaatcaaagactcttaccgtcagcgtaatggatctatcccaaatgtactccccagtgttcgaatacctatccggggaccgacaagtcgaagagtggccaaaagctacctgcaccggagactgtccagagcgctgcggctgcacatccagcacatgcctacacaaggaatggccccactcccgaaactggcgctgcaaccccacctggtgctggggagtaggcaccggctgtacctgctgcgggctggatgtcaaggacttcttcaccgactacatgctcgtcaaatggaaagtcgagtacataaaaacagaggccatcgtatgcgtcgaactaacctcccaggagagacaatgctctctcattgaagccggcacgagattcaacctaggacccgtcacaatcacgctaagcgaacccagaaatgttcaacaacgccttccacccgagattgtcacccttcaccccaagatagaagaaggattcttcgaccttatgcacgttcagaaaatcctaagcgccagcacagtatgcaaactgcaatcctgcacacatggcgtcccgggcgacttccaggtctaccacgtcggcaacctgctccgcggcgacaaagtcaatggccactcaatacacaaaatcgaacctcacttcaacacctcgtggatgagctgggacggttgcgacctagattacttctgcaacatgggagactggccaagctgcacctacaccggcgtcacccagcacaaccgtgccgccttcataaacatgttgaacatagaaactgactacaccaagacattccacttccacagcaaacgagtaaccgcccacggcgacaccccacaactagacctaaaggcccgaccggcttacggagcgggcgaagtcaccgtcttagttgaagtcgcggacctcgaactacacactaaaaagctcgaagtctcaggcctcaaaatcgcctcccttacctgctccggatgttatgcttgcagcagtggaatctcatgcaaggtacgcatccacgtcaacgaaccggatgagttcactgtccacgtgcgaagttccgaccccgacgtggtcgccgccggaagctcgctaatggcgcgaaaaatcgaatttggagccgactccaccttcaaagcattctcctccatgccaaaagactccctctgtttctacattgtagaaaaagactattgctcgagctgcacagacgacgacacccaaaaatgcgttaacacaaagctagaccacccccaaagtatcctcatagaacacaaaggaactataatcggaaagcaaaacgatacctgctcgaccaaaacctcgtgctggctcgagtccgtcaagggcttcttctatgggctcaaaaacatgctctccggcatcttcggcaacgtattccttggcatattcctattcttagccccctttgtgctcctaatcttcttcttcttcttcggctggcgcttactcttctgtctcaaatgctgccgccgcacccgcggcttactcaagtacaaacatctcaaggacgaagaggaagccggctacaagaaaatcatagaacgactgaacggaaagaaaggcaaatcccaactcttcgacggagaacggctagccgacagaaaaatcgccgaactcttctcaacgaaaatacacatagga

SEQ ID NO: 15487 - RNA, 2916 nt, synthetic construct
  misc_feature 1..2916: note = derived and/or modified CDS sequence (opt11) from CCHFV(75024, Artificial)__AB069671.1__Gn-4aa-Gc
  source 1..2916: mol_type = other RNA
tcagaagaatcaggcgacgactgcatcagccgaacccaactcctacgaacagaaactgccgagatccacggcgacaattacggcggccccggggacaaaataactatctgcaacggaagcaccatcgttgaccaacgccttggctcggaaatgggttgctacaccattaatcgcgtaaaatcattcaaattgtgcgaaaactctgccactggcaaaagctgcgagatcgacagtatacccgtcaaatgccggcagggatactgccttaaaataacacaagaaggacgcggccatgtcaaactaagccgcggatcagaagtcgtcctcgacgcctgtgacagctcctgcgaagtcatgattcctaaaggaaccggtgacatactcgtcgactgctccggcggacaacagcacttcttaaaagacaacctcatagacctcgggtgcccctcaatccccctcctcggtaaaatggctatctacatctgcagaatgtccaaccaccccaaaaccaccatggctttcctcttctggttctccttcggttacgtcataacctgcatcctctgcaaagcaatcttctacctcctcataatagtcggcacccttggaaaacgcttcaagcaataccgcgaactaaaaccacaaacctgtacaatctgcgaaaccacacccgctaacgctatagatgcagaaatgcatgatctgaactgctcctacaacatatgcccctactgcgcctcccgactcaccagcgacggcctcgcgagacacgtaacacaatgtcccaagcgcaaagaaaaagtagaggaaaccgaactgtacctaaatctcgaacgcatcccctgggtcgtaagaaaactccttcaagtctcggaatcaacaggcgtggccctcaaacgctcatcctggttaatcgtcctcctggtactcttcgccatatcattgagtccggtccagtcagcccctatcggtcgcaggcccctcttccttgacagcattgtgcgcggaatgaaaaatcaactcaactcaaccagcctggaaacctccctttcaatagaagccccgtggggagcaatcaacgtccaatcaacttacaaacccaccgttagcaccgccaacatcgccctctcctggtcgtctgtggaacaccgcgggaacaagatcctagtatcaggccgatccgaatctattatgaaactcgaagaacgcaccggcatatcatgggacctgggagtcgaagacgcctcagaatccaaactcctcacagtatcagtgatggacctgtctcaaatgtacagcccggtatttgaatacctttcaggggaccgacaagtcgaagagtggccaaaagctacctgcacaggagactgccccgaacgctgcggctgcaccacctcaacgtgcctccacaaggagtggccacactctcgaaactggcgctgcaacccaacatggtgctggggagttggtacaggctgcacatgctgcggcctggatgtcaaagatctatttacagactacatgatcgtgaaatggaaggtcgaatacatcaaaaccgaagccatcgtctgtgtcgagctcacctcccaagaacgccaatgttcgctcatcgaagcaggcacgcgctttaatctagggtcagtcactattaccctcagcgaaccacgaaacatccaacagaaactccctcccgagataatcaccctccacccccgcatcgaagaaggcttcttcgatctaatgcacgtccagaaagtattatccgccagcaccgtatgcaagctacaatcgtgcacccacggagtacccggggacctgcaagtctaccacgtcggaaatctactcaaaggagacaaggtcaacgggcacctcatacacaaaatcgagccccaccttaacacctcctggatgtcttgggacggctgcgaccttgactactactgcaacatgggcgactggccctcctgcacatacacaggagtaacacaacacaaccacgcctccttcgtcaaccttctaaacatcgagacggactacacaaaatccttccacttccactccaagcgagtgaccgcccacggagatacaccacagctggacctcaaggcgcgcccaacatatggagccggcgaaataaccgtactcgtggaagttgccgacatggagttcacccccaagaagatcgaaatcagcggcctaaaattcgcgagtcttacctgcaccggttgctatgcctgttcttccggaatcagctgcaaagtgagaatccacgtagatgaacccgacgaactaacagtccacgtaaaatctgacgaccccgacgtggtagccgcatcctcttctctcatggcaagaaagctagagttcggcaccgactccaccttcaaagccttctccgctatgcccaaaacctctctctgcttctacattgtcgagagggaatattgcaaatcatgctcaaaggaagacacccaaaaatgcgtaaacacgaaacttgaacaacctcaatccatcctgatcgaacacaaaggaaccatcattggcaaacaaaataacacttgcaccgcgaaagccagctgctggctcgaatccgtaaaatccttcttctacggccttaaaaatatgctctcagggatcttcggaaacctgttcatgggcatcttcctattcctagcccccttcatcctcctcatactattcttcatgtttggctggcgaatcctcttctgtttcaaatgctgccgccgcactcgaggcctcttcaaataccgccacttaaaagacgacgaggaaaccggctaccggcgaatcatcgaaaggttaaacaacaagaaaggaaagaataagctgctagacggcgaacgcttagctgaccgccgcatcgccgaactattctccacgaaaacacacataggc

SEQ ID NO: 15488 - RNA, 2916 nt, synthetic construct
  misc_feature 1..2916: note = derived and/or modified CDS sequence (opt11) from CCHFV(7803, Artificial)__AB069672.1__Gn-4aa-Gc
  source 1..2916: mol_type = other RNA
agtgaggagtccggcgacgactgcatcagccgcacccagttgctccggaccgagacggccgagatccacggggacaactacggcgggcccggcgataaaatcaccatctgcaacgggtccaccatcgtggaccagcgcttaggcagcgagatgggctgttacaccatcaaccgggttaagtccttcaagctgtgcgaaaacagcgccacggggaagtcctgtgagatcgacagcataccggtcaaatgccgccagggctactgcctcaaaatcacccaggaggggcggggccacgtgaaactgagtcgcggatctgaggtcatcctggacgcgtgcgattccagctgtgaggtgatgatccccaagggcaccggcgacatcctcgtggactgctccggcgggcagcagcacttcctgaaggataatctgatcgacctcgggtgccccagcatccccctgctggggaagatggccatctacatctgccggatgtccaaccacccgaagaccacgatggccttcctcttctggttcagcttcggctacgtcatcacgtgcatcctgtgcaaggcaatcttctacctgctcatcatcgttgggacgctgggcaagcgcttcaagcagtaccgggagctgaaaccccagacctgcaccatctgcgaaaccaccccagccaacgcgatcgacgccgaaatgcacgacctcaactgctcctacaacatctgcccctattgcgccagccgcctgacctccgacgggctggcccggcacgtgacgcagtgtccgaagcgcaaggagaaggtcgaggagaccgagctctatctgaacctggagcggattccctgggtggtgcgcaaattactgcaagtcagcgagagcaccggcgtggccctgaagaggtccagttggttgattgtgctgctggtcctcttcgccatctccctgagccccgtgcagagcgcccccatcagccggcgtccgctgtttctcgactccatcgtgcgcgggatgaaaaaccccctgaacagcacctccctggagacgagcctctccatcgaggccccctggggcgccatcaacgtccagagcacctacaagcccaccgtgtctaccgcgaacatcgccctgagctggtccagcgtggagcaccgggggaacaagatcctggtctccgggcgcagcgagtccatcatgaagctcgaggaacggacgggcatcagctgggacctgggggtggaggacgcaagcgagtccaagctgctcaccgtgtctgtcatggacctgtcccagatgtacagcccggtgttcgagtacctgtccggcgaccgccaggtagaggagtggcccaaggcgacctgcacgggagactgccccgagcgctgtggctgcacgacgagcacctgtctccacaaggagtggccccactcccggaactggcgatgcaacccgacctggtgctggggcgtggggaccggctgcacgtgctgcgggctggacgttaaggacctgttcaccgactacatgatcgtcaagtggaaggtggagtacatcaagacccggggcatcgtgtgcgtcgaactcactagccaggagcgccagtgctccctgatcgaggccgggacccggttcaacctgggcagcgtgaccatcaccctgtccgagccccgtaacatccagcaaaagctcccgcccgagatcatcaccctgcacccccggatcgaggagggcttcttcgacctcatgcacgtgcagaaggtcctcagcgcatccacggtgtgtaaactgcaaagctgcacccacggggtgcccggcgacctgcaagtctaccacgtggggaacctcctgaagggcgacaaggtgaacggccacttaatccacaagatcgagccccacctcaatacctcctggatgtcgtgggacgggtgcgaccttgactactactgcaacatgggcgactggccctcctgcacctacacgggggtcacccagcacaaccacgccagctttgtgaacctgctcaatatcgagaccgactacaccaagagcttccacttccactccaagcgggtgacggcccacggcgacaccccacaactggacctgaaggcccggccgacctacggtgccggcgagatcaccgtccttgtggaggtggcggacatggagttcacccccaagaagatagagatcagcggcctgaaattcgcttccctgacctgcaccgggtgctacgcctgcagctccggcatcagctgcaaggtccgcatccacgtggacgagccggacgagctaaccgtgcacgtcaaatcagacgaccccgacgtggtggcggccagctccagcctgatggcgcggaagctggagttcgggaccgactccacctttaaggccttcagcgccatgcccaagacctccctctgcttctacatcgtcgagcgcgaatactgtaagagctgttccaaggaggatacgcagaagtgcgtgaacacgaagctggagcagccccagagcatcctgatcgagcataagggcaccatcatcgggaagcagaacaacacgtgcaccgccaaggcgtcctgctggctcgagtcagtgaagtcctttttctacggcctgaagaacatgctgagcggcatcttcgggaacttcttcatgggcatctttctctttctggccccgttcatcctgctgatcctgttcttcatgttcgggtggcggatcctgttttgcttcaagtgctgccgccggacccgcggccttttcaagtaccggcaccttaaggacgacgaggagaccggttaccgccggatcatcgagagactgaacaacaagaagggcaagaacaagctcctggacggcgagcgcctggcggaccggcgcatcgccgagctgttcagcacgaagacccatatcggg

SEQ ID NO: 15489 - RNA, 2916 nt, synthetic construct
  misc_feature 1..2916: note = derived and/or modified CDS sequence (opt11) from CCHFV(79121, Artificial)__AB069673.1__Gn-4aa-Gc
  source 1..2916: mol_type = other RNA
gccgaaggaggatcctcagactgcatcagccggacccagctcgtaaaaacagaggtcgcagaaatccacgaagacagctacgggggccccggcgagaaaatcaccatatgcaacggaagcaccatagtcgaccaaggtctaggttcagaactaggctgctacacaatcaacagagtccgctcctacaaactatgcgaaaactcagcctccggcaaatcgtgcgaaatagactcaatccctgtcaaatgcaaacaaggattctgcctcaaaatcactcaagaaggcagaggacacgtcaaactatcacgcggcacggaaatagtcctcgatgtatgcgacagcagctgcgaactcatgatccccaaaggtaccggcgacattctcgtcgactgttccggcggccaacaacatttcctccaaaacaacctcatcgacctaggatgcccgaacgtcccactcctaggcaaaatggcaatctacgtatgccgaatgtccaaccaccctaagacgacaatggcattcctattctggttctccttcggatacgtcataacctgcatcgcttgccgcgtgctattctacctacttatcgccatcggcacagtgggcaagaaactgaagcagtaccgcgaactaaaaccccaaacttgcatcgtctgcgaatcagtcccagtcaacgcaatcgacgccgaaatgcacgaactcaactgcagctacaacatatgcccctactgtgcaagccgattatcaacagacggcctcatccgacacgtaacacaatgtcccaaaagacgcgagaaagtagaagaaacagaattgtttctcaaccttgaacgcatcccctggctcgtgcgtaaactgctacaggtctccgagtccacaggaatggccctcaaacgaagctgctggatgatcacactcctcatcttactactcgtatccatctctcccgtccagtccgcacccgtcggccgtaaacccctcttcctagattccaccgccaagggcatgaaaagcctcctaaacagcacaagcctcgaaaccagcctatccatcgaagctccctggggagcaatcaatgtccaatctacctttaaacctacagtcagcgccgcaaacatcgcccttagctggtcaagcgtcgaacatcgaggtaacaaaatcctagtctcaggacgtagtgagtccataatgaagctggaagaacggaccggagtcagctggaacctgggcgtagaagacgcctccgagagcaagacgctcaccgtttcagtaatggacctctcccaaatgtactcgcctgtctttgaatacctaagcggagaccgacaagtagaagaatggcccaaggcaacatgtacaggagactgccccgaacgatgtggctgcaccagctcgacctgtctgcacaaggaatggccacattcaagaaattggcgatgcaatccgacctggtgctggggcgtcggcactggctgtacctgctgcggtctggatgtaaaagactttttcaccgattacatgttggtgaaatggaaagtcgagtacataaagaccgaagccattgtctgtgtggaactaacctcacaggaacgacaatgcagcttgatcgaagcgggcacacgatttaaccttggtcccgtcaccatcaccctctccgagccccgaaacgtgcaacaaagactgccacccgaaatagtcactctccaccccaaaatcgaagaaggcttctttgacctcatgcacgtccagaaaatactctccgcatccaccgtctgtaaactacaatcctgcacccacggagtccctggagacttccaaatataccacgtcgggaatctcctccgaggggataaagtgaacggacacagcatccacaaaatagaaccccacttcaacaccagctggatgagctgggacggatgcgatctcgactacttctgcaacatgggtgactggccatcctgcacatacacaggagtcacacaacacaaccgcgccgcattcataaacatgctcaacatcgagacagactatacaaaaacttttcacttccactccaaacgagtcacagcccacggagacacaccccaattggacctcaaagcccgaccagcatacggtgccggagaggtcaccgtcctcgtcgaagtcgccgaccttgagctccacaccaaaaacctcgaagtctccggcctaaaaatagcctcactcacatgcagcggatgctatgcatgttcttccggcatctcatgcaaggtccgcatccacgtcaacgaacccgacgagttcacagtccacgtccgatcaagcgacccggacgtagtagcagccggctcctcgcttatggcacgaaaaatagagttcggcgcggactcaacctttaaagcattttcgagcatgcccaaagactcactgtgcttctacatcgtagaaaaggattactgctcgtcttgcacagacgacgacacccaaaaatgcgtgaacaccaagctcgaccacccccaatccatcctcatcgaacacaaagggacaatcataggaaaacaaaacgatacctgctccaccaaaacttcgtgctggctggaaagcgtaaaaggcttcttctacgggctgaaaaacatgctatccggcatatttggcaacgtattcctcgggatcttcctattcctagcacccttcgtcctactcatcttctttttcttcttcggctggcgactactattctgcctcaaatgctgcagacgaacaagagggttactgaaatacaaacacctaaaagacgaagaagaagcggggtacaagaaaatcatcgagcgcctgaacggcaagaaaggcaaatcccaactcttcgacggagaaagactggcagaccgcaaaatagccgagctgttctcaaccaaaatccacattgga

SEQ ID NO: 15490 - RNA, 2916 nt, synthetic construct
  misc_feature 1..2916: note = derived and/or modified CDS sequence (opt11) from CCHFV(8402, Artificial)__AB069674.1__Gn-4aa-Gc
  source 1..2916: mol_type = other RNA
agcgaagaatcaggagacgactgtatttcacgcacgcaactcctcagaactgaaacagccgaaattcacaacgacaattacggagggccaggcgacaagatcacaatctgcaacggttccacggtcgtcgaccaacgtctcggctctgaactaggttgctacacaataaatcgtgtaaaatccttcaaactctgcgagaactcagccaccgggaaatcctgcgaaatcgactcaacgccagttaaatgccgccaaggcttctgcttaaaaataacccaggagggccgaggacacgtcaaactgagtagaggcagcgaagtcgtactcgacgcatgcgactcatcgtgcgaaatcatgatcccgaaaggtacgggagacattctcgtggactgctccggaggacagcaacacttcctaaaggacaatcttatagacctcggatgccccaacatcccccttctcggaaaaatggccatatacatctgtcgcatgtccaaccaccccaaaacaacgatggcgttccttttctggttttcattcggatacgtcgtcacatgcatactttgcaaagtaatcttctacctccttatcgtcgtaggaactctcggaaagaagttcaaacagtaccgagagctgaagccacaaacctgcaccatctgcgaaactacgcccgtcaacgctatcgacgcagagatgcacgacctcaactgcagttacaacatctgcccctactgcgcatcacgcctcacctccgatggactcgcccgtcacgtaatgcaatgcccaaaacggaaagaaaagatagaagaaacagaactctacctcaacctcgaacggatcccgtgggtcgtcagaaaactactccaggtatctgagtccacaggcgtcgccctcaaacgatcctcatggctcgttgtcctactcgtactactgaccgtctccttgagccccgtccaatccgcacccatcggtcgcaaacccctcttttccgacagcatcgtaaaaggcatgaaaaaccttttgaactcaaccagtcttgagacatccctatccatcgaggcaccctggggagcaatcaacgtccaatcaaccttcaaacccaccgtctccgctgccaacatcgcactcagctggtcctccgttgaacaccgggggaacaaaatactcgtctccggacgatccgaaagcatcatgaagctggaagaacgtacaggcatttcctgggacctaggcgtcgaggacgcctcggaatcaaaactactaacagtgtccgtaatggacctcagccaaatgtactcaccagtattcgagtacctctccggcgaccggcaagtcgaggaatggcccaaggcaacctgcactggggactgccccgagcgctgcgggtgcacatcctccacatgtcttcacaaggaatggccccactcccgtaactggcggtgcaacccaacctggtgctggggcgtcggcacaggctgtacctgctgcggactcgatgtcaaagatctttttaccgactacatgttcataaaatggaaggtcgagtacataaagaccgaagccatcgtatgcgtcgaacttacatcccaagaacgccaatgcaccctcatcgaggcaggaacacgcttcaacctaggccccgtaaccataacgctatcagaaccgcgcaacatccaacaaaagctaccgccagaaatcgtcaccctacacccccgaattgaagaaggcttcttcgacctcatgcacgtccaaaaagtactatccgcctctactgtctgcaaattacaatcctgcacacacggtgtccccggcgatctccaggtataccacataggaaacctactcaaaggggacaaggtcaacggacacctaatacacaaaatcgaaccccatttcaacacctcttggatgtcatgggacggctgcgacctcgactactactgcaacatgggtgactggccatcatgcacctacacgggcgtaacccaacacaaccacgccgcgttcgtcaatatgttaaatatcgaaacagactacactaaaaacttccacttccacagtaaacgggtcaccgcccacggggatactccccaacttgacctcaaagcgagaccgacctacggcgccggcgaaataacagtcctggtagaggtagccgacatggaactacacacaaagaaaatcgagatctccggcctcaaatttgcctccctgacctgcaccggctgctacgcctgctcgtccggcatctcctgcaaagtcaggatccacgtcgacgaacccgacgagctgacagttcacgtgaaatccgaagatcccgatatcgttgccgcctcatcctccctaatggctcggaaactcgagttcggaaccgattcaacctttaaggccttctcggccatgcctaagacatcgctctgcttctacatcgtagaacgggaatactgcaaaagctgctccaaggaagacacacaaaaatgcgtgaacaccaagctcgaacaaccccaatcaatcctaatagaacacaaaggcacaataataggcaagcaatccaatacctgcactgccaaagcgtcctgctggctcgaatcagtgaaatccttcttctacggactcaaaaacatgctaagcggcattttcggaaacgtcttcatcggcgtattcctcttctttgcacccttcatcctccttattctattctttatgttcggctggagaatcctcttctgcttcaaatgctgtagacgcacccgaggactctttaaataccgccaccttaaagacgacgaagaaaccggataccgaaagatcatcgagcgcctcaacaacaagaaaggcaaaaacaagctcctcgacggagaacgcctggcagaccgcaaaattgccgaactcttctccaccaaaacccacattggt

SEQ ID NO: 15491 - RNA, 2916 nt, synthetic construct
  misc_feature 1..2916: note = derived and/or modified CDS sequence (opt11) from CCHFV(88166, Artificial)__AB069675.1__Gn-4aa-Gc
  source 1..2916: mol_type = other RNA
tccgaggaaagcggcgacgactgcattagccgaacccaactgctacgaaccgagacagcagaaatacactccgacaactacggcggcccaggagacaagatcacaatctgcaacggatccaccgttgtcgaccagcgccttggctcagaactaggctgttacacaataaacagagtaaagagctttaagctctgcgaaaacagcgccacagggaagtcctgcgagattgactccacacccgtcaaatgccgacagggattctgcctcaaaataacccaagagggccgaggccacgtaaagctaagccggggcagtgaagtagtgctcgacgcgtgtgactcctcgtgcgaaataatgatccctaaaggcacgggtgacatactcgtcgactgcagcggcggccagcaacactttctcaaagacaacctcatcgacctcggctgcccaaacatcccgctcctcggaaaaatggcgatatacatatgcagaatgtcaaaccaccccaaaaccaccatggggttccttttctggttctcgttcggctacgtagtcacatgcatcctatgcaaagtgatattctatctgctaatcgtcgtaggcacactaggcaaaaagtttaagcaataccgggagctaaagccacaaacctgcaccatctgcgaaaccactccagtgaacgctatagacgccgaaatgcatgacctcaactgcagctacaacatctgcccctactgtgcatcccgccttacctcagacggcctcgcccgccacgtcatgcagtgccccaaaagaaaagagaaaatcgaagaaacagaactatacctcaacctcgaacggatcccttgggtcgtccggaaactcctacaagtatcagaatcgaccggagtcgccttaaaacgctcgagctggctcgtcgtcctactcgtgctactaacagtatccctgtccccagttcaatccgccccaatcggacggaaacccctcttctccgactccatcgtcaaaggaatgaaaaatcttctcaactccacctcccttgaaaccagcctctccatcgaagctccttggggagcgattaacgtccagtccaccttcaaacctaccatgtccgctgcaaatattgccctctcatggagttctgttgaacaccgcggcaacaaaatcctcgtgtcaggacgctccgaatccatcatgaaactcgaagaacgcacaggtatctcatggaacttaggcgtggaggacgcctccgaaagcaaactcctaaccgtatcagtgatggacctatcgcaaatgtactcacctgtctttgagtacctttcaggcgacagacaagtagaggaatggcccaaagcgacttgcacaggagattgccccgaacgctgcggctgtacctcttccacttgcctgcacaaggaatggccacactcacggaactggcgatgcaatccaacgtggtgctggggcgtgggcacaggctgtacctgctgcggcttagatgtcaaagacctattcaccgactacatgttcatcaaatggaaggtcgaatacatcaaaacggaagcaatcgtatgtgtggaactcacttcgcaagaacgccaatgcacgcttatagaagcgggcacccgattcaatctcggcccggtcacaatcaccctctctgagccccgcaatatccaacaaaaactacccccagaaatcgtaactcttcacccaagaatagaagaaggattcttcgacctaatgcacgtccaaaaggtactatccgctagcactgtctgcaaactacaatcatgcacacatggcgtccccggcgaccttcaagtctaccacataggcaacctcctaaaaggagacaaagttaacggacacctaattcacaagatagaaccccactttaacacctcatggatgtcctgggacgggtgcgacctagactactactgcaacatgggagactggccctcttgcacatacacaggcgtgacacaacacaaccacgcagcattcgtcaacatgctaaacatagagaccgactacaccaaaaacttccacttccattccaaacgagtcaccgcacacggagataccccacaactcgacctaaaagcacgacccacctacggcgccggtgagatcaccgtactggtggaagtagccgacatggagctacacacgaagaaaatcgagatatccggactaaaattcgcctcactaacctgcacgggctgctacgcttgctcaagcgggatatcctgcaaagtccgcatacacgtcgacgaacctgacgagctcactgtacacgtcaaatccgaagaccctgacctcgtcgccgcctcctccagcctgatggcacgcaaattggaatttggcaccgacagcaccttcaaagccttttcggccatgcctaaaacatccctctgcttctacatcgtggaacgcgaatactgcaaatcatgtagcaaagaggacacacagaaatgtgttaacaccaaactagaacagccccaatcaatccttatcgaacacaagggaaccatcatcggcaaacaaaacaatacctgcaccgccaaggcctcctgctggcttgaaagcgtaaaatctttcttctacggtctcaaaaacatgctcagcggaattttcggcaacgtattcatcggagtcttcttattcttcgccccttttattctcctcatcctattcttcatgttcggttggcgcatactcttctgctttaaatgctgccgcagaacgagaggcctcttcaaatatcgccacctcaaagacgacgaagagacaggatatcgtaaaatcatcgaacgccttaacaacaagaaaggcaaaaacaaactcctggacggcgagcgactagccgacaggaaaatagcagaactattcagcacaaaaactcacatcggt

SEQ ID NO: 15492 - RNA, 2916 nt, synthetic construct
  misc_feature 1..2916: note = derived and/or modified CDS sequence (opt11) from CCHFV(BA88166, Artificial)__AF338470.1__Gn-4aa-Gc
  source 1..2916: mol_type = other RNA
tccgaggagtccggagacgactgcataagccgcacacaactcttacgtaccgaaaccgccgaaattcattccgacaactacggcggccccggagacaagatcaccatctgcaacggatccacagtcgtcgaccaacggctaggctccgaactgggatgctacaccataaaccgagtcaaatcattcaaactctgcgaaaactcagcgacggggaagtcctgcgagatcgacagcacaccggtaaaatgccggcagggcttttgcctcaaaataacacaggagggacgcggccacgttaaactcagcaggggctcagaagtcgtactagacgcctgcgacagcagctgcgaaatcatgatacccaaaggaaccggggacatactcgttgactgcagcggcggacaacaacacttcctaaaagacaatttgatcgacctaggctgcccaaacatcccgctactcggaaaaatggcaatatacatatgccgcatgtcaaaccacccaaagacgacaatgggcttcctcttttggttctccttcggctacgtcgtcacctgtatactctgcaaagggatcttctacctgctcatcgtagtcggaacactcggtaaaaagttcaaacagtaccgcgaactcaaaccacagacatgcaccatctgcgaaactaccccagtcaacgcaatcgacgccgagatgcatgacctaaactgctcctacaatatctgcccctattgcgcctcacgattgacaagtgacggccttgcacgacacgtcatgcaatgcccaaagcgaaaagagaaaatcgaagaaacagaattgtacctaaacctcgaacgcataccatgggtcgtccgtaaactacttcaggtctccgaaagcacaggagtcgcgctaaaacgatccagctggctagtcgtactcctagtactcctcaccgtaagcctgagcccagtccagagtgccccgatcggccgtaagccactatacctggactccatcgttaaaggcatgaaaaaccttttaaactccacatcactcgaaacatccctctctatcgaagcaccctggggcgccattaacgtgcaatcaaccttcaaaccgaccatgtccgccgcaaacatcgcactctcctggtcaagcgtagaacaccgcggcaacaaaatcttagtatctggcagatccgaatcaatcatgaaactggaagaacgaaccggcataagttggaacctcggagttgaggacgcaagcgagagcaaactccttacagtctccgtcatggacctatctcagatgtattccccggttttcgagtacctctccggcgatcggcaagtcgaagaatggccaaaagccacctgtacgggcgactgcccagagcgatgcgggtgcacctcctcgacctgcctccacaaagaatggccccatagccgcaactggcgatgcaaccccacatggtgctggggcgtcggcactggatgcacatgctgtggcctcgacgtcaaagatctcttcacggactacatgttcatcaaatggaaagtcgaatacataaagacagaagcaatagtatgcgtagagctaacctcacaagagagacagtgcactctcatcgaggccggcacccgtttcaacttaggccccgtaatcatcaccctttccgaaccgcgcaacattcaacaaaagctcccgcctgaaatcgtcaccctccaccccagaatagaggaaggcttcttcgacctcatgcacgttcaaaaagtactctcagcatccaccgtctgcaagctccaaagttgcacacatggcgtgcccggagacctccaagtgtaccacataggcaacctactaaaaggagacaaagtaaacggccacctaatccacaagatcgaaccccacttcaacacttcttggatgagctgggacggatgcgacctcgactactactgcaacatgggcgactggccctcgtgtacatacacgggcgtcacacaacacaatcacgccgcttttgtaaacatgctgaacatcgaaaccgactacaccaagaacttccacttccactccaaaagagttaccgcccacggagacactccccaactcgacctcaaagcacgcccgacctacggagcgggcgaaatcaccgtgctcgtcgaagtcgcagacatggaattgcacacgaagaaaatcgagatcagcggcctcaaattcgcatcactaacctgcacaggctgttacgcatgctccagcggaatcagctgcaaagtcagaatccacgtcgatgagcccgacgaactcacggtacacgtcaaatcagaagaccccgacatagtagccgcatcgtcctctttaatggctcgaaaactagagttcggaacagactccacctttaaagccttctcagcaatgccgaaaaccagcctctgcttttacatcgtcgaacgagaatactgcaaatcctgctccaaggaagatacgcaaaaatgcgtcaacactaaactcgaacagccccagagcatcttaatcgaacacaaaggcacaataattggcaaacaaaacaatacctgcaccgctaaggcctcctgctggctcgagagcgtgaaatccttcttctacggactcaaaaatatgctttccggcatcttcggcaacgtcttcatcggagttttcctgttctttgctcccttcatacttctcatactattcttcatgtttggctggcgcatcctcttctgcttcaaatgttgccggcgcacgcgcggcctcttcaaatacagacacctaaaggacgacgaagaaacaggctaccgaaagataattgaacgccttaacaacaaaaagggcaaaaataaactactagacggagaacgactggccgatcgcaagatcgcagaactcttctcaactaaaacccatatcggc

SEQ ID NO: 15493 - RNA, 2916 nt, synthetic construct
  misc_feature 1..2916: note = derived and/or modified CDS sequence (opt11) from CCHFV(BA66019, Artificial)__AF350448.1__Gn-4aa-Gc
  source 1..2916: mol_type = other RNA
agcgaggagtccggcgatgactgcatcagccgaacccagctgctccggaccgagacggccgaggtgcacggggacaactacggcgggcccggagacaagatcaccatctgcaacgggtccaccatcgtcgaccagaggctgggctccgagctgggctgctacaccatcaaccgggtgaagtccttcaaactctgcgagaacagcgggacgggcaagtcctgtaaaatcgataaacacccggtaaagtgccgccaggggttctgtctgaagatcacccaggagggccgggggcacgtcaagctgagccgcggctcggaggtggtgctcgacgcctgcgacagctcctgcgaaatcatgatacccaagggcacaggggacatcctggtcgactgcagcggcgggcagcagcacttcctgaaggataacctcgtggacctgggctgccccaacatccccctgctcggcaagatggcgatatacatctgccggatgtccaaccacccgaagaccacgatggccttcctgttctggttcagcttcgggtacgtcatcacgtgcatcttctgcaagatcatcttctacctgctcatcgtcgtgggtaccctggggaagaagttcaagcaataccgcgagctgaagccccagacctgcaccatctgcgagaccacccccaccaacgccatcgacgccgaaatgcacgacctcaagtgctcctacaacatctgcccctactgcgcaagccggcttacgtccgacggcctggcgcgccacgtcacccagtgcccgaagcggaaggagaaggtggaggagaccgagctctacctgaacctggagcgcatcccctggatcgtgcggaagctcctccaggtgagcgagtcgaccggggtcgccttaaagcgaagcagctggctaatcgtgctgctggtgctcctgactgtctccttatcccccgtgcaatccgcccccatcggccggaagcccctcttcagcgactccatcgtgaagggcatgaagaacctgcttaacagcacctccctcgaaaccagcctgtccatcgaggccccctggggcgcgatcaacgtccagagcaccttcaagcccacggtgtccaccgcgaacatcgccctgagctggtccagcgtggagcatcgcgggaacaagatcctcgtctccgggcggagcgagtccatcatgaagctggaggagagaaccggcatcagctgggacctcggggtggaggacgcctccgagagcaagctcctgaccgtcagcgtgatggacctctcccagatgtacagcccggtgttcgagtacctctccggcgaccggcaggtagaggagtggccgaaagccacttgcacgggcgactgccccgaccgctgcgggtgcaccagctccacgtgcctgcacaaggagtggccccacagccggaactggcgctgcaaccccacctggtgctggggcgtggggaccggctgcacttgttgcgggctggacgtgaaggacctcttcaccgactacatgttcgtcaagtggaaggtggagtacataaagaccgaggcgattgtgtgcgtcgagctgaactcccaagagcgccagtgcagcctaatcgaggccggcacccggtttaacctgggcccggtgactatcaccctctccgaaccccgcaacatccagcagaagttgccgcccgagatcatcaccctgcacccgcggatcgaggaagggttcttcgacctcatgcatgtgcagaaggtcctgagcgcctccacggtgtgtaaacttcagagctgcacccacggcgtgcccggggacctccagatctaccacatcggaaacttactgaagggcgaccgcgtcaacgggcacctcatccacaagatcgagccccacttcaacacctcctggatgagctgggacggctgcgacctggactattactgcaacatgggggactggccctcctgcacctacacgggcgtgacccagcacaaccacgccgccttcgtgaacctgctcaacatcgagactgattacaccaagaacttccacttccacagcaagcgggtcacggctcacggggacaccccgcagctggatttaaaggcccgccccacctacggcgctggcgagattaccgtgctcgtggaggtcgccgacatggagctgcacacgaagaagatcgccatctccgggctgaagttcgcgtctctgacctgcaccggctgctacgcttgcagctccgggatcagctgcaaggtgcggatccacgtggacgagcccgacgagctgaccgtccacgtgaagtcggaagaccccgacatcgtggccgccagctccagcctgatggcccgcaagctcgagtttggaacggactccaccttcaaggcgttcagcgccatgcccaagacctccctctgcttctacatcgtcgagcgggagtactgcgagagctgctccaaggaggacacccagaaatgcgtgaacacgaagctggagcagccccagagcatcctcatcgagcacaaggggaccataatcggcaagcagaacgacacatgtaccgccaaggcctcctgctggctggaaagcgtgaagtcattcttctacgggctgaagaacatgctcagcgggatcttcggcaacgtcttcatcggaatcttcctgttcctggcgccctttatcctcctgatcctgttcttcatgttcggctggcgcatccttttctgcttcaagtgttgccggcgcacccgggggctgttcaagtaccgctacctgaaggacgatgaggagtccgggtacagacgcatcatagaaaggctcaataacaaaaagggcaagaacaaattgctggacggtgagcgcctcgccgaccgaagaatcgccgagctgttcagcaccaagacccacatcggt

SEQ ID NO: 15494 - RNA, 2916 nt, synthetic construct
  misc_feature 1..2916: note = derived and/or modified CDS sequence (opt11) from CCHFV(BA8402, Artificial)__AF350449.1__Gn-4aa-Gc
  source 1..2916: mol_type = other RNA
tcagaagaatccggcgatgactgcatcagcagaacccagcttctgcgtacagaaaccgccgaaattcacaacgacaactacggcgggccaggcgataaaatcactatatgcaacggtagcactgttgtggaccaaagactaggatccgaactcggctgctacaccatcaacagagtcaactccttcaacctatgcgaaaacaccgccacaggcaaatcgtgcgaaatcgacagcaccccagtcaaatgcagacaaggtttctgcctgaagataactcaagaaggccgaggccatgtcaaactatcaagaggatccgaagtcgtactggatgcctgcgaaagcagctgcgaaattatgatccccaaagggactggagacatcctcgtagactgtagcggcggacaacagcactttctgaaagacaacctgatcgacctaggatgccccaacatccccttattaggcaaaatggccatatacatctgccgtatgtcaaaccacccaaaaaccaccatggcatttctgttctggttctccttcggctacgtcgtaacctgcatactctgcaaggtaatcttctacctactcatagtcgtgggaacgctaggaaagaaattcaaacaataccgcgaactcaaaccccaaacctgcactatatgcgaaaccacccccgtcaacgcaatagacgcggaaatgcacgacctcaactgcagttacaacatatgcccctactgcgcatcccgccccacgagcgacgggctcgcgagacacgtaatgcaatgccccaaacgaaaagagaaaatagaagaaaccgccctctacctaaacctagaacgcataccatgggtcgtcagaaaactactccaagtctcggaatcaaccggtgtcgccctgaaaagatccagctggcttgtcgtgctcctcgtcctactgaccgtctcgttatcgcccgtacaatccgctccaatcggccgaaaaccccttttctccgactcaatagtgaagggcatgaaaaacctcctcaactcaacaagcctcgaaacctccctatcaatcgaggccccatggggagccatcaacgtacaatccaccttcaaacccaccgtgtccgcggcaaacatcgccctttcatggtcgtcagtcgaacaccgagggaacaaaatcctagtctcaggccgcagcgaatcaataatgaaactagaagaaagaacgggcatatcttgggacctcggcgtcgaggatgcctcagaatccaaactcctcacagtatcagtcatggacctaagccaaatgtactccccggtcttcgagtacctaagcggcgaccgtcaagtagaagagtggcccaaagccacctgtacgggagactgtcccgaaagatgcggctgtacctcctcaacctgtctacacaaagaatggccccactcccgaaactggcgctgcaaccccacatggtgctggggagttggcaccggttgtacctgctgcggactagatgttaaagacctcttcacggactatatgttcattaaatggaaggtcgagtacatcaaaaccgaagcaatagtatgcgtagagctgaccagccaagaacgtcagtgcacactcatcgaagccggcacgcgcttcaacctcggacccgttacaatcacgctctccgaaccccgcaacatccaacaaaaactccctcccgaaatcgtaaccctgcacccccgcatcgaagaaggatttttcgacctcatgcacgtccaaaaagtcttgtccgccagcaccgtctgcaagctgcaatcatgcacacatggcgtccccggagatctccaagtctatcacatcggcaaccttctgaagggagacaaggtcaacggccacctcatccataaaatcgagccccactttaatacatcctggatgtcatgggacgggtgcgacctacactactactgcaacatgggagattggcctagttgcacctatacgggtgtcactcaacacaaccacgccgccttcgtcaacatgctaaacatcgaaaccgactatacgaaaaacttccacttccactccaaacgcgttacagcgcacggcgacacaccccaactcgacctcaaagcccgcccgacgtacggcgccggcgagatcaccgtcctggtcgaagttgccgacatggaactccacaccaaaaagatcgaaatctcaggcctgaaattcgcaagtctaacatgcaccggctgctacgcatgctcaagcggcatctcatgcaaagtccgcatccacgtcgacgaacccgacgaactcaccgtccacgtgaaatcagaagacccggacatcgtagcagcatcgagctcactcatggcccgaaaattagaatttggcaccgactccaccttcaaagccttctccgccatgcccaaaaccagcctttgcttctatatcgtagagagagaatactgcgaatcctgcagcaaggaagacacccagaaatgcgtcaacaccaaactcgaacaaccgcaaagcatcctcattgagcacaaaggcactatcatcggcaaacaatcgaatacctgcacggcaaaagcatcttgctggctcgaaagcgtcaaatccttcttttacggcctcaaaaacatgctatccggtatttttggaaacgtgtttatcggagtattcctattcttcgcccccttcatactcctaatcctcttcttcatgttcggctggcgcatcctcttctgcttcaaatgctgccgacgcacccgaggactcttcaaataccgccacctaaaagacgacgaagaaaccggctaccggaagataatcgagcgcctaaacaacaagaaaggcaaaaataaactgctggacggcgaaagactcgccgaccgcaaaatcgccgaactcttctccacgaagacccacatcggc

SEQ ID NO: 15495 - RNA, 2916 nt, synthetic construct
  misc_feature 1..2916: note = derived and/or modified CDS sequence (opt11) from CCHFV(Matin, Artificial)__AF467769.2__Gn-4aa-Gc
  source 1..2916: mol_type = other RNA
tcagaagaatccggcgatgattgcatatccagaacccaactcctacggacagaaacggcagaaatccactccgactcctatggcggccccggcgataagatcaccatatgcaacgggtcaacagtcgtcgaccaaagactcggcagcgaattaggttgttacacaataaaccgagtaaaatctttcaaactctgcgaaaattctgcaaccggcaagtcttgcgaaatagactccacccccgtaaaatgtcgccaagggttctgtttaaaaataacccaagaaggacgggggcacgtgaagctctcccgcggctcagaagtagtcctcgacgcctgcgatagctcctgcgaaattatgatccctaaaggcacaggcgacatcttagtagactgctcaggcggccagcaacacttcctcaaagataaccttatcgacctagggtgccctaacatcccattgctcggaaaaatggcaatatatatatgccgcatgtccaaccaccccaagaccaccatggtgttcctgttctggttctctttcggctatgtaatcacgtgcatactatgcaaagtaatattctaccttctcatcgtagtaggcaccctaggaaagaaatttaaacaatacagggagctaaaaccacagacgtgcaccatctgcgagaccacaccagtaaacgcaattgacgcagagatgcacgaccttaactgcagctacaacatctgcccatactgcgcctcccgactgacctcagatggactcgcgcgacacgtcatgcaatgcccaaagcgcaaggaaaagatcgaagaaaccgagctttacctaaacctcgaacggataccctgggtcgtccgtaaactactccaagtgtccgaatcaactggagtcgcgctcaaacgaagctcgtggctcgtcgtacttttagtgcttcttaccgtctcgctaagcccggtccagtccgccccaataggacgcaaacccctattcctcgactcgatcataaagggaatgaaaaacctcctcaactccacatctctcgagacctccctctcaattgaagccccctggggagctataaacgtacaatccacattcaaacccacaatgagcgccgccaacatagcgctctcctggtcaagtgtagagcaccgcggcaacaaaatactggtgtccggacggagcgaatcgatcatgaaactcgaagaacgcaccggcatatcatgggaccttggcgtagaagacgcgagcgaatccaaactgcttacggtcagcgtcatggacctttcccaaatgtacagccccgtcttcgaatacttatccggagaccgacaagtggaagaatggcccaaagccacttgcaccggcgactgccctgagcgctgcggctgcacatcctctacctgcctccacaaagaatggccacacagcagaaactggcgctgtaaccccacatggtgctggggagtcggcacaggctgtacatgttgcggactcgacgtcaaagacctattcaccgactacatgttcgtcaaatggaaggtagaatacatcaaaaccgaagtgatcgtctgcgtcgaactaacatctcaagagcgccaatgctctctcattgaagcagggacacggttcaacctaggaccagtgaccataactctatcagaaccccgcaacatccaacagaaactgcctccagaaatcgtgactctccacccaagaatcgaagagggcttcttcgacttaatgcacgtccaaaaagtcctcagtgcatccaccgtttgcaaactccaatcctgcacccacggtgtgcccggcgacctccaagtgtaccacatcggcaacttactaaaaggcgacaaagtcaacggccacctaatccacaaaatcgaaccccacttcaacacttcctggatgtcgtgggacggctgtgatctcgactactactgcaacatgggtgactggccatcgtgctcttacaccggcgtcacccaacataaccacgcagcattcgttaacatgctatccatcgaaacggactacactaaaaacttccacttccactccaaacgcgtcacagcccacggagacacaccacaactggacctcaaagcccgccccacctacggagcaggcgaaattactgtcctcgtcgaagtcgcagacatggaactgcacacgaagaaaatagaaataagcggcctgaaattcgcctcgttaacctgcaccggctgttacgcatgtagcagcggaatctcgtgcaaagtaagaatccacgtcgacgaaccggacgaactaaccgtacacgtcaaaagtgaggatccagacatcgtagcagctagcagcagtctcatggctcgaaaactggagttcggaaccgattcgacgttcaaagccttctccgccatgccaaaaaccagcctatgcttctacatagtagaacgcgaatactgcaaaagttgctcaaaagaggacacccagaagtgcgtgaacacaaagctcgaacagccccaatctatcttaatagaacacaaaggcacgatcatcggcaaacaaaacgacacatgcacggcgaaggcctcatgctggctcgaaagcgtcaaatccttcttctacggccttaaaaacatgctaagcggcatattcggcaacgttttcatcggcatattcctattccttgctccattcgccctactcatcctattcttcatgttcggttggagaatcctcttctgctttaaatgttgccgacgaacaagagggcttttcaaataccgacacctgaaggacgacgaagaaacagggtaccgcaagataatagaacgcctcaacaacaagaaagggaaaaacaaactcctcgacggcgaacgcctcgccgaccggaaaatcgccgaactcttctcgactaaaactcacgtggga

SEQ ID NO: 15496 - RNA, 2916 nt, synthetic construct
  misc_feature 1..2916: note = derived and/or modified CDS sequence (opt11) from CCHFV(Baghdad 12, Artificial)__AJ538197.2__Gn-4aa-Gc
  source 1..2916: mol_type = other RNA
agcgaagaatcaggagatgactgcatttcccgcacaagactcctccgcaccgaaaccgccgaaatacacggagactcctacggcggccccggtgataaaataacaatctgcaacggaagcacaatagtagaccagcgactaggcagcgaaatgggttgctacaccatcaaccgtgtaaaatcattcaaactctgcgaaaactccgccaccggcaaaagttgcaaaatcgactccatccccgtcaaatgccgacagggctactgcctcaaaataacccaagaaggccgtggtcacgtaaaactatcgcgaggaagcgaagtagtcctcgacgcatgtgatagcagctgcgaagtcatgataccaaagggcaccggcgacattctagtcgactgctcaggcggtcagcaacacttcctaaaagacaacctgatagacctaggatgcccaaacatccccttactaggtaaaatggcaatctatatctgccgcatgtccaaccaccccaaaaccactatggcctttctgttttggttcagcttcggctacgtcatcacgtgtatactctgcaaggcaatcttctacctcttaatcatagtaggcacgctcgggaagagattcaaacaatacagagaactcaaaccacaaacctgcacaatatgcgaaacaacacccgtaaacgctatagacgcggaaatgcacgacctcaattgctcatacaacatttgcccctactgcgcctctcgcctcacgtccgacggtctagcacgacacgtcacacaatgccccaaacgcaaggaaaaagtcgaggaaaccgaactatacctcaacctagaacggatcccctgggtcgtaagaaaactcctccaagtctccgaaagcaccggagtagcactcaagcgatcctcctggctaatcgtactcctcgtcctcctagcggtctcctcgtcccccgtccaatccgccccaataggccgaaaaccccttttcctagactcaatagttaaaggaaccaaaaacctacttaactccacaagcctcgaaaccagcctatcaatcgaggcaccctggggtgccatcaacgtccaatccacatataaaccaacggtcagcacggccaacatcgcactctcgtggagctccgtagaacaccgggggaacaaaatcctagtctcgggccgaagcgaatcaataatgaaactcgaggaacggacagggatatcctgggacctaggagttgaagacgcatctgaatccaaactcctaacggtgtcagtgatggacctcagccaaatgtactctcccgtcttcgaatacctatcgggagatcgacaagtcgaagaatggcctaaagccacttgcactggcgattgccccgagcgctgcggatgcacaacctccacatgccttcacaaagaatggccccactctcgcaactggcgctgtaaccccacctggtgctggggagtcggcaccggctgtacttgctgcggattagacgtcaaagacctcttcacggactacatgttcgtcaaatggaaagtagaatacataaagacggacgccatagtctgtgtcgaacttacctcgcaagagcgccaatgcagcctcatcgaagcgggaactcgattcaacctcggaagcgtcaccatcacactctccgaaccccgcaacatccaacaaaaactaccccctgagattatcaccctccaccccagaatcgaagagggattcttcgacctaatgcacgtccaaaaagtactctccgcctcaacagtctgcaaattacaaagctgcacacacggggtacccggcgatctccaggtctaccacataggaaacctcctcaaaggcgacaaagtcaacggccacctcatccacaagatagaaccccacttcaacactagctggatgagttgggacggttgcgaccttgactactactgcaacatgggagactggccatcatgcacctacaccggcgtcacacagcacaaccatgcaagttttgttaatctcctcaacatcgaaacggactatacgaaatccttccacttccactccaagcgcgtcaccgcgcacggggacaccccgcaactagacctaaaagtcagacccacctacggagcgggagaaatcaccgtactggtggaggtcgccgacatggaactccacacaaagaagatagaaatttccggcctcaaattcgcctctttaacatgcacaggatgctacgcatgcagcagcggcatatcctgtaaagtccgcatccacgtcgatgaacccgacgagctcaccgtccacgtcaagagcgacgacccggacgtcgtcgcagcctcaagctccttaatggcccgcaaactcgagttcggcacggactcaacattcaaggccttctcagccatgccaaaaacctcactatgtttctacatcgtcgaacgcgaatactgtaaaagttgctccaaagaagacacacaaaagtgcgtcaacaccaaactagaacaaccccaatcaatactaatcgagcacaaaggcaccatcatcggcaaacagaacaatacctgcaccgccaaaacctcatgctggctagaatctgtcaagagctttttctacggcctcaaaaacatgctctcaggaatctttggaaacttcttcatgggcatattcctcttcctcgcacccttcatactcctcatcctcttcttcatgttcggatggcgaatcctattctgcttcaaatgctgccgacgcacacgcggcctattcaaataccgccacctaaaagatgacgaagagaccggctaccgaagaatcattgagcgactgaacaacaagaaaggcaaaaacaaactcctagacggagaacgcctagcagaccgcagaatcgccgaactcttctccaccaaaacccacatcgga

SEQ ID NO: 15497 - RNA, 2916 nt, synthetic construct
  misc_feature 1..2916: note = derived and/or modified CDS sequence (opt11) from CCHFV(VLG/TI29414, Artificial)__AY179961.1__Gn-4aa-Gc
  source 1..2916: mol_type = other RNA
tcagaggaaccaggagacgactgcatctcccgaacccagctcctacgcgccgaacccgcagagatccacgacgacaactacggcggccccggcgacaaaatcacaatctgcaatggatcaaccatcgtcgaccaacggctcggttccgaactcggctgctacaccatcaaccgagtaaaatcattcaaactttgtgaaaactccgcaaccggcaagacgtgcgaaatagactccactcccgtgaaatgccgccagggattctgccttaaaataacccaggaaggacggggccatgtcaaactttcacgaggctccgaagtcgtcctcgacgcctgcgattcatcttgcgaagtaatgataccaaaaggcaccggggacatcctagttgactgttccggcggccaacaacacttccttaaagacaacctcatagacctaggatgcccacatatcccactactagggaaaatggcgatctatatatgccgaatgtccaaccatccgcgcaccaccatggccttcctgttctggttctcgttcggctacgtcatcacatgcatattctgcaaagccctattctactccctaattatcattggaacactcggcaaaaagatcaagcaatatcgagagctcaagccccagacatgtaccatctgcgagaccgctcccgtcaatgccatcgatgcagaaatgcatgacctcaactgctcctacaacatatgcccgtactgcgcttccagactaacatccgacggactcgcccgccacgtcccccaatgccccaagcggaaagaaaaagttgaagaaaccgaactatacctcaacctcgagagaatcccgtggaatgtacgaaaactccttcaggtctcagaaagcaccggagtcgccctaaaacgttccagctggctcattgtcctcctggtcctcctaacagtgtccctgtcgcccgtccaatcagcgccagtggggcgcaaaccactattcctcgactccatagttaaaggcatgaagaacctcctaaactccacaaacctcgaaacctcgctctccatagaagccccgtggggcgcgatcaacgtccaatctacattcaagccaacagtcagcaccgccaacatcgcactatcttggtcaagcgtcgaacacagaggaaacaagatcctcgtgaccggccgcagcgaatccatcatgaagctagaagaacggacaggagttagctgggacctcggcgtcgaagacgcatccgagagcaaactcttaaccgtgagcataatggacctttcgcaaatgtactcccccgtattcgaatacctgagcggcgatcgacaagtagaagaatggccaaaggctacctgcactggtgactgccccgaaagatgcggctgcacaagctcaacctgcttacacaaagaatggccacatagccggaactggcgatgcaatccaacctggtgctgggaagtaggcacaggctgtacctgctgcggttggaatgtcaaagacctcttcaccgaccacatgttcgtaaaatggaaggtcgaatatataaaaaccgaagccatagtttgtgtcgaactcaccagccaagagcgacagtgtagcctgatagaagcaggaacgcgctttaacctgggccctgtaacaatcacactatcggaaccgcgcaatatccaacaaaaactacccccagaaatcattaccctgcaccccaaagttgaagaaggctttttcgatctcatgcacgtacagaaagttctgtccgcctcaaccgtatgcaaactacaatcatgcactcacggaatacccggcgacctacaggtataccacatcggcaacctactcaaaggcgacagagtaaacggacacctaatacataaaatagagccacatttcaacacctcgtggatgagctgggacgggtgcgacctcgactactactgcaacatgggcgactggccctcctgcacatacaccggcatgacccaacacaatcacgcagccttcgttaatctcctgaacatagaaaccgactacacaaaaaccttccacttccattcgaaaagagtcactgctcatggcgacacaccccagctggacctcaaggcccgcccgacctacggcgcgggagagatcacggtactggtagaggttgccgacatggaactccacacgaaaaaggtcgaaatatcaggactcaagtttgcctccctagcctgcaccggctgctacgcatgctcctccggcatctcctgcaaagtacgaatacacgtcgacgaacccgacgaactaacagtccacgtaaaatccaacgaccccgacgtgattgccgcctccacatccctcatggcccgcaaactggagttcggcacagactccacgttcaaagcgttcagcgcaatgcccaaaacatccctctgcttctacatagccgaacgagaatactgcaaatcctgcagcgaagaagacactcagaaatgcgttgacacaaaactggaacaaccccaatcgatcctcatcgaacacaagggaacgatcatcggaaaacaaaatgacacatgtacagcaaaagcctcatgctggctcgagtcagtaaaatcattcttttacggcctcaaaaacatgctcggctccgtcttcggcaatttcttcatcggtatactactcttcctggcccccttcgtcctactcgtcctattcttcatgttcggctggaaaatcttattttgcttcaagtgttgccgacgcacacgcggcctactaaaataccgcctactcaaggacgatgaggaaacaggataccgccgcataatcgagcgactaaacaacaagaaaggaaagaaccgactcctcgacggagaacgactagcagacagaaaaatagccgaactcttctccacaaaaacacacatcgga

SEQ ID NO: 15498 - RNA, 2916 nt, synthetic construct
  misc_feature 1..2916: note = derived and/or modified CDS sequence (opt11) from CCHFV(TADJ/HU8966, Artificial)__AY179962.1__Gn-4aa-Gc
  source 1..2916: mol_type = other RNA
tcagaggagagcggagatgactgcatctcccgaacccaactcctccgcacagaaacagctgagatccacggcgacgactacggaggcccaggagacaaaattaccatttgcaacggctcaactatcgtggaccaacgactcggctctgaacttggatgctacaccatcaatcgagttaaatccttcaaactgtgcgaaaactcggccacgggcaaaaattgcgaaatcgactcagtccccgtcaaatgccggcagggatactgcctaaaaatcacacaagaagggagaggacatgtcaaactatcacgcggctccgaagttgtcctcgacgcatgcgactcgtcttgcgaggtcatgatccccaagggcaccggcgacatatccgtagactgctccggcggccaacagcatttcctaaaggacaacctcatcgacctcggctgcccaaaaatcccactcctaggaaaaatggccatctatatctgccggatgagcaaccaccccaaaaccacaatggcgttccttttctggttctccttcggttatgtaataacaagaatcctctgcaaagccattttctacctactcatcatcgtcggcaccctcggtaaacgtttcaaacaatacagggaactcaaaccccagacttgcacgatctgcgaaactacacccgccaacgcaatagacgccgaaatgcatgacctaaactgctcctacaacatatgcccctattgcgccagccgcttgacgtccgacggactcgcacggcacgtaacccaatgccccaaacgcaaagaacgtgttgaagaaaccgagctatacctcaatctggagcgaatcccctggatagtaagaaaactgctccaagtcagcgaatccaccggagtggcactaaaacgatcgtcctggctcatcgtccttctagtcctattcacagtctcactatcccccgtgcaaagcgcaccgataggacgccgacctctattcctagactccatagtcaaaggcatgaaaaaccctctcaatagcacctcgctagaaacctccctttccatagaggcaccctggggagcgatcaacgttcaaagcacctacaagccaaccgtctccacagcgaacatcgctctctcctggtcatcaatagaacacagaggaaataacatcctcgtctcaggcagatccgaatccataatgaaattagaagaaaggaccggcatcagcggtgacctaggcgtcgaagacgcctccgaatccaaactcctcactgtaagtgtaatggacctctcccagatgtactcgccagtgttcgagtacctatccggcgaccgacaagtagaggaatggcccaaagcaacctgcaccggcgactgccctgaacgatgcggttgcaccagctcaacatgcttacacaaagaatggccccactcaagaaattggcgatgtaacccgacatggtgctggggcgtcggaaccggctgtacctgctgcggactcgatgtaaaggacctcttcatcgactacatgtttgtaaaatggaaagttgactacataaaaaccgaagccattgtctgcgtagaactcacgtctcaagaaagacaatgtagcctcgtcgaagccgggacccgattcaacctaggtccggtcaccataaccctctccgaaccccggaacatacagcaaaaacttcctcccgaaataataacattacacccccgcatcgaagaaggtttcttcgacctcatgcacgtgcaaaaggtcctgtccgcttcaacagtttgcaagctccaatcttgcacccacggggtacccggagatctccaagtatatcacataggcaatttactcaagggcgacaaggaaaacggccacctcatacacaagatcgaaccccacttcaacaccagttggatgagctgggacggctgcgaccttgactactactgcaatatgggcgactggcccagctgtacatacacaggcgtcactcaacataaccacgcttcgttcgtcaatctcctgaacatcgaaaccgactacaccaaatccttccacttccactccaaacgcgtaactgcacacggagacaccccacagcttgaccttaaggcccgccccacctacggtgcaggcgaaatcaccgtcctcgtggaagtcgccgacatggagctccacaccaagaaaatagaaataaccggactgaaattcgcctcactgacatgcaccggatgctacgcctgctcgtccggcatatcttgcaaagtccgcatacacgtcgacgaacccgacgaacttaccgtccacgttaaatccgatgaccccgacgtcgtcgcggcctctagctctctcatggctcggaaactcgagttcggaaccgactccacattcaaagccttcagtgcaatgccaaaaacatccctatgtttctacattgtagagcgtgaataccgaaaatcttgctctaaagaagacacccaaaaatgcgtcaacaccaaactagaacagccacaatctatcctcatcgaacacaaaggcacaatcatcggtaaacaaaacaatacatgcaccgcaaaggcctcctgctggctagaatcagtcaagtcgttcttctacggtctaaagaacatgctctccggaatattcggcaacgtgttcgtaggaatcttcctctttctcgcaccctttatcctcctgatcctattcttcatgttcgggtggaggatactcagctgcttcaaatgctgccgacgaacccgtggtctccttaagcaccgacacctcaaagacgacgaagaaacaggctaccgtcgaatcattgaacgccttaacaacaagaagggcaaaaacaagctgctcgacggtgaaagactcgctgaccggcgaatagcagaactcttctctaccaagacacacatcggc

SEQ ID NO: 15499 - RNA, 2916 nt, synthetic construct
  misc_feature 1..2916: note = derived and/or modified CDS sequence (opt11) from CCHFV(Hodzha, Artificial)__AY223476.1__Gn-4aa-Gc
  source 1..2916: mol_type = other RNA
tcagaagaatctggcgacgactgcatatcccggacccagctcctccgcacggagacagcagaaatacacggcgatgactacggaggcccaggcgacaagataacaatctgcaacggcagcacaatagtcgaccaacggctaggatcagagctaggctgctacacgatcaacagagtcaaaagttttaagctatgtaaaaatagcgccacgggaaaaagctgcgaaatcgacagtacccccgtaaaatgccgccaaggctattgcctcaaaatcacccaagagggccgcgggcacgtcaaactatcgcggggcagtgaagtcgtcctagacgcctgcgacagctcctgcgaagtgatgataccaaaaggaaccggcgacatattagtcgactgctcgggcggccagcaacacttcctaaaagacaacctcatcgatttaggatgcccaagaatccctctgctgggcaaaatggcaatatatatatgccgcatgagcaaccaccccaaaaccacaatggcattcctattctggttcagcttcgggtacgtcataacatgcatcctctgcaaagcaatattctacctacttatcatcgtcggaacccttggcaaaagatttaaacaataccgagagttaaaaccacaaacctgcaccatatgcgaaaccaccccagcgaacgcaatcgatgccgaaatgcacgacctgaactgctcctacaacatatgcccctactgcgcttctcgcctcactagcgacggtctggcccgccacgtaacacaatgccccaagcgaaaagaaaaagtcgaagaaacagaactctacctcaacctcgaaagaatcccctggatcgtccgaaaactcctgcaggtctcagaatcaaccggggtcgcgctcaaacgctcatcatggctcatagtcctacttgtgcttttcgcagtttccctatctcccgttcaaagcgctcccatcggccgccgcccgctgtttctagactcaatcgttaaaggcaccaaaaacctcctaaactccacatcattggaaactagcctatcgatcgaagccccctggggcgcgatcaacgtccagtccacctacaagccaacagtgtcgaccgccaacattgccctcagctggtcgtccgtcgaacaccgcggcaacaagatcctagtatccggccgcagcgaatccatcatgaaactcgaagaacgcacaggaatatcatgggacctcggagtagaggacgcatcggaaagtaaactcctaacagtcagcgtcatggacctatcacaaatgtactcccccgtgttcgaatacctctccggtgaccgccaagtcgaagaatggcccaaagccacttgcaccggagactgccccgaacgctgcggttgcacatcaagtacctgcctccacaaggaatggccccattcccgaaactggaggtgcaacccaacctggtgctggggagtaggcaccggctgcacatgctgcggcctagacgttaaggacctattcacggattacatgtttgtcaaatggaaagtcgattacattaaaaccgaggctatcgtctgcgtcgaacttacctcccaagaacgacagtgctcgctagtagaagcaggcactcgcttcaaccttggtcctgtcacaataactctttcagaaccccggaacatccagcaaaaactcccacccgagatcatcactttacatccccgaatcgaagaaggcttcttcgacctaatgcacgtacaaaaagtgctctctgcctccacggtctgcaaattacaatcatgcacacacggcgtacccggcgacctccaggtataccacatcggaaacctcctgaagggagacaaagtcaacggacacctcatccacaaaatcgaaccccacttcaacacatcctggatgtcctgggacggctgcgaccttgactattactgcaatatgggggattggccctcgtgcacatacaccggtgtaacccaacacaaccacgcatcattcgtcaacctcctaaatatagaaaccgactacaccaaatcattccacttccactccaaacgcgtcaccgctcacggtgatacgccccaactcgacttaaaagcccgaccaacctacggagccggagagatcacagtgctcgtagaggtagccgacatggaactacacaccaaaaagattgagatcacaggtctgaaattcgcctcgctaacctgcaccggatgttacgcttgctcaagcggaatatcatgcaaggtccgcatccacgtggacgagcccgacgaactcacagtacacgtcaagagcgacgaccctgacgttgtggccgcctcctcaagcctcatggcacgcaagctggagttcggcacagactcaaccttcaaagcgttcagcgctatgcccaaaacatcactatgcttctacatcgtagaacgcgaatactgcaaatcctgcagcaaagaagacacccaaaaatgcgtaaacacgaagctagaacaaccccaatcgatcctaatcgaacggaaaggaaccatcataggaaaacaaaacaacacttgcacagccaaagcatcgtgctggctcgaaagcgtcaaatccttcttctacggcctcaaaaacatgctctcaggaatctttgggaacgtcttcgtggggatcttcctcttcctagcaccattcatccttttaattctctttttcatgttcggatggcggatactcttttgcttcaaatgctgtcgccgaaccagagggctattcaaatacaaacacctaaaagacgacgaagaaaccggctaccgccgcatcatcgaacgactaaacaacaagaaaggcaaaaacaaacttctagacggagagcgcctcgccgaccgacgcatagccgaactcttcagcaccaaaacacacataggc

SEQ ID NO: 15500 - RNA, 2916 nt, synthetic construct
  misc_feature 1..2916: note = derived and/or modified CDS sequence (opt11) from CCHFV(Kosovo/9553/2001, Artificial)__AY675511.1__Gn-4aa-Gc
  source 1..2916: mol_type = other RNA
agcgaggaacccggcgacgactgcatctcccgcactcaactcctacggaccgagactgccgaaatccacgacgacaactacgggggcccgggggataagatcaccatttgcaacggcagcaccatcgtggaccagcgcctggggtccgagctgggctgctacactatcaaccgggtcaagagcttcaagttgtgcgagaactccgccacgggcaagacctgcgagatcgacagcacccccgtaaagtgccgccagggattctgcctgaagataacccaggaaggccgcgggcacgtgaagctgtcccgcggctccgaggtcgtgctcgacgcgtgtgactccagctgcgaagtgatgatacccaaggggacgggagacatcctagtcgactgctccggtgggcagcagcatttcctcaaggacaacctcatagatctgggctgcccgcacatccccctgctcggtaaaatggccatctatatagcccgaatgagcaaccacccaaagaccaccatggccttcctgttctggttctcgctgggctacgtgatcacgtgcatcctctgcaaggccctgttctactctctgatcatcatcggcaccctcggtaagaagatcaagcagtaccgcgagctgaaaccccagacctgcaccatctgcgagaccgcgcccgtgaacgccatcgacgccgagatgcacgacctgaactgctcctacaatatctgcccgtactgcgccagccggctcactagcgacggcttggcgcgccacgtcaagcagtgtcctaagcggaaggaaaaggtggaggagaccgaactgtacctcaacctagagcgcataccctgggtcgttcggaagctgctccaggtgagcgagagcaccggggtggccctgaagcgcagcagctggctgattgtcctcctggtgctgctcaccgtgtctttgagccccgtccaatccgccccggtgggccggaagcccctgttcctcgacagcatcgtgaaggggatgaagaacctgctgaactccacgagccttgagacctctcttagcatcgaggccccctggggcgccatcaacgtccagtccaccttcaagcccaccgtgagcacggcgaacatcgccctgtcctggagctcggtggaacaccgcggcaacaagatcctcgtcaccgggcgcagcgagagtatcatgaaactggaggagcgcaccggcgtgagttgggatctaggggtcgaggatgcgtccgagtcaaagctcctgaccgtgtcaatcatggacctgagccagatgtactcaccggttttcgagtacctctccggcgaccgccaggtcgaggagtggcccaaggctacgtgcaccggggactgccccgagagatgcggctgcaccagctctacgtgcctgcacaaggagtggccccatagccggaactggcgctgcaacccgacctggtgttggggcgtggggaccggctgtacctgctgcggtgtggacgtcaaggacctgttcaccgaccacatgttcgtgaagtggaaggtggagtacatcaagactgaggccattgtctgcgtggagctgacctcccaggagcgccagtgcagcctcatcgaagcgggcacccggtttaacctggggcccgtgaccattaccctgtccgaaccccgcaacatccagcagaagctgccgccggagataatcacgctccaccccaagatcgaagagggcttcttcgacctgatgcacgtccagaaggtgctcagcgcgtccacggtgtgtaaattgcagagctgcacacacggcatccccggggacctgcaggtctaccacatcggcaacctcctgaagggggaccgcgtgaacggccatctgatccacaagatcgagccccacttcaacacatcctggatgagctgggacggctgcgacctcgactactactgcaacatgggggattggccatcctgcacgtacaccggtgtgacccagcataaccatgccgccttcgtaaacctgctgaacatcgagaccgactatacgaagaccttccacttccatagcaagcgagtgaccgcccacggggacacgcctcagctcgacctgaaagcgagacccacctacggcgccggggagatcaccgtcctggttgaagtggccgacatggagttacacaccaagaaggtggagatctccggcctgaagttcgccagcctggcctgcaccggttgctatgcttgcagcagcgggataagctgtaaagtacgcatccacgtggacgagccggacgagctcacggtacacgtcaaatctagcgaccccgacgtagtggccgcctccaccagcctgatggcccggaagttagagttcggcactgactccaccttcaaggcgtttagcgccatgcccaagacgtccctctgcttctacatcgtcgagaaggagtactgcaaaagctgctccgaggacgacaccaagaagtgcgtggacaccaagctggagcagccccagagcatcctaatcgagcaccgcgggacaatcatcggcaagccgaacgacacgtgcccggccaagacctcctgctggctagaatcagtgaagtccttcttctacgggctgaagaacatgctgggctccgtattcggcaatttcttcatcggaatcctcctgttcctggctccctttttcctctggatgttgtcgttcatgttcggctggaagattctgttctgcttcaagtgctgtcggcgcacccggggcctctttaagtaccgccacctgaaagacgacgaggagaccgggtaccggcgcatcattgagcgactgaacaacaagaagggaaagaaccgtctcctggacggagagcggctggccgaccgcaagatcgccgagctgtttagcacgaagacccatatcggc

SEQ ID NO: 15501 - RNA, 2916 nt, synthetic construct
  misc_feature 1..2916: note = derived and/or modified CDS sequence (opt11) from CCHFV(SPU41/84, Artificial)__AY900142.1__Gn-4aa-Gc
  source 1..2916: mol_type = other RNA
tccgaagaatcctccgacgactgcatcagccggacacaactcttacgcactgaaactgccgaaatccacggggacaattacgggggcccaggagacaagatcaccatctgcaacggatcaactgtcgtcgaccaacgccttggatcagaactcggctgctataccataaatcgcgttaaaacgttcaagctgtgcgaaaactcagccactggcaaatcctgcgaaatcgacagcgtccctgtcaaatgccgccaaggttactgcctcaagatcacccaagaaggccgaggccatgtcaaactgtcccggggctccgaggttgtcctcgacgcctgcgacacatcctgcgaagtcatgatccctaaaggcacaggggatatcctagtagactgttcagggggccagcaacacttcctgaaagataacctaatcgacctcgggtgcccgaaaatcccacttctcggaaaaatggccatatatatttgtcggatgtccaaccacccaaaaaccacaatggcattcctcttctggttttccttcggctatgtcataacatgcataatctgcaaagtcatcttctacctgctaatcatcgtcggaacactaggcaaacgattcaaacaataccgcgaactgaaaccccaaacctgcaccatctgcgagacaacacccgtgaacgccattgacgccgaaatgcacgacctcaactgcagctacaacatttgcccctactgcgcctcacgcctaacatccgacgggcttgcccgccacgtcacacaatgcccgaaaagaaaagaaaaggtagaagaaacggaactataccttaacctagagaggatcccctgggtagtaagaaaactactccaggtcagcgaaagcacaggcgtcgcccttaaacgctcctcgtggctcgtggtcctcctggtcctactaaccgtatccctaagccccgtccaatcagccccaatttcccgccgccccctcttcctcgacagcatcgtcaaaggcatgaaaaacctccttaattctacctccctcgaaacctccctctcaatagaagcaccctggggagcaataaacgtccaaagcacctataaaccaaccgtgagtaccgccaacatcgcgctctcctggtccagcgtcgagcatcgcggcaacaaaatccttgtctccggacggagcgagtccataatgaaactcgaagaaaggaccggcatctcttgggatctcggcgtggaagacgcaagcgagtccaaactgctgacagtgtccgtaatggacctctcacaaatgtactcacccgtgttcgaatacctaagcggcgaccggcaagtggaagaatggccgaaagcaacctgcaccggggactgcccagagcgatgcggctgcacaagctccacatgcctccacaaagaatggccacactcgcgcaactggcgatgcaacccaacctggtgctggggcgtcgggacaggctgtacctgctgcggactcgacgtaaaagacctgtttaccgactacatgttcgtcaaatggaaagtcgagtatatcaagaccgaagccatagtgtgcgtcgaattgacctcacaagaacgccaatgctcgttaatcgaagccggtacccgattcaacctcggacccgtcactataaccctttcagaaccacgcaacatccaacaaaaactcccacccgaaattatcacactacacccccgcatcgaagagggcttcttcgacctcatgcatgtgcaaaaggtactatcagcgtcaactgtctgcaaattgcaaagctgcacgcacggggtaccaggcgatcttcaagtctaccacatcggcaacctcctcaagggcgacaaggtgaatggccatctagttcacaaaatcgagccacacttcaacacttcctggatgtcctgggacggatgtgatctcgactactactgcaacatgggcgactggccctcgtgcacatatacaggcgtaacccaacacaaccacgccagcttcgtaaatatgctaaacatcgaaactgattatacgaagaacttccacttccactcaaaacgagttacagcgcacggtgataccccacaactcgacctgaaagcacgacccacttatggagcgggagaaatcacggtactcgtggaggtcgccgacatggaactacacaccaagaaaatcgaaatatcgggacttaaattcacctccctaacctgcacgggctgctacgcttgctcgtccgggatctcgtgcaaagtccgtatccacgtcgacgaaccagacgaactaacagtccacgtcaaaagcgaagacccagacgtggttgcagcatccagctccctcatggctcgaaaactcgagttcggcaccgactcgaccttcaaagccttctcagccatgccaaaaacctcgctctgcttctacatcgttgaacgcgaatactgcaaatcctgctcagaggaagacacccagaaatgcgtgaacacaaaactcgagcagccccaatctatcctcatagaacgtaaaggcacaatcatcggaaaacaaaacaacacatgcaaagccaaagctggatgctggctcgaatccgtaaaatcctttttctacgggctaaagaatatgctgtctggaatattcggcaatgtcttcatcggcatattcctcttcttagcccctttcatactcctgatcctattcttcatgtttggctggcgcatcctcttctgcttcaaatgttgtcgccggacccgcgggctgttcaaataccgccacctcaaggacgacgaagaaacaggctacaggaaaataatcgaacgactcaataacaagaaaggcaaaaacaaactactagacggagaacggctagccgacagacggatagcagaactctttagcaccaaaacccacataggg

SEQ ID NO: 15502 - RNA, 2916 nt, synthetic construct
  misc_feature 1..2916: note = derived and/or modified CDS sequence (opt11) from CCHFV(UG3010, Artificial)__AY900143.1__Gn-4aa-Gc
  source 1..2916: mol_type = other RNA
gcagaaggggtaagcaacgactgcgtatccagaacacaactaataaagacagaagtcgccgagatccacgaagacagctacggcggccccggagagaaaatcacaatctgcaacggatccaccatcgtagaccaacgcctaggctccgaactcgggtgctacaccatcaaccgagttaaaacctacaaactgtgcgaaaactccgcaaccgaaaaaggatgtgaaatcgacagtgtaccagtgaaatgcaaacagggtttctgcctaaaagtcacacaggaaggacgcggacacgtaaagctcagccgcggaacggaaatcgtactcgacgtctgcgacaccagctgcgaactcatgatccccaaaggcaccggagatatcctcgttgactgctcaggcggacagcaacacttccttcaggacaacctcattgacctcgggtgcccgaacgtccccctactgggcaaaatggccatctacatatgccgaatgagcaaccacccaaagacaacaatggccttcctcttctggttcagcttcggatacgttatcacgtgcatagtctgcaaagttctattctacctccttattgtcataggcaccctctccaaaaagctgaaacagtacagagaactcaaaccacaaacctgcatagtctgtgaaagcacaccagtcaacgcgatagacgcggaaatgcacgaactcaattgtaactataacatctgtccatattgcgctagccgacttaccagcgacgggctcgtccgtcacgtgaaccagtgcccgaagcgaaaagaaaaggtcgaagaaacagagctatacctaaacctggaacgcatcccctggctagtcaggcgcctactccaagtcagcgagagcaccggaatggcactcaaacgcagctgctggatgactaccctcctcatccttctcgtcgtttcactgtcgccagtacagtccgccccagtgggccgcaaacccctctacctagacagcatagcaaaaggaatgaaaagcctcctaaacagtaccaacctagaaaccagcctctccatcgaagccccatggggagctataaacgtccaaagcaccttcaaaccaacggtgtccgctgccaacatagcattaagctggtcctcagtggagcacagagggaacaaaatcctggtctccggccggtcagagtcgatcatgaaactcgaagaacgaaccggcatatcatggtccctaggagtagaggacgcaagtgagagcaaaaccctaacagtgagcgtaatggacctgtcgcaaatgtactctcccgttttcgagtacttgtccggcgatcgccaggtcgaagagtggcccaaagcaacctgcacaggggactgccaagagcgatgcggctgtacatcctccacatgcctacataaagaatggccccacagccgaaattggcgttgcaaccccacatggtgctggggcgtaggtacaggatgcacgtgctgcggcctagacgtcagagacctcttcaccgactacatgatggtcaaatggaaagtcgaatacgtcaaaactgaagcaataatgtgcgtagaactcacgtcccaagaacgacaatgttctctaatagaagcagggacccgattcaacctaggacccgtaaccataaccctatccgagccccgcaacatccaacaacgactaccaagcgaaatcgtcacgctccaccccaagatagaagaaggattcttcgacctaatgcatgttcagaaggtcctgagcgcctccacagtttgcaaactgcaaagctgcacccacggcgtgcccggcgatctccaggtctaccacgtcggaaacttacttaaaggcgacaaggttaatgggcacagcatccataaaatcgaatcccacttcaacacttcgtggatgtcctgggacggctgcgacctggactacttctgcaacatgggagactggcccagctgcacctacaccggcgttacacaacacaaccgcgccgcgttcataaacatgcttaacatcgaaaccgactacacgaaaacattccactttcactctaaacgagtgacggcccacggagatacgccccaactcgacctaaaagcccgccccacctacggagccggcgaagtaaccgtcctagtcgaagtcgccgacctggaacttcacaccaaaaagatcgaagtctcgggcctcaaattcgcttccctcacgtgctccggctgctacgcctgctcaagcggaatctcatgcaaggtgcgaatccacgtaaacgagcccgacgaatttactgtccacgtcaaatcctcagaccccgacgttgtcgcagcaggcagctccctcatggccagaaaaatcgagttcggtgcagacagcaccttcaaagccttctccagcatgcccaagaactcactctgcttctacatcgtcgaacgagactactgcagcagctgtaccaacgatgacacccaaaaatgcgtcgacacaaagctagaacacccccaaagcatactcattgaacacaaggggaccatcataggcaaacaaaacgatacatgctcaacaaaaacatcctgctggttagagtcggtcaagtcctttttctacggcctgaagaatatgctgggcggaatcttcgggaacgtcttcctcggaatattcctatttctcgcacccttcgcgctcctaatcttcttcttcttcttcggatggagactactcttctgcctcaaatgctgccgacgtaccaggggactactgaaatataaacaactcaaagacgaagaagaagccggctacaagaaaataatagagcgactgaatgacaaaaagggcaaaagccgcctattcgacggcgaacgactggcggacagaaaaatcgcagaattatttagcacaaaaacccacatagga

SEQ ID NO: 15503 - RNA, 2916 nt, synthetic construct
  misc_feature 1..2916: note = derived and/or modified CDS sequence (opt11) from CCHFV(Hy13, Artificial)__AY900145.1__Gn-4aa-Gc
  source 1..2916: mol_type = other RNA
tcggaagaaagtggggacgactgcatcagccggacccaactgtcgcgcacggaaacagcagagatccacagcgacaactacggaggcccaggcgacaagataacgatctgcaacggaagcacgatcgtagaccaacggctagggtccgaacttgggtgctacacaataaaccgcgtgaaatccttcaaactctgcgaaaacagcgccacgggcaaaagttgcgaaatcgactcaaccccaatcaaatgccgacaaggcttttgcctcaaaattacccaagaaggaagaggccatgtcaaactaagtagggggtcggaagtcgtgctagacgcatgcgactcatcctgcgagataatgataccaaaaggcaccggcgacatcctagtcgactgctctggcggacaacagcactttctgaaagataacctaatagacctcggctgtcccaacataccactcctcggaaaaatggccatatatatctgccggatgtccaaccaccccaaaaccacgatggcattcctcttctggttctcctttggctacgtgatcacgtgcattctctgcaaggtgatcttctacctactgatagtagtcggaactctcggaaagaaattcaaacaataccgcgaactcaagccccagacatgcaccatctgcgaaaccacgccggttaacgcgatcgacgccgaaatgcacgacttaaactgctcctacaacatctgcccgtactgtgcctcacgcctgacgtcggacggcctagcgcgacacgtcatgcaatgcccaaaacgcaaagaaaaagtcgaagaaacagaactctacctgaacctggaacggatcccatgggtagtacgaaaactcctccaagtctcggaaagcactggcgttgctctcaaacgctcatcctggctcgtcgtcctactcgtactactgacagtcagcctgagcccggtccaatcagcccccataggccgaaaacccctattctccgactccatcgtaaagggcatgaagaacctcctcaacagtacatccctcgagacatcgctatccatagaagctccctggggagctataaacgttcaaagcaccttcaaacctacagtaagcgcggccaatatagcgctctcatggtcatcagtcgagcaccgaggtaacaaaatcttagtgtccggaagatccgagagcattatgaaattagaggagcgaaccgggatctcctgggacctcggcgtagaggacgcatcggaatctaaactactcacagtctcaatcatggatctctctcaaatgtatagcccggtattcgaatacctctcgggcgatcggcaagttgaagaatggccgaaagcaacctgcactggagactgccccgagaggtgcggctgcacgtccagcacgtgcctccacaaagaatggccccactcgcggaattggagatgcaacccgacctggtgctggggagtcggcaccggctgcacctgttgcggcctcgacgttaaggacctgttcacggaccacatgtttgtcaaatggaaagtcgaatatataaaaaccgaagccatcgtctgcgtagaactcacctcgcaggaacgccaatgctcgctcatcgaagccggcacaagattcaacctgggcccagtaactatcactctctcagaaccgcgaaacatccaacaaaagctgcccccagagatcgtcacactacatccaagaatcgaagagggtttcttcgacctcatgcatgtcaaaaaggtcctaagcgccagcaccgtctgcaaactccaatcatgcacccacggagtccccggcgacctacaagtctatcacataggcaacctactaaaaggggacaaagtcaacggacacctaatccacaagatcgaaccacacttcaacacatcctggatgagctgggacgggtgcgacctcgactactactgcaacatgggagactggccctcctgctcgtacacgggagtaacccagcacaaccacgcagcattcgtaaacatgctcaacatagaaaccgactataccaaaatattccacttccactcaaaacgcgtcacagcccatggcgacacaccccaactcgacctcaaagcgcgccctacgtacggcgcgggagagatcacagtcctcgtcgaggtagccgacatggagttacacacaaagaaaatagaaatcagtggcctaaaattcgcgtccctaacctgcacgggatgctacgcatgctcgtcaggtatatcctgcaaagtacggattcacgttgacgaaccagacgaactcaccgttcacgtcaaaagcgaggacccagacatcgtcgccgcatcatcatctctcatggcaaggaagttagagttcggaactgacagcaccttcaaagccttcagtgccatgcctaaaacctcgctctgcttttacatcgtagaaagagaatactgcaaaagctgcagcaaggaagacacacaaaaatgcgtaaacaccaagctcgaacaaccacaatctattttaatcgaacacaaaggaacaataataggaaagcaaaacgatacctgcacatcaaaagccggatgctggctggaaagcgtcaagtccttcttctacgggctcaaaaacatgctctcaggaatcttcggaaacgtctttattggcatattcctattcctcgctccatttatactactaatactcttcttcatgttcggctggaggattctcttctgcttcaaatgctgccgaagaacacgcggactcttcaaataccgccacctgaaggacgacgaagaaaccgggtacagaaaaatcatcgaacgcctcaacaacaaaaaggggaaaaacaagctcctagacggcgagcgcctagccgaccgaaaaatagccgagctgttcagcacaaaaactcacataggc

SEQ ID NO: 15504 - RNA, 2916 nt, synthetic construct
  misc_feature 1..2916: note = derived and/or modified CDS sequence (opt11) from CCHFV(Semunya, Artificial)__DQ094832.1__Gn-4aa-Gc
  source 1..2916: mol_type = other RNA
gccgagggcgtgagcaacgactgcgtctccagaacccagctgatcaagaccgaggtggccgagatccacgaggacagctacgggggccccggggagaagatcacgatctgcaacggctccaccatcgtggaccagcggctcgggagcgagctgggctgctacaccatcaaccgcgtcaagacctacaagctgtgcgagaactccgcgacggagaagggctgcgagatcgacagcgtgccggtgaagtgcaagcaggggttctgcctcaaggtcacccaggagggccgggggcacgtgaagctgtcccgcggcaccgagatcgtcctggacgtctgcgacaccagctgcgagttgatgatccccaaggggaccggcgacatcctggtggactgctccggcgggcagcagcacttcctgcaggacaacctcatcgacctgggctgcccgaacgtgcccctgctcggcaagatggccatctacatctgccggatgagtaaccacccgaagaccaccatggccttcctgttctggttctccttcggctacgtcatcacgtgcgtggtgtgcaaggtcctgttctacctcctgatagtgatcggcaccctggggaagaagctcaagcagtatcgcgagctgaagccgcagacctgcatcgtgtgcgagagcatccccgtcaacgccatcgacgccgagatgcacgaactgaactgcaactacaacatctgcccctattgcgcgtcccggctcaccagcgacggcctggtgcgccacgtgacccagtgcccgaagcggaaggagaaggtcgaagagacggagctgtacctcaacctggagcgcatcccctggctggtgcggcgcctcctccaggtgtccgagagcaccgggatggctctgaagcggtcctgctggatgaccaccctcctgatactgctcgtcgtgagcctgtcccccgtccagagcgcccccgtgggccgcaagccgctgttcctcgacagcatcgccaaagggaagaagtccctgctgaacagcacgaacctcgagacctctctgagtatcgaggcgccctggggcgccatcaacgtgcagtccaccttcaagcccaccgtcagcgccgccaacatcgccctctcctggagcagcgtagagcaccggggcaacaagatcctcgtgagcgggcgctccgagagcatcatgaagctggaggagcggacgggcatctcctggagcctgggggtcgaggacgcgtccgagagcaaaacccttaccgtgtccgtgatggacttgagccagatgtactcccccgtcttcgagtacctgtcgggcgaccgccaggtggaggagtggccgaaggcgacctgcacgggagactgccccgagcggtgcggctgcaccagcagcacgtgcctccacaaggagtggccccactcccgcaactggcggtgcaaccccacctggtgctggggcgtggggaccggctgcacgtgctgcgggctggacgtccgcgacctgttcaccgactacatgatggtgaagtggaaggtggagtacgtcaagaccgaggccatcatgtgtgtggagctgacctcccaggagcgccagtgcagcctcatcgaggccggtacccgtttcaacctggggccggtgaccatcaccctgtccgagccccgcaatgtccagcagcggctccccagcgagatcgtgaccctgcaccccaagatcgaggagggcttcttcgacctgatgcacgtgcagaaggtcctcttctgcaagtactccctccaggccacgagctgcacccacggcgtgccgggggacctccaggtgtaccacgtcggcaacctgctgaagggggacaaggtgaacggccactccatccacaagatcgagagccacttcaacacctcctggatgagctgggacggctgcgacctggactacttctgcaatatgggtgactggccctcctgcacctacacgggcgtgacccaacacaaccgcgccgccttcgtcaacatgctcaacatcgagaccgactacaccaagacgttccacttccacagcaagcgggtgaccgcccacggggacacgccccagctggacctgaaggcccgccccacctacggcgccggggaggtaacggtcctcgtggaggtggcggacctggaactgcacaccaagaagatcgaggtctccggcctcaagttcgccagcctgacctgctccggctgctatgcctgcagcagcgggatctcctgcaaggtgcggatccacgtgaacgagccggacgagttcaccgtgcacgtcaagagcaacgaccccgacgtggtggccgccggctccagcctgatggcgcgcaagatcgagttcggggccgactccacgttcaaagccttcagctccatgccaaagaacagcctctgcttctacatcgtggaacgggactactgctccagctgcaccgacgacgacacccagaagtgcgtgaacatcaagctggagcacccgcagtccatcctgatcgagcacaagggcaccatcatcgggaagcagaacgacacgtgccccacaaagaccagctgctggttagagtccgtcaagagcttcttctacggcctgaagaacatgctgggcgggatcttcggcaacgtgttcctcgggatcttcctgttcctggcccccttcgcactcctgatcctgttcttcttcttcggctggcgcttactgttctgcctgaaatgttgccggcgcacccgggggctcctgaagtacaagcagctgaaggacgaggaggaggccggctacaagaagatcatcgagcgcctcaacgacaagaagggcaagtcccggctgttcgacggggagcgcctggcagaccggaagatcgccaagctgttcagcacgaagacccacatcggc

SEQ ID NO: 15505 - RNA, 2916 nt, synthetic construct
  misc_feature 1..2916: note = derived and/or modified CDS sequence (opt11) from CCHFV(SPU128/81/7, Artificial)__DQ157174.1__Gn-4aa-Gc
  source 1..2916: mol_type = other RNA
tcagaggaaccatcggacgactgcatctcccgcacacaactcctccgcactgaaaccgccgaaatacatggcgataactacggcggcccaggagacaaaatcacgatctgcaacggatctaccattgttgatcaacgcctcggctccgaactcggctgttacaccatcaaccgcgtcaaatccttcaaactctgcgagaactcagccactggaaaatcgtgcgaaatagaaagcgtgccagtcaaatgcagacaaggctactgcctgcgcatcacacaagaaggacgcgggcacgtaaaacttagccgggggagcgaagtcgtcctcgacgcatgcgacacttcctgtgagatcatgatacctaaaggaactggcgacatcctcgtggactgctcaggcggccaacaacacttcctaaaagacaacctcattgatctaggatgtcccaaaataccactactaggtaaaatggcaatatatatatgccggatgtccaaccaccctaaaaccaccatggccttcctcttctggttcagcttcggctacgtgatcacgtgcatcctctgcaaagcaatattctacctgctaataatcataggcacactaggcaaaaggtttaagcagtatcgcgagttaaaaccgcaaacctgcaccatatgcgaaacaacgcccgtaaacgcgatcgacgccgaaatgcacgaccttaactgcagctacaacatctgcccatattgcgccagccgcctcacatcagacggcctggcgcgacacgtcacgcaatgccccaaaagaaaagaaaaggtagaagaaaccgaactgtacttaaaccttgaacgaataccgtgggtcgtgagaaaactcctccaagtatcagagagtaccggcgtcgccctaaagagatcatcatggctcatagttctccttgtgttattcaccgtcagcctctccccagtacagagcgcaccgataggaaggaaaccgctctttctcgacagcatagtcaaaggcatgaaaaacctccttaactccacttcccttgagacctccctaagcatagaagcgccctggggcgccatcaacgtgcaatcaacatacaaacccacagtctcgacagccaacatcgcactctcgtggtcaagcgtcgagcaccgaggcaacaaaatactcgtcagcggacgatccgaatcaataatgaagctagaagaaagaaccggcatctcgtgggatctcggcgtcgaggatgcctccgaatccaaactgctaaccgtaagcgtgatggacctatcacaaatgtactcccccgtattcgaatacctctccggagatcgccaagtcgaagagtggcctaaggcaacgtgcactggagactgccccgaacgctgtggctgcacgagctcaacatgccttcacaaagaatggccccacagccgaaactggcgctgcaatccaacctggtgctggggcgtgggcacaggctgtacctgctgcggcctcgacgtaaaggatctgttcaccgactacatgttcgtaaaatggaaggtagagtacataaagacagaagccatcgtctgcgtggaactgacaagtcaagagcgtcaatgctcccttattgaggcaggcacacgcttcaacctcggacccgtcacaataacactctccgaacctcgaaacatacaacaaaagctcccacccgagatcatcaccctgcacccgagaatagaagagggcttcttcgacctaatgcacgtccaaaaggtactatccgccagcaccgtatgcaaacttcaatcatgcacccacggcgtccccggagacctgcaggtctaccacataggcaaccttctcaaaggagacaaagtaaatggacatctaatacacaaaatagaaccacacttcaatacgtcgtggatgagctgggacgggtgcgaccttgactactactgcaacatgggcgactggccatcctgcacgtacaccggcgtcacacagcacaaccacgcctcctttgtcaaccttctcaacatagagacagattacaccaaaaacttccattttcactccaaacgcgtcaccgcccacggagacacaccacaactagacctaaaagcacgacccacctacggcgcaggagaaatcaccgtactcgtagaagtggcagacatggaactccacacgaagaaaatcgagatctcaggactcaaatttgcctcactaacctgcacaggatgctacgcatgcagctcaggaatatcatgcaaagtgaggatacacgtcgacgaaccggacgagcttacagtccacgtcaagagcgacgatccagacgtcgtagcagcatcctcctccctaatggccagaaaactcgagttcggaactgacagcaccttcaaggcattcagcgctatgccaaaaacctccctctgcttctatatcgtcgaacgtgaacactgcaaatcttgcagcgaagaagacaccaagaaatgcgtcaataccaaactcgaacaaccacaatccatactcatcgagcacaagggcacaataataggcaagcaaaacagcacatgcacagcaaaagcatcctgttggctagagtccgtaaaatcattcttttacggcctaaagaacatgctctcaggcatcttcggcaacgttttcatcggaatatttttattcctaggccccttcatcctactaatccttttcttcatgttcggctggagaatcctcttctgcttcaaatgttgccgacgcacccgcggcctgctgaaataccgccacctcaaagaagacgaagaaacagggtaccggcgcataattgaacgactaaacaacaaaaaggggaagaacaaactactcgacggcgaaagactcgctgacagacgaatcgccgagcttttcagcaccaaaacacacattggc

SEQ ID NO: 15506 - RNA, 2916 nt, synthetic construct
  misc_feature 1..2916: note = derived and/or modified CDS sequence (opt11) from CCHFV(ROS/HUVLV-100, Artificial)__DQ206448.1__Gn-4aa-Gc
  source 1..2916: mol_type = other RNA
tctgaagaacctggcgacgattgcatcagtagaacccaactcctccgcaccgaaacggcagaaatccacgacgacaactacggcggccctggggacaaaattacgatctgcaacggcagcacaatcgtcgaccaacgcctcggctcagaactcggatgctacacgataaaccgagtcaaatcattcaaactatgcgaaaactccgcgaccggcaaaacttgcgaaatagattccaccccagtaaaatgccgacagggattctgtctaaaaatcacgcaagagggaagaggccacgtaaaactatcacgcggaagcgaagtcgtcctagacgcatgcgacagcagctgcgaagtcatgatcccgaagggtacgggcgacatcctagtcgactgcagcggaggtcaacagcacttcctcaaggacaacctaatcgacctaggctgcccgcacatccccctcctaggtaaaatggcaatctacatatgccgaatgtcgaaccatccacgcaccacgatggccttcctcttctggttctcattcgggtacgtaatcacatgcatcttctgcaaagcactattctactccttgatcattataggaaccctaggaaagaaaattaaacagtacagggaactgaaacctcaaacctgcaccatatgcgaaaccgcacctgtgaacgccatagacgccgaaatgcacgatctcaactgctcatacaacatctgcccctactgcgccagccggctaacctccgacggcctcgcccgacacgtcccacaatgcccgaaacgtaaagaaaaagtagaagaaaccgaactctacctaaacttagaacgcatcccctggatcgtccgaaaactactccaagtgagcgaaagcactggagtggccctcaaacgttcaagctggctcatagtcctcctagtcctcttgaccgtctcgctgtcccccgtccagtcagcacccgtaggccgcaagcctctattcctcgacagcattgtcaaaggcatgaagaacctcctcaactcgaccagcctcgaaacctcgctctccatagaagccccctggggagccatcaacgtacagtcaaccttcaaaccgaccgtctccaccgccaacatcgccctctcgtggagctctgtggaacaccgcggcaacaagatcctcgtcaccggccgcagcgagagcataatgaagctcgaagaacgcaccggagtgtcctgggacctaggcgtcgaagacgcctcagaaagtaaactcctcaccgttagtatcatggatctcagccaaatgtatagcccagtatttgagtacctaagcggcgaccggcaggtcgaggagtggccgaaagcaacctgcaccggcgactgcccagagcggtgtggatgtacatcctcaacgtgcctccacaaagagtggccccactctcgcaactggcgatgtaatcccacctggtgctggggcgtcggaaccggatgcacatgctgcggagtcgacgtcaaggacctcttcaccgaccacatgttcgtcaagtggaaagtcgaatacatcaaaaccgaagccattgtatgcgttgaactaacatcccaggaaagacagtgctccctaatagaggccggcacccgcttcaacctcggcccggtaacgataacactcagcgaaccccgcaacatccaacagaaactaccacctgaaataatcacactccacccgaaagtagaagaagggttcttcgaccttatgcacgtccaaaaagtcctatccgcgagtaccgtctgcaaactacaatcttgcacacacggaatccccggcgacctacaagtctatcacatcggcaacctgcttaagggggaccgcgtcaacggccacttaatccacaaaatagaaccccacttcaatactagctggatgtcctgggacggctgcgacctagactactactgcaacatgggggactggccaagctgcacctataccggtgtcacccaacacaaccacgccgctttcgtcaatctcctgaacatcgaaaccgactacacaaagaccttccacttccacagcaaacgagtcaccgcccacggagacacaccccaactagacctcaaagccagacccacctacggcgccggcgaaatcacggtcctcgtagaagtcgcagacatggaactacataccaaaaaggtagagatctcaggcctaaagttcgcatccctagcctgtactggctgctacgcatgttcttccggcatatcttgcaaagtacgcattcatgtcgacgaacccgacgagctaacagtccacgtaaaaagcagcgaccctgacgtcgtcgccgccagcacctccttaatggcccgtaaactagagttcggaaccgacagcacatttaaagcgttttcggccatgcccaaaacctccctatgcttctacatcgtggaacgcgaatactgcaaatcctgctccgaagaagacacacaaaaatgcgtcgacaccaaactcgaacaaccccaatccatcctaatcgaacacaaaggcaccatcatcggaaagcaaaacgacacatgcacagccaaagcatcgtgctggttagaaagcgtcaaatccttcttctacggcctcaaaaacatgctaggatccgtcttcggaaacttctttatcggcatcctcctcttcctggcccccttcgtcctcctcgttcttttcttcatgttcggttggaaaatcctattctgcttcaaatgttgccgccgaacccgagggctgctaaaatatagactactaaaagatgacgaagagaccggataccggagaataatagaacgcttaaacaacaaaaaggggaaaaaccgacttcttgacggcgagcgactagcggaccgcaagattgccgaactattctcgacgaagacacacatagga

SEQ ID NO: 15507 - RNA, 2916 nt, synthetic construct
  misc_feature 1..2916: note = derived and/or modified CDS sequence (opt11) from CCHFV(AP92, Artificial)__DQ211625.1__Gn-4aa-Gc
  source 1..2916: mol_type = other RNA
tcagagggcggagatggcggctgcatctcccgaacccaactcataaaaacagagacggccgaagtccacggcgacgactacgggggacccggcgagaaaatcaccatctgcaacgggtccaccatcgtcgaccaacggctcggctccgaactaggctgctacaccataaaccgcatcaaatcattcaaactctgcgagaactcagcccaaggtaaaaactgcgaaatagactccgcacccgtccaatgccgccagggctactgcctcaaaatatcccaagagggcaggggacacgtcaaactctcccgaggcagcgaaatcgtattagacgtttgcgacacatcctgcgagattatgatccccaaaggcactggggacatactcgtagattgctcaggaggacagcagcactttctacaatccaacctcgttgacctaggctgccccaacatcccgctgctcgggaaaatggctatctacatctgccgaatgtccaaccatccaaagaccacgatggcctttctattctggttctcctttggctatgtcataacctgcatcctctgcaagacactcttctacatactcatcattatcggcacacttggtaaaaagctcaagcaataccgcgagctaaaaccccagacctgcaccatatgcgagagcgtcccggtcaacgccatcgacgcagaaatgcacgacctaaactgctcatacaacatatgcccctactgcgcatcacgcctcacttcagaaggactcacgcgacacgtcaatcagtgccccaaacgtaaggaaaaagttgaggaaaccgaactgtatttgaacctcgagcgcataccctggatcgtccgcaagctactccaagtctctgaatccacaggagttgcactgaagcgctcatcctggatgatagtcctcctaatccttcttatcgtctccatgtcgccggtccaaagcgcccccatctcaaggaaacccctcttcctcgactcaatcgcgaaaggcgtcaaaaatctgttaaacagcaccagcctcgaaacatcactctcaatcgaggcgccctggggcgccatcaacgcacagtcgacctacaaaccaactgccagctctgccaacatcgccctcacctggtcctcggtggagcaccgcggaaacaaaatcctcgtctcaggacgatcagagtccatcatgaaactcgaggaacgtacagggatcagttggaacttaggcgttgaggacgcctccgaatcccggacactaaccatctcggtaatggacctttctcaaatgtattcgccagtcttcgaatacctcagcggagaccgacaagtcgaagaatggcccaaagctacatgcacggggaattgcccggagcgatgcggatgcaccagctcaacctgcctctacaaagaatggccacactctcgcaactggcgatgtaatccaacctggtgctggggcgtcggaacaggctgcacttgttgcggactcgacgtcaaagaactcttcaccgatcacatgctcgttaagtggaaggtggagtacatcaaaaccgaagcaatagtctgcgtcgaactcacgtcccaggaacgacagtgctccctaattgaagccggcacgcgcttctccctcggcccagtcacgatcaccctttccgaacccaggaacatccagcagaaactgccaccagaattaataaccctacaccctaaaatcgaagacggttacttcgacctaatgcacgtacagaaagtaatgagcgcttccaccgtatgcaaactacaaagctgcacccacggcgtaccaggcgacctccaaatctaccatgtcggcaacctcctaaaaggggaccgagtgaacggacacctgatacacaaggtcgaaccccacctcaacacctcgtggatgtcctgggacggctgtgatctagactacttttgcaacatgggcgactggccatcgtgcacgtataccggagtaacccagcacaaccacgcggctttcgccaaccttctcaacatagaaacagactacacaaagaccttccatttccattcaaaaagagtcaccgcacacggcgacactccccaactggaccttaaagcgcgtccgcgctacggcgccggagaaatcaccgtcctagtcgaagtagccgacatggaacttcacaccaaaaaggtagaagtcaccggcctaaaatttgcatccttaacctgctcaggatgctacgcgtgctcctccggaatctcctgcaaagtccgaatccacgtagacgaacccgacgagctcacagtccacgtcaaatcgtccgaccccgacatcgtcgcggcttcctcaagcctaatggctagaaaaatagagttcggagtcgacagtacctttaaagcattctcaagtatgcccaaagactcactctgtttctacatcgtagaacgcgactactgcaacagctgtaaaaacgaagaaacccagaggtgcgtcaacgccaaactcgaacaaccacaatccatactcatagaacacacaggcacaataataggcaaacaaaacgacacttgcggatcgcgcaccagctgctggctagacagcttcaaaagtttcttctacggcctcaaatccatgctgtccggcatatttggcaatgtcttcctcggaatcttcctgttcctagccccttttgcactcctcctcttcttcttcttcttcggatggcgcatcctattctgtttcaaatgctgcagaagaactcgcggcttattcaaataccgacacattaaagacgacgaggaagtcgggtacaagaaaatcatagaacgcctcaacaacaagaaaggcaaacacaggctcctcgacggggaacgccttgccgacaggaaaatcgccgaactgttcagcacgaaaacccacatcggc

SEQ ID NO: 15508 - RNA, 2916 nt, synthetic construct
  misc_feature 1..2916: note = derived and/or modified CDS sequence (opt11) from CCHFV(ArD8194, Artificial)__DQ211626.1__Gn-4aa-Gc
  source 1..2916: mol_type = other RNA
gccgaaggcggctccaacgactgcgtatccagaacacagctagtcaaaacagaggtggcagagatacacgaagactcctatgggggtccaggcgagaaaataacgatctgcaacggatccaccatagtcgaccaaaggctcggatcggaattaggctgctacacaatcaaccgggtccgaacatacaaactctgcgaaaactcggccactgaaaaatcctgcgagatcgactcagtcccagtcaaatgcaaacaaggcttctgcctcaaaatcacccaagaaggtcgaggacacgtcaagctctctcgcggcactgaaatcgtcctggacgtctgcgacacctcctgcgaattaatgatcccaaaaggcaccggtgacatccttgttgactgcagcggcggacaacagcacttcctgcaagacaacctcatcgacctaggatgccctaacatacccctcctaggacgcacagccatctacgtatgccgaatgtcaaaccaccccaaaacaaccatggcgttcctcttctggttttccttcggatacgtaatcacatgtgttgtctgtaaagtcctgttctacctgctaattgtcatcggaaccttaggcaagcgtctcaagcaatatcgagagctgaaaccccaaacatgtatagtctgcgaatccataccagttaacgcgatagacgccgaaatgcacgacctaaactgcaactataacatctgcccctactgcgcatccagactcacaagcgacggactcgtgcgccacgtaacccaatgcccaaaacgaaaggaaaaagtcgaagaaaccgagctatacctaaacctcgagcgtatcccctggcttgtccgcaaactactgcaggtctcagagtccaccggcgtcgccctaaaacgctcatgctggatgatcacactactaatcctcctgacagtctccatgtcccctgtacagtcagcacccgtcggacgaaaacccctcttcctcgacagaatcgccaagggcatgaaatccctgttaaactcaacctccctcgaaacatcacttagcatcgaagccccatggggagccataaacgttcaatccaccttcaagcccaccgtctccgcagctaacatagcactcagctggagctccgtcgaacacaaaggcaacaagatcctagtctccggacgatcagaaagcatcatgaagctcgaggaacgcaccgggatatcctggtgcctcggcgtcgaggacgccagcgagtccaaaacgctaaccgtaagcgtcatggacctctctcaaatgtactcacccgtcttcgaatacctctcaggtgaccgccaagtcgaagagtggccaaaagcaacctgcaccggggactgcccagagcggtgcgggtgcacatcctctacctgcttacacaaggagtggccccacagccgaaactggcgctgcaacccaacctggtgttggggcgtaggcacaggatgtacctgctgcggcctagacgtcaaagacctcttcacggactacatgctagtcaaatggaaggttgaatacattaagaccgaggcaatcatctgcgtcgaactgacctctcaggaacgccaatgctccctaatcgaagccggaaccagatttaaccttggacccgttaccatcaccctctcagaaccccgcaacgtacaacaacgactccctcccgaaataatcacgttacatcccaaaattgaagaaggctttttcgacctcatgcacgtccaaaaagtaatgtcggccagcacagtatgcaaattacaaagctgcacccacggcgtccccggcgacctccaagtatatcacgtaggaaacctcttaaagggcgataaggtaaatgggcactccatccacaaaatagaatcccacctcaatacttcttggatgtcatgggacgggtgcgatttagactacttctgcaacatgggcgactggccctcctgtacttacacaggcgtaacacagcataaccacgcggccttcatcaacatgctaaatatagaaaccgactacaccaaaaccttccactttcactcaaaacgggtcaccgcccacggcgatacgccgcaattagacctcaaagcccgcccagcctacggggcaggcgaaatcacggtcctcgtcgaagtagccgacctcgaactccacacaaagaaaatagaagtatccggcctcaagttcgcctcactttcctgctctggctgctacgcctgctcgagcggaatatcctgcaaagtccgcatccacgttaacgaacccgacgaatttacagtacatgtcaaaagtaacgacccagacgtcgtcgccgcaggctccagcctaatggcaagaaagatcgagtccggcgcagacagcactttcaaagccttttccagcatgcccaaaaactccctatgcttctacatagtcgaacgggactactgctcgagctgtaccgatgacgatacccagaaatgcgttgacatcaaattagaacacccgcaatcgatcctaatcgaacacaaaggcaccatcatcggcaaacaaaacgacacatgtcccaccaaaaccagctgctggctcgaatcaataaaatcgttcttttacggattgaaaaacatgctaagcggaatcttcggaaacgtcttcctaggaatgctactcttcctcgcccccttcatactactcattcttttcttcttctttggatggcgcctactcttctgcctaaaatgctgccgccggacccggaaactcctaaaatataaacacctacgcgacgaggaagaatcaggatataagaagatcatagaacgattaaacgacaagaaaggaaaatcacgcctcttcgacggagaacgactcgccgaccgaaaaatcgccgaactcttctcgacaaagacccacatcggc

SEQ ID NO: 15509 - RNA, 2916 nt, synthetic construct
  misc_feature 1..2916: note = derived and/or modified CDS sequence (opt11) from CCHFV(ArD15786, Artificial)__DQ211627.1__Gn-4aa-Gc
  source 1..2916: mol_type = other RNA
gcggaaggcggctctaacgactgcgttagccgcacacagctcgtcaaaacagaggtaaccgaaatccacgaagacagctacggagggccaggcgagaaaatcaccatctgcaacggcagcacaatcgtagaccaacgactgggcagcgaactcggatgctacaccatcaacagagtgagaacgtacaaactttgcgaaaactccgccacggagaaaagctgcgaaatcgacagcgtcccagtcaaatgcaaacaaggattttgcctgaaaatcacccaggaagggagaggtcacgtaaagctaagccgaggcacagaaatagtactcgacgtgtgcgacacctcttgcgaactcatgatccccaaaggtacaggcgacatactcgtagactgcagcggcggccagcaacacttccttcaagacaacctaatcgacctaggctgcccaaacataccactcctcggccaaacggccatctacgtctgtcggatgtcaaaccacccaaaaacaacgatggcgtttctattctggttctcattcggatacgtcataacctgcgttgtctgcaaagttctcttttacctactcatcgtcatcggtaccctaggcaagcgcctgaaacaataccgagagctcaaaccgcagacatgcatagtgtgcgagtcaatccctgtaaacgcaatcgacgccgaaatgcacgacctcaactgcaactacaacatatgcccatactgcgcaagcagactcacctccgacggcctagtccgacatgtcacccagtgccccaaacgcaaagaaaaagtagaagaaaccgaactctacctaaacctagaacgcataccctggctcgtcagaaaactcctacaagtctctgaatcgaccggagtcgcactcaagagatcatgctggataattacactcctcatcctcctaactgtctccatgagtcctgtccagtcagcccccgtaggaagaaaacccctaagcctcgacagtatagcaaagggaatgaagtcgctcctcaattcgacttctctagaaacctccctctcgatcgaagccccctggggcgcaatcaatgtccaatcaaccttcaaacccaccatatccgcagccaacattgccctctcctggagctccgtggaacataaaggcaacaaaatcttagtatcgggccgcagcgagagcataatgaagctcgaagaacgcacgggcatctcgtggtgcctaggtgtcgaagacgctagcgaatctaaaacactcactgtgtccgtgatggacctctcccaaatgtactcccccgtcttcgaatacctgtcaggagacaggcaagtagaagaatggccaaaagcaacctgcacaggcgattgccccgaacgctgcggatgcacctcctccacatgcctacacaaagaatggccccactcccgaaactggcgctgtaacccaacctggtgctggggcgtaggtacaggctgcacttgttgcggactcgacgtcaaagacctgttcacggactatatgctcgtcaaatggaaagtcgagtacatcaaaacggaagccatcatctgcgtcgaactaaccagccaagaacgccaatgttcactcatcgaagcaggcacacggttcaacctcggcccagtcacgatcacccttagcgaaccccgcaatgtccaacaacggctccctcccgaaataataacactccacccgaaaatagaggaaggattcttcgacctcatgcacgtacagaaggtcatgtccgcctcgacagtctgcaagctgcaatcctgcacccacggcgtccccggcgacctccaggtataccacgtcggaaacctgctaaaaggcgacaaagtcaacggccactcaatccacaaaatcgaatctcatctcaacacctcatggatgagctgggacgggtgtgacctagactacttttgcaacatgggggattggcccagctgcacctacaccggcgtaacgcaacacaaccgagccgcattcatcaacatgctaaacattgaaacagactacacaaagacgttccacttccacagcaaacgcgtcaccgcgcacggagatactccccaactggatctgaaagccaggccaacctacggagccggtgagattactgtcctcgtcgaagtcgccgaccttgaactacacacgaaaaagatagaggtgtcgggcctaaaattcgcatcgctaacgtgcagcggctgctacgcctgttccagcggaatctcctgcaaggtccggattcacgtcaacgaaccagacgagttcacagtccacgtcaagtccaacgacccagatgtcgtagccgccggctcatctctaatggcgagaaaaatcgaatcaggcgcagactcaacattcaaagccttctcctcaatgcccaaaaactcactgtgtttctacatagtcgagcgagactactgctctagctgcacggatgacgacactcaaaaatgcgtcgacatcaaactcgaacacccccaatccatcctcatcgaacataaaggcaccataataggcaagcaaaatgacacgtgcccaaccaaaacctcctgctggctagagtccatcaaatccttcttctacgggctcaagaacatgctgtcaggaatattcggaaacattttcctcggaatgctgcttttcttagcaccatttgtcctattaattttgtttttcttcttcggctggcgcctactattctgcctaaaatgctgcaggcgcacacgaaaactactaaagtacaagcacctccgtgacgaggaagaaagcggctacaagaaaataatagaaaggctcaacgacaagaaaggaaaatcaagactcttcgacggcgaacgtcttgcagacagaaaaatcgccgaactcttctccacaaaaacgcacgtaggc

SEQ ID NO: 15510 - RNA, 2916 nt, synthetic construct
  misc_feature 1..2916: note = derived and/or modified CDS sequence (opt11) from CCHFV(ArD39554, Artificial)__DQ211628.1__Gn-4aa-Gc
  source 1..2916: mol_type = other RNA
tccgagtccaacaacaacgactgcgtttcccgaacacagctcataaaaactgagaacgccgaaatccacggcgacgactacggcggccccggagaaaagataacaatttgcaacggaagcaccatcgtcgaacagcgtcttggatcggaactcggatgctataccatcaacaggattaaatcatttaaactatgtgagaactccgcaagcggcaaaggatgcgaaatcgacagcacgcccgtaaaatgcaaacaaggattttgcctcaaaatcacccaagaggggcgcggccacgtcaaactcagccgaggctccgaaataatcctcgatgtatgtgactcctcttgtgaaatgatgatcccaaaagggagcggcgacatcctcgtcgactgcagcggcggtcagcaacacttcctccaagacaacctagtagacctcggatgccccaacgtcccgctcctcggtaaaatggcaatctacatctgtcgcatgagcaaccaccccaagacaaccatggcgttcctattctggttctccttcggctacgtcataacctgcatcttctgcaaagttatattctacgtcttaatcatcataggcaccctaggcaagcggataaaacaataccgcgagctcaagccacaaacttgtaccatttgcgaagcaacccccgtcaacgcaatcgacgcagagatgcacgacctaaactgcagttacaacatctgcccctactgcgcctcccgtctaacatcagaaggcctcgtccgccacgtcactcaatgcccaaagcgcaaagagaaaatagaagaaacagaactctacctcaacctagaacggatcccgtggttcgtaaggaaactactccaagtatcagaaagcaccggagtcgcgctcaaacgctcctcatggctagtgactctcttagtactcctaaccgtctccctgagccctgtccagagcgcacccataggccgcaaaccactctttcttgatagcacagccaaatccatgaaatcgctcctcaactcaacttcactagaaacatcgctctctatagaagcaccatggggcgctataaacgtacaaagcacgttcaaacccacggcgtcaaccgcaaacatcgcgctctcgtggtcatcagtagaacaccgtggcaataagatactggtcacaggacggagcgaaagtatcatgaagctagaggaacgtaccggaatatcctggaatctcggggtcgaggacgcctccgagtcaaaaacactcaccgtatctgtcatggatctatctcagatgtactcaactgtcttcgagtacctgtccggcgaccgccaagtagaagagtggcccaaagccacatgcaccggagactgccccgaacgatgcggctgcacctccagcacgtgcctgcacaaggcctggcctcactccagaaactggagatgcaacccgacctggtgctggggtgtggggacaggctgtacctgctgcggactagacgtcaagaacctgttcacggactacatgcttatcaagtggaaagtcgagtttataaagacagaagctatcgtctgcgtcgagctcacctcgcaggagcgccaatgctcacttatcgaagcaggcacacgcttcaacctaggccccgttacaatcacactatccgagccacgcaacatccaacaaaaactcccgcctgagctcgtcacactacacccaagagtagaagaggggttctttgacctaatgcacgttcagaaagtcctcagcgcgagcacagtctgcaaactccaatcatgcacgcacggcgtaccaggtgacctccaagtatatcacgtaggcaacctcctaaagggagataaaatcaacggaaactccttccacaagatcgaaccaaacttaaacacgtcttggatgagctgggacggatgtgacctagactactactgcaatatgggcgactggccatcgtgcacatacacaggagtcacccaacacaaccacgcagcattcgtcaacctcctgaacatcgaaaccgactacaccaaaaacttccacttccacagcaaaagagtaacagcccacggtgagaccccgcaactggatcttaaagcccgcccaaaatacggcgccggcgaagtcacggtcctcgtcgaagttgctgacatggaactccacaccaagaaaatcgagatctcaggactgaaatttgcatcactgacttgcacaggatgctacgcctgctctagcggcatctcctgcaaagtccgcctccacgtagacgagcccgacgagctgactgtacacgtaaaatccgacgacccagacgtagtagcggcctctagttcgctcatggcgcggaaaatagagttcggaaccgactcaacattcaaagcattctccagtatgcccaaagacaaactctgtttctacatagtagaacgggactactgctcctcctgcagcaaagaagacacacagaaatgtgtaaacgccaaacttgaacagccacaatcgatcctaatcgaacacaaaggcacaataatcggcaaacaaaacgacacgtgcaccgtcaaagcatcatgctggctcgaaagcgtcaaatcgttcttctacggcctcaaaaacatgttaggaggcatctttggcaacgtcatcttaggcattataatgttcctagctcccttcgcgctcctactactgttcttcctcttcggctggcgaatactcttctgcctacgttgctgccggcgcacccgtgggctctttaaatacaaacacatcaaagacgacgaagagtctggatacaaacgcattatagagcgactcaataacaagaaaggcaaaaacaaactcttcgatggagaacgtcttgcggacaagaaaatagcagaactcttctccaccaagacacacatcggc

SEQ ID NO: 15511 - RNA, 2916 nt, synthetic construct
  misc_feature 1..2916: note = derived and/or modified CDS sequence (opt11) from CCHFV(C-68031, Artificial)__DQ211629.1__Gn-4aa-Gc
  source 1..2916: mol_type = other RNA
tccgaagaatccggggacgactgcatcagtcggacacaactatcccgcaccgaaacagccgagatccatagcgacaactatggtggccccggagacaaaatcaccatctgtaacggcagcactatcgtagaccaacgcctcggctccgaactcggctgctacaccattaaccgcgtcaagagcttcaaactctgcgaaaactcagctactgggaaaagctgcgaaatcgactcaacccccataaaatgccgacaaggcttctgcctaaaaatcacacaagaaggtagaggccacgtcaaactatctcgcggctcggaagtcgtcctagacgcatgcgattcctcctgcgagatcatgataccgaaaggcaccggtgacatcctcgtcgactgcagcggcggccaacaacatttcctcaaagacaaccttatcgacctcgggtgcccgaacatacccctgctcggcaaaatggccatctatatatgcaggatgtccaaccatccaaaaactacaatggcattcctgttctggttcagcttcggctacgtgatcacatgcatactttgcaaagtgatattctatttgctcatcgtcgtaggaacgctcggcaaaaagttcaagcaataccgcgagctcaaaccgcaaacgtgcaccatctgcgagaccacaccagtgaacgccatcgatgccgagatgcacgacttaaactgctcttacaacatatgcccgtactgcgcatcgcgcctaacctccgacggactcgcccgccacgtcatgcaatgcccaaaacgcaaagaaaaagtcgaagaaactgaactatacctcaacctcgaaagaatcccatgggtagtcaggaaactcctccaagtctccgagtccacaggtgttgctttaaagcgctcctcatggctagtcgtcctcctagtcctattgacagtctccctctcccccgtccagagcgcccccataggacgaaaacccctcttctccgactcaatagtcaaaggaatgaaaaacctcctaaatagcacatccctcgaaacatcactatcaatcgaagccccttggggcgcaattaacgtacaatcaaccttcaaacccacagtaagcgccgccaacattgctctttcctggtcgtccgtcgagcaccgcggaaacaaaattctcgtctccggaaggagtgagtcaataatgaaactcgaagagagaacaggtatctcatgggacctcggggtcgaggacgcaagcgagtccaaactccttaccgtgagcatcatggacctctcccaaatgtacagccccgtattcgaatacctctcaggcgacagacaagttgaagaatggccgaaagctacatgcacgggagattgcccggaacgctgcggctgcaccagcagcacgtgcctacacaaggaatggccacacagtcggaactggagatgcaacccgacctggtgctggggcgttggaaccggatgtacctgctgcggcttagatgtaaaagacctgttcactgactatatgttcgtcaaatggaaagtcgaatacatcaaaaccgaagcaatcgtatgcgtagagctcacatcccaagagcgtcagtgctcactcatcgaagcaggcacacggttcaacctaggcccggtcaccatcaccctatccgaaccacgcaatattcaacagaagctcccacccgaaatcgtaaccctccaccctcgtatcgaggaaggcttcttcgacctcatgcacgtcaaaaaggtactcagcgcctccacggtatgcaaactccaatcttgcacccacggagtccccggagacctacaagtgtatcacattggaaacctcctcaaaggggacaaagttaacggacacttaatacacaagattgagccacacttcaacactagctggatgtcatgggacgggtgcgatctcgactactactgcaacatgggcgactggccatcatgctcctacacgggcgtaacccagcacaaccacgcagcattcgtcaacatgctcaacatcgaaacggactatacaaagatattccacttccactcgaaaagggtcacagcccacggcgacaccccgcagctagaccttaaagcgcggccaacgtacggcgcgggagagataaccgtcctcgttgaagtcgcagacatggaactacacacaaagaaaatcgaaatctccggcctaaaattcgcctcgctcacatgcaccggctgctacgcttgctctagcggcatatcatgcaaagtccgcatccacgtagatgaacccgacgagctaaccgtacacgtaaagtccgaagacccagacatcgtcgcagcgagcagctccctcatggcccgaaaacttgagttcggcacagactctacattcaaggctttctccgcaatgccgaaaaccagcctatgcttctacatcgtcgaacgcgaatactgcaaaagctgttccaaagaagacacccagaaatgcgtcaacaccaaactcgaacaaccacaaagcatactaatcgaacacaaaggcaccatcatcggcaagcaaaacgacacgtgcacaagcaaggccggctgctggctggaaagcgtcaaatccttcttttacggacttaaaaacatgctatcaggaatcttcgggaatgtattcataggcatcttcctattcctagcacccttcatcctcctaatcctgttcttcatgttcggatggcgaatcctattctgcttcaaatgctgccgacgcacccgaggtctctttaagtaccgacacctcaaagacgacgaggagacaggatatcgaaaaatcatcgagcgtctaaacaataaaaagggcaaaaacaagctcctagacggtgaacgtctcgccgataggaagatagcagagctattctccaccaaaacacacatcgga

SEQ ID NO: 15512 - RNA, 2916 nt, synthetic construct
  misc_feature 1..2916: note = derived and/or modified CDS sequence (opt11) from CCHFV(Drosdov, Artificial)__DQ211630.1__Gn-4aa-Gc
  source 1..2916: mol_type = other RNA
tccgaagaaccaggggacgactgcataagcaggacacaactcctcaaaacagagacggccgagatacacgacgacaactacggaggacccggagacaagattacaatctgtaatggctctaccatagtagaccagaggcttggatccgaactcgggtgctacaccattaaccgcgtaaaatcattcaaactttgtgaaaactccgcaacaggaaaaacctgcgagatcgacagcacaccagtcaagtgccgacaaggcttctgcctgaaaatcacacaagaaggccgtgggcacgtcaaactgagccggggctcggaagtagtcctagatgcatgcgactcctcatgcgaagtaatgatcccaaagggcaccggagatatcctagtagactgcagcggcggccaacaacacttcctaaaagacaacttgatcgaccttggatgccctcacatccccctactcggcaaaatggccatctacatctgtcgtatgtccaaccacccacgcacaacgatggcgttcctcttctggttcagctttggttacgtgatcacgtgcatcttctgcaaagctctattctactcgctgatcataatcgggacacttggaaagaaaatcaaacaataccgcgaactaaaaccacaaacctgtaccatctgcgaaaccgcgcccgtaaatgcaatcgacgcggaaatgcacgaccttaaatgctcctacaatatatgcccctactgcgcatcgcgcctaacttccgacggtctcgcccgccacgtaacacaatgcccaaagagaaaagagaaagtcgaagaaaccgaactttacctcaacctagaacgtataccatggatagtccgcaaactgctacaagtctcggaatcgaccggagtggcactcaaacgctcctcctggttgatagtgctcctagtgctcctcacagtgagcctctcaccagtacaaagcgccccggtcggacgaaaacccctattccttgactctacagtaaaaggcatgaagaacctgctcaactcaacctccctagaaacctccctatcaatagaagcaccctggggcgcaatcaacgtacagtccaccttcaagcccacagtgtcaacagcaaacatagccctatcctggtcgtcagttgaacaccgcggtaacaaaattctagtcaccggccgcagcgaatccataatgaaactggaagaacgaacaggagtatcgtgggatttaggagtagaggacgcaagcgaatccaaactcctaaccgtcagcataatggacctctcacaaatgtactccccggtgtttgagtacctctcaggagaccgccaagtagaagaatggccgaaggcgacctgcacaggggactgtccagaacgttgtggctgcaccagcagcacttgcctccataaggagtggccacactcacgaaactggcgatgtaatcctacctggtgctggggagtaggcaccggctgcacatgctgcggggtagacgtaaaggacctcttcaccgaccacatgtttgtgaaatggaaggtcgaatacatgaaaaccgaagccatcgtgtgcgtcgagctcaccagccaagagcgtcaatgctcactcatcgaagccggtacacgcttcaacctaggcccagtaaccatcaccctaagcgaaccccgcaacatccagcagaaactcccgcccgagattatcacactgcatcccaagatcgaggaaggattctttgacctcatgcacgtacaaaaagtcctttctgccagcaccgtttgcaaattgcaatcctgcacacacggaatccccggagaccttcaaatataccacatcgggaacctactcaagggagaccgcgtcaacggccacctaatacacaaaatcgaaccccacttcaacacatcatggatgagctgggacggctgcgacctcgactactactgcaacatgggaaactggccctcctgcacctacaccggcgttacacaacacaaccacgccgccttcgttaacctattaaacatagaaacagactacacaaaaaccttccacttccactccaaacgcgttacagcccacggcgacactcctcaactagacctcaaagcacgacccacatacggcgcaggcgaaatcaccgtcctagtcgaagttgccgacatggagctccacacaaagaaggtcgaaatcagcggcctgaaattcgcatcgctcgtatgcaccggctgctacgcgtgctccagcggtatctcatgcaaagtcaggatccacgtcgacgaacccgacgaactcacagtccacgtcaagtcctctgaccccgacgttgtagcagcatcaacgagcttaatggccaggaaacttgagtttggaacagatagcatcttcaaggcattcagcgcaatgcccaaaacatcactgtgtttctacatcgtcgaacgcgagtactgcaaatcgtgctcagaagacgacacaaagaagtgcgtcgacaccaaactcgaacaaccgcaatcaatactaatcgaacacaaaggtactatcatcggcaaacagaacgatacctgcacagccaaagcatcctgctggctggaatccgtcaagtcattcttctatggccttaagaacatgctcggttcggtgtttggcaacttcttcgtgggaatacttctcttcttggctccattcgtactcctcgtcctatttttcatgttcggatggaaaatcctattctgcttcaaatgctgccgccgcacacgcggcctcttcaagtaccgacacctaaaggacgacgaggaaacagggtacagacgcataatcgaacgcctaaactccaaaaagggcaaaaacagactacttgacggagaaagactcgccgaccgcaaaatagcagaactcttctcaacaaaaacacacatcggc

SEQ ID NO: 15513 - RNA, 2916 nt, synthetic construct
  misc_feature 1..2916: note = derived and/or modified CDS sequence (opt11) from CCHFV(Kashmanov, Artificial)__DQ211631.1__Gn-4aa-Gc
  source 1..2916: mol_type = other RNA
tcagaggaacccggcgacgactgcatctcacgaacccaactgctccgaacagaaacagctgagattcacgacgacaactacggcggccccggtgacaaaataacaatctgcaacggcagcaccatagttgaccagcgcctaggctccgagctaggctgctacaccataaaccgtgtcaaaagtttcaaactatgcgaaaactccgctaccggtaaaacctgtgaaatcgactccacacccgtaaaatgccgacaaggcttctgcctcaaaattacgcaagaaggcaggggccacgtcaagctgagccgcggctccgaagtagtattagacgcttgcgactcaagctgcgaagtaatgatacccaagggaaccggagacatcctcgtcgactgctccggcggtcagcaacatttcctcaaagacaatctcatagacctaggctgcccacatataccactgcttggaaaaatggccatctacatatgccgtatgagcaatcaccctcgcaccaccatggcgttcctattctggttctcattcggctacgtcatcacctgtattttctgcaaagccctattctactcactgattatcatcggcaccctaggcaagaaaatcaaacaataccgagaactcaaaccccaaacctgcacaatatgcgaaaccgcacccgtcaacgctattgacgccgaaatgcacgacctcaattgctcctacaacatctgcccctattgcgcctcccgcctcacttcggatggcctcgcacgccacgtcccccaatgcccaaaacgaaaagaaaaggtcgaagaaaccgaactctacctcaacctagagcgaatcccctggattgtcagaaaactccttcaagtatcggaaagcacaggcgtcgccctaaaacgctcctcatggctaatcgtcctcctcgtactccttactgtctccctctctccagtccaatcggcaccggtaggccgtaaaccactattcctagactccatagtcaaaggcatgaaaaacagcctcaactcaacaagcctagaaacctctctctcaatcgaagccccatggggcgccatcaacgtccaatcaaccttcaaaccaaccgtctcgacagcaaacattgccctctcttggtcctcagtcgaacaccgcggaaacaaaatcctagtcacagggcgcagcgaatccatcatgaaactcgaagaacgaaccggagtatcctgggacctcggagtcgaagacgcaagcgagtccaaactcctgacagtgagtatcatggatctcagccaaatgtactcacccgttttcgagtacctatcaggcgaccgccaggtcgaagaatggcccaaggcaacctgcaccggtgattgccctgagcgatgcggctgcacaagctctacctgcctccataaggaatggccacacagccgtaattggagatgcaaccccacctggtgttggggtgtaggaacaggatgcacatgctgcggcgtagacgtgaaagatcttttcaccgaccacatgttcgtcaaatggaaagtcgaatatatcaagaccgaagccatcgtctgcgtcgaactcacatcccaagaaagacagtgctcactcatcgaggcaggcacccgcttcaacctaggcccagtcacgatcacgcttagcgaacccagaaacatacaacagaaactcccacctgagatcatcacactccatccgaaagtcgaagaaggcttcttcgacctaatgcacgttcaaaaagtactatccgcctccacggtctgcaaactccaaagctgtacccacggcatccccggcgatcttcaagtctatcatataggcaatcttctcaaaggggaccggatcaacggacacctcattcataagatcgaaccccacttcaacacttcctggatgtcatgggacggctgcgacttagactactactgtaacatgggcgactggccctcatgcacgtacacgggggtgacccaacacaaccacgcggccttcgtaaacctcctcaacatcgagactgactacaccaaaaccttccacttccactcgaaacgtgtcacagctcacggagacacaccccaactggaccttaaagcccgaccgacctatggggccggagaaataaccgtactggtagaggttgccgacatggaactacacaccaagaaagtagaaatctctggactgaaattcgcctccctcgcatgcaccggctgctacgcgtgctcgtccggcatatcatgcaaagtacgcatccacgtggacgagccggacgaactcacagttcacgtaaaaagctccgacccagacgtcgtggccgcaagtacctccttaatggccagaaaacttgagttcggcacagactccaccttcaaagcattctccgcaatgccaaaaacaagcctctgcttctacatagtagaacgggaatattgcaaaagctgcagcgaagaagacacccaaaaatgtgtcgacacaaaactcgaacagccccaatcgatactcatagaacataagggcaccataatcggtaagcagaacgatacttgcaccgcaaaggccagctgctggctcgaaagtgtaaagagcttcttctacggcctcaaaaacatgctcggttccgtcttcggaaacttcttcatcggcatcctcctcttcctagctccattcgtcctcctcgttctattcttcatgttcggatggaaaattctcttctgtttcaaatgctgccgccgcacccggggcctgctgaaataccgacacctcaaagacgacgaagagacaggttaccgccgcatcatagaacgcctaaacaacaagaaaggcaaaaaccgcctcctagacggcgaacgcttagccgacagaaaaattgcagaactcttcagcaccaaaacacacattggc

SEQ ID NO: 15514 - RNA, 2916 nt, synthetic construct
  misc_feature 1..2916: note = derived and/or modified CDS sequence (opt11) from CCHFV(Oman, Artificial)__DQ211632.1__Gn-4aa-Gc
  source 1..2916: mol_type = other RNA
tccgaagaaagcggggaagactgcatctcccggacccaactcctccgaaccgaaaccgccgaaattcacggcgacaattacggcgggccaggcgacaagatcacaatctgcaacggcagcacaatcgttgaccagcgattaggctcggaactaggatgctatacaatcaaccgagtaaaatcatttaaactctgcgaaaactccgcaaccggtaaatcgtgcgagatagacaacacccccgtgaaatgcaaacaaggattttgcctaaaaataacccaagaaggccggggacacgtcaaactctcccgagacagcgaagtcgtcctggacgcctgcgactcttcgtgcgagattatgatcccaaaaggaacaggtgatatactcgtagactgttccgggggccaacaacacttccttaaagacaacctcatcgacctaggctgcccgaacatccccctacttggtaaaatggcgatatacatctgtcgcatgtccaaccacccaaagaccaccatggcgttcttattctggttctcattcggctacgtaatcacatgcatcctgtgtaaagttatattctacctcttaatcgtcgtaggcaccttgggcaaaaagttcaaacaatacagagaactcaaaccccaaacctgcaccatctgcgaaaccacgcctgtgaacgccatcgacgccgagatgcatgacctaaactgctcctacaacatctgcccctactgcgcaagccgactgaccagcgacggtctcgcaaggcacgtaatgcaatgtccgaaacggaaggagaaaattgaagaaacagaactctatcttaaccttgaacgaatcccatgggtagtgcgaaaacttctacaagtctccgaaagtacaggggtcgctcttaaaagatcttcgtggcttatcgtcctactcgtgctcctaactgtatccctatcacctgtacagtccgcacccattggccgcaagcccctcttcctagactccatcgccaaaggcatgaaaaatctcctaaactccacatcgctcgaaacctcgctctcaatcgaagcaccctggggagcaatcaacgtacaaagtaccttcaaaccaacggtctccaccgcgaacatcgcactttcctggtcgtcagttgaacaccgaggaaacaaaatccttgtctctggaagaagcgagtccataatgaaactggaagaacggactggaatcagctgggacctgggcgtcgaagacgccagcgaatcgaaactcctcaccgtctcagtcatggacctttcacaaatgtactcaccagtgttcgagtacctgtccggagaccgccaagttgaggagtggcccaaagcgacatgcaccggagactgcccagaaagatgcggatgcacctccagcacatgcctacacaaggaatggccacatagtcgcaactggcgatgcaatccgacctggtgctggggagtcggaacaggatgtacctgctgcggcctcgacgtcaaagacctattcacggactacatgttcgtcaaatggaaagttgaatacataaaaaccgaagccatcgtctgcgttgaactaacctcacaagaacgccaatgctcacttatcgaagccggaacccgcttcaatctaggaccagtcacaatcacgctgtctgaaccccgcaacatacaacaaaagctaccccctgaaatcgtcacgctccacccgcgaatagaggaaggcttctttgacctaatgcacgtacagaaggtcttatctgccagcaccgtctgcaagctgcaatcctgcacacacggcgtcccaggagacctccaagtctaccacataggcaacctactaaaaggcgataaggtcaacgggcacctcatccacaaggtcgagccccacttcaataccagctggatgtcatgggacggatgcgacctcgactactactgcaatatgggagactggccctcctgcacatacacgggagtcacccaacacaaccacgccgccttcgtaaacttactaaacatcgaaacagactatactaaaaatttccacttccactccaaacgcgtcacggcccacggtgatacaccacaactcgacctcaaagcacggcctaattacggggctggcgaagttacagtcctcgtagaagtagccgacatggaattgcacaccaaaaagatagaaatctccggactcaaatttgcttcgctaacatgcacaggatgctacgcctgctcctccggaatatcctgcaaagtacgcatacacgtcgatgaacccgacgaactcaccgtccacgtaaaatccgaagacccggacatcgtagccgcatcatcctccctcatggccagaaaactagagttcggcacagactcaacattcaaagccttctcggccatgcccaaaacctcgctctgcttctatatcgtagaaagagaatactgtaagtcatgttccaaagaggacacccagaagtgcgtcaacgcgaaactcgagcgcccccaatcaatcctaatcgaacacaaaggcacaatcataggaaagcaaaacgatacctgcacagccaaggcttcgtgctggctagaaagtgtcaaatccttcttctacggcctcaaaaacatgttatcaggcatcttcggcaacgtgttcatcggcatattcctattccttgcccccttcatactcctgatactatttttcatgttcggatggcgcatactcttctgcttcaaatgctgccggcgcacccgcggcctcttcaagtaccgacacctcaaggacgacgaagaaacgggatatcggaaaataatagagcgactcaacaacaagaaaggcaaaaacaaactcctcgacggagagcgcctcgccgaccgaaaaattgccgaactcttctccaccaagacccacatagga

SEQ ID NO: 15515 - RNA, 2916 nt, synthetic construct
  misc_feature 1..2916: note = derived and/or modified CDS sequence (opt11) from CCHFV(SPU97/85, Artificial)__DQ211633.1__Gn-4aa-Gc
  source 1..2916: mol_type = other RNA
agcgaagagtcagacggagactgcatcagccgcacccaacttttgcgcaccgaaaccgcagaaatccatagtgacaactacggagggccaggcgacaaaataacaatctgtaacggatccacgatcgtggaccaacgcctaggatccgaactgggctgctacactatcaaccgcgtcaaatccttcaaactatgcgaaaacagcgcgactggcaaaagctgcgagatagactccaccccggtcaaatgccgacaaggcttctgccttaaaatcacccaagaaggaaggggacacgtcaaactgtcccgtggctcagagatcgtcctagacgcctgcgactcatcatgtgaaataatgatccccaaaggtacaggagacatactcgtcgattgctccggaggccaacaacacttcctcaaagacaacctcatagaccttggatgccccaacatacccctcctcgggcgcatggcaatctacatctgcaggatgtccaaccacccaaaaaccacgatggcattcctattttggttcagcttcggctacgtaataacctgcatcttatgcaaagtaatattttacctccttatagtagccggcacggtcggcaaaaagttcaaacagtatcgggaactccgaccgcaaacctgcacaatctgcgagacaacgccagtaaacgcaatagatgcagaaatgcacgatctgaactgctcctacaatatctgcccctactgcgcatcacgcctgacatccgacgggctagctcgacacgtaatgcaatgcccaaaacgaaaagagaaaatcgaagaaaccgaattatatctcaacctcgaacgcataccatgggtagttcgaaaactcctccaagtctccgaatccaccggtgtagccctaaaacgatcctcgtggctaaccgtgctcctcgtactcctcatcgtgtcactttcccccgtccaatcggctcctatcggccggaaacccctattcctcgacagtatagtaaaaggcaagaaaaacctcttaaacagcacttcactcgaaacctcactatccatagaagccccctggggcgccatcaacgttcaatccacgttcaaacccaccgtcagtgcagcgaacatagccctatcgtggtcctccgtagaacaccggggcaacaaaatactcgtctccggacgcagcgaatccatcatgaaactggaagaaagaaccgggatctcctgggacctcggcgtcgaagatgcctcagaatccaaactgctcacagtatcggtcatggacctctcgcaaatgtatagtccggtcttcgaatacttatccggcgaccgacaagtcgaagaatggccgaaagctacatgtaccggagactgcccagaacggtgcggatgcacctcgtcgacctgcctacacaaagaatggccccactcacgcaactggcgctgcaatcccacctggtgctggggcgtaggcacgggatgtacctgctgcggtttagacgtaaaagacctcttcaccgactacatgttcgtcaaatggaaagtcgaatatatcaaaacggaagccatcgtctgcgtcgaactcacgtcacaggagcgccaatgctctctcatcgaagccgggacacgcttcaacctgggcccggtaacaataaccctttccgagccgcgaaatatccagcaaaaactccctcctgaaatcatcacactacacccgcgcatagaagagggcttcttcgacctaatgcacgtccagaaagtactctccgcctccaccgtctgcaaactacagtcgtgcacccacggcgtcccgggcgacctccaagtctaccatatcggcaacctactcaaaggcgacaaagtcaacggtcatctcatccacaaaatcgaaccccacttcaacacctcatggatgtcttgggacggctgcgatctcgactactactgcaacatgggtgactggcctagttgcacgtatacgggagtaacccaacacaaccatgcagccttcgtaaacctcctcaacatagaaacagactacacaaagaacttccacttccactccaaacgggtcaccgcccatggcgacacaccccaactagacctcaaagcccgccccacctatggcgctggagaagtaaccgtccttgtcgaagtcgctgacatggaactacacacaaagaaaatagaaatctcaggcctgaaattcgcctcactctcctgcacgggatgctacgcctgttccagcggcatcagctgtaaagtgcgtatccacgtagacgaacccgacgagcttaccgtacacgtcaaatccgaagaccccgacatagtcgccgctgggtcatcgctcatggcccggaaactcgaatttggcgcagactccaccttcaaagcattttcagcgatgccaaaaacctcactctgcttctacattgtagaacgagaatactgcaaatcttgctcccgagaagacacgcaaaaatgcgtaaacactaagttagaacgcccgcaatcgatcctcatagaacacaaaggaacgattataggaaagcaaaacgacacgtgcaccgcaaaggcctcttgctggctcgaatccgtcaaaagtttcttctacggactcaaatctatgctctccgggatctttggcaatgtattcatcggcatattcctcttcatcgcaccattcgtcctcctaatcctcttcttcatgttcggctggcgtatcctcttctgcttcaaatgctgccgccgaacccgcggactgttcaaataccgacacctaaaagacgacgaggagaccggataccgaaaaatcatcgaaagactaaacaacaagaaagggaaaaacaaacttctcgacggggagcgtctagcagaccgcaaaatagctgaactcttttcaaccaaaagccacatcgga

SEQ ID NO: 15516 - RNA, 2916 nt, synthetic construct
  misc_feature 1..2916: note = derived and/or modified CDS sequence (opt11) from CCHFV(SPU103/87, Artificial)__DQ211634.1__Gn-4aa-Gc
  source 1..2916: mol_type = other RNA
tcagaagaatcctcagacgactgcatatctcgcacccaactcctccgtacagaaaccgcagagatacacggtgacaactacggcggacccggcgataaaataacgatctgcaacggcagcaccattgtcgaccaacgtctgggttcagaactcggatgctacacaatcaatcgagtcaaaacctttaagctctgcgaaaactcagcaaccggcaagtcttgcgaaatcgactccgtcccagtcaaatgccgccagggctactgcctaaaaatcacccaggaaggcagggggcacgtcaaactcagccgcggcagcgaggtcgtgctggatgcctgcgacacatcctgcgaagtaatgataccgaaaggaacgggagacatactcgttgactgctctgggggccagcaacatttcctaaaagacaatctcatagacctcggctgcccgaaaatccctctcctcgggaagatggccatctacatatgccgcatgtctaaccaccccaaaaccacaatggcattcctattctggttcagcttcggctatgtaattacgtgcgtcctctgcaaagccatcttctacctactaatcatcgtaggcacactaggaaaaagacttaagcaataccgagaactaaaaccacaaacatgtaccatctgcgagaccacaccagtaaacgccatcgacgccgaaatgcatgacctcaactgctcatacaacatatgcccgtactgtgcctctcgcctgacatccgacggactcgcccgacacgtaacccaatgccccaaacgcaaggaaaaggttgaagaaacagaactttacctcaacctagaaagaatcccctgggtggtccgccgcctactacaggtctccgaatccaccggcgtcgcgctgaaacgctcatcctggctaatagtactgctggtgctattcacggtaagcctctcccccgtccaatccgcgcccatatcacgacgccccctctttctagacaatatcgtaaagggcatgaaaaatctactcaactcaacatccctcgagacctcactatccatcgaggctccatggggagccataaacgtccaatcgacatataaaccgacagtaagcactgcaaacattgccctttcctggagctccgtggagcaccgaggcaacaaaatactcgtctcaggcagatccgagagcatcatgaaattagaagaacggaccgggataagctgggacctcggggtcgaagacgcatcggaatccaaactactaaccgtgtctgtaatggacctatcgcaaatgtactctcctgtattcgaatacctcagcggagaccgacaagtagaagaatggccaaaagccacgtgtacaggggactgccctgagcgatgcggctgcacatcttcaacctgcctccacaaggaatggccccactcccgaaactggcgctgcaacccaacttggtgctggggcgtaggaaccggttgtacctgctgcggtctagacgtaaaagacctattcacggactatatgttcgttaaatggaaaatcgagtacatcaaaaccgaagccatagtatgcgtagagctcacctcccaagaacgacaatgcagcctcatcgaagctgggacccgtttcaacctgggcccagttaccatcaccctatcagaaccccggaacatccagcaaaagctcccaagcgagatcatcaccctccacccccgaatagaagaaggcttcttcgacctcatgcacgtccaaaaagtactcagcgcaagcacagtctgcaaactccaatcctgcacacacggcgtccccggcgacctacaagtctatcacataggcaacctcctcaagggtgacaaggtcaacgggcacctagtccacaaaatcgagccacactttaatacgtcatggatgtcatgggacggatgcgacttagactactactgcaacatgggggactggccctcatgcacgtacacaggcgtcacacagcacaatcatgccagcttcgtaaaccttcttaacatcgagacggactataccaaaaacttccacttccactctaaaagagtaacagcccacggagacaccccacagctagatctcaaagcccgccccacatatggagcaggcgaaatcacagtcctcgtcgaagtcgcagacatggaactccacaccaaaaagatagaaatcagcggactcaaattcacctcgctcacgtgcaccggctgctacgcctgctccagcggcatctcgtgcaaggtgcgaatacacgtggacgaaccggacgaactcactgtacacgtaaagagcgacgaccccgacgtggtagccgcatccagcagcctaatggcgagaaaactagagttcggcacggacagcactttcaaagcattctcagccatgccaaaaacatccctctgcttctacattgtagaaagggaatactgcaaatcatgtagcgaagaagacacacagaaatgcgtaaacaccaaactagaacaaccccaatccatactcatcgaacacaaaggcactattataggaaaacagaataatacctgcaaagcccgagccggatgctggctagagagcgtaaaatcgttcttttacggactcaaaaacatgctttcgggcatcttcggcaacgtcttcatcggaatattcctattcctcgcccccttcatcctcctcatcctcttcttcatgttcggatggcgtatactattctgcttcaaatgctgccgccgaactcgaggactattcaagtaccgccacctgaaagacgacgaagaaaccgggtatcgcaaaatcatagaacgactaaacaacaaaaagggaaagaacaagctcctcgacggagagcggctagcggacagacgtatagccgagctattctcgaccaagacacacatcggc

SEQ ID NO: 15517 - RNA, 2916 nt, synthetic construct
  misc_feature 1..2916: note = derived and/or modified CDS sequence (opt11) from CCHFV(SPU415/85, Artificial)__DQ211635.1__Gn-4aa-Gc
  source 1..2916: mol_type = other RNA
agcgaggagtccgacggcgactgcatcagccgcacccagctgctccggaccgagacgaccgagatccactccgacaactacgggggccccggggacaagatcaccatctgcaacggcagcaccatcgtagaccagcgcctggggtccgagctgggctgctacacgatcaaccgggtcaagagcttcaagctctgcgagaactccgccaccggcaagtcttgcgagatcgactccaccccggtaaagtgccgccaggggttctgcctgaagatcacccaggagggccgggggcacgtgaagctgagccgcggctccgagatcgtcctcgacgcctgcgactctaactgtgagatcatgatccccaaggggacaggcgacatcttagtggactgctccggcgggcagcagcacttcctgaaggacaacctcatcgacctgggctgccccaacatccccctgctcgggaagatggcgatctacatctgccggatgagcaaccacccgaagaccaccatggccttcctgttttggttctccttcggctacgtgataacctgcatcctttgcaaggtcatcttctacctcctgatcgtggccggcacggtggggaagaagttcaagcagtaccgcgagctgcggccccagacctgtaccatctgcgagaccatccccgtcaacgccatcgacgccgagatgcacgacctcaactgcagctacaacatctgtccctactgcgcgtcccgcctgacgagcgacggcctggcccggcacgtgatgcagtgcccgaagcgcaaggagaaggttgaggagaccgagctctacctgaacctggagcggatcccctgggtcgtgcgcaagctcttacaagtgtccgagagcactggagtcgccctgaagcggagctcctggctcaccgtgctgctggtgctcctgatcgtctctctgtcccccgtgcagagcgcccccatcggccgcaagccacttttcctggactccatcgtcaaggggatgaagaacctgctcaacagcacgtccctggaaaccagcctgtccatcgaggcgccctggggcgccatcaacgtccaaagcaccttcaagcccaccgtgtccgccgccaacatcgccctcagctggtccagcgtggagcaccggggcaacaagatcctggtctccgggcgcagcgagtccatcatgaagctggaggagcggacgggcatcagctgggacctcggggtggaggacgcgtccgagagcaagctgctgacggtcagcgtgatggacctctcccagatgtacagccccgtgttcgaatacctgtccggcgaccgtcaggtcgaggagtggccgaaggcgacctgcaccggggactgccccgagcggtgcgggtgcacgagctccacctgtctgcataaggagtggccccacagccgcaactggcgctgcaaccccacctggtgctggggcgtggggaccggctgcacgtgctgcgggctcgacgtgaaggatttgttcaccgactacatgttcgtcaagtggaaggtggagtacatcaagaccgaggccatcgtgtgcgtcgagctgacctcccaggagcggcagtgcagcctgatcgaggccggcacgcgattcaacctcgggccggtgaccatcaccctgtccgagccccggaacatccagcagaagctgccgcccgagatcatcaccctccacccccgcatcgaggagggcttcttcgacctgatgcacgtgcagcgggtcctgagcgcctccaccgtgtgcaagctccagagctgcacgcacggcgttcccggggacctgcaggtctaccacatcggcaacctgctcaagggggacaaggtgaacggccacctgatccacaagatcgagccccacttcaatacctcgtggatgagctgggacggctgcgacctggactattactgcaacatgggggactggccctcctgcacctacaccggcgtgacgcagcacaaccacgccgccttcgtcaacctcctgaacatcgagaccgactacaccaagaacttccacttccactctaagcgcgtgaccgcccacggggacacgccgcagctggacctcaaggcccggcccacctacggcgcaggggaggtgaccgtcctggtggaggtggcggacatggagctgcataccaaaaagatcgagatctccggcctcaaattcgcaagcctgacgtgcaccggctgctacgcctgcagctccgggatcagctgcaaggtcaaaattcatgtggacgagcccgacgagctgaccgtgcacgtcaagtccgaggacccggacatcgtggccgccggcagctccctcatggcgcgcaagctggagttcggggccgactcaaccttcaaggccttctccgccatgcccaagacgagcctgtgcttctacatcgtggagcgggagtactgcaagtcctgcagccgcgaggacacccggaagtgcgttaacaccaagctcgaccgcccccagtccatcctgatcgagcacaagggcaccatcatcgggaagcagaacaacacgtgcaccgcgaaggccagctgctggctcgagtccgtcaagagcttcttctacggcctcaagaacatgctgtccggcatcttcgggaacgtgttcatcggcatcttcctgttcatcgcccccttcgtgctcctgatcctgttcttcatgttcgggtggcggatcctcttctgcttcaagtgctgccgccggacccgcggcctgttcaagtaccggcacctgaaggacgacgaggagaccggttaccgcaagatcatcgagcggctcaacaacaagaaaggcaagaacaagctgctggacggcgagcgcctcgccgatcgtaagatcgccgagctgttcagcacgaagtcccacatcggg

SEQ ID NO: 15518 - RNA, 2916 nt, synthetic construct
  misc_feature 1..2916: note = derived and/or modified CDS sequence (opt11) from CCHFV(Turkey200310849, Artificial)__DQ211636.1__Gn-4aa-Gc
  source 1..2916: mol_type = other RNA
tcagaagaacctggggacgattgtatcagccgcacgcaactgctccgaacggaaaccgccgaaatacacgacgacaactacggcggccccggcgacaagatcaccatatgcaacggctcaacgatcgtggatcaacgcctcgggtccgaactgggttgctacacaataaatcgcgtaaagtccttcaaactgtgcgaaaactcagccaccggaaagacatgcgaagtcgattcgaccccagttaaatgccgtcaaggcttctgcctcaaaatcacccaagaagggcgcggccacgtgaaactcagtagaggtagcgaagtagtcctcgatgcatgcgattcatcctgtgaagttatgatccccaaaggcaccggggacatactcgtcgactgctcaggaggccaacaacacttcctcaaagacaacctaatagacctgggatgcccccacatccctctccttggcaagatggctatatacatatgccgtatgtccaaccacccccgcacaaccatggccttcctcttctggttctccttcggctacgtaataacctgcatctcgtgcaaggccctattctactccctcataattatcggcaccctcggtaagaaaataaaacagtaccgtgaactaaaaccccaaacttgcacgatctgcgaaaccgcacccgtcaacgcaatagacgccgaaatgcacgaccttaactgctcctacaacatctgcccctactgcgcaagccgtcttacaagcgacggcctagcccggcacgtaacacagtgccccaaaagaaaagagaaagtcgaagaaacagaactctacctaaacctggagcgcattccatggatcgtgcgcaaactcctccaagtctccgaaagcacgggggtcgccctaaaacgtagctcttggttaatcgtactcctagtcctcctcactgtctccctatcccccgtccaaagcgcgcccgttggcagaaaaccactcttccttgactccatcgtcaaagggatgaaaaacctactgaactccacatcactagaaacctcactctctatagaggccccatggggcgccatcaacgtacaatcgaccttcaaaccagccgtatccaccgccaacatcgccctttcatggtcatccgtggagcaccgaggaaacaagatcctcgtaaccgggcggagcgaatcaatcatgaaactagaggagcgcaccggagtctcctgggacctcggtgtagaggacgcgtccgaatcaaaactcctgacagtaagtattatggacctaagccagatgtacagccctgtattcgagtacctatccggagaccgacaggtagaagaatggccaaaagcaacatgcaccggcgactgccctgagcgctgcggctgcacatcttcaacctgcctacataaggaatggccacacagccgaaactggagatgcaaccccacctggtgctggggagtgggaaccgggtgtacctgctgcggtgtcgatgtcaaagatctatttaccgaccacatgttcgtaaaatggaaggtggagtacataaaaaccgaggcgattgtgtgcgtagaactcacctcccaggaaagacagtgctccctaattgaagccggtacccgcttcaacctcggaccagtaacaataactctctcagaacccaggaacatacaacaaaaactaccacccgagatcataaccctccaccccaaaattgaagaaggcttcttcgacctgatgcacgtccaaaaagtgttaagcgcatccacagtatgcaaactccagagctgcacccacgggattcccggcgacctacaagtttaccacatcggaaacctactgaaaggggaccgagtcaacggccatctaatacacaaaatagaatcccacttcaacacttcgtggatgtcttgggacggatgcgacctcgactactactgcaacatgggagactggccaagctgcacctacacgggcgtcacacaacacaaccacgccgccttcgttaacctactgaacatagaaaccgactacacaaaaacatttcacttccactccaaaagagtaaccgcccacggcgacacaccccaactcgacctcaaggctagacccacctacggggccggcgaaatcacagtcctcgtcgaagtcgcagacatggaactccacacgaagaaagtcgaaatatccggactcaaatttgcctcactagcgtgcacaggatgctacgcatgcagttccggaatctcttgtaaagtcagaatacacgtcgacgaacccgacgaactcaccgtacacgtcaaatcatccgacccagacgtagtcgccgcatccacttcactcatggcccgaaaactagagttcggaacagacagtacgttcaaagccttctccgcaatgcccaaaacgtctctatgcttttatatcgtcgaacgtgaatactgtaaatcatgctcagaagacgacacccaaaagtgcgtcgacacaagacttgaacaaccacaatccatcctcatcgagcacaaaggcacaataatcggaaagcagaatgatacctgcaccgcaaaggcctcctgctggcttgagtccgtaaaatccttcttttacggccttaaaaacatgcttggcagcgtctttgggaacctattcatcggtatccttctattcctcgcacccttcgtgctgctcgtcctcttcttcatgttcggatggaagatcctcttctgcttcaaatgctgccgccgcacacgcggcctcttcaagtaccgacatctcaaggacgacgaagaaaccggatatcgcagaatcatcgagcgactgaacagcaaaaagggcaaaaacagactactagacggagacagactcgcagaccgcaagatagcggaactcttcagtaccaaaacccacatagga

SEQ ID NO: 15519 - RNA, 2916 nt, synthetic construct
  misc_feature 1..2916: note = derived and/or modified CDS sequence (opt11) from CCHFV(Iran-52, Artificial)__DQ446215.1__Gn-4aa-Gc
  source 1..2916: mol_type = other RNA
agtgaggagtccggggacgactgtatcagccgcacccagctgctacggaccgagactgccgaggtccacggcgacaactacggcgggcccggcgacaagatcaccatctgcaatgggtcgaccgtcgtggatcagcgcctgggctcagaactgggctgctacaccatcaaccgggtgagatctttcaagctctgcgagaacagcgccacggggaaatcctgcgagatcgacagcatcccggtcaagtgcaaacagggctattgcctgaaaatcacccaggagggacgggggcatgttaagctgtcccgtgggagcgaggtggtcctcgacgtgtgcgattccagctgcgaggtgatgataccgaagggcaccggcgatatcctggtcgactgctccggcggccagcagcacttcctgaaggacaacctcgtggatctggggtgccccaagattcccctgctcggcaaaatggccatttacatctgccggatgagcaaccacccgaagaccacgatggccttcctgttctggttctccttcggctatgtgatcacttgtatcttatgcaaggccatattcttcctcctaatcatcttcgggacccttggcaagcgcttcaagcagtaccgcgagctcaagccccagacctgcaccatctgcgagaccaccccagtcaacgccatcgacgcggagatgcacgacctgaattgcagctacaacatctgcccctactgcgcgtcccgcctgacctcagatgggctcgcccggcacgtcacgcagtgtccgcgccggaaggagaaggtggaagagaccgagctatacctgaacctcgagcgcatcccctgggtcgttcggaagctgctccaggtgagcgagagcaccggcactgtcctgaagagatcttcctggctgattgtgctgttagtgctctttacggtcagcctgtcccccgtgcagagcgcccccatcgggagacgccccctcttcctcgacagtatcgtgaagggaatgaagaacctgctcaacagcacctccctggaaaccagcctgtccatcgaggccccctggggcgcaattaacgtgcagagcacctacaagcccacggtgtccaccgcgaacatcgccctctcgtggtccagtgtggagcaccggggcaacaaagtgctggtgtcgggccgcagcgagtctatcatgaagctggaggagcggaccggtatcagctgggacctcggcgtcgaggacgcctccgagagcaagctgctgaccgtgtcagtgatggacctctcccagatgtacagccccgtcttcgagtacctgagtggggaccgccaggtggaagagtggccgaaggccacgtgcacgggagactgccccgagcgctgcggatgcacctcatccacgtgcctgcacaaggaatggccccacagccggaactggcggtgcaacccgacttggtgctggggcgtggggaccgggtgcacgtgctgcggcctcgacgtcaaggacctgttcaccgactacatgttcgtgaagtggaaagtagagtacatcaagaccgaggcgatcgtctgcgtggagctgaccagtcaggagcgtcagtgctcgctgattgaggccgggacccgcttcaacctcggctccgtgacgatcaccctgagtgagccgcggaacatccagcagaaactgccgcccgagatcatcacgctccaccccaagatcgaagagggcttcttcgacctgatgcacgtccagaaggtgctgtccgccagcaccgtgtgcaagctccagtcctgcacgcacggggtcccgggcgacctccaggtgtaccacatcggcaacctgctgaagggcgaccgtgtgaacgggcacctgatccataaaatcgagcagcacttcaacaccagctggatgtcatgggacgggtgtgacctggattactactgcaacatgggcgattggccatcatgcacctataccggcgtcacccagcacaaccacgcctccttcgtgaacctcctgaacatcgagaccgactacacgaagacctttcacttccacagcaagcgggtgaccgcccacggcgacacgccccagctggatctcaaggcgcgccccacttacggggctggcgagataaccgtcctggtggaggtcgccgatatggagctgcataccaagaagatcgagatcagcggcctcaagttcgccgggctgacttgcacgggctgctacgcttgctcaagcgggatctcctgcaaggtccggatccacgtcgaggagcctgacgagctgaccgtgcacgtcaagagcgacgaccccgacgtggtggcggcatctagctccctcatggcccgaaaacttgagttcggtaccgactcgacattcaaggccttctccgccatgcccaagacgagcctgtgcttttacatcgtcgaacgggagtactgcaagagctgcagcaaggaggacacccaaaagtgcgtgaacaccaagctggagcagccccagtctatcctgatcgagcacaaggggaccatcatcggcaagcagaacaatacgtgcaccgcgaaggccagctgctggctagagtccgtcaagagcttcttctacgggctcaagaatatgctcggcgggatcttcgggaacgtgttcatagggatcttcaccttccttacccccttcatcctgctgatcctgttctttatgttcgggtggcgcatactcttctgcttcaagtgctgcaggcgcacgcgaggcctgttcaagtaccgccatctgaaagacgacgaagagaccggataccggaagatcatcgagcgcctcaacaacaagaagggcaagaaccgtctgctggacggcgagcgcctcgccgaccgcaagatcgccgagctgttctccaccaagacccacatcggg

SEQ ID NO: 15520 - RNA, 2916 nt, synthetic construct
  misc_feature 1..2916: note = derived and/or modified CDS sequence (opt11) from CCHFV(Iran-53, Artificial)__DQ446216.1__Gn-4aa-Gc
  source 1..2916: mol_type = other RNA
agcgaggagtccggcgacgactgcatcagccgcacccagctgctacggaccgagaccgccgaggtccacggggacaactacggcggtcccggcgacaagatcaccatctgcaacgggagcactgtcgtggaccagcgcctcggcagcgaactgggctgctacactatcaaccgggtgcgctccttcaaactttgtgaaaattctgccacggggaaatcctgtgagatcgacagcattcccgtcaagtgcaagcagggctactgcttaaaaataacccaggaagggcggggccacgtgaaactttcgcgcggatcagaggtggtgctcgatgtatgcgactcaagctgcgaggttatgatccctaagggcaccggtgatattctggtcgattgctccgggggccagcagcatttccttaaggacaacctcgtggacctagggtgcccgaagatccccctactcggaaagatggcgatctatatctgccggatgagcaaccacccgaagactacgatggccttcctcttctggttctccttcggctacgtgatcacgtgcatcctgtgtaaggccatcttcttcctcctcatcatattcgggacactaggcaagcgcttcaagcagtaccgggagctcaagccccagacctgtaccatttgtgagactaccccggtcaacgccatagatgccgagatgcacgacctgaactgcagctataacatatgcccctactgcgcgtcccgcctgaccagcgacgggctcgcccggcacgtaacccagtgcccccgcaggaaagagaaggttgaggagaccgagctgtacctgaacctcgaaaggatcccctgggttgtgcgcaagttgctccaggtgtccgagagcacaggcaccgtcctgaagaggagctcctggttgatcgtgctgctcgtgctgttcacggtctcactctccccagttcagagcgcacccatcgggcgacgcccactcttcctggattccatagtgaagggaatgaagaacctgctcaatagcacctccttagagaccagcctgtccatagaagctccgtggggagcgatcaacgtgcagagcacctacaaacccaccgtgtccacggccaacatcgccttgtcatggagctcagtcgaacaccgggggaataaggtgctagtgtccggccgctccgagagcatcatgaagctggaggagcggaccgggataagctgggacctcggcgtggaggacgcctccgagagcaagctgttgactgtgagcgtcatggacctctcccagatgtactcgcccgttttcgagtacctgtccggggaccgccaagtggaggagtggccaaaggccacgtgcaccggcgactgccccgagcgctgcggctgtaccagctccacatgcctgcacaaagaatggccccacagccggaactggcgctgcaaccctacctggtgctggggcgtgggtaccgggtgcacgtgctgtggccttgacgtcaaagacttgttcaccgactacatgttcgtcaagtggaaggtagagtacatcaagaccgaggcaatagtctgcgtcgagcttacgtctcaggagcgccaatgctcactgatcgaggccgggacccgctttaatttaggttccgtgacaatcacgctgagcgagccgcggaacatccagcagaagctgcctcccgagatcatcacgctccatcccaagatcgaggaaggattcttcgacttaatgcacgtccagaaggtcctgtccgccagcaccgtctgcaaactccagtcctgcacccacggggtacctggtgacctccaggtgtaccacattgggaaccttctgaagggcgaccgcgtgaatggccacctgatacacaagatcgagcagcacttcaacaccagctggatgtcctgggacggctgcgacctggactattattgcaacatgggcgactggcccagctgcacctataccggggtcacccagcacaaccacgcctcctttgtgaacctcctgaacatcgaaaccgactacacgaaaaccttccacttccacagcaagcgtgtgaccgcccacggcgacacgcctcaattggacttgaaagcccgccccacctatggggccggcgaagtcacagtgctggtagaggtcgctgacatggagctccacacgaagaagatagagatctctggcctcaaattcgcgggtcttacgtgcactggctgttatgcctgctctagcgggatctcctgcaaggtacgcatccacgtagacgagccggacgagctgaccgtccacgtcaagagcgatgaccccgatgtggtggcggcctccagctccctcatggcccgcaagctggagttcggcaccgacagcacctttaaggctttttccgccatgcccaagacgagcctgtgcttttacattgtggaacgggagtactgcaagtcctgcagcaaggaagacacacaaaaatgcgtcaacacaaagctagagcaaccgcagtccatcctaatcgaacataaggggaccatcatcggcaagcagaacaatacttgcaccgcaaaggcctcctgctggctggagtccgtcaagagcttcttctacggcctcaagaatatgctcgggggcatcttcgggaatgtgtttatcggcatcttcaccttcctgacccccttcatactcctgattctgtttttcatgttcgggtggcgaattttattctgcttcaagtgctgtcgtcgcacgcggggcttgtttaagtaccgccacctgaaagacgacgaggagacaggctaccgtaagatcatcgagcgcctcaacaacaagaagggcaaaaacagactgctggacggcgagcgactcgcagaccgcaagatcgccgagctattctcaaccaaaacccacattggg

SEQ ID NO: 15521 - RNA, 2916 nt, synthetic construct
  misc_feature 1..2916: note = derived and/or modified CDS sequence (opt11) from CCHFV(Kosova Hoti, Artificial)__EU037902.1__Gn-4aa-Gc
  source 1..2916: mol_type = other RNA
agcgaggaaccgggtgacgactgtatatcccggacccaactgttgcggaccgagaccgccgagattcacgacgacaattatgggggcccgggggacaagatcaccatctgcaacggcagcaccatcgtggaccagcggctggggtccgaactgggatgctacaccatcaaccgggtcaagagcttcaaactctgcgagaactctgccacaggcaagacctgcgaaatcgacagcaccccggtgaagtgccgccaagggttctgcctgaagataactcagaagggccgcgggcatgtgaaactgtcccgcgggagcgaggtcgttctcgacgcgtgcgactccaattgcgaggtgatgatccccaaaggaacaggcgacatcctggtcgactgttcaggagggcagcagcacttcttgaaagacaacctcatcgacctagggtgcccgcacatcccgttactcggaaagatggccatctatatctgtcggatgtccaaccatcccaagaccaccatggcattcctgttctggttcagctttggttacgtgatcacgtgcattttctgcaaggccctgttttactccctcattataattggaaccctgggaaagaagatcaaacaataccgcgagctgaaaccccagacgtgcactatctgcgaaaccgccccagtcaacgcgattgacgcggagatgcacgacctaaactgcagctacaacatttgtccctactgcgcctcccggctaaccagcgatggcctggcacgccacgtcaagcagtgcccaaagagaaaagagaaggtggaggaaaccgagctctacctgaatctagagcgcataccctgggtggtccggaaattgctccaggtgtctgagtcgacaggagtggctctgaagcgttcaagctggcttatagtcctgctggtgctcctgaccgtgagcctgtcccctgtgcagtcggctcccgtcggccggaagcccctcttcctggacagtattgttaagggcatgaaaaacctactgaactcgacttcacttgagacctccctgtccatagaggcaccgtggggcgccatcaacgtccagagcacctttaagcctaccgtttccaccgcgaacatcgcacttagctggtccagcgtagaacaccgcgggaacaagatactggtcaccgggcggtccgagagcatcatgaaactagaggaacgcaccggcatttcctgggacctgggggtagaggacgcctctgagtccaaactgctgaccgtctcgatcatggacctctcccagatgtattcaccggtgttcgagtacctgagcggcgaccgccaggtcgaagagtggcctaaggcgacctgcaccggggactgcccccagcggtgtggctgcacctcctcaacttgtctgcacaaagagtggccccattcccggaactggcgctgcaacccgacctggtgctggggagtcgggaccggctgtacgtgctgcggggtggacgtaaaggacctcttcacagatcatatgtttgtcaaatggaaagtggagtacatcaagactgaggccatagtctgcgtcgaactgacgtcgcaggaacgacagtgtagcctcatcgaagccggcacaaggtttaacctggggcccgtgaccatcacactcagcgagcctcgcaacattcagcaaaagctgcccccggaaatcatcacgctgcaccccaaaattgaggaaggcttcttcgacttgatgcacgtgcagaaggttctgtccgcgagcacagtttgcaagctgcagtcctgcacccacggaatccccggagacctgcaggtataccacataggaaacctgcttaaaggggaccgcgtcaatggccaccttatccacaagatcgaaccccacttcaacacctcgtggatgtcctgggacggctgcgacctagactactattgcaatatgggcgactggcccagctgcacatacaccggcgtgacccagcataaccacgccgccttcgtgaatctgttaaatatcgaaactgactacaccaagaccttccacttccactccaagcgcgtcaccgcgcatggggacacccctcagttagatctaaaagccaggccgacttacggcgccggcgagattaccgtcttggtcgaggttgccgacatggaactgcacactaagaaagtggagatcagcggactgaagttcgcctccctcgcctgcaccggttgctacgcctgcagctcagggatcagctgtaaggtgcgcatccacgtcgacgaaccggacgaactgacggtgcatgtgaaaagctcggaccccgacgttgtggcagccgggacctcattgatggcgcgtaagctagagttcgggacggactcgaccttcaaggccttcagcgcgatgcccaaaacgtccctgtgcttctatatagtggagaaggagtactgcaagagctgctccgaggacgacaccaagaagtgtgtcgacaccaaactggagcagccccagagtatcctcattgagcaccgcgggaccatcatcggaaaacagaacgacacatgcaccgccaaggcctcctgctggctggagtctgtgaaatcattcttctacggcctcaaaaacatgttgggcagcgtgttcgggaactttttcatcggcatcctgcttttcctcgctccgttcgtcctgctggttctgttctttatgttcgggtggaagatcctgttttgcttcaagtgctgcaggcgcacgcgcggcttgttcaagtaccgccacctcaaggacgacgaagaaacgggctaccgtcgcatcatcgaaaggctaaataacaagaagggcaagaaccgcctcctcgacggtgagcggctagccgaccgcaaaatagccgaactgttctccacgaaaacccacatcggg

SEQ ID NO: 15522 - RNA, 2916 nt, synthetic construct
  misc_feature 1..2916: note = derived and/or modified CDS sequence (opt11) from CCHFV(YL04057, Artificial)__FJ562094.1__Gn-4aa-Gc
  source 1..2916: mol_type = other RNA
gctgaaggaggatcgtcagactgcatctcccgaacccagctagtgaaaaccgaagtggccgagatccacgaggactcctacggcgggcccggggagaaaatcacgatctgtaatggcagcaccatcgtcgaccaacggctcggtcgcgaactaggctgttacacaataaatagagtccgctcatacaaactatgcgaaaactctgcttctggaaaaagctgcgaaatagactccatccccgtcaagtgcaaacaaggcttttgccttaaaatcacccaagaaggacgcggccacgtcaaactcagtaggggaacagagatagtcctcgatgtctgcgactccagctgcgaactcatgatacccaagggcaccggggacatcctcgtagactgcagcggtggccaacaacacttcctccagaacaatctcatcgacttgggctgccccaacgtacccctcctcggcaagatggcgatctacgtctgccgtatgagcaaccaccccaaaactacaatggccttcctattctggttctcttttggctatgtcataacatgcatagcctgccgcgtcctcttttacctcctcatcgctatcggtacagtaggaaagaaactcaaacaatacagagagctgaaaccccaaacgtgcatcgtatgcgaatccgtcccagtgaacgcgatcgacgccgaaatgcacgaactcaactgcagctacaacatctgcccatactgcgcgtcacgcctctcgacagacggtctgatccgccacgtaacacagtgtcccaaacgacgagaaaaagtagaagaaaccgaactcttcctaaacctagaacgcattccctggctcgtccgaaaactactacaagtctccgagtcgaccggaatggcgctaaaacgatcctgctggatgataacactgcttatcctactcctcgtcagtataagtccggtccagtccgcccccgtaggccgcaaaccactcttcctagacagcatcgccaaaggaaagaaatcactactaaatagcacctcgctagaaacctcgctttcaatcgaggccccatggggagccataaacgtccaatccacattcaaaccaaccgtctccgccgccaacattgcactatcctggtcctccgtcgagcaccgagggaacaaaatacttgtctccggaaggtctgaatccatcatgaagctggaagaacgtaccggagtcagctggaacctaggcgtcgaagacgcgagcgaatcaaaaaccctaacagtctcagtcatggacctatcacaaatgtactcacccgtcttcgagtatctcagcggcgatcgacaagtcgaagaatggcccaaggcaacttgcaccggcgactgtcccgaacgctgcgggtgcacgtcctctacctgccttcataaggaatggccccacagccgaaattggcggtgctccccaacctggtgctggggagtcggcaccggctgcacatgctgcggactcgacgtaaaggacttcttcaccgactacatgctcgtcaaatggaaagtcgagtacataaagacggaggccatcgtgtgcgtcgagctaacctcccaagaacgacaatgcagcttaatagaagccggaacaagattcaacctcggacccgtaactatcacactatccgaaccgcgcaacgtccagcagagactacccccagaaatcgttacactccacccaaaaatcgaagagggcttcttcgaccttatgcacgtccagaaaatactctccgcctccaccgtatgcaaacttcaatcctgcacccacggagttcccggcgacttccaagtctaccacgtcggaaacctccttagaggggacaaggtaaacggccacagcatccacaaaatagaaccccacttcaatacatcgtggatgagctgggacggctgcgacctagactacttctgcaacatgggagactggcccagctgcacatacacaggagtaacccaacacaaccgagccgcgttcatcaacatgcttaacatcgaaactgactacaccaagacattccacttccacagtaaaagagtgaccgcccacggagacacacctcaactagatcttaaagcccgcccggcgtacggcgccggtgaggtcacagtcctcgtagaagtggcagatctcgagctccacaccaaaaagctcgaagtatccggactaaaaattgcctcccttacatgctcaggctgctacgcctgctcatccggaataagctgcaaagtacgcatccacgtcaacgaaccggacgagttcacagtacacgtgcgttcatccgacccagacgtcgtggcggccggcagttccctgatggccagaaaaatagaatttggcgccgactcgactttcaaagccttcagctccatgccaaaagactccctatgcttctacatagtagaaaaggactattgctcctcctgcaccgacgacgacactcaaaagtgcgtcaacactaagctcgaccacccacaatcaatacttatcgaacacaagggcactatcatcggcaaacaaaacgacacatgctcaaccaaaacctcctgctggctcgaatccgtcaaagggttcttctacggccttaaaaacatgctaagcggcatcttcggcaacgtcttcctaggcatactcctcttcctcgcccccttcgtcctcctcatcttcttctttttcttcggctggcgcctgcttttctgcctaaaatgctgccgccgcacacgaggactactcaaatacaagcacttaaaggacgaagaagaagctggctataaaaagataatagaaagactaaacgggaaaaagggcaagtcgcaactctttgatggcgaaagacttgccgaccgaaaaatagccgaactgttctcaactaaaatacacatagga

SEQ ID NO: 15523 - RNA, 2916 nt, synthetic construct
  misc_feature 1..2916: note = derived and/or modified CDS sequence (opt11) from CCHFV(V42/81, Artificial)__GU477490.1__Gn-4aa-Gc
  source 1..2916: mol_type = other RNA
tcgaaagagcccggagacgactgtatcagccgcacccaactaatgcgcacagaaaccgctgaaatccacgacgacaactatggaggtccaggagacaaaataacaatctgcaacggatccacaatcgtggaccagcgacttggctccgaactaggctgctacaccatcaaccgcgtcaaatccttcaaactgtgcgaaaactccgcaaccggtaaagcgtgcgaagttgacagcacacccgtaaaatgcaggcagggcttctgcctcaaaatcacacaagaagggcgcggacacgtcaaactctcaagaggcagcgaagtcgtacttgacgcctgcgactcttcctgcgaagtcatgattccaaaaggaacaggagacattctggtagactgctcagggggccaacaacacttcttaaaagacaacctaatagacctagagtgtccgcacataccgttactaggcaaactcgcgatctacatttgcagaatgagcaatcaccctcgcacaaccatggccttcctcttctggttcggctttggatacgtcatcacatgcatactctgcaaagcattattttattccctcatcataataggaacgctcggcaaaaagatcaaacaatacagagagctcaaacctcagacttgcacaatctgcgaaacagcccccgtaaacgccatagacgcggagatgcacgacctaaactgcagctacaatatctgcccttactgcgcctcgagactcacctcagacggcctagcgcgtcacgtcacgcaatgtcccaaaagaaaagagaaagtcgaagagaccgagctatacctaaacctcgagagaataccctggatcgtccgaaagctcctacaagtctctgaatcaaccggcgtagtcctcaagagatcctcatggctgatagtcctcttagtgctcctcacagtgagcctctcccccgtccaatcagctccggtcggaagaaaaccactgttcctcgatagcatagtcaaaggaaagaaaaacctcctaaactccacatccctagagacctccctgagcatagaggcaccatggggagccataaatatccaatccaccttcaaaccaaccgtgtcagcagctaatatcgccctatcatggtcctccgtggaacaccgcggaaacaaaatcctcgtctccggtcgaagcgaaagcatcatgaagctagaagaaaggacgggcgtatcctggaacctaggtgtggaagacgcaagcgaatcgaagctgctcaccgtaagtataatggacctctcacagatgtactcacccgtcttcgaatacctgtctggcgaccgacaggtcgaagaatggccaaaagcaacgtgtaccggagactgccccgagcgctgtggctgcacctccagtacctgcctccacaaagaatggccccactccagaaactggcgatgcaacccaacctggtgctggggcgtcggaaccggctgcacatgctgcggcgttgacgtcaaggacctgttcatcgaccacatgttcgtcaaatggaaagtggaatacattaaaaccgaagctatcgtctgcgtcgaactaacatcacaagaacgacaatgctcactcatagaggccggcacccgcttcaacctgggcccagtcacgataaccctctccgaacccagaaacatccaacaaaaactacccccagaaatcataaccctccacccaaaaatagaagaaggcttcttcgacctaatgcacgtccaaaaggtactctcggcctcaaccgtctgcaaactacaatcctgcacgcacggcattcccggagacctacaagtttaccacataggaaacctcctcaaaggagacagagtcaatgggcatctaatccacaaaatcgagccccatttcaacacaagctggatgtcatgggacggctgcgaccttgactactactgcaacatgggcgactggccaagctgcacctacactggagtcactcaacacaaccacgccgccttcgtaaacctactcaatatcgaaaccgactacacaaaaacattccacttccactccaaaagggtaaccgcacacggcgaaacaccccaactcgacctgaaggctcgcccagcatatggcgcaggcgaaatcaccgtgctcgtagaagtagccgacatggagttacacacgaagaaagtggaaatctcgggtctgaaattcgcatcactagcctgcacaggctgctacgcatgttctagtggcatctcatgcaaagtacgcatccacgtcgatgaaccagacgaactaaccgttcacgtcaagtccaacgacccagacgtcgtggccgcatcgacctccctgatggccaggaagctggaatccggcacagactctaccttcaaagccttcagcgccatgcccaaaacctccctctgcttctacatagttgaacgagaatactgcaaatcctgctctgaagatgacacccaaaaatgcgtcgaaaccaaactggagcaaccccagtctatcctaatagaacacaaaggaactataatcgggaagcagaacgatacctgcaccgccaaagcatcgtgctggcttgaaagcgtcaagtcatttttctacggactcaagaacatgctcggatcagtattcggcaacttcttcatcggcatactcttgttcctggcacccttcgtcctactcgtcctatttttcatgttcggatggaaaatactattctgcttcaaatgctgccgccgcacccgcggactcttcaaataccgccacctaaaagaggacgaagaaaccggctaccgacgcatcatcgaaagactcaactccaagaaaggcaaaaaccggctactcgacggcgaacgactagccgaccggaaaatcgcagaactcttctcaaccaaaacccatatcgga

SEQ ID NO: 15524 - RNA, 2916 nt, synthetic construct
  misc_feature 1..2916: note = derived and/or modified CDS sequence (opt11) from CCHFV(79121M18, Artificial)__GU477493.1__Gn-4aa-Gc
  source 1..2916: mol_type = other RNA
gccgagggcggctcaagtgactgtatctcccgaacccaactcgtgaaaaccgaagtcgcagagatacacgaagactcgtacggcggccccggcgagaaaatcacgatctgcaatggctcaactatcgtagatcaaggcctgggatccgaactcggttgttacaccatcaaccgagtgcgatcctacaaactctgcgaaaactctgccagcggcaaatcgtgtgaaattgatagcattccggtcaaatgcaaacagggcttttgcctaaaaataacccaagaaggacgaggccacgtaaaactcagccgtggcacagaaatagtccttgatgtatgcgacagctcctgcgagttaatgatccccaaaggtacaggcgatatcctcgtcgactgctccggcggccaacaacacttcctacaaaacaacctgatcgatctagggtgcccgaacgtcccacttctgggtaaaatggccatctacgtctgccgcatgagcaatcacccaaaaaccacaatggcgttcctattctggttctccttcgggtacgtcataacgtgcatagcctgccgcgtactgttttacctcctaatcgcaatcggcacagtaggaaagaaactcaaacaataccgcgaactcaaaccccaaacttgcatcgtgtgcgaaagcgtccccgtgaacgcaatcgacgctgaaatgcacgaactcaactgtagctacaacatatgtccttattgcgcctctcgattgtctaccgacggcctcatccgccacgtaacacagtgtccaaaacgccgagaaaaggtagaggaaacagaactctttctaaacctcgagagaatcccatggctagtccgaaaactacttcaagtcagcgaatccacagggatggccctcaaacgctcctgctggatgataaccctactaattctcctactcgtctccataagccccgtccaaagtgcacccgtcggccgcaaaccactattcctagactccacagctaaaggaatgaaatcgctcctcaattctacatcactagagacatcgctctcgatcgaagcgccatggggagccatcaacgtacaatccactttcaaacccaccgtgtccgcggctaacatcgccctctcatggtcgtccgtagaacaccgggggaacaagatcctcgtatctggccgctcagaatcaatcatgaagctggaagaacgcaccggagtctcctggaaccttggagtcgaagacgctagtgaaagcaagacactgacagtaagcgtcatggacctcagtcagatgtactctcccgtcttcgagtacctctcaggcgatcgacaagtcgaagaatggcctaaagcgacctgcaccggcgactgccccgaacgatgtggctgcacctcaagcacgtgcctacataaagaatggccccacagtcgcaactggcgatgcaaccctacttggtgttggggcgtcggaacaggctgtacctgctgcgggctcgacgtcaaagacttctttaccgactacatgctagtcaaatggaaagttgaatacataaagactgaagcaatcgtatgcgtagaactaaccagccaagaaagacaatgctcattaatcgaagcaggaacccgatttaacctcggcccagtaacgattaccctatccgaaccccggaacgttcaacaacgcttaccgcctgaaatagtgacacttcaccccaaaatcgaagagggtttcttcgacctcatgcacgtccagaaaattctcagcgcttccaccgtctgcaaacttcaatcgtgcacccacggcgtacccggagacttccaaatctatcacgtaggcaacctccttcgcggagataaagtcaatggccactccattcataaaatcgagccccacttcaacacttcatggatgtcctgggatggatgcgacctcgactacttctgcaacatgggcgactggcccagctgcacgtacacgggcgttacacaacacaaccgcgccgccttcatcaacatgcttaacatcgaaaccgactacaccaagacattccacttccacagtaaacgggtaacggcccatggcgacacccctcaactcgatctaaaagcacgccccgcctacggagccggcgaagtaaccgtgctggtcgaggtagccgatctcgaactgcacaccaagaaattggaggtctcgggactcaagatcgcatcattaacatgctctggatgctacgcttgctcaagcggcatctcgtgcaaagtgcggatccacgttaacgaacctgacgagttcacggttcacgtacgcagctcagaccccgacgtcgtcgccgccggaagctcacttatggcgcgaaaaatagagttcggcgccgattcgaccttcaaagccttcagcagcatgccaaaagactcactctgtttttacattgtcgaaaaagactattgcagctcatgcacagacgacgacacacagaaatgcgtcaacacaaaactcgaccatccacaatcaatcctcatcgaacacaaaggcactatcataggcaaacagaacgatacctgctccaccaaaacttcctgctggctagaatccgtcaaaggattcttctacggcctcaaaaacatgctctcaggaatcttcggcaacgtcttccttggcattttcctattcctcgcacccttcgtactcctcatcttcttcttcttcttcggctggcggctcctcttttgccttaaatgctgccgaagaacccgagggctcttgaaatataagcacctcaaagacgaagaagaagcgggctacaagaaaatcatcgaacgcctgaacggcaagaaaggaaaatcccagctattcgacggcgaacggctcgcggataggaaaatagcagaactgttttccactaaaatccacataggt

SEQ ID NO: 15525 - RNA, 2916 nt, synthetic construct
  misc_feature 1..2916: note = derived and/or modified CDS sequence (opt11) from CCHFV(Afg09-2990, Artificial)__HM452306.1__Gn-4aa-Gc
  source 1..2916: mol_type = other RNA
tcggaagaaagcggtgacgactgcatctctcgaacacaactactacggaccgaaaccgccgaggtccatggagacaactacggcggccccggagacaaaataacgatctgcaacggctcaaccgtcgtcgaccaacgtttaggttcggagctcggttgttatacaatcaaccgcgtaagatcgttcaaactctgcgaaaacagcgcaaccggcaaatcttgtgaaatagactccataccagtcaaatgcaaacaaggctattgcctcaaaatcacccaagaaggacgcggacatgtcaagctaagccgaggcagcgaagtcgtgctcgacgtttgtgacagcagctgtgaagtaatgatccccaaaggcacaggcgacatcctggtggactgctccggaggacaacagcactacctcaaggacaacctcgtggacctgggatgcccaaaaatcccgctactgggcaaaatggcgatctacatctgccgcatgtcaaaccaccccaaaacaaccatggccttcctgttctggttctccttcggctatgtcattacctgcatcctctgcaaagccatcttcttcctgctcatcattttcggcaccctaggaaaacgcttcaaacagtacagagaactcaaaccccagacctgcaccatctgcgaaaccacccccgtcaatgccatcgacgccgaaatgcacgacctaaactgctcctacaacatctgcccctactgcgcatccagactaactagcgacggcctcgcccgtcacgtcacgcaatgtcctaggcggaaagaaaaagtagaggaaaccgagctctacctaaacctagaacgtatcccatgggtagtacggaaactgctccaggtcagcgagagcactggaaccgtcctaaagcgttcctcctggcttattgtcctcctcgttctcttcacagtgtctctcagccctgtgcaatccgccccaattggtcgccgccctctcttcctagacagcatcgttaaaggaatgaaaaacctactcaacagcacaagcctagaaaccagcctttcgatcgaggctccctggggcgcaataaacgttcaatcaacctacaaacccacagtctccacagcgaacatagccctctcatggagctcagtcgaacacagaggcaacaaggtcctcgtgagcggccgcagcgaaagtattatgaaactagaggaacgaaccggtatcagctgggacctcggggtcgaggacgcctcagaatcgaaactattaaccgtcagcgtaatggacctctcccaaatgtattcaccagtctttgaatacctcagcggtgaccgccaagtcgaagaatggccgaaagctacctgcacaggtgattgccctgaacgctgcggatgcacctcctcaacctgcctacacaaagaatggccacactcacgtaactggcgctgcaaccccacatggtgttggggagtgggcaccggctgtacgtgctgcgggcttgacgtcaaagacctattcacagactacatgttcgtcaaatggaaagtagagtacatcaaaacagaagccatagtatgcgtggaactaaccagccaagaacgccaatgctctcttatcgaggcaggaacccgcttcaatctaggttcagttaccataaccctcagcgagccacgaaatatccaacaaaaacttccgccagaaataataacgctacaccccaaaatagaggaaggcttcttcgaccttatgcacgtccagaaggtcctctcagcatcgaccgtctgcaaacttcaatcatgtacccacggagtcccaggagacctccaggtataccacattggaaacctattgaaaggggaccgagtaaacggacacctcatacacaaaattgaacaacactttaacacctcctggatgtcatgggacgggtgcgacctagactactactgtaacatgggagactggccctcctgcacgtacaccggggtcacccaacacaaccatgcctccttcgttaacctcctcaacatcgagaccgactataccaaaaccttccacttccacagcaaacgggtaactgcccacggtgatacgccccaactcgacctaaaagcccgacccacctacggcgccggcgaaatcacagtcctcgtcgaagtagccgacatggaactccacacaaagaaaatcgaaatcagtggactgaagttcgccggactcacatgcaccggttgctacgcatgttcgagtggcattagttgtaaagtgcgaatccatgtcgacgaacccgacgaactcaccgtacacgtcaaatccgacgaccccgacgtagtagccgcaagcagctcgctgatggcacgtaaactcgagttcggaaccgatagcaccttcaaagccttctcagcgatgcccaagacttcactctgcttctatatagtagaacgggaatactgcaaatcgtgcagcaaagaagacacccaaaagtgcgtcaacaccaaactagaacaaccacaatccatcctaattgaacacaaaggcaccatcatcggaaaacagaacaacacatgcaccgccaaggcatcctgctggctcgaatcagtaaaatccttcttttacggcctcaaaaacatgctcggaggaatcttcggaaatgtgttcatcggcatcttcacctttcttacacccttcatcctactcatactcttcttcatgttcggctggcgcatactattctgcttcaaatgctgccgccgaacccgcggcctattcaaataccgacacctcaaagacgacgaagaaaccggctatagaaagatcatcgagcgcttaaacaacaaaaagggaaagaatagactactagacggcgaacgactagccgaccgaaaaatagcagaacttttcagcacaaagacacacatcgga

SEQ ID NO: 15526 - RNA, 2916 nt, synthetic construct
  misc_feature 1..2916: note = derived and/or modified CDS sequence (opt11) from CCHFV(Sudan Al-Fulah 3-2008, Artificial)__HQ378184.1__Gn-4aa-Gc
  source 1..2916: mol_type = other RNA
tccgaagaaccctcggatgattgcataagtcgcacacagctcctgagaaccgaaacagctgaaatccacggggacaactacgggggcccgggcgataaaatcacgatatgcaacggcagcaccattgtcgaccaaagactcggttccgaactcggctgctacacaatcaaccgggtcaaatctttcaaactttgcgaaaactccgcaaccggaaagtcctgcgtaattgactccgtacctgtaaaatgccgccaaggctactgcctcagaattacgcaagagggacgtggacacgtcaaactatcacgcggctccgaagtcgttctagacgcgtgcgacaccagctgcgaaatcatgatccccaaaggaacaggcgacatcctcgtcgactgcagcggcggccaacaacatttcctaaaagacaacctcgtcgacctaggctgcccgaaaataccactcctcggcaaaatggccatctatatatgtcgcatgagcaaccacccaaaaacgacaatggcattcctcttctggttctccttcggctacgtaatcacatgcatcctctgtaaagccatcttttacctgctaataatcatcgggaccctcggcaaaagattccgccaataccgtgaactaaaaccccaaacctgcacaatctgcgaaacaactccggtaaacgccatagatgcagaaatgcacgacctcaactgtagttacaacatctgcccttactgcgcatcacgtctgacctctgacggactagcgcgccacgtcacacagtgcccaaagcggaaagaaaaagtcgaagaaacagaactgtacctcaacctcgaacggatcccatgggtagtccgtaaactactacaagtgtcagaatctaccggtgtcgccctaaaacgcagctcctggctaatagtcctcctagtactcttcaccgtctccctgtcccctgtccaatccgccccaatcggacgacgccccctgttcctcgacagcatcgtgaagggaatgaagaacctcctcaactcgacctcgttggaaaccagcctctccatagaagcaccctggggtgctatcaacgtgcaatccacctataaacccaccgtctccacagcaaacatcgcgctaagctggtcttcagtcgaacaccggggaaacaaaatcctagtgtctggccgctccgaatcaatcatgaaactggaggaacgaaccggcatttcgtgggacctcggagtagaagacgcatccgaatcaaaactactcacagtctccgtaatggacctctcacaaatgtacagtcccgtcttcgagtaccttagcggagacagacaagtagaagagtggccaaaagcaacatgcacaggtgactgcccagagcgctgcggttgtacctccagcacatgcctccacaaggaatggccccactcccgcaactggcgctgcaatcccacctggtgctggggtgtcggaacaggctgtacctgctgcggcctcgacgtcaaagacctattcacagactacatgtttgtcaagtggaaagtggaatacattaaaaccgaagcgatcgtatgcgttgaactcacctcacaagagcgtcaatgctcccttatcgaggcgggcacgcgattcaacctgggacccgttaccataaccctgtccgaaccccgtaacatccaacaaaagctgcccccagaaatcatcaccctccacccccgcatcgaagaaggcttcttcgacctcatgcatgtacaaaaagtactatcagcctctacggtctgcaaactacaatcttgcacccacggagtaccaggcgacctacaagtataccacataggcaacctcctcaagggcgacaaagtcaatggacatctcatccataagatagagccccacttcaacacctcgtggatgtcctgggacggatgcgacctagattactactgcaacatgggagactggccaagctgcacctacacgggagtcacccagcacaaccatgccagcttcgtcaatctactgaacatcgaaacagattacacgaaaaatttccactttcacagcaaacgcgtaacagcccacggagacacaccccaactagacctaaaagcaaggccaacctacggcgcaggagaaatcaccgtcctagtagaagtcgcggacatggaactccacacaaagaaaatcgagatctcaggcctcaaattcgcctccctaacgtgcacaggctgctacgcctgcagctcgggtatctcatgcaaagtccggatccacgtcgatgaaccagacgagctaacggtccacgtaaaaagcgatgatcccgacgtcgttgcagcctcaagctccctaatggcgaggaaactcgagttcggcaccgactcgaccttcaaagcgttctcagcaatgcccaaaacctccctctgcttctacatagtcgaaaaagaatactgcaagagctgcagcgaagaggacactaagaaatgcgtcaacaccaaactcgagcagcctcaaagcattctaatagagcacaaaggcactatcattggcaaacaaaactcaacctgcactgcaaaagtcagttgctggctcgaaagcgccaaatcattcttctacggcctgaaggacatgctctccggcatcttcggcaacgtcttcatcggcatctttctcttcctagcccccttcgtcctacttgttctgttctttatgttcggatggcgcatactcctgtgcttccgttgctgccggcggacccgaggcctctttaaataccgtcacctaaaagacgacgaagaaaccggataccgccgcatcatcgaacgcctcaacaacaagaagggcaaaaacaaactcctggacggagaacgcctggctgaccgaaaaatagccgaactcttctccactaaaacgcacataggc

SEQ ID NO: 15527 - RNA, 2916 nt, synthetic construct
  misc_feature 1..2916: note = derived and/or modified CDS sequence (opt11) from CCHFV(Sudan AB1-2009, Artificial)__HQ378187.1__Gn-4aa-Gc
  source 1..2916: mol_type = other RNA
tccgaagaaccatcagatgattgcatcagcagaactcagctcctaagaactgaaaccgccgaaatccacggcgacaactacggcggccccggggacaaaatcaccatctgcaacggatccacgatcgtggaccagaggctgggcagtgagctcggctgctacactataaaccgcgtcaagtccttcaaactctgcgaaaacagcgcaacagggaaaaactgcgaaatcgactccgtacccgtaaaatgccgccaaggttactgcttacggataacacaagaaggccgcggccacgtaaaactgtcacgcggctccgaagtcgtcctagatgcctgcgacacctcatgcgaaatcatgatcccaaaaggaacaggagacattctcgtggactgctctggaggccagcaacacttcctaaaagacaacctgattgacctcggatgtcccaaaatccccctcttaggcaaaatggccatatacatctgccgcatgagtaaccaccccaagaccacgatggccttcctattctggttctcgttcggctacctcataacatgcatactatgcaaggctattttctacctcctgatcatcatcgggacactcggcaagcgtctgaaacaatatcgcgaactaaagccccaaacctgcaccatatgcgaaaccactccggtgaacgccatcgacgcagaaatgcacgacctcaactgcagctacaatatatgcccctattgcgccagccgcctcactagcgacggcctcgcacggcacgtaattcagtgcccgaagcgcaaagaaaaagtggaagagacggaactctacctaaacctcgagcgcataccctgggtcgttcgaaagctccttcaagtgagcgagtcaacaggggtcgcacttaaaaggtcctcctggctaatcgtcctattagtcctcttcaccgtatccctaagccccgtacaatcggcccccatcgggaggaaacccctgtttctagactccatcgccaaaggaatgaaaaatctcctcaattcgacatcccttgagacgtccctatccatcgaagccccttggggagccataaacgtccaatcgacctacaaacctacagtatccacggcaaacatagccctttcatggtcctccgtagaacaccgtggcaataaaatcctggtgtcgggacgttccgaatctataatgaagttagaagaacgaaccggaattagctgggatctgggcgtggaagacgcaagcgaatctaagttactgaccgtctccgtcatggaccttagccaaatgtactcccccgtgttcgaatacctctcaggtgaccgccaagtcgaagaatggcccaaagcgacatgcacaggcgactgtccagagcgctgtggctgcacaagcagtacctgcctccacaaagaatggccacactcgcggaactggcgctgcaacccaacatggtgctggggcgtcggcaccggatgtacctgctgcggtctagatgtcaaagacctcttcacagactacatgttcgtgaaatggaaggtggagtacatcaaaaccgaagccatagtatgcgtagaactcacatcacaagagcgacagtgctccctaatagaagcgggaacgcgcttcaacctaggccccgtaaccatcaccctctccgaaccacgaaacatccaacaaaaactgccacccgaaatcataacactccatcccagaatagaagaaggcttcttcgacttaatgcacgtacaaaaggtcctctccgcttcaaccgtctgcaagctacaatcctgcacgcacggtgtacccggcgacctccaagtctaccacatcggcaacctcctcaaaggagacaaggtcaatggacacctcatccacaagatcgaaccccacttcaacacgagctggatgtcctgggatggttgcgatctcgattactactgtaacatgggcgactggcccagctgcacctacaccggagtcacacaacacaatcacgcctctttcgtcaacctactcaacatcgaaacggactacaccaaaaactttcacttccactcgaaacgcgtcacagcacatggcgacacgccccaactcgaccttaaggcgaggccgacctacggagccggagaaatcaccgtcctagtcgaggtcgcagacatggaactccacacgaagaaaatcgaaatctctggcctcaaattcgcttccctgacctgcacaggctgctatgcatgctcaagcggcatctcctgcaaagtacgcatacacgtggatgaacccgacgaactcacggtccacgtcaaatccgacgacccagatgtagtcgccgcctcgtcctcacttatggcaagaaaacttgagttcggcacggactcaacgttcaaagccttcagtgccatgcccaaaaccagcttatgcttctacatagtagaacgcgaacattgcaaatcatgcaatgaagaagacaccaaaaagtgcgtcaacacaaaactagaacaaccccaatccatcctaatcgaacacaaaggcaccataatcggcaagcaaaattccacatgtacagcccgagcatcatgctggctcgaatcggtcaaatcattcttctacgggcttaaaaacatgctctcgggcatattcggaaacgtattcatgggcatattcctcttcctagcccccttcatcctgctcatcctattcttcatgttcgggtggcgcatcttattctgcttcaaatgttgccggcgaactcgcggactcttcaagtaccgccacctgaaagacgatgaggagaccggataccgccgcatcatcgaacgactgaataacaagaaaggcaaaaataaactactcgacggcgaaaggctcgcagaccggcgcatcgccgaactattctccactaaaacacacatcggc

SEQ ID NO: 15528 - RNA, 2916 nt, synthetic construct
  misc_feature 1..2916: note = derived and/or modified CDS sequence (opt11) from CCHFV(NIVA 118595, Artificial)__JN572083.1__Gn-4aa-Gc
  source 1..2916: mol_type = other RNA
tcggaagaatccggcgacgactgcatctcccgcacccaactcctccgaaccgagacagccgaggtccacggagacaattacggaggacccggcgacaaaataaccatctgcaacggctcaactgtcgtcgaccaacgcctaggatcagaactcgggtgctacaccataaatcgggtcaaatcattcaaactctgcgaaaactccgccactggaaaatcctgcgagattgactcgatccccgtaaaatgccgccaggggtactgcctcaaaatcactcaggaaggcaggggacacgtcaaacttagtagaggcagcgaagtagtgctcgacgcatgcgactccagctgcgaggtcatgatacccaaaggaaccggcgacatcttagtcgactgctcaggcggacaacaacacttcctcaaagacaacctaatcgacctcggctgcccgaaaatcccccttctcggtaaaatggccatatacatatgcaggatgtcaaaccaccctaaaaccacaatggccttcctattctggttctcattcggctacgtcattacctgcatcctctgcaaagtgatcttctacctcctaataatatttggaacactcggaaaacgctttaagcaataccgcgaactcaaaccgcaaacctgcacaatctgcgaaacaacaccggtaaacgccatcgacgcggaaatgcacgacctaaactgtagctacaatatatgcccctactgcgcctcccgcctaactagcgacggcctagcccgccacgtcacccaatgcccaaagcgcaaagaaaaagtcgaagaaaccgaactttacctcaacctcgaacgaatcccctgggtagtacgcaaacttctccaagtcagcgaaagcacaggaatagcactcaaacgctcctcatggctaatagtactgctggtactcttcaccgtgtctatcacccccgtacaatccgccccaataggacgccgtcccctattcctcgattccatagtcaagggaatgaagaacctactaaattctacgtccctcgaaacatcgctaagtatcgaggctccctggggtgccattaacgtccagtcaacctacaaacctacagtatctgcagccaatatagccctctcctggtcgtccgtcgaacaccgcggaaacaaaatactggtcagcggacgaagcgagtccatcatgaaacttgaagaacgcaccggcatcagctgggacctcggcgtggaagacgcgagcgaaagcaaactccttacagtctcagtgatggacctcagccaaatgtactcacctgtcttcgagtatctcagtggagaccgacaggtggaggaatggcctaaagcaacatgcacaggagactgtccggaacggtgcggctgcacaagctccacgtgcctccacaaagaatggccgcactcacgcaattggcgctgcaaccccacctggtgttggggtgtagggaccggttgcacatgctgcggcctagatgtcaaagacctattcacagactacatgttcgtgaaatggaaagtcgagtacataaaaactgaggctatagtgtgcgttgaattgacctcccaggagagacaatgcagcctaatagaagcaggcacgcgattcaacctcggctccgtaaccataacactaagcgaaccccgcaacatccaacaaaaactcccacccgaaatcataaccctccacccccgcatagaggagggcttcttcgaccttatgcatgtccagaaagtcctctcggcgtccaccgtatgcaaactacagagttgcacccacggggttcccggggatcttcaagtataccacatcggaaacttgcttaaaggtgaccgagtcaacggccatctaatccacaagatagagcaacacctcaacacatcctggatgtcctgggacggctgcgatctcgactattactgcaacatgggcgactggccttcctgcacatacaccggcgtaactcagcacaaccacgccagcttcgtcaacctactcaatatcgagacagactacaccaagacgttccatttccatagcaaacgcgtcacagcacacggagacacaccccagctagaccttaaagcccgacccacctacggtgccggtgaaatcaccgtcctagtagaagtagcagacatggaactccacacaaagaaaatcgaaatctccggcctaaaattcgcctccctatcctgcacgggatgctacgcctgttcatcaggcatatcctgcaaagtccgaatacatgtcgacgagccagacgagttaaccgtccacgtcaaatcagacgacccagatgtagttgctgccagcagctcactgatggcacgcaaactcgaaagcggaaccgacagcacattcaaagccttcagcgccatgccgaaaacctccttatgcttctacattgtcgaacgggaatactgtaagggctgctccaaagaggacacccaaaaatgcgtgaataccaagctagaacagcctcaaagcatccttatcgaacacaaaggaaccatcataggaaagcaaaacaatacctgcaccgctaaggcttcatgctggttagaatccgtcaaatcgttcttctacggactcaagaacatgctgtccggcatcttcgggaacgtcttcctagggatattttcctttctcgccccatttgtactgctcattctcttctttatgtttggctggcgaatactattctgctttaaatgttgccgacgaacacgtgggctgttcaaataccgacacctaaaagatgacgaagaaaccggctaccgaaaaataatcgagcgcctcaacaataagaaaggcaaaaacaaactactggacggcgaacgactcgcggacagaaaaattgccgagctcttttcgacaaaaacccacatcggc

SEQ ID NO: 15529 - RNA, 2916 nt, synthetic construct
  misc_feature 1..2916: note = derived and/or modified CDS sequence (opt11) from CCHFV(NIV 112143, Artificial)__JN572085.1__Gn-4aa-Gc
  source 1..2916: mol_type = other RNA
tctgaggagtccggagacgactgcattagccgcacccagctgctgcggacagagacggccgaggtgcacggcgacaactatggcgggcccggagacaaaataacaatttgcaacgggtccaccgtcgtcgaccagagactcggcagcgagttgggctgctacaccataaaccgggtgaagtccttcaaactttgcgagaacagcgccacggggaaatcgtgcgaaatcgactcgatcccggtcaagtgccgccagggttactgcctgaaaatcacccaggaggggcggggccacgtgaaactgtctcgcgggagcgaggtggtactcgacgcgtgcgactccagctgcgaggtaatgatccccaagggcaccggcgacatattggtggactgctccgggggccagcaacacttcctcaaggacaacctcatcgacctggggtgccccaagattccactgctcggcaagatggcaatatacatctgtaggatgagcaaccacccgaagacaaccatggccttcctgttctggttctcgttcggctacgtcatcacgtgcatactgtgtaaggtaatcttctacttactgatcatcttcgggaccctgggaaagcggttcaagcagtaccgggagctgaagccccagacctgcaccatctgtgagaccaccccagtgaacgccatagacgccgagatgcacgacctgaactgttcttacaacatctgcccctattgcgccagtcgcctgacctccgacgggcttgcccggcacgtcacgcagtgtccgaaacgcaaggagaaggtcgaggagaccgaactgtacctgaacctcgagcgtatcccctgggtggtccgcaagctgcttcaagtctccgagagcaccggcatcgccctcaagcggtcgtcatggctgatcgtcttacttgtcctattcaccgtaagcatcacgccggtgcagtccgcccccatcgggcgccggccgctgttcttggacagcatcgtcaagggcatgaagaaccttttgaacagcacgagcctcgagacctccctgagcattgaggcgccctggggtgccatcaatgtacagtctacctacaagcccacggtgagcgccgccaacatcgccctgtcctggtcttccgtcgagcaccgcgggaacaagatcctcgtgagcggccggtccgagagcatcatgaagctggaggagcggaccgggatctcctgggacctgggcgtcgaggacgcaagtgagtccaagctactgaccgtgtccgtgatggacctgagccaaatgtactcccccgtcttcgagtacctaagcggggaccggcaggttgaggagtggcctaaggcgacatgcacgggtgactgccccgagcggtgcggctgcacatccagtacgtgcctgcacaaggagtggccccactccagaaactggcgatgtaacccaacctggtgctggggcgtggggaccgggtgcacgtgctgcggcctggacgtcaaggatctcttcaccgactacatgttcgtgaaatggaaggtggagtacatcaagaccgaggccatcgtctgtgtggaactgaccagccaagaacgccagtgctccttaatcgaggcggggacgcggttcaacctgggcagcgttaccattaccctctccgagccgcgcaacatccagcagaagttgccgcccgagatcatcaccctgcacccccggatcgaagagggcttcttcgacctcatgcacgtccagaaggtactgagcgcatccacggtgtgcaagctgcagagctgcacccacggagtccccggcgacctccaggtctaccacatcgggaacctgctgaaaggcgaccgggtgaacggccacctcatccacaagatcgaacagcacctgaatacgtcctggatgagttgggacgggtgcgacctggattattactgcaacatgggcgactggccctcctgcacctatacaggggtcacccaacacaaccacgcttcattcgtgaacctcctgaacatcgagaccgactacaccaagacgttccacttccattccaaacgggtcaccgctcacggcgacacgccccagctggacctcaaggcgcgacctacctacggggccggcgagatcaccgttctggtagaggtggcagatatggagctacacaccaagaaaatcgagatcagtggcctcaagttcgcatcactttcctgcaccgggtgctacgcctgcagttcgggaatcagctgtaaggtccggatccatgtggacgagccggacgaactgacggttcacgtcaagtctgacgaccccgacgtagtggccgccagctcctccctcatggcccgcaagctggagttcgggaccgactccacattcaaggcgttcagcgccatgcccaagacgagtctgtgtttctacatcgtggagcgggagtactgcaaggggtgcagcaaggaggatacacagaaatgcgtgaacaccaagctcgagcagccgcagtccatcctgatcgagcacaaagggaccatcatcgggaagcagaacaacacgtgcaccgccaaagccagctgctggctggaatccgtaaagagcttcttttacggccttaagaacatgctctccgggatcttcggcaacgtgttcctggggatcttctctttcctcgcaccctttgtcctgctcatcctcttctttatgtttggctggcgtatcctgttctgcttcaagtgctgccggcgcaccagggggctctttaagtaccgccatctaaaggacgatgaggagacagggtaccggaaaattatcgagcgcctgaacaacaaaaagggtaagaacaaactgctcgacggagagcggctggccgaccgaaagatcgccgagttgttctccactaagacccacatagga

SEQ ID NO: 15530 - RNA, 2916 nt, synthetic construct
  misc_feature 1..2916: note = derived and/or modified CDS sequence (opt11) from CCHFV(SCT ex Afghanistan, Artificial)__KC344856.1__Gn-4aa-Gc
  source 1..2916: mol_type = other RNA
agcgaggagtccggcgacgactgcattagccgaacccagctcctacggaccgagacggccgaggtgcacaacgacaactacggcggcccgggggacaagatcaccatctgcaacggctccaccatcgtcgaccagcgcctggggagcgagcttggatgctacaccatcaaccgggtcaagtccttcaaactgtgtgagaacagcgcgacgggcaagtcctgcaagatcgacagcacacccgtcaagtgtcgccaggggttctgcctgaagatcacccaggagggccgggggcacgtcaaattgtcccggggcagcgaggtggtgctcgacgcgtgcgactcctcctgcgagatcatgatccccaaggggaccggtgacatcttagttgactgctccggcgggcagcagcacttcctgaaggacaacctcattgacctgggctgccccaacatccccctgctcgggaagatggccatctacatctgcagaatgagcaatcacccgaagacgaccatggccttcctgttctggttctcctttggctacgttatcacgtgtatcttctgtaaggtgatcttctacctgctcatcgtcgtgggcaccctaggtaagaagttcaagcaataccgcgagctgaagcctcagacctgcaccatctgcgagaccacccccacgaacgccatagacgcagagatgcacgacctcaactgcagctacaacatctgcccctactgtgcgtccagactaacaagcgacggtctggcccgccacgtgacccaatgccccaagcggaaggaaaaagtcgaagagaccgagctctacctgaacctggagcgaatcccgtggatcgtgcggaagctcctccaagtgagtgagagcacgggtgtagccctcaagcggagctcctggctcatcgtgctgctagtgctcctgaccgtctcgctgtcccccgtgcagagcgccccaatcggacggaagcccctcttcctgaactccatcgtgaaggggatgaagaacctgctcaacagcaccaacctggagacctccctgtcgatcgaggccccctggggcgccatcaatgtccagtcaacgttcaaacccaccgtgtccaccgccaacatcgccttgtcctggtcgtccgtcgagcaccgcggcaacaaaatcctggtctccgggcggtccgagagcatcatgaagctcgaggagaggaccggcatctcctgggacctcggggtggaagacgccagcgagtccaagagcctgaccgttagtgtgatggacctgtcacaaatgtactcacctgtgttcgaatacctctccggcgaccggcaggttgaggagtggccgaaggcgacctgcactggggactgccccgaacgctgtggctgcactagctccacgtgcctgcacaaggagtggccccacagccggaactggcgctgtaaccccacctggtgctggggcgtggggaccggttgcacgtgctgcggcttggacgtgaaggacttgtttaccgactacatgttcgtcaagtggaaggtggagtacatcaagacagaggccattgtgtgcgtcgaactgacctctcaggagcgccagtgctcgctgatcgaggccggcacccggttcaacttggggccggtgaccatcacgctctccgagccccgcaacatccagcagaaactcccgcccgagatcatcaccctgcacccgcggattgaggaaggctttttcgacctcatgcacgtgcagaaggtcctaagcgcctcgaccgtgtgcaagctgcagagctgcacccacggcgtgcccggggacctccaggtctatcacatcggcaacctgctgaaaggtgacaagctcaacggccacatgatccacaagatcgagccccacttcaatacgtcctggatgagctgggacggctgcgacctggactactactgcaacatgggggactggcccagttgcacctacaccggagtgacgcagcacaaccacgccgctttcgtgaacttacttaacatcgagacggattacacaaagaacttccacttccacagtaagcgcgtgaccgcccacggggacaccccgcagttagatctgaaggcccgtcccacgtacggtgcgggggagatcaccgtgcttgtggaggtcgctgacatggagttgcacaccaagaagatcgacatctccggcctgaaatttgcgagcctgacctgcgccggctgttatgcctgcagctccggcatcagttgtaaggtgcgcatccacgtggacgagcccgacgagctgaccgtccacgtgaaatccgaggacccggatatagtagctgcaagtacctccctgatcgcgcggaagctagagctgggcactgacagcaccttcaaagccttctccgccatgcccaagacgagcctgtgcttctatatcgtcgagcgcgagtactgtaagtcctgctcaaaggaggacacccaaaagtgcgttaacaccaagttagagcatccccaggggattctgatcgagcacaagggcaccataatcgggaagcaaaacgacacgtgcaccgccaaggcgggctgctggctggaatcagtcaagagcttcttctacggcctcaaaaacatgctgtccggaattttcggcaacgtgtttatcggcatctttctgttcctcgcccccttcgtgctgctcatactgtttttcatgttcggctggcggctgctgttctgcttcaagtgctgccgccggacccgcggcctcttcaaataccgtcacctaaaggaggacgaggaatcggggtaccgtcggatcatcgagcgcctgaacaacaagaagggcaagaataagctcctagacggcgagcggttagccgacaggcggatcgccgagctgttttccaccaagacgcacatcggc

SEQ ID NO: 15531 - RNA, 2916 nt, synthetic construct
  misc_feature 1..2916: note = derived and/or modified CDS sequence (opt11) from CCHFV(Zahedan 2007, Artificial)__KC867273.1__Gn-4aa-Gc
  source 1..2916: mol_type = other RNA
tccgaggagtccggcgacgactgcataagccgcacacaactactccgcaccgagaccgcggaggtacacggagacaactacggcggcccaggggacaaaatcaccatctgcaacgggtccaccgtcgtagaccaacggctcggcagcgaactcggctgctacacaatcaaccgagtccgttcgttcaaactctgcgaaaactccgcgacaggcaaatcatgcgaaatagactccatacccgtcaaatgcaaacaaggtttctgccttaaaatcacacaagaaggccgcggccatgtaaaactctcccgcggcagcgaagtggtccttgatgtctgcgactcgagctgcgaagtcatgatccccaaaggaacaggcgatatcctagtcgactgcagcggcggccaacaacatttcctcaaagacaacctagtagacctagggtgcccaaaaatcccgctattaggtaaaatggccatctacatatgccgcatgtcaaaccaccccaagaccacgatggcatttctcttctggttcagcttcggatacgtgataacctgcatcctatgcaaagccatctttttcctactcattatattcggcacccttgggaagcgcttcaaacaataccgcgaactaaagccacaaacgtgtactatatgcgagacaacgcccgtcaacgccattgacgccgagatgcatgacctaaactgctcctataacatctgcccatactgtgcaagccgtctcacatccgacggactggcccgacacgtcacgcaatgtccccgcagaaaagaaaaggttgaagaaaccgaactctacctcaaccttgagcgaataccgtgggtagtccgtaaactactccaagtatcagaaagcaccgggacggtcctcaaacgctcaagctggctcatcgtcctactcgtgctattcacagtcagtctctccccagtgcagagcgcccctatcggccgccgccccctcttcctggacagcatcgttaaagacatgaaaaacttactaaacagcacttccctagaaacctccctgagcatcgaggcaccctggggcgccatcaacgtacagtccacatacaagccgacagtcagcacagcaaacatcgctctctcatggtcgtccgtcgaacaccgcgggaacaaagtcctcgtctccggccggtccgaatcaattatgaaactcgaggagcgaacaggaataagctgggacctaggggtagaagatgcctcagagtcaaaactcctcaccgtctctgtcatggatctatcacaaatgtactcccctgtattcgaatacctgagcggagaccgccaggtagaggaatggcccaaagcgacctgcacaggtgactgccccgaacgatgcggatgcacgtcctccacatgcctccacaaagaatggccccacagccgcaactggcggtgcaacccaacctggtgctggggagtaggcaccggctgtacctgctgcgggctcgacgtaaaagacctcttcaccgactacatgttcgtcaaatggaaggtagagtacataaagacagaggcaatcgtatgcgtggagctcacctctcaagaacgccaatgctccctcatcgaagccggaacgcgattcaacctcggatcggtcaccatcaccctgtcagaaccccgaaacatccagcaaaagctacctccagaaataataaccctgcaccccaaaatcgaagaaggcttcttcgacctcatgcacgtgcaaaaggtcctttcagcgagtacagtatgcaagctccaatcctgcacacatggcgtaccgggcgatctacaggtgtaccacatcggcaacctactcaaaggcgaccgggtcaatggccacctaatccacaaaatcgaacaacactttaacacgagctggatgtcctgggacggatgcgacctcgactactactgcaacatgggagactggcccagctgcacctacaccggggtcacccagcacaaccacgcaagtttcgttaaccttctgaacatcgaaaccgactacacaaaaaccttccactttcattccaaacgggtcacggcccatggagacactccccagctagacctaaaagcaagacccacctacggcgccggcgaaatcaccgtactggtagaggtggccgacatggaactacacacaaagaaaattgagatctcaggccttaaattcgccggtctgacatgcacgggctgctatgcatgctcaagcggcataagctgcaaagtccgcatacacgtcgatgaaccagacgaactcacagtccatgtaaaatcggacgaccccgacgtagtagcagcctcctcctccctcatggcccgaaaactagagttcggcacagactcaactttcaaagccttctccgccatgcctaaaacatccctctgcttctacatcgtagaaagagaatactgcaaatcatgctcaaaagaagacacacaaaagtgcgtaaacaccaagctcgaacaaccacaatccatcctcatcgaacacaaaggaacgataatcggcaaacaaaacaatacctgcaccgccaaagcgtcttgctggctagaaagcgtcaagagctttttctacggactcaaaaacatgctagggggcatcttcggcaacgtcttcatcggtatattcacgttcctcactccgttcatactgctcatcttcttcttcatgttcggctggcggattctattctgctttaagtgctgcagacgaacacgaggcctcttcaagtaccgccacctgaaagacgacgaggaaaccggttaccgtaaaatcatcgaacgcctcaacaacaagaaaggtaaaaacagactcctagatggagagcgcctcgccgaccgcaaaatcgccgaactcttttcaacgaaaactcacataggt

SEQ ID NO: 15532 - RNA, 2916 nt, synthetic construct
  misc_feature 1..2916: note = derived and/or modified CDS sequence (opt11) from CCHFV(SPU 44/08, Artificial)__KJ682805.1__Gn-4aa-Gc
  source 1..2916: mol_type = other RNA
agcgaagaatccaacgacgactgcctgtcgcgcacccagctcctgcggacagagaacgccgagatccacagtgacaactacggcggcccaggcgacaagatcacgatctgtaacggaagcaccatcgttgaccagcgattgggctcggaactcgggtgctacactatcaatcgggtcaagagcttcaagctgtgcgaaaattcggccaccggaaaaagctgtgagattgactccacaccggtgcgctgtcggcagggattttgcctgaagatcacccaggagggacgcggtcacgtgaagctcagccgaggatccgaggtcgtgctggacgcctgcgactcttcctgcgagattatgatccccaaggggaccggggacatccttgtggactgcagcggcggccagcaacactttctcaaggacaacctggtcgaccttgggtgccccaacatccccttactgggcaaaatggccatttacatctgtcgcatgtcgaaccacccgaagaccacgatggccttcctgttctggttcagcttcgggtacgtaatcacatgcatactctgcaaggccatcttctatctgctgatcgtggtcggcacactcggcaagaaattcaagcagtaccgggaactgaaaccccagacctgcacaatatgcgagaccaatcccgttaatgccatcgacgcggagatgcacgacctgaactgttcgtacaatatctgcccgtactgcgccagccgcctcacttccgacggcctcgcccggcacgtcatgcagtgcccgaaaagaaaggagaagatcgaggaaacagagctctaccttaacttggagcgaataccctgggttgtgaggaagctgttacaggttagcgagagcacgggcgtcgccctaaagagatcatcgtggttggtgatcctcctggttttgcttaccgtcagcctcagccccgtgcagtccgcgcccatcagcagaaagccgcttttcctcgactccatcgtgaaggggatgaagaaccttctgaacagtacctccctggagactagcctgtccatcgaggcaccctggggcgccatcaacgtccaatcaacgtttaaacccaccgtgtcagccgcgaacatcgcgctgagctggtccagcgtggagcacagagggaataagatcctcgtctccggccgcagtgagtccatcatgaagctggaggagcgaactggcatttcttgggacctgggggtagaggacgcatctgagtccaagctcctgaccgtcagtgtaatggacctatctcaaatgtacagcccggtgttcgagtacctatcgggcgaccgacaagtcgaagaatggcctaaggccacgtgcaccggggactgccccgaacggtgcggttgcacctcctccacgtgcctgcacaaggagtggccccacagcaggaactggcgctgcaaccccacctggtgctggggcgtagggactggctgcacgtgctgcgggttggacgtgaaggacttgttcacggactacatgtttgtcaaatggaaagtcgactacatcaagaccgaggccatcgtatgcgttgaattgacctcccaggagcggcagtgctccctaatcgaggccggcacccgcttcaatctggggccggtgaccatcacactatccgagccccggaacatccagcagaagctaccgcccgagatcgtgaccctgcacccccgcatcgaggagggcttcttcgacctcatgcacatccagaaggtcctgtcggcgtccaccgtgtgcaagctgcagtcttgcacccatggtgtgcccggcgacctccagatctaccacattggcaacctgctgaagggggacaaggtaaacggccacctcatccataagatcgagccccacttcaacacctcctggatgagctgggacgggtgcgatcttgactactactgtaacatgggtgactggccctcctgctcctacaccggcgtcactcaacacaaccacgccgccttcgtgaacatgctcaacatcgagacagactacaccaagaacttccacttccacagcaagcgggtcacagcccatggggacactccccagctcgacctaaaggcccgccccacctacggcgcgggggagatcacggtgttagtagaggtcgccgacatggaactccacacgaaaaagatcgagatctccggcttaaagttcgcttcgctaacctgcaccgggtgctacgcctgcagtagcggcatcagctgcaaagtaagaatccacgtggacgagcccgacgagctcactgtgcatgtaaagagcgaggacccggacatcgtggccgcgtcatcctcgctgatggcccgtaagctggagttcggcacggactctacattcaaggccttctcggccatgcccaagacctcgctctgcttctacatcgtggagcgggagtactgcaagtcctgtagcaaggaggatacgcagaagtgtgtaaacacgaagttggagcagccccagtcaattctgatagaacacaaggggactatcatcggcaagcagaacgatacgtgcaccgcgaaggcctcctgctggctcgagtccatcaagagcttcttctacggtctgaagaacatgctgtccggaatcttcgggaatgtgttcataggcatcttcctctttctggcccccttcattatgctgatcctcttcttcatgttcggctggcgtatcctgttttgcttcaagtgctgcagacgcacacgtggactgttcaagtaccgacacctcaaggacgacgaagagataggctaccggaagatcatcgaacgcctgaacaataagaagggaaagaacaagctgctcgacggcgagcggctggccgatcgcaaaattgccgaactattctccaccaagacccacatcggg

SEQ ID NO: 15533 - RNA, 2916 nt, synthetic construct
  misc_feature 1..2916: note = derived and/or modified CDS sequence (opt11) from CCHFV(SPU 383/87, Artificial)__KJ682806.1__Gn-4aa-Gc
  source 1..2916: mol_type = other RNA
tcagaggaatccaacgacgactgcctgagccgcacccagctcctgcggaccgagaatgcggagatccactccgacaactacggcgggcccggcgacaagatcacgatctgtaacggcagcaccatcgtggaccagcgcctgggctccgagctcggatgctataccatcaaccgggtcaagagcttcaagctgtgcgagaactccgccaccggcaagagctgcgagatagactccacgccggtgcgctgtcggcagggcttctgtctgaaaattacccaggaggggcgcggccacgtgaagctcagccgggggtccgaggtcgtgctggacgcgtgcgacagctcctgcgagatcatgatccccaagggcaccggggatatcctggtggactgctctggcggccagcagcacttcctcaaggacaacctggtcgatctggggtgccccaacatccccctcctgggtaagatggccatctatatatgccgcatgtcaaaccaccccaagaccaccatggccttcctgttctggttctctttcgggtacgtgatcacgtgcatcctctgcaaggtgatcttctacctgctggtcgtggtgggcactctcggcaagaagttcaaacagtaccgggaactgaagccccagacctgcaccatctgcgagaccaaccccgtcaatgccatcgacgccgagatgcacgacctgaactgctcttacaacatctgcccctactgcgccagccgcctcacctccgatgggctggcccggcacgttatccagtgcccgaagcgtaaggagaagattgaggagaccgaactgtacctcaatctggagaggatcccctgggtggttcgcaagctgctccaggtgagcgagagcactggcgtagcccttaagcggtccagctggctggtcatcctcctggtgctgctcaccgtgtccctgagccccgtccagtccgcccccattagccgcaagccgttattcctcgactccatcgtgaaaggcatgaagaacctgctgaacagcacctccctcgagacctctctgtccatcgaggcgccctggggagccatcaacgtgcagagcacgttcaagcccaccgtctccgccgccaacatcgccctgagctggtccagcgtggagcacagagggaataagatactcgtctccggccgcagcgaatccatcatgaagctggaggagcggaccggcatcagctgggacctgggggtggaggacgcgagcgaatccaagctcctgaccgtgtccgtcatggacctgtcccagatgtacagccccgtgtttgagtacctctccggcgatcgccaggtggaggagtggccgaaggccacgtgtaccggagactgtccggagcggtgcggctgcaccagctccacgtgtctgcacaaagaatggccccacagccgcaactggcgctgcaacccaacctggtgttggggcgttgggaccgggtgcacgtgctgcgggctggacgtgaaggacctgtttaccgactacatgttcgtgaagtggaaggttgactacatcaagaccgaagccatcgtgtgcgtggagctcacctcccaggagagacagtgcagcctgatcgaggccggcacccgcttcaaccttggaccggtcaccatcacgctctccgagccccggaacatccagcagaagctgcctcccgagatcgtgaccctgcacccccgcatcgaggagggcttcttcgacctcatgcacatccagaaagtgctgagcgcctccaccgtctgcaagctgcagagttgcacccacggggtgcccggcgacctccagatctaccacatcggcaacttgctgaaaggggacaaggtgaacggccacctcatccacaagatcgaaccccacttcaacacctcctggatgagctgggacgggtgcgaccttgactactactgcaacatgggcgactggccctcctgcagctacacgggcgtcacacaacacaaccacgcggccttcgtgaacatgctgaacatcgaaaccgactacacaaagaacttccactttcacagcaagcgggtaacggcccacggggacactccccagctcgacctgaaggcccgccccacctacggcgctggggagatcaccgtcctggtggaggtggcggacatggagctccacacgaagaagatcgaaatctccggcctaaaattcgccagtctaacctgcacagggtgctacgcctgctccagcggcatctcttgtaaggtccggatccacgtggacgagccagatgagctcaccgtgcacgtcaagagcgaggaccccgacatagtggccgcctccagctccctgatggcgcgcaaactggagttcggcacggacagcaccttcaaggcgttctccgccatgcccaagacctccctctgtttctacatcgtggagcgggagtactgcaagtcctgctccaaggaggacacccagaagtgcgtcaacactaaactggagcagccccagtcgatcctgatcgaacacaaggggaccatcttcggcaagcagaacgacacgtgcaccgccaaggcgagctgctggttggagtccgtcaagagcttcttttacgggctaaagaacatgctgtccgggatcttcgggaacgtgttcatcggcgtgtttctctttctggcccccttcatcatgctgatcctcttcttcatgttcggctggcgcatcttattctgtttcaagtgctgccggcgcacccggggactgtttaagtaccgacacctcaaggacgacgaggagatcggctaccggaagatcatcgagcgcctgaataataagaaggggaagaacaagctgctagacggcgaacggctggccgatcggaagattgccgagctgttcagcaccaagacccacatcggg

SEQ ID NO: 15534 - RNA, 2916 nt, synthetic construct
  misc_feature 1..2916: note = derived and/or modified CDS sequence (opt11) from CCHFV(SPU 130/89, Artificial)__KJ682807.1__Gn-4aa-Gc
  source 1..2916: mol_type = other RNA
agcgaagaaccgaactatgactgcttgagccgcacgcaactcctccgcacagaaaacgcagagatccactccgacaactacggaggaccaggcgacaaaataacaatctgcaacggatccaccatcgtcgaccaacgtctaggctcagaactaggctgctatacaatcaacagagtaaagagcttcaaactctgcgaaaactccgctaccgggaaaagttgcgaaatcgactctacaccggtgcgctgccggcagggcttctgcctcaagatcacccaggaaggcagaggccacgtaaaattatcaagaggatcagaagtagtactggacgcctgcgactccagctgcgagatcatgatcccgaaagggaccggtgacatactcgtcgactgctctgggggccaacaacacttcctcaaggacaacctcgtcgacctagggtgccccaacatcccactccttggcaaaatggccatctacatctgccgaatgtcaaaccaccccaaaaccactatggccttcctgttttggttctcctttggatacgtcatcacatgtatcctctgcaaagtaatcttctacctactcatagtggttggcaccctaggcaagaaatttaaacagtacagagaactcaaaccacaaacctgcaccatatgcgaaaccaaccccgtaaacgccatagacgccgaaatgcatgatctcaactgctcatacaacatctgtccatattgtgcatcgagactcaccagcgacggcctcgcacgccacgtaatgcaatgccccaaaagaaaagagaaaatagaggaaacggaactgtacctaaaccttgaacggatcccatgggtcgtccgaaaattattacaagtatctgaatccaccggcgtagccctcaagcgctcctcatggctcgtcgtcctcctagttctactaacagtatcactatcacccgtccagtcagcgccgatctcacgaaaacccctgtccctagatagcattgtcaaaggcatgaaaaacctcctaaactcaacatctttggaaacgtccctatcaatcgaagccccctggggcgcaatcaacgtccagtccacattcaagcccaccgttagcgcagcaaacatcgccttatcatggtcatccgtcgaacaccgaggtaataagatcctggtgtcgggccgatccgagtcaataatgaaacttgaagaacgcaccggcatatcctgggacctaggcgtcgaagatgccagcgaatccaaactactaactgtatccgtgatggacctctcgcaaatgtactcaccagtatttgagtacctgtcaggcgacaggcaggtcgaagaatggcccaaagcaacgtgcacaggcgactgtcccgaaagatgcggctgcacctccagcacatgcttacacaaagagtggccccacagccgcaattggcgctgcaaccccacgtggtgctggggagtaggaaccggctgtacctgctgcggactcgacgtcaaagacctattcaccgactacatgttcgtcaagtggaaagtagactacataaaaaccgaagcaatcgtatgcgtcgaactcacatcccaagaacgccaatgctcactaatagaagccggcaccagattcaacctgggccccgtcaccataaccctaagcgaaccacgaaacatccaacaaaaactacccccagaaatcgtaaccctacatccgcggatcgaagaaggcttcttcgatctcatgcacatccaaaaagtcctctccgcctcgaccgtttgcaaactacaaagctgcacccacggcgtacctggcgacctacagatttaccacatcggcaatctacttaaaggtgataaagtcaacggccaccttatacacaaaatagaaccccacttcaacacctcctggatgtcgtgggacggttgcgacctagactactactgcaacatgggagactggccatcctgcagctacaccggagtcacccaacacaaccacgccgcattcgtcaacatgctgaacatcgaaaccgactacaccaaaaactttcacttccactcaaaacgagtgacagcccacggagatacccctcagctggatctcaaagcccgccctacgtacggcgccggagaaatcactgtccttgtagaagtagccgacatggagttacacacgaaaaaggtcgagatttcaggtctaaaattcgcatcattgacgtgcaccggttgctacgcctgctcctcaggcatcagctgcaaagtccgaatccacgtagacgaacccgacgaactcaccgtgcacgtgaaatccgaggatcccgacatagtagccgcttcttcctcgctcatggcacggaaacttgagttcggcaccgactcaaccttcaaggcattctcagcgatgcccaagactagcctctgcttttacatagtcgagcgcgagcactgtaaaagctgctctaaagaagacacccaacgttgcgtaaacacgaagctggaacaaccccagtcaatcttaatcgaacacaaaggaaccataattggaaaacaaaacgatacctgcaccgcgaaagcatcctgctggctcgaaagcatcaaatccttcttttacgggctcaaaaacatgctgtccggcatcttcggaaacgtcttcatcggcgtctttctgttcctcgcaccgttcattatcctaatactgttcttcatgttcggatggcgtatactgttctgcttcaaatgctgccgccgcacccgcggcctcctaaaataccgccacttaaaagacgacgaagaaatcggttaccgaaaaatcatagaaaggctgaacaacaagaaaggtaaaaacaagctcctagacggcgaaagactcgccgaccgcaaaatcgccgaactcttctccacaaaaacccacatcggc

SEQ ID NO: 15535 - RNA, 2916 nt, synthetic construct
  misc_feature 1..2916: note = derived and/or modified CDS sequence (opt11) from CCHFV(SPU 497/88, Artificial)__KJ682808.1__Gn-4aa-Gc
  source 1..2916: mol_type = other RNA
agcgaagaatcgaatgacgactgcctctcccggacccaactcctacgcacagaaaatgctgaaatccactccgacaactatggcggacccggcgacaaaattacaatctgcaacgggtccaccatagtggaccaacgcctaggaagcgaactgggctgctatacaatcaaccgcgtaaaatccttcaaactatgcgaaaactcagccactggaaagtcatgcgaaatagacagcacacccgtccggtgccggcaaggcttttgcctaaaaatcacccaagaaggaaaaggacacgtcaaactatcccgcggatcggaggtagtcctcgacgcatgcgactcatcctgcgaaatcatgatccccaaaggcaccggcgacatcctggtcgattgctccggagggcaacaacacttcctcaaagacaacctggtcgacctagggtgccccaacatcccactcttaggaaaaatggcaatctacatctgccgcatgtccaaccaccctaagaccaccatggtattcctattctggttcagcttcggctacgtcataacctgcatcctctgcaaagtcatcttctacctacttatcgtagtgggcaccctaggaaagaaattcaaacaataccgcgaactcaagccccaaacatgcactatctgcgagacaaacccagttaacgccatcgacgccgaaatgcacgacctcaactgttcatacaacatctgcccctactgcgcatcgcgcctcacatcggacggtctcgcaagacacgttatgcaatgtccaaaaagaaaagaaaagatcgaggaaaccgaactctacctcaaccttgaacggattccctgggtagtacgcaaactcctgcaagtatccgaatccaccggcgtcgccctcaaacgctcatcctggctcgtcatcctactcgtactccttaccgtctccctaagccccgtccaatccgcccccatttccagaaaacccctcttcctggacagcatagtaaaaggcatgcgcaacctcctgaactccacttcactcgaaacatcactatcgatagaagccccctggggtgcaatcaacgtccaaagcaccttcaaaccaacagtatctgcagcgaatatagcgctatcatggtcctccgtcgaacaccgagggaacaaaatactcgtaagcggccgcagcgagtccataatgaaactagaagaacgcacaggcatctcctgggacctcggagtcgaggatgcgtccgagtcaaagttactgactgtctccgtaatggacctctcacaaatgtacagccccgtcttcgaatatctaagcggcgatcggcaagtcgaggaatggcccaaagcaacctgtaccggagattgccccgaacgctgcggctgtacaagctccacgtgccttcacaaggaatggcctcacagccgaaattggcgctgcaacccaacctggtgctggggtgtaggaaccggctgtacctgctgcggcctagacgtcaaagacctcttcaccgactacatgttcgtaaaatggaaggtcgattacataaaaaccgaggcaatcgtctgcgtagaacttacaagccaagaacgccagtgctcactgatagaggctggtacccgcttcaacctcggacccgtcaccatcaccctttcagaaccacgcaatatacaacaaaagctgcccccagagatagtcaccctgcacccacgaatcgaagagggcttcttcgacttgatgcatatccaaaaagtactgtccgcctcaacggtctgcaagctacaaagttgcacccacggggtcccgggagacctacaaatctaccacatcggcaacctactcaaaggcgacaaagtcaacggacatttgatccacaaaatagagccacacttcaacacatcatggatgtcctgggacggttgcgatctagactactattgcaacatgggcgactggccctcatgcagctacaccggggtcacacaacacaaccacgctgcctttgtaaacatgctaaatatagaaacagactacaccaagaacttccactttcactcgaaacgggtaacagcacacggagacacgccacaactggacctcaaagcacgacccacatacggcgcgggcgaaatcaccgtcctcgtagaagtcgccgacatggaattgcacacaaagaaaatcgagatctccggtctcaagttcgccagtctaacctgcaccggatgctacgcctgctcaagcggcatatcctgcaaagtccggatacacgtagacgagcccgatgaactcactgtccacgtcaaatcagaagaccccgacatcgtcgccgcatcctcctccctaatggccaggaaactggagtttggcacagactccacattcaaagcattctctgcaatgcccaagacatctctctgcttctatatcgttgagcgagagtactgcaaatcatgcagcaaagaagacacccaaaagtgcgtcaacactaagctggaacaaccccaatccatcctaatcgaacacaagggaaccataataggtaaacaaaatgacacatgcacagcacgagccagctgctggctagagtccataaagagcttcttctacggactcaaaaacatgctatcaggtatctttggcaacgtcttcatcggtatcttcctctttttcgcaccattcataatgctaatcctcttcttcatgttcggctggcggatcctcttttgctttaaatgctgcagacgcacaagaggactattcaaatacagacatctaaaggacgacgaagaagtcggctaccggaaaataatagaaagactaaacaataagaaaggcaaaaacaaactactcgatggtgaacgccttgcagaccgaaaaatcgccgaactattctcaactaagacacacatcggc

SEQ ID NO: 15536 - RNA, 2916 nt, synthetic construct
  misc_feature 1..2916: note = derived and/or modified CDS sequence (opt11) from CCHFV(SPU 18/88, Artificial)__KJ682810.1__Gn-4aa-Gc
  source 1..2916: mol_type = other RNA
tccgaagagtcgaacgacgactgcctctcccgtacccaactcctccgcacggaaaacgccgaaatccacagcgacaactacggcggacccggggacaaaataaccatatgtaacggatccaccatcgtagaccaacgactaggtagcgaacttggatgctacaccataaaccgagtcaaatcattcaagctgtgcgagaactcagcaacagggaaatcgtgcgagatagactcgacgccagtacgctgccgacaaggattctgcctaaagatcacccaggagggacgagggcatgtaaaactgtcccggggaagcgaagtggtcctagacgcttgcgactcatcgtgcgagatcatgatacccaaaggcaccggcgacattctggtcgactgctccggaggccaacaacacttccttaaggataacctagtcgacctcgggtgccccaacattcctcttctaggcaaaatggccatctatatctgccggatgagtaaccacccaaaaaccacgatgggattcctgttctggttttcattcgggtacgtcataacctgtatactctgtaaggtcatcttctacctactcatagtagtgggcacgctagggaagaaattcaaacaataccgcgagctcaaaccccaaacatgcactatatgcgagacaaaccccgtaaacgccatagacgccgaaatgcatgacctaaactgcagctacaatatatgcccctactgcgcctcccgactcacgagcgacggcctagcccgccacgtaatgcaatgtcccaaacgcaaagagaaaattgaagagactgaactctacttaaacctcgaaagaatcccctgggtcgtccgcaaattattgcaagtcagtgaaagcacaggcgtagcgctcaaaagaagctcatggctagtcatactcctagtcctcctgaccgtcagcctcagtccagtacaatccgcacccatctcgcgaaaacccctattcttagactcaatagtaaaaggtaagaaaaacctactcaattcaacctcactcgagacctcattaagcatcgaggccccatggggagccatcaacgtccaaagcaccttcaaaccaacagtctcggctgccaacatcgccctcagctggtccagcgtcgaacatcgcggcaacaaaatcctagtgtccggcaggtccgaaagcataatgaaactcgaggaacgcactgggatatcgtgggaccttggagtcgaagacgcgagcgaatcaaaactactcacagtaagtgtcatggacctctcccaaatgtactccccagtattcgagtatctatcaggcgaccgccaagtcgaagaatggccaaaagccacatgcaccggcgactgccccgaaagatgtggatgcaccagctctacctgcctacacaaagaatggccacactcacgaaactggcgatgcaaccccacctggtgctggggcgtcggcaccggctgtacctgctgcggactcgacgtcaaagacctcttcaccgactacatgtttgtcaaatggaaagtcgactacatcaaaacagaagccatagtatgcgttgaactaacctcgcaggaacgccaatgctctctaatcgaggccggcactcgattcaatctcggaccggtcacaataactttatcagaaccccgaaacatccagcagaaactaccccctgagatagtgaccctacacccacgcatagaagaaggcttcttcgacctcatgcacatacagaaagtactaagcgcctcaacagtatgcaagctacaatcctgcacccacggtgtccccggagacctccaaatctaccacatcggcaatctactcaagggcgacaaggttaatggtcacctaatccacaaaatcgaaccacacttcaacacatcatggatgagctgggacggatgcgacctcgattactactgcaacatgggggattggcccagctgctcatacaccggcgtcacacagcacaaccacgcagcattcgtcaacatgctaaacatcgaaacagactacacaaagaacttccacttccactccaaacgggtcacggcacacggagacacaccacagctagaccttaaagcccgcccaacctacggcgccggagaaataaccgtcctcgtagaggtcgcagacatggaactacacaccaagaaaatcgaaatatccggattaaaattcgcctccctaacgtgcacaggttgttacgcatgcagtagcgggatctcctgcaaggtccgaatacacgtagacgagcccgacgagctcaccgtgcacgtcaaatcagaagacccagacatcgtagcagcctccagcagccttatggccagaaaactagagttcggcacagacagcacattcaaagccttctcagcaatgcccaaaacatccctttgcttctatatcgtcgaacgggaatactgtaagagctgcagcaaggaagacacccagaagtgcgtcaacacgaaactagaacaaccgcaatcaatcctcatcgaacacaaagggaccatcattggaaaacagaatgacacgtgcacaggcaaagcaggctgctggctagaatccatcaaatcgttcttctacggcctcaagaacatgctaagcggcatattcgggaacgtcttcataggcatcttcctgttcctagctccgttcataatgctgatcctgttctttatgttcggctggcgtatcctcttctgtttcaagtgctgcagacgcacgcgagggctctttaaataccgacacctgaaagacgatgaggaaatcgggtacaggaaaatcatagaacgccttaaaaacaagaaaggcaaaaataaactgctagacggagaaaggctggctgacagaaaaatagccgagctattcagcactaaaacgcacatcgga

SEQ ID NO: 15537 - RNA, 2916 nt, synthetic construct
  misc_feature 1..2916: note = derived and/or modified CDS sequence (opt11) from CCHFV(SPU 431/85, Artificial)__KJ682812.1__Gn-4aa-Gc
  source 1..2916: mol_type = other RNA
tccgaagaatccgacggagattgcataagcagaactcaactcctacgcacagaaaccacagaaatccacagcgacaactacggcggcccgggcgacaaaatcacgatatgcaacggcagcaccatcgtcgaccaacgactagggagcgagctcggctgctacaccattaaccgcgtaaaatcattcaagttatgcgaaaatagcgcaacgggcaaatcatgcgaaatcgactccacccctgtgaaatgccgacaaggcttctgcctgaaaataacccaagaaggacgcggacacgtcaaactgtcccgcgggtcagaaatagtcctggacgcatgcgactcaaactgcgaaatcatgattccaaaaggcacaggagacatcctagtagactgctccggcggccagcaacacttcctaaaagataacctgatagacctcggatgcccgaatatcccactgctaggaaagatggccatctacatctgccgcatgtccaaccatcccaagacaacaatggctttcctattctggttctcattcggctacgtaataacatgcatactttgcaaagtcatattctacttactaatcgtcgcaggcaccgtcggcaaaaagttcaaacaataccgcgagctacgcccccaaacctgcaccatctgtgaaaccatacccgtaaacgcaatcgatgcagaaatgcacgacttaaactgctcctacaacatctgcccctactgcgcctcacgcctaacatccgacggactcgccagacacgttatgcaatgcccaaaacgcaaggaaaaagtagaagagacagaactctacctaaacctcgagagaatcccctgggtagtacgcaaactgctccaggtatccgaatcgacgggggtcgccctcaaacgttcatcctggcttacggtccttctcgtgctcttgatagtcagcctctcccccgtccaatcagcacccataggacgaaagcccctattcctggactcaatcgttaaaggacggaaaaatctcctcaactcgacaagcctagagacctctctatccatcgaagcaccatggggagcaatcaacgtacagagcaccttcaagccaaccgtcagcgctgcaaacatcgccctatcatggtcttccgtcgaacacagaggaaataaaatcctagtctcaggccgatccgaatccataatgaagctcgaggaacgaaccggcataagctgggatctcggagtcgaagacgcaagcgaaagtaaactcctaacagtcagcgtaatggacctatcccagatgtattcccccgtatttgaatacctctccggcgaccgccaagtagaagaatggcccaaagctacctgcacaggagattgccccgaacgctgcggttgcacatcctctacatgcctgcacaaagaatggccacactctcgcaactggcgctgcaaccccacctggtgctggggcgtaggaacgggctgcacatgctgcggacttgacgtcaaagacctattcacggactacatgtttgtcaaatggaaagtcgaatacataaaaacagaggccatcgtctgcgtagaactaacctcccaggaacgccaatgctcgctaatcgaagctggcacacgattcaatcttggcccagtcaccatcaccttatcagaaccccgcaacatacaacagaaactacccccagaaatcattaccctccacccccggatagaagaagggttcttcgatctcatgcatgtgcaacgagtactctccgcctctaccgtctgcaaactacaatcctgcacacacggggtccccggagatctccaagtttaccacatcggcaacctactaaagggggacaaagtaaatggccatctcatccataaaatagagccccatttcaatacgtcctggatgtcctgggacgggtgcgatctcgactactactgcaacatgggcgactggccctcctgcacatatacaggagtcacacaacacaatcatgccgccttcgtaaatctcttgaacatcgagaccgactacaccaaaaacttccactttcactccaagcgtgtaacagcccacggcgacaccccacaactcgatcttaaagccaggcccacctacggcgccggcgaagtaaccgtcctagtagaggtcgccgacatggagctccacacgaagaaaatagagatatctgggctcaaattcgcctcgctgacctgtacgggatgctacgcctgctcaagcggaatctcatgtaaagtcaaaattcacgtcgacgaacctgacgaactcactgtccacgtcaagtccgaagaccccgacatagtcgccgcaggctccagcctcatggctcgaaagctcgaatttggagcggattcaactttcaaggcattctccgcaatgcccaaaactagcctctgcttctacatagtcgaacgggaatattgcaagtcctgcagccgggaagacacccgaaagtgcgtcaacacaaaactcgacagaccacaatccatcctcatagaacacaaaggtactataatcggcaagcagaacaacacgtgcactgcaaaagcctcctgctggctcgaaagcgtgaaaagtttcttctacggacttaaaaacatgctaagcggcatctttggaaacgtcttcatcggtatatttctattcatcgccccgttcgtcttactcatattgttcttcatgttcggctggcgcatactcttctgcttcaaatgctgtcgtcgaacaagaggcctgtttaaataccgtcacctcaaggacgacgaagaaacaggataccgcaaaatcatcgaaagactaaataataagaaaggcaaaaacaaactactggacggagaacgcctagccgacaggaagatcgccgaactcttcagcacgaaatcccacatagga

SEQ ID NO: 15538 - RNA, 2916 nt, synthetic construct
  misc_feature 1..2916: note = derived and/or modified CDS sequence (opt11) from CCHFV(SPU 48/90, Artificial)__KJ682813.1__Gn-4aa-Gc
  source 1..2916: mol_type = other RNA
tccgaagaaccatccgacgactgcatctcacgtacacagctcctccgaacagaaactgccgagatacacggcgacaactacgggggccccggcgataaaataactatctgcaatgggagcactatcgtagaccaacgactaggcagcgaacttggctgttacaccataaaccgcgtaaagtcattcaagctctgcgaaaactccgcgacaggcaaaagctgtgtcatagactccgtacccgtcaaatgtcggcaaggctattgcctccgaataacccaagaaggacgcggccacgtaaaactctcaagaggctccgaggtcgtcctcgacgcctgcgacacatcttgcgaaataatgatacccaaaggcaccggagacatactcgtcgactgctcgggtggtcaacaacacttcctcaaagacaacctgatcgatctcggctgcccaaaaatccccctcctgggcaaaatggccatatacatttgcagaatgagcaaccaccccaccacaacaatggcattcctcttctggttctcctttggatacgtaatcacttgcatactctgtaaagccatcttctacctcctcattatcataggtaccctgggaaaaagatttagacaataccgcgaactaaaaccacaaacatgcaccatctgcgaaacaacccccgtcaacgccatagacgcggaaatgcacgacctcaactgctcatacaatatctgcccttactgcgcctcacggctcacctccgacgggttagctcgccatgtgacccaatgccctaagcgcaaagagaaggtagaagaaacagaactatacctcaacctagagcgaataccctgggtcgtacgaaaactgcttcaggtaagtgagagcaccggcgtcgctctcaaacgatcctcctggctcatagtcctcctcgtcctctttaccgtatcactctctccagttcaatctgcccccataggacgaaaacccctcttcagagactcaatcgtcaagggaatgaaaaacctgctcaactctacatcactagaaacgtctctctccatagaagctccctggggcgcaattaacgtccaatccacgtacaaaccgaccgtgagcaccgccaacatcgccctctcctggtcctcagtcgaacacaggggcaacaaaatcttagtatccggacgatcggaatccattatgaaactcgaagaacgcactggaatcagctgggacctaggcgtggaagacgcgagcgagtcaaaactccttaccgtcagcgtcatggacctatcccaaatgtacagccccgtattcgaatacttatcaggtgaccgacaagtagaagaatggcccaaggccacatgcacaggtgactgccccgaacgatgcggatgcacatcaagcacatgccttcacaaggaatggccacattcccgaaactggcgatgcaatccgacctggtgctggggcgtgggcaccgggtgcacatgttgcggacttgatgtaaaagacctattcacagactatatgtttgtcaagtggaaagtcgaatacataaagacagaagccatagtctgcgtcgaactgacctcacaagaacgccagtgttccctcatagaagccggcacccgattcaaccttggacccgtcacaatcacactatctgaaccgcgtaacatccaacagaaactaccccctgagataatcacactacacccccgaatcgaagaaggcttcttcgacctcatgcacgtccaaaaagtgctcagcgcctccaccgtctgcaaactccaatcctgcacgcacggtgtccccggagatcttcaagtctaccacataggcaatctactcaaaggcgacaaagtcaatggtcacttaatccacaaaatagaaccacactttaacacctcctggatgtcctgggacgggtgcgaccttgattactactgcaacatgggcgactggcccagctgcacttacaccggagtcacacagcacaaccgcgcctcctttgtaaacctacttaacatcgaaactgactataccaagaacttccacttccactcgaaacgcgtcaccgcacacggcgatacgccccagcttgacctgaaagcccgacccacctacggcgcaggcgaaatcaccgtgctcgtagaagtcgcagacatggaactccacaccaagaaaatagaaatctcaggcctcaaattcgcctcactaacctgcacaggctgttacgcatgcagctccggtatttcgtgcaaagtccggatccacgtcgacgaacccgacgaactcacagtccacgtcaaatcagacgatcccgacgtagtagccgcgtccagcagcctcatggcacgcaaacttgagttcggcaccgactcaacgttcaaagcattctccgcaatgccaaaaacctccctctgcttctacatcgtcgaaaaagaatactgtaaaagctgctccgaggaagacaccaagaaatgcgtaaacaccaaactagaacaaccccaatccatactaatcgaacacaaaggcaccatcatcggcaaacaaaactccacctgtacggcgaaggtgtcgtgctggctcgaaagcgccaaatcgtttttctacggactcaaggacatgctctccggcatcttcggaaatgtattcatcggcattttcctctttctagcccccttcattctactcatcctgttctttatgttcggctggcgaatcctcctatgcttcaagtgctgtcggcgaacaagaggtctctttaaataccggcacctcaaagatgacgaggagactggataccgccgaatcatcgaacgcttgaacaacaaaaaggggaaaaacaaactgctcgacggagaaagactcgccgaccgtcgcatagccgagctcttttcaaccaagacgcatatcgga

SEQ ID NO: 15539 - RNA, 2916 nt, synthetic construct
  misc_feature 1..2916: note = derived and/or modified CDS sequence (opt11) from CCHFV(SPU 187/90, Artificial)__KJ682814.1__Gn-4aa-Gc
  source 1..2916: mol_type = other RNA
tccgaagaaccctccgacgactgcatttccagaacacagctcctccgaaccgaaaccgccgaaatacacggggacaactacggcggcccgggcgacaaaatcacaatctgcaatggaagcaccatcgtagatcagcgcctaggatccgaattaggctgctacaccatcaaccgcgtcaaaagtttcaagctctgtgaaaactcagccacaggcaaatcctgcgaaatcgattccgtacccgttaaatgcagacagggctactgcctccgcatcacccaggaaggccgcggccacgtcaaacttagtcgcggcagcgaagtagtcctcgacgcctgtgacacctcctgcgaaatcatgatcccaaaaggcaccggggacatactcgtagactgcagtggcggacaacaacacttcctaaaggacaacctcatcgacctcggatgccccaaaatccccctactagggaaaatggccatatacatatgcagaatgtcaaaccaccccaaaacgaccatggcgttcctcttctggttctcattcgggtacgtcataacgtgcatactctgcaaagcgatcttctacctgctcatcatcataggcaccctgggaaaacgtttcaaacaatatcgggaactcaaaccacaaacatgcacaatatgcgaaaccacccctgtgaacgccatcgacgccgaaatgcatgacctcaactgttcttacaacatctgcccctactgcgcctcacgcctgacctcagacgggctcgcccgccatgtcacgcagtgtccaaaacgaaaggaaaaagtagaggagaccgaactctacctcaatctggaaaggatcccgtgggtcgtacgcaaactcctacaggtctcagagtctaccggagtagccctaaaaagatcgtcatggcttatagttctcctcgtcctattcacggtctccttaagtccagtccaatccgccccaattggtcggcgacccctatttctagactctatcgttaaaggcatgaaaaacctgctaaactctacctccctagaaacctccctttcaatagaggctccctggggagccataaatgtgcaatcgacctataaacccaccgtctccaccgccaacatcgccctctcctggtcatccgtagaacaccgtggcaataaaatactggtctcgggaagatcagaatccatcatgaaactagaagaacgcaccggaatcagctgggatctaggcgtagaagacgcctccgaatcaaagctgctgacagtttccgtcatggacctaagccagatgtactcaccggtcttcgaatacctttccggggaccggcaagtcgaagagtggcccaaagcaacctgcacgggagactgccctgaacgttgcgggtgcacctcatcaacctgccttcacaaagaatggccacactcccgaaactggcgctgcaacccaacctggtgctggggtgttgggaccggatgtacctgctgcggcctagacgtaaaggacctcttcaccgactacatgttcgtcaaatggaaagtagaatacatcaaaaccgaagccatcgtgtgcgtagaattaacatcccaagaacgacaatgctcactcattgaagccggtaccaggttcaacctcggcccagttacaataaccctctcggaaccaagaaacattcagcaaaagctaccaccggaaattattaccctccacccgcgaatcgaggaaggcttcttcgacctcatgcacgtacagaaggtcctatcagcttccacggtctgtaaactacaatcatgcacgcacggggttccgggcgacttacaagtataccacatcggaaacctcctaaaaggagacaaagtcaatggtcatctcatacacaaaattgaaccacacttcaacacctcctggatgtcctgggacggatgcgatctcgactactactgcaacatgggcgactggccctcgtgcacctatacaggagtcacccaacacaatcacgcctccttcgtcaacctcctaaatatcgaaaccgattacaccaaaaacttccacttccacagcaagcgggtcacggcacacggagacactccccaactagaccttaaagcccgccccacatacggtgctggtgagatcactgtcctagtagaggtagcagacatggaacttcataccaagaaaatcgagatcagcggcctcaaattcgcctccctcacatgtacaggctgctacgcctgcagctcaggcatatcatgtaaagtccgtattcacgtcgacgagcccgacgaactgacggtccacgtcaaatccgacgaccccgacgttgtcgcagcctccagctcactaatggcacgcaaactggagttcggaactgactcgatcttcaaagcgttctctgccatgcccaaaacatccctctgcttttatatagtcgaacgcgaacactgcaaatcctgcagcgaagaagacactaagaaatgcgtgaacaccaaactcgaacaaccccaatccatcctaatagaacacaaaggcaccatcataggcaaacaaaactcaacgtgtaccgcgaaaacctcatgttggctcgagtccgtgaaatcattcttctacggcctcaagaacatgctgagtggaatcttcgggaacgtcttcattggcatattcctttttctcgctcctttcatactcctcattctattctttatgttcggatggcgcatccttttctgctttaaatgctgccgccgcactcgagggctattcaaataccgacacctaaaagatgatgaagaaacaggctaccgccgaatcatcgaacgactcaataacaagaaaggcaaaaacaaactcctagacggcgaacggctcgctgaccgccgcattgcagaactcttctccactaaaacccacatcggc

SEQ ID NO: 15540 - RNA, 2916 nt, synthetic construct
  misc_feature 1..2916: note = derived and/or modified CDS sequence (opt11) from CCHFV(Haskovo-V46/13, Artificial)__KR092379.1__Gn-4aa-Gc
  source 1..2916: mol_type = other RNA
agcgaagaactaggggacgactgcataagccgcacccagctcctacgaaccgaaaccgccgagatccatgacgacaactacggaggccctggcgacaagatcacaatttgcaacggcagcactatcgtcgatcaaagactcggcagtgaactcggatgttatacaataaaccggggtaagtcattcaagttgtgcgaaaactcagccaccggaaaaacctgcgaaatcgattcaacacccgtcaaatgcaggcaaggtttctgcttaaaaataacccaagaaggacgcgggcatgtcaaactaagccgcggatcagaggtcgttctggacgcctgcgacagctcatgcgaagtcatgatacccaaggggaccggcgatatattagtcgactgttccggcgggcaacaacacttcctaaaagacaatttgatagatttgggatgcccccacatacccctcctagggaaaatggcaatatacatctgccggatgagcaatcaccctcgcaccacaatggcattcctattctggttctccttcgggtacgtaataacctgcatcttctgcaaagcattgttctactccttaatcatcatcggcacactgggcaaaaagataaaacaatacagagaactaaaaccacagacctgcacaatctgcgagactactccagtaaacgcaatcgacgccgaaatgcacgacctaaattgctcatacaacatatgcccctactgcgccagccgcctcacaagcgacggcctcgcccgacatgtaacgcaatgtccaaaacgcaaagagaaagtggaagagactgagctatatctcaacctagaaagaataccctggatcgtcagaaaactcctacaggtcagcgagtcaaccggcgtagccctaaagcgctccagttggctcatcgtccttctcgtcctcctaccggtatccctctcccccgtccaatcagcccctgttggacgtaaacccctcttcctggactctatagtcaaagggatgaaaaatctactaaactcaacgtccctcgaaacctccctctcaatagaagcaccctggggagctatcaatgtccaaagcaccttcaaaccgacagtctcaaccgcaaacatcgccttaagctggagttccgtagaacaccgaggcaacaagatcctagtcaccggccggtctgaaagcatcatgaaacttgaagaacgcacaggggtctcgtgggacctaggagtcgaagacgcgagcgaatcaaaactcctaacagtatctataatggacctaagccagatgtacagccccgtattcgagtacctgagcggggatcggcaagtcgaggaatggccgaaagcaacgtgcacaggcgattgccctgagcgctgtggctgcacttcatccacatgcctccacaaagaatggccccactctcgtaactggcgatgcaatccaacatggtgctggggcgtaggtacaggctgcacatgctgcggcgtcgacgtaaaagacctcttcacagaccacatgttcgtaaaatggaaggtagagtacatcaaaacagaggccatagtctgtgtcgaactaaccagccaagaacgacaatgctccctcatcgaagccggaacacgcttcaatctcggcccagtcaccatcaccctatcagaaccacgaaacatccaacaaaaactcccacctgaaatcataaccctccacccaaaaatcgaagaaggcttcttcgacctcatgcacgtccaaaaggtcctcagcgcttccacggtctgtaaactccaatcgtgcacccacgggatcccaggagatctccaggtctaccacatcggcaatcttttaaagggcgaccgagtaaacggacacctcatccacaaaatcgagccccatttcaacacctcctggatgagctgggatgggtgcgacctcgactactattgcaacatgggcgactggccctcgtgcacgtacacgggtgtcacacaacacaaccacgcagccttcgtaaacctcctaaacatcgaaaccgactacacaaagacattccacttccactcaaagcgcgtaaccgcacacggtgacactccccaactcgacctaaaagcaagaccgacctatggagccggtgaaatcaccgtactcgtggaagtcgcagacatggaactccacaccaagaaagtcgaaatcagtggactcaaattcgcatccctcacctgtacagggtgttacgcctgcagcagcggtataagctgcaaggtccgcatccacgtagacgaacccgacgaactaaccgtccacgtcaagtcctcagacccagacgtcgtcgcagctggcacatccctcatggcccgaaaactagagttcggcacagactcgacattcaaagccttctcagcaatgcccaaaacatcactctgcttctacatcgtcgaacgcgaatactgcaaatcctgctcagaggatgacacccaaaagtgcgtcgataccaaacttgaacagccgcagagcatactcatcgaacacaaaggcaccattatcggaaaacaaaacgacacatgcaccgcgcgagccagctgctggctcgaatcagtcaaatcctttttctacggcctaaagaacatgctcggaagcgtatttggtaacttccttattggcatactactctttctcgcccccttcgtgctcctagtcctcttcttcatgttcggctggaagatcctcttttgctttaagtgctgccgtcgaacccgcggccttttcaaatatcgtcacctcaaggacgacgaggaaacgggataccgtcgcataatagaacgactcaactccaagaaaggaaagaacagactccttgacggggaacggctcgcagaccggaagattgccgaactattcagcacgaaaacccatatcggc

SEQ ID NO: 15541 - RNA, 2916 nt, synthetic construct
  misc_feature 1..2916: note = derived and/or modified CDS sequence (opt11) from CCHFV(24-R-2012, Artificial)__KR814856.1__Gn-4aa-Gc
  source 1..2916: mol_type = other RNA
agcgaagaacccggagacgactgtatcagccgaacccaactcctccgaaccgaaacggcagaaatccacgacgacaactacggtgggccaggagacaaaatcaccatctgcaacggctctaccatagtagaccaacgcctcggaagcgaactcggttgctacacaataaaccgggtgaaatcattcaaactctgcgaaaactccgcaacaggtaaaacatgcgaaatcgactccacccccgtcaagtgtcgccaagggttttgcctcaaaatcacacaagaagggcgcggacacgtaaaactatcacgtggatccgaagtcgtcctcgacgcctgcgatacaagctgcgaggtcatgatacccaaaggcactggagacatcctagtagactgctccggcggccagcaacacttcctcaaagacaacctcatcgatctcgggtgcccccacatccccctcctaggaaaaatggcaatatacatctgccgaatgtccaaccatcccaggacaaccatggcgttcctattctggttctcttttggctacgtcatcacttgtatattctgcaaagctctcttctactccctcatcataataggaacactaggcaagaaaataaaacaataccgagaactcaaaccgcaaacctgcacaatctgcgaaaccgcccccgttaacgctatagatgcagaaatgcacgacctgaactgtagctacaacatctgcccttattgcgcatcccgactcacatccgacgggctcgcccgacatgtaccacaatgccccaagcgaaaagagaaagtggaagaaacggaactatacctgaacctcgaacgcataccgtggatcgtacgaaaattactacaagtctccgaatccacgggcgtggcactcaaacgctcaagctggctcatagtccttctcgtactcctgaccgtcagcctatcacccgtccagtccgcccccgttggacgaaaacccctatttctcgacagcatcgtcaaaggaatgaaaaacctccttaactctacctccctcgagacctcattatctatagaggctccctggggcgcaatcaacgtccagtcaacctttaaacctaccgtatccacggcaaacatcgcactctcctggtcctccgtcgaacaccgaggtaacaagatcctcgtaacgggacggtccgaatcgataatgaaactagaggagcgaaccggagtctcgtgggacctcggcgtcgaggacgcatctgagagcaaactccttaccgtatcaatcatggacctatcacaaatgtactcccccgttttcgagtacctctcaggggaccgccaagtcgaagagtggcccaaggctacatgcacaggagactgccccgaaagatgtggatgcaccagctcgacatgtctacacaaggaatggccccacagccggaactggcgttgcaaccccacctggtgctggggcgtcggaaccggctgtacctgctgcggcgtcgacgtgaaagacctatttaccgaccacatgttcgtcaaatggaaagttgaatacataaaaacggaggccatcgtctgcgtagaactcaccagccaagaacgccagtgctcactaatcgaagccgggacacgcttcaacctgggaccagtcactatcaccctaagcgaaccgagaaacatccaacaaaaactcccacccgaaataatcaccctacaccccaaagttgaagaaggcttcttcgacctcatgcacgtccaaaaggtgttgtccgcatcgaccgtctgcaaactgcaatcttgcacacatggcattcccggtgacctccaagtctaccacatcggaaacctactcaaaggggaccgcgtaaacggccacctcatccacaaaatagagccgcacttcaacacctcatggatgtcgtgggacggctgtgatctcgactactactgcaacatgggagactggccctcatgtacctacacaggagtcacacaacacaaccacgccgccttcgtcaacctactgaacatcgaaaccgactataccaaaacgttccactttcactcaaaacgcgtcacagcccacggcgacaccccgcaactagacctcaaggccagaccaacctacggcgccggagaaattaccgtcctcgtcgaggttgcggacatggaactacacacaaagaaagtagaaatctccggactaaaattcgcctcgcttgcctgcacaggctgttacgcctgcagcagcggaatctcatgcaaagtcagaatacatgtggacgagcccgacgaactaacagtccacgtcaagagcaacgacccagacgttgttgccgcatccacttcactcatggctagaaaactggagttcggcaccgacagtactttcaaggcattctcagcaatgcccaaaacctctctttgcttctatatcgtagaaagagaatactgcaagtcatgcagcgaagaagacacccaaaagtgcgtcgacaccaaactagaacaaccgcaatcgatcctcattgaacataaaggcacaataattggcaaacaaaacgacacctgtaccgccaaggcttcctgctggctcgaatccgtcaaatccttcttctacggcctcaaaaacatgctcggctcagtcttcggcaacttcttcatcggcatactcctgttcctcgccccattcgtactactcgtcctcttcttcatgttcggctggaaaatcctattctgcttcaaatgttgcagaaggacacgaggtcttctcaaatacaggctactgaaagacgacgaggaaaccggataccgacgcatcatcgaacgcctcaacaacaagaaaggcaaaaaccgcctcctcgacggagaacgactagccgaccggaaaatcgccgaactcttcagcacgaaaacccacatcgga

SEQ ID NO: 15542 - RNA, 2916 nt, synthetic construct
  misc_feature 1..2916: note = derived and/or modified CDS sequence (opt11) from CCHFV(36-ST-2014, Artificial)__KR814857.1__Gn-4aa-Gc
  source 1..2916: mol_type = other RNA
tcagaagaacccggcgacgactgcatctcccggacccaactactgaaaactgaaaccgccgaaatccacgacgataactacggtggccccggcgacaaaataaccatctgtaatggcagcacaatcgttgaccaacgcctaggctcagaactgggatgctacactatcaaccgagtcaaatccttcaaattatgcgaaaactccgcaacaggtaaaacgtgcgagatcgactcaactcccgtaaaatgcagacaaggattttgcctcaaaataacacaagaaggaagaggacacgtcaaactcagccgcggctccgaagtagtcctcgatgcctgcgactccagctgcgaaatcatgatccccaaaggcacgggagacatactcgtcgactgctccggaggccaacagcacttcctcaaagacaacctcattgacctgggatgtccacacatccccctactcggcaaaatggcaatatacatctgcaggatgagcaaccacccccgaactaccatggcctttctcttctggttcagcttcggctacgtcataacctgcatattttgcaaagcactcttctactcactgatcataatcggaacactaggaaagaaaatcaaacagtaccgcgaactcaagccgcaaacatgcacaatctgcgaaacagcaccagtcaacgccatcgacgcagaaatgcacgacctcaactgctcctacaacatctgcccatactgtgctagccgcctaacctccgacggacttgctcgccacgtcacccagtgtccaaaacgaaaggaaaaagtcgaagagaccgagctctacctaaacctagaacggataccgtggatcgtccgcaagctcctacaggtcagcgagtcaacaggagtagccctaaaaagatcatcttggctaatcgtactgcttgtgctcctcacagtctcactctccccagtacaatccgctcccgtcggccgcaagcccctattcctggactccatcgtaaaaggcatgaaaaacctcctaaacagtacctccctcgaaacatccctttccatagaagccccttggggcgctatcaacgtacaatcaacgttcaaacccacagttagcacagccaacatcgccctatcatggtcctccgtcgaacacaggggaaacaaaatactcgttacaggcagatctgaatcaatcatgaaactcgaggaacgcacaggcgtctcctgggacctaggagtcgaggacgcatccgagtccaagctactgactgtgtcaatcatggacctctcccagatgtactcacccgtattcgagtacctatcaggagatcgacaagtagaagaatggccgaaagcaacctgcaccggagactgtccggaacggtgcggctgcactagcagtacctgcctccacaaagaatggccccactccaggaactggcgctgcaaccccacatggtgctggggcgtgggaacaggatgtacctgctgcggagtcgacgtcaaggacctattcaccgaccacatgttcataaaatggaaagtcgaatatatcaaaaccgaagccatcgtttgcgtcgaactcacatcacaagagcgccaatgcagcctcatcgaagccggcacgcgcttcaacctcggacccgtcaccataacactctctgaaccacgcaatatccaacaaaaacttccacccgaaatcatcacactccacccaaaaatcgaagagggcttcttcgacctcatgcacgtccagaaagtactatcggcctcgaccgtctgtaagctccagtcctgcacccatggaatcccgggcgacctacagatataccacatcggaaacctactaaaaggagaccgactgaatggccacctaatccacaagatcgaaccacactttaacaccagctggatgtcatgggacggatgcgatctagactactactgtaacatgggcgactggccctcctgcacgtacaccggcgtcacccaacataaccacgctgcattcgtgaaccttctcaacattgaaacagattacactaaaaccttccactttcactcaaaacgagtaacagcacacggcgacactccccagctagacctcaaggcaagacccacctacggtgcaggcgaaataacagtcctcgtcgaagtagcagacatggaactccacaccaagaaagtcgagatctccggcctgaaattcgcctctctagcatgtaccggctgctacgcatgctccagcggcatcagctgcaaagtccgaatccacgtggacgaacccgacgaacttacggtacacgtaaagtctagcgacccagacgtcgtcgccgcatccacctccctcatggccagaaaactagagttcggaacagacagcacctttaaagcctttagcgcaatgccaaaaacctccctgtgcttctatatagtcgaacgtgaatactgcaaaagctgctctgaagacgacaccaagaaatgcgtagacactaaactcgaccaaccccagtccatactcatcgagcacaagggaactataataggaaaacaaaacgacacgtgcacagccaaagcatcctgctggctcgagagcgtcaagtccttcttttacggcctcaaaaacatgctcggatccgtattcggcaacttcttcgtaggcatactcctattcctagcccccttcgtcctgctggtcctattcttcatgtgtggatggaaatttctcttctgtttcaaatgctgccgccgaacccgcggcctattcaaataccgtcacctcaaagatgacgaagaaacaggttacagacgaatcatcgaaagactcaactccaagaaaggcaaaaatcgtctactagatggcgagcgcctggctgaccgcaaaatcgccgaactgttctccaccaaatcccacattgga

SEQ ID NO: 15543 - RNA, 2916 nt, synthetic construct
  misc_feature 1..2916: note = derived and/or modified CDS sequence (opt11) from CCHFV(37-R-2013, Artificial)__KR814858.1__Gn-4aa-Gc
  source 1..2916: mol_type = other RNA
agcgaagaacctggcgacgactgcataagccgtacccaacttctccgaactgagaccgccgaaatccacgacgacaactacggcggccccggcgacaaaattacaatttgcaacggctcaacaattgtagaccaacggcttggaagcgaactaggctgctacacaatcaaccgggtaaaaagtttcaaactttgcgagaactctgccaccggaaagacatgcgaaatagattctactcccgtcaaatgccgccaaggattctgcctcaaaatcacacaagaaggccgaggacacgtaaaactgtcaagaggctcggaagtagttttggacgcgtgcgacacctcatgcgaagtaatgatacccaaaggcacaggagacatcctagtcgattgctcaggcggccaacaacactttctcaaagacaacctcatcgatctaggctgcccccatatccccctacttggcaagatggcaatttacatctgccgcatgtccaatcacccccgcaccacgatggccttcctcttttggtttagcttcggctacgtcataacctgcatcttctgcaaggccttattctacagccttatcatcatcggcaccctcggaaagaaaataaaacaataccgcgagcttaagccacaaacatgcactatatgcgaaacagccccagtaaacgcaatcgatgctgaaatgcacgacctcaactgctcatacaacatctgcccgtactgcgccagcaggctcaccagcgacggactcgcccgtcacgtcccacaatgccccaagcgcaaagaaaaagtagaagaaaccgaactatacctaaacctagagcgcataccctggatcgtacgcaaattactacaggtatccgaatccacaggcgtcgccctgaaacgatcatcttggctaatagtcctgcttgtcttacttaccgtaagcctctcccccgtccaatccgcgccggtcggccgcaaacccctgttcctcgattccatcgtaaagggcatgaaaaacctcctaaactcaacatcgctagaaacctccctttccatagaagcaccctggggagcaataaacgtacaatccaccttcaaaccaactgtctccaccgcgaacatcgccctctcctggagctccgtagaacatcgcggcaacaaaatactcgtaacaggcaggtcagaatcaatcatgaaactagaagaacgaacaggagtatcctgggacctaggggtagacgacgcatccgagtcaaagctcctcaccgtgtctataatggacctgtcccagatgtactccccagtctttgaatacctcagcggtgaccgacaagtagaagaatggccgaaagccacgtgcaccggagactgccccgaacggtgcggatgcacatcctcgacctgcctacacaaagaatggcctcatagccgaaactggcgatgcaatccaacctggtgctggggcgtgggcacaggctgtacctgctgcggcgtagacgtcaaagatctattcaccgaccatatgttcgtcaaatggaaagtcgaatacatcaaaaccgaagccatcgtatgcgtcgagctgacatcccaagagcgccaatgctccctcatagaagccggcacacgatttaacctgggaccagtaacaatcaccctatccgaaccacgaaacattcagcagaagctgccacccgaaataataaccctacaccccaaagtcgaggaaggctttttcgacctcatgcatgtacagaaagtactgagcgcctccacagtctgcaagctacaaagctgcacccacggtatcccaggcgaccttcaggtgtaccacataggcaacctactcaaaggcgacagagtgaacggccacctcatccacaaaattgaaccccacttcaacacatcttggatgtcttgggacgggtgcgacctcgactactactgcaacatgggcgactggcccagctgcacctatacaggagtaacccaacacaaccacgccgcattcgttaacctactaaacatcgaaaccgactatacaaaaaccttccatttccacagcaaaagggtaaccgcccacggcgatactccccaactagacctaaaggcccgacccacgtacggagcgggcgaaatcaccgtcctcgtcgaggtagcagacatggaactacacacaaagaaagtcgagatctccggcctcaaattcgcatcactcgcctgcacgggctgttatgcatgttcatcaggcatctcctgcaaagtcagaatacacgtcgacgagcctgacgaactcacggtacacgtaaaatcaaacgaccccgacgtggtagcagcatccaccagcctcatggcccgaaaactcgagttcggcaccgactcaaccttcaaagccttctccgccatgccgaaaacatcgctgtgtttctacatagtcgaaagggaatactgcaaatcctgctcagaagaagatacacaaaagtgcgtagatacaaaactcgaacaaccccaaagcatcttaatcgaacacaaaggaaccatcatcggcaagcaaaacgtaacatgcaccgctaaagccagctgctggctagaatcagtcaagtctttcttctacggcctcaagaacatgctaggatcagtcttcggcaactttttcataggcatcttactcttcctcgcaccattcgtcctcctagtcctcttcttcatgttcgggtggaaaatactattctgcttcaaatgctgccgtagaacaagaggcctcctaaaatatcgattgcttaaagacgacgaagaaacgggatacaggcgcatcatagaacgacttaacaacaagaaaggtaaaaacagactactagacggcgaacgcctagctgacagaaaaatcgccgaactcttctccacaaaaacccacattggt

SEQ ID NO: 15544 - RNA, 2916 nt, synthetic construct
  misc_feature 1..2916: note = derived and/or modified CDS sequence (opt11) from CCHFV(44-ST-2010, Artificial)__KR814859.1__Gn-4aa-Gc
  source 1..2916: mol_type = other RNA
tcggaagaaccaggcgacgactgcatcagcagaacacaactcctcaaaacggaaacagccgagatacacgacgacaactatggaggccccggcgacaaaataacaatctgcaacggcagcaccatcgtcgaccaacgcctcggcagcgagctaggctgttacacgatcaaccgcgtcaaatccttcaagctatgtgaaaactctgcaaccggcaagacatgtgaaatagattccacccccgtcaaatgccgccagggattctgcctgaaaatcacccaggaaggccgcggacacgtcaaacttagccgaggttccgaggtcgttctcgacgcctgcgactcgagctgcgagataatgattcctaaaggcaccggagacatccttgtcgactgcagcgggggccaacaacacttcctcaaagacaacctaatagacctaggttgcccccacatcccactcctcgggaagatggccatctacatctgtagaatgtccaatcaccccagaaccaccatggcattcctcctatggttctcattcggctacgtaatcacatgtatcttttgtaaagccttattttacagcctcatcattatcggaaccctagggaagaaaataaaacagtaccgcgaactcaaaccacagacctgcaccatatgcgaaaccgcaccagtaaacgccatagacgcggaaatgcacgacctcaattgcagctacaacatctgcccctactgcgcatcaagactaacctcagacggcctagcacgtcacgttactcaatgcccaaaacgaaaagaaaaagtcgaagaaacagaactctacctcaacctggagagaataccatggatcgtacgcaaactgctacaagtatccgagtccacaggagttgcgttaaagcgcagctcgtggctaatcgtactacttgtactcctcacggtcagcctcagccctgtccagtccgcgcccgtaggccgcaaacccctcttcctcgactccatagtcaagggcatgaaaaacctcctgaactcaacaagcctcgaaacatccctatcgatagaagcaccatggggcgccatcaacgtacaaagtaccttcaaacccactgtcagcaccgccaacatcgcactctcctggtcatccgtcgaacaccgaggcaacaagatcctcgtcaccggacgatccgaatccataatgaaactcgaggaacgcaccggcgtctcgtgggacctcggcgtcgaagatgccagtgaatccaaattactcacagtcagcattatggacctctcccaaatgtacagccccgtattcgaatacctaagcggtgaccgccaagtcgaagaatggccgaaagctacatgtacaggtgactgtccagaacgttgcggttgcacatccagtacctgcctccacaaagaatggccacacagccgcaactggagatgcaaccctacctggtgctggggcgttggaaccggatgtacctgctgcggggtcgacgtaaaagacctattcaccgaccatatgtttataaagtggaaagttgaatacataaagaccgaagcgatagtgtgcgtcgaactcaccagccaagaacggcaatgctcactcatcgaagccggcactcgctttaacttagggcccgtcacaatcacactctcagaaccccgcaacatacagcaaaaactcccgcccgaaatcatcactcttcaccccaaaatcgaagagggcttctttgacctcatgcacgtacaaaaggtactgtcggccagcaccgtttgcaaactacaatcctgcacacacgggatcccgggcgacctgcaaatataccacatcggcaacctcctcaagggagaccgcctcaacggccacctcatccacaaaatagaaccccactttaacacctcctggatgtcctgggacggctgcgacctcgactactattgtaatatgggcgactggccatcatgcacctacaccggggtaacccaacacaatcacgcggccttcgttaacctgctcaacatcgaaacggactacacaaagacattccacttccactcaaagagagtcacagcccatggcgacacaccgcaactcgacctcaaagcccgccccacttacggcgccggcgagatcaccgtactcgtcgaagtagccgacatggaattacacactaaaaaggtcgagatcagcggtctcaaattcgcctctctcgcatgcaccgggtgctacgcctgttcatcggggatatcatgcaaggtccggatacacgtcgacgaacctgacgaactaaccgtacacgtcaaatcctcagacccagacgtcgtcgccgcgtctactagcctcatggctcgcaagctggaatttggcacagactccacctttaaggctttctcagccatgcccaaaacctccctttgcttctacatagtcgagcgcgaatactgcaaatcatgttccgaagacgataccaagaaatgcgtcgacaccaaactcgatcaaccccaatccatccttatcgaacacaaagggacgataataggcaaacagaacgatacctgcacagcgaaagcatcctgctggctcgaatcagtaaaatcgttcttttacggactcaaaaatatgctcggctcggtatttggcaacttcttcgtcggcatactcctcttcctagcaccctttgtcctattagtccttttcttcatgtgcgggtggaaaatcctcttctgcttcaaatgttgccgaagaacccgcggactattcaaatacaggcacttaaaagacgacgaagagacaggctaccgccgcataatcgagagactcaactcgaagaaaggcaaaaaccgcctcctcgacggagaacgactagccgaccgcaaaatcgcggaactcttctccaccaaatcacacatagga

SEQ ID NO: 15545 - RNA, 2916 nt, synthetic construct
  misc_feature 1..2916: note = derived and/or modified CDS sequence (opt11) from CCHFV(46-ST-2012, Artificial)__KR814860.1__Gn-4aa-Gc
  source 1..2916: mol_type = other RNA
agtgaggaacccggtgatgactgcattagtcgcacccagctcctacggaccgagacggccgagatccacgacgacaactacgggggcccgggggacaagatcaccatctgcaacggctcgactatcgtggaccagagactgggatcggagctgggctgctacactatcaaccgggtcaagagcttcaagctctgcgagaactcagccacgggtaagacatgcgagatagattcaacccccgtgaagtgccgccaggggttctgcctgaagattacccaggaaggccgggggcacgtgaagttgtcccgcggctctgaagtagtgttggacgcgtgtgactccagctgcgaggtgatgatccccaaaggtacgggggatatcctggtcgactgctccggcgggcaacagcacttcctgaaagacaacctcatcgacctgggatgcccgcacatccctctgctcgggaagatggccatctacatctgcagaatgagcaaccacccccgcaccaccatggcgttcctgttctggttctccttcggctacgtgatcacttgcatattctgtaaggccttattctactcactcatcatcatcggcaccctggggaagaagatcaagcagtaccgggagctgaaaccccagacatgtacgatctgcgagaccgccccagtgaacgcgatcgacgccgagatgcacgacctcaactgctcctacaacatatgcccgtactgcgcctcacgcctgacgtccgacggcctggcccggcacgtcccccagtgccccaagcgcaaggaaaaggttgaggagaccgagctctaccttaaccttgagcggatcccttggatcgtgcgcaagctcctgcaggtcagcgagtccacgggggtagcgctgaagcgaagcagctggctcatcgtgctgctggttctcctgactgttagtctgagcccagtgcagtccgcccccgtcggccgcaagcccctcttcctggacagcatcgtgaaggggatgaagaacctgctcaactccacgagcctagagacctccctgtctatcgaagcaccgtggggcgccatcaacgttcagtccaccttcaaaccgactgtcagcacggcgaacatcgcgctctcctggagctccgtggaacaccggggcaacaagatcctggtgacagggcgcagcgagtccatcatgaagctggaggaacgcaccggcgtcagctgggacctcggggtggaagacgcctccgagagcaagctgctgaccgtctccatcatggacctcagccagatgtactcacccgtcttcgagtatctgtccggcgaccgccaggtggaagagtggcccaaggccacgtgtaccggggactgtcccgagcggtgtggctgcaccagctccacgtgcctgcacaaggagtggccacatagcaggaactggcgctgcaaccccacctggtgctggggcgtcggcaccggctgcacgtgctgcggggtggacgtgaaggacctcttcaccgaccatatgttcgtcaagtggaaggtggagtatatcaaaaccgaggctattgtctgcgtcgagctgacctcccaggagcggcagtgctctctgatagaggctggcacccgcttcaacctggggcccgtgaccatcaccctctccgagccccggaacatccagcagaagttaccgcccgagatcatcacgctgcatccaaaggtggaggagggcttcttcgacctcatgcacgtccagaaggtgctaagtgcgtccaccgtgtgcaagctgcagagctgcacccacggcatccccggggacctccaagtctaccacatcggcaacttgctgaagggggaccgcatcaacggccacctcatccataagatcgagccgcattttaacacatcctggatgagctgggacggctgcgacttggactactactgtaacatgggggactggccctcctgcacgtacactggcgtgacccagcacaaccacgccgcgttcgtgaacctgctcaacatcgagaccgactacaccaagaccttccacttccacagcaagcgggtaacagcccacggggacacaccccaactggacctgaaggcgcgcccgacctacggcgcgggggagatcaccgtgctcgtggaggttgccgacatggagctgcacaccaagaaggtggagatcagtggcctgaagttcgccagcctcgcctgcaccgggtgctacgcctgctctagcgggatcagctgcaaggtgcggatccatgtcgacgagcccgacgagctgacggtccacgtgaagtccagcgaccccgacgtcgtggcagcctccaccagcctcatggcccgcaagctcgagttcggcaccgactcgaccttcaaggccttcagtgcgatgcctaagacttccctgtgcttctacatcgtggagcgggagtactgcaagagctgctccgaggaggacacccagaagtgcgtcgacacccggctagagcagccgcagagcatcctcatagaacacaaagggaccatcatcggcaagcagaacgacacgtgcaccgccaaggcatcctgctggctggagtccgtcaagtccttcttttacgggctgaaaaacatgctgggcagcgtgttcggcaatttcttcataggcatcctgctgtttctcgccccctttgtgctactggtccttttcttcatgttcggctggaagatcctcttctgcttcaagtgctgcaggcgcacccgggggctgctcaagtaccgccacctgaaggacgacgaggaaaccggctaccggcgcattatcgagcggctgaacaacaagaaggggaagaaccgcctcctggacggagaacgcctggccgatcgcaaaatcgcggagctgttctccacgaagacccacataggc

SEQ ID NO: 15546 - RNA, 2916 nt, synthetic construct
  misc_feature 1..2916: note = derived and/or modified CDS sequence (opt11) from CCHFV(47-ST-2013, Artificial)__KR814861.1__Gn-4aa-Gc
  source 1..2916: mol_type = other RNA
agcgaggagcctggcgatgactgcatatcccgcacgcagctgctcaagaccgaaacggcggaaatccacgacgacaactacgggggcccgggggacaaaatcaccatatgcaacggctccaccatcgtcgaccagcggctgggctccgagctgggctgttacaccatcaaccgcgttaagagcttcaagctgtgcaagaactccgccaccggcaagacctgtgagatcgatagcactccagtgaagtgccgtcaagggttctgcctgaagatcacacaagaaggccgcgggcacgtgaagctctcccggggcagcgaggtcgtactggacgcgtgcgactccagctgcgagatcatgatcccgaaggggacgggcgatatcctggtggactgctccggcggccagcagcacttcctgaaggacaacctcatcgacctgggctgcccccacatcccgttgctcgggaagatggccatctacatctgtcgtatgagcaaccaccctcggaccactatggcattcctgttctggttctcgttcggctatgtcatcacgtgtatcttctgcaaggccttgttctactcactcatcatcatcggcaccttagggaaaaagattaagcagtaccgcgagctcaagccccagacgtgcaccatctgcgagaccgcccccgtgaacgctattgacgccgagatgcacgacctcaactgctcctacaacatttgtccgtactgcgctagccggctgacctccgacggcctggcccgccacgtgacccagtgtcccaagcgtaaagagaaggtggaggagaccgagctctacctcaatctggagcgcatcccttggattgtccggaagctcctccaagtgagcgaatccaccggcgtagcactgaagcggagcagctggctgatagtgctgctggtgttgctgacggtatccttgagtccagtgcagtctgccccggtgggccggaaacccctcttcctggacagcatcgtcaagggcatgaagaacctgctcaacagtaccagcctggagacctccctgtcaatcgaagccccctggggcgctatcaacgtgcagtccaccttcaaacccaccgtctccacagccaacatagctctctcctggtcctccgtcgagcaccgcggcaacaagatcctggtgaccgggcgaagcgagtccatcatgaaactggaggagcgcaccggcgtctcctgggacctcggcgtggaggacgcctccgagagcaaactgctgacggtgtccatcatggacctgagccagatgtacagcccggtcttcgagtacttgtccggggaccgccaggtggaggagtggcccaaggcgacctgcaccggggagtgcccggagcggtgcggctgcaccagttccacatgcttgcataaggagtggccccacagccggaactggcgctgcaaccccacctggtgctggggcgtggggaccggctgcacgtgctgcggcgtcgacgttaaggacctcttcaccgaccacatgtttatcaagtggaaagtggagtacataaagaccgaggccatcgtttgcgtggagctgacctcccaggagcgccagtgcagcttgatcgaggccggcacgcggttcaacctggggcccgtcaccatcacgctctccgagccccgcaacatccagcaaaagctgccccctgagataatcacactgcaccctaagatcgaggaggggttcttcgaccttatgcacgtccagaaggtactgagcgcctccaccgtctgcaagctacagagctgcacccacggcatccccggggacctccagatataccatatcggcaacctgctgaagggggaccgggtcaatggccatctcatccacaagatcgaaccccacttcaacacgtcctggatgtcctgggacggctgcgacctagattactactgcaacatgggcgactggccgtcctgcacctacaccggcgtgactcagcacaaccacgccgccttcgtgaacctgctcaacatcgagacggactacaccaagaccttccacttccacagcaaaagagtcacggcacatggggacacgcctcaactggatctgaaggccaggcccacctacggcgcgggggaaatcaccgtgttggtggaggtcgccgacatggagctgcacaccaaaaaggtggaggttagcggcctgaaattcgccagcctcgcctgcacgggctgctatgcctgctccagcggaatctcttgcaaggtaagaatccacgtggacgagccggacgagctgaccgtccacgtcaagtccagcgaccccgacgtggttgctgcttccaccagcttgatggcccggaagctcgagttcggcacagactccacgttcaaggccttcagcgcgatgcccaagacctccctgtgcttctacattgtcgagcgtgagtactgcaagtcctgttccgaggatgacaccaagaagtgcgttgacaccaagctggagcagccccaaagcatcctcatcgaacacaaggggacgatcatcgggaagcagaacgacacgtgcaccgccaaggcctcttgctggctggagagcgtgaagtccttcttctacggcttaaagaacatgctcggcagcgtctttggcaacttcttcgtggggatcctgctgtttctggcccctttcgtcctgctggtcctcttcttcatgtttggctggaagatcctattctgctttaaatgctgccggcgcactcggggtctgttcaagtaccgccacctcaaagatgacgaggaaaccggataccgtcgcataatcgagagactgaactccaagaagggcaagaaccgcctgctcgacggcgagcggctggccgatagaaagatagcggagctgttcagcactaaaacccatatcggt

SEQ ID NO: 15547 - RNA, 2916 nt, synthetic construct
  misc_feature 1..2916: note = derived and/or modified CDS sequence (opt11) from CCHFV(52-R-2014, Artificial)__KR814862.1__Gn-4aa-Gc
  source 1..2916: mol_type = other RNA
tctgaagaaccaggcgacgattgcatctcacgaacccaactactacgcaccgagactgcagaaatacacgatgataactatggagggcctggagacaaaatcacaatatgcaacggcagcactatcgtcgaccagcgcctcggcagcgaattaggctgctacacaataaatcgtgtaaaatctttcaaactgtgtgaaaactcagcaaccggtaaaacctgcgaaatcgactcaactccggtcaaatgcagacaaggcttctgcctgaagatcacccaagaaggacgaggtcacgtcaaactgagccgcggctcggaagtcgtcctagatgcatgcgacacctcatgtgaggtcatgatccccaaaggaaccggtgacatcctagtggactgctcaggcggacaacaacacttcctcaaagacaacctgatcgacctcgggtgcccgcacgtacctctactcggcaagatggctatctacatctgccggatgtcgaaccacccccgcaccaccatggcattcctattctggttctccttcggatacgtaatcacctgtatattctgcaaagccctgttctattcactcatcatcatcggcactctgggcaagaagattaaacaatatagagaactaaaaccacaaacctgtaccatatgcgaaacagcccccgtaaatgccatagacgccgaaatgcacgaccttaactgcagctacaacatctgcccctactgcgccagccgcctaacatccgacggcctggcgcgccacgtgccgcagtgcccaaaacgcaaggaaaaggtagaagaaaccgaactctacctcaacctcgaacgaataccatggatcgtgcggaaactcctacaagtaagcgaatcgaccggcgtcgcactaaaaagatcatcctggctaatcgtactcctagtcctactaacggtgtccctatcccccgtacaaagcgcgccagtcggtcggaaacccctcttcctagacagtattgttaaagggatgaaaaatctcctgaactccacttccctagaaacatcactctcgattgaagcgccatggggagcaataaatgtgcaatccaccttcaaacccacagtatctactgctaacatcgctctatcctggtccagcgtggagcatcgcggcaacaaaatccttgttaccggtcgctcagaatccatcatgaaactcgaagaacgaacgggggtcagctgggacctaggagtcgatgatgcatctgaaagcaaattactgaccgtttcaatcatggacctatctcaaatgtactcccccgtattcgagtacctatccggtgaccgccaggttgaagaatggcccaaagcaacctgcacgggcgactgcccagaacggtgcggctgcacttcgtctacctgccttcacaaggaatggccccattcccgcaactggcgatgcaaccccacctggtgctggggtgtcggcaccggctgtacctgctgcggcgtagacgtaaaagaccttttcactgaccacatgttcgtcaagtggaaggtcgaatacatcaagacagaagccatagtctgcgtcgaactaacctcccaagaacgacaatgctcccttatcgaagccggcacacgcttcaacctaggcccagtcaccataactctatccgaaccacgcaacattcaacaaaaactaccgcccgaaataatcaccctccaccccaaagtagaggagggattcttcgacctaatgcacgtgcaaaaagtactcagcgcctcgacagtgtgtaaactccaaagttgcacccacggcatccccggcgacctccaggtgtaccacatcggcaaccttctaaaaggcgacagagtaaacgggcacctcatacacaaaatcgaaccgcatttcaacacctcatggatgtcatgggacggctgcgacctcgactactactgcaacatgggcgactggccctcctgcacctacaccggcgtgacccaacacaaccacgccgccttcgtgaacctactcaacatagaaacggactacacaaagaccttccacttccactcaaaacgcgtaacagcccacggagacaccccgcaactcgacctaaaagcccgcccaacctacggcgccggagagataacggttctagtagaagtagccgacatggaactacacacaaagaaagtagagatatccggcctcaaattcgccagcctagcgtgcaccggttgttacgcatgctcctctggcatatcctgcaaagtccgcatacatgtcgacgaaccggatgaattaacagtacacgttaaatctaatgacccagacgtcgtagcagcctccaccagccttatggcacgaaaactagagttcggcaccgactccacctttaaagcattctccgcgatgccgaaaacctcgctctgcttctacatagtagaaagagaatactgcaaatcttgttccgaagaagacacccaaaaatgtgtcgacacaaaactcgaacaaccacagtcgatcctcatagaacacaaaggtacaattatcgggaaacaaaacgacacttgcacagcaaaagccgggtgctggctcgaaagcgtaaaatccttcttttacggcctaaagaatatgctcggctccgttttcggcaatttcttcatcggaatcctcctattcctagccccattcgtcttactcgtcctattcttcatgttcggttggaaaatcctattctgcttcaaatgctgccgccgtacgcgcgggctacttaagtaccggctcctcaaggacgacgaagagactggatatcgtcgcataatagagagacttaacaacaagaaaggcaaaaaccggctactggacggcgaacgcctcgccgacagaaaaatcgctgaactattctcaacgaaaacacacataggc

SEQ ID NO: 15548 - RNA, 2916 nt, synthetic construct
  misc_feature 1..2916: note = derived and/or modified CDS sequence (opt11) from CCHFV(75-R-2012, Artificial)__KR814863.1__Gn-4aa-Gc
  source 1..2916: mol_type = other RNA
tccgaagaacccggcgacgactgcatctcccgcacacaactactacgcacagaaacggctgagatccacgacgacaactatggcggccccggagacaaaatcaccatctgcaacggctccaccatcgtggatcaacgcctgggctcggaactcggatgctacacgatcaacagagtcaaatcatttaagctatgcgaaaactccgccaccggtaaaacatgtgagatagacagtgcgccagtaaaatgccgtcaaggcttctgcctcaaaataacacaggaaggccgaggacacgtaaaactaagccgcggctccgaagtcgtactcgatgcatgcgacagctcctgcgaagtgatgatcccaaaaggcaccggcgacatactcgtcgactgcagcggaggacaacaacacttcctcaaagacaacctcattgaccttggatgcccccacatccccctcctcggcaagatggccatctacatatgcagaatgtccaaccatccccgtacaaccatggcattcctattctggttctccttcggctacgtgatcacatgtatattctgcaaagccctcttctactcgttaataatcatcggaaccctaggcaagaaaatcaaacaataccgcgaactcaaaccacagacatgcaccatatgcgaaactgcccccgtcaacgcaatcgacgcagaaatgcacgatctcaactgctcctacaacatatgcccctactgcgcaagccggctgacctctgacggccttgcacgacatgttcctcaatgccccaagcgcaaggaaaaagtcgaagaaacagagctatacctcaacttagaacggatcccgtggattgtccgcaaactgcttcaagtctcagaaagcaccggcgtcgccctcaagcgatcaagttggctcatagtcctcctagtgttattaacagtgagcctgagccccgtccaatctgcacccgtgggccgcaaacccctattcctcgacagcatagtgaagggaatgaaaaacctactcaactcaacctcgctcgaaacctcgctttccatagaggccccttggggagcaattaatgttcagtcaaccttcaaaccaaccgtcagcaccgcaaacattgcattatcatggtcatccgtggagcatagaggaaacaaaatactggttacaggtcggtcagaaagcatcatgaagttagaagaacgtacgggcgtatcgtgggacctcggcgtagaagacgccagcgaaagcaagctactcactgtcagcatcatggacctaagccaaatgtactcccctgtattcgaatacctctcgggggaccgacaggtcgaagaatggccaaaagccacctgtaccggcgactgtcctgagcgatgcggatgtacttcatctacctgcctgcacaaagaatggccacattccagaaactggcgctgcaacccaacctggtgctggggcgtcggaaccgggtgcacatgctgcggcgtcgacgttaaggacctattcaccgaccacatgttcgtcaaatggaaggtcgagtatatcaaaacagaagcgatcgtctgcgtcgaactcacctcccaagaacgtcaatgctcgctcatcgaagccggcacccgcttcaacttgggcccggtcacaataacgctaagcgagccacgaaacatccaacagaaactaccccctgaaatcataaccctccaccccaaagtcgaggaaggcttcttcgacctaatgcacgtccaaaaggtcctgtcagcctctaccgtctgcaaactgcaaagctgcacccacggcatcccaggcgacctgcaggtataccatattggaaatctcttaaaaggcgaccgcgtcaacggacaccttatacacaagatagaaccccacttcaacacctcttggatgagctgggacggttgcgacctcgattactactgtaacatgggtgactggccctcatgcacctatacaggagtaacgcaacataatcacgccgccttcgtcaatctgctcaacatagaaacagattacaccaaaaccttccacttccactcaaaaagagtaacagcacacggcgacacgccccaactggatctgaaagcccgacccacatacggagccggtgaaattaccgtcctcgtagaagtcgccgacatggaactccacacgaagaaagtcgagatctccggactaaaattcgcatcgctagcctgcacaggctgttacgcctgctcatctggaatcagttgcaaagtccgcattcatgtagatgaacccgacgagctcacggtccacgtcaaatcatccgatccagacgtcgtagccgcatcaacatctcttatggcgcgtaaactcgagttcggcaccgactcgacattcaaagccttctccgcaatgcccaaaacgtcactctgcttctacattgtagaaagggaatactgcaaatcgtgctccgaagaagacacccaaaaatgcgtcgatacgaaacttgagcaaccacaatcaattctaatcgaacacaaaggcaccatcataggtaaacagaacgatacatgcaccgccaaagcaagctgctggctagaatccgtcaagagcttcctctacgggctcaaaaacatgctgggctccgtcttcggcaacttcttcattggcatattactcttcctcgccccctttgtactactcgtcctgttcttcatgttcggttggaaaatactattttgcttcaaatgctgccgacgcacccgaggactcctcaaatatcgactcctcaaagatgacgaagagaccgggtaccgacgcatcatcgaacgtctaaacaataagaaaggcaaaaaccgcctactagacggagaacgactggcggacagaaaaattgccgaactcttcagcacgaaaacccacatagga

SEQ ID NO: 15549 - RNA, 2916 nt, synthetic construct
  misc_feature 1..2916: note = derived and/or modified CDS sequence (opt11) from CCHFV(75-ST-2010, Artificial)__KR814864.1__Gn-4aa-Gc
  source 1..2916: mol_type = other RNA
tccgaagaatctggcgacgactgcatttcccgcacgcaacttcttagaaccgaaaccgcagaaatacatgacgacaactacgggggacccggagacaaaataaccatatgcaacggcagcacaatcgtggaccagcgcctcggctccgaactcggttgctacaccataaaccgtgtcaaatcattcaaactctgcgaaaattccgcgaccggcaaaacctgcgagatcgacagcaccccagtcaaatgccgacagggcttctgcctcaaaataacacaagagggccgaggacacgtgaagctctcccgaggctctgaagtggtcctcgacgcttgcgactcgagctgcgaagtcatgattcctaaaggtacaggggacatacttgtggactgctcgggcggtcagcagcactttctgaaggacaacctcatcgacctaggctgcccacacatacccctactcggaaaaatggccatatacatctgccgaatgtccaaccaccccagaaccaccatggcgttcctattctggttctccttcggctacgtgattacctgcctgttctgcaaagccctcttctactcactcataatcatcggcaccctcggcaagaaaatcaaacaatacagggaactccgtccgcagacctgcacaatctgcgaaacggcccctgtcaacgcaatcgacgccgaaatgcacgaccttaactgctcctacaacatctgcccatactgtgccagccgactaacatccgacggactagcacgccacgtaccccagtgcccaaaaaggaaggaaaaggtagaagaaacggagctctacctcaatctagaacggatcccatggatcgtccgaaaactcctacaagtgtccgagtcaacaggagtagctctaaaaagatcctcttggctaatagtcctactcgtactactaacagtttcactatcccccgttcagagcgcacccgtgggccgaaaaccactattcctcgactccatagtcaaaggtatgaaaaacctcctcaactcaaccagcctagagacttcgttaagcatagaagccccatggggcgctatcaacgtccaatccacctttaaacctactgtatccactgctaacatcgccctatcctggtcaagcgtagaacaccgcggcaacaaaatcctcgtcacgggcaggtccgaaagcataatgaaactcgaagaaagaaccggcgtatcctgggacctaggcgtagaagacgcatcggaatccaaattactcacagtgagcatcatggacctaagccaaatgtactcccccgtattcgagtacctctctggggaccgtcaagtagaagaatggcctaaagcaacctgcactggcgactgccccgaacgatgcggctgcaccagctccacctgtttacacaaagagtggcctcactcccgaaactggcgctgcaacccaacatggtgctggggcgttggcactggctgtacctgctgcggcgtagacgtcaaagacctattcaccgaccacatgttcgtaaaatggaaggtcgaatacatcaaaaccgaagccatagtgtgcgtcgaacttacctcccaagaacgccaatgctctctaatcgaagccggcacccgcttcaacctgggcccagtcaccatcaccctctcagaaccccgaaacatccaacagaagttaccgcccgagataatcaccctccacccaaaagtagaagagggatttttcgacctcatgcacgtccaaaaggtactatcagccagcaccgtatgcaaattacaatcttgcacacacggcatcccaggcgatctccaagtataccacattgggaacctactcaagggcgaccgggtcaatggacatctaatacacaaaatcgagccccacttcaacactagctggatgtcttgggacggctgcgacttagactactactgcaacatgggagactggccctcctgcacctacactggcgttacacagcacaaccacgccgctttcgtcaacctactaaacatcgagacagactacaccaaaacgttccatttccactcaaaacgcgtaacagcccacggtgacacgccccaacttgacctgaaagctcgaccgacgtacggcgcaggcgagatcacggttctggtcgaagtcgccgacatggaactccatacaaagaaagtcgaaataagcggcctcaaattcgcatcgctagcttgcaccggctgctacgcctgcagctcaggcatctcctgcaaagtcagaatccacgtcgacgaaccagacgaactcacagtccacgtcaaaagcagcgatcctgacgtagtcgccgcctcgacctcccttatggcccgaaagctcgaatttggaacggactccaccttcaaagccttctccgcaatgcccaagacgagcctttgcttctatatagtggagcgagaatactgcaagtcctgcagcgaagaagatacacaaaaatgtgtcgacaccaagctagaacaaccgcaatccatcctcatagaacataaaggcaccatcatcgggaaacaaaacgatacctgcacagccaaggcctcgtgctggctcgaatccgtcaaatcattcttctacggcttgaaaaacatgctagggtccgtattcgggaatttctttataggcatcctcctcttcctagctcccttcgtacttctagtcctatttttcatgttcggatggaaaatcctattctgctttaaatgctgccgacgcgcgcgcgggctcctgaaataccgccacctaaaagacgacgaagagacaggctaccgcaaaatcatcgagcgactgaacaacaagaaaggcaaaaaccgacttctcgacggtgagcggctagcggacaggaaaatcgcagaacttttcagcacaaaaacacacatagga

SEQ ID NO: 15550 - RNA, 2916 nt, synthetic construct
  misc_feature 1..2916: note = derived and/or modified CDS sequence (opt11) from CCHFV(3756-ST-2007, Artificial)__KR814866.1__Gn-4aa-Gc
  source 1..2916: mol_type = other RNA
tcagaagaacccggagacgactgcatctcaagaacccagctcctcaaaacggaaactgcagaaatccatgacgacaactacggaggtcccggcgacaaaatcaccatctgcaatggctctaccatcgtagaccagcgcctaggctccgaattaggctgctacaccatcaacagagtaaaatcattcaaactctgcgaaaatagcgccaccggcaaaacctgcgaaatagactcaactccagtcaaatgccgccagggcttctgcttaaagataacacaagaggggcgcggacatgtaaagctaagccgcggatcggaagtagtcctcgatgcgtgcgattcatcctgcgaaatcatgatcccaaaggggacaggagacatcctcgttgactgcagcggcggccaacaacacttcctcaaagacaatctaatcgatcttggctgcccccacatccccctcctagggaagatggccatatacatctgcagaatgtcgaaccacccccgcacaaccatggcattcctcttttggttctccttcggatacgtcattacttgcattttctgcaaagcgctattctactcccttatcatcataggcacactaggaaagaaaatcaaacagtaccgcgaacttaaaccccagacctgcaccatatgcgaaactgctcccgtaaatgcgatcgacgcggaaatgcacgatctaaactgtagctacaacatctgtccctactgtgcctcgcggctcacgtccgacgggctcgcacggcacgtaacccaatgccccaaacgcaaagaaaaagtagaagaaacagagctctacctcaacctggaaaggatcccctggatcgtacgcaagctcctacaggtaagcgagtcaaccggcgtcgctttgaaaagatcctcttggctcatcgtcctactcgtgctcctcaccgtgtccctatccccagtacagtcagcgcccgtgggacgcaaacccctatttctcgacagtatcgtcaaaggtatgaaaaacctactcaactcaacatctctagaaacttccctatcaatagaggccccctggggcgccatcaacgtacaatccacattcaaaccgaccgtcagcacggccaacatcgccctttcatggagcagcgtagaacaccgcggaaataaaatactcgtcacgggccgctccgaaagcatcatgaaattagaagaacgcaccggggtcagctgggacctgggcgtcgaagacgcctccgagtcgaaactactaaccgtctccataatggacctatctcaaatgtattcccctgtattcgagtacctttccggggaccgccaagtcgaagaatggcctaaagccacttgcacaggtgactgccctgaacgctgcggctgcacttcaagcacatgcctgcacaaggagtggccccactcccgaaactggcgatgtaaccccacatggtgctggggtgtaggcacgggctgtacatgctgcggcgtcgacgtaaaggatctctttacagaccacatgttcatcaagtggaaagtggagtacatcaaaacagaggcgatcgtatgcgtagaactaactagccaggaaagacaatgctctctcatcgaagccggaacacgcttcaacctgggccccgtcacaattacactctcggaaccccgaaacatccaacaaaaactacctcccgaaataataacactgcaccccaagatcgaagagggcttctttgacctaatgcacgtacaaaaagttctctccgcgagcaccgtatgcaaactacaatcgtgcacacacggcatacccggcgacctccaaatataccacatcggcaatctcctaaaaggcgaccgagtaaacggtcacctcattcacaaaatagaaccccacttcaacaccagctggatgagctgggatggctgcgacctagattactactgtaacatgggagactggccttcatgcacgtatacgggtgtaacacagcacaaccacgcggccttcgtaaacctcctcaacatagagaccgactacacgaaaacattccactttcactccaaacgggtgacggcgcacggggacacgccccaattagatctcaaggcacggcccacctacggggcaggagaaatcaccgttctagtggaagtcgccgacatggaactccacactaaaaaggtcgaaatctccggcctcaaattcgcctccctcacctgtaccggctgctacgcatgctcgagtggtatcagctgcaaagtccgcatccacgtcgacgaacccgacgaactcacagtccatgtaaagtcctccgacccggacgtagtcgctgcctcaacgtcactaatggcccgcaaactggagttcggcaccgactcaaccttcaaagccttcagcgcaatgcccaaaacatcactatgcttctatattgtcgagcgagaatactgtaaaagctgctccgaagacgatacaaagaaatgcgtcgacaccaaactcgagcaaccacaatcgatcctaatagaacacaaaggcaccataatcgggaaacaaaacgatacctgcacagccaaagcctcatgctggctagaaagcgtaaaatcgttcttctacggcctcaagaacatgctagggtcagtattcggcagtttcttcgtcggaatactcttattcctcaccccgttcgtgctcctagtactattcttcatgttcggttggaaaatcctattttgctttaagtgctgccgccgtacgcgcggactattcaaataccgacacctcaaagacgacgaagaaactgggtacaggagaataattgagcgcctaaactcgaaaaaggggaaaaaccggctcctagacggcgaacgccttgcagaccgaaaaatagcggaactcttctcaacgaaaacccatataggc

SEQ ID NO: 15551 - RNA, 2916 nt, synthetic construct
  misc_feature 1..2916: note = derived and/or modified CDS sequence (opt11) from CCHFV(3809-ST-2007, Artificial)__KR814867.1__Gn-4aa-Gc
  source 1..2916: mol_type = other RNA
tccgaagaacccggagacgactgcataagcagaactcaactccttcgcaccgaaacagccgaaatccacgacgacaactacggaggcccaggcgacaaaattaccatatgtaacggctctaccatagtagaccaacgactaggctccgaactaggctgctacaccatcaatcgcgtgaaatccttcaaattgtgtgagaacagcgccactggaaaaacctgcgagatcgacagcacaccagtaaaatgccgacaaggcttctgcctcaaaatcacccaagaaggcagaggccacgttaaactttcacgcggctccgaagtcgtcctcgacgcctgtgactcttcctgcgaagtaatgatccctaaaggcactggggacatcctcgtggactgctccggtggccaacaacacttcctaaaagacaacttaatagacctcgggtgcccccatatccccctgctcggcaaaatggctatctacatatgtcgaatgtccaaccaccctcgaaccaccatggccttcctgttctggttctccttcggctacgtaataacatgcatcttctgcaaagcattattctactcactcatcatcatcggcaccctcggcaagaaaatcaagcaataccgcgaactcaaaccacaaacttgcactatctgcgaaaccgcccccgtaaacgcaatcgacgctgaaatgcacgaccttaactgctcctacaacatctgcccgtactgcgcatcccgactaacctccgacggcctagcacgccacgtcccacaatgccccaaacgcaaagaaaaggtagaagaaaccgaactctacctcaatctagaacgcatcccctggatagtccggaaacttctacaagtttcagaatcaaccggagttgcccttaaacgctcatcctggttaatcgtgttacttgtacttctgaccgttagtctctcaccagtccaatccgcccctgtaggccgcaagcccctctttctcgactcaatcgtgaaaggcatgaaaaacctcctaaactccacatccctcgaaacctctttaagcatcgaagccccttggggcgcgatcaacgttcaatccaccttcaaaccaaccgtctccaccgctaacatcgccctcagttggtcctcagtagaacaccgcggcaacaagatcctcgtcacaggccgctctgaatcaatcatgaaactcgaggaacgtaccggagtctcctgggacctcggcgtcgaggacgcctcagaatccaaactactcacagtcagcattatggacttgtcccaaatgtactcaccagtctttgaatacctgtcgggcgaccgacaagtcgaggaatggccaaaggccacatgcaccggcgactgccccgagcggtgcggctgcacgtctagcacctgtctacacaaagagtggccgcactcacgaaactggcgttgcaacccgacatggtgctggggtgtcggaactggctgtacttgctgcggcgtcgacgtaaaggacctcttcaccgaccacatgttcgtcaagtggaaagtcgagtacatcaaaacagaagcgatcgtatgcgtagagctgacctcccaagaacgacaatgctccctcatcgaagcaggcacccgcttcaacttaggccccgtcaccattaccctatccgaaccgagaaacatacaacaaaagctccctcccgagattataacccttcatcccaaagtcgaagaaggcttctttgacctcatgcacgtccaaaaggtactgtctgcaagcaccgtatgcaaactacaatcctgcactcacggaataccaggtgaccttcaggtataccacataggtaacctacttaaaggcgaccgagtcaacggacacctcatccacaaaatcgaaccccacttcaacaccagctggatgtcctgggacggctgcgacctagactattactgcaacatgggcgactggccctcctgcacttacacgggggtcacacaacacaaccatgcagcgtttgtaaaccttctaaacatcgaaacagactacacaaaaactttccatttccacagtaaacgcgtaactgcacacggggacaccccacagctcgacctcaaagcacgccccacatacggagccggagaaatcaccgtcctcgtagaagtagccgacatggaactgcacacaaagaaggtagaaatttcgggcctaaagttcgcttccctcgcctgtacaggatgctacgcatgctcgagcggaatatcctgcaaagtacgcatccacgtagacgagccagacgaactcacagttcatgtaaagtcaagtgacccggacgtcgtagccgctagcacctccttaatggcacgcaaactcgagttcggcactgactcaaccttcaaagcatttagtgccatgccaaagaccagcctctgcttctacatcgtagaaaaagaatactgcagatcatgctccgaagaagacacgcaaaagtgcgtcgacacaaagctcgaacagccccaaagcatactcatcgaacacaaaggcaccataatcggtaaacaaaacgatacctgcacggccaaagcctcatgctggctcgaatctgtcaagagctttttctatgggctcaaaaacatgcttggttccgtcttcgggaatttcttcatcggcatacttttattcctaacacccttcgtacttctagtactcttcttcatgttcggctggaaaatcctcttctgtttcaaatgttgccgtcgaacacggggcctcctcaaataccgccatctcaaagacgacgaggaaactggctaccgccgaatcatagagcgcctcaacaacaagaaaggcaaaaatcgactcctcgacggagaacgcctcgctgaccggaaaattgcagaactcttctccaccaaaacacacatcggt

SEQ ID NO: 15552 - RNA, 2916 nt, synthetic construct
  misc_feature 1..2916: note = derived and/or modified CDS sequence (opt11) from CCHFV(3820-ST-2007, Artificial)__KR814868.1__Gn-4aa-Gc
  source 1..2916: mol_type = other RNA
agcgaggaaccaggtgacgactgcatatcccgtacccaactcctcaagacagaaaccgcagagatacacgacgacaactacggaagcccgggagataagatcacaatctgcaacggaagcacgatagtcgaccaacgactcgggtcagagctaggctgctacacaataaacagagtcaagtcgttcaaactatgcgaaaacagcgccactggcaagacttgcgaaatagacagcacgcctgtcaaatgccgacagggtttctgtctaaaaataacacaagagggccgcgggcacgtgaaattatcccgcggaagcgaagtagtcctagatgcctgcgacagcagctgcgaaataatgatacccaagggaacaggggacatcctggtggactgcagcggcggccaacaacacttcctgaaagacaacctcattgacctgggatgcccacacatccccctactcggaaagatggccatctacatctgccgaatgtcaaatcacccccgaacaacaatggcgttcctattctggttctcattcggctacgtcataacttgcatattctgcaaggccctcttctatagtctaataatcattggcaccctggggaaaaagataaaacaataccgcgaactcaaaccccagacctgcacaatatgcgagaccgcccccgtaaacgcgatcgacgcggagatgcacgacctaaactgcagctacaacatatgcccctactgcgctagccgtctaacaagcgacggactcgcccgccacgtcacccaatgccccaaacgaaaagaaaaggtcgaagaaacagaactctacctcaaccttgaacgcattccctggatcgtacgaaaactcctccaagtatccgagtccaccggcgtggccctcaagcgatccagctggctcatcgtcctactcgtcctactcgcagtatcgctcagccccgtacaaagcgcaccagtaggcagaaagcccctattcctagactcaatcgttaaaggcatgaaaaatctactgaactccacatcgctagagacttcactgtccatcgaagccccctggggcgccataaacgtacaaagcacattcaagccaaccgtctccaccgcaaacatagccctctcatggtccagcgtagagcacagagggaacaaaatcctcgtaaccggtcgctcagagagtatcatgaagctagaagaacggacaggcgtctcatgggacctaggggtagaagacgcaagcgaatcaaagctactaacagtatccatcatggacctgtcccaaatgtactctccggtcttcgaatacctctctggagacagacaagtcgaggaatggccgaaagctacctgcacaggagactgtccagagcgctgcggctgcacctcctctacctgcctccacaaagaatggccccactcacgcaactggagatgcaacccaacctggtgctggggcgtggggacaggctgcacatgctgcggcgtcgacgtcaaagacttgttcaccgaccacatgttcatcaaatggaaagtcgaatatatcaaaaccgaagcaatcgtctgcgtcgagctcacctcacaagaacgccaatgctccctcatcgaagccggaacgaggttcaacctcggcccagtcaccatcacactatcggaacccagaaacatccaacaaaagctcccacccgaaatcatcaccctacaccccaaaatagaagagggcttcttcgacctaatgcacgtccaaaaagtgttatcggcatcgaccgtctgcaaactgcaatcgtgcacacacggcatccccggggacctgcagatataccacatcggcaatctcctcaaaggcgaccgcgtcaacggacacctgatacacaaaatcgaaccccacttcaacacctcttggatgagttgggacggatgcgacctagactactactgcaacatgggggactggccctcatgcacgtatacgggcgtcacacagcacaaccacgcggcattcgtaaacctcctaaacatagaaacagactacacaaaaaccttccatttccactcaaaacgtgtcacggcccatggcgatacaccccagctcgacctcaaagccagaccaacttacggtgcaggggaaataacggtgctagtggaagtagccgacatggagctacacaccaaaaaggtagagatatccggcctcaaattcgcctcgttaacatgcacaggctgttacgcctgtagttctggcatctcatgcaaagtcaggattcatgtagacgaaccggacgagctaaccgtccacgtaaaaagctcagaccccgacgtggtagcagcctcgacaagcctaatggcaagaaagctagagttcgggaccgactccaccttcaaagcgttctcagcaatgccaaaaacatccctctgcttctacatcgtagaacgcgaatactgcaaaagctgcagcgaagacgacaccaagaaatgtgtagacaccaaactcgaacaaccccaatccatccttatcgagcacaaaggtaccataattggcaaacaaaacgacacatgcacggccaaagcctcctgctggcttgaaagcgtaaagtcattcttctatggactaaagaacatgcttggatcggtcttcggctcgttcttcgtcggcatactattattcctcgccccgttcgtactcctcgtcctcttcttcatgttcggatggaaaatcctattctgcttcaaatgctgccgcagaacccgagggctattcaaataccgccaccttaaagacgacgaagaaaccggctacagacgcataatcgaacgactaaacagcaaaaagggcaagaacagactactagacggcgaacgcctagcagaccgtaaaattgccgaactattctcaacaaaaacacacatcgga

SEQ ID NO: 15553 - RNA, 2916 nt, synthetic construct
  misc_feature 1..2916: note = derived and/or modified CDS sequence (opt11) from CCHFV(4495-ST-2008, Artificial)__KR814869.1__Gn-4aa-Gc
  source 1..2916: mol_type = other RNA
tccgaagaaagcggcgacgactgcatctccagaacgcagctcctccgcaccgagacggcagaaatacacgacgacaactacggcggaccaggggacaagatcaccatctgtaacggcagcacgatagttgaccaaagactcggatcagagctagggtgttacaccatcaaccgagtaaagagcttcaaactctgtgagaactccgcaacaggaaagacatgcgagatagacagcacacccgtcaaatgccgccaaggcttctgcctgaagataacacaagaaggccgcggtcacgtcaaacttagtagaggatcggaagtcgtcctcgacgcctgcgactcaagctgcgaagtcatgatacccaaaggtaccggcgacatcctcgtagactgcagcggagggcaacagcacttcctaaaagacaaccttatcgacctcggatgcccgcacatacccctactcggcaagatggcaatctacatttgccgcatgtccaaccacccgcgaacaacgatggccttcctattctggttctcattcggctacgtaataacctgcctgttctgcaaagcacttttctactccctcatcatcatcggcacactcggaaagaaaataaaacaataccgagaactccgtccacaaacatgcacaatatgcgaaacagctcccgtaaacgctatcgacgccgagatgcacgacctcaactgcagctataatatctgtccctactgcgcttcacggctgacatccgacggcctagcaaggcacgtaccccaatgcccgaaacgcaaagagaaagtcgaagaaacagaattatacctaaacctcgaacgcataccctggatcgtccgcaaactgctacaggtcagcgaatcaacaggagtggccctgaagcgatcctcgtggctcatcgtgcttctagtcctacttactgtaagcctaagccccgtacaaagcgcccccgtaggacgcaaaccgctattcttagatagtatcgtcaaaggcatgaaaaacctcctcaactctacatctcttgaaacatccctctcgatcgaagcaccatggggagcaatcaacgtacagagcactttcaaacccaccgtgagcaccgccaacattgcactatcctggtcgtccgtagagcacagaggcaacaaaatcctcgtcaccggccgcagcgaatctattatgaaactagaagaacgaaccggcatatcatgggacctcggcgtcgaagacgcatccgaaagcaaacttctaaccgtttcaattatggacctctcgcaaatgtactcacccgtattcgaatacctgtcaggcgaccgccaagtcgaagaatggcccaaagctacctgcacaggagactgccccgagcgatgcggatgcacatcctccacctgtcttcataaagaatggccccactcccgaaactggcgatgcaatcccacctggtgctggggcgtagggaccggctgcacgtgctgcggcgtcgacgtcaaggacctcttcaccgaccacatgttcgtcaaatggaaagtcgaatacatcaagacagaagccatcgtatgcgtagaacttacctcccaagagcggcaatgctccctcatagaagcgggcacccgcttcaacctaggacccgtcaccatcacactaagcgagccacgtaacatacagcaaaagctcccgccagaaatcataacactgcacccaaaagtggaagaaggcttcttcgacctcatgcacgtccaaaaagtcctcagcgcatccaccgtgtgcaagctacagtcttgcacacacggcatacccggcgacctacaagtttaccacatcggcaacctcctgaaaggagatcgcgtaaacggccatctcatacacaagatcgaaccacactttaacacctcatggatgtcctgggacggttgcgacttagactattactgcaacatgggggactggccctcatgcacctacaccggcgtcactcaacacaaccatgccgccttcgtcaacctcctgaacatcgagacagactatactaagaccttccacttccacagcaaacgagtaactgcacacggagacacaccccaactagacctgaaagcgcgcccgacctacggtgccggcgaaattacggtcctagtagaggtagccgacatggagctccacaccaagaaagtcgagatctccggcctcaaattcgcgtctcttgcctgcaccggttgctatgcctgctcaagcggtatctcctgcaaagttcggatccacgtagacgaacccgacgaactcaccgtccacgtaaagagctcagaccccgacgtcgtcgcagccagtacttctcttatggcccgtaaactcgagttcggcaccgactcaaccttcaaagccttttccgccatgccaaaaacctcgctatgcttctacatcgtcgaacgagaatactgcaaatcttgcagcgaagaagatacccagcgatgtgtcgacacgaagctcgaacaaccccaatccatactcatcgaacacaagggcaccatcataggcaaacagaacgacacatgcaccgcaaaggcttcatgctggctcgaatcagtcaagtccttcttctatggcctcaagaacatgctcggctccgtcttcggcaacttcttcattggcatacttctgttccttgcacccttcgtactcctagtactgttcttcatgttcggctggaaaatactattctgcttcaaatgctgcaggcgagcgcgcggcctacttaaataccgccacttgaaggacgacgaagaaaccggctatcgaaaaatcatagaacgattaaacaacaagaaaggcaaaaaccgtttactcgatggagaacggctagccgaccgtaaaatagccgaactcttcagcacaaaaacccacataggg

SEQ ID NO: 15554 - RNA, 2916 nt, synthetic construct
  misc_feature 1..2916: note = derived and/or modified CDS sequence (opt11) from CCHFV(4691-ST-2009, Artificial)__KR814871.1__Gn-4aa-Gc
  source 1..2916: mol_type = other RNA
tccgaagaaccaggcgacgactgcatctcgcgtacccaactcctaaaaaccgagacagcggagatacacgacgacaactacggcggcccaggtgacaaaatcaccatatgtaacggatcgaccatcgtagaccaacgactcggctcagaactcggatgctacacaataaaccgagtcaaatcgttcaaactttgtgaaaacagcgcgaccgggaaaacctgcgagatcgactccacaccagtaaaatgccgccaaggattctgtctcaagatcacccaggaaggacgaggccatgtcaaactctctcgtggaagcgaagtggtgctcgacgcctgcgactcctcctgcgaaatcatgatccccaaaggcacaggagacatcctagtcgactgcagcggcggccagcaacacttcctcaaagacaacctcattgacctcggttgcccacacatacccctactcggaaagatggccatctacatctgccgcatgtcaaaccacccccgaacgacaatggcattcctgttctggttctccttcggctacgtcatcacatgcatattctgcaaagcccttttctattccctcatcatcattggaaccctcggcaagaaaataaaacaataccgcgaactaaaaccccaaacctgcacaatttgcgagacagcccccgtcaacgccatagatgccgaaatgcacgacctaaactgctcctacaacatctgcccctactgcgcctcacgcctaacttccgacgggttagcacgccacgtcacccagtgcccaaaacgaaaagaaaaagtagaagaaaccgaactctacctaaacctagaacgcatcccctggattgtccgaaaactgcttcaagtctccgaaagcaccggggtcgcactaaaacgatcttcctggcttattgtcctccttgtactcctaacagtaagcctaagccccgtacaatccgcgcccgttggacgcaaacccctcttcctcgattccatagtcaagggcatgaagaacctcctaaattcaacttcactcgaaacatccctaagcatagaggcaccctggggagccataaacgtacaaagcacctttaaacctgctgtctccaccgctaacatcgcactatcatggagcagcgtcgaacaccgcgggaacaaaattctcgtaacgggccgatccgaatcaataatgaaactcgaagaaagaaccggcgtaagctgggatctcggcgtagaggacgctagcgaatccaaactcctaacggtctccatcatggacctatcacaaatgtacagcccagtattcgaatacttatcaggcgaccgccaggtcgaagagtggccaaaggcaacgtgtacaggagactgcccagaacgctgcggctgtacatcaagtacctgcctacacaaggagtggccccactcccgaaactggagatgcaaccctacatggtgctggggtgttggcacaggatgtacctgctgcggagtagacgtaaaagacctattcaccgaccacatgttcatcaagtggaaagtcgaatacatcaaaaccgaagctatcgtatgcgtcgaactaacctctcaagagcgccaatgctcactaatcgaggcaggaacccgcttcaatttaggacccgtcacgataaccctatcagaaccccgaaatatccaacaaaaactgccacccgaaataatcacacttcaccctaaaatcgaagaaggcttcttcgacctcatgcacgtacaaaaagtcctgagtgcctcaacggtttgcaaacttcagtcctgcacccacggaatcccgggagatcttcaaatctaccacataggcaaccttcttaaaggagatcgcgtaaacggccacctcatccacaaaatcgagccacacttcaacacctcgtggatgagctgggacggctgcgatcttgattattactgcaacatgggggactggccatcctgtacgtacaccggcgtcactcagcacaaccacgcagcattcgtcaacctactcaacatcgaaacagactacacaaagacatttcactttcacagcaaacgcgtcaccgcccacggcgacacaccccaactcgacctcaaagccaggccgacctacggcgcaggagaaatcactgtcttagtcgaggtcgccgacatggaactccacaccaagaaagtcgaaatctcaggcctcaaattcgcatcgctcgcatgcaccggttgctacgcctgctcctccggaatatcttgcaaagttcggatacacgttgacgagcccgacgagctaactgtccacgtaaagagctccgatcccgatgtcgtcgccgcctccacctcactaatggcccgaaaacttgagttcgggaccgactctaccttcaaagccttctcagccatgcccaaaaccagcctttgcttctatatcgtggaacgggaatactgcaagagctgctccgaagacgacaccaagaaatgcgtagacacaaaacttgaacaaccccaatccatactgatcgaacacaaaggaacaatcataggcaaacaaaacgatacgtgcaccgcaaaagcgagttgttggctagaaagcgttaagtcattcttctacgggttaaagaacatgctaggtagcgtgttcggaaacttcttcgttggcatcttactattcctcgcacccttcgtcctcctagtactattcttcatgttcggttggaaaatactattctgcttcaaatgctgtcgacgcacccggggccttttcaaatacagacacctcaaagacgacgaagaaaccgggtatcggcgaatcatcgaacgcctaaactccaagaaaggtaaaaatcgactactcgacggcgaacgcctcgctgatcggaaaatcgctgaattattctccacaaaaacccacatcggc

SEQ ID NO: 15555 - RNA, 2916 nt, synthetic construct
  misc_feature 1..2916: note = derived and/or modified CDS sequence (opt11) from CCHFV(4701-ST-2009, Artificial)__KR814872.1__Gn-4aa-Gc
  source 1..2916: mol_type = other RNA
agcgaggaaccgggcgatgactgcatctcgcgcactcaactgctaaaaaccgaaacagccgagatacacgacgacaactacggcggacctggcgacaaaataacaatatgcaacggctcaaccgttgtcgatcaacgactcggcagcgaactcggatgctacaccataaaccgcgtaaaatccttcaaactctgcgagaacagtgccaccgggaagacctgcgaaatagactcaacaccagtcaaatgccgacagggcttctgtctcaaaatcacacaggaaggccgcggccacgtaaaactcagccgcggctccgaggtagtactcgacgcctgtgatagctcctgtgaaatcatgataccaaagggaactggcgacatactcgtcgattgtagcggaggccaacagcacttcctgaaagacaacttgatcgacctcggctgcccccacatacccctcctcggaaaaatggccatctacatttgccgcatgagcaaccacccacgcacaacgatggcgttcctgttttggttcagtttcggttacgtcataacctgcatcttctgtaaagccctattctactccctcatcatcatcggtacgctaggtaagaaaatcaaacagtacagagagcttaaaccgcagacatgcaccatctgcgaaaccgcccccgtaaatgccattgacgcagagatgcacgatctcaactgctcctataacatctgcccctactgcgccagccgtctcaccagcgacggcctagcgcgacacgtcacacaatgtcccaagagaaaggaaaaagtagaagaaactgaactatacttaaacctcgaacgtataccatggatagtaaggaaactcctacaggtgtcggaatcaaccggggtcgcgctgaagcgaagctcctggctgatcgtattactcgtactcctcacagtatcactctcaccagtccaatccgcaccagtagggcgcaagccactttttctcgattccatagtaaaaggcatgaaaaacctactcaattccacatcgctcgaaacctcactgtccatcgaagcaccatggggcgccatcaacgtgcaatcgaccttcaaacccaccgtctccaccgccaacatcgcgctgagctggtcctccgtagaacaccgcggcaacaaaatactcgtcacaggccgcagcgaatcaatcatgaaactagaggagcgcaccggcgtttcatgggacctaggggtcgaagacgcctcagagtcgaaactgctaactgtctcaatcatggacctctcacaaatgtactcccccgtctttgaatacctatccggcgaccgacaagtagaagaatggccaaaagcaacctgcacaggtgactgccccgaacgctgcggctgtacgtcatcaacctgcctccacaaagaatggccgcactcccggaactggcgatgcaacccaacatggtgctggggcgtaggtacaggctgtacctgctgcggagtcgacgtcaaagacctattcaccgaccacatgttcatcaaatggaaagtagaatacataaaaaccgaagcgatagtgtgcgtcgaactaacctcccaagaacgccaatgctccctgatcgaagcaggcacccgcttcaatctcggaccagtaacaataaccctaagcgaaccccgtaacatacaacagaagctaccacccgaaataataacactgcaccccaaaattgaagaaggattcttcgacctgatgcacgtccaaaaagtcctatccgcaagcacagtctgcaaactccaatcctgcacccacggcatccccggagacctccagatctaccacatcggaaacctacttaagggagatcgagtaaacggccacctcatccacaagatcgaaccccacttcaacactagctggatgtcctgggacggatgcgacctcgactactactgcaacatgggtgactggccctcatgtacctacacaggcgtcacccaacacaatcacgccgcgttcgtaaaccttctaaatatcgaaacagactatacaaaaaccttccacttccattccaaaagggtaaccgcccacggcgacacaccccaactcgacctaaaagcaagacccacctacggcgcaggagagataaccgtactcgtggaagtcgcagatatggaactccacactaagaaggtagagatcagcggactcaagttcgcatcccttacctgcaccggctgctacgcctgctcatcaggcatctcctgcaaggtccgaatccacgtcgatgagccagacgaactcacagtccacgtcaaaagctcagacccagatgtagtcgcagcatccacatccctaatggcccgtaaactagagttcggcaccgactctacattcaaagccttctccgctatgcccaaaacctcactgtgcttctacatagtagaaagggaatactgcaagtcctgcagcgaggacgacaccaaaaagtgcgtcgacactaaactcgagcaaccacaaagcatattgatagaacacaaaggaaccattatcggcaaacaaaacgatacctgcaccgccaaggcatcatgctggctagagagcgtcaaatcattcttctacgggctgaaaaacatgctcggttcggtgttcggcggcttctttgtgggtattctgctctttctggcccccttcgtactacttgtcctattcttcatgttcgggtggaaaatcctcttctgcttcaaatgctgcagacggacgcgcgggctattcaaatataggcaccttaaggacgacgaggaaacaggctaccgacgcatcatcgaacgcctaaactcaaagaaaggcaaaaatcgactcctcgatggagaacgcctcgccgaccgcaaaatcgccgaactcttcagcacaaaaacccacataggc

SEQ ID NO: 15556 - RNA, 2916 nt, synthetic construct
  misc_feature 1..2916: note = derived and/or modified CDS sequence (opt11) from CCHFV(5170-R-2011, Artificial)__KR814873.1__Gn-4aa-Gc
  source 1..2916: mol_type = other RNA
tcagaagaaccgggggacgactgcatatccagaacacaactcctcaaaactgaaaccgccgaaattcacgacgacaactacggcggccctggagacaaaattacaatctgcaatggctcaaccatcgttgaccagcgcctaggatccgaactcggctgctacaccatcaatcgagtaaaatccttcaagctctgcgaaaacagcgctaccggaaaaacctgcgaaatcgacagcacccccgtcaagtgtcgacagggcttctgcctgaagataacccaagaaggtcgcgggcatgtaaaactttctcgcggatcagaagtagtactggacgtctgcgacagctcctgcgaaataatgatcccgaagggcactggagatatcctagtagactgcagtgggggacaacagcacttcctcaaagacaacctcatagacctggggtgcccccacataccgttactaggcaagatggcgatatacatatgtcgcatgtcaaaccaccccagaaccaccatggcctttttattctggttcagtttcgggtacgtcatcacgtgcatcttctgcaaagcactattctactcactaatcatcatcggcacgttgggtaaaaagataaaacaatatagagaactgaaaccacaaacctgcaccatctgtgaaaccgccccagtgaatgcgattgacgccgagatgcatgaccttaactgctcttataacatctgcccctactgcgcctcgagactcacatccgaaggactcgcacgccatgtgactcaatgcccaaaacgcaaggaaaaagtggaagaaacagaactatacctaaacctcgaaagaatcccctggatagtacgcaagctactgcaagtcagcgagtcgacgggcgtcgccctcaaacgctcatcctggctaatagtcctcctagtcctcttaaccgtaagcctatccccagtccagagcgccccagtaggccgaaaaccactcttcctcgacagcatcgtaaaggggatgaaaaacctcctgaactccacaagcctagaaacatccctctctatcgaagccccctggggcgccatcaacgttcaatccacgtttaaaccgacagtctccactgccaacatagccctgtcatggtcttccgtagaacaccgaggcaacaaaatccttgtaaccggccgttctgaatccataatgaagctcgaagaacggactggcgtaagctgggacctaggagtcgaagacgcatcagaatccaaactcctcactgtctccatcatggacttatcacaaatgtactcgcctgtcttcgaatacctcagcggggaccgtcaggtcgaagaatggcctaaagccacatgcaccggggactgtccagaacgctgcggctgcacctccagcacatgcctacacaaggaatggccacacagccggaactggcggtgtaacccaacctggtgctggggcgtcggcactggatgcacatgttgcggcgtcgacgtaaaagacctatttaccgaccacatgttcatcaaatggaaagtagaatacataaagacagaggccatcgtctgcgtggagttaacctctcaagaacggcaatgctcgcttatagaagctggaacccgttttaatctcggtcctgtaaccatcacactctcggaaccccgcaacatacaacaaaaattaccacccgagatcatcaccctgcacccaaaaatagaagaaggcttcttcgacttaatgcacgtccaaaaagtcctaagcgcaagcaccgtctgtaaactccaaagctgcacccacgggatccccggcgacctccaaatttatcacatcggcaacctcctcaagggagaccgagtaaacggacacctcatccacaaaatcgaaccccacttcaacacatcctggatgtcgtgggacggctgcgacctcgactactactgcaatatgggcgactggccctcatgtacgtacacaggtgtgacacaacacaaccacgcggccttcgtaaatctccttaacatcgaaacggactacacaaaaaccttccacttccactcaaaaagagtaacggcccatggagacacaccgcaactggacctcaaggcacgaccaacatacggagcaggcgaaatcacagtattagtagaagtcgccgacatggaactccacaccaagaaagttgaaatatccggcctcaagttcgcctcactaacctgcacaggctgctatgcttgcagcagcgggatctcatgcaaggtccgaatccacgtggacgaacctgacgagctcacagtccatgtcaagtcctcggaccccgacgtagtagcagccagcacctctctcatggcccggaagctagagttcggcacagactcgacctttaaagccttctcagccatgcctaaaacctccctctgcttctacatcgtcgaacgagagtactgcaaatcctgcagtgaggacgacaccaaaaagtgcgtagacaccaaactagaacagccacaatccatcctcatagaacacaaaggcaccatcataggcaaacaaaacgacacatgcaccgcaaaagcctcatgctggctcgagtcagtgaaatcattcttctacggcctcaaaaacatgctcggatcagtgttcggtagcttcttcgtcggaatcctcctgttcctcgctcccttcgtactactcgtactcttcttcatgttcggatggaaaatcctattctgcttcaaatgctgtcgtcgcacacgtggtttattcaaataccgacacctcaaggatgacgaggaaacaggttaccgacgcatcattgaacgtctaaactccaagaagggcaagaatagactattagacggcgaacgactagccgaccgcaaaattgccgaactcttcagcacaaaaacacacatcggg

SEQ ID NO: 15557 - RNA, 2916 nt, synthetic construct
  misc_feature 1..2916: note = derived and/or modified CDS sequence (opt11) from CCHFV(Oman-199809166, Artificial)__KR864901.1__Gn-4aa-Gc
  source 1..2916: mol_type = other RNA
tccgaggagagcggagaggactgcatcagccgaacccagctcctgagaaccgaaaccgcagaaatccatggcgacaactacggcggcccaggcgacaagattaccatctgcaacggaagcactatagtcgaccaaagactcggctcagaactcggatgctataccatcaatcgcgtcaaatcgttcaaactctgtgaaaacagcgcaactggcaaatcctgcgaaatcgacaatacccccgtcaaatgtaagcaaggattctgcctgaaaatcacccaggaaggacgcgggcacgtcaaactgtctcgagactccgaagtagtgttagacgcctgcgattcatcctgcgaaataatgattccaaaaggaaccggagacatcctcgtcgactgctcaggcggacagcaacacttcctcaaagacaacctcatcgatttagggtgcccaaatatccccctcctcgggaaaatggccatatacatctgccgcatgtcgaaccaccccaaaaccaccatggcattcctcttctggttctctttcggatacgtaatcacgtgcatcctatgcaaggtcatcttttatcttctaatcgtcgtaggcacacttggcaagaaattcaaacaataccgagaactcaaaccgcaaacttgcaccatctgcgaaaccaccccagtaaacgctatcgacgccgagatgcacgacctaaattgtagctataacatatgcccctactgcgcctcgcgacttacctcggacggactagcacgacacgtcatgcaatgcccaaaacgtaaagagaaaatagaagaaaccgaactctacctaaacctcgaacgaataccctgggtagtacggaagctcctccaagtttcagaatcaaccggcgtagcgctcaaacgttcatcttggctaatagtactgctagtcctcctaacagtctcactctcccccgtacagtcagcacccatcggccgcaagccactcttcctcgacagcatagccaaaggcatgaaaaacctgctcaacagcaccagccttgaaacatctctttcaatcgaagcgccctggggcgccatcaacgtgcaatcgacattcaaacccaccgtatccacggcaaacatagcgctgtcctggtcctccgtcgaacacagaggcaacaaaattctagtttccggccgctccgagtccatcatgaaactcgaagaacgcacggggatctcctgggatctaggcgtcgaggacgcctcggaaagcaagctcctcaccgtctccgtgatggacctctcgcaaatgtacagccccgtgttcgagtatctctccggagaccgacaggtagaagagtggccaaaggccacctgtaccggcgactgccccgaacgctgcggatgcacctccagcacatgtctgcacaaggaatggccccacagtagaaactggcgctgcaaccccacctggtgctggggcgtaggaaccggctgcacctgttgcggcctcgacgtaaaagaccttttcaccgactacatgttcgtcaagtggaaggtcgaatacattaaaacagaagcaatagtgtgcgtcgaactaaccagccaagaacgacaatgctcactgatcgaagccggtacccgattcaacctcggccccgtcacgataacactatcagaaccacggaacatccagcaaaaattacccccggaaatcgtaacgttacatccacggatcgaggagggcttcttcgacctcatgcacgtccaaaaggtcctctcagcctccacggtctgtaaactgcaaagctgcacacatggcgtgcccggcgatctccaagtctaccacatcggcaacctcctgaagggcgataaagtaaacggccacctcattcacaaagtagaaccccacttcaacacatcatggatgtcttgggacggatgcgacctcgactactattgcaacatgggagactggccctcatgcacatacaccggagtcacccagcacaaccacgcggccttcgtcaacctactaaacattgaaacggactacacaaagaacttccacttccattcaaaacgcgtaacagcacacggcgacacaccccaactggacctcaaagcccgcccgaactacggcgcaggcgagatcaccgtactcgtcgaagtagcagacatggaactacacacaaagaaaattgagatctctggccttaaattcgctagcctaacctgtaccgggtgctacgcatgttcctccggaatcagctgcaaagtccgcatacatgtcgacgaacccgatgaattaacggtccacgtcaaaagcgaggaccccgacatagtcgccgcatcaagctcgctcatggcccggaagctagaatttggcaccgactcgacgttcaaagccttctcagccatgcccaaaaccagcctatgcttttacattgtcgaacgggaatattgcaaatcatgttcaaaggaagacacccagaaatgcgtcaacgccaaactcgaacgcccccaatccatcctaatcgaacataagggcaccatcatcggaaagcagaacgacacatgcaccgccaaagcatcctgttggctcgaatccgtcaagagcttcttctacggactcaaaaacatgctctcaggaattttcggaaacgtatttataggaatctttcttttcttggcccccttcatcctactcatccttttcttcatgtttggctggcgcatacttttctgcttcaaatgctgccgccgaactcgtggactcttcaaataccgacacctcaaagacgacgaagaaactggctatcgcaaaatcatcgaaagactgaacaacaaaaagggtaaaaacaagctactcgatggggaacggctggccgaccgaaaaatcgccgaactcttcagcaccaaaacacacatcgga

SEQ ID NO: 15558 - RNA, 2916 nt, synthetic construct
  misc_feature 1..2916: note = derived and/or modified CDS sequence (opt11) from CCHFV(200406546-Turkey, Artificial)__KR864902.1__Gn-4aa-Gc
  source 1..2916: mol_type = other RNA
agcgaggaacccggagacgactgcatctcccggacccaactcctccgaacagagaccgcagaaatccacgacgacaactacggaggcccaggagacaagatcaccatctgcaacgggagcacgatcgtagaccaacgactaggctccgaactagggtgctacacgataaacagggtaaagagctttaagctgtgcgaaaacagcgcaaccggaaaaacctgcgaaatcgactcaacccccgtgaagtgccgccaaggattctgcttaaaaatcacacaagaaggacgaggccacgtcaaattatcacgcggatccgaagtcgtcctggacgtctgtgactcatcatgcgaggtcatgatccccaaaggaaccggagacattctagttgactgttccggaggacagcaacacttcctaaaggataacctcatcgacctaggctgcccgcacgtacccctgctcggccgcatggccatctacatctgcagaatgagtaatcacccccggaccaccatggcctttctgttctggttctcattcggatacgtcattacatgcatattctgcaaagcactcttctactcactaatcatcatcggaaccctcggcaagaaattcaaacaataccgcgagctaaaaccccaaacttgcacaatctgtgaaacagcaccagtcaacgccatagacgcagaaatgcacgacctgaactgctcttacaacatatgcccatactgcgcaagtcgtctaaccagcgacggtctggccagacatgttccccaatgccccaaacgcaaagaaaaagttgaagaaactgaactctaccttaacctcgaacgaatcccatggatcgtcagaaaactcctccaagtctcggagtcaaccggcgtcgctctgaaacgctccagctggttaatcgtcctccttgtgctcctaacggtatccctctcccccgttcaaagcgcaccagtaggacgaaaaccgctgttcctcgactcaattgtcaaaggcatgaaaaacctcctcaactccacaagcctggaaacctcactttccatcgaagcaccgtggggagctatcaatgtacaatctaccttcaagcccactgtgtccaccgccaacatcgcactatcgtggagctcaatcgagcaccgtgggaacaagatcctcgtcactggacgaagtgaatccatcatgaaactcgaggaaagaaccggggtctcctgggacctgggcgtagaagacgccagcgaaagcaaactcctcacagtgtccatcatggatttatcccaaatgtactcaccagtcttcgagtacctaagcggagaccgccaagtcgaagaatggcccaaagcaacttgcacaggggattgcccggagagatgtggctgcaccagctccacatgcctccataaagaatggccacattcacgtaactggcgatgcaacccaacatggtgctggggcgttggaaccggctgtacctgctgtggagtcgacgtgaaagacctgttcacagaccacatgtttgtcaaatggaaagtagaatacatcaagacggaagcaatcgtatgcgtagaactcacctcgcaagaacgacaatgctctctgatagaggccggcacgcgcttcaatttaggacccgtcaccatcaccctttccgaaccaagaaatatccaacaaaaattgccaccagaaataataaccctccacccaaaagtcgaagagggcttcttcgatctaatgcacgtccaaaaagtactctccgcctcaaccgtctgcaaactccaatcctgcacccacggcataccaggcgacctacaagtataccacattggcaacctcctgaagggagacagggtcaacggacacctcatccataaaatagaaccccacttcaacacctcatggatgtcctgggacggctgcgacctagactattactgcaacatgggggactggcccagctgcacatacaccggagtcacccagcacaaccacgccgccttcgtcaacctacttaacatcgaaaccgactacaccaaaacattccacttccactccaaacgcgtaacagcccacggtgacacaccccaactagatttgaaagcacgaccgacctacggggccggagagataaccgtcttggtcgaggtcgctgacatggagctccacacgaagaaagtggagatctccggcctcaaattcgcctcgctcgcatgcaccggatgttacgcgtgctcatccggtataagctgcaaagtacgcatccatgtcgacgagccagacgaactcaccgtccacgtcaaatcctcagacccagacgtagtagcagcatcgacctcgctaaccgcacggaaactagagttcggcacagactctacattcaaagccttctccgccatgccaaagaccagcttatgcttttacatagtcgaaaaagaatactgcaagtcctgcaacgaagacgacacacaaaaatgcgtcgacactaagctagaacaaccccagtccatcctcatcgagcacaagggcaccatcatcggaaaacaaaacgatacctgcaccgccaaggcctcatgctggctcgagtccgtcaaatccttcttctacggcctgaaaaacatgctaggatcagtcttcggcaacttcttcatcggcatactactattcctggctcccttcgtcctcctagtcctcttcttcatgttcggttggaaaatcctcttctgcttcaaatgctgcagacgcacccgcggcctcttcaagtatcgtcacctaaaggacgacgaagagacagggtacaaacgcataatcgaacggctaaacaataagaaaggcaaaaacagactactcgacggagaaaggctagcagacagaaaaattgccgagctattctccacaaaaacacatatcgga

SEQ ID NO: 15559 - RNA, 2916 nt, synthetic construct
  misc_feature 1..2916: note = derived and/or modified CDS sequence (opt11) from CCHFV(1-CR/HU-2015, Artificial)__KU161584.1__Gn-4aa-Gc
  source 1..2916: mol_type = other RNA
tcggaagaaccaggcgacgactgtatttcccgcacgcaactactaagaacagaaaccgccgaaatccacgacgataactacggagggccaggggacaaaataacaatttgcaacgggtcaaccatcgttgaccaacgactcgggtccgagctaggctgttacaccatcaacagagtaaagagcttcaaattatgcgaaaactcagccaccggcaaaacctgcgaaatcgactccacccccgtaaaatgccgacagggattctgtctcaaaataacgcaagaaggccgcggccacgtaaaactctcgcgaggcagcgaagtagtactagacgcctgcgattcatcctgcgaagtaatgatccccaaaggaaccggcgacatcctggtagactgctcaggcggacaacaacacttcctaaaagacaaccttattgacctaggctgcccacacatcccactcctcggcaaaatggccatctacatctgccgcatgtccaaccaccccaggacaacaatggccttcctcttctggttctcgtttggctacgtcataacttgcatcttctgcaaagccctgttctacagcttaataatcatagggaccctcggtaagaagataaaacagtacagagagctaaaaccacaaacatgcaccatatgtgagaccgcccctgtcaacgcaatcgacgctgaaatgcacgacctgaattgctcgtacaatatatgtccttactgcgccagcaggctcacgtccgacggcctcgcccgccacgtgacccaatgccccaaaagaaaagaaaaagtcgaagagacagaactctacctcaacctcgaacgcatcccgtggatcgtacgaaaactactgcaagtctccgaatcaactggggtcgccctgaaaagaagcagctggctaatagtcctcctagtacttctcacagtctccctaagccccgtccagtccgctccagtaggtcgcaaaccactcttcctcgactccatcgtgaaaggcatgaaaaatctcctcaactccacatcgctcgagacatcactctcaatcgaagcaccctggggcgcaataaacgtccaatctacattcaaaccaaccgtatccaccgcaaacatcgcactctcctggtcaagcgtcgaacaccgcggcaacaaaatcctcgtaacaggccggagcgaatctattatgaaactagaggaaaggactggagtaagttgggaccttggagtagaagatgccagcgaatcaaaactcctcacagtatcaatcatggatctctcacagatgtattcccccgtattcgaatatctatccggagacagacaagtagaagaatggcccaaagctacatgcaccggcgactgtccagagcgatgcggctgcacctcaagcacatgccttcacaaagaatggccccacagccgcaactggagatgcaacccaacatggtgttggggcgtgggtacgggctgtacctgctgcggagtcgacgtcaaagatctgttcactgatcacatgttcgtcaaatggaaagtagaatacatcaagaccgaagccatagtctgcgttgaactgacttcgcaagagcgacaatgctctctaatagaagccggcacccgcttcaacctcggaccagtaaccatcactctctcagaacctcgcaacatacaacaaaaactcccaccagaaatcataacgctacaccccaaaatagaagaaggcttcttcgacctgatgcacgtacagaaagtcctgagtgcctcaaccgtatgcaaactacaatcctgcacccacggcataccaggagacctacaagtataccacataggaaatctactcaagggcgaccgagtcaacggccacctcatacacaaaatagaaccacacttcaacacctcctggatgagctgggacggctgcgacctagactactactgcaacatgggcgactggccctcatgcacatacaccggagtaacccagcacaatcacgcagccttcgtcaacctcttaaacatcgaaacagactacaccaaaaccttccacttccactcaaaacgcgtaacggcgcacggcgacacgccccaactcgacctcaaggcaagacccacctacggcgcaggcgagatcaccgtactcgtagaagtggccgacatggaacttcacaccaagaaagtagaaatatctggcttaaaattcgcctcactcgcatgcactggctgctacgcatgtagcagcggcatatcctgcaaagtacgtatacacgtcgacgaacctgatgaactcaccgtacacgtcaagagctcagacccagacgttgtagccgcaagcacatccctgatggcccgtaaactcgagttcggtaccgattccacattcaaggcgttctccgccatgccgaagacctctctctgtttctacatagtggaacgcgaatactgcaaatcctgctccgaagatgacacaaagaaatgcgtagatacaaaactcgaacagccacaatcaatcctcatagaacacaaaggaaccataattggcaaacagaacgatacctgcacagctaaggcctcatgctggttagaatccgtcaaatcattcttctacggccttaaaaacatgctaggatcagtctttggcaacttcttcataggcatactccttttcctcgcaccattcgtgctcctagtgctgttcttcatgttcggctggaagatcctcttctgctttaaatgctgcagaaggacccgcggcctgttcaagtatcgacacctaaaagacgacgaagaaaccggttaccgacgaatcatcgaacgcctaaacaacaagaaaggcaaaaacagactcctcgacggagaacgcctcgccgaccggaaaatagccgaactgttcagcaccaaaacacacattggt

SEQ ID NO: 15560 - RNA, 2916 nt, synthetic construct
  misc_feature 1..2916: note = derived and/or modified CDS sequence (opt11) from CCHFV(Gaib, Artificial)__KX013445.1__Gn-4aa-Gc
  source 1..2916: mol_type = other RNA
tccgaagagtcgagcgacgactgcatcagccgcacccagctcttgcgcaccgaaaccgccgaaatacacaacgataattacgggggccccggcgacaaaatcacaatatgcaacggatcaacaatcgtcgaccaacggctcggctcagaactaggctgttataccatcaaccgggtaaagagcttcaaactctgcgaaaacagcgccaccggcaaatcatgcgaaatcgactccatccccgtcaaatgccgacaaggcttctgcctgaaaatcacccaggaagggcgcggccatgtgaaactcagccgcggctctgaagtcgtcctcgacgcctgcgactcatcctgcgaaatcatgatcccaaaaggcaccggcgacattctagtcgactgcagcggagggcaacaacacttcctcaaggacaacctcatcgacctcgggtgccccaatatacccctactcggaaaaatggctatctacatatgccgcatgtccaaccaccccaaaaccacaatggctttcctattctggttctcatttggatacgtcatcacatgtatattctgcaaagcaatattctacctactcataatcgtaggtacacttggtaagaaatttaaacagtaccgagaacttaaacctcagacctgcactatatgcgaaacgactcccgtcaacgcaatagacgccgaaatgcatgacttaaactgctcctataacatctgcccctactgtgcctctcgactaacttcagacggcctcgccagacacgtagtccattgcccaaaacgcaaagagaaaatagaagaaaccgaactatatctcaacctcgagcgtgtaccgtgggtcgtgcgaaaactgctccaagtgtccgaatccactggtgttgccctcaaacgctcctcctggctcatagtcctcctcgtcctactcaccgtctccctgtcacccgtccaatccgcccccataggtagaaaacccctcttttcagactcaatcgtaaaaggcatgaagaacctgctcaactccacatctcttgaaacctccctatcaatcgaggctccatggggcgcaatcaacgtccaatcaacattcaagcccactgtctcaacggcaaacatagccctgtcgtggtcctccatcgagcacagaggcaacaaaatcctagtttccggtcgctccgaaagcataatgaaactcgaagaacgaacaggaataagctgggacctcggtgtcgaggacgcatcagaatcccgcctactaaccgtaagcgtaatggatctatcacagatgtattcacccgtttttgaatacctcagtggcgaccggcaagtcgaagaatggcccaaggcaacctgcaccggagattgcccagaaagatgtggatgcacctcgtcaacgtgcctacacaaggaatggccacactccagaaactggcgctgtaaccctacctggtgctggggagtgggcacgggctgcacctgttgcggcctagacgtcaaagacctcttcaccgactacatgttcgtcaagtggaaagtcgaatacatcaaaaccgaggctatcgtgtgcgtcgaattaacttcccaagagcgccagtgcagcctaatagaggccggcacacgcttcaacctaggacccgtaacaatcacacttagcgaacccagaaacatccaacaaaaactcccacccgaaatcatcaccctccacccccgcatagaggaaggcttctttgacctaatgcacgtccaaaaggtgctatccgcctcgaccgtctgcaaactacaaagctgcacacacggcgtacccggtgacctccaagtctaccacataggcaatctgctcaaaggcgataaagtcaacggccacctcatccataaaatagaaccccatttcaacacaagctggatgtcctgggacgggtgcgacctagactattactgcaacatgggcgactggccatcatgcacctacacaggagtcacccagcacaaccacgcagctttcgtcaacctcctcaacatcgaaaccgactatacaaagaacttccacttccacagcaaaagggtcaccgcacacggcgacaccccacaactcgacctcaaagcacgacccacatatggagccggagagatcacagtcctagtcgaagttgctgacatggagctacacaccaagaaaatagaaatctcaggactcaaattcgcctcactaacatgtaccggatgctacgcatgttcttcaggcatctcatgcaaagtcagaatccacgtcgacgaaccagacgagctcacagtacacgtcaaatcagaggacccagacattgtcgcagcatcctccagcctgatggcaagaaaactggagttcggaacagattccacctttaaagccttttcggctatgcccaaaacctcgctatgcttctatatcgtcgaacgagaatactgcaaaagttgcagccgggaagacacccagaaatgcgtatcgactaaactcgaacaaccccaatccatacttatcgaacacaagggcaccatcatcggcaaacaaaacaacacgtgcacaaccaaaacaacctgctggctcgaaagcgtaaaatcattcttctacggcctcaaaaacatgctctcctccatcttcggcaacgtcttcgtcggaatcttctcctttctagccccgttcattctcttgatactgttcttcatgttcggctggcgcatcctattctgcttcaaatgctgccgccgcacccgcggcctcttcaaataccggcacctcaaggacgacgaagaaactggctaccgacgcatcatcgaacgcctcaacaacaagaaaggcaaaagtaaactcctcgacggagaacgactcgctgaccgcaagatcgcagaactattctcaacaaaaactcacatcgga

SEQ ID NO: 15561 - RNA, 2916 nt, synthetic construct
  misc_feature 1..2916: note = derived and/or modified CDS sequence (opt11) from CCHFV(Hodzha, Artificial)__KX013448.1__Gn-4aa-Gc
  source 1..2916: mol_type = other RNA
tccgaagaaagtggcgacgactgcatcagcaggacccaactcctacgaacagaaacagcggagatccacggcgacgactacggcggccctggcgacaaaatcaccatctgtaacgggtccaccatagtagaccagcgcctcggctcagaactgggatgctataccataaaccgggtaaaatccttcaaactctgtgaaaactccgccaccggaaagagctgtgaaatagactcaactcccgtgaaatgcagacagggctactgccttaaaatcacccaagaaggacggggtcatgtaaaactcagccgtggctccgaagtcgtactggacgcatgtgactcctcatgcgaggtaatgattccaaagggaaccggtgacatactcgtagactgctcagggggccaacaacacttcctcaaggataacttgatcgacctaggctgcccccgaatacccctactaggaaagatggccatctacatctgccgcatgtccaaccacccagagacaaccatggccttcctgttctggttctccttcggatacgtcataacatgcatcctatgcaaagcaatcttctatctactgataatcgttggcacgctcggcaaaaggttcaaacaataccgagagctcaagccccaaacctgcaccatctgcgagactacacccgcaaacgcaatcgacgcagagatgcacgacctaaactgctcctacaacatctgcccgtactgcgcttcccgactcacatcggatggcctcgcacgccatgtaacacaatgccccaaaagaaaggagaaagtagaagagaccgaattgtacctcaacctcgaacggatcccatggatcgtccgaaaactcctacaggtcagcgaatcgaccggagtcgcactaaaacgttcaagctggctcatcgtcctcctagtactgttcgcagtatccttaagccccgtccaatccgcacccattggccgacgacccctattccttgactccatcgtcaaaggcaaaaagaacctactaaactcaacctccctcgaaacatcgctcagcatagaggccccctggggagcaatcaacgtacaatcaacatacaaacctaccgtcagtacagccaacatcgcactgtcatggtccagtgtcgaacaccgcggtaacaaaatcctcgtatcgggccgctccgaaagcatcatgaaactcgaagaacgaacaggtatctcctgggacctcggagtcgaagacgcgtccgaatccaaactcctcaccgtaagcgtgatggacctaagccagatgtactcacccgtcttcgaatacctctcgggagaccgacaggtagaagaatggcccaaggcgacctgcacaggcgactgcagcgaaagatgcggctgcacctcaagcacatgcctccacaaagagtggcctcactcccggaattggcgatgcaacccaacctggtgctggggcgtcggcactggatgtacctgctgcgggttagatgttaaggacctgtttaccgactacatgttcgtgaagtggaaagtcgactacattaaaactgaagccatagtctgcgtcgaacttacatcccaggagcggcagtgcagcctagtcgaagcaggcacgcgcttcaacctaggtcccgtcaccatcacactctcagaaccgcgaaacatccaacaaaagctaccacccgaaatcattaccctgcacccccgcatcgaagaaggctttttcgacctgatgcacgtgcaaaaagtgctaagcgcgtccaccgtttgcaaactacaaagctgcacacacggcgtcccaggcgacctccaagtctaccacatcggcaacctactcaaaggcgacaaggtcaacggtcaccttatccacaaaatcgaaccacacttcaacacctcctggatgagctgggacgggtgtgacctagactactactgtaacatgggcgactggccaagctgcacgtatacgggcgtaacacagcacaaccacgcgtccttcgtcaacctgcttaacatagagaccgactacaccaagagtttccatttccattccaaacgcgttacggcacacggcgatacccctcaactggacctaaaagcacgccctacatacggggcgggcgagataaccgtcctagtagaggtagccgacatggaactccatactaagaaaatagagatcaccggcctaaaattcgcatccctgacctgcacaggatgctacgcatgcagctccggtatctcatgcaaggtacgcatccacgtcgatgaacccgacgaactcaccgtacacgtcaaatccgacgacccagacgtggtcgctgcatcctcatctctaatggcgaggaaactcgagttcggaaccgattcgaccttcaaagcgttctcggccatgccaaagacatcactctgtttctatatcgtggaacgagaatactgcaaatcctgctctaaggaagacacccaaaaatgcgttaacacaaaactcgagcaaccccaatcaatcttaatcgagcaaaaaggcacaatcatcgggaagcaaaacaatacctgcacagccaaagcctcgtgctggctagaatccgtgaaatcattcttctatgggctcaaaaacatgctatcggggatcttcggaaacgtcttcgtcggcatcttcctcttcctagcgccattcatactcctcatcctcttcttcatgtttggatggcgcatactcttctgcttcaagtgctgccggcgcacacgaggcctcttcaaatacaaacacctcaaagacgatgaagaaacaggctacagacggatcatagagcgcctcaataacaaaaagggaaagaacaaacttcttgatggcgaacggctcgcagacagacgcatcgcagaactattctccacaaaaacgcacataggc

SEQ ID NO: 15562 - RNA, 2916 nt, synthetic construct
  misc_feature 1..2916: note = derived and/or modified CDS sequence (opt11) from CCHFV(IbAn7620, Artificial)__KX013451.1__Gn-4aa-Gc
  source 1..2916: mol_type = other RNA
tcggaagaaccctcagacgattgtatctctcgaacccaacttctccgtacagaaaccgcagagatccacggagataactacggcggtcccggagacaagatcacaatctgcaacgggtccacaatcgtagaccagcgcctaggatcagaactgggctgctacactatcaacagagtgaaatctttcaagttgtgcgaaaacagcgccacaggtaaaaactgcgaaatcgatagcgtccccgttaaatgccgccaaggctactgcctgcgtatcacgcaagaaggcagaggccacgtgaaactttcacgcggctccgaaatagtcctcgacgcctgcgacacctcctgcgaaatcatgatcccgaaaggcacaggcgacattcttgtcgactgctccggaggacaacaacactttctcaaagataacctaatcgacctcggatgcccaaagatcccacttctcggcaaaatggctatctacatatgcaggatgagcaaccacccaaaaaccacaatggctttcctgttctggttctcattcgggtacgttattacgtgcatcctctgcaaggcgatattctacctgctaataatcataggaaccctaggcaaacgcctaaagcaataccgagaactaaaacctcagacatgcaccatatgcgaaaccacccccgtgaacgcaatcgacgccgaaatgcacgatctcaactgcagctacaacatctgcccctactgcgcctcacgtctgacatccgacgggctggcccgtcacgtgatacaatgccccaagcgtaaagaaaaagtagaggaaacagaactatacctaaacctggaacgaatcccttgggttgttcgaaaacttctgcaggtctcagaatcaaccggcgtcgccctaaagcgatccagctggctcatagtgctcctcgtcctatttaccgtttcgttgtcccccgtacagagcgcaccgataggtagaaaaccactgttcctggactcaatcgccaaaggaatgaagaaccccctaaactctacctccctggaaacctcactctcgatcgaagccccgtggggtgcaatagacgtacagtcaacctacaagccaaccgtgtccacagccaatatcgcactctcatggagctcagttgagcaccgcgggaacaaaatcctggtctccggcagatcagaatcaatcatgaaactagaagaacgcaccggtatctcttgggacctgggtgtggaggacgcatctgaatccaaactgctaacagtgtccgtaatggacctctcacaaatgtactcccccgtcttcgagtacctgtcaggcgaccgacaagtggaagaatggcccaaagcaacctgcaccggcgactgccccgaacgctgcggctgcacgtcatcaacatgcctacacaaggaatggccacattccagaaattggcgctgcaaccccacatggtgctggggcgtcggcaccggctgtacctgctgcggcctcgacgtcaaggacctgttcaccgactacatgttcgttaagtggaaagtcgagtatataaaaacagaagccatcgtctgcgtcgaactgaccagccaagagcgccaatgctctctcatcgaagccggaacaaggttcaacctcggtccggtcaccatcactctcagcgaacccagaaacatacaacaaaagctcccacccgaaattatcacactacaccccagaatcgaagagggctttttcgacctcatgcacgtccaaaaagtactcagcgcatccacagtatgcaaactccaatcgtgcacccacggcgtcccgggcgatctacaagtatatcatataggaaacctcctaaaaggcgacaaagttaacggccacctcatacacaaaatagaaccacatttcaacacatcgtggatgtcctgggacggatgcgacctcgactactactgcaacatgggcgattggcccagctgcacctataccggcgtcacacaacacaaccacgcctcattcgtcaacctgctaaacatcgaaacagactacaccaaaaacttccacttccactccaaacgcgtcacagcacacggcgacacaccccaactagatctaaaagcaagacccacctacggagctggcgagatcaccgttctagtagaagtagccaacatggaactccacaccaagaaaattgaaatatcaggcctgaagttcgcatcattaacttgcactggctgctacgcttgctcatccggaatttcttgtaaagtacgaatccacgtcgacgaacccgacgaactaaccgtccacgtcaaaagcgacgacccggacgtcgtcgccgcctcctccagcctgatggcccgcaaactcgagttcggcacggactccacattcaaagccttcagcgccatgccaaagacatccctctgcttctacatagtcgaacgcgaacactgcaaaagctgctcggaagaagacaccaaaaagtgcgtaaataccaaactagaacagcctcaatccatcctaatcgaacacaaaggcacgatcatcggcaaacaaaacagtacctgcactgcaaaggcctcatgttggctcgaatcagtcaaatcgttcttttacgggctaaagaacatgctatccggcatattcggaaatgtatttatgggcatcttcctattcctggcccccttcatcctgctaatcttattcttcatgttcggctggcgcatacttttctgcttcaagtgctgccgccgcactcgcggcctcttcaaataccggcaccttaaggacgacgaggaaacagggtaccgacgcatcatcgaacgactaaacaacaagaaagggaaaaacaaactactggacggagaacgtctggcagatcgacgcatcgcagaactcttctcgactaaaacccacataggc

SEQ ID NO: 15563 - RNA, 2916 nt, synthetic construct
  misc_feature 1..2916: note = derived and/or modified CDS sequence (opt11) from CCHFV(K128_76, Artificial)__KX013454.1__Gn-4aa-Gc
  source 1..2916: mol_type = other RNA
agcgacgagtcgggcgacgactgcatcagccgcacccagctgctcagaactgagacggccgagatccacggggacaactacggcgggccaggcgacaagatcaccatctgcaacgggtccacaatcgtggaccagagactgggcagcgagctgggctgctacaccatcaaccgggtcaagtccttcaagctctgtgagaatagcgccacgggaaagtcctgcgagatagacagcatccccgtgaagtgccgccagggctactgcctgaagatcacccaggagggccggggacacgtgaaactgtcccgcgggagcgaagtcgtgctcgacgcgtgcgactcaagctgcgaagtgatgatccccaagggcaccggcgacatcctggtcgactgctcagggggccagcagcacttcctgaaggacaacctcatcgacctggggtgcccaaaaatccccctgcttggcaagatggcaatctacatatgccggatgagcaatcacccgaagaccacgatggccttcctattctggttctcgttcggctacgtgatcacctgtatcgtgtgcaaggccatcttctacctgctcattattgtcgggacactgggcaagcgcttcaagcagtaccgggagctgaaaccccagacctgcacaatctgcgagaccactcccaccaacgccatcgacgcggagatgcacgacctcaactgcagctacaacatctgcccctactgcgcctcccgcctgacgagcgatgggttggcccggcacgtgacccactgcccgaagcggaaggagaaggtagaagaaaccgaactatacctgaatctggagcggatcccctgggttgtgcgcaagctcctccaggtgtccgagagcaccggcgtggccctgaaacggagctcctggctcatcgtgctgctggtcctcttcgcggtgagcctgtcccccgtgcagagcgccccaataagtcgacggccgctgttccaggacagcatcgtgaaggggatgaagaacctcctcaactccacgagcctggagacctccctcagcatcgaggccccctggggtgccatcaatgtacagtccacctacaagcccgccgtgagcgcggccaacatcgccctgtcctggagctccgtggagcaccgcggcagcaagatcctggtctccgggcggtccgagtccatcatgaaacttgaagaacgcactggcatcagctgggatctgggggtagaggacgccagcgagtcaaagctgcttacggtaagcgtcatggatctctcccaaatgtattcccccgtgttcgaatacctgagcggcgaccggcaagtcgaagagtggccgaaggctacgtgcacaggcgactgccccgagcgatgcggctgcaccagctctacgtgcttacacaaggagtggccccactctcgcaactggcggtgtaaccccacctggtgctggggagtggggaccggctgcacgtgctgtgggctggacgtgaaggacctgttcaccgactacatgttcgtcaagtggaaggtcgagtacatcaagacagaagccatcgtatgcgtcgagctcacatcccaggaaaggcagtgcagcctgatcgaggcaggcacccggttcaacctgggccccgtgacgatcaccctgtccgagccccgcaatattcagcagaagctcccgcccgagatcatcaccctgcacccccggatcgaggagggcttcttcgatctgatgcacgttcagaaggtcctcagcgcctccaccgtgtgcaagctgcagagctgcacacacggcgtgcccggggacctgcaggtctaccacataggcaacttactgaagggggatcgtgtgaacggccacctgatacacaagatcgagccccactttaatacgtcctggatgagctgggatggctgcgatctcgactattattgcaacatgggggactggcccagttgcacctatacaggcgtcacccagcacaaccacgccagctttgtcaacctgctgaacatcgagacggactataccaagagcttccacttccactccaagcgggtgaccgcacacggggacaccccacaactcgatctgaaggcgcgccccaactacggcgccggggagatcacagtgctggtcgaggtggccgacatggagcttcacaccaagaagatagagatcagcggcctgaagttcgcctccctgacttgcaccgggtgctatgcctgcagctccggaatctcttgcaaggtgagaatccacgttgacgagcccgacgagcttactgtgcatgtgaagtccgacgacccggacgtcgttgcagccagctccagtctgatggcgcgcaagctggagttcggcaccgactccaccttcaaggccttctccgcgatgcccaaaacgtccctttgcttctacattgttgagcgggagtactgcaaaagctgctccaaggaggacacacagaagtgcgtcaataccaagctggagcagccccagagcatcctcatcgaacacaaggggaccatcataggaaagcaaaacaacacgtgtaccgccaagacctcatgctggttggagagcgtgaaatctttcttctacgggctcaagaacatgctgagcggaatcttcggcaacgtgttcgtcgggatcttcctcttcctggcccccttcatcctactcatcctgttcttcatgttcggctggcgcatcctgttctgcttcaagtgctgccggcgcacccggggcctcttccgctacaagcacctggagaacgacgaagagaccgggtacagacgcatcatcgaacggctgaataacaagaaggggaagaacaagctcctggacggcgagcgcctggccgaccgccggatcgccgaactgttcagcacaaagacccatatcggc

SEQ ID NO: 15564 - RNA, 2916 nt, synthetic construct
  misc_feature 1..2916: note = derived and/or modified CDS sequence (opt11) from CCHFV(K168_40, Artificial)__KX013457.1__Gn-4aa-Gc
  source 1..2916: mol_type = other RNA
agtgatgagtctggggacgactgcatcagtcgcacccagctgctccggaccgagaccgcggagatccacggggacaactacggcggtcctggagacaagatcaccatctgcaacgggtccaccatcgtggatcagcgcctcggcagtgagctgggctgctacaccatcaaccgggtcaagtccttcaagctctgcgagaactcagccactgggaagtcctgcgaagtggacagcatccccgtcaagtgccgacagggctactgcctgaagatcactcaggaggggcgcggccacgtcaaactgagtcgcggcagcgaggtggtgctcgacgcttgcgacagtagctgcgaggtcatgatacccaagggtaccggtgacatcctggtggattgctcagggggccagcaacacttcctgaaggacaatctcatcgacctgggctgccccaagatccccctgctcgggaagatggccatctacatctgccggatgtcgaatcatccgaagaccacgatggcattcctgttctggttctccttcggctacgtcataacttgcatcgtatgcaaggccatcttctacctgctcatcatcgtcgggaccctgggcaaacgcttcaagcagtatagagaactgaaaccccagacctgcacaatctgcgagactaccccgaccaacgcaatagacgcggagatgcacgacctgaactgtagctacaacatctgcccctactgcgcgtcccgactgacgtcggacgggcttgccagacacgtgacgcactgcccgaagcgtaaggagaaagtcgaggagaccgaactctatctgaacctggaacgaatcccctgggttgtgcgcaagttgttacaggtgtccgagagtaccggggtagccctgaagcggagctcctggttaatcgtgctgctcgtactgttcgcggtgagcctgtcccccgtgcagagcgcccccatcgggcgtcggccgctgttcttagacggaatcgtcaagggcatgaagaacctgctgaactccacgagcctagaaacctccctctcgatcgaggccccctggggcgccatcaacgtgcagtccacctacaagccgacggtatcagctgcgaacatcgccctgtcctggagctccgtcgagcatagggggaacaagatccttgtgagcgggcggagcgagagcattatgaagctggaggagcgtacgggaatctcctgggacctgggtgtagaggacgcaagcgagagcaagctcctgaccgtgtcagtcatggacctgagccagatgtactcccccgtcttcgagtacctcagcggcgaccggcaagtggaggaatggccgaaagctacatgcaccggcgactgccctgagcgctgcgggtgcacgtccagtacctgtctgcacaaagagtggccccactcccgcaactggcggtgcaaccccacctggtgctggggtgttgggaccggctgcacgtgctgcgggttagatgtaaaggacctcttcaccgactacatgttcgtgaagtggaaggtggagtacatcaagaccgaagctatcgtttgtgtggagctgaccagtcaagagcgccagtgctccctgatagaggcgggtacgcgtttcaacctggggccggtgaccataaccctcagcgagccccgcaacatccaacagaagttgcccccagaaatcatcaccctacacccgcggatcgaggaggggttcttcgatctcatgcacgtacagaaagtactatccgccagcaccgtgtgcaagctgcagtcctgcacgcatggcgtccccggggaccttcaggtttatcatatcggcaacctgctgaagggcgacaaagtgaacgggcacttgatccataagatcgagccccacttcaacaccagctggatgtcctgggacggctgcgacttagactactactgcaacatgggggactggccttcctgcacatacacaggtgtcacccagcacaatcacgcctcattcatcaatctgctcaacatcgagaccgactacaccaagagcttccacttccattcgaaacgcgttaccgcccacggagacacccctcagctggacctgaaagctcggcccaactacggcgccggcgagatcaccgtgctcgtcgaggtggccgacatggaacttcacactaagaagatcgagatcagcgggctcaagttcgcctcgctcacttgcactggctgctacgcctgcagcagcggtatctcatgcaaggtacgcatacacgtcgacgagcccgacgagctcaccgtgcacgtgaagtcggacgaccctgacgtcgtagccgcgtcctcttccctgatggcccgaaagctcgagttcggcaccgatagcaccttcaaggccttctccgccatgcccaagacttccctgtgcttctacatcgtggagcgcgagtactgcaagtcatgcagcaaagaagacacccagaagtgtgtcaacactaaactggagcacccccagtccatactcatcgagcacaaagggaccatcatcggcaagcaaaacaacacgtgcaccgcgaagaccagctgttggctcgagtccgtgaagtccttcttctacggcctgaagaatatgctctccggaatcttcggcaacgtgttcgtcgggatatttcttttcctagcccccttcatcctcctgatccttttcttcatgttcggatggagaatcctcttttgcttcaaatgttgccgcaggacgcgcgggctgttccggtacaagcacctggaggacgacgaggagacgggctaccggcggatcatagaacgactcaacaataagaagggcaagaacaaactgctggacggggagcggctcgccgaccgccgcatcgccgaactgtttagcaccaagacccacatcggc

SEQ ID NO: 15565 - RNA, 2916 nt, synthetic construct
  misc_feature 1..2916: note = derived and/or modified CDS sequence (opt11) from CCHFV(K168_125, Artificial)__KX013460.1__Gn-4aa-Gc
  source 1..2916: mol_type = other RNA
tcagacgaaagcggcgacgactgcataagcagaacacaactcctacgcacagaaaccgctgaaatccacggcgacaactacggaggcccaggagataaaatcactatatgcaacggtagcaccatagtcgaccaacgcctaggctctgaactaggctgctataccatcaatagagttaaatccttcaaactctgcgaaaacagcgcgaccgggaaatcatgcgaagtcgactccatcccagtaaaatgccgccaaggctactgcctcaaaataacccaggaggggcgagggcacgtcaagctctcaagaggatccgaagtagtattagacgcgtgtgacagctcttgcgaagtcatgatccccaaaggcaccggcgacatccttgtcgactgtagcgggggacaacaacacttcctgaaagacaacctaatcgacctgggctgcccgaaagtccccctcctcggaaaaatggccatatacatatgccgcatgtccaaccacccaaagaccacaatggccttcctattctggttctcattcggctatgtcataacctgcatagtctgcaaagcaatcttctatctcctcatcatcgtaggaaccctaggcaagcggttcaaacaataccgcgaacttaagccccaaacttgcaccatatgtgaaacgactcccaccaatgccatcgatgctgaaatgcacgacctcaactgcagctacaatatctgcccctactgtgcatcgcgcctaacctcagacgggctcgcccgccacgtaacgcattgcccgaaacgtaaggagaaagtagaggagaccgaactctacctcaacctagagcgcataccctgggtagtacgcaaactcctacaagtatcagaatccacaggcgtagccctgaaacgctcctcctggctgatcgtcctactcgtcctcttcgcagtctccctcagccccgtacagtccgccccaatcggtcgacgacccctcttcctagactccatagtaaaaggaaagaaaaacttactgaactcaaccagtctcgaaaccagcctatctatcgaagccccatggggagcaatcaatgtccagagcacctacaaacccaccgtctccgcagccaacatcgccctatcgtggtccagcgtcgaacatcgcggcaacaaaatcctagtctccggccgctcagaaagtataatgaaactagaggaacgtaccggcatctcctgggatttaggggtcgaggacgccagcgaaagcaaattgctaacagtttccgtaatggacctctcccaaatgtactctcccgtattcgaatacctcagcggagacagacaagtagaggaatggcctaaggcaacctgcaccggtgactgcccagaacgatgtggatgcacctcatccacatgcctccataaagaatggccccactcgaggaactggcgctgcaacccaacatggtgttggggcgtagggaccggttgcacatgctgcgggctagacgtaaaagacttgttcaccgattatatgttcgtcaaatggaaagtcgaatacataaaaaccgaagccatagtatgcgtagaactaacgtcccaggaacgacagtgcagcctcatagaagccggcacacgcttcaatcttggccccgtcaccatcaccctatcggagccccgcaacatccaacaaaaactgccgcccgagataataacactccatccaaggatcgaagaagggttcttcgaccttatgcacgtccaaaaagttctatcggcttctaccgtctgtaaactccaaagctgtacacacggcgtgccaggtgaccttcaggtttaccacatcggaaatctactcaagggcgacaaagttaacggccacttaatccacaagatcgaaccccacttcaacaccagctggatgtcctgggacgggtgcgacctagactactactgcaacatgggtgactggccttcgtgcacatacactggcgtaactcagcataaccacgccagcttcataaaccttctcaacatcgaaaccgactacaccaaatctttccacttccacagcaagagggtaaccgcccacggagacacaccacaactcgacctcaaagcccgccccaactatggcgcaggagaaatcaccgtcttggtagaagtcgccgacatggaactacacaccaagaaaatcgaaataagcggcctcaaattcgcatcactaacgtgtacaggatgctacgcgtgctcgtcaggaatcagctgcaaagtccggatccacgtagacgaaccggacgaactcacggtccatgtaaagagcgacgaccccgacgtcgtcgccgcctcaagcagcctcatggcccgaaaactcgagttcggaaccgactctaccttcaaagccttctcagctatgcccaaaacaagcctgtgtttctacatcgtcgaaagggaatactgcaaatcctgcagcaaagaagatacccaaaaatgcgtaaacacaaaactcgaacacccccaatctatactcatcgaacataaaggcacaatcatcggcaagcaaaacaatacctgcaccgcgaaaaccagctgctggctggaatccgtcaaatccttcttctacggactaaagaatatgctatcaggcatcttcggcaacgtcttcgtcggcatcttcctgttcctagctccgttcatactactcatcctcttctttatgtttggctggcgcattctcttctgcttcaaatgctgtcgccgcacacgaggcctgttccgatacaagcacctcgaggacgatgaagagaccggctatcgccgcatcattgaaagactaaacaacaagaaaggcaaaaacaagctcttagacggtgaacgtctcgccgaccgccgcattgctgaacttttcagcacaaaaacccatatcggc

SEQ ID NO: 15566 - RNA, 2916 nt, synthetic construct
  misc_feature 1..2916: note = derived and/or modified CDS sequence (opt11) from CCHFV(K229_194, Artificial)__KX013463.1__Gn-4aa-Gc
  source 1..2916: mol_type = other RNA
tcagaggaaccgggcgacgactgtatcagccgcacccaattactaaagaccgaaaccgccgaaatccacgatgacaactacggcggcccaggagacaaaatcactatctgcaacggctcaacaatagtcgatcagagactgggatccgaactaggttgctataccatcaatcgagtcaagagcttcaaactgtgcgaaaactccgccaccggtaagacatgtgaaatagacagcacaccggtcaaatgtcgccaaggattctgcctcaaaataactcaggaaggacgtggacacgtcaaacttagtcgcggaagcgaagtcgtactagacgcctgcgactcaagctgcgaaatcatgatacccaagggcacaggagacatactggtcgactgctccggaggtcaacaacacttcctcaaagggaacctaatcgacctgggctgtccacatataccactattaggaaagatggccatctacatttgccgcatgtcaaaccacccccgaaccacaatggcctttctattctggttctcattcggctacgtaatcacatgcatcttctgcaaagcgctcttttacagcctaattatcatcggcaccctgggcaagaaaatcaaacaataccgtgaactcaaaccccaaacgtgcaccatatgcgagactgccccggtcaatgccatagacgccgaaatgcacgacctaaactgctcttacaacatctgcccatactgcgcatcacggctcacatccgacggactcgcccgacacgtaacccaatgccctaaacgcaaagaaaaggtggaagaaaccgaattatacctcaacctcgagcggatcccatggatcgtaagaaaactcctacaagtctccgaatctaccggcgtcgcgctcaagcgatcatcctggctaatcgtactactcgttctcctcaccgtcagcctgagccccgttcagtcagcacccgtcggacgaaaaccactgttcctcgacagtatcgtcaaaggcaagaaaaacctcctgaactccacatccctagagacaagtctaagcatcgaagcaccatggggagcaataaacgtacagagcacgttcaaaccaaccgtctccaccgcaaacatagcactcagctggtcatccgtcgaacaccgaggaaacaaaatcctcgtcaccggccggtccgagagcatcatgaaattagaagaaagaacaggcgtcagctgggacctcggagttgaagacgccagcgaaagcaaactcttaaccgtgtccatcatggacctctcacaaatgtactcacccgtcttcgaatacttatccggcgaccgacaagtggaagaatggccaaaagccacttgcaccggagactgtcctgagcggtgcggctgcacctcaagcacttgcctacacaaagagtggccacactcgagaaactggcgctgcaacccgacatggtgctggggcgtcgggacgggttgtacctgttgcggagtcgacgtcaaagaccttttcacggaccatatgttcataaagtggaaggtagaatacatcaaaaccgaagctatcgtctgtgtcgaacttacatcccaggaacgtcagtgctccttaattgaagccggcaccagattcaacctcggaccagtcacaataacactatccgaaccccgaaacatccagcaaaaacttccacccgaaatcatcacactgcatcccaaaattgaagaaggcttcttcgaccttatgcacgtacaaaaagtactcagcgcatccaccgtctgcaaacttcaatcctgcacccacggcatcccgggggacctacaaatctaccacatcggcaatttactaaaaggcgaccgactcaacggccacctaatccacaagatcgaaccacactttaacaccagctggatgtcctgggacggctgcgacctggactattactgcaacatgggtgactggccttcctgcacctacaccggcgtaacccagcacaaccacgcagccttcgtgaacctactaaacatagagaccgattacaccaaaacttttcacttccacagcaaacgtgtaaccgcccacggcgacacaccgcaactcgacctcaaagcccgacccacatacggggccggcgaaattaccgtcctcgtagaagtagcagacatggaactccacaccaaaaaggttgagatatcggggctgaaattcgcttcccttgcctgtaccggctgctattcctgctcaagcggaatctcatgtaaggtcagaatacacgtcgacgagcccgacgaactcacggtccatgtcaaatcatcagaccccgacgtcgtcgcagcatcaacatccctcatggcgcggaaactagagttcggcaccgactccacattcaaagccttctccgcaatgccaaaaacctccctatgcttctacatcgtcgaacgcgaatactgcaaatcctgctccgaggacgacaccaagaaatgcgtggacacaaaactcgaacaaccccaatcaatcctaatagaacacaaaggcacaataatcggaaaacaaaacgacacctgtacagctaaagcctcttgctggctcgaatccgtaaagtccttcttctacggcctcaaaaacatgctcggcagcgtcttcggcaactttttcgtcggtatactcctattcctcgcacccttcgtcctccttgtcctatttttcatgttcggctggaaaatcctcttctgcttcaaatgctgtaggcgaacccgcggcctctttaaatatagacacctcaaagacgacgaagagaccggctaccgaaaaatcatagagcgactcaactccaaaaagggcaaaaacagactgctcgacggagagcgcctagcagaccgaaaaatcgccgagctattcagcaccaaaacccacataggc

SEQ ID NO: 15567 - RNA, 2916 nt, synthetic construct
  misc_feature 1..2916: note = derived and/or modified CDS sequence (opt11) from CCHFV(K229_243, Artificial)__KX013466.1__Gn-4aa-Gc
  source 1..2916: mol_type = other RNA
tcagaggagccgggagacgattgcatcagccgaacacaactcctaagaaccgaaaccgcggaaatccacgacgacaactacggaggacccggcgacaaaatcaccatatgcaatggatccacaatcgtagaccagcgactcggctccgaactaggatgctacaccatcaacagagtcaaatccttcaagctctgcgaaaactctgccacaggcaaaacctgcgaaatcgactccacccccgtcaaatgccgacaaggcttttgcctaaaaatcactcaagaaggcagaggacacgtcaaactgtcccgcggcagtgaagtcgtactcgacgcctgcgacagcagctgcgaggtaatgatcccaaaaggaacaggagacatcctcgtcgactgctcaggcggacagcaacacttccttaaagacaacctcatagacctcggatgcccacacatccccctccttggcaagatggccatatacatctgtcggatgtcaaaccacccccgcacaacaatggcattcctcttctggttcagcttcggctacgtcattacatgcatattctgcaaagccctattctactccctaatcataatcggaaccttaggaaagaaaatcaaacagtaccgcgaactcaaaccacagacctgcaccatatgcgaaaccgcccccgtaaacgcgatcgacgcagaaatgcacgacttaaactgctcatacaatatttgcccctactgtgcctcgcggctaacatccgacggactagcgcggcacgtcccacaatgccctaaaaggaaagaaaaagtagaagaaacggagctttatctaaacctagagagaataccatggatagtccggaaactactccaagtatccgagagcaccggcgtagcattaaaacgctcgtcatggctgatagtacttctcgtactgctcaccgtctcactaagcccggtccaatcagccccagtcggacgcaaacccctcttcctcgacagtatagtaaagggcatgaagaatcttctaaattccaccagtctagaaacaagcctaagcatcgaagcaccatggggcgctatcaacgtgcaatcaaccttcaaaccaaccgtaagcacggcaaacatcgccctctcgtggtcgagcgtcgaacatcgcggtaacaaaatcctagtgacaggccgctctgaatccataatgaagctagaggaacgaaccggcgtctcatgggacctcggcgtagaggacgcgagtgaaagtaaactactcacagtttccataatggacctctcccaaatgtactcgcccgtctttgagtacctctcaggcgaccggcaagtcgaggagtggccaaaagccacatgcaccggagactgccccgagcgctgcggctgcaccagttccacttgcctacacaaagagtggccccacagccgcaactggcgctgcaaccctacatggtgctggggtgtgggcacagggtgcacatgctgcggcgtcgatgtcaaagacttattcaccgaccacatgtttgtcaagtggaaagtcgaatacatcaaaacagaggccatcgtctgtgtcgaactaacaagccaggaacgacagtgctccctaatcgaagcaggcacgcgcttcaatctcggaccagtcacaataaccctctcagagccccgcaacatccagcagaaactcccacccgagattataaccttacaccccaaagtggaagaaggcttcttcgacctcatgcacgtccagaaagtgctctccgccagcaccgtctgcaaactgcaatcctgcacccatggtatacccggcgacctacaggtttaccacattggaaacctcctaaaaggtgaccgagtaaacggacacctcattcacaaaatcgaaccccacttcaatacgagctggatgtcctgggacggctgcgacctagactactactgcaacatgggcgactggccctcctgcacctacaccggcgtaacacaacacaaccatgctgccttcgtcaatctgctaaacatagagacagactatactaaaaccttccatttccacagcaagcgcgttaccgcccacggcgatactccccagctcgacctcaaagcccgacccacgtacggagcaggagaaataaccgtactcgtagaagtagccgacatggaattacacacaaagaaagtcgaaatctccggcctaaaattcgcatctctcgcctgcacaggatgttacgcatgctccagcggaatctcctgcaaagtaaggatccacgtagacgaaccagacgagctcaccgtccacgtcaaatcctcagaccccgacgtcgtagccgccagcaccagcctcatggcccgaaagctcgagttcggcaccgactcgacattcaaggccttctccgcgatgccaaagaccagcctatgcttctacatagttgaaaaagaatattgcaagtcctgcagcgaagaggacacccaaaagtgcgtggatacaaaactcgaacaaccccagtccatcctaatagaacacaaaggcacgatcataggcaaacaaaacgacacatgcactgccaaagccagctgctggctcgaatccgtcaagtcgttcttctacgggctcaaaaacatgttgggcagcgtattcggcaacttcttcatcggcatactgcttttcctgaccccgttcgtgctcttagtactattcttcatgttcggatggaaaatccttttctgcttcaagtgctgccggcgaacccgcggcctcctgaaatacagacacctcaaagacgacgaagaaacaggataccgacgaatcatagaaaggctcaacaacaaaaagggcaaaaaccgcctcctcgacggcgagcgactcgccgaccgaaaaatagcagaactcttcagcacaaaaacccacattgga

SEQ ID NO: 15568 - RNA, 2916 nt, synthetic construct
  misc_feature 1..2916: note = derived and/or modified CDS sequence (opt11) from CCHFV(K315_14, Artificial)__KX013469.1__Gn-4aa-Gc
  source 1..2916: mol_type = other RNA
tcagaggaaccaggcgacgactgcatatcacggacacaactcctgaagaccgaaactgccgagatacacgacgacaactacggcggtcccggtgataagattacaatctgcaacggcagcaccgtcgtcgaccaaagactcggctccgaacttggctgctacaccataaaccgcgtaaaatccttcaaactctgcaaaaacagcgccaccggaaagacgtgcgagatagactcaacccccgtcaaatgccgacaaggattctgcctcaagattacacaagagggtcgaggccatgtaaaactaagccgcggctcggaagtagttctcgacgtctgcgacagctcgtgtgaaattatgatacccaaaggaaccggagacatcctcgtagactgctccggtggacaacaacactttctcaaagacaacctgatagacctaggttgcccccacatacccctcctcggcaaaatggctatctacatctgcagaatgtccaaccacccacgcactaccatggctttcctattctggttctcgttcggctacgttataacctgcattttctgcaaagctctcttctactcgctcatcataatcggtactctaggcaagaaaatcaagcaataccgtgaactaaagccccaaacatgcaccatttgtgaaaccgcgcctgtcaacgccatcgacgccgaaatgcacgacctcaactgcagctacaacatttgcccatactgcgcgtctcgactaaccagcgaaggcctggcccggcacgtcacacagtgcccaaaaagaaaagaaaaagtcgaagaaaccgaactatacctcaacctagaacgaatcccatggatcgtcagaaaactactccaagtctcagaatccaccggcgtcgcactaaagagatcctcttggctaatcgtgctactcgtcctgctaaccgtttcgctaagccccgtccaatccgcacccgtcggacgtaagccactgttccttgactcaatagtcaaaggaatgaagaaactcctcaacagcacatccctcgagacctccctctccatcgaagctccctggggcgccatcaacgtccagtccacgtttaaaccaacggtcagtacagcaaacatcgccctctcatggagctccgtcgaacaccgcgggaacaaaatactcgtcaccggccggtcagagtcaataatgaaactcgaagaacggaccggcgtctcctgggatctgggagtggaggacgcctcagagtccaaactcctaacggtcagcatcatggacctgagccaaatgtactcaccggtcttcgagtatcttagcggagaccgccaagtcgaagaatggcccaaggcaacctgtaccggagactgccccgaacgctgtggctgtacctcatccacttgcttacacaaagaatggccccacagccgcaattggcgatgcaacccaacctggtgctggggagtcggaaccggatgtacatgctgcggcgtcgacgtcaaagaccttttcactgaccacatgttcatcaaatggaaagtcgagtacatcaagaccgaagccatcgtctgcgtcgaactcacctcccaggaacgtcagtgctcactcatagaagcaggcacgcggttcaacctcggccccgttaccataacactcagcgaaccaagaaacattcaacaaaaacttcccccagagatcataacgctccaccccaaaatcgaagaaggcttctttgacctaatgcatgtccaaaaagtccttagcgccagcacggtatgcaaactgcaatcctgcacgcacggcatcccaggggacctccaaatctaccacatcgggaatcttctaaaaggggaccgagtcaatggccatttaatccacaaaatagaaccccacttcaacacaagctggatgtcatgggacggctgcgacctagactactactgtaacatgggcgactggccatcctgcacatacaccggagtcacacaacacaaccacgccgccttcgtcaacctactaaacatcgaaaccgactacaccaaaaccttccacttccacagcaaacgcgtaacagcccacggcgacaccccacagctcgacttaaaagcaagaccaacctacggagccggcgaaattaccgtcctagtagaagtcgcggacatggaactacacacaaagaaagtagaaatctccggactcaaattcgcctcgctcacttgcaccggatgctacgcgtgctcatccggcatctcctgcaaggttcgaatacacgtagacgaacccgacgaactcaccgtccacgtgaagtcctctgacccagacgttgtagccgcctcaacgagcctcatggcacgcaaacttgagttcggcacagactccaccttcaaagccttctccgccatgcccaaaacctccctctgcttctacatcgtcgaacgcgaatattgcaaatcatgctcggaagacgacaccaagaaatgcgtcgacacaaaactcgaacaaccgcaatcaattctaatcgagcacaaaggtactatcataggaaaacaaaacgatacctgcacagccaaagcctcatgttggctagagtccgtcaaatcctttttctacggactcaaaaacatgctaggctcagtgttcgggtcgttcttcgtaggaatacttctcttcttagccccctttgtcctgctggtccttttctttatgttcggatggaaaatcttattttgcttcaagtgctgccgacggaccagaggactcttcaagtaccgtcatctaaaagacgacgaagagaccggctaccgacgcataatagaacgtctcaattctaaaaagggtaagaaccgcctcctcgacggcgaacgtctcgccgaccgcaaaatcgctgaactcttctctaccaaaacccacatcggt

SEQ ID NO: 15569 - RNA, 2916 nt, synthetic construct
  misc_feature 1..2916: note = derived and/or modified CDS sequence (opt11) from CCHFV(K323_27, Artificial)__KX013472.1__Gn-4aa-Gc
  source 1..2916: mol_type = other RNA
tctgaggaacccggcgacgactgcatctccagaacccaactactcaaaacggagacagccgaaatccacgacgacaactacggcggccccggcgacaaaatcaccatctgcaacggcagcaccatcgtagaccaaaggctcggctcagaactaggctgctacaccatcaacagagtaaaatccttcaaactctgtgaaaactccgcgaccggcaagacctgtgaaatagactccacgccagtcaaatgcagacaaggcttctgcctgaaaataacccaggaaggacgcggccacgtaaaactctcaagaggaagcgaggtagtcctagatgcttgcgattcctcatgcgaaataatgataccaaaaggcaccggagatatcctggttgattgcagcggtggccagcaacacttcctcaaagacaacctcattgacctcggctgcccccacatccccctcctcggcaaaatggccatttacatttgccggatgtctaaccacccacgcactactatggcgttcctattctggttcagtttcggatacgtcataacctgcatcttttgcaaagcccttttctacctactcatcataatcggcaccctcggcaagaaaataaaacaataccgagagctcaagccacaaacgtgcactatctgcgaaacagcccccgtcaacgctatagacgccgagatgcacgatctcaattgctcatacaacatatgcccctactgcgcatcccgcctgacctccgacggactcgctcgacacgtcacccaatgcccgaagcgaaaggaaaaggtcgaggaaaccgaactatacctaaacctcgaacggatcccgtggatcgtccgtaaactcctccaagtatcggagagcacaggcgtggccctcaagcgcagtagctggctcaccgtacttctagttctactaacagtctccctaagccccgttcaatcagcaccagtaggccgcaagcccctattcctcgatagcatcgccaaaggcatgaaaaacctacttaactccaccagcctcgaaacaagcctatccatagaagcaccttggggagcaatcaatgttcaaagcacgttcaagcccactgtctccaccgccaacatagccctatcatggagttccgtcgaacacagaggcaacaaaatcctagtcacaggacgctccgagtcaataatgaagctagaagagagaacaggcgtctcatgggacttaggcgtcgaagacgcgtcggaatccaaactactaacggtctccatcatggacctctcccaaatgtactccccagtcttcgaatacttatccggagaccgacaggtggaagagtggccaaaggcaacctgcacaggcgactgccccgaacgctgcggatgcacctcctccacttgcctacacaaagaatggccccactcacggaactggcgctgcaacccaacctggtgctggggcgtaggcacagggtgcacttgctgcggggtagacgtaaaagacctcttcaccgaccacatgttcatcaaatggaaagtagaatacattaaaacagaagcaatagtatgtgtagaactaaccggccaagaacgacaatgttccctaatagaagccggaactcgcttcaacctggggcccgtaacgataaccctaagcgaaccccgaaacatacaacaaaaacttcctccagaaataattaccctacaccccaaaatcgaagaagggttcttcgacctaatgcacgtccaaaaagtcctttcagcatcgactgtatgcaagctacaatcttgcacgcacgggatcccaggagacctgcaaatatatcacatcggaaatctcctaaaaggagaccgcgtaaacgggcacctaatccataaaatagaacctcacttcaacacctcatggatgagctgggatggctgtgacctcgactactactgcaacatgggcgactggccgtcctgcacatacaccggcgtcacacaacacaaccacgcagccttcgtgaacctcctaaacatagagaccgactacaccaaaacatttcacttccacagcaaacgggtaaccgcccacggtgacacaccccagctagacctaaaggcccgacccacctatggtgccggtgaaatcaccgtcctcgtcgaagtagcagacatggaactccacaccaagaaagtcgaaatatcgggcctaaaattcgcgagcctgacgtgcaccggctgctacgcctgtagctcgggcatcagctgcaaagtcaggattcacgtagacgaacccgacgagttaacagtgcacgtgaaatcatcggacccagacgtagtcgcagcgtccacctccttgatggcccgaaaacttgagttcggcacagacagcacattcaaagcattctcggcgatgccaaaaacttccctatgcttctatatcgtggaacgagaatactgtaaatcatgtagcgaagacgacaccaaaaagtgcgtggacaccaaactggaacaaccccagtccatactcatcgaacacaaaggcaccataataggcaaacaaaacgatacctgcacagccaaagcatcctgttggctggaatcagtcaaatccttcttctatggcctcaaaaacatgttaggctcggtattcgggagcttcttcgtcggaatcctcctcttcctcgccccattcgtcctccttgtacttttcttcatgttcggatggaaaatcctattctgcttcaaatgctgccgcagaacacgaggcctcttcaagtacagacacctgaacgacgacgaggagaccggctaccgaagaataatagaacgactcaattctaaaaagggcaagaaccgcctgctggacggagaacgtcttgcagaccgcaagatcgcagagctattctccaccaagacacacatcggc

SEQ ID NO: 15570 - RNA, 2916 nt, synthetic construct
  misc_feature 1..2916: note = derived and/or modified CDS sequence (opt11) from CCHFV(K340_6, Artificial)__KX013475.1__Gn-4aa-Gc
  source 1..2916: mol_type = other RNA
agcgaggaaccaggtgacgactgcatttcgcgcacccaactcctaaagaccgaaacagccgagatccacgacgataactacggcggtcccggtgacaagataacgatatgcaatgggagcacaatcgtagaccaacggctcggctcggaactcggatgctacacgatcaacagagtcaagtcatttaaactttgtgaaaacagcacgaccgggaagacctgcgaaatcgacagcacgcctgtaaaatgccgccaggggttctgtctcaagataacacaagaaggtcgcggacatgtaaaactctcgcgcggctcagaagtcgtactagacgcttgcgactcttcttgcgaaattatgataccgaaaggcaccggagacatcttagtagactgcagcggcggacaacaacacttcctgaaagataacctcatcgacttaggctgccctcacataccgccccttggaaaaatggcaatatacatctgccgaatgtcaaatcacccccggaccacaatggcattcctattctggttctccttcggatacgtgataacatgcatcttctgcaaagccctcttctacagcctcatcatcataggcacactaggaaagaaaataaagcaatacagagaactgaaaccccaaacgtgtacaatatgcgaaaccgcccccgtaaacgccatcgacgctgaaatgcacgacctaaactgttcgtacaacatttgcccctactgcgccagtcggctaacatcggacggcctagcacgccacgtcacgcaatgcccgaaacgcaaagaaaaagtcgaagaaaccgagctgtacctaaacctcgaacgcataccatggatcgttcggaaactgctacaagtctcagaaagcacgggcgtagcactgaaacgatcctcctggctaatcgtactcttagtactactcaccgtctcactcagcccagtccagtccgcgccggtaggacggaaaccactatcattagactccatcgtaaagggcatgaaaaacctcctcaactcaaccagcctcgaaacctccttatcaatcgaagccccatggggagcgatcaacgtccaatctacgttcaaaccaaccgtaagtaccgcaaacatcgcactgtcctggtccagcgttgagcaccgaggcaacaaaatcttagtcacgggtcgaagcgaaagcattatgaaactagaagaaagaactggcgtctcgtgggacctcggtgtagaagacgctagtgagagcaaactactaactgtttccatcatggacctttcccaaatgtactcacccgtgtttgaatacctatcaggtgaccgccaagtcgaagaatggcccaaagccacatgcaccggcgactgccccgagcgctgcggctgcacaagctcaacctgcctccacaaagaatggccccacagccgaaactggagatgcaacccaacctggtgctggggagtggggaccggatgtacctgctgcggcgtagacgtaaaagacctcttcaccgaccacatgttcataaaatggaaggtcgagtacataaaaacagaagccatcgtctgcgtcgagctgacctcccaagaacgccaatgcagccttatagaggcaggaacgcggttcaacctcggacccgtgacaatcacgcttagcgaaccacgaaacatacaacaaaaactaccacccgaaataatcaccctgcaccccaaaatagaggaaggcttcttcgacttaatgcacgtacaaaaagtcctctccgcgtccactgtctgcaaactccaatcgtgcacccacggcatacccggtgacctccaaatctatcatataggaaatctcttaaaaggcgaccgagtcaacggccatctcatccacaaaatagaaccccacttcaacacatcgtggatgtcctgggacggatgcgacctcgactattattgcaatatgggcgactggccctcctgcacctacacaggcgtgacccagcacaaccatgctgctttcgtaaacttacttaacatagaaacagactacacaaagacattccacttccattccaaacgagtgacagcccacggagatactcctcaactagacctcaaagcccgccctacctacggcgccggagagatcaccgtgctcgtcgaagttaccgacatggaattacacacaaagaaagtcgaaatttccggtcttaaattcgcctccctaacctgcacaggatgctatgcctgctcctccgggatatcctgcaaagtccgcattcacgtagacgaacccgacgagctaaccgttcacgtaaaaagctctgacccagatgtcgtagcagcctcaacctccctgatggcccgaaaacttgagttcggtaccgactcaaccttcaaggctttctccgccatgcctaaaacgtcactctgcttttacatcgtcgaacgcgagtactgcaaaagctgctcggaggacgacaccaaaaagtgcgtcgacaccaaactagaacaacctcaatcaatactaatcgaacacaagggcactataataggcaagcaaaacgacacatgcacagcaaaagcctcatgctggctcgaatcggtcaagtccttcttctacggactcaaaaacatgctcgggtccgtattcggcagctttttcgtaggcatcctcctattcctcgcaccattcgtactcctcgtactgttctttatgttcggctggaagatcctattctgcttcaaatgctgccgcagaactcgaggactcttcaaatacagacacttcaaagacgatgaagaaaccggctaccgacgcataatagagcgtctcaacagcaaaaaggggaaaaacagactccttgacggagagcgcctcgcggacagaaaaatagccgaactcttttccaccaaaacccacatcggc

SEQ ID NO: 15571 - RNA, 2916 nt, synthetic construct
  misc_feature 1..2916: note = derived and/or modified CDS sequence (opt11) from CCHFV(Mamon, Artificial)__KX013478.1__Gn-4aa-Gc
  source 1..2916: mol_type = other RNA
tccgaagaaccgggagacgattgcatctcacgaacgcaactactgcgaacagagaccgccgaaatccacgacgacaactatggaggcccgggagataaaatcacaatctgcaacggatccactatcgtcgaccaacgactgggctccgaactcggctgttacacgatcaaccgcgttaagagcttcaaactctgcgagaacagcgccaccggcaaaacgtgcgaaatcgactcaacgccggtcaaatgtagacagggattttgcctaaaaataacacaagaaggccgcggccacgtaaaactatcccggggcagcgaagtggtctcagacgcatgcgattcatcctgcgaagtaatgattccgaaaggcaccggcgatatcctagtcgactgctccggaggtcaacaacatttcctaaaagacaacctcatcgacctcggctgcccacacattccactgctcggaaagatggcaatatacatctgtagaatgtccaaccacccacgtaccaccgtcgcatttctcttctggttctcattcggctacgtcatcacatgcatcttctgcaaagccctattctactccctcataattatcggaacactcggaaagaaaatcaaacaataccgcgaactaaaaccacagacctgcaccatttgcgaaacggcaccagtcaacgccatcgacgccgaaatgcacgatttgaattgcagctacaacatctgcccctactgcgccagccgactcacttcagacggactcgcccgccacgtcccccaatgccctaaaaggaaggaaaaagtggaggaaaccgaactctacctaaacctagaacgaatcccatggatagtacgcaaactcctacaggtctcagaatctacaggcgtagccctaaaacgatcctcctggctcatagtcttactcgttctcctgacggtaagcctttcccccgttcaaagcgcgccagtcggacgcaaaccactttttctagacagcatcgtcaaaggaatgaaaaacctactcaactcgaccagcctcgaaacctcactatccatcgaagccccatggggcgccatcaacgtccaaagcaccttcaaacccaccgtcagcacagcaaatatagcactaagctggtcaagcgtggaacaccggggtaacaaaatcctcgttacgggccgatccgagtcaatcatgaaactagaagaaagaaccggcgtctcctgggacctcggcgtcgaggacgcctctgaatcgaaactgctcaccgtctcaatcatggacctctcccaaatgtacagccctgtattcgaatacctctccggggaccgccaagtcgaggaatggccaaaagctacatgtacgggtgactgccccgagagatgcggctgcacaagctcaacgtgcctacacaaagaatggcctcactcgcgcaactggcgatgcaacccaacatggtgttggggcgtggggacaggctgtacctgctgcggcgtagacgtaaaggatctcttcacagatcacatgttcgtaaaatggaaggtagaatacatcaaaacggaagcaatcgtatgcgtagaactaacaagccaagagcgccaatgttccctaatagaagcaggaacacggttcaacctaggcccagttaccataaccctaagcgaaccccgaaacatccagcaaaaactaccgcccgaaataattacactacaccccaaagtcgaggaaggcttcttcgatctcatgcacgtccaaaaagtcctaagcgccagcactgtctgtaaactccagtcctgcacccacggaatccccggcgacctacaagtttaccacataggcaacctcctaaaaggcgaccgagtaaatggccacctaatccataagatagaaccacattttaatacgtcctggatgtcttgggacggctgtgacttagactactactgcaacatgggcgattggccctcctgcacttacaccggcgtaacccagcacaaccacgctgcattcgtcaacctcctaaacatagaaacagactacaccaaaacctttcacttccactcaaaacgtgtcaccgctcacggcgacactccacaactggacctcaaagcccgacccacctacggggccggagagattaccgtgctcgtcgaggtagctgacatggagttacacaccaaaaaggtggaaatctccggtcttaaattcgcatccttagcctgtacaggatgctacgcctgctcctctggaatctcatgcaaagtccgcatacatgttgacgaacctgacgagctgaccgtacacgtaaaatcttcagacccggacgtggtagccgctagcacctctctcatggcccgaaaacttgagttcggcaccgactccaccttcaaagcattctctgccatgcccaaaacctccctctgcttctacatcgtcgaacgggaatactgcaagtcctgctcagaagaagacacccaaaaatgcgttgacacaaaactagaacaaccccagtctatcctcattgaacacaaaggcaccatcatcggtaaacaaaacgacacatgcaccgccaaaacctcatgctggctcgaatcagtcaaatctttcttctacggtctcaaaaatatgctcggcagcgttttcgggaatttcttcatcggcatactcctattcctagcccccttcgtcctcctcgtcctattcttcatgttcggatggaaaatcctattttgcttcaaatgctgccgtcgcaccagaggactcctcaaataccgccacctcaaggacgacgaagaaaccgggtaccgacgcatcatagagcgcctcaacaataagaaagggaaaaatcgcctactcgacggagaacgactagccgaccgcaagatcgccgaactattcagcacaaaaacacacatcggt

SEQ ID NO: 15572 - RNA, 2916 nt, synthetic construct
  misc_feature 1..2916: note = derived and/or modified CDS sequence (opt11) from CCHFV(Min, Artificial)__KX013481.1__Gn-4aa-Gc
  source 1..2916: mol_type = other RNA
tcggaagaacccggtgacgactgcattagccgaacccaacttttaagaaccgagacagccgaaattcatgacgacaactacgggggccctggggacaaaatcacaatctgcaacggctccaccatagtagaccaacgcctaggcagcgaactagggtgctataccatcaaccgggtcaaatctttcaaactctgtgaaaactcagccacaggaaaaacctgcgaaatagactccacccccgtcaaatgccgccaaggattctgcctaaagatcacccaagaaggccgaggccacgtcaaactatcacgcgggtccgaagtagtcctcgacgcctgcgactcctcctgcgaggtaatgatacctaaaggcaccggggacatcctcgtcgactgtagcggcggccagcaacacttcctgaaagacaacctgatcgacctaggctgcccgcacattcccctcctaggcaaaatggccatctacatttgcagaatgagcaaccacccgcgcactacaatggcattcctcttctggttctcatttggctatgtcatcacatgcatattttgcaaggccctgttctactcgctaataatcatcggcacactcggcaagaaaataaaacagtacagagaactcaaaccccaaacctgcaccatatgcgaaaccgcccccgtcaatgcgatagacgccgagatgcacgatctcaactgttcctacaatatctgcccctactgcgcatcacgcctgacgtcagacggacttgcacgacatgtcccccaatgccccaaacgaaaagagaaagtcgaagaaactgagctatacctcaacctcgaacgcattccgtggatagtccgcaaattactgcaggtatcagaatccaccggcgtcgctctcaaacgctcctcatggttaattgttctcctcgtactactaactgtcagcctaagtccagtccaatccgccccagtcgggcgaaaacccctattcctggattccatcgtcaagggcacgaaaaacctcctgaactctacctcactcgagacttcactatccatcgaggcaccctggggagcaataaatgtacagtctacgttcaaacccacagtctccaccgcgaacatagcgctatcttggtcttctgtggaacatcgtgggaacaaaatactggtaacaggacgtagcgaaagtattatgaaacttgaggaaaggacgggcgtatcatgggacctcggcgtcgaagacgcaagcgaaagcaagctcctcaccgtcagcatcatggatctctcccaaatgtactcccccgtcttcgaatatctgagcggagaccgacaagtcgaagaatggccgaaagcaacctgcaccggagactgccccgaacgatgcggttgcacatcatcaacctgcctccataaggaatggccgcacagccgtaactggcgatgcaaccccacctggtgctggggcgtaggcacaggctgcacctgttgcggagtcgacgtcaaggacctcttcaccgaccacatgttcgtcaagtggaaggtcgaatacatcaaaacagaagccatcgtatgtgtcgaacttacctcacaagaacgccaatgctcgctcatagaagccggcacacgcttcaacctgggacccgttacaatcaccctatccgagccccgaaatatacaacaaaaactgccgccagagattatcactctgcacccaaaagtggaagaaggcttcttcgatctcatgcacgtacaaaaagtccttagcgcctccacagtatgcaagctccaaagctgcacccacggcatccctggcgacctacaagtataccacatcggcaacctactcaaaggagaccgaataaacggccacctcatacacaagatcgagccccacttcaacacctcatggatgagctgggacggatgcgacctcgactactattgcaacatgggcgactggccctcctgcacctacacgggagtcacgcagcacaaccacgcagccttcgtcaacctgttgaacatcgaaaccgactacacaaaaaccttccacttccactccaaacgagtaacagcccacggcgatacaccgcaactagacctaaaggcccgccctacctacggcgccggagagatcaccgtactggtagaggtcgctgacatggaactacacaccaagaaagtcgaaatcagcggcctcaaattcgcatcactagcctgcacaggctgctacgcctgtagctcaggaatctcctgcaaagtgcgcatacatgtagacgaaccagacgaactaactgttcacgttaaaagctcagacccagacgtcgtagcagcctccacctccctaatggcacgaaaactagagttcggaacggactctaccttcaaagccttctcagccatgccaaaaaccagtctgtgcttctacatagtcgaacgcgagtattgcaaatcctgctccgaagaagatacccaaaaatgcgtcgacactaaactggaacaaccacaatcgatccttatagagcacaaaggcaccatcatcggcaaacagaacgacacttgcaccgccaaggcatcgtgctggctcgaatcagtcaaatccttcttctacgggctcaagaacatgcttggcagcgtattcgggaacttcttcataggaatcctcctcttcctggccccgttcgtcctactcgtcctctttttcatgttcggatggaaaatcctcttctgctttaaatgctgcagacgcacccgcggcctacttaaataccgacacctaaaggacgatgaagaaacggggtatcggcgcattatcgagcgcctaaacaacaagaaaggcaaaaaccgacttctcgacggagaacgcctcgctgatcgcaaaatagccgaacttttctccaccaaaacccacattggc

SEQ ID NO: 15573 - RNA, 2916 nt, synthetic construct
  misc_feature 1..2916: note = derived and/or modified CDS sequence (opt11) from CCHFV(Nakiwogo, Artificial)__KX013484.1__Gn-4aa-Gc
  source 1..2916: mol_type = other RNA
gctgaaggagtatccaacgactgcgtatcgcgaacccagctcatcaaaaccgaagtcgctgagatccacgaagacagctacggtggccccggcgaaaagatcactatctgcaacggcagcacaatcgtcgaccaacgactaggttctgaattgggctgctacacaatcaacagagttaaaacctacaaactatgcgagaactcagccactgagaagggctgcgaaatcgactccgttcccgtgaagtgcaaacaaggcttctgcctcaaggtcactcaggagggtcgcggccacgtcaaactatcccgcggaacagagatcgttctcgacgtctgcgatacctcttgcgaactcatgatcccaaaaggcaccggtgatatccttgtagactgctccggaggccaacagcatttccttcaagacaacctcatagacctcggatgcccgaacgtccccctactcggcaaaatggccatatacatctgccgaatgagcaaccaccccaaaactaccatggccttcctattctggttctcattcggctacgtcataacctgcgtcgtctgcaaagttctcttctacctactgatcgtcataggtacactaggaaagaaactaaaacagtaccgagagctcaaaccccagacctgcatcgtatgcgaatccatacccgtaaacgtcatcgacgcggaaatgcacgaactcaactgcaactacaacatctgcccctactgcgcaagccgcctaacaagtgacggactggtacgtcatgtcacacaatgcccgaaacgcaaagagaaagtcgaagagacagaactttacctaaaccttgaacggatcccctggctcgtcaggcgactactacaggtctcggaaagcacaggcatggccctcaaacgctcctgctggatgactacgctactaatcctattagttgtctccctctctccggtccagtccgcgccagtgggaagaaaacccctataccttgactcgatagccaaaggcatgaaatcacttcttaactctacgaacctcgaaacaagccttagcatcgaagcaccatggggcgcgatcaacgtgcaatcaacattcaaacccaccgtgagcgcagccaacatagccctttcatggtcatccgtcgagcaccgaggaaataaaatactcgtctcaggccgcagcgaaagcattatgaaactcgaggaacgaaccgggatatcctggagcctcggcgtcgaagacgccagcgagtccaaaaccttaacagtcagcgtgatggacctatcacaaatgtacagcccagtgttcgagtacctttccggcgatcgccaagtcgaagaatggcccaaggcaacctgcaccggagactgccctgaacgatgcggctgcacttcctccacgtgcctacacaaagaatggccccacagccggaactggcgctgcaaccccacctggtgctggggtgtaggcaccggctgcacatgctgtggcctcgacgtccgcgacctcttcacagactacatgatggtcaaatggaaagtcgaatacgttaagacagaagccattatgtgcgtagaactaacttcacaagaacgacaatgcagcctaatcgaagcaggtacacgattcaatctaggaccagtaactatcaccctaagcgagccccgaaatgtacaacaacggctaccatcggaaatagtcaccctgcacccaaaaatagaagaaggattcttcgacctcatgcacgtacaaaaagtactattctgcaaacatagtctgcaagcaacatcctgcacccatggcgtcccaggagaccttcaagtttaccacgtaggcaacctgctcaaaggggacaaagtaaacgggcactccatccacaagatagaaagccacttcaacacatcctggatgtcctgggacggctgcgacctggactatttctgcaacatgggagattggccatcgtgcacctacactggcgtcacccaacacaaccgagccgcctttgtcaacatgctgaacatagagaccgattacaccaaaacctttcacttccacagcaaacgggtcacggcccacggggacacgccacagttagaccttaaagcacgccccacttacggagccggcgaagtcaccgtcctagtcgaagtcgcagatctcgagctacacaccaagaaaatagaagtatcggggctaaaattcgccagccttacctgctcaggctgttacgcctgctcaagtggcatcagctgcaaggtccgcatacacgtgaacgaacccgacgagttcacagtccacgtcaagtccaacgaccccgacgtggtagcagccggctccagcctaatggcccgcaaaatcgaactgggcgcagactccactttcaaagccttctcctcaatgcccaaaaactcattatgcttctacatcgtagagagagactactgcagcagctgcacagacgatgacacacagaaatgcgttaacactaaattagaacacccacaaagcattctcatcgaacacaagggcaccatcatcggcaaacaaaacgacacatgccccaccaaaacctcctgctggttagaatcagtaaaatcattcttctacggactcaaaaacatgctcggaggaatttttggcaacgtcttcctaggaatcttcctattcttagcaccattcgccctcctcatactgttcttcttcttcggctggcgcttactcttctgcctgaagtgttgtcgaagaacccggggactcttaaaatacaaacaactcaaggacgaagaagaggcaggctacaagaaaatcatcgagcgcctcaatgacaagaaaggtaaaagccggcttttcgacggtgaacgcctagccgataggaagatcgcagaactgttctctacaaaaacccacatcgga

SEQ ID NO: 15574 - RNA, 2916 nt, synthetic construct
  misc_feature 1..2916: note = derived and/or modified CDS sequence (opt11) from CCHFV(Saf, Artificial)__KX013487.1__Gn-4aa-Gc
  source 1..2916: mol_type = other RNA
agcgaggaaccaggagacgactgcatctcccggacccagctgctccggaccgagacggccgagatccacgacgacaactacggcggcccgggggacaagatcaccatctgcaacggcagcaccatcgtggaccagcgcctgggatccgagctaggctgctacaccatcaaccgcgtcaagagcttcaagctctgcgaaaactccgccacgggcaagacttgcgagatcgacagcacccccgtgaagtgccgccaggggttctgcttgaagatcacgcaggagggcagagggcacgtgaagctgagccgcggtagcgaggtcgtgctcgacgcatgcgactccagctgcgaggtgatgatccccaaggggacgggcgacatactggtcgactgctccggcgggcaacaacactacctgaaggacaacctcatcgacctgggctgcccccacatcccgctgctcggtaagatggccatctacatctgccgaatgagcaaccacccccgaaccaccatggcctttctgttctggttctccttcggatacgtgatcacgtgcatcttctgcaaggccctgttttacagcctgatcataatcggcaccctggggaagaagatcaagcaataccgcgaactgaagccccagacctgcaccatatgcgagaccgccccagtgaacgcgatcgacgctgagatgcatgacctcaactgctcctacaacatctgcccttactgtgctagccggctgacgagtgacggcctggctcggcacgtcccccagtgccccaaacgcaaggagaaggttgaggagacggagctataccttaacctggagcggatcccctggatcgtgcgcaagctcctgcaggtcagcgagtccacgggggtggcgctgaagaggagcagctggctcatcgtgttgctggtcctcctgaccgtgtccctgagccctgtacagagcgcccccgtcggtcgcaagccattattcagcgattccatcgttaagggtatgaagaacctgctgaactccacgtccctcgagactagcttatccatagaggccccctggggcgccatcaatgtgcagagcaccttcaagccgaccgtctccacggccaacatcgcgctgtcttggtccagcgtagagcaccggggaaacaagatcctcgtgaccggccgatccgaaagcatcatgaagctggaggagcggaccggagtctcctgggacctgggggtggaggacgccagcgagtccaagctcctgaccgtcagcatcatggacctgagccagatgtactcccccgtcttcgaatacctcagcggcgaccgccaagtggaggagtggcccaaggccacgtgcactggggactgccccgaacggtgcggctgcacctccagcacgtgcctgcataaggagtggccgcattcccgtaactggaggtgcaaccccacctggtgctggggagtcgggaccggctgtacttgctgcggggtggacgtaaaagacctgttcaccgaccatatgttcgtcaagtggaaggtggaatatatcaagaccgaggccatcgtgtgcgtcgagcttacaagccaagagagacagtgctccctgatcgaggcgggaacccgcttcaacctggggcccgtgaccatcacactgagcgagccccggaacatccagcagaaactcccgccagagatcatcacgctgcatcccaaagtggaggagggtttcttcgacctgatgcacgtacagaaagtgctctccgcgagcaccgtgtgcaagctgcagtcctgcacccacggcatccccggggacctgcaggtctaccacatcggaaacctcctgaagggggaccgcgtaaacggccacctgatccacaagatcgagccgcacttcaacaccagctggatgtcctgggacggctgcgacctcgactactactgcaacatgggggactggcccagctgtacgtacaccggcgtgacccagcacaaccacgccgccttcgttaacctactgaacatcgaaaccgactatatgaagacctttcacttccactcaaagcgagtcaccgcccacggtgatacgccccagttagacttgaaggcccgcccgacctacggcgccggggagatcacagtgctggtcgaggtggccgacatggagctccataccaagaaggtggagatcagcggcctgaaattcgtctccctggcctgcaccggatgctacgcctgcagctctggtatctcctgcaaggttcggattcacgtggacgagcctgacgagctcaccgtccacgtcaagtcttccgacccagatgtggtggccgcgagcacgtcgctgatggcccgcaagctggagttcggcaccgacagcaccttcaaggccttctccgccatgcccaaaacaagcctctgcttttatatcgtagaacgggagtactgcaaatcctgcagcgaggaggacacgcagaaatgcgtggacaccaaacttgagcagccgcagtccatcctgatcgaacacaagggtaccatcatcggcaagcagaacgacacgtgcaccgcgaaggccagctgctggctcgagtccgttaagagcttcttctacgggctgaagaatatgctgggctccgtcttcggtaacttcttcatcgggatcctcctgttcctggcacccttcgttctcctggtcctgttcttcatgttcggctggaaaattctcttctgctttaagtgctgccgccggacccgggggctgctgaagtaccggcacctcaaggacgacgaggagaccggctaccgccggattatcgagcgcctgaacaacaagaaagggaagaaccggctgctcgacggcgagcgcctggccgaccgtaaaatcgccgagcttttcagcaccaagacgcacataggg

SEQ ID NO: 15575 - RNA, 2916 nt, synthetic construct
  misc_feature 1..2916: note = derived and/or modified CDS sequence (opt11) from CCHFV(Ast199, Artificial)__KX056051.1__Gn-4aa-Gc
  source 1..2916: mol_type = other RNA
agcgaagaacccggcgacgactgcatctctcgcacacaactcctaaaaaccgagaccgcagagatccacgacgataactacggaggacccggagacaaaatcaccatatgcaacggatccaccatcgtcgatcaacggctgggctcagaactcgggtgctacaccatcaacagggtcaagtcttttaagttgtgcgaaaattcagcaaccggcaagacctgcgaaattgactccacccccgtaaaatgccgacagggcttctgcttaaaaataacccaagaaggccgaggccatgtaaaattgtcccgtggatccgaagtcgtcctcgatgcttgcgactcatcatgcgagatcatgatacccaaaggcaccggcgacatccttgtagactgctctggagggcaacaacacttcctgaaagacaacctcatcgacctgggatgcccacatattcctctcttaggcaaaatggccatctacatctgccggatgagcaaccacccccgcaccaccatggccttcctattctggttttccttcggctacgtcataacatgcatcttctgcaaagccctcttctactccttaataatcatcggcacgctcggaaagaaaataaaacagtacagggaactgaaaccacaaacttgcacgatctgcgaaacagcgccagtcaacgcgatcgacgcagaaatgcacgaccttaactgctcatacaacatctgcccgtactgcgcatcccgtctcacctcggacggcctcgcacgacacgtcacccagtgccctaaacggaaggagaaagtcgaagaaacagaactatacctcaacttagaaaggataccctggatcgtgaggaaactccttcaggtaagcgaaagcaccggcgtcgccctaaaaagatgctcctggctcatcgtgctcctggtcctcctaaccgtgtccctttccccagtgcaatccgcaccggtaggacggaaacccctcttccttgactccattgtcaagggcatgaaaaacctcctaaactcgacaagcctcgaaacctccctatccatagaagccccctggggagccatcaacgttcaatccaccttcaagccaacagtatcaacagccaacatcgcactatcctggagctccgtcgagcaccgcggaaacaagatcctagtcactggccggtcagagtcaatcatgaagctagaagaacgcacaggcgtgtcatgggatctcggcgttgaagatgcatcggaaagcaaactgctaaccgtcagcatcatggacctctcgcagatgtacagccccgtatttgaatacctgagcggtgaccggcaagttgaagaatggcctaaagctacctgcaccggggactgccccgaacgctgcggatgcacatcgtctacgtgcctccacaaggaatggcctcactcccgcaactggcgttgcaaccccacctggtgctggggagtcggaacgggctgtacctgctgcggcgtagacgtcaaggacctcttcaccgaccacatgtttataaaatggaaagtagagtatatcaaaaccgaggcaatagtgtgcgtagaactcacctcccaagaacgccaatgctcactcatagaggccggcaccagattcaacctaggaccagtcaccatcaccctgtcagaaccccgcaacatacaacaaaaacttccacccgaaataataacactacatcctaaaattgaggaaggcttcttcgaccttatgcatgtccaaaaagtactctccgcctccactgtctgtaaactccaatcatgcacccacggaatacccggcgaccttcaaatataccacataggcaacctcctaaaaggagaccgcctaaacggacaccttatccataagatagaaccccacttcaacaccagttggatgtcctgggatggctgcgatctcgactactactgcaacatgggcgactggccaagctgtacctataccggagtaacccaacataaccacgccgcattcgtcaatctcctaaatatcgaaacagactacaccaaaacattccacttccactctaagagagttacggcccacggagacacaccacaactagacctcaaagcccgaccaacatacggagccggcgaaataaccgtccttgtcgaagtcgcagatatggaactccacacgaagaaagtagaagtctcaggcctcaaatttgcctcactcgcctgcaccggctgttatgcctgctccagcggcatttcctgcaaggtccgcatccacgtagacgagcccgacgaactcaccgtccatgtgaaatcctcagacccagatgtcgtcgccgcctcgacgtccttaatggcccggaaactcgagttcggcacagactcgacattcaaagccttctcggctatgcccaagacctccttgtgtttctacatcgtcgaaagggagtactgcaagtcctgctccgaggacgacaccaagaaatgcgtagacacgaaactagaacaaccacaaagcatactcatcgaacataaaggcaccatcatcggcaaacaaaacgacacttgtacagcaaaagcgtcctgttggctcgaatccgtcaaatccttcttctacggcttaaagaacatgctcggctcggtattcggaaatttcttcgtcggaatcctactattcctagccccgttcgtcctcctcgtactattcttcatctttggctggaagatcctgttctgctttaaatgttgccggcgaacacgaggactcttcaagtaccgccacctcaaggacgacgaggaaaccggctatagaaaaatcatagaacgtcttaactcgaagaaaggcaagaaccgactgctagacggagagaggctcgcggaccgaaaaatagcagaactcttcagcaccaagacccacatcggt

SEQ ID NO: 15576 - RNA, 2916 nt, synthetic construct
  misc_feature 1..2916: note = derived and/or modified CDS sequence (opt11) from CCHFV(Ast149, Artificial)__KX056054.1__Gn-4aa-Gc
  source 1..2916: mol_type = other RNA
agcgaagaaccaggagacgactgcatatcccggactcagctactcaaaaccgaaacagcagagatccacgacgacaactacggaggaccaggagacaagatcaccatctgcaacggttcaacaatcgtagatcagaggctaggatccgaactaggctgttacacgatcaaccgagtaaaatcatttaaactgtgcgaaaacagcgccacaggaaaaacctgcgagatcgacagcacccccgtcaaatgcaggcagggattctgtctcaaaataacacaagaagggcggggtcacgtgaaactatcccgcggtagcgaagtcgtccttgacgcatgcgactcgtcatgcgaaataatgatcccaaaaggcaccggcgacatcctcgtcgactgctcaggaggccaacagcacttcctcaaagacaatctaatagacctcggctgcccacacatccctctactcggcaaaatggccatatacatctgccgaatgtccaatcacccccgaacaacaatggccttcctattctggttctcgttcgggtacgtgatcacatgcatcttttgcaaagcccttttctacagcctcattatcattggaacactaggaaagaaaattaaacaataccgcgaattaaaaccgcagacgtgcaccatatgcgaaactgccccagtcaacgcaatcgatgccgaaatgcacgacctcaactgctcctacaatatctgcccgtattgcgcatcacgcctcacatccgacggcctagcacggcacgtaactcagtgcccgaaacgcaaggaaaaagtcgaagaaacagaactctacctgaacctagaacgcataccgtggatagtcaggaaactactccaagtgagcgagtcgacaggcgtagccctcaaacgatcgagttggcttatcgttctgctagtcctccttaccgtatctctttcccccgtacagagcgccccagtcggccgcaaaccactcttcttagacagcatcgtcaaaggcatgaagaacctcctgaactcaacaagccttgaaacttcgctttccatcgaagccccctggggcgccatcaacgtacaaagcacattcaagcccaccgtcagtaccgcgaacatagcactaagctggtcatccgtggagcacagaggtaacaagattcttgtaaccgggcgcagcgagtccattatgaagctcgaggaacgcaccggagtatcctgggacctaggcgtcgaagacgccagcgaaagcaagctcctaaccgtgagcatcatggacctctctcaaatgtactccccagtcttcgagtatctatccggagaccgccaagtcgaagaatggcccaaggccacgtgtaccggcgactgcccggagcgctgcgggtgcacctcaagtacctgcctgcacaaagaatggccacatagccgcaactggagatgcaacccgacatggtgctggggagtaggaaccggctgcacttgttgcggagtcgacgtaaaagaccttttcaccgaccacatgttcatcaaatggaaggtcgaatacatcaagaccgaagctatcgtctgcgtcgagctaaccagccaagagcggcagtgctcacttatcgaagcgggaacacgctttaacctcggcccggtcacaatcaccctctcagaaccacgtaacatacagcaaaagctaccaccagaaataattacgcttcaccccaaaatcgaagaaggcttcttcgacctaatgcacgtgcaaaaagttctatccgcctccacagtatgcaaactacaatcatgcactcacggaatccccggcgacctccaaatttaccacataggcaatctccttaaaggcgaccggttaaacggccacctcatccacaaaatcgaaccccacttcaatacatcatggatgtcgtgggacggctgtgatctcgactactactgcaacatgggcgactggccctcatgcacatacacgggagtaacacaacacaaccacgccgccttcgtcaacctactcaacattgagacagactacaccaaaacattccacttccactcaaaacgcgttacagcacacggcgacacaccccaactggacctcaaagcccgacccacctacggagccggagagatcaccgtcctcgtcgaagtcgctgacatggaactacacacgaagaaagtcgaagtctccggactcaaattcgcgagcctagcctgcacaggatgctacgcctgctcatccggaatctcgtgtaaagtacgaatccacgtcgacgaaccagacgaacttacggtgcacgtaaaatcatccgaccccgatgtcgtcgccgcatccacatcactcatggcccgcaaactcgaatttggcaccgactccaccttcaaagccttctccgccatgccaaaaaccagcctctgcttctacattgtcgaacgcgaatactgtaaatcatgctctgaggacgacaccaagaaatgcgtagacaccaaactagaacaaccccaatccatactcatagaacacaaaggaactatcatcggcaaacagaacgacacgtgcaccgccaaagccagctgctggctagagtcagtcaagtcattcttttacggactcaaaaacatgctcggctcagtgttcggtaatttcttcgtcggaatactcctcttcctcgccccgttcgtcctcctagccctcttcttcatcttcggctggaaaatactcttctgcttcaaatgctgccgacgcacaagaggtctcttcaaataccgccacctgaaagacgacgaagagaccggatacagaaaaataatagaacgcctcaactcgaagaaaggcaaaaaccgactactcgacggggaaagacttgccgaccgcaaaatcgcagaactattcagcacaaaaacacacatcggc

SEQ ID NO: 15577 - RNA, 2916 nt, synthetic construct
  misc_feature 1..2916: note = derived and/or modified CDS sequence (opt11) from CCHFV(Ast137, Artificial)__KX056057.1__Gn-4aa-Gc
  source 1..2916: mol_type = other RNA
agcgaggagcccggcgacgactgcatctcccgcacacagctgctcaagaccgagacagctgagatacatgatgacaactatgggggaccgggggacaagatcactatctgcaatggctctaccatcgtggaccagaggctggggtccgagctgggctgctacaccatcaaccgcgtcaagagcttcaagctctgcgagaactctgccacgggcaagacctgcgagatcgatagtacccccgtgaaatgccggcaggggttctgcctgaagatcacccaggagggccgcgggcacgtcaaactgtcgcggggcagcgaagttgtgctcgacgcgtgtgattccagctgcgagatcatgatccccaaggggacgggagacatcctggtggactgctccgggggacaacaacactttttaaaagacaatctcatcgacttgggctgcccccacatcccgctgctcgggaagatggccatacacatctgccgaatgtcaaaccacccccggaccaccatggctttcctgttctggttttccttcggctacgtcatcacgtgcatcttctgcaaggcgctgttctattcgctcatcatcatcggaacgctggggaagaagattaagcagtaccgcgagcttaagcctcagacctgcaccatctgcgagaccgcacccgtgaacgcgatcgacgccgagatgcacgacctcaactgctcatacaacatctgtccgtactgcgccagccggttgacgtccgatggtctggccagacacgtgacccagtgccccaaacggaaggagaaggtcgaggaaactgagctatacctgaaccttgaacgcatcccatggatcgtacgaaaactcctccaggtgtctgagtccaccggtgtcgcgctaaagcgcagcagctggctcatcgtgctgctggtgctcctgacggtgtccctgagccccgtgcagtccgcgccggtgggccggaagcccctcttcctggacagcatcgtcaaggggaccaagaatctgctcaactccacttcactggagacctccctgagcatcgaggccccctggggcgcgataaacgttcagtccacgttcaagcccaccgtaagcaccgccaacattgcgctctcctggagctccgtcgagcaccgcggaaacaagatcctcgtgaccgggcggagcgagtccatcatgaagctggaggagcgcacgggagtgagctgggacctcggggtcgaggacgcctccgagagcaagctgctaaccgtgtccatcatggacctcagccagatgtacagccctgtcttcgagtacctgagtggcgaccgtcaagtggaggaatggcccaaggccacctgtaccggggactgccccgagcgttgcggctgcaccagctctacctgcctgcataaagaatggccccacagccggaactggcgctgcaacccgacctggtgctggggcgtggggactggctgcacgtgctgcggggtcgacgtcaaggacctcttcacggaccacatgttcattaaatggaaggtggagtacatcaagaccgaggccatcgtctgtgtggagttgacctcccaggagcgccagtgcagcctgatcgaggccggcacccggttcaacctggggcccgtgacgatcactctgtccgagccccgcaacatccagcagaagctgccccctgagatcatcaccctgcaccccaagatcgaggaaggcttcttcgacttaatgcacgtccaaaaggttctgagcgcgtcaaccgtgtgcaagctgcagagctgcacgcacggcatccccggtgacctccaaatataccatatcggcaacctgcttaaaggggacagactcaacggccacctgatccacaagatcgagccccactttaacacctcctggatgagctgggacggctgcgacctggattactattgcaacatgggggactggccgtcctgcacatataccggcgtcacgcagcataaccacgccgccttcgtgaatctcctgaatatcgagaccgattacaccaagaccttccacttccacagcaaacgcgtaacggcccacggggacacgccacagctggacctcaaggcccggcccacatatggagcgggagagatcaccgtcctggtggaggtggccgacatggagctgcacacaaagaaggtcgaggtgtcaggcctcaagttcgccagcctggcttgcaccggctgctacgcctgctcctctgggatcagctgcaaggtgaggatccacgtcgatgagccggacgagctgactgtgcacgtgaaatctagcgaccccgacgtcgttgcggcctccaccagcctgatggcccggaagctggagttcggcacggactccaccttcaaggccttcagcgcgatgcccaagacctccctgtgcttctacatagtagagcgcgagtactgcaagagctgcagcgaggacgacaccaagaagtgcgttgacactaagctagagcagccgcagtcgatcctgatcgagcacaaggggaccatcatcggcaagcagaacgatacctgcaccgccaaggcctcctgctggctggagagcgtgaagtccttcttctacgggctcaagaacatgctgggcagtgtcttcggcaactttttcgtcgggatcctcctgttcctggccccgttcgtgctgctcgtcttattcttcatattcggttggaagatcctgttctgctttaagtgctgccggcgcacgcgaggactcttcaaataccgccacctgaaagacgacgaagagaccgggtaccggaagatcatcgagcgccttaactccaagaaggggaagaaccggctgctggacggcgagcgcctggccgaccggaagatagcggagttattcagcaccaaaacccacatcggc

SEQ ID NO: 15578 - RNA, 2916 nt, synthetic construct
  misc_feature 1..2916: note = derived and/or modified CDS sequence (opt11) from CCHFV(Ast133, Artificial)__KX056060.1__Gn-4aa-Gc
  source 1..2916: mol_type = other RNA
tcagaggaaccagacgacgactgcatctcccgtactcagctccttaaaacagaaaccgccgaaatacacgacgacaactacggtggccccggcgacaaaataacgatatgtaacgggtccacgatcgtagatcagcgcctcggatccgagctaggatgctacacaattaaccgcgtcaaatccttcaaactatgtgaaaactcggccaccggcaaaacctgcgaaatagattcaacccccgtaaaatgcagacaaggcttctgcttgaaaatcactcaagaaggacgaggccacgtcaagctctcaaggggctccgaggtcgtactagacgcgtgcgacagctcctgcgaaatcatgatccccaaaggcaccggcgacatcctcgtggactgttccgggggccagcaacactttctcaaagacaacctgatagatctcggctgcccacacatccccctcctcggaaaaatggccatctacatctgcagaatgtccaaccacccgcgcaccaccatggcattcctattctggttcagcttcggctacgtcataacctgcatcttctgcaaggccctcttctaccttctaataattataggcacacttgggaaaaagataaaacaatacagagaactcaaaccccaaacttgcacaatatgcgaaaccgccccagtaaacgccatcgacgcggagatgcacgacctaaactgctcctacaacatatgcccctactgcgcctcccgcctcacaagcgacggacttgcaagacatgtaactcagtgcccgaagcgcaaagaaaaggtcgaggaaacagaactatacctaaacctagaacgcatcccctggatagtccgaaaattactacaagtctcggagtccacaggagtcgccctcaaacgatctagctggctaatagtgctcctagtcctactgaccgtgagcctctcccccgtacaatccgccccagtcggaagaaaacccctgttctcagacagcatagtcaaaggaatgaagaacctcctcaattccacatccctcgaaacctccctatcgattgaagccccatggggagccatcaatgtccaatcaaccttcaaacccacggtgtccacggcaaacatcgccctctcctggtcgtccgtcgaacaccgagggaacaaaatcttagtgacaggcagatccgaaagcataatgaaactagaagaacgcacaggcgtgagctgggacctcggcgtagaggacgcctcagaaagtaaactcctaacggtctccatcatggatctatcccaaatgtattcccccgtattcgaatacctgtccggagacagacaagtagaagaatggccaaaagcaacctgcacaggagattgcccagagcgctgcggctgcaccagctctacatgcctacacaaagaatggccccactcaagaaactggcgatgcaaccccacctggtgctggggagtaggcaccgggtgtacctgctgcggcgtggacgtaaaagatctattcaccgaccacatgttcatcaaatggaaggtcgaatacatcaagacagaagcaatagtctgtgtggaactcacatcccaagaaagacaatgtagcctcatcgaagcgggcacacgcttcaacctgggccccgtcaccatcactctcagcgagccacgcaacatacaacaaaaactcccgcccgaaataatcaccctacatcccaagatagaggaagggttcttcgacctaatgcacgtacagaaagtcctcagcgcatccacagtctgcaagctccaaagctgtactcacggcatcccgggagacctacagatctaccacataggtaacctcctcaagggcgacagggtgaacggccatcttatacacaaaatcgaacctcacttcaatacatcatggatgagctgggacggatgcgacctcgactactactgcaacatgggagactggccgagctgcacctacacaggtgtcacccaacataaccacgccgccttcgtaaacctcctaaacatcgaaacagattacaccaaaacattccacttccactccaaacgagtgacggcccacggcgacaccccacaactggacctaaaggccaggcccacgtacggcgccggtgaaataacagtcctcgtagaggtcgcagacatggagctacacaccaagaaggtggaaatcagcggactcaaattcgcaagcctaacatgcaccggttgctacgcatgctccagcggcataagctgcaaggtcagaatccacgtagacgaacccgacgaactaacggtccacgtcaaatcatcagacccagacgtagtcgccgcctcgacatcactcatggctaggaaactagagttcggcactgactcaacattcaaagccttcagcgccatgcctaaaacctctctctgcttctacatcgtggaacgcgaatactgcaaatcctgctcggaagacgacaccaagaaatgtgtagatacaaaactcgaacaaccacaaagcatcctgatcgaacacaaaggtaccataatcggcaaacaaaacgacacatgcaccgcaaaagcctcgtgctggctcgagagcgtgaaatcgttcttctacggcctcaaaaacatgctcggctcggtcttcggcagcttcttcgtcggcatattacttttcctcgcacccttcgtccttctcgtgctattcttcatgttcggatggaaaatactcttctgcttcaaatgctgccgacgaacacgtgggctttttaaataccgacaccttaaagacgacgaagaaacaggctatcgccgaataatcgagcgactcaacagtaagaaaggtaaaaacagattattagacggggagcgcctcgcggatcgaaaaatcgcagaattattcagcagcaaaactcacatcggc

SEQ ID NO: 15579 - RNA, 2916 nt, synthetic construct
  misc_feature 1..2916: note = derived and/or modified CDS sequence (opt11) from CCHFV(SK/2015/human, Artificial)__KX458183.1__Gn-4aa-Gc
  source 1..2916: mol_type = other RNA
tcagaagagtccggggacgactgcatcagtaggacccgactcctccgcaccgagacggccgaaatccacggcgactcatacgggggccccggtgacaaaataacgatctgtaacgggagtaccatcgtcgaccaacgactaggctcagaaatgggatgctacacaatcaaccgcgtcaaatccttcaaactctgtgaaaactccgccaccggtaaatcctgcgaaatagactccatcccagtccgctgccgccaaggctactgcctcaaaatcacccaagaaggtcgagggcacgtaaaactaagccgcggcagcgaagtcgtcctcgacgcttgcgactcgtcatgcgaggttatgatccccaaaggcaccggggatatcctagtcgattgctccggtggacagcaacacttcctaaaagacaacctaatcgacctcggatgccccaacatccccctactaggaaaaatggccatctacatatgtcgcatgagcaaccacccaaaaaccactatggcattcctattctggttctcctttggctacgtcatcacatgtattctatgtaaggctatattctaccttctgataattgttggcaccttggggaaacgcttcaaacaatatcgagagttaaagcctcaaacatgcaccatatgcgaaaccacccctgcaaacgccatcgacgccgagatgcacgacctgaactgctcctataccatctgcccgtactgcgcatcccgcctaacatcagacggcctcgcccgacacgtaacacaatgccccaaacgcaaggaaaaagtagaggagacggaactatacctcaacctggagcgaataccctgggtcgtacggaagctactgcaagtatcagaatcaacaggcgtggccttaaaaagatcttcctggcttattgtactcctcgtactcttcaccgtgagcctctcacccgtccaaagcgctcctatcggcagacgcccactcttcctggactccatagtccgcggaatgaaaaacttgctgaacagcacctccctcgagacctccctgtcaatagaagcgccatggggagccataaatgtccaatccacctacaaacctacagtctcaaccgctaacatcgccctatcgtggtccagcgtcgaacaccgcgggaacaagatcctcgtctcgggcagaagcgaaagcatcatgaaactagaagaacgaaccggggtcagctgggaccttggggtcgaagacgcctccgagtccaagctactcaccgtatccgtcatggatcttagccaaatgtactccccagtcttcgagtacctctcgggcgaccgacaagtcgaagaatggccgaaagcgacctgcaccggcgactgcccagaacgctgcgggtgcacaaccagcacatgcctccacaaagaatggcctcacagccgtaactggcgatgcaacccaacctggtgctggggcgtcggcacgggctgtacctgctgcggactagacgtcaaggacctattcaccgactacatgttcgtaaaatggaaagtcgaatacatcaaaaccgaagcaattgtttgcgtcgagctaacgagccaaggccgacagtgctcgctaatcgaggcaggtactcgcttcaaccttggatctgtcaccatcacgctcagcgaaccccgcaacatccaacacaaacttccccctgaaatcataacgctacacccaagaatcgaagaaggcttcttcgacctaatgcacgtccaaaaagtcctgtcagcatccacagtctgcaaactacaatcatgcacacacggagtccccggagatctgcaggtataccacatcggaaacctcctcaaaggagacaaagtcaacggtcacctaatccacaaaatagagccgcacttcaacacttcatggatgagctgggatggctgcgatcttgactattactgcaacatgggcgactggccaagctgcacctacactggagtcacgcagcataaccacgcctccttcgtaaaccttctaaacatcgaaacagactacaccaaaaacttccacttccacagcaaaagagttacggcacacggcgacaccccacagctcgatctaaaggcccgcccaacctacggcgctggcgaaatcaccgtcctggtcgaagtcgctgacatggaactccacactaaaaagatcgaaatctccgggctgaaatttgcctcattaacatgcaccggctgttatgcctgctccagcggaatctcctgcaaggtacgcattcacgtcgacgaacccgacgagctcaccgtacacgttaaatccgacgacccggacgtagtcgcagcctcatccagcttaatggcccgcaaactggagttcggcaccgactctacatttaaggcattctcggccatgcccaaaacatccctctgcttttatatcgtcgaacgagaatattgcaaaagctgcagcaaggaagacacccagaagtgtgtcaacacaaagctcgagcagccccagtcaatactcatcgaacacagaggcaccatcatcggcaaacagaacaacacttgcatagccaaagcctcttgctggctcgaaagtgtaaagtcattcttctacggacttaagaacatgctatccggaattttcggcaacctgttcctaggaatattcctattcctcgcacccttcatattgctaatcctcttctttatgtttgggtggcgcatactcttttgcttcaaatgctgccgacggacccgcggtctgttcaaataccgccacctcaaagacgacgaagaaaccggctacagacgcataatcgagcgcctgaacaataaaaagggtaaaaacaaactacttgacggagaacgtctcgccgacagacgcatagccgaactcttcagcaccaagacacacatcggc

SEQ ID NO: 15580 - RNA, 2916 nt, synthetic construct
  misc_feature 1..2916: note = derived and/or modified CDS sequence (opt11) from CCHFV(YL16070, Artificial)__KY354081.1__Gn-4aa-Gc
  source 1..2916: mol_type = other RNA
gcagagggcggatcatccgactgcatatcacgaacccagctagtaaaaaccgaggtagcggaaatccacgaggactcatacggcggcccaggcgagaaaatcacgatatgcaacgggtccacaatcgtcgaccaacgactaggctccgaacttggctgttacacaatcaatcgagtcaaaagctacaagctatgtgaaaatagcgcctccggaaaatcctgcgaaatagactctatccccgtcaagtgcaaacaaggattctgcctgaaaatcacccaagaaggacgcggccacgtaaaactaagccgcggcacggaaatcgtactcgacgtctgcgactcctcctgtgaactcatgatccccaaaggcacaggagacatcctcgtcgactgcagtggaggccaacaacactttctacaaaacaacctgatagatctcgggtgccccaacgtccccctcttaggaaaaatggcaatatacgtctgccgcatgtctaaccaccccaagaccacaatggccttcctcttctggttctccttcggatacgtaataacatgcatcgtctgccgagtactcttctacctcctaatcgccatcggcacagtaggaaagaaacttaaacaataccgagaactcaagccccagacctgcatcgtatgcgaatcagtacccgttaacgccatcgacgcagaaatgcacgaactaaactgctcctataatatctgcccctactgcgcctcccgcctttccaccgacggattaatacgacacgtcacccaatgccccaagcgccgggagaaggtcgaagagaccgaacttttcctcaacctagaacgcatcccatggctagtgcgaaaactgctccaagtttcggaatcgacggggatggctctaaaacgctcatgctggatgattacactcctcattctacttctcgtgtccatgtcgccggtccaatctgccccagtcggacgcaaaccactcttcctagactccatagcaaaaggaatgaaaagcctgcttaacagcacctcccttgagacctcgctgtctatagaggcaccttggggcgcgataaacgtccaaagcaccttcaaacctaccgtctccgccgcaaacattgccctatcctggtcaagcgttgaacacagaggaaacaagatcctcgtctcaggtcgcagcgagtccatcatgaagctggaagaacgaaccggggtatcctggaacctgggcgtagaagacgcctccgagtccaaaaccctcaccgtcagcgtaatggacctatcacaaatgtacagccccgtattcgagtaccttagcggcgaccgacaagtcgaagaatggcccaaggcaacatgcacgggagattgccccgagcgttgcggttgcacctcaagcacgtgccttcacaaagaatggccacattcacgaaactggcggtgcaaccccacatggtgctggggcgtaggcacaggctgtacctgctgcggcctcgacgtaaaagatttcttcaccgactacatgctcgttaaatggaaagtggagtacatcaaaacagaggcgatcgtttgcgtggagcttacgtcccaagagaggcaatgttcgctcatcgaagccggcacgcgcttcaacctcggacccgtcaccattacactatcggaacctcgcaacgtccaacaacgacttccacccgagatagtcaccctgcatcctaaaatcgaagaagggttcttcgacttaatgcacgtacagaaaatcctatcagcctcaacagtctgcaaactccaatcgtgcacccacggcgtcccaggcgacttccaagtatatcacgtcggcaatctcctcagaggcgacaaagtcaacggccacagcatacataaaattgagccccacttcaacacctcctggatgtcgtgggatggctgcgatctggactacttctgtaacatgggcgactggccatcgtgcacatacacaggagtgacccaacacaaccgggcagccttcataaacatgctcaacatagaaacagactacaccaagaccttccacttccattccaaacgagtaacagcccatggcgacacccctcaactagacctaaaagcgcgtcccgcctacggtgcaggagaagtcacggtccttgtcgaggtggccgaccttgaacttcacacaaagaaactagaagtctccggcctcaaaattgcctcactcacatgctcaggatgctatgcctgctcgagcggaatctcatgcaaagttcgcatccacgttaacgaacccgatgagttcaccgtacacgtccgctcctctgaccccgacgtcgtagcagccggatcctccctgatggcacgaaaaatcgagttcggagcggactcaaccttcaaagccttctcctcgatgccaaaagactccctctgcttctacatcgtagaaaaagactactgcagctcctgcaccgacgacgatacccagaaatgcgtcaacaccaaacttgaccacccacaaagcatccttattgaacataaagggaccatcatagggaaacaaaacgatacctgctccacaaaaacctcatgctggctcaaatccttcaaagggttcttctacgggcttaaaaacatgctctccggcatcttcgggaacgtattcctcggaatcctcctattcttagccccatttgtactcctaatattcttcttcttcttcggctggcgcctcctattctgtctaaaatgctgcaagaaaaccaaaggactcctaaagtacaaacacctcaaggacaaagaagaagccggctacaaaaagatcatagagcggctcaatgggaaaaagggaaaatctcaactcttcgacggcgaaagactcgcaaaccggaaaatagccgaactcttctccacgaaaatccacatcgga

SEQ ID NO: 15581 - RNA, 2916 nt, synthetic construct
  misc_feature 1..2916: note = derived and/or modified CDS sequence (opt11) from CCHFV(Oman_812956, Artificial)__KY362518.1__Gn-4aa-Gc
  source 1..2916: mol_type = other RNA
agcgaggagtccggcgaggactgcatcagccgcacccagctgctccgtaccgagacggccgagatccacggggacaactacggcgggcccggcgacaagatcaccatctgcaacgggtccaccatcgtggaccagcgcctggggagcgagctgggctgctacaccatcaaccgggtgaagtccttcaagctctgcgagaacagcgccacggggaagtcctgcgagatcgacaacacccctgtgaagtgtaagcaaggcttttgcctgaagatcacccaggaggggcgcggccacgtgaagctgagccgggactccgaggtcgtgctcgacgcgtgcgacagctcctgcgagatcatgattcccaaggggaccggcgacatcctggtggactgcagcggcgggcaacagcacttcctgaaagataacctcatcgacctaggctgccccaacatccccctgctcgggaagatggccatctacatctgccgcatgtccaaccacccgaaaacgaccatggcgttcctgttctggttcagcttcggctacgtcatcacgtgcatcctgtgcaaggtgatcttctacctcctgatcgtggtcggaaccctggggaagaagttcaagcagtaccgggagctcaagccccagacctgcaccatctgcgagacaacccccgtgaacgccatcgacgccgagatgcacgacctgaactgctcctacaacatctgcccctactgcgcgagccgcctgacgtccgacggactcgcccggcacgtgatgcagtgcccgaagcgcaaggagaagatcgaggagaccgagctctatctgaacctcgagcggatcccctgggtcgtacgcaagttactccaggtgagcgagtccaccggggtcgccctgaagcggagctcctggctgatcgtcctgctcgtgctgctgaccgtctccctcagccccgtgcagtccgccccaatcggccgcaagccgctgttcttcgacagcatcgcgaaggggatgaagaacctgctgaactccacgagcctggaaacctccctgagcatcgaggccccctggggcgccatcaacgtgcagtccaccttcaagcccaccgtctcgacggccaacatcgccctctcctggagctccgtggagcaccggggcaacaagatcctggtgagcgggcgctccgagagcatcatgaagctggaggagcgaaccggcatctcctgggacctcggggtggaggacgcgagcgagtccaagctgctgaccgtgagcgtcatggacctcagccagatgtactcccccgtgttcgagtacctgagcggcgaccgccaggtggaggagtggccaaaggcgacctgcacgggggactgccccgagcgttgtggctgcacctccagcacgtgcctgcacaaggagtggccccactcccgcaactggcggtgcaaccccacttggtgctggggcgtcgggaccggctgcacgtgctgcggtctcgacgtgaaagacctgttcaccgactacatgttcgtgaagtggaaggtcgagtacatcaagacagaggccatcgtgtgcgtggagctgaccagccaggagcgccagtgctccctgatcgaggccggcacccgcttcaacctcgggccggtcaccatcaccctgagcgagccccggaacatccagcagaagctgccgcccgagatcgtgaccctccacccccgcatcgaggagggcttcttcgacctaatgcacgtgcagaaggtcctctccgccagcacggtgtgcaagctccagtcctgcacccacggcgtgcccggggacctgcaggtataccacatcggcaacctgctcaagggggacaaggtgaacggccacctgatccacaaggtggagccccacttcaacaccagctggatgtcctgggacggctgcgacctggactactactgcaacatgggggactggcccagctgcacctacacgggcgtcacccaacacaaccacgccgccttcgtgaacctcctgaacatcgagaccgactacaccaagaacttccacttccactccaagcgggtgacggcccacggggacaccccgcagctggacctcaaggcccgccccaactacggcgccggggagatcaccgtcctagtggaggtggcggacatggagctgcacaccaagaaaatcgagatcagcggcctcaagttcgcctccctgacgtgcaccggctgctacgcctgcagcagcgggatctcctgcaaggttcggatccacgtggacgagcccgacgagctgaccgtgcacgtcaagtccgaggacccggacatagtggccgcctcctcgtccctcatggcgcgcaagctggagttcggcaccgacagcacgttcaaggccttctccgccatgcccaagaccagcctgtgcttctacatcgtggagcgggagtattgcaagtcctgcagcaaagaggacacccagaagtgtgtcaacgccaagctcgagcgcccccagtccatcctgatcgagcacaaggggaccatcatcggcaagcagaacgacacgtgcaccgcgaaggccagctgctggctggagtccgtcaagtcgttcttctacgggctcaagaacatgctgtctggcatcttcggaaacgtgttcatcggaatctttctgttcctcgccccctttatcttgctgatcctcttcttcatgttcggctggcggatcctgttctgcttcaagtgctgccgccggacccgagggctgttcaagtaccggcacctcaaggacgacgaggagaccggctaccgcaagatcatcgagcggctgaacaacaagaaggggaagaataagctgctcgacggcgagcgcctggccgaccggaaaatcgccgagctgttcagcacgaagacccacatcggc

SEQ ID NO: 15582 - RNA, 2916 nt, synthetic construct
  misc_feature 1..2916: note = derived and/or modified CDS sequence (opt11) from CCHFV(UCCR4405, Artificial)__KY484029.1__Gn-4aa-Gc
  source 1..2916: mol_type = other RNA
agcgaagaaccgggcgacgactgcatctcccgcacacaattactaaagacggaaaccgccgaaatacacgacgacaattacgggggcccaggcgacaagataacaatctgcaacggaagcacaatcgtagaccagcgcctcggctccgagctaggatgctacacaatcaaccgcgtcaagtccttcaagctatgcgaaaactccgccacagggaaaacatgcgaaattgactccacgcccgttaaatgccgccaagggttctgtctaaagatcacccaagaaggacgcggacatgtaaaactctcccgcggctcggaagtagtcctcgacgcatgcgattcatcgtgcgaagttatgatccccaaaggaaccggcgacattctcgtggactgttcaggcggccaacaacacttcctgaaagacaatctcatcgacctcggctgcccccacatacccctactcggaaagatggccatctatatatgcaggatgtccaaccacccacgaaccaccatggctttcctattctggttctccttcggctacgtgattacctgcatcttctgcaaagcacttttctactcactcataatcatcggtacactcggaaagaaaatcaaacaataccgagaacttaaaccccagacatgcacaatctgcgaaaccgcacccgtaaacgcaatcgacgccgaaatgcacgacctaaaatgctcatacaacatctgcccatactgcgcttccagactcaccagcgatggcctagcaagacacgtcacccaatgccccaaacgcaaagaaaaggtcgaagaaaccgaactataccttaacctcgagagaataccatggatagtacgcaagctactccaagtctccgaatccactggcgtcgcactaaagcgcagctcatggctaatcgtcctcctagtgctcctcaccgtcagccttagccccgtccagagcgcccccgtcggacggaaacctcttttcctcgacagcaccgtcaagggaatgaaaaacctcctaaactccacatccctggagacgtccctatccatcgaggccccctggggtgccatcaacgtccaatcaacattcaaaccaaccgtgtccactgcaaacatagccctctcatggtcgagcgtcgaacaccgaggcaacaagatactcgtgacaggacgaagcgaatccatcatgaaactcgaggaacggaccggagtcagctgggacctcggcgtagaggacgctagtgagagcaaactcttaacagtcagcataatggacctgtcccagatgtactctcccgtattcgaatacctatccggggaccgtcaagtagaagaatggccgaaagcaacctgcaccggagactgcccagaacgttgcggctgcacaagctccacatgccttcacaaagaatggccacactcccgcaactggcggtgcaaccccacatggtgctggggagtcggcaccggctgcacatgctgcggagtagacgtcaaagacctcttcaccgaccatatgtttgtcaaatggaaagtagaatacataaaaaccgaggccatcgtgtgcgtcgagctaaccagccaagaacgacaatgctccctaatcgaagccggcacccgcttcaacctgggccctgtcacaataaccctctccgaaccccgaaacattcaacaaaaattgccgcccgagataataactttacatccaaaaatagaagaaggtttcttcgacctaatgcacgttcaaaaagttttatctgcctccaccgtatgcaaactacaaagctgcacccacggaatcccaggggacctgcaaatatatcacattggcaacctcctaaaaggcgaccgcgtcaacggccacctcatacacaaaattgaaccccacttcaacacatcatggatgagctgggatggctgcgacctcgactactactgtaacatggggaactggccctcatgcacctacaccggcgtaacccaacacaaccacgccgcttttgtcaacctccttaatatagaaacagactacaccaaaaccttccacttccactctaaacgcgtaacggcacacggcgacaccccacaactggacctaaaggccaggccaacctatggcgccggcgaaatcaccgtcctagtcgaagtcgcagacatggaactacatacgaagaaagttgagatctccggcctgaaattcgcctcgctcgtctgtactggatgctacgcctgctcatcaggaatctcctgcaaagtcaggatccacgttgatgagcccgacgagctaaccgtacacgtgaaatcaagcgaccctgacgtcgtcgccgcttcgacctcacttatggcacgaaagctcgagttcggcacggactccatattcaaagccttcagcgccatgcccaagaccagcctctgcttttacattgtggaacgcgagtactgcaaatcatgctccgaagacgacaccaagaaatgcgtagacaccaaactggaacaaccgcagtcaatactcatcgaacataagggcaccatcatcggcaagcaaaacgacacatgtaccgccaaagcatcctgctggctagagtccgtcaagagcttcttctacggcctcaaaaacatgctgggatccgtattcggcaacttctttgtcggcatcctcctcttcttagcaccattcgtactattagtactattcttcatgttcggatggaagatcctcttctgcttcaaatgctgccgtcgaacacgaggcctcttcaaatacagacacctaaaagatgacgaagaaacaggctatcgaagaattatcgaacgcctcaattccaagaaaggcaaaaaccggctactcgacggagagcggctcgcagatcgcaagatcgctgaactcttcagcactaagacacacataggc

SEQ ID NO: 15583 - RNA, 2916 nt, synthetic construct
  misc_feature 1..2916: note = derived and/or modified CDS sequence (opt11) from CCHFV(UCCR4401, Artificial)__KY484035.1__Gn-4aa-Gc
  source 1..2916: mol_type = other RNA
tccgaagaaccttcggacgactgcatttcacgcactcagctactacgaaccgagaccgccgaaatccacggagacaactatggcggacccggcgacaagataaccatatgcaacggttcaaccatcgtagaccaacgcctaggatctgaactcggctgttacaccatcaaccgtgtacgatccttcaaactctgcgaaaacagcgccacgggcaaaaactgcgaaatcgactccgtgcccgtgaaatgccgccagggctactgcctccgaatcacacaagaaggccgagggcacgtcaaactcagcaggggttccgaagttgtcctcgacgcatgcgacacatcctgcgaaatcatgatccccaaagggaccggagacatcctcgtcgactgctctggaggtcagcaacacttcctcaaagataatctaatagacctcggctgccctaaaataccacttcttggcaaaatggcaatatacatctgccgcatgtccaatcaccccaagaccactatggccttcctgttctggttctccttcggatacgtaatcacgtgcatactatgcaaggcaattttctacttactcatcatagtgggcaccctaggcaaacgactcaagcagtatcgagaattaaagccccagacatgcacaatctgtgaaaccacaccagtcaacgccatcgatgccgagatgcacgacctaaactgctcatacaacatttgcccttactgtgcttcccgcctcacatcagacggcctggcgcgtcacgtaatccaatgcccaaaacgcaaagaaaaggttgaagagactgagctttaccttaaccttgaacgcatcccctgggtcgtacgaaaactcctgcaagtctccgaatcaaccggcgtcgcactaaaaagatcgtcctggttaatagtattactcgtcctattcaccgtctcgctatcccccgtccaatcagcaccaatcgggcgaaaaccactcttccttgactctaccgctaagggcatgaaaaacctcctcaactccacttcactcgagacctcactcagcatcgaagcgccatggggagcaatcaacgtccaatccacatacaaaccaacagtttccacagcaaatatagccctctcctggtcatcagtcgaacacaggggcaacaaaatcctagtctcaggccgctccgaaagcatcatgaaactagaagaacgaactggaatctcctgggacctcggggtcgaggatgcctccgaatcaaaacttctcacggtatcagtcatggatctctcccagatgtactcaccagtctttgagtacctaagcggagaccgccaagtcgaagagtggcccaaagccacatgcactggagactgccccgaacgctgcggatgcacatcgtcgacctgcctacataaagaatggccccactcccgtaactggagatgcaaccccacttggtgctggggagtaggcaccggctgtacctgctgcggccttgacgttaaggacctattcaccgactacatgttcgtgaagtggaaagtcgagtacataaaaacagaagccatcgtatgcgtcgaacttacttctcaagaacgccaatgctccttaatagaagccggcacgagattcaacctaggccccgtaaccatcacactttcggaacccagaaacatccagcaaaagctccctcctgaaataatcaccctccacccccgaatcgaagaagggttcttcgaccttatgcacgtacaaaaagtactaagcgcatccacagtttgcaaactgcaatcatgtacccacggagttccgggagaccttcaagtttaccacatcggcaacctactaaaaggtgacaaagtcaatggccacctgatacacaaaatagaaccccacttcaacaccagctggatgtcctgggatggatgcgacctcgactactactgcaacatgggcgactggcccagctgcacctacacaggcgttacccaacacaaccatgcctccttcgtaaacctactcaacatagaaactgactacaccaaaaactttcacttccactccaagagagtaacagcccacggcgacaccccgcaattagaccttaaagcacgacccacctacggagcaggagaaatcaccgtactcgtcgaggtcgcagacatggaactccacaccaagaaaattgagatctcaggcctcaaattcgcctcacttgcctgcactggctgctacgcctgctcatcaggtatatcatgcaaagtccgcatacacgtagacgaacctgacgagctcacagtacacgtaaaaagcgatgacccggacgtagtcgcagcctcgtccagcttgatggcccgaaagctagaatttggcacagattcaaccttcaaagccttctccgccatgccaaagaccagcctttgcttctacatcgtcgaacgcgagcactgcaaatcatgctcagaggaggacaccaagaaatgcgtcaacaccaaactagagcaacctcaatctatcctcatcgaacacaaaggtaccatcatcggcaaacaaaacagtacctgcaccgccaaggcatcctgctggctcgaatccgtcaaatccttcttctacggcctcaagaacatgctctccggcatcttcggcaatgtcttcatgggaatcttcctcttccttgccccattcatcctgctgatccttttcttcatgttcggctggcgcatacttttctgcttcaagtgctgccgtcgaacccgaggcctcttcaaatatcggcacctcaaggacgacgaagaaaccggttaccgacgcatcatcgaaaaactcaacaacaagaaaggcaagaataaactgctcgacggggaacgactcgccgaccgccgcattgccgaactcttctctacaaaaacacacatcggc

SEQ ID NO: 15584 - RNA, 2916 nt, synthetic construct
  misc_feature 1..2916: note = derived and/or modified CDS sequence (opt11) from CCHFV(UCCR4448, Artificial)__KY484042.1__Gn-4aa-Gc
  source 1..2916: mol_type = other RNA
agcgaggagacctccgacgactgcatcagccgcacccagctgctccggacggagaccgccgagatccacggcgacaactacggagggcccggggacaagatcaccatctgcaacgggtccacaatcgtggaccagcgcctggggagcgagctcggctgctacacgatcaaccgggtcaagtccttcaagctctgcgagaacagcgccaccggcaagtcctgcgagatcgacagcgtgccggtgaagtgccgccaggggtactgcctgcggataacccaggaggggcgcgggcacgtcaagctgtcccgggggtccgaggtagtactcgacgcgtgcgacacctcctgcgagatcatgatccccaaggggacgggagacatcctggtcgactgcagcggcgggcagcagcacttcctgaaggacaacctcatcgacctgggctgccccaagatccccctgctcgggaagatggccatctacatatgccgcatgtccaaccacccgaagaccaccatggccttcctgttctggttcagtttcggctacgtgatcacgtgcatcctgtgcaaggccatcttctacctcctgatcatcatcggcaccctgggtaagcggttcaagcagtaccgcgagctcaagccccagacctgcaccatctgcgagaccacgcccgtgaacgccatcgacgcggagatgcacgacctgaactgctcctataacatctgtccctactgcgccagccggctgacctccgacggcctcgcccgccacgtcacccagtgcccgaagcggaaggagaaggtggaggagaccgagctgtacctgaatctcgagcgcatcccctgggtggttcggaagctgctccaggtgagcgagtccacgggggtggccctgaagcgcagcagctggctgatcgtcctgctcgtgctgttcaccatctccctgagccccgtgcagtccgcgcccatcagccggaagcccctcttcctggactccatcgtcaagggcatgaagaacctgctcaacagcacctcccttgagaccagcctgtccatcgaggccccctggggcgccatcaacgtgcagagcacgtacaagcccaccgtgtccaccgccaacatcgccctcagctggtccagcgtcgaacaccgcgggaacaagatcctggtgtccggccggagcgagtccatcatgaagctggaggagaagaccgggatcagctgggacctcggcgtggaggatgcgtccgagagcaagctgctgacggtcagcgtgatggacctctcccagatgtacagccccgtcttcgagtacctgtccggggaccgccaggtggaggagtggccgaaggcgacttgcaccggcgactgtcccgagcggtgcggatgtaccagctccacgtgcctgcacaaggagtggccacacagccggaactggcgctgcaaccccacctggtgctggggcgtgggcaccgggtgcacgtgctgcggcctcgacgtcaaggacctgttcaccgactacatgttcgtgaagtggaaggtggagtacatcaagaccgaggccatcgtctgcgtggagctgacctcccaggagcggcagtgcagcctgatcgaggccgggacacgcttcaacctcggcccggtgaccatcacgctgtccgagccccggaacatccagcagaagctgccgcccgagatcatcaccctccacccccgcatcgaggaggggttcttcgacctgatgcacgtccagaaggtgctgagcgcctctaccgtgtgcaagctccaaagttgcacccacggggtccccggcgatctccaggtgtaccacatcgggaacctgctgaagggcgacaaggtgaacggacacctgatccacaagatcgagccccacttcaacacgtcctggatgagctgggacggctgcgacctggactactactgcaacatgggcgactggccctcctgcacctacaccggggtcacccagcacaaccacgccagcttcgtgaacctcctgaacatcgagacggactacaccaagaacttccacttccactccaagcgggtgaccgcccacggcgacaccccgcagctggacctaaaggcccgccccacgtacggggccggcgagatcaccgtcctggtggaggtggccgacatggagctgcacaccaagaagatcgagatcagcgggctcaagttcgcgagcctgacctgtacgggctgctacgcctgctccagcggcatctcatgcaaggtccgcatccacgtggacgagcccgacgagctgaccgtgcacgtcaagagcgacgacccggacgtggtggcggcctccagctccctcatggcccgcaaacttgagttcgggaccgacagcaccttcaaggcgttctccgccatgcccaagacgagcctgtgcttctacatcgtcgagcgggagcactgcaagtcctgcagcgaggaggacaccaagaagtgcgtgaacaccaagctcgagcagccgcagtcaatcctgatcgagcacaagggcaccatcatcgggaagcagaacagcacatgcaccgccaaggcctcctgctggctggagagcgtgaagtccttcttctacggcctcaagaacatgctgagcgggatcttcggcaacgtcttcatcggcatcttcctgttcctcgcgccctttattctgctgatcctcttcttcatgttcgggtggaagatccttttctgcttcaagtgctgccgccggacccgcggcctgttcaagtaccggcacctcaaggacgacgaagagaccgggtaccgccggatcatcgagcgcctgaacaacaagaagggcaagaacaagctgctcgacggggaaatcctggccgaccggcgcatcgccgagctgttctccacgaagacccacatcggg

SEQ ID NO: 15585 - RNA, 2916 nt, synthetic construct
  misc_feature 1..2916: note = derived and/or modified CDS sequence (opt11) from CCHFV(SPU 45/88, Artificial)__KJ682809.1__Gn-4aa-Gc
  source 1..2916: mol_type = other RNA
tccgaagagagctccgacgactgcctaagccgcacacagctacttcgcactgaaaacaccgagatccactcagacaactatggcggccccggcgataaaattaccatatgcaacggcagtacgatcgtagaccagcgcctcggctcagagctaggctgctatacaatcaacagagtgaaatcgttcaagctctgcgaaaactcggcgaccggcaaaagctgcgaaatcgattccacccccgtgcgatgccgacaaggcttctgtctgaaaataacccaagaaggcagagggcacgtaaaactgtctagaggatcagaagtcgtgctcgacgcatgcgacagctcctgcgaaatcatgatccccaaaggcacaggcgacatcctcgtcgactgtagcggtggccaacagcacttcctaaaagacaacttggtcgacctcgggtgtccaaacatccctctccttggaaagatggccatttacatctgccgaatgtcgaaccacccgaaaaccacaatgggcttcttattctggttctccttcggctacgtcataacctgcatcctatgcaaagtcatcttctacctcctcatcgtcgtaggaaccttgggcaagaaatttaaacaataccgggaactcaaaccccaaacctgcacgatctgtgaaaccacgcccgttaacgcaatcgacgccgagatgcacgacctaaactgcagctacaacatatgcccctactgcgcaagccggctaacatcagacgggcttgcccggcatgttatgcaatgcccaaaacgaaaagaaaagatcgaagaaaccgaattatacctcaacttagaacgcataccatggatagtacggaaactcctccaagtaagcgaatccacaggcgtcgctctcaaacgatcctcttggctcgtcgtcctcctcgtattactcaccgtcagcctcagccctgttcagagcgcccccattggccgcaagcccttattccttgacagcattgttaaagggaagaaaaacctcctcaactcaaccagtctagaaacctccctgtcaatcgaagcaccatggggagccataaacgtacaatcaacctttaagccgactgtgtcagccgctaacattgccctatcctggtcctccgtcgaacacagaggcaacaagatcctagtatccggccgatccgaatcaatcatgaagctcgaggaacgcaccggcatatcatgggacctaggcgtggaagatgccagcgaatccaagctcctgaccgtctcagtcatggacctttcccaaatgtacagcccagtattcgaatacctgtctggtgaccgacaagtagaagaatggcctaaagctacatgcacaggcgactgccccgagagatgtggatgtacctcgtccacctgtctacacaaagaatggccacattcacgcaactggcgatgtaacccaacctggtgctggggcgtcggcacaggctgcacctgttgtgggctagatgtcaaagacctctttacggactacatgttcgtcaaatggaaagtagattacatcaaaaccgaggcgatcgtctgcgtcgaactcacctcacaagaacgccaatgctccctcatagaggctggcacccgatttaacctgggccctgtcaccatcacactctccgaacccagaaatatccaacagaaactcccacctgagatcgtcacactacaccccagaatcgaagaaggtttcttcgacctcatgcacgtccagaatgtcctatccgccagcactgtatgcaaactccaatcctgcacacacggcgtcccaggcgacctacaaatctaccatattggcaatctcctgaagggcgacaaggttaacgggcacctcatccacaaaatcgaaccccatttcaacacctcttggatgtcgtgggacggctgtgacctagactactactgcaacatgggcgactggcccagctgctcctacacaggcgtgacccagcacaaccacgcggcgttcgtcaacatgctgaacatcgagaccgactacaccaaaaacttccacttccactccaaaagagtcacagctcacggcgacacaccccagctagaccttaaagctcggccgacctatggagccggtgagatcaccgtcctcgtagaagtcgccgacatggaactacacaccaagaaaatcgaaatctccggcctgaaatttgcttccctgacatgtaccggctgctacgcgtgctcatccggcatcagctgcaaagtccgcatccacgtagacgaacccgacgaactcacagtgcacgtaaaatcagaagacccggacatcgtcgccgcatccagctccctcatggcgcgaaaactagaatttggaacagactcaacattcaaagcattctctgcaatgccaaaaacttcactgtgcttctacatcgtcgagcgagaatactgcaaatcctgcagcaaagaagacacccagaaatgcgtgaacacaaaacttgaacaaccccaatccatacttatcgaacacaagggcacaatcatcggcaagcaaaatgacacatgcaccgccaaagcatcatgctggctagagtccgtaaagagcttcttctacggcctgaaaaacatgctctcaggcatcttcgggaacgttttcatcggtatcctcctgtttcttgccccattcatcatgctcatcctcttcttcatgttcggctggcgtatcctcttctgcttcaaatgctgcagacgcacccgcgggctattcaaatatcgacaccttaaagacgacgaagaaataggttacagaaaaatcatcgaacgactcaataacaaaaaggggaaaaacaagctcctcgacggcgagcgcctcgccgaccgcaaaatcgcggaactcttctccacaaaaacacatattgga

SEQ ID NO: 15586 - RNA, 2916 nt, synthetic construct
  misc_feature 1..2916: note = derived and/or modified CDS sequence (opt11) from CCHFV(3010, Artificial)__DQ019222.1__Gn-4aa-Gc
  source 1..2916: mol_type = other RNA
gcggaaggagtatcaaacgactgtgtaagccgaacgcaactaataaaaaccgaagtcgccgaaattcacgaagactcctatggtgggcctggggagaaaattaccatatgcaacggtagcaccatcgtcgaccagagactcggatcggaactgggatgctacacaataaaccgagtgaagacatacaagctctgcgaaaacagcgccacagaaaaaggctgcgagatagacagcgtacccgtcaaatgcaaacaaggcttttgcctaaaggtcacacaggaaggaagagggcacgtaaaactctcccgaggtaccgaaatagtcctcgacgtatgcgacacttcgtgcgagctcatgatccccaagggaaccggcgacatccttgtggattgctccggagggcagcaacacttcctacaagacaacctaatagatctcggatgcccaaacgtaccccttctgggcaaaatggccatctacatctgccgtatgtcaaaccaccccaagacaactatggccttcctcttctggttctcattcggatacgtcataacatgtattgtctgcaaggtcctcttttacctcctgatagtaattggaaccctatcaaagaagctcaaacaatatcgcgagttaaaaccacagacttgcatcgtctgcgaatcaacacccgtcaacgcaatcgacgccgaaatgcacgaactaaactgcaactacaacatatgcccctactgcgcctcccgactaacatccgacggccttgtccgccacgtaaaccaatgccctaagcgcaaagaaaaggtcgaggaaacggaactatacctaaacttagagcgtatcccctggctcgtcagaagactcctgcaagtgtccgaatccaccggcatggccctaaagcgctcttgctggatgacaactcttctaatactcctagtcgtaagcctgtcccccgtccaatccgcccccgtcggccgacgcccactattcctagacagcattgtcaaaggcatgaagaacctactaaactctacttccctcgaaacatcgctatccatagaagcaccctggggagctatcaacgtccaatccacctacaagcccaccgtaagcaccgcaaacatagcactatcatggtcatcagtcgagcaccgcggaaacaaagtcctagtttccggcagatccgaaagcataatgaagctcgaagagagaaccggcatcagctgggaccttggagtcgaagatgcttccgaatcaaagctcctaacagtgtccgtgatggacctctcgcagatgtactcgcccgtatttgaatacctctccggtgataggcaagtagaggaatggccgaaggccacctgtacgggcgactgcccagagcgctgcggctgcacctcctccacatgccttcacaaagaatggcctcattcccgcaactggcgatgcaaccccacctggtgttggggcgtaggcacgggctgcacgtgctgcggcctagacgtaaaagacctcttcacagactacatgttcgtaaaatggaaagtcgaatacatcaaaaccgaagcaatcgtatgcgtggaactcacctctcaagaaagacaatgctcactcatcgaagcgggaacgcggttcaacctaggaagcgtcaccatcaccctcagcgaaccacggaacatacagcagaaactaccgccggaaataatcacactgcaccccaaaatcgaagaaggatttttcgacctcatgcacgtccaaaaagtgctctcagcaagcacagtatgtaaactccaaagctgcacacacggcgtgcccggtgacctgcaggtctaccatatcggcaacctcctcaaaggagaccgagtcaacggccaccttatccacaagatcgaacagcacttcaatacctcgtggatgtcatgggacggatgcgacctcgattactactgtaacatgggggactggccatcctgcacgtacacgggcgtaacacagcacaaccacgcgagtttcgtaaaccttctcaacatcgaaaccgactacaccaaaaccttccacttccacagcaaaagagtcaccgcccacggagacacaccccaactcgacctaaaagcgagacccacctatggggccggggaagtaacagtcctagtagaggtagcagacatggagttacacaccaagaaaatagaaatatccggactgaaattcgcaggactaacctgtaccggttgctatgcatgcagcagcggcatctcatgcaaagtccgcatacacgtagacgaacccgacgaactcaccgtccacgtcaaatcagacgaccccgacgtcgtcgccgcgagcagctcactcatggccaggaagctcgaatttggcaccgactcaacctttaaagccttttccgcaatgcccaaaacctccctctgcttctacatcgtcgagcgcgaatactgtaagtcttgctccaaagaagacacgcaaaaatgcgtcaatacgaaactcgaacaacctcaatcgattctgatcgagcataagggcaccataataggaaaacagaacaacacgtgcaccgccaaagcctcatgctggctcgagagtgttaaatcgttcttctacggcctcaaaaacatgcttggaggcatcttcgggaatgtcttcatcggaatctttacattcttaaccccatttatcctcctcatcctcttcttcatgtttggctggcgcatactgttctgcttcaaatgttgcagacgaacccgcgggttattcaaataccggcaccttaaagacgacgaggaaacaggctaccgcaaaattatcgaacgactcaacaacaagaaagggaaaaatcgcctactggacggagaacgccttgccgatcggaaaattgctgaactctttagcacgaaaacccacatcggc

SEQ ID NO: 15587 - RNA, 972 nt, synthetic construct
  misc_feature 1..972: note = derived and/or modified CDS sequence (opt11) from CCHFV(10200)__U39455.2__Gn
  source 1..972: mol_type = other RNA
tccgaagaaccctccgacgactgcgtctcccgaacccaactcctccgcaccgaaaccgccgaaatccacggggacaactacggcggcccaggcgacaaaatcaccatctgcaacggcagcacgatcgtcgaccaacgcctcggctccgagctcggatgctacaccatcaaccgcgttcgctcattcaagctctgcgaaaactcagccaccggcaaaaactgcgaaatcgactccgtccccgtcaaatgccgccagggatactgcctgcgaatcacccaagaaggccgcggccacgtaaaactctcccgcggctcagaagtagtactcgacgcctgcgacacctcatgcgaaatcatgatccccaaaggcacaggagatatcctcgtcgactgctccggaggccaacaacacttcctcaaagacaacctcatagacctaggctgccctaaaatcccactcctcgggaaaatggccatatacatctgccgaatgtccaaccaccccaaaaccacaatggccttcctcttctggttctccttcggctacgtaataacctgcatcctctgcaaagccatcttctaccttctcatcatcgtcggcaccctaggacgccgcctaaaacaataccgtgaactcaaaccccaaacctgcaccatatgcgaaactacccccgtcaacgccatagacgccgaaatgcacgacctaaactgctcctacaacatctgcccctactgcgcctcccgcctaacctcagacggactagctcgccatgtcatccaatgccccaaacgcaaagaaaaagtcgaagaaaccgaactatacctcaaccttgaacgcatcccctgggtcgtccgaaaactactacaagtctccgaatcaactggcgtcgccctcaaacgatcgtcctggctcatcgtcctcctagtcctcttcaccgtctcactctcccccgtccaatccgccccaatcggc

SEQ ID NO: 15588 - RNA, 972 nt, synthetic construct
  misc_feature 1..972: note = derived and/or modified CDS sequence (opt11) from CCHFV(IbAr10200)__AF467768.2__Gn
  source 1..972: mol_type = other RNA
tccgaagaaccctccgacgactgcatctccagaacccaactcctccgaaccgaaaccgccgaaatccacggcgacaactacggaggccccggcgacaaaatcacgatctgcaacggaagcacaatcgtagaccaacgcctcggctccgaacttggctgttacacaatcaaccgcgtccgctccttcaaactctgcgaaaatagcgcaaccggcaaaaactgcgaaatcgactccgtccccgtcaaatgccgccaaggctactgcctccgaatcacccaagaaggccgaggccacgtcaaactcagccggggctccgaagtcgtcctcgacgcatgcgacacctcatgcgagataatgatcccaaaaggcaccggcgacatcctcgtcgactgctcaggcggccaacaacacttcctcaaagacaacctaatcgacctcggctgcccaaaaatccccctcctcggaaaaatggccatatacatatgcagaatgtcaaaccacccaaaaaccaccatggcattcctattctggttctcattcggctacgtaataacctgcatcctctgcaaagccatcttctacctactaatcatcgtcggcaccctcggcaaacgcctcaaacaataccgcgagcttaaaccccaaacctgcaccatctgcgaaaccacacccgtcaacgccatcgacgccgaaatgcacgacctaaattgcagctacaatatctgcccttactgcgcatcccgactcacctcagacggcctcgcgcgccatgtcatccaatgcccaaaacgcaaagaaaaagtcgaagaaaccgaactctacctcaacctcgaaagaatcccatgggtagtcagaaaactactccaagtctccgaatcaaccggcgtagccctcaagcgctcaagctggcttatcgtactgctcgtcctcttcaccgtctcactctcacccgtccaatccgcccccataggc

SEQ ID NO: 15589 - RNA, 972 nt, synthetic construct
  misc_feature 1..972: note = derived and/or modified CDS sequence (opt11) from CCHFV(Turkey-Kelkit06)__GQ337054.1__Gn
  source 1..972: mol_type = other RNA
tccgaagaacccggagacgactgcatcagccgcacccaactactacgcaccgaaaccgccgaaatccacgacgacaactacggtggccctggcgacaaaatcaccatctgcaacggctcaaccatcgtcgaccaacgactcggctccgaactcggctgctacacaatcaaccgcgtaaaatctttcaaactctgcaaaaactccgccaccggcaaaacctgcgaagtcgactcaacacccgtcaaatgccgccaaggcttctgcctaaaaatcacacaagaaggccgcggccacgtcaaactttcacgaggctcggaagtcgtcctcgacgcctgcgactcctcatgcgaagtcatgatcccaaaaggcacaggcgacatcctcgtcgactgctccggcggccaacaacacttcctaaaagataacctcatcgacctcggctgcccccacatacccctgctaggccgcatggccatctacatatgccgaatgtcgaaccaccccagaaccaccatggccttcctgttctggttctccttcggctacgtcataacctgcatcttctgcaaagcactcttctactccctcatcatcatcggaacactcggaaagaaaatcaagcaataccgcgaactaaaaccccaaacctgcaccatctgcgaaaccgcccccgtaaacgccatcgacgccgaaatgcacgacctcaactgcagctacaacatatgcccctactgcgcttcacgcctcacatctgacggcctagcccgtcacgtaacccaatgccccaaacgcaaagaaaaagtcgaagaaaccgaactttacctcaaccttgaacgtatcccatggattgtccgcaaactcctccaagtctccgaatcaaccggagtcgcactcaaacgctcctcctggctaatagtcctgcttgtcctcttaaccgtatccctctcccccgtccaatccgcccccgtagga

SEQ ID NO: 15590 - RNA, 972 nt, synthetic construct
  misc_feature 1..972: note = derived and/or modified CDS sequence (opt11) from CCHFV(SR3)__AJ538199.1__Gn
  source 1..972: mol_type = other RNA
tccgaagaatccggcgacgactgcatctcacgtacccaactcctccgcaccgaaaccgccgaagtacacggcgacaactacggaggacccggcgacaaaatcacaatctgcaacggcagcaccgtcgtcgaccaacgcctcgggtccgaactcggctgctacacaataaaccgcgtccgatccttcaaactctgcgaaaactccgccacaggcaaatcctgtgaaatcgactcaatcccagttaaatgcaaacaaggctactgcctaaaaattacacaagagggccgaggacacgtcaaactctcacgcggctcagaagtcgtcctcgacgtctgcgacagctcctgcgaagtcatgatccccaaaggaaccggagacatcctcgtcgactgcagcggcggccaacaacacttcctaaaagacaacctcgtcgacctaggctgccccaaaatccccctcctaggtaaaatggccatctacatctgccgcatgtccaaccacccaaaaaccaccatggccttcctattctggttctctttcggatacgtcataacctgcatcctctgcaaagctatctttttcctactaataatcttcggcaccctcggtaaacgcttcaaacaataccgcgaacttaaaccccaaacctgcaccatctgcgaaaccacacccgtcaacgccatcgacgccgaaatgcacgaccttaactgctcctacaacatctgcccctactgcgcctcccgcctcacctccgacggcctcgcccgccacgtaacacaatgcccccgccgcaaagagaaagtcgaagaaaccgaactatacctcaacctcgaacgcatcccctgggtcgtccgaaaactcctccaagtctccgaatcaaccggcaccgtgctaaaacgctcctcctggctcatcgtcctcctcgtcctattcacagtctcactttccccagtccaaagcgccccaatcgga

SEQ ID NO: 15591 - RNA, 972 nt, synthetic construct
  misc_feature 1..972: note = derived and/or modified CDS sequence (opt11) from CCHFV(UCCR4413)__KY484038.1__Gn
  source 1..972: mol_type = other RNA
tccgaatcctccgcctccggctgcatctcccgcacccagatgatcaaatctgagaccgcagaaatccacgacgacatatatggtggacccggcgaaaaactaaccatctgcaacggcaccacagtcgtcgaccaacgactcggctccgagctaggatgttacaccatcaaccgtatcaaaacatacaaactatgcgaaaactccgtgaaagaaaaaacctgcgaaatcgactcagtccccgtcaaatgccgacaaggcctatgcctcaaaatcactcaagaaggccgcggccacgtaaaactctcccggggctccgaaatcgtccttgacatctgcgactccagctgcgaacttatgatccccaaaggcaccggcgacatcctcgtcgactgctcaggcggccaacaacacttcctacaagacaacctcgtagacctcggctgcccaaacatccccctccttggcaaagtcgccatatacatctgccgcatgtccaaccacccaaaaaccaccatggccttcctattctggttctcattcggctacgtcatcacctgcatcctatgcaaaatcctcttctacctcctaatcattaccggcacactcggcaaaaaactcaaacaataccgcgaactcaaaccccaaacctgcaccatctgcgaatccacccccgtcaacgcaatcgacgcagaaatgcatgacctaaactgctcatacaacatctgcccctactgcgcctcacgcctcacttccgacggcctcatccgacacgtcaacctatgcccaaaacgcaaagaaaaagtagaagaaaccgaactatacctcaacctcgaacgcatcccctggtttgtccgcaaactcctacaggtctcagaatccaccggcgtagccctcaaacgtagctcctggctcctcatcctcgtcatcctccttaccgtctccatgtcccccgtccaatccgcacccataaac

SEQ ID NO: 15592 - RNA, 972 nt, synthetic construct
  misc_feature 1..972: note = derived and/or modified CDS sequence (opt11) from CCHFV(66019)__AB069669.1__Gn
  source 1..972: mol_type = other RNA
tccgaagaatccggtgatgactgcatctcccgtacccaactactccgcacagaaaccgccgaagtccacggcgataattacggcggaccaggcgacaaaataaccatctgcaacggctcaaccatcgtcgaccaacgactaggatccgaactcggctgctacaccatcaaccgcgtcaaatccttcaaactctgcgaaaactccggcaccggcaaatcatgcaaaatagacaacacccccgtcaaatgccgtcaaggcttctgcctcaaaataacccaagaaggccgcggccacgtaaaactctcccgcggctccgaagtcgtcctcgacgcctgcgactcttcctgcgaaatcatgatacccaaaggcaccggcgacatcctagtcgactgctctggaggccaacaacacttcctcaaggacaacctcgtcgacctaggctgccccaacatccctctcctaggaaaaatggccatatacatctgccgcatgtccaaccacccaaaaaccacaatggcattcctattctggttctcattcggatacgtcataacctgcatcttctgcaaaatcatattctacctactcatcgtcgtcggcacactcggcaagaaattcaaacaataccgcgaactcaaaccccaaacttgcacaatctgcgaaaccacacccaccaacgccatcgacgcagaaatgcacgacctcaaatgctcctacaatatctgcccttactgcgcatcccgcctcacctccgacggcctagcccgccacgtaacccaatgccccaaacgcaaagaaaaagtcgaagaaaccgaactctaccttaacctcgaacgaatcccctggatcgtcagaaaactcctccaagtctcagaatcaaccggcgtcgccctcaaacgctcctcctggctcatcgtactcctcgtactcctcacagtctctctctcccccgtccaatccgcccccatcggc

SEQ ID NO: 15593 - RNA, 972 nt, synthetic construct
  misc_feature 1..972: note = derived and/or modified CDS sequence (opt11) from CCHFV(7001)__AB069670.1__Gn
  source 1..972: mol_type = other RNA
gccgaaggcggctcctcagactgcatctcccgcacccaactcgtcaaaaccgaagttgccgaaatccacgaagactcctacggcggccccggagagaaaatcaccatctgcaacggctccacaatcgtcgaccaacgtctcggctccgaactaggatgctacacaatcaaccgagtccgctcttacaaactctgcgaaaacagcgcctcaggcaaatcctgcgaaatagactccatccccgtaaaatgcaagcaaggcttctgcctcaaaatcacccaagagggccgtggccacgtaaaactatcccgcggcaccgaaatcgtcctagacgtctgcgactcctcatgcgaactaatgatcccaaaaggcaccggcgacatactcgttgactgcagtggcggccaacaacacttccttcaaaacaaccttatcgacctcggctgccccaacgttcccctcctcggcaaaatggccatctacgtctgcagaatgtcaaaccaccccaaaaccacaatggccttcctcttctggttctccttcggctacgtcatcacatgcatcgcctgccgcgtactattctatctactcatagccatcggcacagtcggaaagaaacttaaacagtaccgcgaactcaaaccacaaacctgcatcgtatgcgaatctgtcccagtcaacgccatcgacgccgagatgcacgaactcaactgcagctacaacatctgcccctactgcgcctcccgcctctccaccgacggactcatccgccacgtcacacaatgcccaaaacgccgtgaaaaagtcgaagaaaccgaactcttcctaaacctagaacgcatcccatggctcgtccgcaaactcctacaagtctccgaatccaccggaatggccctcaaacgctcctgctggatgatcacactcctgatcctcctcctagtcagcatctcccccgtccaaagcgcgcccgtagga

SEQ ID NO: 15594 - RNA, 972 nt, synthetic construct
  misc_feature 1..972: note = derived and/or modified CDS sequence (opt11) from CCHFV(75024)__AB069671.1__Gn
  source 1..972: mol_type = other RNA
tccgaagagtccggtgacgactgcatctcacgtacccaactactccgaaccgaaacagccgagatccacggcgacaactacggcggccccggcgacaaaatcacaatctgcaacggctccaccatcgtcgaccaacgcctcggctccgaaatgggctgctacaccatcaaccgcgtaaaatcattcaaactctgcgaaaactccgccaccggcaaatcctgcgaaatcgacagcatccccgtcaaatgccgccaaggctactgcctcaaaataacccaagaaggacgcggccacgtcaaactttcccgcggctccgaagtagtactagacgcctgcgactcctcttgcgaagtcatgatccccaaaggaacaggagacatcctcgtagactgctccggcggtcagcaacacttcctcaaagacaacctcatagacctcggctgccccagcatacccctcctcggcaaaatggccatctacatctgccgaatgtccaaccacccaaaaaccaccatggccttcctcttctggttctcattcggatatgtcataacctgcatcctctgcaaagccatcttttacctgctcatcatcgtaggcaccctcggcaaaagattcaaacaataccgcgaactcaaaccacaaacctgcaccatctgcgaaacaacacccgccaacgccatagacgccgaaatgcacgacctcaactgctcctacaacatatgcccctactgcgcctcccgcctaacctccgacggcctcgcccgacatgtcacccaatgccccaaacgcaaagaaaaagtcgaagaaaccgaactctacctcaacctcgagcgcatcccttgggtagtccgcaaactcctccaagtctccgaatcaacaggtgtcgcactcaaaagatcctcctggctcatcgtcctgctcgtcctcttcgccatctccctctccccggtccaaagcgcccccatcggc

SEQ ID NO: 15595 - RNA, 972 nt, synthetic construct
  misc_feature 1..972: note = derived and/or modified CDS sequence (opt11) from CCHFV(7803)__AB069672.1__Gn
  source 1..972: mol_type = other RNA
tccgaagaatccggcgacgactgcatctcccgcacccaactcctacgaaccgaaaccgccgaaatccacggcgacaactacggcggacccggcgacaaaattaccatctgcaacggatccacaatcgtcgaccaacgcctcggctccgaaatgggctgctacacaatcaaccgcgtcaaatccttcaagctctgcgaaaacagcgccaccggaaaatcctgcgaaatcgactccatcccagtcaaatgccgccaaggctactgcctcaaaatcacacaagagggccgcggccacgtcaaactctcacgaggctccgaagtaatactcgacgcctgcgactcatcctgcgaagtcatgatccccaaaggcaccggcgacatcctcgtcgactgctccggcggacaacaacacttcctaaaagacaacctcatcgacctcggatgcccctcaatcccactgctcggcaaaatggccatctacatctgccgcatgtctaaccaccccaaaacaaccatggccttcctattctggttctccttcggctatgtcatcacttgcatactctgcaaagccatcttctacctcctgatcatcgtcggcaccctcggtaaacgcttcaaacaataccgagaactcaaaccccaaacctgcaccatatgtgaaacaacacccgccaacgccatcgacgccgaaatgcacgacctcaactgctcatacaacatatgcccctactgtgcctcccgcctaacatccgacggcctagcccgccacgtaacccaatgcccaaaacgcaaagaaaaggtcgaagaaaccgaactctacctcaacctcgaacgcatcccctgggtagtccgcaaactcctccaagtctccgaaagcaccggggtcgccctcaaacgatcctcctggctcatcgtcctcctcgtcctcttcgccatcagcctctcccccgtccaatcagcccccatctcc

SEQ ID NO: 15596 - RNA, 972 nt, synthetic construct
  misc_feature 1..972: note = derived and/or modified CDS sequence (opt11) from CCHFV(79121)__AB069673.1__Gn
  source 1..972: mol_type = other RNA
gccgaaggaggctcatcagactgcatctcacgcacacaactcgtcaaaacagaagtcgccgaaatccacgaagactcctacggcggccccggcgagaaaatcaccatctgcaacggctccacaatcgtagaccaaggcctcggctccgaactcggatgctacacaatcaaccgcgtccgctcctacaaactatgcgaaaactccgcatccggcaaatcctgcgaaatcgactctatccccgtcaaatgcaaacaaggcttctgcctcaaaataacccaagaaggccgcggccacgtcaaactctcccgcggcaccgaaatcgtcctcgacgtctgcgactcctcatgcgaactcatgatcccaaaaggcaccggcgacatcctcgtcgactgctcaggaggccaacaacacttcctccaaaacaaccttatagacctaggatgcccaaatgtacccctcctgggaaaaatggccatatacgtctgcagaatgagcaatcaccccaaaacaaccatggccttcctcttctggttctcattcggctacgtcataacctgcatcgcctgccgcgtcctcttctacctcctcatcgccatcggaaccgtcggcaagaaactcaaacaataccgcgaactcaaaccccaaacatgcatcgtctgcgaatccgtacccgtaaacgccatcgacgccgaaatgcacgaactcaactgctcctacaacatctgcccctactgcgcttcccgcctctcgacagacggactaatccgccacgtcacacaatgccccaaacgacgcgaaaaagtcgaagaaaccgaactattcctcaacctcgaacgcataccctggctcgtcagaaaactacttcaagtatccgaatctacaggcatggcactcaaacgctcctgctggatgatcaccctcctcatactcctccttgtatccatctcacccgtccaatccgcccccgtcggc

SEQ ID NO: 15597 - RNA, 972 nt, synthetic construct
  misc_feature 1..972: note = derived and/or modified CDS sequence (opt11) from CCHFV(8402)__AB069674.1__Gn
  source 1..972: mol_type = other RNA
tccgaagaatccggcgacgactgcatctcccgcacccaactcctccgcaccgaaaccgccgaaatacacaacgacaactacggcggccccggcgacaaaatcaccatctgcaacggctccaccgtagtcgatcaacgactaggctccgaactcggctgctacacaatcaaccgcgtcaaatccttcaaactctgcgaaaactccgccaccggcaaatcctgcgaaatcgactccacccccgtcaaatgtcgccaaggcttctgcctcaaaatcacccaagaaggccgcggacacgtcaaactatcccgcggatccgaagtcgtcctcgacgcatgcgactcctcctgcgaaataatgatcccaaaaggcaccggcgacatcctagtcgactgctccggaggccaacaacacttcctaaaagacaacctcatcgacctcggctgccccaacatccccctactcggcaaaatggcaatctacatctgccgcatgtccaaccacccaaaaaccacaatggccttcctattctggttctccttcggctacgtcgtaacctgcatcctctgcaaagtcatcttctacctcctcatcgtcgttggcaccctcggcaagaaatttaaacaataccgcgaactcaaaccccaaacctgcacaatatgcgaaaccacccccgtaaacgccatcgacgcagaaatgcacgacctcaactgcagctacaacatatgcccctactgcgcctcccgcctaacctcagacggactcgcccgccacgttatgcaatgccccaaacgcaaagagaaaatcgaagaaaccgaactatacctcaacttagaaagaatcccttgggtcgtcagaaaacttctccaggtctctgaatcaacaggcgtcgccctcaaacgctcatcctggctcgttgtactcctggtactcctcaccgtttccctctcccccgtccaatccgcacccatcggc

SEQ ID NO: 15598 - RNA, 972 nt, synthetic construct
  misc_feature 1..972: note = derived and/or modified CDS sequence (opt11) from CCHFV(88166)__AB069675.1__Gn
  source 1..972: mol_type = other RNA
tccgaagaatccggcgacgactgcatctcccgcacccaactcctccgcaccgaaaccgccgaaatccactccgacaactacggcggccccggcgacaaaataacaatctgcaacggcagcaccgtcgtcgaccaacgactcggctccgaactcggctgctacaccatcaaccgcgtcaaatccttcaaactttgcgaaaactccgccactggcaaatcctgcgaaatcgactcaaccccagtcaaatgccgccaaggcttctgcctaaaaataacccaagaaggacgcggccacgtcaaactctcccgcggatccgaagtagtcctcgatgcatgcgactcctcctgcgaaataatgatcccaaaaggcaccggagacatcctagtcgactgctccggaggccagcaacacttcctcaaagacaacctcatagacctcggctgccccaacatacccctcctcggcaaaatggccatctacatctgccgcatgtccaaccaccccaaaaccaccatgggcttcctattctggttctcgttcggttacgtcgtaacctgcatactctgcaaagtcatcttctacctactaatcgtcgtaggcaccctgggaaagaaattcaaacaataccgcgaactcaaaccccaaacctgcaccatctgcgaaaccacacccgtcaacgcaatcgacgccgaaatgcatgacctcaactgctcctacaacatctgcccctactgcgccagcagactgacatccgatggcctcgcccgccacgtcatgcaatgccccaaacgcaaagagaaaatcgaagaaaccgaactgtacctcaacctcgaacgaatcccctgggtcgtccgcaaactcctccaagtctccgaatcaaccggcgtcgccctaaaacgctcatcctggctcgtcgtcctcctagtcctcctaaccgtcagcctctcacccgttcaatcagcccccataggc

SEQ ID NO: 15599 - RNA, 972 nt, synthetic construct
  misc_feature 1..972: note = derived and/or modified CDS sequence (opt11) from CCHFV(BA88166)__AF338470.1__Gn
  source 1..972: mol_type = other RNA
tccgaagaatccggcgacgactgcatctcacgaacccaactcctacgcacagaaaccgccgaaatccactcagacaactacggtggtcccggagacaaaatcaccatctgcaacggcagcacagtcgtagaccaacgcctcggcagcgaactcggctgctacaccatcaaccgcgtcaaatccttcaaactatgcgaaaactccgcaacaggcaaatcatgcgaaatcgactccacccccgtaaaatgtcgacaaggcttctgcctcaaaataacccaagaaggccgaggccacgtgaaactctctcgcggctcagaggtcgtactcgacgcctgcgactcctcatgcgaaatcatgatccccaaaggcaccggcgacatcctcgtcgactgctccggcggacaacaacacttcctcaaagacaacctcatcgacctcggatgccccaacatcccactcctcggcaaaatggccatctacatctgccgcatgtcaaaccaccccaaaaccaccatgggattcctattctggttctcctttggatacgtcgtcacatgcatcctctgcaaaggaatcttctacctcctcatcgtcgtaggtaccctaggtaaaaaattcaaacaataccgcgaactcaaaccccaaacctgcaccatttgcgaaaccacccccgtcaacgccatcgacgccgaaatgcacgacctcaactgctcctacaacatctgcccctactgcgcctcccgactaacctcagacggcctcgcacgccacgtcatgcaatgcccaaaacgcaaagagaaaatagaggaaaccgaactatacctcaacctagaaagaatcccctgggtcgtccgcaaactcctacaagtctccgaatctaccggcgtcgccctcaaacgctcctcctggctcgtcgtcctactcgtcctcctcaccgtctccctatcccctgtccaatcagcccccatcggc

SEQ ID NO: 15600 - RNA, 972 nt, synthetic construct
  misc_feature 1..972: note = derived and/or modified CDS sequence (opt11) from CCHFV(BA66019)__AF350448.1__Gn
  source 1..972: mol_type = other RNA
agcgaagaatcaggagacgactgcatatcccgcacccaactactacgcaccgaaacagccgaagtccacggcgacaactacggcggccctggagacaaaatcaccatatgcaacggatcaacaatagtcgaccaacgcctcggctccgaactcggctgctacaccatcaaccgtgtaaaatcattcaaactctgcgaaaactccggcaccggaaaatcgtgcaaaatcgacaaacaccccgtaaaatgccgccaaggcttctgcctaaaaatcacccaagaaggccgcggccacgtaaaactctcccgcggctccgaagtcgtccttgacgcttgcgactcaagctgcgaaatcatgatccccaaaggaaccggcgacatactcgtcgactgctccggcgggcaacaacacttcctcaaagacaacctcgtcgacctcggctgccccaacatccccctcctcggaaaaatggcaatctacatctgccgcatgtccaaccacccaaaaacaaccatggccttcctcttctggttctccttcggctacgtcataacctgcatcttctgcaagatcatcttctacctcctaatcgtagtcggaactctcggcaagaaattcaaacaataccgagaactcaaaccccagacctgcaccatctgcgaaaccaccccaactaacgccatcgacgccgaaatgcacgacctcaaatgctcctacaacatatgcccctactgcgcctcaagacttacctccgacggcctcgcccgccacgtaacccaatgccccaaacgcaaagaaaaagtcgaagaaaccgagctctacctcaacctagaacgcatcccatggatcgtccgaaaactactccaagtctcagaatccaccggcgtagccctaaaacgctcctcctggctcatcgtcctcctcgtcctcctaaccgtctccctctcacccgtacaatccgcccccatcggc

SEQ ID NO: 15601 - RNA, 972 nt, synthetic construct
  misc_feature 1..972: note = derived and/or modified CDS sequence (opt11) from CCHFV(BA8402)__AF350449.1__Gn
  source 1..972: mol_type = other RNA
tccgaagaatcgggagacgactgcatctcccgcacccaactccttcgcaccgaaaccgccgaaatccacaacgacaactacggcggacccggcgacaaaatcaccatctgtaacggatcaaccgtcgtggaccaacgcctaggcagcgaactcggctgctacaccatcaaccgagtaaactccttcaacctctgcgaaaacaccgcaacaggcaaatcctgcgaaatcgactccacccctgtcaaatgccgccaaggcttctgcctcaaaatcacccaagaaggccgaggccacgtaaaactttcccgcggctccgaagtcgtactcgatgcctgcgaatcctcctgcgaaatcatgatccccaaaggcaccggcgacatcctcgtagactgctccggcggccaacaacacttcctcaaagacaacctcatcgacctcggctgcccaaacatcccactccttggaaaaatggccatctacatctgccgcatgtccaaccaccccaaaaccaccatggcattcctcttctggttctccttcggatacgtcgtcacctgcatcctctgcaaagtcatattctacctactaatcgtcgtcggcactctcggcaaaaaattcaaacaataccgcgaactaaaaccccaaacctgcaccatctgcgaaaccacccccgtaaacgccatcgatgcagaaatgcacgacctcaactgctcctacaacatttgcccctactgcgcctcccgcccaacatccgacggtctagcccgccacgtaatgcaatgccccaaacgcaaagaaaaaatcgaagaaaccgccctctacctcaatcttgaacgcatcccctgggtcgtccgcaaactacttcaagtatctgaaagcaccggcgtcgccctcaaaaggtcctcctggctcgtagtactcctagtcctactcacagtatccctatcccccgtccaatccgcccccataggc

SEQ ID NO: 15602 - RNA, 972 nt, synthetic construct
  misc_feature 1..972: note = derived and/or modified CDS sequence (opt11) from CCHFV(Matin)__AF467769.2__Gn
  source 1..972: mol_type = other RNA
tccgaagaaagcggcgacgactgcatctcccgaacccaactcctccgcaccgaaacagcagaaatccactccgacagctacggcggccccggcgacaaaatcaccatctgcaacggcagcaccgtcgtcgaccaacgcttaggctctgaactcggctgctacaccatcaacagagtcaaatccttcaaactctgcgaaaacagcgctaccggaaaatcatgcgaaatcgactccacgcccgtaaaatgccgccaaggcttctgcctcaaaataacccaggaaggccgcggccacgtcaaactatcacgcggctccgaagtcgtcctcgacgcctgcgactcctcctgcgaaatcatgatccccaaaggcaccggcgacatcctcgtagactgctccggcggccaacaacacttcctcaaagacaacctcatcgatctaggctgccccaacatccccctcctcggcaaaatggcaatctacatatgccgcatgtccaaccaccccaaaaccaccatggtcttcctcttctggttctccttcggatacgtcatcacatgcatactatgcaaagtaatcttctacctcctaatcgtcgtcggcacactcggcaaaaagttcaaacaataccgagaactaaaaccccaaacctgcaccatctgcgaaaccaccccagtcaacgccatcgacgccgaaatgcacgacctcaactgcagctacaacatctgcccctactgcgcatcacgtctaacctccgacggactcgcccgacacgtcatgcaatgccccaaacgaaaagagaaaatcgaagaaaccgaactatacctcaaccttgaacgcatcccctgggtcgtgcgcaaactcctccaagtctccgaatccaccggagtcgccctcaagcgctcctcctggctagtagtcctcctcgtactactaaccgtctccctgagcccagtacaatccgcacccatcgga

SEQ ID NO: 15603 - RNA, 972 nt, synthetic construct
  misc_feature 1..972: note = derived and/or modified CDS sequence (opt11) from CCHFV(Baghdad 12)__AJ538197.2__Gn
  source 1..972: mol_type = other RNA
tccgaagaatcaggagacgactgcatctcacgcacccgactcctccgcaccgaaaccgccgaaatccacggcgactcctacggtggacccggcgacaaaatcacaatctgcaacggctcaaccatagtcgaccaacgcctcggctccgaaatgggatgctacaccatcaaccgcgtcaaatccttcaaactctgcgaaaactccgccaccggcaaatcctgcaaaatagactccataccagtcaaatgccgccaaggctactgcctcaaaataacccaagaaggacgcggccacgtcaaactttcacgcggctccgaagtcgtcctcgacgcttgcgactcctcttgcgaagtcatgatccccaaaggcaccggcgacatcctcgtcgactgctcaggcggccaacaacacttcctcaaagacaacctcatcgacctaggctgccccaacatcccactcctcggcaaaatggccatctacatatgccgcatgagcaaccaccccaaaaccactatggccttcctcttctggttctccttcggctacgtcattacctgcatcctctgcaaagccatcttctacctactaatcatcgtcgggacactaggcaaacgcttcaaacaataccgcgaacttaagccccaaacctgcaccatatgcgaaacaacccccgtcaacgccatcgacgccgaaatgcacgacctaaactgctcctacaacatctgcccctactgcgcaagccgcctcacctccgacggactcgcccgccacgtcacccaatgccccaaacgaaaagaaaaagtcgaagaaaccgaactatacctcaacctcgaacgaatcccatgggtcgtccgtaaactcctacaggtctcagaatccaccggcgtcgccctcaaacgcagctcgtggctcatcgtcctcctcgtcctcctagctgtctcctcctcccccgttcaatccgcccctatcggc

SEQ ID NO: 15604 - RNA, 972 nt, synthetic construct
  misc_feature 1..972: note = derived and/or modified CDS sequence (opt11) from CCHFV(VLG/TI29414)__AY179961.1__Gn
  source 1..972: mol_type = other RNA
tcagaagagcccggcgacgactgcatctcacgcacacaactcctccgagccgaaccagcagaaatccatgacgacaactacggcggcccaggcgacaaaatcaccatctgcaacggctccaccattgtagaccaacgcctcggctccgaactcggctgctacacaatcaaccgcgtcaaatccttcaaactctgtgaaaacagcgcaaccggaaaaacctgcgaaatcgactccacccccgtcaaatgccgccaaggcttctgtctaaaaatcacccaagagggacgcggacacgtcaaactaagccgcggctccgaagtcgtcctagacgcctgcgatagctcctgcgaagtaatgatacccaaaggcaccggagacatcctcgtcgactgctccggcggccaacaacacttcctcaaagacaacctaatcgacctaggctgcccccacatcccactcctcggcaaaatggccatctacatctgccgcatgtccaaccacccccgcaccactatggcattcctcttctggttctccttcggctacgtaatcacctgcatcttctgcaaagccctcttctactcactcatcatcatcggaacactcggcaaaaaaatcaaacaataccgagaactcaaaccccaaacatgcaccatctgcgaaaccgcacccgtcaacgccatcgacgccgagatgcacgacctaaactgcagctacaacatctgcccgtactgcgcatcacgcctcacctcagacggactagcacgccacgtaccccaatgtcccaaacgcaaagaaaaagtcgaagaaaccgaactatacctcaacctcgaacgcataccatggaacgtccgaaaactactccaagtctccgaatccaccggcgtcgccctaaaacgctccagctggcttatcgtcctcctcgtcctcctaaccgtctccctaagcccagtccaaagcgcccccgtcggc

SEQ ID NO: 15605 - RNA, 972 nt, synthetic construct
  misc_feature 1..972: note = derived and/or modified CDS sequence (opt11) from CCHFV(TADJ/HU8966)__AY179962.1__Gn
  source 1..972: mol_type = other RNA
tccgaagaaagcggcgacgactgcataagcagaactcaactcctacgcaccgaaaccgccgaaatccacggcgacgactacggcggacccggcgacaaaatcaccatatgcaacggctccaccatcgtagaccagcgcctcggctccgaactaggctgctacaccataaaccgagtcaaatcattcaaactctgcgaaaactccgccacaggcaaaaactgcgaaatcgactccgtccccgtcaaatgccgccaaggctactgcctcaaaatcacccaagaaggacgaggccacgtcaaactcagccgcggctccgaagtcgtcctcgacgcctgcgactcctcatgcgaagtcatgatacccaaagggacaggcgacatatccgtcgactgctccggaggccaacaacacttcctcaaagataacctcatcgacctcggctgccccaaaatcccactactcggcaaaatggcaatctacatctgccgaatgtccaaccaccccaaaaccaccatggcattcctcttctggttctcattcggctacgtcatcacgagaatcctctgcaaagcgatcttctaccttctaatcatcgtaggaaccctcggcaaacgattcaaacaataccgcgaactcaaaccccaaacatgcaccatctgcgagacaacccccgccaacgccatcgacgccgaaatgcacgacctcaactgcagctacaacatatgcccctactgcgcatcccgcctcacctccgacggtctcgcacgccacgtcacccaatgccccaaacgaaaagaacgcgtcgaagaaacagaactctacctaaacctagaacggatcccctggatcgtccgcaaactactccaagtctccgaatccacaggagtcgccctcaaacgctccagctggctcatcgtcctcctagtcctcttcaccgtaagcctcagccccgtccaatccgcacccatcggc

SEQ ID NO: 15606 - RNA, 972 nt, synthetic construct
  misc_feature 1..972: note = derived and/or modified CDS sequence (opt11) from CCHFV(Hodzha)__AY223476.1__Gn
  source 1..972: mol_type = other RNA
tctgaagaatccggcgacgactgcatctcacgaacccaactcctccgcaccgaaaccgccgaaatccacggcgacgactacggcggccccggcgacaaaatcaccatctgcaacggctcaacaattgtcgaccaacgcctcggctcagaactaggatgctacacaatcaaccgagtcaaatcattcaaactctgcaaaaactccgcaaccggcaaatcatgcgaaatcgactccacacccgtcaaatgccgccaaggatactgcctcaaaatcacccaagaaggccgaggccacgtcaaactatcccgaggctccgaagtagtcctcgacgcctgcgactcctcctgcgaagtcatgatccccaaaggaaccggcgacattctcgtcgactgcagcggaggccaacaacacttcctcaaagacaaccttatagacctaggctgcccccggatccccctactcggcaaaatggccatctacatctgcagaatgtccaaccaccccaaaaccactatggccttcctcttctggttctccttcggctacgtcataacctgcatcctctgcaaagccattttctacctcctaatcatagtcggaacactcggcaaacgattcaaacaataccgagaactaaaaccccaaacatgcactatctgcgaaaccacccccgcaaacgccatagacgcagaaatgcacgacctcaactgctcgtacaacatctgcccgtactgcgcaagccgcctcacatccgacggcctcgcccgccacgtcacccaatgccccaaacgcaaagaaaaagtagaagaaaccgaactttacctaaacctcgaacgcatcccctggatagtccgcaaactactccaagtatcagaatccaccggcgtcgccctcaaaagatcctcatggctcatcgtcctcctcgtactatttgccgtctctctatcccccgttcaatcagccccaatcggc

SEQ ID NO: 15607 - RNA, 972 nt, synthetic construct
  misc_feature 1..972: note = derived and/or modified CDS sequence (opt11) from CCHFV(Kosovo/9553/2001)__AY675511.1__Gn
  source 1..972: mol_type = other RNA
tccgaagaaccaggcgacgactgcataagccgcacccaactccttcgcaccgaaaccgccgaaatccacgacgacaactacggaggccccggcgacaaaatcaccatctgcaacggcagcaccatcgtcgaccaacgcctcggatcagaactaggctgctacaccatcaaccgtgtaaaatcattcaaactctgcgaaaactccgccacaggaaaaacctgcgaaatagactccaccccagtaaaatgccgccaaggcttctgcctgaaaatcacccaagaaggcagaggccacgtcaaactatcacgcggctccgaagtcgtcctcgacgcctgcgacagctcctgcgaagtcatgatccccaaaggcacaggcgacatactcgtcgactgcagcggaggacaacaacacttcctaaaagacaatctcatcgacctcggctgcccacacatccccctgctcggcaaaatggccatctacatcgcccgaatgtcaaaccaccccaaaaccacaatggccttcctattctggttctccctaggatacgtaataacctgcatcctctgcaaagccctcttctactccctaatcatcatcggcaccctcggcaagaaaatcaaacaataccgagagctcaaaccccaaacctgcacaatatgcgaaaccgcacccgtaaacgcaatcgacgccgaaatgcacgaccttaactgctcctacaacatatgcccctactgcgcctcccgcctaacctccgacggcctagcccgccacgtcaaacaatgccccaaacgcaaagaaaaggtcgaggaaaccgaactctacctaaacctggaacgcatcccgtgggtcgtccgcaaactcctccaagtctcagaatccaccggagtagcactcaaacgctcatcctggctaatagtcctactcgtactcctcaccgtctctttatcacccgtccagagcgcccccgtagga

SEQ ID NO: 15608 - RNA, 972 nt, synthetic construct
  misc_feature 1..972: note = derived and/or modified CDS sequence (opt11) from CCHFV(SPU41/84)__AY900142.1__Gn
  source 1..972: mol_type = other RNA
tccgaagaatcctcagacgactgcatatcccgcacccaactcctacgcaccgaaaccgccgaaatccacggcgacaactacggcggcccaggcgacaaaatcaccatctgcaacggctccacagtcgtcgaccaacgcctcggctccgaactaggctgctacaccataaaccgcgtcaaaacattcaaactctgcgaaaactcagccaccggcaaaagctgcgaaatcgactccgtccccgtcaaatgccgccaaggctactgcctcaagattacccaagaaggacgaggccacgtcaaactctcacgcggttccgaagtcgtcctcgatgcatgcgacacatcatgcgaagtcatgatccccaaaggcaccggagacatcctcgtcgactgctcaggaggccaacaacacttcctaaaagacaacctaatagacttaggctgccccaaaatcccactactaggcaaaatggccatctacatctgccgcatgtccaaccaccccaaaacaaccatggccttccttttctggttctcattcggctacgtcatcacatgcatcatctgcaaagtcatcttttacctcctcatcatcgtcggcactcttggcaaacgcttcaaacaataccgagaactcaaaccccagacatgcaccatatgcgaaaccacccccgtcaacgcaatcgacgcagaaatgcacgacctcaactgctcatacaacatatgcccttactgcgcatcacgcctaacatcggacggcctagcccgccacgtcacccaatgccccaaacgtaaagaaaaagtcgaagaaactgagctatacctcaacctcgaacgcataccctgggtcgtccgtaaactactccaagtctccgaatcaaccggcgtcgccctcaaacggtcctcctggctcgtcgtactcctagtcctcctcaccgtctcactctcccccgtccaatccgctcccatatcc

SEQ ID NO: 15609 - RNA, 972 nt, synthetic construct
  misc_feature 1..972: note = derived and/or modified CDS sequence (opt11) from CCHFV(UG3010)__AY900143.1__Gn
  source 1..972: mol_type = other RNA
gctgaaggagtctccaacgactgcgtctcccgaacccaactcataaaaacagaagtagccgaaatccacgaagactcctacggcggcccaggcgaaaaaatcaccatctgcaacggctccaccatcgtcgaccaacgcctcggctccgaactcggctgctacacaatcaaccgcgtcaaaacctacaaactctgcgaaaactccgccaccgaaaaaggctgcgaaatcgactccgtccccgtcaaatgcaaacaaggcttctgcctaaaagtcacccaagaaggccgcggacacgtaaaactcagccgcggcaccgagatagtcctggacgtctgcgacacctcctgcgaactcatgatcccgaaaggcaccggagacatcctcgtcgactgctcaggcggacaacaacacttccttcaagacaacctcatcgacctcggatgccccaacgtacccctcctaggcaaaatggccatctacatatgccgaatgtcaaatcaccccaaaaccaccatggccttcctcttctggttctccttcggctacgtcatcacctgcatcgtctgcaaagtactcttctacctcctcatagtaatcggcacccttagcaaaaaactgaaacaataccgcgaactaaaaccccaaacctgtatcgtctgcgaatccaccccagtcaacgcaatcgacgccgaaatgcacgaactaaactgcaactacaacatctgcccctactgcgcctcccgcctcacctcagacggcctcgtccgtcatgtcaaccaatgccccaaacgcaaagaaaaagttgaagaaaccgaactctacctaaacctcgagcgcatcccctggctcgtccgccgcctactccaagtctccgagtccaccggcatggccctcaaacgctcctgctggatgaccactctactaatcctcctcgtcgtctccttatcccccgtccaatccgccccagtcgga

SEQ ID NO: 15610 - RNA, 972 nt, synthetic construct
  misc_feature 1..972: note = derived and/or modified CDS sequence (opt11) from CCHFV(Hy13)__AY900145.1__Gn
  source 1..972: mol_type = other RNA
tccgaagaatccggcgacgactgtatctccagaacccaactatcccgcaccgaaacagctgaaatccactccgacaactacggcggccccggcgacaaaatcaccatctgcaacggttccacaatcgtagaccaacgcctaggctccgaactcggctgctacaccatcaaccgtgtcaaatccttcaaactctgcgaaaactcggccaccggaaaatcctgcgaaatcgactccacacccatcaaatgccgtcaaggcttctgcctcaaaatcacccaagaaggccgcggccatgtcaaactgtcccgcggatccgaagtcgtcctcgacgcctgcgacagctcctgcgaaatcatgatacctaaaggcaccggtgacatcctcgtcgactgctcaggaggccaacaacacttcctcaaagacaacctcatagacctcggctgccccaacatccccctactcggcaaaatggccatctacatctgccgcatgtccaaccaccccaaaaccaccatggccttcctattctggttctccttcggatacgtcatcacatgcatcctctgcaaagtcatcttctaccttctcatagtcgtcggcacactcggcaagaaattcaaacaataccgcgaactcaaaccccaaacctgcaccatctgcgaaacaacacccgtcaatgccatcgacgccgaaatgcacgacctcaactgcagctacaacatatgcccctactgcgcctcccgcctaacatccgacggcctcgcacgccacgtcatgcaatgccccaaacgaaaagaaaaagtcgaagaaaccgaactctacctcaacctcgaaagaatcccctgggtcgtccgaaaactactacaagtcagcgaatccaccggcgtcgcactcaaacgctcctcctggctagtcgtcctcctagtcctactaaccgtctcactctcccccgtccaatccgcacccatcggc

SEQ ID NO: 15611 - RNA, 972 nt, synthetic construct
  misc_feature 1..972: note = derived and/or modified CDS sequence (opt11) from CCHFV(Semunya)__DQ094832.1__Gn
  source 1..972: mol_type = other RNA
gcagaaggcgtttcaaacgactgcgtctcacgcacccaactcataaaaaccgaagtcgccgaaatccacgaagactcctacggaggccccggcgagaagatcacaatctgcaacggaagcaccatcgtcgaccaacgcctcggctccgaactcggctgctacaccatcaaccgtgtcaaaacatacaaactctgcgaaaactccgccaccgaaaaagggtgcgaaatcgactccgtccccgtcaaatgcaaacaaggcttctgcctcaaagtcacccaagaagggcgaggacacgtcaagctctcccgaggcaccgaaatcgtcctagacgtctgcgatacctcctgcgaactcatgatcccgaaaggcaccggcgacatactcgtcgactgctccggaggccaacaacacttcctccaagacaacctcatcgacctaggctgcccaaacgtccccctcctaggcaaaatggccatctacatctgcagaatgtccaaccacccaaaaaccacaatggcattcctcttctggttctccttcggatacgtaataacctgcgtcgtctgcaaagtcctcttctacctactcatcgtcatcggcacactcggcaagaaactcaaacaataccgcgaactcaaaccacaaacatgcatcgtatgcgaaagcataccagtcaacgccatagacgccgaaatgcacgaactcaactgcaactacaacatctgcccctactgcgcctcacgcctcacctccgacggactcgtccgccacgtcacccaatgccccaaacgaaaagaaaaagtcgaagaaaccgaactctacctgaacctagaacgaatcccatggctcgtccgacgcctactccaagtctccgaaagcacaggcatggccctcaaacgcagctgctggatgaccacccttctcatcctcctagtagtaagcctctcccccgtccagtccgcacccgtcgga

SEQ ID NO: 15612 - RNA, 972 nt, synthetic construct
  misc_feature 1..972: note = derived and/or modified CDS sequence (opt11) from CCHFV(SPU128/81/7)__DQ157174.1__Gn
  source 1..972: mol_type = other RNA
tccgaagaaccatccgacgactgcatcagccgaacacagctcctgagaaccgaaaccgccgaaatccacggcgacaactacggaggccccggagacaaaatcaccatctgcaacggctccaccatcgtcgaccaaagactcggatcagaactaggctgctacactatcaaccgagtcaaatccttcaaactctgcgaaaacagcgccaccggcaaatcatgcgaaatcgaaagcgtccccgtcaaatgccgccaaggctactgcctccgaatcacccaagaaggtcgcggacacgtcaaactatcccgaggctctgaagtcgtcctcgacgcctgcgacacatcatgcgaaatcatgatccccaaaggcactggcgacatcctcgtcgactgctccggaggccagcaacacttcctaaaagacaacctaatcgacctcggctgccccaaaatacccctcctcgggaagatggccatctacatctgccgcatgtccaaccaccccaaaacaacaatggcattcctattctggttctcgttcggctacgtcataacctgcatcctatgcaaagcaatcttctaccttctcatcatcatcggcaccctcggcaaaagattcaaacaataccgcgagctcaaaccccaaacctgcaccatatgcgagaccaccccagtcaacgccatcgatgcagaaatgcacgacctcaactgctcctataacatctgcccatactgcgcctcacgactcacctccgacggcctagcccgccacgtcacacaatgccccaaacgcaaagaaaaagtcgaagaaaccgaactgtacctcaaccttgaaagaataccctgggtcgtccgcaaactactccaagtctccgaatcaaccggcgtcgcactcaaacgctcatcctggctaatcgtcttactcgtcctcttcaccgtaagcctctcacccgtccaatccgcccccataggc

SEQ ID NO: 15613 - RNA, 972 nt, synthetic construct
  misc_feature 1..972: note = derived and/or modified CDS sequence (opt11) from CCHFV(ROS/HUVLV-100)__DQ206448.1__Gn
  source 1..972: mol_type = other RNA
tccgaagaaccaggcgacgactgcatctcaagaacccaactcctccgcaccgaaaccgccgaaatccacgacgacaactacggcggacccggcgacaaaatcaccatatgcaacggctcaaccatcgtcgaccaacgactcggcagcgaactcggctgctacaccatcaaccgcgtcaaatcattcaaactttgcgaaaactccgccacaggcaaaacctgcgaaatcgactccacccccgtcaaatgccgacaaggcttctgcctcaaaatcacccaagaaggacgaggccacgtcaaactctcccgcggctccgaagtagtactcgacgcctgcgactccagctgcgaagtcatgatccccaaaggcaccggcgacatcctcgtcgactgctcaggcggccaacaacacttcctcaaggacaacctcatcgacctcggatgcccccacatcccccttctcggcaaaatggccatctacatctgccgaatgtcaaaccacccccgcaccaccatggccttcctcttttggttctcattcggctacgtcataacctgcatcttctgcaaagcactattctactcactcatcatcatcggcaccctcggcaagaaaatcaaacaataccgagaactcaaaccacaaacctgcaccatctgcgaaaccgcccccgtcaacgccatagacgccgaaatgcacgacctcaactgcagctacaacatctgcccctactgcgcctctcgactaacctccgacggcctcgcccgccacgtaccacaatgccccaaacgaaaagaaaaagtagaagaaaccgaactatacctaaacctagaacgcatcccatggatcgtccgaaaactactccaagtctccgaaagcaccggcgtagcactaaaacgatcctcatggctaatcgtccttctcgtcctactcaccgtatccctatcccccgtccaatcagcccccgtcgga

SEQ ID NO: 15614 - RNA, 972 nt, synthetic construct
  misc_feature 1..972: note = derived and/or modified CDS sequence (opt11) from CCHFV(AP92)__DQ211625.1__Gn
  source 1..972: mol_type = other RNA
tccgagggaggcgacggaggctgcatctcccgaacccaactcataaaaaccgagaccgcagaagtacacggtgacgactacggaggcccaggcgaaaaaatcaccatctgcaacggctcaaccatagtcgaccaacgcctcggctcagaactcggctgctacacaatcaatcgcatcaaatccttcaaactctgcgaaaactccgcccaaggcaaaaactgcgaaatagactccgcacccgtccaatgccgccaagggtactgcctaaaaatctcccaagaaggccgaggccacgtaaaactctcccgcggctccgaaatcgtactcgacgtatgcgacacaagctgcgaaatcatgatccccaaaggcaccggcgacatcctagtagactgctccggcggccaacagcactttctacaaagcaacctagtcgacctcgggtgcccaaacatcccgctactaggcaaaatggcaatctacatctgccgcatgtccaaccacccaaaaaccaccatggccttcctcttctggttcagcttcggctacgtcatcacctgcatcctctgcaaaaccctcttctacatcctaatcataatcggcaccctcggcaaaaaactcaaacaataccgcgaactcaaaccccaaacctgcaccatctgcgaatccgtccccgtaaacgccatcgacgccgaaatgcacgacctcaactgcagctacaacatttgcccctactgcgcatcccgactcacctccgaaggcctcacccgacacgtcaaccaatgcccaaaacgaaaagaaaaagtcgaagaaacagaactctacctcaacctagaaagaataccctggatcgtacgaaaactactccaagtctccgaatcaaccggagtagcactcaaacgctcctcatggatgatcgtcctcctaatactcctgatagtctcaatgtcccccgtccaatccgcccccatatcc

SEQ ID NO: 15615 - RNA, 972 nt, synthetic construct
  misc_feature 1..972: note = derived and/or modified CDS sequence (opt11) from CCHFV(ArD8194)__DQ211626.1__Gn
  source 1..972: mol_type = other RNA
gccgaaggaggctccaacgactgcgtatcccgtacccaactcgtaaaaacagaagtcgcagaaatccacgaagactcctacggcgggcccggcgagaaaatcacaatctgcaacggatccactatcgtcgaccaacgcctaggctcagaactaggctgctacaccatcaaccgcgtccgaacctacaaactatgcgaaaacagcgccaccgaaaaatcctgcgaaatcgactccgtccccgtaaaatgcaaacaaggcttctgcctaaaaatcacccaagaaggccgcggccacgtaaaactaagcagaggcacagaaatcgtcctcgacgtctgcgacacttcctgcgaactcatgatcccaaaaggcaccggagacatcctagtcgactgcagcggcggccaacaacacttcctccaagacaacctgattgacctcggctgccccaacatccccctcctaggacgaacagcaatatacgtctgccgcatgtccaaccacccaaaaacaaccatggccttcctcttctggttctccttcggctacgtcataacctgcgtcgtctgcaaagtcctattctacctcctaatcgtcatcggcacccttggaaaacgcctcaaacaataccgtgaactaaaaccacaaacctgcatcgtctgcgaatccatccccgtcaacgccatcgacgccgaaatgcacgacctaaactgcaactacaacatatgcccctactgcgcctcacgcctcacctcagacggccttgtacgccatgtcacccaatgccccaagcgcaaagaaaaagtcgaagaaaccgaattgtacctcaacctagaacgcatcccctggctcgtccgcaaactcctccaagtctctgaatcaacaggcgtcgctctcaaacgctcatgctggatgatcacactactcatactcctcacagtctccatgagccccgtccaatccgctcccgtcggc

SEQ ID NO: 15616 - RNA, 972 nt, synthetic construct
  misc_feature 1..972: note = derived and/or modified CDS sequence (opt11) from CCHFV(ArD15786)__DQ211627.1__Gn
  source 1..972: mol_type = other RNA
gccgaaggcggctcaaacgactgcgtatcccgaacccagctcgtcaaaacagaagtcaccgaaatacacgaagactcctacggcggccccggcgagaaaattacaatctgcaacggctccacaatcgtcgaccaacgcctcggctccgaactaggatgctacacaatcaaccgcgtacgaacatacaaactctgcgaaaactccgcaaccgaaaaatcatgcgaaatcgacagcgtacccgtcaaatgcaaacaaggcttctgcctaaaaatcacacaagaaggccgaggccacgtcaaactatcacgaggcacagaaatcgtcctcgacgtctgcgacacatcatgcgaactcatgatccccaaaggaaccggcgacatcctagtggactgcagcggaggccaacaacacttcctccaggacaacctaatagacctaggctgcccaaacatcccactcctcggacaaaccgccatctacgtctgccgcatgtccaaccaccccaaaaccacgatggccttcctcttctggttctccttcggctacgtcatcacatgcgtcgtctgcaaagtcctattctacctcctaatcgtcatcggcacactcggaaaacgcctaaaacaataccgcgaactcaaaccccaaacctgtatcgtatgcgaatccatccccgtcaacgccatcgacgccgagatgcacgacctcaactgcaactacaacatctgcccatactgcgcctcccgcctaacctcagacggcctcgtccgccacgtcacacaatgccccaaacgaaaggaaaaagtcgaagaaaccgaactctacctaaacctcgaacgaatcccctggctagtacgcaagctcctccaagtctcagaatccaccggcgtcgccctcaaacgcagctgctggattatcaccctcctcatactcctaaccgtaagcatgtcccccgtccaatccgcacccgtaggc

SEQ ID NO: 15617 - RNA, 972 nt, synthetic construct
  misc_feature 1..972: note = derived and/or modified CDS sequence (opt11) from CCHFV(ArD39554)__DQ211628.1__Gn
  source 1..972: mol_type = other RNA
tcagaaagcaataacaacgactgcgtctcacgcacccaactcatcaaaactgaaaacgccgaaatccacggcgacgactacggcggccccggcgaaaagatcaccatatgcaacggctccactatcgtcgaacaaagactaggctctgaactcggatgctacaccatcaaccgcatcaaatccttcaaactctgcgaaaactccgcctccggcaaaggctgcgaaatcgactcaacaccagttaaatgcaaacaaggattctgcctcaaaatcacccaagaaggccgcggccacgtcaaactatcgcgcggctccgaaatcattctcgacgtatgcgactcctcctgcgaaatgatgatcccaaaaggctccggcgacatactcgtagactgcagcggcggccaacaacacttcctacaagacaacctagtagacctcggatgccccaacgtcccactcctcggaaaaatggcaatctacatctgccgtatgtccaaccacccaaaaaccaccatggccttcctattctggttctcattcggatacgtaataacctgtatcttctgcaaagtaatcttctacgtcctcatcatcatcggcaccctcggcaaacgcataaaacaataccgcgaactcaaaccacaaacctgcacaatatgcgaagcaacacccgtaaacgccatcgacgccgaaatgcacgacctaaactgctcctacaacatatgcccctactgcgcttcccgactcacctccgaaggcctcgtccgccacgtaacccaatgccccaaacgcaaagagaaaatcgaagaaaccgaactctaccttaacctagaacgcataccctggttcgtccgaaaactcctccaagtctcagaatccaccggagtcgccctaaaacgctcctcctggctcgtcaccctcctcgtcctcctaaccgtctccctctcacccgtccaatcagcccccatcggc

SEQ ID NO: 15618 - RNA, 972 nt, synthetic construct
  misc_feature 1..972: note = derived and/or modified CDS sequence (opt11) from CCHFV(Drosdov)__DQ211630.1__Gn
  source 1..972: mol_type = other RNA
tctgaagaacccggcgacgactgcatctcacgcacccaactcctcaagacagaaaccgccgaaatccacgacgacaactacggcggccccggcgacaaaataaccatctgcaacggctctaccatcgtcgaccaacgtctcggctcagaacttggctgctacacaatcaaccgcgtcaaatcatttaaactctgcgaaaactccgccacaggcaaaacctgcgaaatcgacagcacccccgtcaaatgccgccaaggcttctgtctcaaaataacccaagaaggccgcggacacgtcaaactatcccgaggctccgaagtcgtcctagacgcatgcgactcatcatgcgaagtcatgatcccaaaaggaaccggcgacatcctagtcgactgcagcggcggccaacaacacttcctcaaagacaacctaatcgacctaggctgcccacatatcccgctcctcggcaagatggcaatctacatctgccgaatgtccaaccacccccgaacaaccatggcattcctcttctggttctccttcggctacgtcataacctgcatcttctgcaaagccctcttctactccctaatcataataggcacactaggaaagaaaatcaaacaataccgcgaactcaaacctcaaacatgcaccatctgcgaaaccgccccagtcaacgccatagacgcagaaatgcacgacctcaaatgctcctacaacatctgcccatactgcgccagccgcctcacatcagacggcctagcccgccacgtcacccaatgccccaaacgcaaagaaaaagtcgaagaaaccgagctctacctaaacctcgaacgcatcccctggatcgtccgaaaactcctccaagtctccgaatccaccggcgtcgccctcaaaagatcctcatggcttatagtcctcctcgtactccttaccgtctccctctcccccgtccaatccgcccccgtaggc

SEQ ID NO: 15619 - RNA, 972 nt, synthetic construct
  misc_feature 1..972: note = derived and/or modified CDS sequence (opt11) from CCHFV(Oman)__DQ211632.1__Gn
  source 1..972: mol_type = other RNA
tccgaagaaagcggcgaagactgcatctcccgaacccaactactccgcaccgaaacagccgaaatccacggcgacaactacggcggtccaggcgacaaaatcaccatctgcaacggctccaccatcgtcgaccaacgcctcggctcagaactgggctgctacacaatcaaccgtgtcaagtcatttaaactatgcgaaaactccgccaccggaaaatcctgcgaaatcgacaacaccccagtcaaatgcaagcaaggattctgcctcaaaatcacccaagaaggccgtggccacgtcaaactctcccgagactcagaagtcgtcctagacgcctgcgactcctcctgcgaaatcatgatcccaaaaggaaccggcgacatcctcgtagactgctccggcggccaacaacacttcctcaaagacaacctcatcgacctaggatgccccaatatacccctcctcggcaaaatggccatctacatatgccgaatgtccaaccaccccaaaaccacaatggcattcctattctggttctccttcggctacgtcataacctgcatcctttgcaaagtaatattctacctcctcatcgtcgtcggcaccctaggcaagaaattcaaacaatacagagaactaaaaccccaaacctgcaccatctgcgaaaccacccccgtcaacgccatcgacgcggaaatgcacgacctaaactgctcatacaacatctgcccctactgcgcctcccgcctaacctccgacggccttgcccgccacgtcatgcaatgccccaaacgcaaagagaaaatcgaagaaaccgaactctacctcaacctcgaacgcattccctgggtcgtacgaaaactcctacaagtctccgaatccaccggcgtcgccctcaaacgctcctcctggctaatagtactcctagtcctactaaccgtctccctctcccccgtccaatcagccccaatcggt

SEQ ID NO: 15620 - RNA, 972 nt, synthetic construct
  misc_feature 1..972: note = derived and/or modified CDS sequence (opt11) from CCHFV(SPU97/85)__DQ211633.1__Gn
  source 1..972: mol_type = other RNA
tcagaagaaagcgacggcgactgcatcagccgaacccaactactccgcaccgaaaccgccgaaatacactccgacaactacggcggccccggcgacaaaatcaccatctgcaacggctcaacaatcgtcgaccaacgcctcggctccgaactcggctgctacaccatcaaccgcgtcaaatccttcaaactatgcgaaaactccgccacaggaaaatcctgcgaaatcgactcaacccccgtcaaatgccgccaaggcttctgcctaaaaataacccaagaaggccgcggccacgtcaaactatcccgaggctcagaaatagtcctcgacgcctgcgactcctcctgcgaaatcatgatccccaaaggcacgggagacatcctcgtcgactgctccggaggacaacaacacttcctcaaagacaacctcatagacctcggctgccccaacatccccctcctcggacgaatggccatctacatctgccgcatgtccaaccaccccaaaactaccatggccttcctattctggttctcattcggctacgtcataacctgcatcctctgcaaagtcatcttctacctcctcattgtagcaggcaccgtcggcaaaaaattcaaacaataccgtgaactacgaccacaaacctgcaccatatgcgaaaccacacccgtcaacgcaatcgacgccgaaatgcacgacctcaactgctcatacaacatctgcccctactgcgccagccgcctaacctccgatggcctagcccgccacgtcatgcaatgccccaaacgaaaagaaaaaatcgaagaaacagaactctacctaaacctcgaacgcatcccatgggtagtccgtaaactactccaagtctcagaatcaaccggcgtcgcactcaaacgcagctcctggctcaccgtcctcctcgtcctcctaatcgtctcactgtcccccgtccaatccgcacccatcgga

SEQ ID NO: 15621 - RNA, 972 nt, synthetic construct
  misc_feature 1..972: note = derived and/or modified CDS sequence (opt11) from CCHFV(SPU103/87)__DQ211634.1__Gn
  source 1..972: mol_type = other RNA
tcagaagaatcctcagacgactgcatatcccgcacacaactcctccgaaccgaaaccgccgaaatccacggcgacaattacggcggcccaggagacaaaatcacaatctgcaacggctccaccatcgtcgaccaacgactgggctccgaactcggatgctacacaatcaacagagtcaaaaccttcaaactctgcgaaaactcagccaccggcaaatcatgcgaaatcgactccgtcccagtcaaatgccgccaaggatactgcctcaagatcacccaagaaggccgaggccacgtaaaactatcccgaggctccgaagtcgtacttgacgcatgcgacacctcatgcgaagtcatgatacccaagggcaccggcgacatcctcgtcgactgttcaggcggccaacaacacttcctcaaagacaacctcatcgacctcggatgccctaaaatacccctcctcggaaaaatggcaatctacatctgccgcatgagcaaccaccccaaaaccactatggcgttcctcttctggttctccttcggctacgtcataacctgcgtcctctgcaaagccatcttctacctcctaatcatcgtcggcaccctcggcaaacgcctcaaacaataccgagaactcaaaccccaaacatgcaccatctgcgaaaccacccccgtcaacgccatcgacgccgaaatgcacgacctcaactgctcctataacatctgtccctactgcgcctcacgcctaacctcggacggcctcgcccgccacgtcacccaatgcccaaaacgcaaagaaaaagtcgaagaaaccgaactctacctaaacctcgaacgcatcccctgggtagtccgccgcctcctccaagtcagcgaatccaccggcgtcgcactcaaacgatcctcctggctcatagtcctcctcgtactcttcaccgtctccctgtcccccgtccaatccgcccccatcagc

SEQ ID NO: 15622 - RNA, 972 nt, synthetic construct
  misc_feature 1..972: note = derived and/or modified CDS sequence (opt11) from CCHFV(SPU415/85)__DQ211635.1__Gn
  source 1..972: mol_type = other RNA
tctgaagaatctgacggcgactgcatctcacgcacccaactcctgcgcaccgaaaccaccgaaatccactccgacaactacggaggcccaggcgacaaaatcaccatctgtaacggcagcacaatcgtcgaccaacgcctgggctccgaactcggctgctacacaataaaccgcgtcaaatcattcaaactctgcgaaaactccgcaaccggcaaaagctgcgaaatcgacagcacccccgtcaaatgccgccaaggcttttgcctaaaaatcacccaagaaggtcgcggccacgtaaaactctcacgcggctcagaaatcgtcctcgacgcctgcgactccaactgcgaaatcatgataccaaaaggaaccggagacatcctcgtcgactgctccggcggccaacaacacttcctcaaagacaacctcatcgacttaggctgcccaaacatccccctcctcggcaaaatggccatctacatatgccgaatgtccaaccaccccaaaaccacaatggccttcctgttctggttctccttcggctacgttatcacctgcatcctctgcaaagtcatcttctacctcctcatcgtagccggcaccgtcggaaaaaaattcaaacaataccgcgaactcagaccacaaacctgcaccatctgcgagaccatccccgtcaacgccatcgacgcagaaatgcacgacctcaactgttcctacaacatctgcccatactgcgcctcgcgactgacctcagacggactcgcccgccacgtcatgcaatgtcccaaacgcaaagaaaaagtcgaagaaaccgaactctacctaaacctagaacgcataccctgggtcgtccggaaactcctccaagtctcagaatcaaccggagtcgcactcaaacgatcctcctggctcacagtcctcctcgtcctactaatcgtctcactgtcacccgtccaatccgcccccatcggc

SEQ ID NO: 15623 - RNA, 972 nt, synthetic construct
  misc_feature 1..972: note = derived and/or modified CDS sequence (opt11) from CCHFV(Turkey200310849)__DQ211636.1__Gn
  source 1..972: mol_type = other RNA
tctgaagaacccggcgacgactgcatatcccgcacacaactcctccgcaccgaaaccgccgaaatccacgacgacaactacggaggccccggcgacaaaatcacaatctgcaacggcagcaccatcgtcgaccaacgcctaggctcagaactcggatgctacacgatcaaccgcgtaaaatccttcaaactatgcgaaaactccgccaccggcaaaacctgcgaagtcgactccacccccgtcaaatgccgccaaggattctgcctcaaaatcacccaagaaggacgcggacacgtcaaactatcccgcggctctgaagtcgtcctcgacgcctgcgactcctcctgcgaagtcatgatacccaaaggaaccggcgacatcctcgtcgactgctccggtggccaacaacacttcctcaaagacaacctcatcgacctcggctgcccccacattcccctactcggcaaaatggccatctacatctgccgcatgtcaaaccacccacgcaccaccatggccttccttttctggttctccttcggatacgtcataacctgcatctcctgcaaagcactcttctactccctcatcatcatcggcaccctcggcaagaaaatcaaacaataccgcgaactcaaacctcaaacctgtactatctgcgaaaccgccccagtcaacgcaatagacgccgaaatgcacgacctgaactgcagctacaacatctgcccctactgcgcctcccgcctcacctccgacggcctcgcccgccacgtcacacaatgccccaaacgcaaagaaaaagtcgaagaaaccgaactctacctcaacctcgaacgcatcccatggatcgtccgaaaactcctccaagtctccgaatcaaccggagtcgccctcaaacgctcctcatggctcatcgtactcctagtcctcctcaccgtatcactctcccccgtccaatcagcccccgtagga

SEQ ID NO: 15624 - RNA, 972 nt, synthetic construct
  misc_feature 1..972: note = derived and/or modified CDS sequence (opt11) from CCHFV(Kosova Hoti)__EU037902.1__Gn
  source 1..972: mol_type = other RNA
tccgaagaacccggcgacgactgcatcagccgcacccaactcctccgaaccgaaacagcagaaatccacgacgacaactacggcggccccggcgacaaaatcacaatctgcaacggctccactatcgtcgaccaacgcctaggctcagaactcggctgctacaccatcaatcgcgtcaaatcattcaaactttgcgaaaactccgccaccggcaaaacctgcgaaatcgactccacccccgtaaaatgtcgccagggcttctgcctcaaaatcacacaaaaaggccgcggacacgtcaaactttcccgaggctccgaagtcgtcctcgacgcctgcgacagcaactgcgaagtcatgatccccaaaggcaccggcgatatcctcgtcgactgctccggaggccaacaacacttcctcaaagacaacctgatcgacctcggatgcccacacatccccctactcggcaaaatggcaatctacatatgccgcatgtccaaccacccaaaaaccaccatggccttcctcttctggttctccttcggctacgtaatcacatgcatattctgcaaagccctcttctactccctcatcataatcggcaccctcggcaagaaaattaaacaataccgcgaactaaaaccccaaacctgcaccatctgcgaaaccgccccagtcaacgccatcgacgcagaaatgcacgacctaaactgctcatacaacatctgcccatactgcgcctcacgcctcacctccgacggcctcgcccgccacgtaaaacaatgccccaaacgaaaagaaaaagtcgaagaaaccgaactctacctcaacctcgaacgcatcccctgggtcgtccgcaaactactccaagtctccgaatcaaccggcgtcgccctcaaacgatcatcctggctcatagtcctcctcgtcctcctcaccgtatccctctccccagtccaaagcgccccagtcggc

SEQ ID NO: 15625 - RNA, 972 nt, synthetic construct
  misc_feature 1..972: note = derived and/or modified CDS sequence (opt11) from CCHFV(YL04057)__FJ562094.1__Gn
  source 1..972: mol_type = other RNA
gccgaaggcggttcatcagactgcatctcccgaacccaactcgtcaaaaccgaagtcgccgaaatccacgaagactcatacggcggccccggcgagaaaatcacaatatgcaacggatccaccatcgtcgaccagcgcctcggccgcgaactcggctgctacacaatcaaccgagtccgctcctacaaactctgcgaaaactctgcatccggaaaatcctgcgaaatagactccatccctgtcaaatgcaaacaaggcttctgcctaaaaatcacccaagaaggccgcggacacgtcaaactatcccgaggcaccgaaatagtcctcgacgtctgcgactcatcctgcgaactcatgatccccaaaggcacaggtgacatcctagtagactgctccggcggacaacaacacttcctccaaaacaaccttatcgacctcggatgccccaacgtccccctcctcggcaaaatggccatatatgtctgccgcatgtccaaccaccccaaaaccacaatggccttcctcttctggttctccttcggctacgtaatcacttgcatcgcctgccgcgtcctcttctacctccttatcgccataggcaccgtcggcaagaaactcaaacaataccgcgaactcaaaccccaaacctgcatagtatgcgaatccgtcccagtcaacgccatcgacgccgaaatgcacgaactcaactgctcatacaacatctgcccctactgcgcctcacgtctcagcacagacggcctcatccgccacgtcacacaatgccccaaaagacgagaaaaagtagaagaaaccgaactattcctaaacctagaacgcatcccttggctcgtacgaaaactcctccaagtctccgaatccacaggcatggccctaaaacgctcctgctggatgataaccctcctcatcctactcctcgtaagcatctccccagtccaaagcgcccccgtcggc

SEQ ID NO: 15626 - RNA, 972 nt, synthetic construct
  misc_feature 1..972: note = derived and/or modified CDS sequence (opt11) from CCHFV(V42/81)__GU477490.1__Gn
  source 1..972: mol_type = other RNA
tccaaagaacctggcgacgactgcatcagccgcactcaactcatgcgcaccgaaaccgccgaaatacacgacgacaactacggcggacccggagacaaaatcaccatctgcaacggatctaccatcgtcgaccaacgactcggctccgaactcggttgctacaccatcaatcgcgttaaatccttcaaactctgcgaaaactccgcaaccggaaaggcctgtgaagtagacagcacccccgtaaaatgccgccaaggcttctgcctaaaaatcacacaagaaggccgcggacacgtcaaactatcccgcggctccgaagttgtcctcgacgcctgcgacagctcctgcgaagtcatgatcccaaaaggcacaggcgacatcctagtcgactgcagcggaggccaacaacactttctaaaagacaacctcatcgacctcgaatgcccccacatacccttacttggcaaactcgccatctacatctgccgcatgtctaatcacccccgcactaccatggcattcctcttctggttcggcttcggctacgtcataacctgcatcctctgcaaagccctcttctactcactaatcatcataggaaccctaggcaaaaagatcaaacaataccgcgaactaaaaccacaaacatgcacaatctgcgaaaccgcccccgtcaacgccatagacgccgaaatgcacgacctcaactgctcatacaatatctgcccctactgcgcctcgagactcacctccgacggactcgcccgacacgtaacccaatgccccaaacgcaaagaaaaagtcgaagaaaccgaactatacctaaacctcgaacgaatcccatggatagtccgcaaactccttcaagtatccgaatccaccggcgtcgtactcaaacgctcctcttggctcatcgtcctcctcgtcctcctcacagtctccctctcccccgtccaatccgcccccgtaggc

SEQ ID NO: 15627 - RNA, 972 nt, synthetic construct
  misc_feature 1..972: note = derived and/or modified CDS sequence (opt11) from CCHFV(Afg09-2990)__HM452306.1__Gn
  source 1..972: mol_type = other RNA
tcagaagaatccggcgacgactgcatctccagaacacaactcctacgaacagaaaccgcagaagtccacggagacaactacggcggccccggcgacaaaatcaccatttgcaacggcagcaccgtcgtcgaccaacgccttggctcagaactcggatgctacaccatcaaccgcgtccgcagcttcaaactctgcgaaaactcagccaccggcaaatcctgcgaaatcgactccattcccgtcaaatgcaaacaaggctactgcctcaaaatcacccaagaaggccgcggccacgtcaaactatcacgcggctcagaggtagtcctcgacgtctgcgactcctcctgcgaagtaatgatccccaaaggaaccggcgacatcctcgtcgactgctcaggcggccaacagcactacctcaaagacaacctcgtcgacctaggatgccccaaaatacccctcctcggcaaaatggctatctacatctgccgaatgtcaaaccaccccaaaaccaccatggccttcctcttctggttctcattcggatacgtaataacctgcatcctatgcaaagctatattcttcctcctaatcatcttcggcacactaggcaagagattcaagcagtaccgcgaactcaaaccacaaacctgcaccatctgcgaaaccaccccagtcaacgccatcgacgcagaaatgcacgacctcaactgctcctacaacatatgtccctactgcgcctccagactaacctccgacggcctcgcccgacacgtcacccaatgccccagacgcaaagaaaaagtcgaagaaacagaactctacctcaacctcgaacgcataccctgggtagtacgcaaactcctacaagtctccgaatccaccggcaccgtcctaaaacgctcatcctggctaatagtcctactcgtcctcttcactgtcagcctctcacccgtccaatccgcacccataggc

SEQ ID NO: 15628 - RNA, 972 nt, synthetic construct
  misc_feature 1..972: note = derived and/or modified CDS sequence (opt11) from CCHFV(Sudan Al-Fulah 3-2008)__HQ378184.1__Gn
  source 1..972: mol_type = other RNA
tccgaagaaccctccgacgactgcatctcccgaacccaactactccgaaccgaaacagccgaaatacacggcgacaactacggcggccccggagacaaaatcaccatctgcaacggcagcacaatcgtagaccagcgcctcggatccgaactcggctgctacaccatcaaccgcgtcaaatccttcaaactctgcgaaaactccgccaccggaaaatcatgcgtcatcgactccgtccccgtcaaatgccgccaaggctactgcctacgaatcacccaagaaggacgcggacacgtcaaactctcccgaggctcagaagtagtcctagacgcatgcgacacctcctgcgaaatcatgatccctaaaggcaccggcgacatactcgtcgactgctccggcggacaacaacacttcctaaaagacaatctcgtcgacctcggctgccccaaaatccccctcctcggaaaaatggccatctacatctgccgcatgtccaaccaccccaaaacaacaatggccttcctcttctggttctcattcggctacgtcataacctgcatcctatgcaaagccatcttctacctcctcatcataatcggcaccctcggtaaaagattcagacaataccgagaactcaaaccccagacctgcaccatctgcgaaaccactcccgtcaacgccatagacgccgagatgcacgacctcaactgctcctacaacatctgcccatactgcgcctcccgcctcacctcagacggcctagcccgccacgtcacacaatgccccaaacgcaaggaaaaagtcgaagaaaccgaactatacctaaacctcgaacgcatcccatgggtcgtacgcaaactactacaagtctccgaaagcaccggagtcgccctaaaacgctcctcctggctcatcgtcctcctagtcctcttcacagtctcactttccccagtacaatccgcccccatcgga

SEQ ID NO: 15629 - RNA, 972 nt, synthetic construct
  misc_feature 1..972: note = derived and/or modified CDS sequence (opt11) from CCHFV(Sudan AB1-2009)__HQ378187.1__Gn
  source 1..972: mol_type = other RNA
tccgaagaaccctcagacgactgcatctcccgcactcaactcctacgcaccgaaaccgccgaaatccacggcgacaactacggaggacccggcgacaaaataaccatctgtaacggatccacaatcgtcgaccaacgcctcggctccgaactcggctgctacaccatcaaccgagtcaagagcttcaaactctgcgaaaactccgccaccggcaaaaactgtgaaatcgactccgtcccagtcaaatgccgccaaggctactgcctccgaatcacacaagaaggccgaggccatgtcaaattaagtcgcggatccgaagtagtcctcgacgcatgcgacacctcttgcgaaatcatgatccccaaaggcaccggcgacatcctcgtagactgctccggcggccaacaacacttcctcaaagacaacctcatcgacctcggctgccccaaaatccccctcctaggcaaaatggccatctacatctgccgaatgtccaaccaccccaaaaccactatggcattcctcttctggttctccttcggctacctcataacctgcatcctatgcaaagccatcttttacctactcatcatcatcggcaccctcggcaaaagactcaaacaataccgagaactaaaaccccaaacatgcaccatctgcgagacaacccccgtcaacgccatcgatgccgaaatgcacgacctcaactgctcatacaacatctgcccctactgcgcctcacgcctcacatccgacggactagcccgccacgtcatccaatgccccaaacgcaaagaaaaagtcgaagaaaccgaactttacctcaacctcgaacgaataccctgggtagtccgcaaactactccaagtatccgaatccaccggagtcgcactcaaacgctcctcctggctcatcgtcctacttgttctcttcaccgtctccctctccccagtccaatcagcccccataggc

SEQ ID NO: 15630 - RNA, 972 nt, synthetic construct
  misc_feature 1..972: note = derived and/or modified CDS sequence (opt11) from CCHFV(NIVA 118595)__JN572083.1__Gn
  source 1..972: mol_type = other RNA
tccgaagaatccggcgacgactgcatctcccgaacccaactcctccgaacagaaaccgccgaagtccacggcgacaactacggcggccccggcgacaaaatcaccatctgcaacggctccaccgtcgtcgaccaacgcctcggatcagaactcggctgctacaccatcaaccgcgtcaaatccttcaaactctgcgaaaactccgcaaccggaaaatcctgcgaaatcgactcaatccccgtaaaatgccgacaaggctactgcctcaaaataacacaagaaggacgaggccacgtcaaattatcccgcggctccgaggtcgtcctcgatgcctgcgacagcagctgcgaagtcatgatccccaaaggcaccggcgacatcctagtcgactgctcaggcggacaacaacacttccttaaagacaacctcatagacctcggctgccccaaaatacccctcctaggcaaaatggccatatacatatgccgcatgtccaaccaccccaaaactaccatggccttcctcttctggttctccttcggctacgtaattacctgcatcctctgcaaagtcatcttctacctcctcatcatcttcggcaccctcggcaaaagattcaaacagtaccgcgaactaaaaccccaaacctgcaccatctgcgaaaccacgccagtcaacgccatcgacgccgaaatgcacgacctaaactgctcctacaacatctgcccctactgcgcctcacgcctaacaagcgacggccttgcccgccacgtaacacaatgccccaaacgcaaagaaaaggtcgaagaaaccgaactctacctcaacctcgaacgcatcccctgggtcgtacgcaaactactccaagtctccgaatcaaccggcatcgcccttaaacgatcctcctggctcatcgtcctcctcgtcctcttcaccgtaagcatcacccccgtccaatccgcacccatcggc

SEQ ID NO: 15631 - RNA, 972 nt, synthetic construct
  misc_feature 1..972: note = derived and/or modified CDS sequence (opt11) from CCHFV(SCT ex Afghanistan)__KC344856.1__Gn
  source 1..972: mol_type = other RNA
agtgaagaatccggcgacgactgcataagtcgcacccaactcctaagaaccgaaaccgcagaggtccacaacgacaactacggcggccccggcgacaaaatcaccatttgcaacggctccaccatcgtcgaccaacgcctcggatctgaactcggctgctacaccataaaccgagtcaaatccttcaaactatgcgaaaactccgcaaccggcaaaagctgcaaaatcgactccacgcccgtcaaatgccgccaaggcttctgcctcaaaatcacccaagaaggccgcggccatgtcaagctctcaaggggctccgaagtcgtcctcgacgcatgcgactcatcctgcgaaatcatgatccccaaaggcaccggcgacatcctcgtcgactgcagcggcggccaacaacacttcctcaaagacaacctcatcgacctcggatgcccaaacatccccttactaggcaaaatggccatctacatctgccgcatgtccaaccaccccaaaacaaccatggccttcctattctggttctccttcggatacgtcattacatgcatcttctgcaaagtaatcttctacctcctaatcgtcgtaggcacactcggcaagaaattcaaacaataccgagaactcaaaccccaaacctgcactatatgcgaaacaaccccaaccaacgccatcgacgccgaaatgcacgacctcaactgctcatacaacatttgcccctactgcgcctcccgcctcaccagcgacggcctcgcccgacacgtcacccaatgccccaaacgcaaagaaaaagtagaagaaacagagctctacctcaacctagaacgcatcccctggatcgtccgcaaactcctccaagtctcagaatccacaggcgtcgccctcaaacgctcatcctggctcatcgtcctcctcgtactcctcaccgtctccctatcacccgtacaatctgcccccatagga

SEQ ID NO: 15632 - RNA, 972 nt, synthetic construct
  misc_feature 1..972: note = derived and/or modified CDS sequence (opt11) from CCHFV(Zahedan 2007)__KC867273.1__Gn
  source 1..972: mol_type = other RNA
tccgaagagtcgggcgacgactgcatctcacgtacccaactcctccgcaccgaaaccgccgaagtacacggagacaactacggaggccccggcgacaaaatcacaatctgcaacggctccaccgtagtagaccaacgcctcggctctgagctcggctgctacaccatcaaccgagtccgctcattcaaactatgcgaaaactccgcaacaggcaaatcatgcgaaatcgactccatccccgtaaaatgcaaacaaggcttctgcctaaaaatcacccaagaaggccgcggccacgtcaaactctcccgcggctccgaagtcgtcctcgacgtctgcgactcctcctgcgaagtcatgatccccaagggcaccggcgacatcctcgtcgactgcagcggcggccaacaacacttcctcaaagacaacctcgtcgacctaggatgccccaaaatccccctcctaggcaaaatggccatctacatctgccgaatgagcaaccaccccaaaaccaccatggcattcctcttttggttcagcttcggctacgtcataacctgcatcctctgcaaagccatcttcttcctcctcatcatcttcggaacccttggaaaacgcttcaaacaataccgagaactaaaaccacaaacctgtacaatatgcgaaacgacccccgtaaacgccatcgacgccgaaatgcacgacctcaactgctcctataacatatgcccctactgcgcctcccgactcacatccgacggcctcgcccgccacgttacccaatgcccaagacgtaaagaaaaagtcgaagaaacagaactctacctcaacctcgaaagaatcccctgggtagtccgcaaactcctacaagtaagcgaatccacaggcaccgtcctcaaacgctcatcctggctcatcgtactactcgtactattcacagtctccctctcccccgtccaatcagcccccataggc

SEQ ID NO: 15633 - RNA, 972 nt, synthetic construct
  misc_feature 1..972: note = derived and/or modified CDS sequence (opt11) from CCHFV(SPU 44/08)__KJ682805.1__Gn
  source 1..972: mol_type = other RNA
tctgaagaatccaacgacgactgcctatcacgcacccaactcctccgcactgaaaacgccgaaatccactccgataactacggcggccccggtgataaaatcaccatctgtaacggctccaccatcgtcgaccaacgcctcggctcagaactcggctgctacaccatcaaccgtgtcaaatccttcaaactctgcgaaaactccgcaaccggcaaatcttgcgaaatcgactcaacccccgtacgatgccgacaaggcttctgccttaaaataacccaagaaggacgcggccacgtaaaactctcacgcggctcagaagtcgtcctcgacgcatgcgactcctcatgcgagatcatgatccccaaaggaacaggagacatcctcgtcgactgctccggcggccaacaacacttcctcaaagacaacctcgtcgacctcggatgccctaacataccactcctcggaaaaatggccatctacatctgccgcatgtccaaccatcccaaaaccacaatggcattcctcttctggttttcctttggatacgtaataacctgcatcctatgcaaagccatcttctacctccttatcgtagtcggcaccctcggcaagaaattcaaacaataccgagaactcaaaccccaaacctgcaccatatgcgaaaccaaccccgttaacgccatcgacgccgaaatgcacgacctcaactgctcctacaacatctgcccctactgcgcctcccgcctcacctcagacggcctcgcccgccacgtcatgcaatgccccaaacgcaaagagaaaatcgaagaaaccgaactctacctaaacctcgaacgaatcccatgggtcgtccggaaactactccaagtctctgaatcaaccggcgtcgccctaaaacgatcatcctggctcgtaatacttctcgtactcctcaccgtctccctatcccccgtccaatccgcccccatcagc

SEQ ID NO: 15634 - RNA, 972 nt, synthetic construct
  misc_feature 1..972: note = derived and/or modified CDS sequence (opt11) from CCHFV(SPU 383/87)__KJ682806.1__Gn
  source 1..972: mol_type = other RNA
tccgaagaatcaaacgacgactgcctatcccgaacacaactcctccgcaccgaaaacgccgaaatccacagcgacaactacggcggacccggcgacaaaatcacaatctgcaacggctccaccatcgtagaccaacgcctaggctccgaactcggctgctacaccatcaaccgcgtaaaatccttcaaactctgcgaaaactcagccacaggcaaatcgtgcgaaatcgactccactcccgtccgctgccgtcaaggattctgcctcaaaatcacccaagaaggccgcggacacgtaaaactctcacgcggctccgaagtcgtcctcgacgcctgcgactcatcctgcgaaatcatgatccccaaaggcacaggcgacatccttgtcgactgctcaggcggacaacaacacttccttaaagacaaccttgtcgacctcggctgcccaaacatcccccttctcggcaaaatggccatctacatctgccgcatgtccaaccaccccaaaacaacaatggcattcctcttctggttctctttcggatacgtaataacctgcatcctctgcaaagtaatcttctacctcctcgtcgtcgtcggcaccctcggcaagaaattcaaacaataccgcgaactcaaaccacaaacctgcaccatatgcgagaccaaccccgtcaacgcaatcgacgccgaaatgcacgacctaaactgcagctacaacatctgcccctactgcgcctcccgcctcacctccgacggcctagcacgccacgtaatccaatgccccaaacgcaaagagaaaatcgaagaaaccgaattatacctaaacctagaacgaatcccttgggtcgtccgcaaactcctccaagtctccgaatcaacaggcgtcgccctcaaacgctccagctggctcgtcatcctcctagtactactcaccgtcagcctctcccccgtccagtccgctcccatctca

SEQ ID NO: 15635 - RNA, 972 nt, synthetic construct
  misc_feature 1..972: note = derived and/or modified CDS sequence (opt11) from CCHFV(SPU 130/89)__KJ682807.1__Gn
  source 1..972: mol_type = other RNA
tccgaagaacccaactacgactgcctctcccgcacccaactcctgcgcacagaaaacgccgaaatccactcagacaactacggcggccccggcgacaaaatcaccatctgcaacggatccaccatcgtcgaccaacgactcggctccgaactcggctgctacaccataaaccgcgtcaaatccttcaaactctgcgaaaactccgccaccggcaaatcctgcgaaatcgactcaacgcccgtacgctgccgacaaggcttctgcctcaaaatcacccaagaaggccgcggccacgtcaaactctccagaggctccgaagtcgtcctcgacgcatgcgactcttcctgcgaaatcatgatccccaaaggcaccggcgacatcctcgtcgactgctccggcggccaacaacacttcctaaaggacaacctagtcgacctaggctgccccaacatacccctcctgggcaaaatggcaatctacatatgccgaatgtccaaccaccccaaaaccaccatggcattcctattctggttctcattcggctacgtcataacctgcatcctatgcaaagtcatcttctacctactcatcgtagtcggcacactcggcaagaaattcaaacagtacagagaactcaaaccccaaacctgcaccatctgcgaaaccaaccccgtcaacgccatcgacgccgaaatgcacgacctaaactgctcctacaacatctgcccctactgcgcctcccgccttacctccgacggcctcgcacgccacgtcatgcaatgccccaaacgcaaagagaaaatcgaagaaaccgaactctacctcaacctcgaacgcatcccctgggtcgtccgcaaactcctccaagtttccgaatctacaggcgtcgccctaaaacgctcctcctggctcgttgtcctcctcgtcctcctcaccgtctccctctcccccgtccaatcagcccccatctcc

SEQ ID NO: 15636 - RNA, 972 nt, synthetic construct
  misc_feature 1..972: note = derived and/or modified CDS sequence (opt11) from CCHFV(SPU 497/88)__KJ682808.1__Gn
  source 1..972: mol_type = other RNA
tccgaagaatccaacgacgactgcctcagccgaacccaactccttcgaaccgaaaacgccgaaatccacagcgacaactacggcggccccggagacaaaatcaccatctgcaacggaagcaccatagtcgaccaacgccttggatcagaactcggctgctacaccatcaaccgcgtaaaatcattcaaactctgcgaaaactccgccaccggcaaatcctgcgaaatcgacagcacccccgtacgctgccgacaaggcttctgcctaaaaatcacccaagaaggaaaaggccacgtcaaactctcccgcggatccgaagtcgtccttgacgcatgcgactcctcctgcgaaatcatgatccccaaaggaaccggcgacatcctcgtcgactgctccggcggccaacaacacttcctcaaagacaacctcgtcgacctcggatgccccaacatcccactcctcggcaaaatggccatatacatctgccggatgtccaaccatcccaaaacaaccatggtattcctcttctggttctcattcggctacgtcatcacatgcatcctctgcaaagtcatcttctacctcctcatagtcgtaggcaccctcggcaagaaattcaaacaataccgcgaactcaaaccacaaacctgtaccatatgcgaaacaaaccccgtcaacgccatcgacgccgaaatgcacgacctcaactgctcctataacatatgcccctactgtgcctcacgactaacctcggacggcctcgcccgccacgtcatgcaatgccccaaacgcaaagagaaaatcgaagaaaccgaactctacctcaacctcgaacgaatcccctgggtcgtccgcaaactcctacaggtctccgaatccaccggcgtcgccctcaaacgatcctcctggctagtgatactcctagtcctcctcaccgtctccctctcccctgtacaatccgcccccataagc

SEQ ID NO: 15637 - RNA, 972 nt, synthetic construct
  misc_feature 1..972: note = derived and/or modified CDS sequence (opt11) from CCHFV(SPU 18/88)__KJ682810.1__Gn
  source 1..972: mol_type = other RNA
tcagaagaaagcaacgacgactgcctaagccgcacccaactactccgaacagaaaacgccgaaatccactccgacaactacggcggtccaggagacaaaatcacaatctgcaacggcagcacaatcgtagaccaacgcctgggctcagaactaggctgctacacaatcaaccgcgtcaaatccttcaaactctgcgaaaactccgccacaggaaaatcctgcgaaatcgactcaacacccgtccgatgccgccaaggcttctgcctcaaaataacccaagaaggtcgcggccacgtcaaactctcccgaggctccgaagtcgtcctcgacgcttgcgacagctcctgcgaaatcatgatccccaaaggaaccggagacatcctcgtagactgctccggcggccaacaacacttcctcaaagacaaccttgtcgacctcgggtgccccaacatccccctcctcggcaaaatggccatctacatatgccgtatgtccaaccaccccaaaaccacaatgggattcctattctggttctccttcggctacgtcattacctgcatcctctgcaaagtcatcttctacctactaatcgtcgtaggcaccctcggcaagaaattcaaacaataccgcgaactaaaaccccaaacctgcaccatctgcgaaaccaaccctgtcaacgccatcgacgccgaaatgcacgacctaaactgcagctataacatctgcccatactgcgcctcccgcctcacctccgacggactcgcccgccacgtcatgcaatgcccaaaacgcaaagaaaagatagaagaaaccgaactctacctaaacctagaacgaatcccatgggtcgtaagaaaactactacaagtctcagaatccacaggcgtcgccctcaaacgatcttcatggctagtaatcctcctagtcctactaaccgtgtccctatcaccagtccaatccgccccaatcagc

SEQ ID NO: 15638 - RNA, 972 nt, synthetic construct
  misc_feature 1..972: note = derived and/or modified CDS sequence (opt11) from CCHFV(SPU 48/90)__KJ682813.1__Gn
  source 1..972: mol_type = other RNA
tcagaagaacccagcgacgactgcatctcccgcacccaactcctccgcaccgagaccgccgaaatccacggcgacaactacggcggacccggcgacaaaatcaccatatgcaacggctcaacaatagtcgaccagcgcctcggctcagaactaggctgctacaccatcaaccgcgtcaaatccttcaaactctgcgaaaactccgccaccggcaaatcctgcgtcatagactcagtccccgttaaatgccgtcaaggctactgccttcgcattacccaagaaggccgcggacacgtcaaactctcccgcggctccgaagtcgtactcgacgcctgcgacacctcatgcgaaataatgatccccaaaggcacaggagacatcctcgtagattgctccggcggacaacaacacttcctcaaagacaacctcatcgacctcggctgcccaaaaatacccctcctcggcaaaatggccatctacatctgccgtatgtccaaccatcccaccaccaccatggcattcctcttctggttctccttcggctacgtaataacctgcatcctctgcaaagcaatcttctacctactcatcatcatcggcacactcggcaaacgcttcagacaataccgagaactcaaaccccaaacatgcaccatctgcgaaaccacaccagtcaacgccatcgacgccgaaatgcacgacctcaactgctcctacaacatctgcccatactgcgcctcccgcctcacctcagacggcctcgcccgacacgtcacacaatgccccaaacgcaaagaaaaagtcgaagaaaccgagctatacctcaacctcgaacgcatcccctgggtcgtccgcaaattactccaagtctccgaatcaacaggcgtagcccttaaacgttcttcatggctcatcgtgctcctcgtcctcttcaccgtctccctctcccccgtccaatcagcacccataggc

SEQ ID NO: 15639 - RNA, 972 nt, synthetic construct
  misc_feature 1..972: note = derived and/or modified CDS sequence (opt11) from CCHFV(SPU 187/90)__KJ682814.1__Gn
  source 1..972: mol_type = other RNA
tccgaggaaccctctgacgactgcatctcccgcacccaactcttacgcaccgaaaccgccgaaatccacggcgacaactacggcggccccggcgataaaataaccatctgcaacggatccaccatcgtcgaccaacgcctcggctccgaactcggctgctacacaatcaatcgcgtaaaatccttcaaactctgcgaaaacagcgccacgggcaaatcctgcgaaatcgactccgtccccgtcaaatgccgccaaggatactgcctccgcataacccaagaaggccgcggccatgtaaaactctcccgcggctctgaagtcgtcctcgacgcctgcgacacctcatgcgaaatcatgatcccaaaaggcaccggagacatcctcgtcgactgcagcggaggccaacaacacttcctcaaagacaacctaatcgacctcggctgccccaaaatccccctcctaggcaaaatggccatctacatctgccggatgtccaaccaccccaaaaccaccatggcattcctgttctggttttccttcggctacgtcataacctgcatcctatgcaaagcaatcttctacctcctcatcatcatcggcaccctagggaaaagattcaaacaataccgcgaactcaaaccacaaacctgcaccatctgcgaaaccacccccgtaaacgccatcgacgccgaaatgcacgacctcaactgctcatacaacatctgcccatactgcgcctcccgactcacctccgacggcctcgcccgccacgtcacccaatgccccaaacgcaaagaaaaagtcgaagaaaccgaactatacctaaacctcgaacgcatcccttgggtcgtccgcaaactcctacaagtctcagaatccaccggtgtcgccctcaaacgatcttcctggctcatcgtcctcctcgtcctattcaccgtctccctctccccagttcaatccgcaccaatcggc

SEQ ID NO: 15640 - RNA, 972 nt, synthetic construct
  misc_feature 1..972: note = derived and/or modified CDS sequence (opt11) from CCHFV(Haskovo-V46/13)__KR092379.1__Gn
  source 1..972: mol_type = other RNA
tcagaagaacttggcgacgactgcatcagccgcacccaactcctacgcaccgaaaccgccgaaatccacgacgacaactacggcggcccaggcgacaaaatcaccatatgcaacggctccaccatcgtcgaccaacgactcggttccgaactaggatgctacacgatcaaccgcggaaaatcgttcaaactctgcgaaaactccgccacaggtaaaacctgcgaaatcgactccacccccgtcaaatgccgacaaggattctgcctaaaaataacccaagaaggccgtggccacgtcaaactctcccgcggcagcgaagtcgtcctcgacgcctgcgactcctcatgcgaagtcatgatccctaaaggcaccggcgacatactcgtagactgctccggcggccaacaacacttcctcaaagacaacctaatcgacctaggctgcccccacatcccactcctcggaaaaatggccatctacatctgccgcatgtcaaaccacccccgcaccaccatggccttcctcttctggttctccttcggatacgtcattacctgcatcttctgcaaagcactcttctattcactcatcatcatcggcacactcggcaagaaaatcaaacaataccgcgaactcaaaccccaaacatgcaccatctgcgaaaccacccccgtaaacgccatagacgccgaaatgcacgacctcaactgctcctacaacatttgcccctactgcgcctcccgcctcacctccgacggcctcgcccgccacgtcacccaatgccccaaacgcaaggaaaaagtcgaagaaaccgaactctacctaaacctcgaacgcatcccatggatcgtccgcaaactcctccaagtctccgaatccacaggtgtcgccctcaaacgatcctcctggctaatcgtcctactcgtcctcctcccagtctcactctcccccgtccaatccgccccagtcggc

SEQ ID NO: 15641 - RNA, 972 nt, synthetic construct
  misc_feature 1..972: note = derived and/or modified CDS sequence (opt11) from CCHFV(24-R-2012)__KR814856.1__Gn
  source 1..972: mol_type = other RNA
tccgaagaaccaggcgacgactgcatctcaagaacccaactcctacgaaccgaaaccgccgaaatccacgacgacaactacggcggacccggcgacaaaataaccatctgcaacggttcaacaatcgtagaccaacgcctcggcagcgaactcggctgctacaccatcaaccgcgtaaaatccttcaaactatgcgagaattccgccacaggcaaaacctgcgaaatcgacagtaccccagtcaaatgccgccagggattctgcctcaaaataacccaagaaggccgcggacacgtcaaactctcccgcggcagcgaagtcgtcctagacgcttgcgacacctcctgcgaagtcatgatccccaaaggcaccggcgacatcctcgtcgactgctccggcggacaacaacatttcctcaaagacaacctcatcgacctcggatgcccccacatccccctactaggcaaaatggccatatacatctgccgaatgtccaatcacccccgcaccaccatggcattcctcttctggttttccttcggctacgtaatcacatgcatcttctgcaaagccctcttctactccctcatcatcataggcacactcggcaaaaaaataaaacaataccgcgaactaaaaccccaaacctgcaccatctgcgaaaccgccccagtcaacgccatagacgccgaaatgcacgacctcaactgctcctacaacatctgcccctactgcgcctccagactcacatccgacggactcgcccgccacgtcccccaatgcccaaaacgcaaagaaaaagtcgaagaaaccgagctctacctaaacctcgaacgcatcccctggatagtacgcaaactactacaagtcagcgaatccaccggcgtcgccctcaaacgctcatcctggctcatcgtcctcctagtcctcctcacagtctccctctccccagtccaatccgcccccgtcgga

SEQ ID NO: 15642 - RNA, 972 nt, synthetic construct
  misc_feature 1..972: note = derived and/or modified CDS sequence (opt11) from CCHFV(36-ST-2014)__KR814857.1__Gn
  source 1..972: mol_type = other RNA
agcgaagaacccggcgacgactgcatctcccgcacacaactactaaaaacagaaaccgccgaaatccatgacgacaactacggaggccccggcgacaaaatcaccatctgtaacggctccaccatcgtcgaccaacgcctcggctccgaactcggctgttacaccatcaaccgcgtcaaatcattcaaactctgcgaaaactccgccacaggtaaaacatgcgaaatcgactccacccccgtcaaatgccgacaaggcttctgcctcaaaatcacccaggaaggccgaggccacgtcaaactcagccgcggatctgaagtcgtcctcgacgcctgcgactcctcttgcgaaatcatgatacccaaaggaaccggcgacatcctagtagactgctccggaggccaacaacacttcctcaaagacaacctaatcgacctaggatgcccccacataccactcctcggcaaaatggccatctacatctgccgaatgtccaaccacccccgcaccaccatggccttcctcttctggttctccttcggctacgttataacctgcatcttctgcaaagccctcttctacagcctaatcatcatcggcaccctaggcaagaaaatcaaacaataccgcgaacttaaaccccaaacctgcaccatctgcgaaaccgccccggtaaacgccatcgacgccgaaatgcatgacctcaactgctcctacaacatatgcccctactgcgcctcccgcctcacctcagacggcctcgcacgccacgtaacccaatgcccaaaacgcaaagaaaaagtcgaagaaaccgaactctacctcaaccttgaacgcatcccctggatcgtccgcaaactcctccaagtctcagaatccacaggcgtcgccctaaaacgctcatcttggctaatcgtcctcctcgttctcctcaccgtcagcctatcccccgtccaatccgcacccgtaggc

SEQ ID NO: 15643 - RNA, 972 nt, synthetic construct
  misc_feature 1..972: note = derived and/or modified CDS sequence (opt11) from CCHFV(44-ST-2010)__KR814859.1__Gn
  source 1..972: mol_type = other RNA
tcagaagaaccaggagacgactgcatatcccgcacccaactcctaaaaaccgaaaccgctgaaatccacgatgacaactacggaggccccggcgacaaaatcaccatctgcaacggctcaaccattgtcgaccaacgactcggctcagaacttggctgctacaccataaaccgcgtcaaatccttcaaactctgcgaaaactccgccaccggcaaaacctgcgaaatcgacagcacacccgtcaaatgccgccagggcttctgcctcaaaatcacccaagaaggccgcggccacgtaaaactctcccgcggctccgaagtcgtcctcgacgcttgcgacagctcatgcgaaatcatgatacccaaaggcaccggcgacatcctcgtcgactgctccggcggacaacaacacttcctaaaagacaatctcatcgacctcggctgcccacacatccccctcctcggaaaaatggccatatacatctgccgaatgtccaaccacccccgcaccacaatggcatttctactctggttctccttcggctacgtcataacatgcatcttctgcaaagcactcttttactccctcatcatcatcggcaccctaggaaaaaaaatcaaacaataccgcgaactaaaaccacaaacctgcaccatatgcgaaaccgcccccgtcaacgcaatagacgcagaaatgcacgacctcaactgttcctacaacatatgcccctactgcgcatcccgcctcacttcagacggcctcgcccgccacgtcacccaatgccccaaacgcaaagaaaaagtagaagaaaccgaactctacctcaacctagaacgcatcccctggatagtcagaaaactgctccaagtctcagaatccaccggcgtcgccctcaaacgctcatcctggctcattgtcctcctcgtactcctaaccgtcagcctatccccagtccaatccgcacccgtaggc

SEQ ID NO: 15644 - RNA, 972 nt, synthetic construct
  misc_feature 1..972: note = derived and/or modified CDS sequence (opt11) from CCHFV(47-ST-2013)__KR814861.1__Gn
  source 1..972: mol_type = other RNA
tccgaagaacccggagacgactgcatatcacgcacccaacttctcaaaaccgaaacagccgaaatccacgacgacaactacggcggccccggcgacaaaataacaatctgcaacggatccaccatcgtcgaccaacgcctcggctccgaactcggctgctacaccatcaaccgcgtcaaatccttcaaactctgcaaaaacagcgccaccggcaaaacctgcgaaatcgacagcacaccagtcaaatgccgccaaggcttctgcctcaaaatcacccaagaaggccgcggccacgtaaaactcagccgcggatccgaagtcgtcctagacgcctgcgactcctcatgcgaaatcatgatacccaaaggcaccggcgacatcctcgttgactgctccggcggccaacaacacttcctaaaagacaacctcatcgacctgggatgcccacatatccccctccttggcaaaatggccatctacatctgccgaatgtccaaccacccacgcaccaccatggccttcctcttctggttctcattcggctacgtcataacctgcatcttctgtaaagccctgttctactcactcataatcatcggcacactaggaaagaaaatcaaacaataccgcgaactaaaaccccaaacctgcaccatctgcgaaaccgcccccgtcaacgccatcgacgccgaaatgcacgacctcaactgctcctacaatatatgcccctactgcgcatcccgcctcacctccgacggactcgcccgccacgtaacacaatgccccaaacgcaaagaaaaagtcgaagaaaccgaactctaccttaacctagaacgcatcccctggatcgtccgcaaacttctccaagtatccgaatccaccggagtcgcacttaaacgctcctcctggctcatcgtcctcctagtcctactaaccgtatccctctcccccgtccaatccgcccccgtcggc

SEQ ID NO: 15645 - RNA, 972 nt, synthetic construct
  misc_feature 1..972: note = derived and/or modified CDS sequence (opt11) from CCHFV(52-R-2014)__KR814862.1__Gn
  source 1..972: mol_type = other RNA
tcagaagaacccggcgacgactgtatctctcgaacccaactcctacgcaccgaaaccgccgaaatccacgacgacaactacggaggacccggcgacaaaataacaatctgcaacggctcaaccatcgtagatcaacgcctcggcagcgaactcggctgctacaccatcaaccgcgtcaaatccttcaaactctgcgaaaactccgccaccggcaaaacctgcgaaatcgactccacacccgtaaaatgccgccaaggattctgcctcaaaatcacccaagaaggccgaggacacgtaaaactctcacgcggctcagaagtcgtcctcgacgcctgcgacacctcatgcgaagtcatgatccccaaaggcaccggcgacatcctcgtcgactgctccggcggccaacaacacttcctcaaagacaacctcatcgacctcgggtgccctcacgtccccctactcggcaaaatggccatctacatctgccgaatgtccaaccacccacgcaccaccatggcattcctcttctggttctcattcggatacgtcataacctgcatcttctgcaaagcactattctacagcctcatcatcatcggcaccctcggcaagaaaatcaaacaataccgcgaactcaaaccccaaacctgcaccatctgtgaaaccgcacccgtcaacgccatcgacgcagaaatgcacgacctcaactgctcatacaacatctgcccatactgcgcctcccgcctaacctcagacggactcgcccgacacgtcccacaatgccccaaacgcaaagaaaaagtcgaagaaaccgaactctacctgaacctcgaacggatcccctggatagtccgtaaactcctccaagtctcagaatccacaggagtcgcactaaaacgctcctcatggctcatagtcctactcgtcctcctcaccgtatctctctccccagtccaatcagcacccgtcgga

SEQ ID NO: 15646 - RNA, 972 nt, synthetic construct
  misc_feature 1..972: note = derived and/or modified CDS sequence (opt11) from CCHFV(75-R-2012)__KR814863.1__Gn
  source 1..972: mol_type = other RNA
tccgaggaacccggtgacgactgcatcagccgcacccaactcctccgaaccgaaaccgccgaaatacatgacgacaactacggcggacccggagacaagatcaccatatgcaacggatccaccatcgtagaccaacgcctcggctccgaactcggctgctacaccatcaaccgagtcaagagcttcaaactctgcgaaaattccgccacaggcaaaacctgcgaaatcgacagcgctccagtcaaatgccgccaaggcttctgcctcaaaatcacccaagaaggacgcggccacgtaaaactctctcgcggcagcgaggtcgtcctagacgcctgtgactcatcctgcgaggtcatgatcccaaaaggcaccggcgacatcctcgtcgactgctccggcggccaacaacacttcctaaaagacaacctcatcgacctcggctgcccccacatcccactactcggcaaaatggccatctacatctgccgcatgtcaaaccacccccgcaccaccatggccttcctattctggttctctttcggctacgtcataacctgcatcttctgcaaagcactattctactctctcatcatcatcggcaccctaggaaagaaaatcaaacaataccgcgaactaaaaccccaaacctgcaccatctgcgaaaccgcccccgtaaacgccatcgacgccgagatgcacgacctcaactgctcatacaacatctgcccctactgcgcctcccgcctcacctccgatggccttgcccgacacgtcccccaatgccccaaacgcaaagaaaaagtcgaagaaacagaactctacctaaacctagaacgcatcccatggatcgtccgaaaactcctccaagtctccgaatccacaggagtagccctcaaacgctcatcctggctaatcgtccttctcgtactactcaccgtgtcactctcacccgtacaatccgcacccgtcggc

SEQ ID NO: 15647 - RNA, 972 nt, synthetic construct
  misc_feature 1..972: note = derived and/or modified CDS sequence (opt11) from CCHFV(75-ST-2010)__KR814864.1__Gn
  source 1..972: mol_type = other RNA
tcagaagaatccggcgacgactgcatatcacgcacccaactcctgcgcaccgaaaccgccgaaatccacgacgacaactacggaggccccggcgacaaaatcacgatctgcaacggctccaccatagtcgaccaacgcctcggatccgaactcggctgctacaccatcaaccgcgtcaaatccttcaaactttgcgaaaactccgccacaggcaaaacctgcgagatcgacagcacacccgtcaaatgccgccaaggcttctgcctaaaaatcacacaagaaggccgcggccacgtcaaactctcccgcggctccgaagtagtcctagacgcatgcgactcctcctgcgaagtcatgatccccaaaggcaccggcgacatactcgtcgactgcagcggaggccagcaacacttcctaaaagacaacctaatcgacctcggctgcccccacatcccactcctaggaaaaatggccatctacatctgccgaatgtccaaccacccccgaaccaccatggcattcctattctggttctccttcggctacgtcataacttgcctcttctgcaaagccctcttctactccctaatcatcatcggcaccctcggaaagaaaatcaaacaataccgcgagctccgaccacagacctgcaccatatgcgaaacagcaccagtcaacgcaatcgacgccgaaatgcacgacctaaactgctcctacaacatatgcccctactgcgcctcacgccttacatccgacggactcgcccgccacgtcccacaatgccccaaacgaaaagaaaaagtcgaagagacagaactatacctcaacctcgaacgcatcccatggatcgtccgcaaacttctccaagtctcagaatcaaccggcgtcgccctaaagcgatcgtcctggctcatcgtcctactcgtcctccttaccgttagcctctccccagtccaatccgcgcccgtcggc

SEQ ID NO: 15648 - RNA, 972 nt, synthetic construct
  misc_feature 1..972: note = derived and/or modified CDS sequence (opt11) from CCHFV(3820-ST-2007)__KR814868.1__Gn
  source 1..972: mol_type = other RNA
tctgaagaacccggcgacgactgcatctcccgcacccaactcctcaaaactgaaacagccgaaatccacgacgacaactacggttcccctggcgacaaaataacaatctgcaacggatccaccatagtcgaccaacgcctaggctccgaactcggctgctacaccatcaaccgcgtaaaatccttcaaactctgcgaaaattcagccaccggcaaaacctgcgaaatcgactccacacccgtcaaatgtcgccaaggcttctgcctcaaaatcacccaagaaggccgcggccacgtcaaactcagccgcggctccgaagtcgtcctcgatgcctgcgactcctcctgcgaaatcatgatcccaaaaggaaccggagacatcctcgtcgactgctccggcggccaacaacatttcctcaaagacaacctaatcgacctcggctgcccacacatccccctcctcggaaaaatggccatctacatatgccgcatgtccaaccacccccgcaccacaatggccttcctattctggttctccttcggctacgtcataacctgcatcttctgcaaagccctcttctattctctcatcatcatcggaaccctcggcaagaaaataaaacaataccgtgaactaaaaccccaaacctgcacaatctgcgagaccgcccccgtaaacgccatcgacgccgaaatgcacgacctgaactgctcatacaacatctgcccctactgtgcctcccgcctaacctccgacggcctcgcccgccacgtcacccaatgccccaaacgcaaagaaaaagtcgaagaaaccgaactctacctcaacctcgaacgcataccctggatcgtccgtaaactactccaagtctctgaatccaccggtgtcgccctcaaacgctcctcctggctcatcgtcctactcgtcctcctcgccgtctccctctcacccgtccaatccgcccccgtcggc

SEQ ID NO: 15649 - RNA, 972 nt, synthetic construct
  misc_feature 1..972: note = derived and/or modified CDS sequence (opt11) from CCHFV(4701-ST-2009)__KR814872.1__Gn
  source 1..972: mol_type = other RNA
agcgaagaacccggcgacgactgcatcagccgaacccaactacttaaaaccgaaaccgccgaaatccacgacgacaactacggcggccccggagacaaaataaccatctgcaacggatccaccgtcgtagaccaacgtctcggatccgaactcggatgctacaccatcaaccgagtaaaatccttcaaactctgcgaaaactccgcaaccggaaaaacctgcgaaatcgactccaccccagtcaaatgccgccaaggcttctgcctcaaaataacccaggaaggacgcggccacgtcaaactctcacggggctccgaagtagtcctagacgcatgcgacagctcctgcgaaattatgatccccaaaggcaccggcgacatcctagtagactgctccggcggccagcaacacttcctcaaagacaacctaatcgacctcggctgcccacacatcccactccttggcaaaatggccatctacatctgccgcatgtccaaccacccccggaccacaatggccttcctcttctggttctccttcggatacgtcataacctgcatcttctgcaaggccctcttctactccctcatcatcatcggcaccctcggcaaaaagatcaaacaataccgcgaactaaagccccagacctgcaccatctgcgaaacagcccccgtcaacgccatcgacgccgaaatgcacgacctaaactgcagctacaacatctgcccctactgcgcgtcccgcctcacctccgacggactcgcacgccatgtaacccaatgccccaaacgcaaagaaaaagtcgaagaaaccgaactatacctaaacctagaacgcatcccctggatcgtgcgcaaactactccaagtctccgaatccaccggcgtcgccctcaaacgctcctcctggctaatagtcctcctcgtactcctcaccgtctcactctcccccgtccaatccgcccccgtcggc

SEQ ID NO: 15650 - RNA, 972 nt, synthetic construct
  misc_feature 1..972: note = derived and/or modified CDS sequence (opt11) from CCHFV(5170-R-2011)__KR814873.1__Gn
  source 1..972: mol_type = other RNA
tccgaagaaccaggcgacgactgcatcagccgcacccaactcctcaaaacagaaaccgccgaaatccacgacgacaactacggcggacccggcgacaaaatcaccatatgcaacggctccaccatcgtcgaccaacgcctcggctcagaactcggctgctacaccatcaaccgcgtcaaatccttcaaactctgcgaaaactcagccaccggcaaaacctgcgaaatcgactccacacccgtcaaatgccgccagggcttctgcctaaaaatcacacaggaaggccgcggccacgtaaaactcagcagaggcagcgaagtggtcctcgatgtctgcgacagctcctgcgaaatcatgatacccaaaggcaccggcgacatcctcgtcgactgctccggcggccaacaacacttcctaaaagacaacctcatcgacctaggctgcccccacatccccctactaggcaaaatggccatctacatctgccgcatgtcgaaccacccccgcaccacaatggccttcctcttctggttctcattcggctacgtcatcacatgcatcttctgcaaagcactcttctactcccttatcatcatcggaaccctcggaaaaaaaataaaacaataccgagaactcaaaccccaaacctgcaccatttgcgaaaccgctcccgtcaacgccatagacgcagaaatgcatgacctcaactgctcctacaacatctgcccctactgcgcatcacgcctaacatccgaaggcttagcccgacatgtcacccaatgccccaaacgcaaagaaaaagtcgaagaaaccgaactatacctaaacctcgaacgcataccctggatagtccgaaaactcctccaagtatccgaatccacaggagtcgccctaaaacgctcctcctggctaatcgtcctcctcgtcctcctaaccgtttccctcagccccgtccaaagcgcccccgtaggt

SEQ ID NO: 15651 - RNA, 972 nt, synthetic construct
  misc_feature 1..972: note = derived and/or modified CDS sequence (opt11) from CCHFV(200406546-Turkey)__KR864902.1__Gn
  source 1..972: mol_type = other RNA
tccgaagaacctggagacgactgcatctcccgcacccaactcctcagaaccgaaaccgccgaaatccatgacgataactacggcggccccggcgataaaatcaccatctgcaacggctcaaccatcgtcgaccaacgcctaggatcagaacttggatgctacaccatcaaccgcgtcaaatctttcaaactctgcgaaaactcagctaccggaaaaacctgcgaaatagacagcacccccgtcaaatgccgtcaaggcttctgcctcaaaatcacacaagaaggccgcggccacgtcaaactcagccgaggctccgaagtcgtcctcgacgtatgcgactcttcctgcgaagtcatgatccccaaaggcacaggcgacatcctagtcgactgctcaggcggccaacaacacttcctcaaagataacctcatcgacctcggatgcccccatgtaccacttctcggccgcatggcaatctatatatgccgcatgtccaaccacccccgaaccaccatggccttcctcttctggttctccttcggctacgtcattacatgcatcttctgcaaagcactattctactcactaataatcatcggaaccctcggcaaaaaattcaaacaataccgcgaactcaaaccccaaacctgtacaatctgcgaaaccgcccccgtgaacgccatcgacgcagaaatgcacgacctaaactgctcctacaacatctgcccatactgcgcctcccgcctcacctccgacggcctcgcccgacacgtcccccaatgccccaaacgcaaagaaaaagtcgaagaaacagaactctacctcaacctagaacgcataccctggatcgtccgcaaactcctccaagtctcagaatcaaccggcgtcgcacttaaacgctcctcctggctcatcgtccttctcgtcctcctcaccgtctcactatcccccgtccaatccgcccccgtcggc

SEQ ID NO: 15652 - RNA, 972 nt, synthetic construct
  misc_feature 1..972: note = derived and/or modified CDS sequence (opt11) from CCHFV(1-CR/HU-2015)__KU161584.1__Gn
  source 1..972: mol_type = other RNA
tctgaagaaccaggcgacgactgcatcagcagaactcaactcctccgaaccgaaaccgccgaaatccacgacgacaactacggcggccccggcgacaaaatcaccatctgcaacggatccacaatcgtcgaccaaagactcggctccgaactcggctgctacaccataaaccgcgtcaaatcattcaaactctgcgaaaactccgcaaccggcaaaacctgcgaaatcgactccacccccgtcaaatgccgccaaggcttctgtctaaaaataacccaagaaggccgcggccacgtcaaactctctcgaggctccgaagtcgtcctcgacgcctgcgacagctcctgcgaagtcatgatccccaaaggcaccggcgacatcctagtcgactgctccggaggccaacaacacttcctaaaagacaacctcatcgacctcggatgcccccacatccccctcctgggcaaaatggccatctacatctgccgcatgtccaaccacccccgaacaaccatggccttcctgttctggttctctttcggctacgtcataacctgcatcttctgcaaagcactcttctactccctcatcataatcggcacactcggcaaaaagataaaacaataccgcgaactcaaaccccaaacctgcaccatctgcgaaaccgcacccgtaaacgccatcgacgccgaaatgcacgaccttaactgctcctacaacatctgcccatactgcgcctcccgactcacatcagacggcctagcccgccacgtcacacaatgcccaaaacgcaaagaaaaagtcgaagaaaccgaactctacctcaacctagaacggatcccatggatagtccgaaaactactacaagtctccgaatctaccggagtcgccctcaaacgctcctcctggctcatcgtcctcctcgtcctcctaaccgtatctctaagcccagtccaaagcgcccccgtcggc

SEQ ID NO: 15653 - RNA, 972 nt, synthetic construct
  misc_feature 1..972: note = derived and/or modified CDS sequence (opt11) from CCHFV(Gaib)__KX013445.1__Gn
  source 1..972: mol_type = other RNA
tccgaagaatcttccgacgactgcataagccgcacccaactcctccgcactgaaacagccgaaatccacaacgacaactacggcggccccggcgacaaaatcaccatctgcaacggctccaccatcgtcgaccagcgcctcggctccgaactaggctgctacaccatcaaccgcgtcaaatctttcaaactttgcgaaaatagcgccaccggaaaatcatgtgaaatagactccatccccgtcaaatgtcgccaaggattctgcctaaaaatcacacaagaaggccgcggccacgttaaactctcccgcggatccgaagtagtcctcgacgcctgcgactcctcatgcgaaatcatgatcccaaaaggcaccggcgacatcctcgtcgactgctccggcggccaacaacacttcctaaaagacaacctcatcgacctcggctgccccaacatacccctcctaggcaaaatggccatctacatctgccgaatgtccaaccaccccaaaacaaccatggccttcctattctggttctccttcggctacgtcatcacatgcatattctgcaaagccatcttctacctcctcataatcgtcggcactctcggcaaaaaattcaaacaataccgcgaactaaaaccccaaacctgcacaatctgcgaaaccacccccgtcaacgccatcgacgccgaaatgcacgacctcaactgctcctacaacatctgcccctactgcgcctccagactcacatccgacggactagcacggcacgtcgtccactgccccaaacgcaaagaaaaaatcgaagaaaccgaactatacctcaacctcgaaagagtcccatgggtcgtccgaaaactcctccaagtctccgaatcaaccggcgtagccctcaaacgatcctcatggctcatcgtccttctcgtcctcctcaccgtatccctaagccccgtacaatcagcaccaataggc

SEQ ID NO: 15654 - RNA, 972 nt, synthetic construct
  misc_feature 1..972: note = derived and/or modified CDS sequence (opt11) from CCHFV(Hodzha)__KX013448.1__Gn
  source 1..972: mol_type = other RNA
tccgaggaatccggcgacgactgcatctcacgcacccaactcctacgaaccgaaaccgccgaaatacacggcgacgactacggaggacccggcgacaaaatcaccatatgcaacggcagcacgatagttgaccaacgcctaggctccgaactcggctgctacaccataaaccgcgtcaaatccttcaaactatgcgaaaactccgccaccggcaaaagctgcgaaatcgactcaacccccgtaaaatgccgccaaggctactgcctaaaaatcacccaagaaggacgcggccacgtcaaactgagccgcggctccgaagtcgtcctagacgcctgcgacagctcctgcgaagtcatgatcccaaaaggcacaggcgacatcctcgtagactgctcaggcggccaacaacacttccttaaagacaacctcatagacctaggctgccccagaatccccctcctcggcaaaatggccatctacatctgccgaatgtcgaaccaccccgaaacaaccatggccttcctattctggttctccttcggctacgtaataacctgcatcctctgcaaagctatcttttacctcctcatcatcgtcggcaccctcggaaaacgcttcaaacaataccgcgaactcaaaccccaaacctgcaccatatgcgaaacaacacccgccaacgccatcgacgcagaaatgcacgacctcaactgcagctacaacatctgcccatactgcgcatcccgcctcacctcagacggactagcccgccacgtaacccaatgccccaaacgcaaagaaaaagtcgaagaaaccgaactctacctaaacctcgaacgaatcccctggatcgtccgcaaactactccaagtctcagaatcaaccggcgtcgcactcaaacgatcctcctggctcatcgtactcctagtactcttcgccgtcagcctctcccccgtccaatccgcccccatcggc

SEQ ID NO: 15655 - RNA, 972 nt, synthetic construct
  misc_feature 1..972: note = derived and/or modified CDS sequence (opt11) from CCHFV(IbAn7620)__KX013451.1__Gn
  source 1..972: mol_type = other RNA
tccgaagaaccctcagacgactgcatatcccgcacccaactcctccgcacagaaaccgctgaaatccacggcgacaactacggcggcccaggagacaaaatcaccatctgcaacggatcaactatcgtcgaccaacgcctaggctccgaactcggctgctacaccatcaaccgcgttaaatccttcaaactctgcgaaaactccgcaaccggcaaaaactgcgaaatcgacagcgtccccgtcaaatgccgccaaggttactgcctccgcatcacccaagaaggccgaggacacgttaaactatccagaggctcagaaatcgtcctcgacgcatgcgacacatcgtgcgaaatcatgatccccaaaggcaccggagacatactcgtcgactgctccggcggacaacaacacttcctcaaagacaacctcatcgacctcggctgccccaaaatccccctacttggaaaaatggccatttacatctgccgcatgtccaaccaccccaaaacaacaatggccttcctattctggttctccttcggctacgtcataacctgcatactatgcaaggcaatcttctacctactaatcatcatcggcaccctaggcaaacgcctcaaacaataccgcgaactcaaaccacaaacctgcaccatctgcgaaacaacccctgttaacgctatcgacgccgaaatgcacgacctcaactgctcctacaacatctgcccatactgcgcctcacgcctaacctccgacggcctagcccgccacgtcatccaatgccccaaacgcaaagagaaagtagaagaaaccgaactctacctcaacctcgaacgaatcccatgggtcgtccgcaaactcctccaagtctcagaatccaccggtgtagccctaaaacgatcatcctggctcatcgtcctcctagtcctcttcaccgtctccctaagtcccgtacaatcagcccccatcgga

SEQ ID NO: 15656 - RNA, 972 nt, synthetic construct
  misc_feature 1..972: note = derived and/or modified CDS sequence (opt11) from CCHFV(K128_76)__KX013454.1__Gn
  source 1..972: mol_type = other RNA
tccgacgaatccggcgacgactgcatctccagaacccaactcctacgcaccgaaaccgccgaaatccacggcgacaactacggcggccccggagacaaaatcaccatatgcaacggctccaccatcgtagaccaacgccttggatccgaactcggctgctacacaataaaccgggtcaaatccttcaaattatgcgaaaattccgcaaccggtaaatcatgcgaaatagactccatccccgttaaatgccgccaaggctactgcctaaaaataacccaggaaggccgcgggcacgtcaaactaagccgaggctccgaagtcgtcctcgacgcctgcgacagcagctgcgaagtcatgatcccaaaaggcaccggagacatcctcgtcgactgctccggcggccaacaacacttcctaaaggacaacctaatcgacctaggttgccccaaaatacccctcctcggcaaaatggccatctacatctgccgcatgtcgaaccacccaaaaaccaccatggccttcctcttctggttctccttcggctacgtcataacctgcatcgtatgcaaagcaatcttctacctcctcatcatcgtcggcaccctcggcaaacgcttcaaacagtaccgagaactcaaaccacaaacctgcaccatctgcgaaactacccccaccaacgccatcgacgcagaaatgcacgacctcaattgctcctacaacatctgcccttactgcgcctcacgcctaacatccgacggcctagcccgccacgtcacacactgccccaaacgcaaggaaaaagtcgaagaaaccgagctatacctaaacctcgaacgtatcccatgggtagtccgcaaactcctccaagtctccgaatccaccggcgtcgccctcaaacgctcatcctggctaatcgtcctcctagtcctcttcgccgtctcactctcccccgtccaatccgcccccatctcc

SEQ ID NO: 15657 - RNA, 972 nt, synthetic construct
  misc_feature 1..972: note = derived and/or modified CDS sequence (opt11) from CCHFV(K168_40)__KX013457.1__Gn
  source 1..972: mol_type = other RNA
tccgacgaatccggtgacgactgcatctcaagaacccaactactacgcaccgaaacagccgaaatccacggagacaactacggaggacccggcgacaaaatcactatatgcaacggctccaccatcgtcgaccaacgactaggctccgaactcggctgctacaccatcaaccgcgtcaaatccttcaaactctgcgaaaacagcgccaccggcaaatcctgcgaagtcgacagcatccccgtcaaatgccgccaaggctactgcctcaaaatcacccaagaaggaagaggacacgtcaaactctcccgcggctccgaagtcgtcctcgacgcctgcgacagctcatgcgaagtcatgatccccaaaggcaccggcgacatcctcgtcgactgctccgggggccaacaacacttcctcaaagacaacctcatcgacctcggatgcccaaaaatcccactactaggcaagatggccatctacatctgccgcatgtcaaaccacccaaaaaccaccatggccttcctattctggttctccttcggctacgtcatcacatgcatcgtctgcaaagccatcttctacctcctaatcatcgtcggcaccctcggcaaacgtttcaaacaataccgcgaactgaaaccccaaacctgcaccatatgcgaaacaacccccacaaacgccatagacgcagaaatgcacgacctcaactgctcctacaacatctgcccctactgcgcctccagacttacctcagacggtctcgcccgacacgtcacccactgccccaagcgcaaagaaaaagtcgaagaaactgaactataccttaacctagaacgcatcccttgggtcgtccgcaaactactccaagtctcagaatccaccggcgtcgccctaaaacgatcaagctggctcatagtccttctagtcctattcgccgtctccctctcccccgtccaatcagcccccatagga

SEQ ID NO: 15658 - RNA, 972 nt, synthetic construct
  misc_feature 1..972: note = derived and/or modified CDS sequence (opt11) from CCHFV(K168_125)__KX013460.1__Gn
  source 1..972: mol_type = other RNA
agcgacgaatctggcgacgactgcatctcccgcacccaactcctccgaaccgaaaccgccgaaatccacggcgacaactacggcggccccggggacaaaatcaccatctgcaacggctccaccatcgtcgatcaacgcctaggatccgaactcggttgctacaccataaaccgcgtaaaatccttcaagctctgcgaaaacagcgccactggcaaatcctgcgaagtcgactccatacctgtcaaatgccgccaaggctactgcctaaaaatcacacaagaaggacgcggccacgtcaaactctcccgcggctcagaagtcgtcctagatgcctgcgactcctcctgcgaagtcatgatccccaagggcaccggcgacatcctcgtcgactgctcaggcggccaacaacacttcctaaaagacaacctaatcgacctaggatgccccaaagtaccactactaggaaaaatggccatctacatatgccgaatgtccaaccatcccaaaaccaccatggcattcctcttctggttctccttcggctacgtaataacatgcatcgtctgcaaagccatcttctacctcctcatcatcgtcggcaccctaggcaaacgtttcaaacaataccgagaactcaaaccccaaacctgcacaatctgtgaaaccaccccaaccaacgcaatcgacgcagaaatgcacgacctcaactgctcctacaacatctgcccctactgcgccagccgcctcacatcagacggcctagcccgacacgttactcactgcccaaaacgcaaagaaaaagtagaagaaacagaactctacctcaacctagaacgcatcccctgggtcgtccgaaaactactccaagtctccgaatccaccggcgtcgcacttaaacgctcctcctggctcatcgtcctcctcgtcctcttcgccgtctcactttccccagtccaatccgcccccatcgga

SEQ ID NO: 15659 - RNA, 972 nt, synthetic construct
  misc_feature 1..972: note = derived and/or modified CDS sequence (opt11) from CCHFV(K229_194)__KX013463.1__Gn
  source 1..972: mol_type = other RNA
tccgaagaacccggcgacgactgcatctccagaacccaactactaaaaacggaaaccgccgaaatccacgacgacaactacggaggccccggcgacaaaatcaccatctgcaacggatccacaatagtcgaccaacgcctaggctctgaactcggatgctacaccatcaaccgcgtaaagtcattcaaactctgcgaaaactccgcgaccggcaaaacctgcgaaatcgactccacccctgtcaaatgccgacaaggcttctgtctaaaaatcacacaggaaggacgcggacacgtaaaactctcccgaggatccgaagtagtcctcgacgcctgcgactcaagctgcgaaatcatgatccccaaaggcaccggcgacatcctcgtcgactgctccggcggccaacaacacttcctcaaaggcaatctcatagacctcggatgcccccacatacccctcctcggcaaaatggccatctacatatgccgcatgtccaaccacccccgcacaactatggccttcctcttctggttctcattcggctacgtcataacctgcatcttctgcaaggcactattctactccctcataatcatcggaaccctcggcaagaaaatcaaacaataccgagaactcaaaccccaaacctgcacaatctgcgaaaccgctcccgtcaacgccatcgacgccgaaatgcacgacctaaactgcagctacaacatctgcccctactgcgcctcccgcctcacctccgacggcctcgcacgccacgtcacccaatgccccaaaagaaaagaaaaagtcgaagaaaccgaactctacctcaacctagaacgcatcccctggatcgtccgcaaactcctccaggtctccgaatccacaggcgtagcgctcaaacgatcctcctggctcatcgtcctacttgtactcctcaccgtctcactctcccccgtccagagcgcccccgtaggc

SEQ ID NO: 15660 - RNA, 972 nt, synthetic construct
  misc_feature 1..972: note = derived and/or modified CDS sequence (opt11) from CCHFV(K315_14)__KX013469.1__Gn
  source 1..972: mol_type = other RNA
tcagaagaaccaggcgacgactgcatatccagaacccaattactcaaaaccgaaaccgccgaaatccatgacgacaactacggcggccccggcgacaaaatcaccatctgcaacggctccaccgtcgtcgaccaacgcctcggctccgaactaggatgctacaccatcaaccgcgtcaaatctttcaaactatgcaaaaactccgccaccggcaaaacctgcgagatcgactccacccccgtaaaatgccgccaaggcttctgcctcaaaataacccaagaaggccgcggacacgtcaaactctcacgcggctcagaagttgtcctcgacgtctgcgactcctcatgcgaaatcatgatcccaaaaggcaccggcgacatcctagtcgactgctccggcggccaacaacacttcctcaaagacaacctcatcgacctcggctgcccccacatccccctcctcggcaaaatggcaatatacatatgccgcatgtccaaccaccccagaacaacaatggccttcctattctggttctccttcggctacgtcataacctgcatcttctgcaaagctctattctactccctcatcatcatcggaaccctcggcaaaaaaatcaaacagtaccgcgaactaaaaccccaaacctgcaccatctgcgaaaccgcccccgtcaacgctatcgacgccgaaatgcacgacctcaactgcagctacaacatctgcccctactgtgcatcccgcctaacctccgaaggcctcgctcgccacgtaacacaatgccccaaacgaaaagaaaaagtcgaagaaaccgaactctacctgaacctcgaacgaatcccatggatcgtccgaaaactactccaagtctccgaatccaccggagtcgccctcaaacgctcctcatggctcatcgtcctcctcgtcctcctcaccgtctccctctcccccgtacaatccgcacccgtcggc

SEQ ID NO: 15661 - RNA, 972 nt, synthetic construct
  misc_feature 1..972: note = derived and/or modified CDS sequence (opt11) from CCHFV(K323_27)__KX013472.1__Gn
  source 1..972: mol_type = other RNA
tccgaagaacccggcgacgactgcatctcacgcacacaactcctcaaaacagaaaccgccgaaatccacgacgacaactacggaggccccggcgacaaaatcaccatctgcaacggatcaacaatagtagaccaacgcctcggctccgaactcggatgctacaccatcaaccgcgtcaaatccttcaaactctgcgaaaactcagccaccggcaagacttgcgaaatcgactccacccctgtcaaatgccgacaaggcttctgcctcaaaataacccaagaaggcagaggccacgtaaaactctctcgcggttccgaagtcgtcctcgacgcatgcgactcatcctgcgaaataatgatcccaaaaggcaccggcgacatcctcgtcgactgctctggcggccaacaacacttcctcaaagacaacctcattgaccttggctgcccacacatccccctcctcggcaaaatggccatctacatctgccgcatgagcaaccacccccgcaccaccatggccttcctcttctggttctccttcggctacgtcatcacatgcatcttctgcaaagccctcttctacctccttatcataatcggcaccctcggcaagaaaatcaaacaataccgcgaactcaaaccccaaacttgcacaatctgcgaaaccgccccagtcaacgccatcgacgccgaaatgcacgacctcaactgctcctacaacatatgcccatactgcgcctcacgcctcacctcggacggcctcgcacgccatgtcacccagtgtcccaaacgcaaagaaaaagtcgaagaaaccgaactctacctgaacctagaacgaatcccctggatcgttcgaaaactcctacaagtatccgaatccacgggcgtcgcactaaaacgctcctcctggctcaccgtcctcctcgtcctcctcaccgtctccctatcccccgtccaatccgcccccgtcggc

SEQ ID NO: 15662 - RNA, 972 nt, synthetic construct
  misc_feature 1..972: note = derived and/or modified CDS sequence (opt11) from CCHFV(K340_6)__KX013475.1__Gn
  source 1..972: mol_type = other RNA
tccgaagaacccggcgacgactgcatctcccgaacccaactactcaaaacagaaaccgccgaaatccacgacgacaactacggaggaccaggcgacaaaataacaatctgcaacggcagcaccatcgtcgaccaacgactcggctcagaactcggctgctacaccatcaaccgagtaaagagcttcaaactctgcgaaaactccacaacaggcaaaacctgcgaaatcgactctaccccagtcaaatgccgccaaggattctgcctcaaaatcacccaagaaggccgcggccacgtaaagctctcacgcggatccgaagtcgtcctcgacgcttgcgactcctcctgcgaaatcatgatccccaaagggaccggcgacatactcgtcgactgctccggcggacaacaacacttcctcaaagacaacctcatcgacctaggctgcccacacatcccacccctcggcaaaatggccatctacatctgccgcatgtccaaccacccccgcaccaccatggccttcctcttctggttttcctttggatacgtcattacctgcatcttctgcaaagccctcttctactcattaatcatcatcggaaccctaggcaagaaaatcaaacagtaccgagaactcaaaccccaaacctgcaccatatgcgaaaccgcccccgtcaacgccatagacgcagaaatgcacgaccttaactgctcctacaacatctgcccttactgcgcctcccgactcacctccgacggtctcgcccgccacgtcacccaatgccccaaacgcaaagaaaaagtcgaagaaaccgaactctacctcaacctcgaacgcatcccctggatagtccgcaaactcctacaagtctccgaatccacaggcgtcgccctcaaacgatcatcatggctcatcgtcctcctcgtcctgctcaccgtctccctatcccccgtccaatccgcacccgtcggc

SEQ ID NO: 15663 - RNA, 972 nt, synthetic construct
  misc_feature 1..972: note = derived and/or modified CDS sequence (opt11) from CCHFV(Mamon)__KX013478.1__Gn
  source 1..972: mol_type = other RNA
tcggaagaacccggagatgactgcatatcccgaacacaactcctccgcacagaaaccgccgaaatccacgacgataactatggcggccccggcgacaaaatcacaatatgcaacggatcaacaatcgtcgaccaacgcctcggctccgaattaggctgctacaccataaaccgcgtaaaatccttcaaactctgcgaaaactccgccaccggcaaaacctgcgaaatcgactcaacccctgtaaaatgccgccaaggcttctgcctcaaaatcacacaagaaggccgtggacacgtcaaactatcccgaggctccgaagtcgtctccgacgcctgcgactcctcatgcgaagtcatgatccccaaaggcacaggagacatcctcgtcgactgctcaggcggccaacaacacttcctcaaagacaacctcatcgacctcggctgcccacacatccccctcctcggcaaaatggccatctacatctgccgaatgagcaaccacccccgcaccaccgtcgccttcctattctggttctccttcggatacgtaatcacatgcatcttctgcaaagccctcttctactccctaatcatcatcgggaccctcggcaaaaaaatcaaacaataccgcgaactcaaaccccaaacctgcaccatctgcgaaaccgcccccgtcaacgccatcgacgccgaaatgcacgacctaaactgctcctacaacatttgcccatactgcgcatcccgcctcacctccgacggactcgcacgccacgtcccccaatgccccaaacgaaaagaaaaagtcgaagaaacagaactttatctaaacctcgaacgaatcccctggatcgtccgaaaactcctacaagtatccgaatccacgggagttgccctcaaacgctcaagctggctcatcgtactcctcgtcctcctcaccgtctccctctcacccgtccaatccgcccccgtaggc

SEQ ID NO: 15664 - RNA, 972 nt, synthetic construct
  misc_feature 1..972: note = derived and/or modified CDS sequence (opt11) from CCHFV(Nakiwogo)__KX013484.1__Gn
  source 1..972: mol_type = other RNA
gcagaaggcgtctcgaacgactgcgtgagccggacccaactcataaaaacggaagtcgccgaaatccacgaagactcctacggcggccccggagagaaaatcaccatctgcaacggcagcaccatcgtcgaccaacgcctcggctccgaactcggctgctacaccataaaccgcgtcaaaacctacaaactatgcgaaaacagcgctaccgaaaaaggatgcgaaatcgactcagtacccgtaaaatgcaaacaaggcttctgcctcaaagttacccaagaaggccgcggccacgtcaaactatcccgcggcaccgaaatcgtcctcgacgtctgcgacacctcatgcgaactcatgatcccaaaaggaacaggcgacatcctagtcgactgctccggcggccaacaacacttccttcaagacaacctcatcgacctcggctgccccaacgtcccactcctcggaaaaatggccatctacatctgccgcatgtccaaccaccccaagaccaccatggcattcctcttctggttctcattcggctacgtaataacctgcgtagtctgcaaagtcctcttctacctcctcatagtcataggaaccctcggcaagaaactaaaacaataccgagagctcaaaccccaaacctgcatcgtatgcgaatccatccccgtcaacgtcatcgacgccgagatgcacgaactgaactgcaattacaacatctgcccctactgcgcatcccgcctcacctccgacggactcgtcagacacgtcacccaatgccccaaacgcaaagaaaaagtcgaagaaaccgaactatacctcaacctcgaacgtatcccctggctagtccgccgcctactccaagtctcagaaagcaccggcatggccctcaaacgctcctgctggatgaccacactcctcatcctcctcgtagtctccctctcccccgtccaatcagcccccgtcggc

SEQ ID NO: 15665 - RNA, 972 nt, synthetic construct
  misc_feature 1..972: note = derived and/or modified CDS sequence (opt11) from CCHFV(Saf)__KX013487.1__Gn
  source 1..972: mol_type = other RNA
tccgaagaacccggagacgactgcatctcccgcacacaactcctccgcaccgaaaccgccgaaattcacgacgacaactacggcggccccggcgacaaaatcaccatctgcaacggctccaccatcgtagaccaacgcctaggctccgaactcggctgttacaccataaaccgcgtcaaatccttcaaactctgcgaaaactccgcaaccggcaaaacctgcgaaatcgactctacccccgtaaagtgccgccaaggcttctgcctcaaaataacccaagaaggccgcggccacgtaaaactctcacggggctcagaagtcgtcctcgatgcctgcgactccagctgcgaagtaatgatccccaaaggaaccggagacatcctagtcgactgctcagggggccaacaacactacctcaaagacaacctcatcgacctcggatgcccgcacatccccctactcggaaaaatggccatctacatctgccgcatgtccaaccacccccgaaccaccatggccttcctgttctggttctccttcggctacgtcataacctgcatcttctgcaaagccctcttctactccctaatcatcatcggaacactcggaaagaaaatcaaacaataccgcgaactcaaaccccaaacctgcacaatctgcgaaaccgcccccgtcaatgccatcgacgccgaaatgcacgacctcaactgctcatacaacatctgcccttactgcgcctcacgcctaacatcagacggcctcgcccgccacgtcccccaatgcccaaaacgcaaagaaaaagtcgaagaaaccgaactctacctaaacctcgaacgaataccctggatcgtacgaaaactcctccaagtctcagaatccaccggagtagccctcaaacgttcctcatggctcatcgtccttctcgtactcctcaccgtctccctatcacccgtccaatccgcccccgtcggc

SEQ ID NO: 15666 - RNA, 972 nt, synthetic construct
  misc_feature 1..972: note = derived and/or modified CDS sequence (opt11) from CCHFV(Ast199)__KX056051.1__Gn
  source 1..972: mol_type = other RNA
tccgaagaacccggcgacgactgcatctccagaacccaactcctaaaaacagaaacagccgaaattcacgacgacaactacggcggccccggagacaaaatcaccatttgcaacggctccaccatcgtcgaccaacgattaggctccgaactcggctgctacaccatcaatcgcgtcaaatccttcaaactctgcgaaaactccgccaccggcaaaacctgcgaaatcgactccacccccgtaaaatgccgccaaggcttctgcctaaaaatcacccaagaaggccgcggacacgtaaaactctcccgcggctccgaagtagtcctcgacgcctgcgactcctcatgcgaaatcatgatccccaaaggcaccggcgacatcctcgtcgactgctcaggcggccaacaacacttcctaaaagacaacctaatagacctcggctgcccccacatccctctactcggcaaaatggcaatctacatctgccgcatgtcaaaccaccctcgcaccacaatggccttccttttctggttctcattcggatacgtcatcacctgcatcttctgcaaagctctattctactccctcatcatcatcggtacactcggtaaaaaaatcaaacaataccgcgaactcaaaccccaaacctgcaccatatgcgagaccgccccagtcaacgcaatcgacgccgaaatgcacgacctcaactgcagctacaacatatgcccttactgcgcctcccgactaacttccgacggcctcgcccgtcacgtcacccaatgccccaaacgaaaagaaaaagtagaagaaaccgagctctacctcaacctcgaacgcattccctggatcgtacgcaaacttctccaagtctcagaatccacaggcgtagccctcaaacgctgtagctggctcatcgtcctcctcgtcctccttaccgtctctctgtcacccgtacaatcagcccccgtcgga

SEQ ID NO: 15667 - RNA, 972 nt, synthetic construct
  misc_feature 1..972: note = derived and/or modified CDS sequence (opt11) from CCHFV(Ast137)__KX056057.1__Gn
  source 1..972: mol_type = other RNA
tcagaagaacccggcgacgactgcatcagccgcacccaactcttaaaaaccgaaaccgccgaaattcacgacgacaactacggaggcccaggagacaaaatcaccatatgtaacggctccaccatcgtcgaccaacgcctcggctccgaactcggctgctacacaatcaaccgcgtcaaatccttcaaactctgcgaaaactccgccaccggaaaaacctgcgaaatcgacagcacccccgtcaaatgccgccaaggattctgcctaaaaataacacaagaaggccgcggccacgtcaaactctcccgcggctccgaagtcgtcctcgacgcctgcgactcctcctgcgaaatcatgataccaaaaggcaccggagacatactcgtcgactgctccggaggccaacaacacttcctcaaagacaacctcatcgacctcggctgcccccacatacccctcctaggcaaaatggccatccacatttgccgaatgtccaaccacccacgcaccactatggccttcctcttctggttctccttcggctacgtcataacctgcatcttctgcaaagcactattctactccctcataatcatcggcaccctcggcaagaaaatcaaacaataccgcgaactaaaaccccaaacctgcaccatctgcgagaccgcacccgtcaacgccatcgacgccgaaatgcacgacctcaactgctcctacaacatctgcccctactgcgcctcccgcctcacatccgacggcctcgcacgccacgtcacacaatgccccaaacgcaaagaaaaagtcgaagaaaccgaactgtacctcaacctcgaacgcatcccctggatcgtccgcaaactcctgcaagtatctgaatcaaccggcgtcgccctaaaacgctccagctggctcatcgtcctcctcgtactcctcaccgtctccctctcacctgttcaatccgcacccgtcggt

SEQ ID NO: 15668 - RNA, 972 nt, synthetic construct
  misc_feature 1..972: note = derived and/or modified CDS sequence (opt11) from CCHFV(Ast133)__KX056060.1__Gn
  source 1..972: mol_type = other RNA
tccgaagaacccgacgacgactgcatatcacgaactcaactcctcaaaaccgaaacagccgaaatccacgacgacaactacggcggccccggcgacaaaatcaccatctgcaacggctccaccatcgtcgaccaacgcctcggctcagaactcggctgctacaccatcaaccgcgtcaaatccttcaaactatgcgaaaacagcgccaccggcaaaacctgcgaaatcgactcaacccccgtcaaatgccgtcagggcttctgcctcaaaatcacccaagaaggcagaggccacgtcaaactaagccgaggctccgaagtcgtcctcgacgcatgcgactcctcatgcgaaatcatgatccctaaaggcactggcgacatactagtcgactgctccggaggccaacaacacttcctaaaagacaacctaatcgacctcggatgcccccacatacccctactcggcaaaatggctatctacatctgccgcatgtcaaaccacccccgcacaaccatggccttcctcttctggttctccttcggatacgtcataacctgcatattctgcaaagccctattctacctcctaataatcataggcaccctcggtaaaaaaatcaaacaatacagagaactcaaaccccaaacctgcaccatctgcgaaacagcccccgtcaacgccatcgacgccgaaatgcacgaccttaactgcagctacaacatctgcccatactgcgcctcccgcttaaccagcgacggcctcgcacgacacgtcacccaatgccccaaaagaaaagaaaaagtcgaagaaaccgaactgtacctcaacctagaacgaatcccatggatcgtccgcaaactactccaagtctcagaatccaccggcgtagcccttaaaaggagctcatggctcatcgtcctcctcgtcctcctaaccgtctcactctcacccgtccaatccgccccagtcgga

SEQ ID NO: 15669 - RNA, 972 nt, synthetic construct
  misc_feature 1..972: note = derived and/or modified CDS sequence (opt11) from CCHFV(SK/2015/human)__KX458183.1__Gn
  source 1..972: mol_type = other RNA
tccgaagaatcaggcgacgactgcatctcccgaacccgcctccttcgaaccgaaacagccgaaatccacggagactcctacggcggacccggcgacaaaatcacaatctgcaacggctccaccatagtcgaccaacgcctaggaagcgaaatgggctgctacacaatcaaccgagtcaagagcttcaaactatgcgaaaattccgccaccggtaaatcctgcgagatcgactcgatccccgtccgctgccgacaaggatactgccttaaaataacccaagaaggacgcggccacgtaaaattaagccgaggctccgaagtcgtcctagacgcatgtgacagctcctgcgaagtaatgatcccaaaaggcaccggcgacatcctcgtagactgctccggcggccaacaacacttcctcaaagacaacctcatcgacctcggctgcccaaacatacccctactaggcaaaatggccatctacatatgccgaatgtcaaaccaccccaaaaccaccatggcattccttttctggttctccttcggttacgtcataacctgcatcctctgcaaagccatcttctaccttctaatcatcgtaggcacactcggaaaacgcttcaaacaataccgcgaactcaagccacaaacatgcacgatctgcgaaaccacccccgcaaacgcaatcgacgccgaaatgcacgacctaaactgcagctacaccatttgcccatactgcgcctcacgcctcacctccgacggcctcgcccgccacgtcacccaatgccctaaacgcaaagaaaaagtcgaagaaaccgaactctacctcaacctagaacgcataccctgggttgtccgcaaactacttcaagtctccgaatcaaccggcgtcgccctcaaacgatcctcatggctcattgtcctcctcgtcctcttcaccgtctccctctcaccagtccaatccgcccctatcgga

SEQ ID NO: 15670 - RNA, 972 nt, synthetic construct
  misc_feature 1..972: note = derived and/or modified CDS sequence (opt11) from CCHFV(YL16070)__KY354081.1__Gn
  source 1..972: mol_type = other RNA
gcagagggcggctcatcagactgcatatcccgtacccaactcgtcaaaaccgaagtcgccgaaatccacgaagactcctacggcggccccggcgagaaaatcaccatctgcaacggtagcacaatcgtcgaccaacgcctaggctcagaacttggctgctacaccataaaccgcgtcaaatcctacaaactatgcgaaaactccgcctccggcaaatcatgcgaaatagacagcattcccgtaaaatgcaaacaaggcttctgcctaaaaatcacccaagaaggccgaggccacgtaaaactctcccgaggcaccgaaatagtgctagacgtctgcgactccagctgcgaactaatgataccaaaaggcacaggagacatcctcgtagactgctcaggaggacaacaacacttcctccaaaacaacctcatcgacctcggctgccccaacgtacccctcctcggcaaaatggccatctacgtatgcagaatgtccaaccaccccaaaaccaccatggccttcctgttctggttctcctttggctacgtcataacctgcatcgtctgccgcgtactcttctacctcctaatcgccatcggcaccgtcggtaagaaactcaaacaataccgcgaactaaaaccccaaacctgcatcgtatgcgaatccgttccagtaaatgcaatagacgcagaaatgcacgaactcaactgctcgtacaacatatgcccatactgcgcctcacgcctctccacagacggcctcatccgccacgtcacgcaatgcccaaaacgccgagaaaaagtcgaagaaaccgaactcttcctaaacctcgaacgcataccatggctagtacgcaaactcctccaagtatccgaatccaccggcatggccctaaaacgctcctgctggatgatcacgctactcatcctactcctcgtctccatgtcccccgtccaatcagccccagtcggc

SEQ ID NO: 15671 - RNA, 972 nt, synthetic construct
  misc_feature 1..972: note = derived and/or modified CDS sequence (opt11) from CCHFV(UCCR4448)__KY484042.1__Gn
  source 1..972: mol_type = other RNA
tccgaagaaacctccgacgactgcatctcccgcacccaactactccgtaccgaaaccgccgaaatccacggcgacaactacggaggccccggcgacaaaatcaccatatgcaacggctccaccatcgtcgaccaacgactcggctccgaactcggctgctacaccatcaaccgagtaaaatccttcaaactctgcgaaaactccgccaccggcaaatcctgcgaaatcgactccgtcccagtcaaatgccgccaaggctactgcctccgcatcacccaagaaggccgcgggcacgtcaaactctcccgcggctccgaagtcgtcctcgacgcatgcgacacctcatgcgaaataatgataccaaagggcaccggcgacatactcgttgactgctcaggcggccaacaacacttcctcaaagacaacctcattgacctcggctgcccgaaaatccctctcctcggaaaaatggctatatacatctgccgcatgtccaaccaccccaaaacaacaatggccttcctattctggttctccttcggctacgtaataacctgcatcctctgcaaagctatcttctacctcctcataatcataggaaccctcggaaaacgcttcaaacaataccgagaactaaaaccccaaacatgcacaatatgcgaaaccacccccgtaaacgccatcgacgcagaaatgcacgacctaaactgctcatacaacatatgcccctactgcgcctcccgcctcacctccgacggcctcgcccgacacgtcacccaatgccccaaacgcaaagaaaaagtcgaagaaaccgagctctacctcaacctcgaaagaatcccctgggtcgtccgcaaactactgcaagtatccgaatccaccggcgtcgccctcaaacgctcctcatggctaatagtcctcctcgtcctcttcaccatctcactcagccccgtccaatccgcacccatctcc

SEQ ID NO: 15672 - RNA, 972 nt, synthetic construct
  misc_feature 1..972: note = derived and/or modified CDS sequence (opt11) from CCHFV(SPU 45/88)__KJ682809.1__Gn
  source 1..972: mol_type = other RNA
tccgaagaaagctctgacgactgcctcagccgaacacaactcctccgcaccgaaaacaccgaaatccactccgacaactacggcggcccaggcgacaaaatcaccatatgcaacggttccaccatcgtagaccaacgactaggctccgaactcggctgctacaccatcaatcgcgtaaaatccttcaaactctgcgaaaacagcgccaccggcaaaagctgcgaaatcgactccacccccgtacgctgccgccaaggattctgcctcaaaatcacacaagaaggccgcggccacgtcaaactatcccgcggctcagaagtcgtcctcgacgcatgcgactcctcctgcgaaatcatgattcccaaaggcaccggcgacatactcgtcgactgctccggcggccaacaacacttcctaaaagacaacctcgtagacctcggatgccccaacatccccctcctcggcaaaatggccatctacatctgccgaatgtccaaccaccccaaaaccacaatgggattcctattctggttttcattcggatacgtcataacctgcatcctctgtaaagtcatcttctacctccttatcgtcgtcggcacactcggcaagaaattcaaacagtaccgcgaactcaaaccccaaacctgcaccatctgcgaaaccactcccgtaaacgcaatagacgccgagatgcacgacctcaactgctcctacaacatctgcccctactgcgcctcacgcctcacatccgacggactcgcccgccacgtcatgcaatgccccaaacgcaaagagaaaatcgaagaaaccgaactctacctcaacctagaacgcatcccctggatcgtccgcaaactcctccaagtttccgaatcaaccggagtcgcgctcaaacgctcctcctggctcgtagtcctcctcgtcctactaaccgtctccctatcacccgtccaatccgctcccatcggc

SEQ ID NO: 15673 - RNA, 1932 nt, synthetic construct
  misc_feature 1..1932: note = derived and/or modified CDS sequence (opt11) from CCHFV(10200)__U39455.2__Gc
  source 1..1932: mol_type = other RNA
ttcctcgacagcaccgccaaaggcatgaaaaacctcctcaactcaacatccctcgaaacctcattatctatagaagccccctggggcgcaataaacgtccaatccacctacaaacccactgtatccacggccaacatcgccctatcctggtcgagcgtagaacatagaggtaacaagatcctggtatccggacgctcagagagcataatgaaacttgaagaacgcaccggcatctcctgggacctaggtgtcgaagacgcctccgagtccaaactcctcaccgtcagcgtaatggacctctcccaaatgtactcccccgtcttcgagtacctctccggggacagacaagtcgaagaatggccaaaagcaacctgcaccggagactgccccgaaagatgcggctgcacctcatccacatgcctccacaaggaatggccccactcccgaaactggcgctgtaacccaacctggtgctggggcgtcggcaccggctgcacatgctgcggactagacgtaaaagacctcttcacagactacatgttcgtaaagtggaaagtagaatacataaaaacagaagccatagtatgcgtcgaactgacctcacaagaacggcaatgctcccttatcgaagcggggacaagattcaaccttggccccgttacaatcaccctctccgaaccacgcaacattcaacaaaaactccctcccgagataatcactctccacccacgaatagaggaaggcttcttcgacctcatgcacgtccaaaaagtactctcggccagcacggtctgtaaactccaatcttgcacccacggggtccccggcgacctccaagtctaccacataggcaacctcctcaaaggtgacaaagtcaacggacacctcatccacaaaatagaaccccacttcaataccagctggatgtcatgggacggctgtgacctcgactactactgcaatatgggagactggccctcctgcacatacaccggagttacccaacacaaccacgccagctttgtaaacctcctcaacatcgagaccgactacaccaaaaacttccatttccactccaaacgcgtaacagcccacggcgacacacctcaactagacctaaaagcccgccctacatacggagccggagaaataaccgtactcgttgaagtcgccgacatggaattacacaccaagaaaatcgaaatatccggactgaaattcgcatctctcgcgtgcacaggctgctacgcctgctcaagctccatctcatgcaaagtcagaatccacgtagacgaaccagacgaactaaccgtccacgtcaaatcagacgacccagacgtagtcgccgcctcatccagcctcatggcccgaaaactcgagttcgggaccgactccactttcaaagcgttctccgccatgcccaagacctccctctgcttctacatcgtagaacgcgaacactgcaaatcatgctcagaagaagacaccaagaaatgcgtcaacacaaaacttgaacaaccacaatcgatcctgatcgaacacaaaggcacgatcatcggaaaacagaactcaacatgcacagccaaggcatcatgctggctcgaatcagtgaaatccttcttctacggtctcaaaaacatgctaagcgggattttcggcaacgtcttcatgggaatcttcctattcttagcccccttcatactcctaatcctcttcttcatgtttggctggcgcatactcttttgcttcaaatgctgccgccgaacacgcggactattcaaataccgccacctcaaagacgacgaagaaaccggatatcgcagaataatcgaaaaactcaacaacaagaaaggcaaaaacaagctcctcgacggagaaagactcgccgacggacgaatagccgagctcttttcaactaaaacccacatcggt

SEQ ID NO: 15674 - RNA, 1932 nt, synthetic construct
  misc_feature 1..1932: note = derived and/or modified CDS sequence (opt11) from CCHFV(IbAr10200)__AF467768.2__Gc
  source 1..1932: mol_type = other RNA
ttcctagactccacagccaaaggaatgaaaaacctgctcaacagcacatccctagaaacatccctatccatcgaagccccctggggagctatcaacgtccaatcgacctacaaacccacagtttccacagccaacatagcattatcctggagctctgtcgaacaccggggcaacaaaatacttgtatcaggacggtccgaaagcataatgaagctcgaggagcgtaccggcatctcatgggacctcggagtcgaagacgcgtccgaatccaaactcctcaccgtctcagtaatggacctctcccaaatgtactcacccgtcttcgagtacctctccggcgacaggcaagtaggagaatggccaaaagcaacctgcactggcgactgccccgagcgatgcggatgcacctcatccacttgcctccacaaggaatggccccacagccgcaactggcgctgtaacccaacttggtgctggggagtcggcacaggctgtacctgctgcggtctcgacgtcaaagacctcttcacagactacatgttcgttaagtggaaagtcgaatacatcaagaccgaagccatcgtctgcgtagaactaacctcccaagagcggcaatgctcccttatcgaagcaggcacccgattcaacctaggtccagtaaccatcaccctctccgaaccgagaaatatccaacaaaaactacctccagaaatcatcaccctacacccgagaatagaagaaggattcttcgacctaatgcacgtccagaaggtcttaagcgcctcaaccgtctgcaaactccaaagctgcacacacggagtccccggcgacctccaagtataccacataggcaacctcctaaaaggcgacaaagtcaacggacaccttatccacaagattgaaccccacttcaacacctcatggatgagctgggacggctgcgacttagactactactgcaacatgggcgactggccgtcatgcacctacaccggcgtcacacaacacaaccacgcctcatttgtcaacctcctcaacatagagaccgattacacgaaaaatttccacttccacagcaaacgcgtcacagcccacggcgacacaccccaactcgacctaaaagccagacccacctacggcgccggcgaaataacagtcctagtcgaagtcgccgacatggaactacacaccaagaaaattgaaataagcggccttaaattcgccagcctcgcctgcaccggatgctacgcctgctcaagcggcatctcgtgcaaagtccgcatccacgtagacgaacccgacgaactcacagtacacgtaaaatccgatgacccagacgtcgtagccgcctcatccagccttatggcccgaaagctggagttcggcacagactccactttcaaagccttctcagccatgcccaaaacctccctatgcttttacatcgtcgaacgcgaacactgtaagtcctgctccgaagaagacaccaaaaagtgcgtaaacacaaaactagaacaaccccaatccatcctcatcgaacacaaaggaaccatcatcggcaagcaaaattccacatgcaccgccaaagcatcgtgctggcttgaatccgtaaaatctttcttctacggcctcaaaaacatgctatccggcatcttcggcaacgtcttcatgggaatcttcctcttcctcgcacccttcatactactaatcctcttcttcatgttcggatggcgaatcctattctgctttaaatgctgccgccgaacccgcggcctctttaaataccgacatctaaaagacgacgaagaaacaggctaccgccgcatcatcgagaaactcaataacaagaaaggcaaaaacaaactcctcgacggagaacgattagcagaccgcagaatcgccgaactcttctccaccaaaacccacatcggc

SEQ ID NO: 15675 - RNA, 1932 nt, synthetic construct
  misc_feature 1..1932: note = derived and/or modified CDS sequence (opt11) from CCHFV(Turkey-Kelkit06)__GQ337054.1__Gc
  source 1..1932: mol_type = other RNA
ttccttgacagcatcgtcaaaggtatgaaaaacctcctcaactctacgtcactcgagacctcactatcaattgaagcaccatggggcgccatcaacgtccaaagcaccttcaaacccacagtatccaccgccaacatcgccctctcctggagctctgtcgtccaccgcggcaacaaaatccttgtcaccggacgctccgaatcaatcatgaagctcgaagaacgcacgggcgtcagctgggacctcggcgtcgaagacgcatcagagtcgaaactactaaccgtctcaataatggacctatcccaaatgtactcaccagtcttcgaatacctaagcggcgacagacaggtagaagagtggccaaaagcaacctgcacaggcgactgccccgaacggtgcggctgcacatccagtacctgcctccacaaagagtggtcacactcacgcaactggcgctgcaatccgacctggtgctggggcgtcgggacaggatgtacctgctgcggagtcgacgtcaaagacctcttcactgaccacatgttcgtcaaatggaaggtcgaatacataaaaaccgaagccatcgtatgcgtcgccctaacaagccaggaacgccaatgctccctcatcgaagcaggaaccagattcaacttaggacccgtaaccatcacgctctccgaaccccgaaacatacaacagaaactcccacccgaaatcataacccttcaccccaaaatagaagaaggcttcttcgacctcatgcacgtccaaaaagtactctccgcctccacagtctgcaaactacaaagctgcacccatggcatacccggcgacctccaagtctaccacatcggcaacctactaaaaggcgaccgcgttaacggccacttaatccacaaaatagaatcccacttcaacacctcctggatgtcctgggacggctgcgacctagactactactgcaacatgggcgactggcccagctgcacctacaccggagtcacacaacacaaccacgccgcgttcgtcaacctcctcaatatagaaacagactacacaaagacattccacttccactccaaaagagtaaccgcccacggcgacacaccacaactcgacctaaaagcgcgccccacatacggggccggaggcatcaccgtcctagtagaagtcgcagacatggagctacatacaaagaaagtagaaatatccggcctcaagttcgcatcactcgcctgcacaggctgttacgcttgttcatcaggcatctcatgcaaagtacgcattcacgtcgacgaacccgacgaactaaccgtacacgtcaaatcgtcagacccagacgtagtagcagccagcacgtcactcatggcccgaaagctcgagttcggaaccgattcaaccttcaaggccttctcagctatgcccaaaacctcactctgcttctacatcgtcgaacgcgaatactgcaaatcatgctcagaagacgacacccaaaaatgcgtagacacccgcctagaacaaccccaatcaatcctaatagaacacaaaggtacgataataggaaagcaaaacgatacctgcaccgcaaaagcatcctgctggcttgaatccgtcaaatcgttcttctatggcctcaaaaacatgctcggaagcgtattcggcaacctcttcatcggaatactcctgttcctcgcccccttcgtcctcctcgtcctattctttatgttcggctggaagatcctcttctgcttcaaatgctgccgtcgcacacgtggcctcttcaaataccggcacctaaaagacgacgaagaaaccggctaccgcagaatcatagagcgacttaattctaaaaagggcaagaaccgtcttctcgacggcgaccgcctcgctgaccgcaaaatcgcagaactattctccacaaaaacccacatcggc

SEQ ID NO: 15676 - RNA, 1935 nt, synthetic construct
  misc_feature 1..1935: note = derived and/or modified CDS sequence (opt11) from CCHFV(SR3)__AJ538199.1__Gc
  source 1..1935: mol_type = other RNA
ctcttcctcgacagcattgtaaagggaatgaaaaacctactaaactcaaccagcctagagacatcactctcaatcgaggccccctggggcgccatcaacgtccaaagcacatacaaacccaccgtaagcacggccaacatagccctatcctggtccagcgttgaacatagaggcaacaaggtcctcgtatcaggccgctcagaatccatcatgaaactcgaggaacgcacaggcatatcgtgggacctcggcgtcgaagacgcctcagaatccaaactactcaccgtatcagtcatggacctctcccaaatgtactcacccgtattcgaatacctcagcggcgaccgccaagtcgaagaatggccaaaagcgacatgcaccggagactgccccgagcgctgcggctgcacttcctccacgtgcctccacaaggaatggccccacagccgaaactggcgctgtaacccgacatggtgctggggcgtaggcaccggctgtacctgctgcggcctcgatgtaaaagatctcttcacagactatatgtttgtcaaatggaaagtcgaatacataaagaccgaagccatagtttgcgtcgaactgacctcacaagagcgccagtgctcactcatcgaggccggaacccgattcaaccttggcagcgtaacgataactctcagcgaaccacgaaacatccaacaaaaactcccacccgaaatcatcaccctacaccccaaaatcgaagagggcttcttcgacctcatgcacgtacaaaaagtcctctccgcgagcacagtatgcaaactccagtcatgcactcacggcgtaccaggcgacctacaggtctaccacatcggcaacctactcaaaggggaccgagtcaacggccacctaatccacaaaatcgaacaacacttcaacacctcatggatgtcgtgggacggatgcgacctagactactactgcaacatgggcgattggccctcctgcacatacacaggagtaacacaacacaaccacgcatcgttcgtcaacctcctaaacatcgaaacagattacaccaagaccttccacttccactccaaaagagtcacagcccatggcgacaccccacaactggacctcaaagcccgaccaacctacggagcgggcgaaatcacagtcctcgtcgaagtcgcagatatggagctccacaccaagaaaatcgagatcagcggcctaaaattcgccggactaacctgcaccggctgctacgcctgctcctccggcatctcatgcaaggtacgcatacacgtcgacgaaccggacgagctcaccgtccatgtcaaatcagacgaccccgatgtagtcgccgcatctagctcactcatggcccgaaaactagagttcgggaccgactccacattcaaagcattctccgccatgccaaaaacctccctatgcttctatatcgtggaaagagaatactgcaaatcctgcaacaaagaagacacccagaaatgcgttaacacaaaactcgaacaaccccaatcaatactaattgaacacaagggcaccatcatcgggaagcaaaacaatacctgcaccgccaaagcctcctgctggctcgaatcagtaaaatcattcttctacgggctcaaaaacatgctcggcggcatctttggcaacgtgttcatcggcatattcactttcctcacacccttcatactcctgatactcttcttcatgttcggatggcgaatcctcttttgcttcaaatgctgccgacgcacaagaggcctcttcaaataccgccatctaaaggacgacgaagaaacagggtaccgcaaaatcatcgagcgcctgaacaacaagaaaggcaaaaaccggctccttgacggcgaacgactagccgaccgaaagatcgccgaactgttctccactaaaacccacataggc

SEQ ID NO: 15677 - RNA, 1935 nt, synthetic construct
  misc_feature 1..1935: note = derived and/or modified CDS sequence (opt11) from CCHFV(UCCR4413)__KY484038.1__Gc
  source 1..1935: mol_type = other RNA
ttcctatccagcatcgtcaaaggaaagaaaaacctcctaaacagcgcttccctcgagacgtcgctctcaatagaagcaccctggggcgcgataaacgcacaaagcaccttcaaacccactatctccacagccaacatagcactatcatggtcatccgtcgaacaccgaggcaacaaagtcctcgtcagcggaagatcagaatccatcatgaaactcgaagaacgcaccggcatctcgtggaacctcggagtcgaagacgccagcgaaagcagaatgcttacggtttccgtcatggacctttctcaaatgtacttacccgtcttcgagtacctctcaggcgaccggcaagttgaagaatggcccaaagccacctgtacaggcgactgccctgagcgatgcggctgcacatcctccacatgcctccacaaagaatggccccattcccgcaactggcgatgcaaccccacctggtgctggggcgtcgggaccggttgtacctgctgcggcctagacgtaaaagacctcttcaccgactacatgttcgttaaatggaaagtcgaatacataaaaactgaggcaatcgtctgcgtagaactaaccagccaagaacgtcagtgctccctcatcgaagcagggactcgattcaacctcggtccggtcactatcaccctatccgaaccacgtaacatccagcaaaaactaccctccgagatcgtgaccctgcaccccaaaatcgaagagggcttcttcgacctgatgcacgtgcagaaagtactctccgcctcaacggtatgcaagctccaaagctgcacccacggagttgccggcgacctacaagtctaccacgttggaaatctcctcaaaggagacaaaatcaacggacactcaatccataaaatagaaccccacctcaacacatcctggatgagctgggacggttgcgaccttgactactattgcaacatgggtgactggccctcctgcacctacaccggcgtcacccaacacaaccacgcagccttcgtcaacctcttaaacatcgaaacggactacaccaagagcttccacttccactccaaacgcgtcaccgctcacggcgacacgccccaacttgacctaaaagcgcgccccatgtacggggccggcgaaatcaccgtcctcgtcgaggtagccgacatggaactccattccaaaaacatcgaaatctccggtctcaaattcgccagcctaacctgctccggctgttacgcatgctcctccggaatctcctgcaaagtccgcatccacgtagacgaacctgacgaactcgcagtccatgtcaaatcagacgacctcgacgttgtcgcggccagctcctccctcatggcccgaaaaatagagttcggcacagactccaccttcaaagccttctccagcatgcccaaagaatcactctgcttctacatagtcgaaagagacttctgcaaatcctgcgcagccgaagacacgcagaaatgcgttaaagctaaactggaacaaccccaatccatcctcatcgaacacaaaggaactatcataggaaaacaaaacgatacctgctccactaaaacatcctgctggctcgaatcattcaaatcattcttctacggtctcaagaacatgctctccggagtgtttggctcggccatcatgggcattcttctgttcctcgcccccttcatcctcctaatcctcttcttcttcttcggctggcgaatactcttctgcctccgctgctgccgccgtacacgaggactcttcaagtacaaacacataaaagacgacgaagaagccggctacaagaaaatcatcgaaaaactcaacaacaagaaaggcggaacctccaaactactcgacggagagcgccttgccgaccgaaaaatcgcagaactattctcaaccaaagctcacatcgga

SEQ ID NO: 15678 - RNA, 1932 nt, synthetic construct
  misc_feature 1..1932: note = derived and/or modified CDS sequence (opt11) from CCHFV(66019)__AB069669.1__Gc
  source 1..1932: mol_type = other RNA
ttcagcgactctatagtcaaaggtatgaaaaatctcctcaactcgacatcactggaaacctccctttccatagaagccccctggggcgctatcaacgtgcaatccaccttcaaacccaccgtcagtaccgccaacatcgcactctcctggtccagcgttgaacaccgcggcaacaagatattagtatccggacgctctgagagcatcatgaagctcgaagaacgcaccggaatcagctgggacctcggagtcgaagacgcgagcgagagcaaactcctaacagtcagcgtcatggacctatcccaaatgtacagcccagtgttcgaatacctcagcggcgaccgacaggtggaagaatggccaaaagcaacatgcaccgggaattgccccgatcggtgcggctgcaccagcagcacatgcctccataaggaatggccccacagcagaaactggcgctgcaacccaacctggtgctggggcgtcggaaccggatgtacctgctgcggcctcgatgtcaaggacctcttcaccgactacatgttcgtcaaatggaaagtcgaatatatcaaaacggaagccattgtctgcgtcgaactcaactcccaagaacgacaatgctcactcatcgaagcaggcaccagattcaacctaggccccgtaacaatcacgctatccgaaccgcgcaacatccaacaaaagctaccaagcgaaataatcaccctccacccgcgaatcgaagaaggcttcttcgacctgatgcacgtccaaaaagtactctcagccagcaccgtctgcaagctccaatcatgcacacacggcgtcccaggcgacctccagatctaccacatcggtaacctactaaaaggagaccgcgtcaacggccacctaatacacaaaatagaaccccactttaacacctcctggatgtcctgggacggctgcgatctcgactattactgtaacatgggcgactggccctcgtgcacctacacgggcgtcacacagcacaatcacgcagcattcgtcaacctcctgaacatcgaaaccgactacaccaaaaacttccacttccactccaaacgtgtcaccgcccacggcgatacaccccaactcgacctaaaagcacgcccgacctacggcgctggagaaatcactgtcttggtcgaagtagccgatatggaactccatactaagaaaatagcaatctccggcctgaaattcgcctccctcacctgtaccggatgctacgcctgctccagcggaatttcgtgcaaagtccgcatccacgtcgacgaaccggacgaactcacagttcacgtaaaaagcgaggaccccgacatagtcgcggcctcctccagccttatggcacgaaaactagagttcggcacagactccaccttcaaggctttctccgccatgcccaaaacctcactctgcttctacatcgtggaaagggaatactgcgaatcttgcagcaaagaggacacccagaaatgcgtcaacactaaactcgaacaaccccaatcaatactgatagaacacaaaggcacgataataggaaaacaaaacgatacctgcaccgccaaagcctcctgctggctagaatccgtaaaatcgttcttctacggcctgaaaaacatgctcagcggcatattcggaaacgtcttcataggaatattcctcttcctagcccccttcatcctactgatcttgttcttcatgttcggctggagaatcctcttctgcttcaagtgctgccgccgcacccgcggactcttcaaataccgctacctcaaagacgacgaagagtcaggataccgccgcatcatcgagcgactaaacaacaagaaaggcaaaaacaaactcctcgacggagaacgactcgcagaccgccgcatagccgaactattcagcaccaagacacatatcggc

SEQ ID NO: 15679 - RNA, 1932 nt, synthetic construct
  misc_feature 1..1932: note = derived and/or modified CDS sequence (opt11) from CCHFV(7001)__AB069670.1__Gc
  source 1..1932: mol_type = other RNA
ttcctagacaacatcgcaaaaggcatgaaatcactactgaactcaacatcactcgaaacatccctatccatagaagccccctggggagccataaacgtacaatcaacattcaaacccacagtcagcgccgccaacatcgctctctcatggtccagcgtggaacaccgcggcaacaagatcctcgtaagcggccggagcgaatctatcatgaaacttgaggaaagaaccggggtatcatggaacctgggagtcgaagacgcaagcgaaagcaagaccctgaccgtatccgtcatggacctctcacaaatgtactcccctgtattcgaatacctcagtggcgaccgccaagtggaagagtggcccaaagctacttgtacaggagactgccccgaaagatgcgggtgcacctcctccacctgtctccacaaggaatggccccacagcaggaactggcgctgcaaccccacctggtgctggggcgtcggaacaggctgtacctgctgcgggctagacgtcaaagacttcttcacagactacatgctagttaaatggaaagtcgaatacataaaaaccgaagcaatcgtatgcgtcgaactaacttcgcaggaacgccagtgctccctcatagaagcaggcacccgattcaacttaggccccgtcaccatcaccctgagtgaacctcgaaacgtacaacaacgactgcccccagaaatcgtaaccctccacccgaaaatcgaagagggcttctttgaccttatgcacgtacagaaaatcctctccgcatcaacagtatgcaaactccaatcctgcacccacggcgtcccaggagactttcaagtataccacgtcggcaacctcctccgcggcgacaaagtaaacggccactccatacacaagatcgaaccccactttaacacatcgtggatgagttgggacggctgcgacctagactacttctgcaacatgggagactggccctcctgcacatacaccggcgtcacccaacacaaccgcgccgcattcatcaacatgctaaacatagaaacggactacactaaaacattccacttccactccaaacgagtcacagcacacggagacacccctcaactagaccttaaagcgcgaccagcatacggagccggcgaagtcaccgtcctagtcgaggtcgccgacctcgaactacacacaaagaaactcgaagtctcgggcctcaagatagccagcctaacctgctccggatgctacgcatgctcctccggaatctcctgcaaggtaagaatccacgttaacgaaccggacgagttcaccgtccacgtacgcagctcggacccagacgtcgtagcagcaggctcctccctcatggcccgcaaaatagagttcggcgccgactccaccttcaaggcattctcttcaatgccaaaagactcactctgcttctacatcgtcgaaaaggactactgcagctcatgcaccgacgacgacacccaaaaatgcgtcaacaccaagctcgaccacccacaatccatcctgatagaacacaaaggaaccatcatcggcaaacagaacgatacctgctctaccaagacatcctgctggctagaaagcgtaaagggattcttctacggcctcaaaaacatgctatccggaatcttcgggaacgtattcttaggaatcttcctcttcctcgcaccgttcgtactcctaatcttcttctttttcttcggctggcgactactattctgcctaaaatgctgtagacgcaccagagggctcctaaaatacaaacacctcaaagacgaagaagaagccggctacaagaagatcatagagcgcctaaacggcaagaaaggcaaaagtcaactcttcgacggagaacgactagcagaccgcaaaattgcagagcttttctcaactaaaatacacatcggc

SEQ ID NO: 15680 - RNA, 1932 nt, synthetic construct
  misc_feature 1..1932: note = derived and/or modified CDS sequence (opt11) from CCHFV(75024)__AB069671.1__Gc
  source 1..1932: mol_type = other RNA
ttcctagactcaatagtcagaggaatgaaaaatcaactcaacagcacatccctcgagacctccctatccatcgaagccccctggggagccataaacgtacaatcgacctacaaaccaaccgtcagcaccgcaaacatcgccctcagctggtctagtgtcgaacaccgcgggaacaaaatactcgtatcgggccggtccgaatcaataatgaaactagaagaacggaccggcatatcatgggacttaggcgtcgaagacgcaagcgagtccaagctcctcaccgtgtccgtcatggacctctcccaaatgtactcccccgtcttcgagtacctctccggtgatcgacaagtagaagagtggcccaaggcgacatgcactggagactgcccggagcgctgtggatgcacaaccagcacttgcctacacaaagaatggccccacagcagaaactggcgctgcaaccctacctggtgctggggcgtcggaacaggatgtacctgctgcggcctcgacgtcaaagatctatttaccgactacatgatagtcaaatggaaagtcgaatacataaaaacggaagccatcgtatgcgtggaactaacatcgcaagaacgccaatgctccctcatcgaagcaggaacgcgcttcaacctgggaagcgtaacaatcaccctctcagaaccccgcaacatacaacaaaaactcccacccgagattatcactcttcacccccgcatagaagaaggcttcttcgacctcatgcacgtccaaaaagtcctaagcgcatccacagtatgcaagctccaatcgtgcacacacggcgtacccggcgacctccaggtctaccacgtaggcaacctcctaaaaggcgacaaagtcaacggccacctaatacacaaaatagaaccccacctaaacacctcatggatgtcctgggacggctgcgacctcgactactactgcaacatgggcgactggccctcttgcacctacaccggcgtcacccaacacaaccacgcatccttcgtaaacctactcaacatcgaaactgactacaccaaaagtttccacttccactcaaaacgcgtcaccgcacatggcgacacaccccaactcgacctcaaggcccgtcccacctacggcgcaggagagataaccgtactggtcgaagtcgccgacatggagttcacaccgaaaaagatagaaataagcggcctgaaatttgcctccctaacatgcacaggctgctacgcctgctcatccggcatctcctgcaaagtcagaatccacgtcgacgagccagacgagctcaccgtccacgtcaaatctgacgacccggacgttgtagccgcctccagctctcttatggcccgaaaactcgagttcggaacggattcaacattcaaagccttctcagccatgcccaaaacctccctgtgcttctacatcgtcgaacgcgaatactgcaagtcctgctccaaagaagacacccaaaagtgcgtcaacacaaaactcgaacagccccaaagcatcctgatcgaacacaagggcacgataatcgggaaacaaaacaacacgtgcactgccaaagcctcatgctggctcgaatccgtcaaatcattcttctacggcctcaaaaacatgttatcaggcatatttggcaacctcttcatgggcatattcttgttcctcgccccgttcatactactaatcctattcttcatgttcggctggcgaatcctcttctgcttcaaatgctgccgacgaacgcggggcctcttcaaataccgacacctcaaagacgatgaagagaccggataccgacgcataattgaacgactaaacaacaagaaaggcaagaacaaacttctcgacggcgaacgcctcgcggacaggcgaatcgccgaactcttctccacgaaaacgcacataggc

SEQ ID NO: 15681 - RNA, 1932 nt, synthetic construct
  misc_feature 1..1932: note = derived and/or modified CDS sequence (opt11) from CCHFV(7803)__AB069672.1__Gc
  source 1..1932: mol_type = other RNA
ttcctcgattccatcgtccgcggaatgaaaaaccccctcaacagcacgtccctcgagacatctctcagcattgaggcaccttggggagccataaacgtacaaagcacatacaaaccgaccgtatccaccgccaacatcgccctatcctggtcgtccgtcgaacacagagggaacaaaatcctagtctccggcaggtccgaaagcataatgaaactggaagaacgaaccggcatatcctgggacctgggcgtcgaggacgcatcagaatccaaactactcacagtaagcgtaatggacctctcgcaaatgtactccccagtttttgaatacctatccggggaccgacaagttgaagaatggcccaaagcgacctgcaccggcgactgccccgagcgctgcggctgcacaacgtcaacctgcctccacaaagaatggccccacagccgcaactggcgatgcaacccaacctggtgctggggcgtcggcacaggctgcacttgctgcggcctcgatgtcaaagacctgttcacagactacatgatcgtaaaatggaaagtagaatatatcaaaacgcgcggaatcgtatgcgtagaactcacaagccaagaaagacaatgctcgctgatcgaagccggtaccagattcaacctcggcagcgtcaccatcacactatcagagccccgaaacatccagcaaaaactcccaccagaaatcatcacccttcacccccgcatcgaggaaggcttcttcgacctaatgcacgtccaaaaggtactctccgcatccaccgtatgcaaactccaatcctgcacgcacggggtcccgggtgacctccaggtataccacgtcggcaacctcctcaaaggcgacaaagtcaacggccacctcatccacaaaatcgaaccccacctcaacacctcctggatgtcctgggacggctgcgacctcgactactactgcaacatgggtgactggccatcatgcacatacaccggagtgacccaacacaaccacgccagcttcgtcaacctgctgaacatagagactgactacactaaatccttccacttccactctaaacgcgtaaccgcccacggcgacactccccaattagacctgaaagcccgccccacctacggagccggcgaaatcaccgtccttgtcgaagtcgccgacatggaatttacccccaaaaagatcgagatctcaggccttaaattcgccagcctaacctgcacaggctgctacgcatgctcaagcggaatctcttgcaaggttcgcatccacgtcgacgaacccgacgaactcaccgtgcacgtcaaaagcgacgaccccgacgtcgtcgcagcctcttcatccctgatggcccgaaaactagagttcggaaccgactccacattcaaagccttctcagccatgccgaaaacctcgctatgcttctacatcgtagaacgggaatactgcaaaagctgcagcaaagaagacacccaaaaatgcgtcaacaccaaactcgaacagccccaatctattctcatcgaacacaaaggcaccataatcggcaaacaaaacaacacatgcaccgcaaaggcttcctgctggctagaatccgtgaaatcgttcttctacgggctcaaaaacatgctatccggcatcttcggaaactttttcatgggcatcttcttgttcctcgccccctttatcctgctcatcctctttttcatgttcggatggagaatactattctgcttcaaatgctgcagacgcacacgcggcctcttcaaataccgccacctaaaagacgatgaagaaaccggataccgacgcataatcgaacgccttaacaacaagaaaggcaaaaacaaactcctggacggagaacgcctcgcagaccgccgcatagccgaactcttcagcaccaaaacccacatcggc

SEQ ID NO: 15682 - RNA, 1932 nt, synthetic construct
  misc_feature 1..1932: note = derived and/or modified CDS sequence (opt11) from CCHFV(79121)__AB069673.1__Gc
  source 1..1932: mol_type = other RNA
ttcctcgacagcaccgcaaaaggcatgaagtccctactaaactcaacctccctagaaacctccctgtccatcgaagccccatggggagcaataaacgtccaatccacattcaaaccaactgtctccgcagcaaacatcgcattatcctggtcatccgtggaacaccgcggcaacaagatactcgtctccggacgctccgaatccatcatgaaactcgaagaacgaaccggtgtatcatggaacctcggggttgaagacgccagcgagtctaagacacttacggtcagcgtgatggatctaagccaaatgtactcacccgtcttcgaatacttgtcaggcgaccgccaagtcgaggaatggcccaaagcaacctgcacaggagattgccccgaacgatgcggttgtacctcctccacatgcctacacaaagaatggccccatagcagaaactggcgctgcaatcccacctggtgctggggcgtcggcacgggctgcacgtgctgcggcctagacgtaaaggactttttcaccgactacatgctagttaaatggaaagtcgaatacataaaaaccgaagccatagtatgcgtcgaactcacctcgcaagaacgccaatgctccttaatagaagccggcacccgtttcaacctcggccccgtaaccatcactctatccgaaccacgcaacgttcaacaacgactcccgcctgaaatcgtcacccttcaccccaaaatcgaagaaggctttttcgacctaatgcacgtacagaaaatacttagcgcaagcacggtctgtaaactccaatcatgcacacacggagtccccggcgactttcaaatctaccacgtcggcaacctacttcgcggcgacaaagtaaacggtcactccatccacaaaatagaaccccacttcaacaccagctggatgtcctgggacggctgcgacctcgattacttctgcaacatgggcgactggccgtcctgcacgtacacaggcgtgacacaacacaaccgagcagcattcattaacatgctcaatatagaaacagactacaccaaaaccttccacttccactccaaacgcgtaacagctcacggcgacaccccacaactagacctcaaagcacgcccagcatacggcgcgggcgaagtcaccgtacttgtcgaggtcgccgacctcgaactccacaccaaaaacctagaggtttctggcctcaaaatcgcctcacttacatgttccggatgctacgcctgctcctccggaatctcatgcaaagtacgcatccacgtaaacgaacccgacgaatttaccgtccacgtccgcagctccgaccccgacgtagtcgccgcgggctccagcctaatggcaaggaaaatagagttcggcgccgactcaacattcaaagcgttcagcagcatgcccaaagactccctatgcttctacatagtcgaaaaggattactgctcctcatgcaccgacgacgacacacaaaaatgcgtcaacacaaaactcgaccacccccaatccatactaatcgaacacaaaggcacaatcattggcaaacaaaacgatacctgctccaccaaaacctcctgctggctcgaatccgtcaaaggtttcttctacggcctcaaaaacatgctatccggcatattcggcaacgtcttcctcgggatattcctatttctcgccccattcgtcctcctaatatttttcttcttcttcggttggcgcctcctgttctgcctcaaatgctgccgccggacccgcggcctcctaaaatacaaacacctcaaggacgaagaagaagccggctacaagaaaataatagaacgcctcaacggcaagaaaggaaaatcgcaactcttcgacggcgaacgcctcgccgaccgcaagatagcagaacttttcagcaccaaaatccacatcgga

SEQ ID NO: 15683 - RNA, 1932 nt, synthetic construct
  misc_feature 1..1932: note = derived and/or modified CDS sequence (opt11) from CCHFV(8402)__AB069674.1__Gc
  source 1..1932: mol_type = other RNA
ttctcagactccatcgtcaagggaatgaaaaacctcctaaactccacatcgctagagacaagcctctcaatcgaagcaccttggggagccatcaacgtccaaagcaccttcaaacctaccgtcagcgcagcaaacatcgccctgagctggtccagcgtggagcaccgcggaaacaaaatcctcgtcagcggccgctccgaatcaatcatgaaactagaagaacggaccggcatatcctgggacctcggcgtcgaagacgcctcggaatccaaactcctaactgtcagcgtgatggatctctcacaaatgtactcacccgtattcgagtacctcagcggcgacagacaggtagaagaatggccaaaagccacatgcacaggagactgcccagaacgttgcggctgtacctcaagcacatgcctgcacaaggaatggccccactcacgaaactggcgctgcaacccaacctggtgctggggcgtaggaaccggctgcacatgctgtggcctcgacgtcaaagatctcttcaccgactacatgttcatcaaatggaaagtagaatacataaaaaccgaagcaatagtctgcgtcgaactcacctcacaagaacgccagtgcaccctcatcgaagccggcacacgcttcaacctcggcccggtaaccatcacactatctgaaccccgaaatatccagcaaaagctgcccccagaaatagtcaccctccaccccagaattgaagagggcttcttcgacctcatgcacgtacaaaaagtactaagcgcctccacagtctgcaaactacaatcgtgcacccacggggtgcccggcgacctccaagtctaccacatcggcaacctcctaaagggggacaaagtaaacggacacctaatccacaaaatcgaaccccacttcaacacctcatggatgtcatgggacggatgcgacctcgattattattgcaatatgggcgactggccctcgtgcacatacaccggagtaacccaacataaccacgccgccttcgtcaacatgctgaacatagaaaccgactacaccaagaacttccacttccactcaaaacgcgtcaccgcacatggtgacactccacaactcgacctcaaagcccgccccacctacggcgctggtgagataacagtcttggtggaagtagcagacatggaactccacaccaaaaagatagagatctccggcctgaaattcgccagcctaacctgcaccggctgctacgcctgctcctccggaatctcctgtaaggtccgcatccacgtcgacgaaccagacgagctaaccgttcacgttaaaagcgaggatccggacatcgtcgcagcctcaagctcactcatggcccgcaaactagagttcggaacagactccaccttcaaagccttctcggccatgcccaaaacctcgctctgcttctacatcgtggagcgcgaatactgcaaaagctgctccaaagaagatacacaaaaatgcgtcaatactaagctagaacaaccccaatcgatattgatcgaacacaagggtaccatcatcggcaaacaatccaacacttgcacagccaaggcatcatgctggcttgaatccgtaaaatcattcttctacggcctcaaaaacatgctctccggcatcttcggaaacgtattcatcggcgtcttcctcttcttcgcacccttcatactactaatcctcttcttcatgttcgggtggcgcatcctcttctgcttcaaatgctgccgacgcaccagaggcctcttcaaataccggcatctcaaagacgatgaagagaccggatacagaaaaataatcgaacgcctcaacaacaagaaagggaaaaacaaactcctagacggcgaacgcctcgccgaccgcaaaatcgccgaactcttctcaacaaaaacacacatcgga

SEQ ID NO: 15684 - RNA, 1932 nt, synthetic construct
  misc_feature 1..1932: note = derived and/or modified CDS sequence (opt11) from CCHFV(88166)__AB069675.1__Gc
  source 1..1932: mol_type = other RNA
ttcagcgactccatcgtcaaagggatgaaaaacctgcttaactcaacctccctcgaaacgtccctatcaattgaagccccctggggcgccataaacgtccaatccactttcaagcctaccatgtcagcggcgaacatcgcactttcttggagctccgtagaacaccgaggcaacaaaatcctggtatccggccggtcagaatccataatgaaactcgaagaacgcacgggcatatcctggaacctaggcgtcgaagacgccagcgaaagcaaactactcaccgtcagcgtaatggacctctcgcagatgtactcacccgtcttcgaatacctcagtggcgaccgccaagtcgaagaatggcccaaagcgacctgcactggcgactgccccgaacggtgcggctgcacttcatcaacctgcctacacaaagaatggccccacagccgcaattggcgctgcaaccccacatggtgctggggcgtcggcaccgggtgtacctgctgcggactagatgtcaaagacctcttcaccgactacatgttcatcaaatggaaagtagaatacataaaaacagaagcaatcgtgtgcgttgaactaaccagccaagaacgccagtgcaccctaatcgaggcagggacacgcttcaacctcggccccgtaaccatcacactctccgaaccccgcaacatccaacaaaaactaccacccgaaatcgtaaccctacacccccgcatagaagaaggattcttcgacctaatgcatgtgcagaaggtactctcagccagcacagtctgcaaactccaaagctgcacccacggagtacccggcgacctacaagtctaccacatcggaaacctcctaaaaggagacaaagtcaacggccacctcatccacaaaatagaaccccacttcaacaccagctggatgtcatgggacggctgcgacctcgactactattgcaacatgggagactggcccagctgcacgtacacaggcgtcacccaacacaatcatgccgccttcgtgaacatgctgaacatagaaaccgactacactaaaaacttccacttccactccaaacgcgtcaccgcacacggcgacaccccgcaactagatctaaaggcacgcccaacatacggcgccggagaaataaccgtcctagtcgaagtagcagacatggagctccacacgaagaaaatcgaaatctcaggacttaaattcgcatccctaacatgcaccggctgctacgcatgctcaagcggaatctcatgcaaagtccgcatccacgttgatgaaccagatgaactcacagtccatgtcaaaagcgaagaccccgacctcgtcgccgcctcgtcatccctcatggccaggaaactcgagttcggcacagactcgaccttcaaagccttctccgccatgccaaaaacctcactctgcttctacatagtggaacgagaatactgcaaatcatgcagcaaagaagacacccagaaatgcgttaacaccaagctagaacaaccgcagtcgatcctaattgaacacaagggaaccatcatcggcaagcaaaacaacacgtgcaccgccaaggcctcctgctggctagaaagtgtaaaatccttcttctacggactcaaaaacatgctctcgggcatattcggcaacgtattcatcggcgtcttcctcttcttcgccccattcatactactaatactgttcttcatgttcggctggcgcatcctcttctgcttcaaatgctgccggcgcacccgaggactattcaaataccgccaccttaaagacgatgaagaaaccggctacaggaaaataatcgaacgactcaacaacaaaaagggaaagaacaaactactcgacggagaaagactcgccgacaggaagatcgcagaattattcagcaccaaaacccacatcggc

SEQ ID NO: 15685 - RNA, 1932 nt, synthetic construct
  misc_feature 1..1932: note = derived and/or modified CDS sequence (opt11) from CCHFV(BA88166)__AF338470.1__Gc
  source 1..1932: mol_type = other RNA
tacttagacagcatagtcaaaggaatgaaaaaccttctgaactccacctcactcgaaacatccctgtccatcgaagccccatggggcgccataaacgtccaatcgaccttcaaaccaaccatgtcagctgccaacatagccctctcatggtccagcgtggaacaccgcggcaacaagatcctcgtatccggccgctccgaatcaatcatgaaactcgaagaacgcaccggcatctcatggaacctaggagtagaggacgccagcgaaagcaaactccttacagtaagcgtaatggacttaagccaaatgtactccccagtttttgaatacctgagcggggaccgccaagtcgaagagtggcccaaagcgacatgcaccggagactgtccagagcgctgcggctgcacctcctcaacctgcctacacaaagaatggccccactcccgcaactggcgctgcaacccaacctggtgctggggcgtaggaacgggatgcacatgctgcggactcgacgtcaaagacctcttcacagactacatgtttatcaagtggaaagtcgaatacataaaaacagaggcaatcgtatgcgtcgaactcaccagccaagagcggcaatgcacactcatcgaagcaggcacacgattcaacctaggccctgtcatcatcacactatccgagccacgaaatatccagcaaaaactacccccagaaatagtcactctgcacccccgcatcgaagaaggcttcttcgacctcatgcacgtacaaaaagtcctaagcgcctccaccgtatgcaaactccagtcatgcacccacggggtccccggcgaccttcaggtatatcacataggcaacctcctcaaaggcgacaaagtcaacggccacctaatccacaaaatagagccccacttcaatacatcatggatgtcctgggacggatgcgacctagactactactgcaacatgggagactggccctcctgcacctacacaggcgtgacacaacacaaccatgcggcatttgtcaacatgttaaacattgaaaccgactacaccaaaaacttccacttccactcaaaacgcgtcactgcccacggtgacaccccacaactcgacctgaaagcacgacctacctacggcgccggcgaaattacagtcctggtagaggtcgccgacatggaactacacacaaagaaaatagaaataagcggactaaaattcgccagtcttacctgcaccggctgctatgcatgctcctccggaatttcctgcaaagtcaggatccacgtcgacgaacccgacgaacttaccgttcacgtcaaaagcgaggaccccgacatagtcgctgcctcctcttccctcatggcccgcaaactagagttcggtacagattctactttcaaagccttctcagccatgcccaagacctccctatgcttctacatcgtcgaacgcgaatactgcaaatcctgcagcaaagaagacacccagaaatgcgtaaacaccaaactcgaacaaccccaatcaatcctaatcgaacacaaaggcacaattataggcaaacagaataatacctgcaccgccaaagcctcttgctggctcgaaagcgtcaaatccttcttctacggcctcaaaaacatgctttctggcatattcggaaacgtcttcatcggcgtattcctcttcttcgcaccgttcatcctactcatcctcttcttcatgttcggatggagaatccttttctgtttcaaatgctgccgacgcacccgcggcctattcaaatacagacacctaaaggacgacgaagaaacaggataccgcaaaatcatcgagcgcctaaacaacaagaaagggaaaaacaaactcctagacggagagcgcctggcagaccgcaaaatcgcagaactattctccaccaaaacccacatcgga

SEQ ID NO: 15686 - RNA, 1932 nt, synthetic construct
  misc_feature 1..1932: note = derived and/or modified CDS sequence (opt11) from CCHFV(BA66019)__AF350448.1__Gc
  source 1..1932: mol_type = other RNA
ttcagcgacagtatcgtcaaaggcatgaaaaacctcctaaactcaacctccctcgaaacctccctctccatcgaagcaccatggggagccatcaatgtgcaatccaccttcaaaccgaccgtctctaccgcgaacatcgcactatcatggtctagcgtagaacacagagggaacaaaatcctcgtctcaggcagaagcgaaagcataatgaaactcgaagaaaggacaggcatttcctgggaccttggcgtagaagacgccagcgaaagcaaactcctaaccgtctcagtcatggacctctcccaaatgtattcccccgtcttcgaatacctgagcggcgaccgacaagtcgaagaatggcccaaagcaacctgcaccggggactgccccgaccgatgcggctgcacctcatcaacctgcctacacaaagaatggccccacagccgcaactggcgatgcaacccgacctggtgttggggcgtcggcacaggttgtacctgctgcggcctcgacgtaaaagaccttttcaccgactacatgttcgtcaaatggaaagtcgagtacatcaaaacagaagcaatagtctgcgtagaactcaactcgcaagaacgccaatgctccctcatagaagccggtactcgctttaacctcggcccagtcaccatcaccctatcggaaccacgcaacatccagcaaaaactcccgcccgagatcataaccctacacccccgaatcgaagagggcttcttcgacctcatgcacgttcaaaaagtcctcagtgcgagcacagtgtgcaaacttcaatcgtgcacccacggcgtaccaggcgacctccaaatctaccatataggcaacctactcaaaggcgacagagtcaatggccacctcattcacaaaatagaaccccacttcaacacatcatggatgtcttgggacggatgcgacctcgactactactgcaacatgggcgactggccctcatgcacatacaccggcgtgacccaacacaaccacgcagcctttgtcaacctccttaatatcgaaactgactacaccaaaaacttccacttccacagcaaaagggtcaccgcccacggcgacacacctcaactagacctcaaagcacgcccaacatacggcgccggtgaaatcaccgtcctagtagaggtagcggacatggagctacacacaaagaaaatcgccatctcgggcctcaaattcgcctccctcacatgcaccggctgctacgcctgctcctcaggcatctcttgcaaagtgcgcatccacgtagatgaaccagacgaactcacggtacacgtcaaatccgaagacccggacattgtagcagcctcctcctctctaatggcacgcaaactggagttcggaaccgactcgacattcaaagcattctccgctatgccaaaaacctccctctgcttctacatcgtcgaaagagaatactgcgaaagctgctccaaagaagacacccagaaatgcgtcaacaccaagctcgaacaaccccagtcaatactaatcgaacacaagggcacaatcatcggtaagcagaacgacacatgcacagctaaagcatcctgctggctcgaatcagtcaagagcttcttctacggacttaaaaacatgctctccggcatcttcgggaacgtattcatcggcatcttcctgttcctcgcaccattcatcctactaatcctcttcttcatgttcggatggcgtatcctgttctgcttcaaatgctgccgccgcacccgaggcctcttcaaataccgttacctaaaagacgacgaagaatccggctaccgccgaataatcgaacgtctcaacaacaagaaagggaaaaacaaactcctcgacggagaacgtctagccgaccgtcgaatagccgaactattttccacgaaaacacacataggc

SEQ ID NO: 15687 - RNA, 1932 nt, synthetic construct
  misc_feature 1..1932: note = derived and/or modified CDS sequence (opt11) from CCHFV(BA8402)__AF350449.1__Gc
  source 1..1932: mol_type = other RNA
ttcagcgatagcatagtcaagggcatgaaaaacctcctcaactctacatcactcgaaacctcactctccatcgaagcaccctggggcgctataaacgtgcaatccacgttcaaacccaccgtgtccgccgcaaacatagccctctcatggtcgtccgtagaacatcgagggaacaaaatcctcgtctccggccggtccgagtcgatcatgaaactcgaagagagaaccggaatatcctgggatctaggagtagaggacgcatccgagtccaaactcctcaccgtttccgtcatggatctctcgcaaatgtactcccccgtcttcgaatacctctccggcgatcgacaagtagaagaatggccaaaagcgacctgcaccggagactgccccgaacgctgcggctgcacctcatcaacctgtctccacaaagagtggccccactcccgaaactggcgctgcaacccaacctggtgctggggcgtcggaaccggctgtacctgctgcggacttgacgtcaaagacctcttcaccgactacatgttcatcaaatggaaagtcgaatacataaaaactgaagccatagtatgcgttgaactaacttcacaggagcgccaatgcacactcatcgaagccggcacccgcttcaacctcggccccgtcacgatcaccctaagcgaacctcgcaacatacagcaaaaactacccccagaaatcgtaaccctccaccctcggatcgaagaaggctttttcgacctcatgcacgtacaaaaagtcctcagcgccagcaccgtctgcaaactccaatcatgcacccacggcgtcccgggagatctccaagtctaccacattggcaacctcctcaaaggagacaaggtaaacggacacctaatacacaagatagagccccacttcaatacatcatggatgagctgggacggctgcgacctacactactactgcaacatgggcgactggccctcgtgcacgtacacgggagtcacacaacacaaccacgctgccttcgtaaacatgctcaacatcgaaacagactacaccaaaaatttccatttccactccaaacgcgtcacggcccacggcgacaccccgcaattagatctaaaggcccgacccacatacggcgccggcgaaataaccgtcctcgtcgaagtcgccgacatggaactccacaccaagaaaatcgaaatctccggcctcaaatttgcatccctcacctgtaccggatgctacgcctgttccagcggcatctcctgcaaagttcggatacacgtcgacgaacccgacgaactcactgtccacgtcaaatccgaagaccccgacatagtcgcagcaagcagctccctcatggcccggaaactggagttcggcaccgactccaccttcaaagcattctccgcaatgcccaaaacctccctatgcttctacatcgtagaacgcgaatactgcgaaagctgctccaaagaagacacacaaaagtgcgttaacacgaaactcgagcaaccccagtcgatcctaatcgaacacaaaggcaccatcatagggaagcaatcgaacacatgcaccgcaaaggcctcatgctggctcgaaagcgtcaagtcgttcttctacggactcaaaaacatgctctcaggaatattcggcaacgtcttcatcggcgtattcctctttttcgctccattcatcctactaattctcttcttcatgttcggctggcgcatactcttctgtttcaaatgctgccgacgcacccgtgggctattcaaataccgccacctaaaggacgacgaagaaacaggttacagaaaaatcatagaacgccttaacaacaagaaaggcaaaaacaagctcctcgacggcgaacgtcttgccgaccgaaaaatcgccgaactattctccaccaaaacacacatagga

SEQ ID NO: 15688 - RNA, 1932 nt, synthetic construct
  misc_feature 1..1932: note = derived and/or modified CDS sequence (opt11) from CCHFV(Matin)__AF467769.2__Gc
  source 1..1932: mol_type = other RNA
ttcctcgactcaatcataaaaggcatgaaaaacctcctgaactcaacatccctagaaacctccctcagcatagaagccccatggggcgcaatcaacgtacaatctacattcaaaccgaccatgagcgccgccaacattgcactctcctggagcagcgtagaacacagaggaaataaaatactggtctctggacgcagcgaatccatcatgaaacttgaagaacgcacagggatctcatgggacctcggcgttgaggacgcgtccgaatccaagctcctaaccgtcagcgtaatggacctgtcccaaatgtactccccagtattcgagtatctctcaggagaccgccaagtcgaagaatggcccaaagctacttgcaccggcgactgccccgaacgatgcggctgcaccagctcgacctgcctacacaaggagtggccacactcccgcaactggcgatgcaaccccacatggtgctggggcgtcggtacaggatgtacctgctgcggactcgacgtcaaagacctattcaccgactacatgtttgtaaaatggaaggtcgaatacataaaaaccgaagtcattgtatgcgtcgagctcacatcccaagaacgccagtgctcactcatcgaagccggcacccgattcaacctcggccccgtcaccatcaccttatccgaaccacgcaatatccaacaaaagctcccacccgaaatagtgaccctacacccacgcatagaagagggattctttgacctcatgcacgtccaaaaggtcctctccgcctccacagtctgcaaactgcaatcgtgcacccacggcgtacccggcgacctacaagtgtatcacataggcaacctactgaaaggggacaaagtaaacggacacctaatccacaaaatagaaccccacttcaacacctcctggatgtcctgggacggctgcgacctcgactactattgcaacatgggcgattggccatcatgctcgtacacgggcgtaacccaacacaaccacgccgctttcgtcaacatgctgagcatcgaaacagactacaccaagaacttccacttccactcaaaacgcgtaaccgctcacggcgacaccccgcagctagacctcaaagcacggccaacctacggcgccggagaaatcaccgtcctcgtagaagtcgcagacatggaactacataccaaaaagatcgaaatctctggtctaaaattcgcatccttaacatgcacgggatgctacgcgtgcagctcagggatatcctgcaaagtccgaatccacgttgacgaaccagacgaactcaccgttcacgtcaaatccgaagaccccgatatcgtcgccgcctctagctccctaatggcccgaaaactcgagttcggcaccgactccacctttaaagcattttcagcaatgccaaaaacatctctctgcttctacattgtggaacgtgaatactgcaaatcctgcagcaaagaagacacccaaaaatgcgtcaacaccaaactagaacaaccccaatccatcctaatcgaacacaaaggaaccatcatagggaaacaaaacgacacatgcacggccaaagcatcctgctggctcgagtcagttaaatcattcttctacggactcaaaaatatgctatccggcatattcggcaatgtcttcattggcatctttctattcctcgcccccttcgcactcctgatactattcttcatgttcggctggcgcatactcttctgcttcaaatgctgcagacgcacacggggactcttcaaataccgccacctaaaggacgacgaagaaaccggctatcgaaaaatcatcgaacgcctcaacaacaagaaaggcaaaaacaaactactcgacggcgaacgcctagccgacagaaaaattgctgaattattctccaccaaaacccacgtcgga

SEQ ID NO: 15689 - RNA, 1932 nt, synthetic construct
  misc_feature 1..1932: note = derived and/or modified CDS sequence (opt11) from CCHFV(Baghdad 12)__AJ538197.2__Gc
  source 1..1932: mol_type = other RNA
ttcctagactccatcgtcaagggaacaaagaacctgctcaactccacctccctcgagacaagcctctccatcgaggccccatggggcgcaatcaacgtccaatccacctacaaacccacagtctctaccgcaaatatcgccctctcctggtcctcagtggaacaccgtgggaacaaaatcctcgtatccggccgctccgaatcaatcatgaaactggaagagaggacgggcatctcctgggacctcggcgtcgaggacgctagcgaaagcaaactactaaccgtttctgtcatggatctcagccagatgtactcgccagtcttcgaatacctcagcggggaccgacaagtcgaagaatggcccaaagcgacctgcaccggcgactgcccagaacgctgcggctgtaccacatcaacctgcctacacaaagaatggccccactcccgcaactggcgatgcaacccgacctggtgttggggcgtcggaacaggctgtacctgctgcggcctcgacgtcaaagacctcttcaccgactacatgttcgtcaaatggaaagtcgagtacatcaaaacagacgccatcgtatgcgtcgaactgacatcccaagagcgccaatgctccctcatcgaagccggcacacgcttcaacctcggctccgtcaccatcaccctttccgaaccacgcaatatccaacaaaaactaccacccgaaatcatcaccctccacccacgaattgaggagggattcttcgacctaatgcatgtgcaaaaagttctctccgcctccaccgtctgcaaacttcaatcctgcacgcacggcgtacccggcgacctccaagtctaccacatcggcaaccttttgaaaggcgacaaagtaaacggacacctcatccacaagatcgaaccccacttcaacacctcgtggatgtcctgggacggctgcgacctcgactactattgcaacatgggagactggccctcctgcacttacactggcgtaacccaacataaccacgcgtcattcgtcaacctgctcaacatcgagacagactatacaaagagcttccacttccactccaaacgagtaaccgcccacggcgatacaccccaactagacctcaaggtccggccaacctacggcgccggagaaatcaccgtactcgtagaagtcgcagacatggaactccacactaaaaagatcgagatctcgggcctaaaattcgcgtcactaacctgcacaggatgctacgcctgctcgtctggtatctcctgcaaagtccgaatccatgtcgacgaacccgacgaactcaccgttcatgtcaaaagcgatgaccccgacgtcgtagcggcatcgtcctcactaatggccagaaaactggagttcggcacagactcaacattcaaggctttctctgccatgcccaaaacatcactttgcttttacatcgtcgaacgcgaatactgcaaatcttgctctaaagaagacacccaaaaatgcgtcaacaccaaactcgaacaaccccaatccatcctcattgaacacaaaggcaccatcatcggcaaacaaaacaatacctgcacagccaaaaccagttgctggcttgaatccgtcaaatccttcttctacggactcaaaaacatgctctcaggcatattcggcaacttctttatgggcatcttcctcttccttgctccgttcatacttctcatcctattcttcatgttcggctggcgcatcctcttctgcttcaaatgctgccgccgaacaagaggactctttaaataccgccacctcaaagacgacgaagaaacaggatacagacgaatcatagaacgcctaaacaacaagaaaggcaaaaacaaactactcgacggagaacgcctcgcggaccgccgcatcgcagaactcttctccacaaaaacccacatagga

SEQ ID NO: 15690 - RNA, 1932 nt, synthetic construct
  misc_feature 1..1932: note = derived and/or modified CDS sequence (opt11) from CCHFV(VLG/TI29414)__AY179961.1__Gc
  source 1..1932: mol_type = other RNA
ttcctggacagcatagtcaaaggaatgaaaaacctcctcaactccacaaacctcgaaacatcactcagcatcgaggcaccctggggagcaataaacgtccaatccacattcaaacccaccgtatccacggcaaatatagcattatcatggtcgtcagtcgaacaccgtggcaacaaaattctagtaaccgggaggagcgaatccatcatgaaactagaagaaagaaccggcgtctcctgggacctcggggtcgaagacgccagcgaaagcaaactactcacggtcagcataatggacctcagccaaatgtactcccctgtcttcgaatacctcagcggcgaccgtcaagtggaagaatggccgaaagcaacatgcacaggcgactgcccagagcgctgcggctgcacatccagtacctgcctacacaaagaatggccacacagcagaaactggcgatgcaaccccacctggtgctgggaagtgggcacaggctgtacctgctgcggctggaacgtaaaggacctattcaccgaccacatgttcgtcaaatggaaagtcgaatacataaaaaccgaagccatcgtgtgcgtagaactaacctcccaagaacggcaatgctccctcatcgaagcgggaacacgattcaacttagggccagtcaccataaccctgtccgaaccacgaaacatccaacaaaaactacccccagaaatcatcacgctccatccaaaagtcgaagagggtttcttcgacctcatgcacgtccaaaaagtccttagcgccagcaccgtctgcaaactccaatcctgcacccacggcatccccggcgacctacaagtctaccacataggcaacctcctaaaaggcgaccgagtcaacggccacctcatccacaaaatcgaaccacacttcaacacctcctggatgtcctgggacggctgcgacctcgactactactgcaacatgggcgactggccatcgtgcacctacacgggaatgacacaacataaccacgctgccttcgtaaacctcctcaacatcgaaacagactacaccaaaacattccacttccactctaagcgagtcaccgctcacggcgacacaccccaactagacctaaaagccagacccacctacggagccggagaaatcaccgtcctcgtcgaagtcgcagacatggaactccacaccaagaaagtcgaaatctcaggcctgaaatttgcctcacttgcgtgcactggctgctacgcttgctcctccggcatctcatgtaaagtccgcattcacgtcgacgaaccagacgaactgacagtacacgtcaaatccaacgatcccgacgtaatagcagcctccacaagcctcatggccagaaaactggagttcggcacagactctaccttcaaagccttcagcgccatgcccaaaacctccctgtgtttctacatcgctgaacgcgaatactgcaaatcttgctccgaagaagacacccaaaaatgcgtagacacaaaactcgaacaaccacagtccatactcatagaacacaaaggcaccatcataggcaagcaaaacgatacctgcacagcaaaagccagctgctggcttgaaagcgtcaaatccttcttctatggcctcaaaaacatgcttggctcagtcttcggaaacttctttatcggaatcctactcttccttgcacccttcgttctcctcgtcctcttcttcatgttcggctggaaaatactattctgcttcaagtgctgccgtcgcacccgaggcctcctcaaataccgactactaaaagacgacgaagaaaccggctaccgaaggataatcgaacgtctcaacaacaagaaaggcaaaaaccgacttctggacggagaacgcctcgccgatcgaaaaatagcagaactattcagcaccaaaacccacatcggc

SEQ ID NO: 15691 - RNA, 1932 nt, synthetic construct
  misc_feature 1..1932: note = derived and/or modified CDS sequence (opt11) from CCHFV(TADJ/HU8966)__AY179962.1__Gc
  source 1..1932: mol_type = other RNA
ttcctcgactccatcgtcaagggcatgaaaaaccctctaaacagcacctcactagaaacctcactaagcatcgaagcaccatggggtgccataaacgtccaatcgacatacaaaccaaccgtcagcacggccaacatagccctctcatggtccagcatagaacatcgtggtaacaacatactcgtatcaggacgaagcgaatcaatcatgaaactcgaagaacgcacagggatatctggcgacctaggggtcgaagacgcctcagaaagcaaactcctcaccgtctccgtcatggacctctcgcaaatgtactccccagtattcgagtacctctccggcgaccggcaagtagaagaatggcccaaagcaacctgcacaggggactgcccagaaagatgtggctgcacctcctccacatgcctccacaaagaatggccccatagccgcaactggcgctgcaaccccacttggtgctggggcgtcggcactggctgtacctgctgcggcctagacgtaaaagacctattcatagactacatgttcgtcaaatggaaggtcgactacattaaaacagaagccatcgtatgcgtagaactaaccagccaggaacgacaatgctccctcgtcgaagccggcacacgcttcaacctcggcccagtaacaatcaccctatcagagccccgaaacatacaacaaaagctccctcccgaaatcatcactctccacccccgcatcgaagaaggctttttcgacctcatgcacgtgcaaaaggtcctctcagcaagcaccgtctgcaaactccaatcgtgcacacacggagtccccggcgacctccaagtataccacatcggcaacctcctcaaaggagacaaagaaaacggccatctcatccacaagatcgaaccccacttcaacacctcgtggatgagctgggacggctgcgacctagactactactgcaacatgggcgactggccctcatgcacatacacaggagtaacccaacataaccacgcctccttcgtcaacctcctcaacatcgaaacggactacaccaagagcttccacttccactcgaaacgggtcaccgctcacggcgacacaccccaacttgacctcaaagcccgccccacctacggagccggcgaaatcaccgttctagtagaggtcgcagacatggaactccacaccaagaaaatcgaaataaccggactcaaattcgcatccctcacatgcacgggctgctacgcctgctcgtctgggatatcctgcaaagtacgtatccacgtcgacgagcccgacgagcttaccgtccacgtaaaatccgacgacccggacgtggtcgccgcctcgtcctccctaatggcacgcaaactggagttcggcacggactccaccttcaaagccttctccgctatgccaaaaacctccctatgcttctatatcgtagaaagagaataccgcaaaagctgcagcaaagaggacacccaaaaatgcgttaacaccaaactcgaacaaccccaatcaatattgatcgaacacaagggcactataataggcaagcaaaacaacacatgcaccgccaaggcctcctgttggctcgaatccgtaaaatctttcttctacggcctaaagaacatgttatccggcatcttcggaaacgtattcgtcggcatcttcctcttcctggccccattcatactccttatactatttttcatgttcggctggcgcatcctcagctgcttcaaatgctgcagacgcacacgagggctactaaaacaccgccatctcaaggacgacgaagagaccggctaccgacgaatcatcgaacgacttaacaacaagaaaggcaaaaataaactccttgacggcgaaagacttgcggaccgacgcatcgccgaactcttctccacaaaaacacacatcggt

SEQ ID NO: 15692 - RNA, 1932 nt, synthetic construct
  misc_feature 1..1932: note = derived and/or modified CDS sequence (opt11) from CCHFV(Hodzha)__AY223476.1__Gc
  source 1..1932: mol_type = other RNA
tttcttgactcaatagtcaaaggaaccaaaaacctactcaactcaacatcgctagaaacatccctctccattgaagcaccctggggagcaatcaacgtccaatcaacctacaagccgaccgtctcaaccgcaaacatcgccctgtcctggtccagcgtcgaacaccgcggcaacaagatacttgtctccggccgatccgaaagcattatgaagctcgaagaaagaaccggaatatcatgggacctcggggtcgaagacgcaagcgaaagcaaactccttaccgtgagcgtcatggacctctcccaaatgtactcaccagtcttcgaatacctcagcggagaccggcaagtagaagaatggccaaaagcgacatgcaccggcgactgcccagaacgctgcggctgcacctcctcaacctgccttcacaaagaatggccacactcccgcaattggcgctgcaaccccacttggtgctggggcgtcggaacaggatgcacatgctgcggcctcgatgtaaaggatctcttcacggattacatgttcgtcaaatggaaggtcgactacataaaaaccgaagcaatcgtttgcgtagaactcacctcccaggaacgacaatgctcactcgtcgaagcaggcacacgttttaacctgggcccagtcacaataaccctgtcggaacctcgcaacatccagcaaaaactaccccctgaaataatcacattgcacccccgcatcgaagaaggattcttcgacctaatgcacgtccagaaagtactgtccgcctcaacagtatgcaaactacaaagctgcacacatggagtccccggcgacctccaagtataccacatcggcaacctcctcaaaggcgacaaagtcaacggccacctaatccataaaatcgagcctcacttcaacacctcatggatgagctgggacgggtgcgacctagattactactgcaacatgggcgactggcccagctgcacctatacgggagtcacccagcacaaccacgcctcatttgttaacctactaaacattgaaacagactacacaaaatccttccacttccactccaaacgagtcaccgcccacggagacaccccacaactcgacctaaaagcccgccccacatacggtgccggcgaaatcacagtccttgtcgaggtcgcagacatggaactccacaccaagaaaatcgagataacaggcctaaaattcgcctccctaacctgcaccggctgctacgcatgctcctcaggtatctcatgcaaagtacgaatacacgtagacgaacccgacgaactaaccgtccatgtaaaatcagacgatcccgacgtagtcgccgcctccagttccctcatggcacgaaaattagagttcggcaccgactcaacgtttaaagcattctccgccatgcccaagacctcactatgcttctacatcgtagaacgagaatactgcaaaagctgctcaaaggaagatacccaaaaatgcgtcaacacaaaactcgaacaaccacaatcaatcctcatagaacggaaaggcaccataattggaaaacaaaataacacatgcacagccaaagcatcctgctggctagaatctgtaaagtcattcttctacggcctcaaaaacatgctctccggcatattcggcaacgtattcgtaggaatattcctattcctcgcccccttcatcctactaatcctcttcttcatgttcggatggcgcatactcttctgcttcaagtgctgccgcagaacccgcgggctattcaaatacaaacacctaaaggacgacgaagaaaccggctaccggcgaataatagaacgcctaaacaacaaaaagggcaaaaacaagctcctggacggcgaacgactggccgacaggcgcatagcggaactattctcaacgaaaacccacatcgga

SEQ ID NO: 15693 - RNA, 1932 nt, synthetic construct
  misc_feature 1..1932: note = derived and/or modified CDS sequence (opt11) from CCHFV(Kosovo/9553/2001)__AY675511.1__Gc
  source 1..1932: mol_type = other RNA
ttcctagactcgatagtcaaaggcatgaaaaacctacttaactcaaccagcctagaaaccagcctaagcatcgaggccccatggggcgccatcaacgtccagagcaccttcaaacccacagtctcgacagctaacatagcactttcatggtcatccgtcgaacaccgcggcaacaaaatcctcgtaacaggccgtagcgaatcaataatgaaattagaagaacgcacaggcgtcagctgggacctcggcgtagaggacgcatccgaatccaaactcctcacagtctcaataatggacctctcccagatgtactccccagtcttcgaatacctctccggcgaccgacaagtagaagagtggccaaaagcaacctgcaccggagactgcccagaacgatgcggctgcacctcctcgacctgcctccataaagaatggccacactcccgcaattggagatgcaaccccacatggtgttggggagtaggcaccgggtgtacctgctgcggagtcgacgtcaaagacctctttaccgaccacatgttcgtaaaatggaaagtcgaatacatcaaaaccgaagccattgtatgcgttgaactcacaagccaggaacgtcaatgctccctcatcgaagccggcacccgctttaacctcggaccagtcactattaccctatccgaaccacgaaacatccaacagaaactcccgcccgaaataatcaccctccaccccaaaatcgaagaaggcttcttcgacctcatgcatgtccaaaaagttctctccgcctccaccgtatgcaaactccaatcctgcacacacggaatccccggagacctacaagtataccacatcggaaatctactcaaaggagaccgagtaaacggacacctcatccacaagattgaaccgcacttcaacacatcatggatgagctgggacggctgcgacctcgactactactgcaacatgggcgactggccttcctgcacctacaccggagtcacccaacacaaccacgccgccttcgtaaatctactaaacatcgagaccgactacaccaaaacgttccacttccacagcaaacgagtcaccgcacacggagacacaccccaacttgatctaaaagcccgccccacctacggagccggcgaaatcaccgtgctcgtcgaagtcgccgacatggagctccacaccaagaaggtcgaaatctccggcctgaaattcgcatcccttgcatgcacaggctgctacgcctgctcgtctggcatatcatgtaaggtccgcatccacgtcgacgaaccggacgaactaacagtccacgtcaaaagctccgaccccgacgtcgtcgccgcttccacatccctcatggcacgcaaactcgagttcggcaccgactccactttcaaagccttctccgcaatgcctaaaaccagcctctgcttctacattgtagaaaaagaatactgcaaatcatgcagcgaagacgacacaaagaaatgcgtcgacaccaaactagaacaaccccagtccatactcatcgaacaccgcggaaccataataggaaaacccaacgacacctgtcccgcaaaaacaagctgctggctagaatcagttaaatccttcttctacggcctcaaaaatatgctagggtcggtattcggcaacttctttataggcatactacttttcctagccccattcttcctctggatgctctccttcatgttcggatggaaaatactattctgcttcaaatgctgccgccgcacacgcggcctcttcaaataccgacacctaaaagacgatgaagaaaccggctaccgcagaatcatagaaagactaaacaacaagaaaggcaaaaaccgattactcgatggagaaagactcgcagaccgaaaaatagcagaactcttttccaccaaaacacacatcggg

SEQ ID NO: 15694 - RNA, 1932 nt, synthetic construct
  misc_feature 1..1932: note = derived and/or modified CDS sequence (opt11) from CCHFV(SPU41/84)__AY900142.1__Gc
  source 1..1932: mol_type = other RNA
ttcctcgactcaatcgttaaaggcatgaaaaacctcctcaactcgacatcgctcgaaacctcgctctccatcgaagcaccctggggcgccataaacgtacaatcaacctacaaaccaaccgtatccacggcaaacatagcactctcctggtcctccgtcgagcaccgaggaaacaaaatcctcgtctcaggtaggtccgagtccatcatgaaactcgaggaacgaaccggcatctcgtgggacctcggcgttgaagacgcaagcgaaagcaaactcctcaccgtatccgtcatggacctatcgcagatgtactcccccgtattcgaatacctgagcggcgacagacaagttgaagagtggccaaaagcgacctgcaccggagactgccccgagcgctgcggatgtacatcgagcacatgcctccacaaagaatggccccacagccgcaactggcgctgcaacccaacctggtgctggggcgtaggaaccggctgtacctgctgcggcctcgacgtcaaagacctgtttaccgactacatgttcgtcaagtggaaagtcgaatacatcaaaacggaagccatagtgtgcgtcgaactaacctcgcaagaacgtcagtgctcactaatagaagccggaacgcgcttcaacttaggccccgtaacaatcacactatccgaaccccgcaacatccaacaaaaactaccacccgaaatcataaccctacacccgcgcatagaagagggtttcttcgacctaatgcacgtgcaaaaagtactctccgcctccacagtctgcaaactgcaatcctgcacgcacggtgtccccggcgatctccaagtctatcacatcggtaacctcctcaaaggcgacaaggtcaatgggcacctagtccataagatcgaaccccacttcaacacctcctggatgtcctgggacggctgcgacctggactactactgcaacatgggggactggccctcgtgcacgtacaccggcgtcacccagcacaaccacgcctccttcgtcaacatgcttaacatcgaaacggactacacaaagaactttcacttccactcaaaacgagtcactgcccacggtgatacaccccagctggacctgaaagcccgacccacctatggagccggtgagatcacggtcctagtcgaggtcgccgacatggaactccatacgaagaaaattgagatctccggactcaaattcacatcgctaacctgcacaggttgctacgcctgctcatctggaatatcttgcaaagtacggatccacgtcgacgaaccagatgaactcacagtccacgtcaaaagcgaggaccccgacgtagtcgccgcatcaagctccctcatggcccgcaaactggagttcggcacagactcgaccttcaaagcgttcagcgccatgcctaaaacctccctatgcttctacatagttgaacgcgaatactgcaaaagctgctcagaagaagacacccaaaaatgcgtcaacacaaaactcgaacagccccaatcaatcctcatagaacgcaaaggcacaatcatcggcaaacagaacaatacctgcaaagccaaggccggatgctggttagagagcgtaaaatcattcttctacgggctcaaaaacatgctttcaggaatcttcggaaacgttttcatcggcatctttctctttctcgccccattcatcctcctcatactattctttatgtttggctggcgcattctattctgcttcaaatgctgccgacggacacgcggactcttcaaataccgccacctcaaagacgacgaagagaccggctaccgtaagataatcgaacgcctaaacaacaaaaagggaaagaacaagctcctagacggggaacgcctcgctgaccgacgcatagccgaactcttctccacaaaaacccacatcggc

SEQ ID NO: 15695 - RNA, 1932 nt, synthetic construct
  misc_feature 1..1932: note = derived and/or modified CDS sequence (opt11) from CCHFV(UG3010)__AY900143.1__Gc
  source 1..1932: mol_type = other RNA
tacctagactcaatagccaaaggcatgaaatcactattaaactccaccaatctagaaacctccctctcaatagaagccccatggggagccatcaacgttcaatcgacattcaaaccgactgtaagcgcagcaaacatcgccctctcatggtcctccgtagaacaccgcggaaacaaaatcttagtctccggcagatccgaatccatcatgaaactcgaggagcgcacgggcatctcatggtccctcggagtcgaagacgcctccgagagcaaaactttaaccgtcagcgtaatggacctcagccaaatgtactccccagtattcgaatacctatccggcgatcgccaagtcgaagaatggcccaaagcaacctgtactggcgactgccaagaacgatgtggctgcacatccagcacatgcctccacaaggaatggccacatagccgcaactggcgatgcaaccccacgtggtgctggggagtcggaaccggatgcacttgctgtggccttgacgttcgagacctcttcacagattacatgatggtcaaatggaaagtagaatacgtaaaaaccgaagcaatcatgtgcgtggaactaacctcgcaagagcgccaatgctccctaatcgaggcaggaacccgatttaacctaggccccgtaacaatcacactatcggagccacgcaacattcaacaaagactccccagcgaaatcgttaccctccaccccaaaatcgaagagggcttcttcgacctcatgcacgtccaaaaagtactgtcagcctccaccgtctgcaagctccaatcctgcactcatggcgtccccggagacctccaagtataccacgtcggcaacctactaaaaggcgataaagtaaacggccactcgatccacaagatcgaatcccacttcaacacctcatggatgtcctgggacggctgcgacctagactacttctgcaacatgggagactggccctcctgcacctacaccggtgtaacccaacacaaccgcgcagccttcatcaacatgctcaacatagaaaccgactacacaaaaacatttcacttccattccaaacgcgtcacagcccacggagacacccctcaactagatcttaaggcacgtccaacctacggcgccggcgaagttaccgtactcgtcgaggtagccgacctagagctccacactaagaaaatagaagtctccggcttaaaatttgcatcactaacttgctcaggatgctacgcctgctcctccggcatctcatgcaaagttaggatacacgtcaacgaacccgacgagttcaccgtccacgtcaagtcctccgaccccgacgtggtcgccgccggttcttccctcatggcccgcaaaatcgagttcggcgcagactcgaccttcaaagccttctcctcaatgcccaagaactccctatgcttctatatcgtggaacgcgattactgctccagctgcaccaacgacgacacacaaaaatgcgtcgacaccaaactcgaacacccacagtccatcttgatcgaacacaaaggcaccatcatcggcaagcagaacgacacatgctcaaccaaaacctcctgctggctcgaatccgtaaagagcttcttctacggcctcaaaaatatgctaggaggcatcttcggaaacgtcttcctcggcatatttctgttcctagcacccttcgccctcctaatctttttcttctttttcggctggcgcctcctcttctgcctaaaatgttgccgccgaacccgcggcctcctcaaatacaaacaactcaaagacgaagaagaagccggctacaagaaaatcatcgaacgactcaacgacaagaaaggcaaaagccgactattcgacggcgaacgactcgccgaccgcaaaatagccgaactcttcagtaccaaaacccacatcggt

SEQ ID NO: 15696 - RNA, 1932 nt, synthetic construct
  misc_feature 1..1932: note = derived and/or modified CDS sequence (opt11) from CCHFV(Hy13)__AY900145.1__Gc
  source 1..1932: mol_type = other RNA
ttctccgactcaatagtcaaaggcatgaaaaaccttctcaactccacctccctcgaaacatcactatccatagaagccccctggggcgccatcaacgtacaatctactttcaaacccactgtttctgccgcaaatatcgccctctcctggtcttcagtcgaacaccgcggaaacaaaatcctagtctccggccgcagcgaatccatcatgaaacttgaggagcgcactgggatctcctgggacctcggcgtagaagacgcaagcgagtccaaactcctaaccgtcagcatcatggacttatcacaaatgtactcacccgtattcgagtacctaagcggcgaccgacaagtagaggagtggccaaaagcaacctgcaccggagactgccccgagcgctgcggctgcacctcatctacatgcctccacaaagaatggccccactcgcgcaactggcgctgcaacccaacctggtgctggggcgttggtacaggatgtacctgctgcgggctcgacgtcaaagacctgttcacagaccacatgttcgtcaaatggaaagtagaatacataaaaactgaagccatagtgtgcgttgaactgacctcgcaagagcgccaatgctcactcatcgaagcaggcacccgattcaaccttggccccgtaacaatcacactctccgaacccagaaacatccaacaaaaactcccacccgaaatcgtcaccctccatccgcggatagaagaaggcttcttcgacctcatgcacgtgaagaaagtcctgagcgcttccacagtgtgcaaactccagtcatgcacgcacggcgtccctggcgacctccaagtataccacatcggcaacctactcaaaggcgacaaggtcaacggccatctcatccacaagatcgaaccacacttcaacacctcctggatgagctgggatggctgcgacctagactactactgcaacatgggagactggccatcatgctcgtacaccggagtaacccagcacaaccacgccgcctttgtcaacatgctcaacatcgaaaccgactacacaaaaatcttccatttccacagcaagcgcgtcaccgcccacggagacacaccccaactcgacctcaaagcccgacccacctacggcgccggagaaattacggtactcgtcgaagtcgccgacatggaattacatactaagaaaatcgaaatcagcggccttaaattcgcctcacttacctgcacaggctgctacgcatgctcctcaggaatatcctgcaaagtccgaatacacgtcgacgaacccgacgaactcactgttcacgtcaaaagcgaagaccccgacatagtcgcggcctccagctccctaatggcccgcaaactcgagttcggcacagattcgaccttcaaagccttcagcgccatgcccaaaacctcactctgcttctacatcgtcgaacgggaatattgcaaatcctgcagcaaagaagacacccagaaatgcgtcaacaccaagctcgaacaaccccaaagcatactcatcgaacacaaaggcaccatcatcggcaaacaaaacgacacatgtacctccaaagcaggctgctggctagaatcagtaaaatcctttttctacggactcaaaaacatgctctccggcatattcggcaacgtgttcatcggaatcttcctattcctcgcacccttcatcctcctcatcctattcttcatgttcggctggcgcatcctcttctgctttaaatgctgccgccgcacacgtggcctattcaaataccgccatctcaaggacgacgaagaaaccggctacagaaaaataatcgaacgcctaaacaacaagaaaggcaaaaacaagctcctcgacggagaaaggcttgccgaccgcaaaatcgccgaactcttcagcacaaaaacacacatcggc

SEQ ID NO: 15697 - RNA, 1932 nt, synthetic construct
  misc_feature 1..1932: note = derived and/or modified CDS sequence (opt11) from CCHFV(Semunya)__DQ094832.1__Gc
  source 1..1932: mol_type = other RNA
ttcctcgactccatagccaagggcaagaaatcactcctcaactcaacaaaccttgaaaccagcctcagcatagaagcaccctggggagccataaacgtacaatcaaccttcaaaccaacagtaagcgcagccaacatcgccctatcctggtcatccgtagaacaccgcggaaacaaaatcctagtatccggccgctcggagagcataatgaaactcgaagaacgcacaggaatctcttggtcactcggcgtcgaagacgcatccgaaagtaaaacactaacagtatcagtaatggacctctcacaaatgtactcaccagtcttcgagtacctcagcggggacagacaagtagaagaatggccaaaagcaacatgcaccggagactgcccagagagatgcggatgcacctcatcaacctgcctccacaaagaatggccccactcccgcaactggcgatgcaacccgacatggtgctggggcgtcggcacagggtgtacatgctgcggactagacgtccgcgacctgttcacagactacatgatggtcaagtggaaagtcgaatacgtcaagacagaagccatcatgtgcgtggaactaacatcccaagaaagacaatgttccctcatcgaagccggcacacgatttaacctcggacccgtgactataacgctcagcgaaccgcgcaatgtacaacaacgacttccatccgaaatcgtaaccctacaccctaaaatagaagaaggatttttcgacctcatgcatgtccaaaaagtactcttctgcaaatacagcctgcaagccacatcatgcacccacggagtcccaggcgacctccaagtctaccacgtaggaaacctcttaaaaggcgacaaagtcaacggccacagtatccacaaaattgaaagccactttaacacctcatggatgagctgggacggctgcgacctcgactatttctgcaacatgggagactggccatcctgcacctacaccggtgtcacccaacacaaccgagcagccttcgtcaacatgctaaacatcgaaacggactacacaaaaacgttccacttccacagcaaacgcgtaactgcacacggagacaccccacaactcgacctaaaagcgagaccgacatacggggccggcgaagtcacagtactcgtagaagtcgcggacctcgaattacacaccaaaaagatagaggtctccggcctcaaattcgccagccttacgtgctccggctgttacgcatgctcgtccggcatctcctgcaaggtccgaatccacgtcaacgaaccggacgagttcaccgtccacgtaaaaagcaacgacccggacgtagtcgcagccgggtcctccctcatggcccgcaaaatcgaatttggcgcagacagcactttcaaagccttctcatccatgcccaaaaactcactatgcttctacatagtcgaacgagactactgctcctcctgcaccgacgacgacacccaaaaatgcgttaatatcaaactggaacacccgcaaagcattctaatcgaacacaaaggcacaatcatcggcaaacagaatgatacctgccccacaaaaacttcctgctggctagaatccgttaaatcattcttctacggactcaaaaacatgctaggaggcatattcggaaacgtattcctcggaatattcctatttctcgcccccttcgccctactcattctctttttcttcttcggctggcgcctactcttctgcctcaaatgctgccgacgcacacgcggcctcctcaaatacaaacaactcaaagacgaagaagaggcaggctacaagaaaataattgaacgcctaaacgacaagaagggaaagagccgcctcttcgacggagaacgcctcgcagaccgaaaaatagcaaaactcttctcaactaaaacccacatcggc

SEQ ID NO: 15698 - RNA, 1932 nt, synthetic construct
  misc_feature 1..1932: note = derived and/or modified CDS sequence (opt11) from CCHFV(SPU128/81/7)__DQ157174.1__Gc
  source 1..1932: mol_type = other RNA
ttcctagactccatagtcaaaggaatgaaaaacctcctaaactcaacctccctggaaacctcactctcaatcgaagcaccctggggcgccataaacgtacaatccacttacaaaccgacagttagcaccgcaaacatcgccctctcttggtcatccgtggaacaccgagggaacaaaatcctagtgtccggccgatccgaatccataatgaaactagaagaacgaaccggcatttcctgggacctcggcgtagaagacgccagcgaaagcaagctcctaacagtaagcgtaatggacctatcacaaatgtactctcccgtcttcgaatacctgagtggagaccggcaagtagaagaatggcctaaagcaacctgcacaggggactgccccgagcgatgtggatgcacctccagcacatgcctgcacaaagaatggccccactcccgcaactggcgatgcaacccaacctggtgctggggcgtcggcacaggatgtacctgctgcggcctagacgttaaagacctattcaccgactacatgttcgtcaaatggaaggtcgaatacattaaaacggaagccatagtatgcgtagaactaacctcccaggaacgacagtgctccctcatcgaagccggcacacgtttcaatctaggcccagtcacgatcacactctcggaaccccgcaacatccagcaaaagctcccgccagagatcataaccctccacccgcgaatcgaagaaggcttcttcgacctcatgcatgtacaaaaggtcctaagcgccagcaccgtctgcaaactgcaatcatgcacccacggcgtcccgggcgacctacaagtataccacatcggcaacctcctaaaaggcgacaaggtcaacggccacctcatacacaaaatcgagccccacttcaacacctcctggatgagctgggacggctgcgacctcgactactactgcaatatgggagactggccatcgtgtacatacaccggcgtcacccaacacaaccacgcttccttcgtcaatttactaaatatcgaaacagactacacgaaaaacttccacttccactccaaaagggtcaccgcccacggagacacgccacaactcgacctcaaagcacgcccgacctatggcgccggagaaatcacggtcctagtcgaagtcgcagacatggaacttcacaccaagaaaatcgaaatatcaggcctcaaattcgcctccctaacttgcactggctgctacgcatgctcgtccggcatctcatgcaaagtcagaatccatgtcgatgaaccagacgaactcacagtccacgtaaaaagtgacgaccctgacgtggtcgccgcatcctcatccctaatggcacgcaaactggagttcggtacggactccaccttcaaagccttctcagccatgccaaaaacctccctatgtttctacatcgtggaacgagaacattgcaaaagctgctcagaggaagacacaaagaaatgcgtcaacacaaaactcgagcaaccacaatccatactaatagaacacaaaggcacaatcatcggtaagcaaaatagcacatgcactgccaaagcatcctgctggctcgagagcgtcaaatccttcttttacggccttaaaaacatgctctcaggcatattcggcaacgtattcataggaatcttcctcttcctcggacccttcatccttctcatcctattcttcatgttcggctggcgcatcctcttctgcttcaaatgctgccgacgcacccgaggcctcttgaaataccgccacctcaaagaagacgaagagaccgggtaccggcgcatcatcgaacgcctcaacaacaagaaaggtaaaaacaaactcctcgacggcgaacgcctcgcagaccgccgcatcgcagaactcttcagcaccaaaacgcacatcggc

SEQ ID NO: 15699 - RNA, 1932 nt, synthetic construct
  misc_feature 1..1932: note = derived and/or modified CDS sequence (opt11) from CCHFV(ROS/HUVLV-100)__DQ206448.1__Gc
  source 1..1932: mol_type = other RNA
ttcctcgactccatcgtcaaaggaatgaagaacctcctaaactccacaagcctcgaaaccagcctgtccatcgaagccccttggggtgccatcaacgtacaatccacattcaaacccacagtaagcacggctaacatcgcactaagctggtcgagcgtagagcaccgaggcaacaaaattctcgtaacagggcgcagcgaatccatcatgaagctcgaggaacgaactggagtctcctgggacctaggagtagaggacgccagcgagtctaagctactaaccgtgtccataatggacctctcacaaatgtactcacccgtattcgaatatctctccggcgaccgacaagtggaagaatggcccaaagctacctgcaccggcgactgccccgaacgctgcggatgcacttccagcacctgtctccacaaagaatggccccacagccgaaactggcgatgtaaccccacatggtgctggggagtaggaaccggttgtacctgctgcggcgtagacgtcaaagacctattcacagaccacatgttcgtcaaatggaaagtcgaatacatcaaaacagaagccattgtctgcgtagaactcacatcacaagagaggcaatgcagtctcatagaagcaggtacacgattcaacctaggccccgtaaccatcacactgtcagagccccgaaatatccaacaaaaactcccgcccgaaatcattactctacacccaaaagtcgaggaaggcttcttcgacctcatgcacgtccaaaaagtactcagcgcgtccacagtctgcaaactccaatcctgcacccacggaatccccggcgacctccaagtctaccacatcggcaacctcctcaaaggagaccgcgtgaacggccacctcatccacaagatcgaaccacacttcaacacctcgtggatgtcctgggacggctgcgacctcgactactactgcaacatgggcgattggccatcctgcacatacacaggcgtcacacagcacaaccatgcagccttcgtcaatctcctcaacatcgaaacagactacacaaaaaccttccacttccactccaaacgcgtcacagcccacggagacacacctcaactagacctcaaagcacgacccacttacggtgccggcgaaatcacagtcctggtcgaggtagccgatatggaactccacaccaagaaagtagagatatcaggtctgaaatttgcctcactcgcttgcacaggctgctacgcctgctcctccggaatatcatgcaaagtacgaatccacgtcgacgaaccagacgaactcaccgtccacgttaaatcctccgaccccgacgtcgtcgccgcctccacctccctcatggcccgaaaactagagttcgggaccgactcaactttcaaagcattctcggcgatgccaaaaacctccctctgcttctacatcgtagaacgagaatactgcaaatcctgctcagaagaagacacccaaaaatgcgtcgacacaaaactcgaacaaccgcagtccatactaatcgaacacaaaggcaccataatcggcaaacaaaacgatacctgcacagccaaagccagctgctggctcgaaagcgtaaaatcattcttctacggcctcaagaacatgctaggctcagtcttcggaaacttcttcatcggcatcctcctattcctcgccccattcgtcctcctcgtcctcttcttcatgttcggatggaaaatcctcttctgcttcaaatgctgccgaagaaccagagggctcctaaaataccgcctcctgaaggacgacgaagaaaccggatacaggcgcataatcgaacggctgaacaacaagaaaggcaaaaaccgcctactcgacggcgaacgactagcagacagaaaaatagccgaactattctccaccaaaacccacatcggc

SEQ ID NO: 15700 - RNA, 1932 nt, synthetic construct
  misc_feature 1..1932: note = derived and/or modified CDS sequence (opt11) from CCHFV(AP92)__DQ211625.1__Gc
  source 1..1932: mol_type = other RNA
ttcctcgactcaatagccaagggagtcaaaaacctcctaaactcgacatcactcgaaacctccctatccatagaagccccctggggcgcaataaacgcccaatccacttacaaaccaacagccagttcagccaacatagcacttacgtggtcatccgtagaacaccgagggaacaaaatcctcgtatcgggccggagtgaaagcataatgaagctagaagaaagaaccggcatctcctggaaccttggcgtcgaagacgccagcgaatcacgaaccctaacaatctccgtcatggacctctcgcaaatgtactcgccagtcttcgaatacctcagtggcgaccgccaagtcgaagagtggcccaaagccacttgcacaggcaactgccccgaacgatgcggatgcacctcgtccacatgcctctataaggaatggccccacagcagaaactggcgctgcaaccccacctggtgctggggagtcggcacaggatgtacctgctgcggcctcgacgttaaagaactcttcaccgaccacatgctagtcaaatggaaggtagagtacatcaaaaccgaggcaatagtatgcgtcgaacttacatcccaagaacgtcaatgcagcctcatagaggccggaacgcgattctccctcggcccagtcacaatcaccctatcggaaccccgcaacatccaacaaaaactaccgccagagctcatcacacttcaccctaaaatcgaagacggctacttcgacctcatgcacgtccaaaaagtaatgtccgcctccactgtatgcaaactccaatcgtgcacccacggcgtcccaggcgacctacaaatctaccacgtcgggaaccttctcaagggcgaccgcgttaacggacacctcatccacaaggtcgaaccccacctaaacacctcctggatgtcttgggacggctgcgacctcgactacttctgcaacatgggggactggccatcctgcacatacaccggagtcacccagcacaaccacgccgctttcgccaacttactcaacatcgaaaccgactacacaaaaacattccatttccactccaaacgggtcaccgcccatggcgacaccccacagctagaccttaaagcacgcccccgctacggcgctggtgagatcacagtcctggtcgaagtcgcagacatggaactccacactaagaaagtcgaagtcacggggctaaaattcgcctccctgacatgctccggatgctatgcctgcagcagcgggatatcatgcaaagtccgaatacacgtcgacgaacccgacgaactcaccgtacatgtaaaatcctcagacccagacattgtcgcagcatcatcttcgcttatggcccgcaaaatcgagttcggagtagactcaacattcaaagcgttcagctcaatgccaaaagactcactctgcttctatatcgtcgaacgcgactactgcaactcatgcaagaacgaagagacacaacgctgcgtaaacgccaaactcgaacaacctcaatcaatcctaatcgagcacaccggaacaataataggcaaacagaacgatacctgcggaagcaggacctcctgctggctagacagctttaaatccttcttctacggactcaaatcaatgttatccggcatattcgggaacgtattcctgggtatattcctcttcctcgctccattcgcacttctactcttcttcttcttcttcggatggcgaatactcttctgcttcaaatgctgccgtagaacgcgcggcctattcaaataccgccatatcaaagacgacgaagaagtcgggtacaaaaagatcatcgaacgcctcaacaacaaaaagggcaaacatcgcctcctagacggagaacgactcgcagaccggaaaatagcagaactcttcagcacaaaaacacatatcggc

SEQ ID NO: 15701 - RNA, 1932 nt, synthetic construct
  misc_feature 1..1932: note = derived and/or modified CDS sequence (opt11) from CCHFV(ArD8194)__DQ211626.1__Gc
  source 1..1932: mol_type = other RNA
ttcctcgaccgaatagcaaaaggcatgaaatcactgctcaactcaacctccctcgagacatcactcagcatcgaagcaccatggggcgccataaacgtgcaatccaccttcaaaccaaccgtctccgccgccaacatagcactctcctggtcatcagtagaacacaaaggaaacaagatcctcgtgtcgggccggagcgaaagcataatgaaactagaggaacgcacaggcatctcatggtgcctaggtgtagaagacgcatccgagtccaagactctcacagtaagcgtgatggacctatcacaaatgtactccccagtcttcgaatacctatctggcgaccgacaagtcgaagaatggcccaaagccacttgcacaggggactgccccgaacgctgcggatgcacctcctccacttgcctgcacaaagagtggccccactcccgcaactggcgctgcaaccccacctggtgctggggcgtaggcaccggctgtacctgctgcggcctggacgtcaaggacctattcaccgactacatgcttgtcaaatggaaagtagaatacataaaaaccgaagccataatttgcgtcgaactaaccagccaagaaagacagtgctcattaatagaagctggcacccgctttaacctcggcccggtcaccataacactttccgaacccagaaatgtccaacaacggctcccacccgaaataataacactacaccccaaaatagaagaaggcttcttcgacctcatgcacgtacaaaaagtaatgagcgcctccaccgtatgcaaactccaatcctgcacccacggagtccccggcgacctccaggtctaccacgtcggcaacctcctcaaaggcgacaaggtcaacggacacagcatccacaaaatagaatcccacctgaacacatcctggatgagctgggacggatgcgacctagactacttctgcaatatgggggattggccatcctgcacatacaccggagtcacccaacacaaccacgccgccttcatcaacatgctaaacattgaaactgactacacaaaaaccttccacttccactcgaaacgcgtaaccgcccacggcgacacaccccaactcgacctaaaagcgcgccccgcctatggcgcaggcgaaatcaccgtcctcgtagaggtcgccgacctggaactccacaccaagaaaatcgaagtctccggactaaaattcgcctcactctcctgctcaggctgctacgcctgctcctcagggatatcctgcaaagtccgcatccacgtcaacgaaccagacgaatttaccgttcacgtcaaatctaacgaccccgacgtcgtagccgccggaagtagcctcatggcccgcaaaatcgaatcaggcgcagactcaaccttcaaagccttctcatccatgcccaaaaactccctttgcttttacattgtggaaagggactactgttcgagctgcaccgacgacgacacccaaaaatgcgtcgacattaaactcgaacacccccaatccatactgatcgaacacaaaggcaccataataggcaaacaaaacgatacctgcccaaccaaaacttcctgctggctagagagcatcaaaagtttcttctacggcctcaagaacatgctctccggtatattcggcaacgtcttcctgggcatgctcttattcctagcccccttcatcctcctcatcctcttcttcttcttcggctggcgacttctgttctgcctcaaatgctgccgccgtacccgaaaactactcaaatacaaacacctccgcgacgaagaggaaagtggctacaagaagatcatcgaacgcctcaacgacaagaaaggcaaaagccgcctcttcgacggcgaacgtctcgccgaccgaaaaatagccgaactattctctaccaaaacccacataggc

SEQ ID NO: 15702 - RNA, 1932 nt, synthetic construct
  misc_feature 1..1932: note = derived and/or modified CDS sequence (opt11) from CCHFV(ArD15786)__DQ211627.1__Gc
  source 1..1932: mol_type = other RNA
tcactagactcaatagccaaaggaatgaaatcacttctcaacagcaccagcctcgagacctccctctccatcgaagcaccctggggagccatcaacgtccaatctacattcaaacccaccatctcagcggccaacatagcactatcatggtcctcagtcgaacataaaggaaacaaaatactcgtatccggccgctccgaatccatcatgaaacttgaggaacgcaccggtatctcatggtgcctaggggtcgaggacgcgagcgaatccaagacactaaccgtctccgttatggacctctcccaaatgtactcccctgtcttcgaatacctgtccggcgaccgccaagtcgaggaatggccaaaagccacctgtaccggagactgtcccgaacgatgcggctgcacctccagcacatgtctccacaaagaatggccccactcccggaactggcgctgcaatccgacctggtgctggggcgtcggaaccggctgcacgtgctgcggactagacgtcaaagacctattcaccgactacatgcttgtcaaatggaaggtcgaatacataaaaaccgaagccatcatctgcgtcgaattaacctcgcaagaacgccaatgctcactcatagaagccggaacccgcttcaacctggggcccgtcacaatcacactctctgagccccgcaacgttcaacaacgcctcccacctgagatcataaccctgcaccctaaaatcgaagaaggcttcttcgacctcatgcacgtccaaaaagtcatgagcgcaagcacagtctgcaaactacaatcgtgcacccacggcgtacccggcgacctacaagtctaccacgtcggcaaccttctcaaaggcgacaaggttaacggccactccatacacaaaattgaatcacacctcaacacctcctggatgtcctgggacggatgcgatctagactacttctgcaatatgggcgactggccctcgtgcacctacaccggcgtgactcaacacaaccgagcagccttcatcaatatgttaaacatagaaaccgactacaccaaaaccttccacttccactcaaaacgcgtcaccgcccacggagacacaccccagctagacctaaaagcccgaccaacctacggagctggcgagatcacagtcctcgtcgaagtagcggacctcgaactacacacaaagaaaattgaggtttcaggactcaaattcgcctccctaacctgctccggatgctacgcatgctccagcggtatatcgtgcaaagttcgcatacacgtcaacgaaccggacgagttcaccgtccatgtcaaaagcaacgacccggacgtcgtagcagccggctccagcctaatggcacgaaaaatcgaatccggcgccgactcaacattcaaagcattctcgtcaatgcccaaaaacagcctatgcttctacatcgttgaacgagactattgctcctcctgcacagacgacgacacccaaaaatgcgtagacatcaaactcgaacacccacagtcaatcctcatcgaacacaaaggaaccataatcggtaaacaaaacgatacctgcccaaccaaaaccagctgctggctcgagagcatcaaatcgttcttctacggcctcaagaacatgctctccggcatcttcggaaacatctttctcggcatgctcttattcctagcccctttcgtcctccttatcctcttcttcttcttcggctggcgactcctattttgcctcaaatgctgccgaagaaccagaaaactcctcaaatacaaacacctccgagacgaagaagagtcaggctacaagaaaatcatagaacgcctcaacgacaagaagggcaaatcccgcctattcgacggagaaagactcgcggaccgcaaaatcgctgaactcttttccacaaaaacccacgtcggc

SEQ ID NO: 15703 - RNA, 1932 nt, synthetic construct
  misc_feature 1..1932: note = derived and/or modified CDS sequence (opt11) from CCHFV(ArD39554)__DQ211628.1__Gc
  source 1..1932: mol_type = other RNA
ttcctagactccaccgccaaatccatgaaatcactcctaaactccacatccctcgaaacctcgctttctatcgaggccccctggggagccataaacgtccaatccacattcaaaccgaccgcaagcacggccaacatcgcactctcatggtctagcgtggaacaccgcggaaacaaaatccttgtaaccggcagaagcgaatcaataatgaaactcgaggaacgaaccggaatctcatggaaccttggcgtcgaggacgcctcagaaagcaaaaccctcacagtctctgtcatggacctctcccaaatgtactcaaccgtcttcgaatatctgagcggagaccgacaagtagaggaatggccgaaagcaacatgtaccggagactgcccagaacgatgcggatgcacatcatcaacatgcctgcacaaggcatggccccactcccgtaactggcgatgcaaccccacctggtgctggggcgtcggcacgggctgtacctgctgcggtctagacgtcaaaaacttattcacggactacatgttaatcaaatggaaagtagagttcatcaaaactgaagctatcgtatgcgtagaactgaccagccaagagcggcagtgctcactcatcgaagccggcacccgcttcaacctgggacccgtcacaatcacactatccgaaccccgaaacatccaacagaaactcccacccgaactcgtcacactccacccccgcgtagaagaaggcttcttcgacctcatgcacgtccagaaagtactaagcgcctccaccgtatgcaaactccaatcctgcacacacggggtccccggcgaccttcaggtataccacgtgggcaacctactcaaaggggacaaaatcaacggaaactcattccacaaaatcgaaccaaacctcaacacttcctggatgtcctgggacggctgcgacctcgactactactgcaacatgggcgactggccctcgtgcacatacacaggcgtcacccagcacaaccacgccgcctttgtaaacctcctcaacatcgaaacggactacaccaaaaacttccacttccactcaaaaagggttacagcccacggcgagacaccccaactagaccttaaagcacgccccaaatacggggccggcgaagtaacagtcctagtcgaagtcgcggacatggaactacacaccaaaaagatcgagatctccggccttaaattcgctagcctcacttgcacaggctgctacgcctgctcatccggcatctcgtgcaaagtccggctgcacgtcgacgaacccgacgagctcacagtccacgtgaagagtgacgacccggacgtcgtagcagcctcgagcagcctcatggctagaaagatagaatttggaacggactccactttcaaagcgttctcaagcatgcccaaggacaagctatgcttctatatcgtcgaacgagactactgcagctcctgttcaaaggaagacacccaaaaatgcgtcaacgctaaactcgaacaaccccaatcgatcctcatcgaacacaagggcaccatcatcggaaaacaaaacgacacatgcaccgtcaaggcctcctgctggctcgaatcagtaaagtccttcttctacggcctcaaaaacatgctcggaggtatcttcggcaacgtcatactaggcatcatcatgttcctcgccccattcgccctccttctactcttcttcctatttggatggcgcatactcttctgtctccgctgctgccgcagaacccgcgggctattcaaatataaacatataaaagacgacgaagaatcaggatataaacgcataatagaacgcctaaacaacaaaaagggcaaaaacaaactctttgacggcgaacggctcgccgacaagaaaatagccgagcttttctcaacgaaaacgcacatcggg

SEQ ID NO: 15704 - RNA, 1932 nt, synthetic construct
  misc_feature 1..1932: note = derived and/or modified CDS sequence (opt11) from CCHFV(C-68031)__DQ211629.1__Gc
  source 1..1932: mol_type = other RNA
ttctccgacagcatcgttaaaggcatgaaaaacctcctcaactccacaagcctcgaaacatcactctcgatagaagcaccttggggcgccatcaacgtccaatccacgttcaaacccaccgtgtccgcggcaaatatcgccctctcatggtcatccgtcgaacaccgcgggaataaaatcctcgtgtccgggcgcagcgagtccataatgaaactcgaagaacgaactggaatctcgtgggacctaggcgtagaagacgcatccgaatccaaactcctcacggtcagcataatggacctatcgcagatgtactcccccgtcttcgagtacctctccggggaccggcaagttgaagaatggccaaaagcaacttgcacaggcgactgcccggaacgatgcggctgtacctcgagcacatgcctacacaaagaatggccccactcaagaaattggcgctgtaaccccacctggtgctggggtgtgggaacaggatgtacatgctgtggactcgacgtcaaagacctgttcacagactacatgttcgtcaagtggaaagtcgaatatatcaaaacagaagcaatcgtctgcgtcgaactcacatcgcaagagcgccagtgctccctcatagaagcaggtacacgcttcaacctaggccccgtaaccataacactcagcgaacctcgcaacatccagcaaaaactaccacccgaaatcgtgaccctacacccccgaatagaggagggcttctttgacctcatgcatgtgaagaaagtactaagtgcaagcacagtctgcaaactccaatcatgcacacatggcgtcccgggcgacctccaggtctatcacataggcaacctactcaaaggcgacaaagtgaacggacacctcatccacaaaatcgaaccccacttcaacacttcatggatgtcctgggacggatgcgacctcgactactactgcaacatgggcgactggccatcctgcagctacaccggagtgacccaacacaaccacgccgccttcgtcaatatgctgaacatcgagacagattacacaaaaatcttccacttccactcaaaaagagtcaccgcccacggcgatactccccaactagacctcaaagcgcgaccaacctacggcgccggcgaaatcacagtcctagtcgaagtcgccgatatggaactccacaccaagaaaatcgaaatctcaggcttaaaattcgcgtccctaacctgcacaggctgctacgcatgctcatcaggcatctcatgcaaagtaagaatccacgtcgacgaacccgacgaactcaccgtccacgtcaaatcagaagacccagacatagtagcggcatcctcctcactcatggcccgcaaactagagttcggcaccgactccacctttaaagccttttcagctatgccaaaaacctccctctgcttctacatcgtcgaaagagaatactgcaagtcctgtagcaaagaagacacccaaaaatgcgtcaacaccaaactcgaacaaccacaatcaatcctaatcgaacacaaaggaacaatcataggcaaacaaaacgacacatgtacttccaaagccggatgctggctagaatccgtcaaatcattcttctacggactcaagaacatgctcagcggcatcttcggcaacgtctttatcggcatattcctcttcctggctcccttcatactactaatcctcttcttcatgttcggctggagaatcctcttttgctttaaatgctgccgacgcacccgcggactcttcaaataccgccacctcaaggacgacgaagagaccggctaccgcaaaatcatcgaaaggctcaacaacaagaaaggcaaaaacaaactcctagacggcgaaagactagcagaccgaaaaatcgccgaactcttcagcaccaaaacacacatcgga

SEQ ID NO: 15705 - RNA, 1932 nt, synthetic construct
  misc_feature 1..1932: note = derived and/or modified CDS sequence (opt11) from CCHFV(Drosdov)__DQ211630.1__Gc
  source 1..1932: mol_type = other RNA
tttctggattcaaccgtcaaaggcatgaaaaatctactaaactcaacatcgctagagacatcactatccatcgaagccccttggggagcaatcaacgtgcaatcgacattcaaaccaacagtcagcacagcaaacatagccctatcctggagctccgtggagcatcgcggaaacaaaatcctcgtaaccggccgcagcgaaagcatcatgaaactcgaagaacggactggagtcagctgggacctcggagtcgaagacgccagcgagagcaaactccttaccgtctcaatcatggacttgtcccaaatgtactcacccgtattcgaatacctatcaggcgaccggcaagtcgaagaatggcctaaagcgacctgcaccggcgattgcccagaaagatgcggctgcacctcctcaacatgcctccataaagaatggccccacagccgcaattggcgctgcaaccccacatggtgctggggagtcggcaccggctgcacgtgctgcggagtcgacgtaaaggaccttttcaccgaccacatgttcgtaaaatggaaagtcgaatacatgaaaacagaagccatcgtgtgcgtggaactcacctcacaagaacgccaatgctccctcattgaagccggaacccgcttcaacctaggacccgtcacaatcacactctcagaaccacgcaacattcaacaaaaactaccgccagagatcataaccctacaccccaaaatcgaagaaggcttcttcgatctcatgcacgtacaaaaagtcttaagcgcctccaccgtctgcaaactacaatcatgcacccacggcatcccgggcgacctccaaatctaccacataggaaacctactcaaaggcgaccgtgtgaacggccacctaatacacaaaatcgaaccacacttcaatacttcctggatgagctgggatggatgcgacctcgactactactgcaatatgggtaactggccatcctgcacatacaccggagtaacccagcacaaccacgccgccttcgtcaacctcctcaacatcgagaccgactatacaaagacattccacttccactccaaacgcgtcaccgcacacggcgacacacctcagctagacctcaaagcaagacccacatacggcgcaggggagattacagtcctagtagaagtagccgacatggaactccacacaaagaaagtcgaaatctccggcctaaaattcgcctccttagtttgcaccggctgctacgcatgctcaagcggcatatcgtgcaaagtacgtatccacgtcgacgaacctgacgaactcacagtacatgtaaaatcctcagaccccgacgtagtcgcagcctccacatccctcatggcccgcaaactcgagttcggaacagactccatattcaaagcattctccgccatgcccaaaacctcactctgcttctacatagtcgaacgagaatactgcaaatcctgcagcgaggacgacaccaagaaatgcgtcgacaccaaactcgagcaaccccaatcaatcctcatagagcacaagggcactataatcggaaaacaaaacgacacatgcacagcaaaagcatcctgctggctagaatccgtcaagagcttcttctacgggctcaaaaacatgctcggatccgtgttcggcaacttctttgtcggcatcctactcttccttgcccccttcgtcctcctggtcctatttttcatgttcggctggaaaatcctcttctgcttcaaatgctgccgacgtacccgcggcctattcaaataccgccacctcaaagacgacgaagaaaccggctaccgacggataatagaacgactaaactctaagaaaggcaaaaacagactactggacggcgaaagactcgccgaccgcaaaatcgcagaactcttcagcacgaaaacacacatcggc

SEQ ID NO: 15706 - RNA, 1932 nt, synthetic construct
  misc_feature 1..1932: note = derived and/or modified CDS sequence (opt11) from CCHFV(Kashmanov)__DQ211631.1__Gc
  source 1..1932: mol_type = other RNA
ttcctcgactcaatcgtaaaaggcatgaaaaactctctaaactcgacatccctcgagacttctctaagcatcgaggcaccatggggagcaataaacgtccaatccacctttaaacccacggtctcaaccgccaatatcgccctctcatggtccagcgtagaacaccgggggaacaaaatcctcgtcaccggacgtagcgaatcaattatgaaactcgaggaacggaccggcgtctcctgggacctaggtgtcgaagacgcctccgagtctaaactcctaaccgtctccataatggacctatcacaaatgtactccccagtatttgaatacctaagcggagacagacaagtcgaagagtggcccaaagccacttgcaccggcgactgcccagagcgctgtggctgcacctctagcacgtgccttcacaaagagtggccacacagccgcaactggcgctgcaaccccacctggtgttggggcgtcggcaccggctgtacctgctgcggagtcgacgtcaaagacctcttcaccgaccacatgtttgtcaaatggaaggtcgagtacatcaaaaccgaagcaatcgtatgcgtcgaactcacatcacaagaaagacaatgctcccttatagaagcaggaacccgcttcaacctgggcccggtcacaataactctctccgaaccccgaaacatccagcagaaactcccacccgagataattaccctccaccccaaagtcgaagaaggcttcttcgaccttatgcacgtccaaaaggtactatcagcatccaccgtctgcaaactccaatcctgcacacacggaatccccggcgatctccaggtttaccacatcggcaacctactgaaaggggaccgaatcaacggccacctcatacacaaaatcgaaccccacttcaacacctcctggatgtcctgggacggatgcgacctcgactactactgcaacatgggcgactggccctcctgcacatacaccggcgtaacccaacacaaccacgcagcgttcgttaacctcctgaacatcgagacagactacacaaaaacattccatttccactcgaagcgggtaacagcacacggagacacaccccaacttgacttgaaagcacgccccacctacggcgctggcgaaatcaccgttctcgtcgaagtcgccgacatggaactccacacaaagaaagtcgagatctcaggactcaaatttgcatctctagcctgcaccggctgctatgcctgctcaagcggcatctcctgcaaagtcagaatccacgtcgacgaaccagacgaattaaccgtccacgttaagtcctcagaccctgacgtcgtcgccgcatcaacatcccttatggctcgcaaactcgagtttggaaccgacagcaccttcaaagccttctccgccatgcccaaaaccagtctctgtttctacatcgttgaacgggaatactgcaaatcatgctccgaggaagacacccaaaaatgcgtagacaccaaactagagcaaccccaaagcatcctaatagaacacaaaggcaccataataggcaaacaaaacgatacctgcaccgccaaagcatcctgctggctcgaaagcgtcaaatcctttttctatggcctcaaaaacatgctcggatccgtcttcggaaatttcttcataggcatcctactattcctagccccattcgtcctcctagtcctcttcttcatgttcggctggaaaatactcttctgcttcaaatgctgcaggcgcacacgcggcctcctaaaataccgccacctcaaagacgacgaggaaactggataccggcgcatcatcgaacgactaaacaacaaaaagggcaagaaccgactactggacggggaacgcctagccgaccgaaaaatagcagaactcttctcaacaaagacacacatcggc

SEQ ID NO: 15707 - RNA, 1932 nt, synthetic construct
  misc_feature 1..1932: note = derived and/or modified CDS sequence (opt11) from CCHFV(Oman)__DQ211632.1__Gc
  source 1..1932: mol_type = other RNA
tttctcgacagcatcgccaaaggcatgaaaaacctactcaactccacatcactcgaaacttccctatccatcgaagccccatggggagccatcaacgtccagtccaccttcaaaccaaccgtatccaccgccaatatcgccctctcctggtccagcgtagaacacagaggaaacaaaatcctcgtatcgggccgttcggaatccatcatgaaactcgaagaacgcacaggaatctcctgggacctgggtgtagaagacgcctccgaaagcaaacttctcaccgtatccgtcatggacctatcacaaatgtattcacccgttttcgaatacctcagcggcgaccgccaggtggaagaatggcccaaagccacatgcaccggagactgccccgaacgctgcggttgcacctcctccacgtgcctacacaaagagtggccccactcgcgaaactggagatgcaacccaacctggtgttggggagtcggcaccggatgtacctgctgcggattagacgtcaaagacctcttcacagactatatgttcgtaaagtggaaggtcgagtacataaaaacagaggcgatcgtatgcgttgagctcacatcccaagaacgccaatgctccctcatcgaagcgggtacccgctttaacctcggccccgtcaccattacactctcagaaccaagaaacatccaacaaaaactaccaccagaaatcgtcacactccatccccgcatagaagaaggcttcttcgacctgatgcacgtccaaaaagtactatcagcctcaacagtctgcaaactgcaatcatgcacccacggcgtcccaggtgacctccaagtctaccacatcggtaacctcctcaaaggcgacaaagtcaacggccacctaatccacaaagtagaaccccacttcaacacgtcctggatgtcttgggacggctgcgacctcgactattactgcaacatgggagactggcccagctgcacctacacaggcgttacacagcacaaccacgccgccttcgtcaacctcctcaatatcgaaaccgattacaccaagaatttccacttccactcgaagcgcgtcaccgcgcatggcgacacaccccaactcgacctgaaagcccgccccaactacggagccggagaagtcacagtcctggtcgaagtagcggacatggaacttcacaccaagaaaattgaaatcagcgggctaaaattcgcctccctaacctgcaccggctgctacgcctgctcctccggcatctcctgcaaagtccgcatccacgtagacgaacccgacgaactcaccgtccatgtcaaaagcgaagaccccgacatcgtcgccgcatcatcatcactcatggcccgcaaactcgagttcggaaccgactcaaccttcaaggctttctcagccatgcccaaaacctccctctgcttctacatagtcgaacgcgagtactgcaaaagttgttcaaaagaagacactcagaaatgcgttaacgccaaactcgaacgcccccaatccatactaatcgaacacaaaggaacaatcatcggcaaacaaaacgatacctgcaccgccaaggcttcctgctggctcgagtcagtgaaatcgttcttctacggactgaaaaacatgctatcaggcatcttcggcaacgtattcataggaatcttcctattcctggcccccttcatcctcctcatcctattcttcatgttcggatggcgcatcctattctgcttcaaatgctgccgccgcaccagagggctattcaaataccgccacctcaaggacgacgaagaaacaggatacagaaaaatcatcgaacgacttaataacaagaaaggcaaaaacaaactactagacggagaacgcctcgccgaccgaaaaatcgccgaactcttctccaccaaaacccacatcggc

SEQ ID NO: 15708 - RNA, 1932 nt, synthetic construct
  misc_feature 1..1932: note = derived and/or modified CDS sequence (opt11) from CCHFV(SPU97/85)__DQ211633.1__Gc
  source 1..1932: mol_type = other RNA
ttcctcgactctatagtcaaaggcaaaaagaatctactcaactccacctccctcgaaacctccctatccatagaagctccatggggcgctatcaacgtccaaagcaccttcaaaccaacagtctccgccgccaacatcgctctatcctggagctctgtagaacaccgcgggaacaaaatactggtatccggccgatccgagtccataatgaagctcgaagaacgaaccgggatatcctgggacctcggagtcgaagacgcctccgaaagtaagctcctgaccgtatccgtcatggacctctcccaaatgtacagcccagtcttcgaatacctctctggagaccgacaggtcgaagaatggccaaaggctacctgcactggcgactgccccgagcgctgcggatgcacatcatcaacctgcctccacaaggaatggccccactccagaaactggcgatgcaaccccacatggtgctggggcgtaggaaccggttgcacgtgctgcggcctagacgtaaaggacctattcacagattacatgttcgtaaaatggaaagtcgagtacataaaaacagaagctatagtctgcgtcgaactaaccagccaagaaagacagtgctccctaatcgaagctggcacacgcttcaacctcgggccagtaaccatcaccctgagcgaaccccgcaacatccagcaaaaactgcccccagaaatcataaccctccacccgcgcatagaagaaggcttcttcgacctcatgcacgtccaaaaagttctcagcgccagcacagtatgcaaactccaatcctgcacccacggcgtcccgggagacctccaagtctatcacataggcaacctcctcaaaggcgacaaggtcaacggacacctgatccacaaaatagagccacactttaacacatcctggatgtcctgggacggctgcgacctagactattactgcaacatgggcgactggccctcctgcacctacacaggcgtcacacaacacaaccacgcggctttcgtaaacttactgaacatcgaaaccgactacaccaaaaacttccacttccacagcaaacgagtcacagcacacggcgacactccccaactcgacctaaaagcaagaccaacctacggcgccggagaggtaaccgtcctagtcgaagtcgccgacatggaattacacaccaaaaagatcgaaatcagcggactcaagttcgcctcgctatcctgcaccggatgctacgcgtgctcctccggaatcagctgcaaagtccgcatacacgtagacgaaccagacgaactcaccgtacacgtcaaatcagaagacccagatatcgtagcagcaggatcttcactcatggcccgtaaactggagttcggtgccgacagcaccttcaaagcattctccgccatgcccaaaacctcactatgcttctacatcgtggaacgggaatactgcaaaagttgctcccgagaagacacccaaaagtgcgtcaacactaagctagagcggccccagtccatcctcatcgagcacaaaggcaccataataggaaaacagaacgacacatgcaccgcaaaagcctcctgctggctagaatccgtaaagagcttcttctacggactaaaaagcatgctctcaggaatctttggcaacgtctttatagggatattcctgttcatagcaccattcgtccttctcatcctattcttcatgttcggctggcgaatcctgttctgcttcaaatgctgccgcagaacacgcggactcttcaaataccgccaccttaaagatgacgaagaaaccggataccgcaaaatcatagaacgcctcaacaacaagaaaggcaaaaacaaactcctcgacggcgaacgcctagctgatcgaaaaatcgccgaactcttctccaccaaaagccacatcggc

SEQ ID NO: 15709 - RNA, 1932 nt, synthetic construct
  misc_feature 1..1932: note = derived and/or modified CDS sequence (opt11) from CCHFV(SPU103/87)__DQ211634.1__Gc
  source 1..1932: mol_type = other RNA
ttcctggacaacattgttaaaggcatgaaaaacctcctgaactccacatcactcgaaacatccctctcgatcgaagccccgtggggcgccatcaacgtccaatccacctacaaacccacggtgagcaccgccaacatagccctctcatggtccagtgtcgaacaccgcggcaacaaaatcctcgtctccggacgctccgaaagcataatgaagctcgaggaacgaaccggaatttcttgggaccttggagtcgaggacgcatccgaaagcaaattactcaccgtaagcgtcatggacctaagtcaaatgtactcacccgttttcgaatacctgtcgggagaccgccaagtagaggagtggcccaaagcgacctgcacaggtgactgccccgaacgctgcggctgcacctcctccacgtgcctacacaaagaatggccccacagccgaaactggcgctgcaaccccacctggtgctggggcgtaggcacgggttgcacttgctgcggactcgacgtaaaagacctcttcaccgactacatgttcgtcaaatggaagatcgaatacatcaaaaccgaagccatcgtctgcgtcgaacttacatcacaagagcgacagtgctcactcatcgaagccggaacgcgcttcaacctaggacccgtaacaatcacactctctgaaccccgcaatatacaacaaaaactccccagtgaaatcatcaccctccaccccaggattgaagaaggattcttcgacctgatgcacgtccaaaaagttctcagcgccagcactgtctgcaaactacaatcctgcacacacggcgtacccggcgacctacaagtataccacatcgggaacctcctcaaaggagacaaagtcaatggacacctcgtccataaaatcgaaccgcacttcaacacctcctggatgagctgggacggatgcgacctcgactactactgcaacatgggagactggccatcctgcacatacacaggcgtcacccaacacaaccacgcatccttcgtcaatctcctcaacatagaaaccgactacacaaagaacttccacttccacagcaaacgcgtaacggcgcacggcgacacaccgcaactagacctcaaagcccggcccacctacggcgccggcgaaatcacggtgctagtcgaagtcgcagacatggagctccacaccaagaaaatagaaataagcggcctgaaattcaccagccttacatgcaccggctgctacgcatgctccagcggaatatcatgcaaagtccgcatccacgtcgacgagccagacgaactcacagtacacgtaaagtcggacgaccccgacgtcgtagcagcatcatcctcactcatggcccgcaaactcgaatttggaaccgactccacctttaaagcattctccgctatgcccaagacatcactctgcttctacatagtcgaacgagaatactgcaaatcatgcagtgaagaagacacccagaaatgcgtaaacaccaaactagagcaaccccaatcaatcctcatcgagcacaaaggtactataatcggcaagcaaaacaatacctgcaaagcccgggccggctgctggcttgagtccgttaaatccttcttttacggactaaagaacatgctctccggcattttcggcaacgtattcataggcatcttcctcttcctagcccccttcatcctactcatcctattcttcatgttcggatggcgcatactattctgcttcaaatgctgccgccgcacacgaggcctcttcaaataccgccacctgaaagacgacgaagaaaccggataccggaaaataatcgaacgcttaaacaacaagaaaggcaaaaacaaacttctagatggagaaagacttgccgaccgacgcatagcggaactcttctccacaaaaacccacatcggc

SEQ ID NO: 15710 - RNA, 1932 nt, synthetic construct
  misc_feature 1..1932: note = derived and/or modified CDS sequence (opt11) from CCHFV(SPU415/85)__DQ211635.1__Gc
  source 1..1932: mol_type = other RNA
ttcctcgactccatcgtaaaagggatgaaaaacctactaaactcgacatccctcgagaccagcctaagtatcgaagcaccatggggcgcaataaacgtacaatcaacattcaaaccaaccgtcagcgccgcaaacatagccctatcctggtccagcgtggaacaccgcggcaacaagatcctggtctccggaagatcggagagcatcatgaaactcgaagaacgcaccggaataagttgggacctaggagtcgaggacgcctcagaatcaaaactgctcacggtcagcgtcatggaccttagccaaatgtactctcccgtattcgaatacctctccggagaccgccaagtcgaagaatggccaaaggcaacatgtaccggcgattgtcccgaaagatgcggctgcacaagcagcacgtgccttcacaaagaatggccccactcccgaaactggcgctgcaacccaacctggtgctggggcgtcggcacaggctgcacatgctgcggcctagacgtcaaagatctattcacagactacatgttcgtcaaatggaaagtggaatacataaaaacagaagcaatcgtgtgcgtcgaactgacaagccaagaacgccaatgcagcctcatagaagccggaacacgcttcaacctcggacccgtaaccatcactctctcagaaccccgaaatatacagcaaaaactaccccctgagatcataaccctccacccacgcatcgaagaaggattcttcgacctcatgcacgtgcaacgcgtcctgtcagccagcacggtctgcaagctacaaagctgcacacacggcgtccccggagatctccaagtctaccacataggcaatctactcaaaggtgacaaggtaaacggccacctcattcacaagatcgaaccacacttcaacacctcgtggatgagctgggacggctgcgacctagactattactgcaacatgggggattggccctcctgcacgtacaccggtgtcacacaacacaaccacgcagcattcgtcaacctcctcaacatagaaaccgactacaccaaaaacttccacttccactccaaaagagtcaccgcccacggcgacaccccacaacttgacctcaaagcacgacccacatacggcgccggcgaggtaacagtactggtagaggtcgcagacatggaactgcacaccaaaaagatagaaatatcgggcctcaaattcgccagcttaacatgtaccggctgctacgcatgcagcagcgggatcagctgcaaagtcaaaatccacgtagacgaacccgacgagctcacggtccacgtgaaaagcgaagaccccgacatcgtcgcagcggggagctccctcatggcccgcaaactcgaatttggcgcagactcaaccttcaaagccttctcagccatgcctaaaacatccctctgcttctacatcgtagagcgcgaatactgcaagtcctgctccagagaagacacacgcaaatgcgtcaacaccaaactagatcgaccccaatctatactaatcgaacacaaaggaaccatcatcggcaaacagaacaacacatgcaccgcgaaagcgtcgtgctggctagaatccgtaaaatcattcttctacggccttaaaaacatgctaagcggtatcttcggaaacgtattcataggcatattcctcttcatcgcacccttcgtactactcatcctattcttcatgttcggctggcgcatactcttctgcttcaagtgctgccgccgaacccgaggtctcttcaaatatcgacatctcaaagacgacgaagagaccggctaccgcaaaatcatagaacgcctaaacaacaagaaaggcaaaaacaaactactagacggagaacgcttagcagaccggaaaattgccgaactcttcagcaccaaaagccacataggc

SEQ ID NO: 15711 - RNA, 1932 nt, synthetic construct
  misc_feature 1..1932: note = derived and/or modified CDS sequence (opt11) from CCHFV(Turkey200310849)__DQ211636.1__Gc
  source 1..1932: mol_type = other RNA
ttcctagactcaatagtcaaaggcatgaaaaacctcctaaattcaacgtcactcgaaacctccctatccatagaagccccctggggagcaataaatgtacaaagcaccttcaaacccgccgtaagcaccgccaacatagcactaagctggagcagcgttgaacaccgaggtaacaaaatcctcgtcactggacggagcgagagcataatgaagctagaagaacgcaccggcgtcagctgggacctaggggtcgaggacgctagcgaaagcaaactactcacagtgtcaatcatggacctctcacaaatgtactcgcccgtcttcgaatacctaagcggcgaccgacaagtcgaagagtggccaaaggcaacatgcaccggcgactgccccgaacgatgcggatgcacctcatcgacatgcctgcataaggaatggccccactcccgcaactggcgctgcaacccaacttggtgctggggcgtgggcaccggatgcacatgctgcggagtagacgtaaaagacctcttcaccgaccacatgttcgttaagtggaaagtcgaatacatcaaaaccgaagcaatcgtgtgcgtcgaactcaccagccaagaacgccaatgctcactaatcgaagcaggaacgcgcttcaacctaggccctgttaccatcacactctccgaaccccgcaacatccaacaaaaactcccaccagaaatcataacactacaccccaaaatagaagaaggattcttcgacctaatgcatgtccaaaaagtcctatctgcatcgaccgtatgtaaattgcaatcctgcacccacggcatcccaggcgacctccaagtctaccacataggcaacctcctaaaaggggatcgagtaaacggacacctcatccacaagatagaatcccacttcaacacgtcgtggatgagctgggacggatgcgacctcgactactactgcaatatgggagactggccatcatgcacatacacgggagtcacccaacacaaccacgccgccttcgtcaacctcctcaacatagagacagactacaccaagacattccatttccactcaaagcgcgtcaccgcccacggcgacacaccccaactcgacctcaaagcacgtccaacctacggcgccggcgagataaccgtcctcgtagaggtagccgacatggaactccacaccaagaaagtcgaaatctcaggcctaaaattcgcctcccttgcatgcaccggatgctacgcctgctcgagcggcatctcctgtaaagtacgcatccatgtcgacgagcccgatgaactaaccgtacacgtcaaatcctccgaccccgacgtcgtagccgcctcaacaagcctaatggcccgcaaactagagttcggaaccgacagcacgttcaaagcattctcggccatgccaaaaacatccctctgcttttacatcgtcgaacgcgaatactgcaagagctgctcagaagacgacacccagaaatgcgttgacacccgcctggaacaaccacaatccatcctgatcgaacacaaaggaaccataataggcaaacaaaatgatacctgcaccgccaaagcatcatgctggttagaatcagtcaaaagtttcttttacggactcaaaaacatgctcggctcagtctttggtaacctcttcataggaatactactcttcctagccccgttcgtactcctagtactattcttcatgtttggctggaaaatcctcttctgcttcaaatgctgccgccgcacacgaggcctcttcaaatacagacacctcaaagacgacgaagagaccggctaccgacgaataatagaacgactgaactctaagaaaggcaaaaaccgactcctagacggcgaccgcctcgcagacagaaaaatagccgaactcttctcaacgaaaacacacatcggg

SEQ ID NO: 15712 - RNA, 1932 nt, synthetic construct
  misc_feature 1..1932: note = derived and/or modified CDS sequence (opt11) from CCHFV(Iran-52)__DQ446215.1__Gc
  source 1..1932: mol_type = other RNA
ttcctcgacagcatagtaaaaggcatgaaaaacctactgaactccacatcactcgagacctcactatcaatcgaagccccatggggagccatcaacgttcaatcaacatacaaaccaaccgtaagcaccgccaacatcgccctcagctggagcagtgtcgaacaccgaggaaacaaagtcttagtctccggacgctcagagtctatcatgaaactcgaagaacgaacaggaatctcatgggacctaggagtcgaagacgcgtcggaaagcaaactcctcactgtatccgtcatggacctcagccaaatgtactccccggtcttcgagtatctcagcggcgaccgccaggtagaagaatggcccaaagccacttgtacaggcgactgccccgagcgctgcggctgcaccagctcaacgtgcctacacaaggagtggccacattccagaaactggcgttgcaaccccacctggtgctggggcgtcggcacaggctgcacatgctgcgggctcgatgtaaaggacctcttcacggactacatgttcgtaaaatggaaagtcgaatacataaagaccgaagcaatcgtatgcgtcgaactcacctcccaagaacgacagtgctccctcatagaagcgggcacacgattcaacctcggctccgtcaccatcaccctttccgaaccccggaacatacaacaaaaactcccgcccgagataatcaccctacaccccaaaatcgaagagggattcttcgacctcatgcacgtccaaaaagtcctttccgcctccaccgtctgcaaactccaatcatgcacccacggagttcccggcgacttacaagtctaccacatcggaaacctcctcaaaggagaccgagtaaacggacacctcatccataaaatcgaacaacacttcaacacctcctggatgtcctgggacggctgcgacctcgactactactgcaacatgggagactggccatcatgcacgtacacaggcgtcacccagcacaaccacgccagcttcgtcaacctactcaatatcgaaacggactacaccaaaacattccacttccactccaaacgcgttaccgcccacggcgacacccctcaactcgacctaaaagcacgccccacctatggcgcgggcgaaatcaccgtcctggtcgaagtggcagacatggaactgcacaccaagaaaattgaaatatccggcctcaaattcgctggattaacatgcaccggttgctacgcctgctcctcaggcatctcctgcaaagtacgaatacacgtcgaagaacccgacgaactcacagtccacgtcaaatccgacgacccggacgtcgtagcggcctcgtcgtccctaatggctcgcaagctcgagttcggcaccgactcgacattcaaagcattctccgccatgcccaaaacctccctatgcttctacatcgtcgaacgagaatactgcaaatcctgctccaaagaagacacacaaaaatgcgtcaacaccaaactcgaacaaccccaaagtatcctgatcgaacacaaagggaccatcatcggcaaacaaaacaacacgtgcacagcaaaagcatcctgctggctagaatcagttaaatcattcttttacggcctgaaaaacatgctaggaggcatcttcggcaacgtcttcatcggaatattcacattcctaacccccttcatcctcctcatactcttcttcatgtttggctggcggattctattctgtttcaagtgctgccgacgaacccgcggactcttcaaataccgccacctcaaagacgacgaagaaaccggctaccgcaaaatcatcgagcgcctcaacaacaaaaagggcaagaaccgacttctagacggggaacggctagccgatagaaaaatagcagaactcttcagcacaaaaacccacatagga

SEQ ID NO: 15713 - RNA, 1932 nt, synthetic construct
  misc_feature 1..1932: note = derived and/or modified CDS sequence (opt11) from CCHFV(Iran-53)__DQ446216.1__Gc
  source 1..1932: mol_type = other RNA
ttcctcgactcaatcgtcaaaggcatgaaaaacctccttaactcaacctccctcgaaacatcactatccatcgaagccccctggggcgccatcaacgtccaaagtacctacaaaccgacggtcagcaccgccaatatcgcactctcctggtcaagtgtcgaacaccgaggcaacaaagtactcgtctcaggccgtagcgaaagcatcatgaaactcgaagaacgaacaggcataagctgggacttaggagtagaggacgcctccgaatccaaactactgaccgtatccgtgatggacctctcgcaaatgtattcccccgtcttcgaatacctatccggcgaccgccaagtcgaagagtggccaaaagctacttgcacaggagactgcccagaacgctgcggctgcacgtcctcaacctgcctccacaaagaatggccccactcccggaactggcgctgcaaccccacctggtgctggggtgtaggcaccggctgcacatgctgcggactcgacgtcaaagacctattcaccgactacatgttcgtcaaatggaaagtagaatacatcaaaaccgaagcgatcgtatgcgtagaactaaccagccaagaacgccaatgctccctcatagaagccggaacccgcttcaacctaggctcagtcacaatcaccctatctgaacccaggaacatccaacagaaactgccacccgaaataataaccctccaccccaaaatcgaagaaggcttcttcgacctcatgcacgtccaaaaggtcctatcagcgagcacagtttgtaaactccaatcatgcacccatggtgtccccggcgaccttcaagtctaccacatcggaaacctcctgaaaggagaccgagtaaacggccacctcatccacaaaatagaacaacacttcaacacatcctggatgtcctgggacggctgcgacctggactactactgcaacatgggcgactggccctcgtgcacatacaccggcgtaacgcaacacaatcatgccagcttcgtcaacctactcaacatcgaaacagactacacaaaaaccttccacttccacagcaaacgggtaacagcccacggagacaccccacaactagacctcaaagcacggcccacatacggtgcaggagaagtcaccgtcctagtcgaagtcgccgacatggaactacacacaaagaaaatcgaaatctccggcctgaaattcgcagggttgacctgcacaggatgctacgcctgcagctccggtatatcatgcaaagtccgtatccatgtggacgaaccagacgaactcactgttcacgtaaaatcagacgaccccgacgtcgtcgccgcctcgtcctcactcatggcccgcaaactcgaatttggaaccgactccacattcaaagccttctccgcaatgccaaaaacctccctctgcttctacatcgtcgaacgagaatactgcaaatcctgcagcaaagaagatacccagaaatgcgtcaacacgaaactcgaacaaccccaatcaatactcatcgagcacaaaggcactatcatcggcaaacaaaacaatacctgcacagcgaaggcaagctgctggctcgaatccgtcaaatcattcttctatggcctcaaaaacatgctcggaggcattttcggcaacgttttcatcggcatattcacattcctaacccctttcatcctcctaatcctattcttcatgttcggctggcgcatcctattctgcttcaaatgctgcagaagaacccgcggcctattcaaataccgccacctcaaagacgacgaagaaaccggctacagaaaaatcatagaacgcttgaacaacaagaaaggcaaaaaccgcctgctagatggcgaacgactcgccgaccgcaaaattgcagaactcttcagcacgaaaacccacatcggc

SEQ ID NO: 15714 - RNA, 1932 nt, synthetic construct
  misc_feature 1..1932: note = derived and/or modified CDS sequence (opt11) from CCHFV(Kosova Hoti)__EU037902.1__Gc
  source 1..1932: mol_type = other RNA
tttctcgactcaatcgtaaaaggaatgaaaaacctcctgaactccacatcactcgagacctccctctcaatcgaagccccgtggggagccataaacgtccaatcgacattcaaaccgaccgtcagcaccgccaacatcgcgctatcctggtcgtccgtcgaacaccgagggaacaaaatcctagtcacaggacggagcgaatccataatgaaactcgaagaacgcactgggatctcatgggatctaggcgtagaggacgcgtccgaaagcaaactcctcacagtcagcataatggacctctcccaaatgtactcccccgtgttcgaatacctgagcggcgaccgccaagtagaagaatggcctaaagcgacgtgtaccggtgattgcccccagcgctgcggatgcacatccagtacctgcctacacaaagaatggcctcacagccgaaactggcgctgtaacccaacctggtgctggggagtaggtacaggctgtacctgctgcggagtcgacgtcaaagacctcttcacagaccacatgtttgtcaaatggaaagtcgaatacataaaaaccgaggccatcgtctgcgtagaactgacctcacaggagagacaatgctccctaatcgaagcaggcacccgcttcaacctgggccccgtaactataacacttagcgaaccaagaaacatacagcaaaaattaccacccgaaataatcaccctacacccgaaaatagaagaaggcttctttgacctcatgcacgtacaaaaagtcctctcagcctccaccgtatgcaaactccaatcctgcacccacggcatcccaggagacctacaagtataccacatagggaacctactgaaaggtgaccgcgtcaacggacatctcatccacaaaatcgagccccacttcaacacctcctggatgtcctgggacggatgcgacctcgactactactgcaacatgggcgactggccctcctgcacctacaccggcgtcacccagcacaatcacgccgccttcgtcaatctgctaaacatagaaacagactacaccaaaaccttccacttccactccaaacgagtaacagcccacggcgacacaccccaactagacctcaaagcccgcccgacctacggcgccggcgagataacggtactggtcgaagtagcagacatggagctacacaccaaaaaggtcgaaatctcgggcctcaaattcgcatcactcgcctgcaccggttgctacgcatgctcatccgggatatcgtgcaaagtccgcatacacgtagacgaacccgacgaactcaccgtccacgttaagtcctcagatcccgatgtcgtcgccgccggaacttccctcatggcccgcaaactagagttcggaaccgactcgacattcaaagccttttccgccatgccaaaaacctccctctgcttctacatagtagaaaaagaatactgcaagagctgctccgaagacgacactaagaaatgcgtagacaccaaactagaacaaccccaatcaatacttattgaacaccgcggcaccatcatcggcaaacagaacgacacgtgcacagccaaagcatcctgctggcttgaatcagtaaaatcgttcttctacggcctcaaaaatatgctcggatccgtattcggcaacttcttcatcggcatcctcctgttcctggcccccttcgtactcctagtcctattcttcatgttcggctggaaaatcctattttgcttcaaatgctgcaggcgaacccgcggcctcttcaaatatcgtcacctcaaagacgacgaagagaccggctaccgccgcataatagaacgactcaacaacaagaaaggcaaaaaccggctactcgacggtgagcgcctagccgaccgaaaaatagccgaactattctcaaccaaaacacacatcgga

SEQ ID NO: 15715 - RNA, 1932 nt, synthetic construct
  misc_feature 1..1932: note = derived and/or modified CDS sequence (opt11) from CCHFV(YL04057)__FJ562094.1__Gc
  source 1..1932: mol_type = other RNA
ttcctagactctatagcaaaaggcaagaaatccctcctcaattccacctccctcgaaacctcactcagcatcgaagcaccatggggcgccatcaatgtacaatcgactttcaaaccaacagtatccgcagccaacatcgcactctcctggtcctccgtcgaacaccgcggcaacaaaatcctcgtctcaggacgctccgaatcaatcatgaaactagaagaacgaaccggcgtctcgtggaacctcggcgtcgaagacgcatccgaaagtaaaacactcaccgtctccgtaatggacctcagccaaatgtactccccagtattcgaatacctcagcggcgaccgccaagtagaagaatggcccaaagcaacctgcacaggagattgccccgaacgatgcggatgcacctcctccacttgcctccacaaagaatggccccactcccgaaactggcgctgcagcccgacctggtgctggggcgtcggcaccggatgcacatgctgcggtctcgacgtcaaagacttcttcacggactacatgctcgtcaaatggaaagtcgaatacatcaaaacagaagccatcgtctgcgtagaactaacatcccaggaacggcaatgctcgctcatcgaggccggaacccgcttcaacctgggaccagtaacaatcaccctatccgaaccacgcaacgtccaacaacgcctacccccagagatcgtcaccctacacccaaagatagaagaaggcttcttcgacctaatgcacgtccagaaaatattatccgcctcaaccgtgtgcaagctacaatcatgcacccacggagtccccggcgacttccaagtttaccacgtaggcaacctcctgcgcggagacaaagtaaacggccactccatccacaagattgaaccacacttcaacacatcatggatgtcatgggacggatgcgacctagactacttctgcaacatgggcgactggccatcatgcacctacaccggagtaacccaacataatcgcgccgccttcatcaacatgctcaacatagaaaccgactacaccaaaactttccacttccactccaagcgcgtcaccgctcacggagacacgccccaactagatctcaaagcgcgtcctgcctacggagccggagaagtcaccgtactcgtggaggtcgccgaccttgaactacataccaagaaactcgaagtaagcggcctgaaaatagccagcctcacatgcagcggctgctacgcatgctcatcaggaatctcgtgcaaagtccggatccacgtcaacgaacccgacgaatttaccgtccacgtccgctcatccgacccagacgtagtcgcagccggatcctctctcatggccagaaaaattgagttcggcgccgactcgacattcaaagccttcagctccatgccgaaagactccctatgcttctacattgttgaaaaagactactgctcctcctgtaccgacgacgacacccaaaaatgcgtcaacacaaaactcgaccacccccaatcgatcctcatcgaacacaaaggaacaataataggcaaacaaaacgatacctgctcaaccaaaacctcctgctggctagaaagcgtcaaaggcttcttctacggcctcaaaaacatgctatccggaatctttggaaacgtcttcttaggcatcctcctattcctagccccatttgtcctactcatcttcttcttcttcttcgggtggcgactactattctgcctaaaatgttgccgccgtacacgcggtctcctcaagtacaagcaccttaaggacgaagaagaggccggctacaagaaaataatcgagcgtctcaatggcaagaaaggaaaatcccaactcttcgacggcgaacggctagccgaccgcaaaatagctgaactcttctccaccaaaatccacatagga

SEQ ID NO: 15716 - RNA, 1932 nt, synthetic construct
  misc_feature 1..1932: note = derived and/or modified CDS sequence (opt11) from CCHFV(V42/81)__GU477490.1__Gc
  source 1..1932: mol_type = other RNA
ttcctcgacagcatagttaaaggcaagaaaaaccttttaaactcaaccagcctcgaaacctccctctccatcgaagccccatggggagccatcaacatacagtccacattcaaacccaccgtctccgccgccaacatagccctatcctggtcctccgtcgaacaccgcggcaacaagatcctagtctctggccgcagcgaatcaataatgaaactcgaggaacgaaccggcgtctcatggaacctaggagtagaggacgcctcagaatctaaactactcacggtctcaatcatggacctatcccagatgtactcacccgtcttcgagtacctatctggcgacagacaagtcgaagaatggcccaaagcaacctgcacaggagactgccccgaacgctgtggctgcacctcctccacctgtctacacaaagaatggccacactcccgcaactggcggtgcaatcccacatggtgttggggagtaggcaccggctgcacatgctgcggcgtcgacgtcaaagatctgtttatcgaccacatgttcgtaaagtggaaagtcgaatacatcaaaacggaggccatcgtctgcgtagaactaacctcccaagagcgacaatgcagccttatcgaagccgggacaagattcaacctaggcccagtgaccataacactctcagaaccccgaaacatacagcaaaaactgcccccagaaatcatcaccctccaccccaaaattgaagaaggcttcttcgacctaatgcacgtccaaaaagtcctttccgcttccacagtctgcaagctacaatcatgcacgcacggcatacccggtgacctacaagtttaccacatcggaaaccttctcaaaggcgaccgagtaaacggccacctcatccacaaaatcgaaccccacttcaacacctcctggatgagctgggatggatgcgatctagactactactgcaacatgggagactggccatcctgcacctacaccggcgtaacccagcacaaccatgccgcattcgtgaacctgctcaacatcgaaactgactacactaaaaccttccacttccactccaaacgtgtaacagcccacggagaaaccccgcaactggaccttaaagcccgcccagcatacggcgcaggcgagataacagtgctcgtcgaagtagccgacatggaactccacacgaagaaagtagaaatctcaggcctaaaatttgcatcactagcttgcacaggctgctacgcctgctcctcaggcatatcctgcaaagtccgaatacacgtagacgaacccgacgaactcaccgtccacgtcaaatccaatgacccggacgtcgtagcagcctccacctccttaatggcacgaaaactagaatccggcacagactccacctttaaagccttctccgcaatgcccaaaacctcactctgcttttacatcgtcgaacgcgaatactgcaaatcctgcagcgaagacgacacccaaaaatgcgtcgagacaaaactcgaacaaccccaatccatcctaatcgaacacaaaggaactatcatcggaaaacaaaacgatacctgcaccgccaaagctagctgctggttagagtccgtcaaatccttcttctacggcctcaaaaacatgctcggctccgtcttcggcaacttctttattggaatactactctttctagctccattcgtactcctagtcctcttcttcatgttcggatggaaaatcctattctgcttcaaatgctgcagacgcacgcgaggactcttcaaataccgacacctcaaagaagacgaagagaccggataccgccgaatcatcgagcgcctcaactcaaagaaagggaaaaaccgccttctcgacggtgaacgcctcgccgatcgcaaaatcgcggaactcttctccacgaaaacccacataggc

SEQ ID NO: 15717 - RNA, 1932 nt, synthetic construct
  misc_feature 1..1932: note = derived and/or modified CDS sequence (opt11) from CCHFV(79121M18)__GU477493.1__Gc
  source 1..1932: mol_type = other RNA
ttcctcgactcaacagccaaaggaatgaaaagcctcctaaactcgacgtctctggaaacctcactcagcatagaagctccctggggcgccataaacgtccagtccaccttcaaacccaccgtgtcagccgcaaatatcgcacttagctggtccagcgtcgaacaccgcggcaataaaatcctggtctcaggacgatccgaatccatcatgaaactcgaagaacgaaccggcgtcagctggaacctaggagtcgaagatgcctccgaatcaaaaacccttacagtatcagtcatggacctctcccaaatgtactcacccgtattcgaatacctatccggcgaccgccaagtagaagagtggcccaaagcaacctgcaccggcgactgcccagagcgatgcgggtgcacctcctcaacctgcctccacaaagaatggccacatagccgtaactggcgctgcaaccccacctggtgctggggcgtgggaaccggctgcacatgctgcggactagacgtcaaagacttcttcaccgactacatgctagtaaaatggaaagtcgaatacatcaaaaccgaagcaatcgtctgcgtagaactcacctcacaagaacgccagtgctcccttatagaagcgggcacccgctttaacctaggaccagtcacgatcacgctctccgaaccgcgcaacgtccaacaacgcctaccaccggaaatcgtcacccttcaccccaaaatcgaagaaggcttcttcgacctcatgcacgtacagaaaatcctctccgcatccaccgtctgcaaactccaatcgtgcacccacggcgtccccggtgacttccaaatctaccacgtcggcaacctcctacgaggtgacaaagtaaacggacactccatccacaaaatagaaccccacttcaacacttcgtggatgtcgtgggacggctgcgacctagactacttctgcaacatgggcgactggccatcctgcacatataccggcgtcacccaacacaaccgcgccgccttcatcaacatgcttaacatcgaaaccgactataccaaaaccttccacttccacagcaagcgagtaacagctcacggagacacaccccaactcgacttaaaagccagaccagcctatggagctggcgaagttaccgtcctcgtcgaagtcgcagacctagaacttcacaccaagaaactcgaagtctccggcctcaaaatcgcatcacttacgtgctcaggctgctacgcctgctcctccgggatctcatgcaaagtccgaatccacgtaaacgaaccggacgagttcaccgtccacgtaagatcatccgaccccgacgtcgtagccgccggctcctccttaatggcccgcaaaatagagttcggcgccgactccaccttcaaagcattctcgtcaatgcccaaagacagcctatgcttctacatcgtcgaaaaggactattgcagcagctgcaccgacgacgacacccaaaaatgcgtcaacaccaagctcgaccacccccaatccatcctcatcgaacacaaaggcacaatcatcggaaaacaaaacgatacctgctcgaccaaaacctcatgctggctcgaatccgtcaagggtttcttctacggcctcaagaacatgctctccggaatattcggaaacgtattcctgggcatattcttattcctcgcaccctttgtgctcctcatcttctttttcttcttcggctggcgccttctgttctgcctgaaatgctgccgcagaacccgcggcctactcaagtacaaacacctcaaagacgaagaagaagccggctacaagaaaatcatcgaaagactcaatggcaagaaaggcaaatcccaattattcgacggagaacgtctagccgaccgaaaaatcgccgaactcttctcaaccaaaatccacatcggc

SEQ ID NO: 15718 - RNA, 1932 nt, synthetic construct
  misc_feature 1..1932: note = derived and/or modified CDS sequence (opt11) from CCHFV(Afg09-2990)__HM452306.1__Gc
  source 1..1932: mol_type = other RNA
ttcctagacagcatcgtcaagggcatgaaaaacctcctcaactcgacatccctcgaaacatcgctcagcatcgaagccccatggggagccatcaacgtccaatccacatacaaaccgaccgtcagcaccgccaacatcgcactttcctggagcagcgtagaacatcgcgggaataaggtcctagtctccggacgctctgaaagcatcatgaaactagaagaacgaaccggtatctcctgggacctcggcgtcgaagacgcgtcggaaagcaaactcctaaccgtgtcagtaatggatctatctcaaatgtactcaccagtcttcgaatacctatcaggcgacagacaagtagaagagtggcccaaagcgacctgcaccggcgactgcccagaacgctgcggctgcacctcttcaacatgcctccacaaagaatggcctcacagccgtaactggcgctgcaaccccacctggtgctggggagtagggaccggctgcacctgttgcggactagacgttaaggacctattcaccgactacatgttcgtcaaatggaaagtagaatacatcaaaacagaggccatagtctgcgtagaactcacaagccaagagagacagtgctcgctcatagaagcaggcaccaggttcaacctaggctccgtcaccatcaccctctccgaaccgagaaacattcaacaaaaactcccacccgagatcataactctccacccaaaaatcgaagaaggcttcttcgaccttatgcacgttcaaaaagtcctcagcgcatcaacagtgtgcaaactccaatcttgcacccacggcgtcccaggagacctacaagtataccacataggaaacctcctaaaaggcgaccgcgtcaacggccacctcattcacaaaattgagcaacactttaacacatcctggatgagttgggacggctgcgacctagactactactgcaatatgggtgactggccctcatgcacctacacaggagtcactcaacacaaccacgccagcttcgtcaatcttctaaacatcgaaaccgactacaccaaaaccttccacttccactccaaaagggtaaccgcacacggtgatactccccaactcgacctgaaagcccgccccacctacggagcgggcgaaataaccgtactggtagaagtcgctgacatggaactacacaccaaaaagatcgagatcagcggcctaaaattcgcaggcctaacctgcacgggctgctacgcctgctcctccgggatctcctgcaaggtccgcatccacgtagacgaaccagacgaactcacagttcacgtcaaatccgacgaccccgacgttgtagcggcatccagctcgctcatggcccgcaaactagagttcggaacagacagcaccttcaaagcgttctccgccatgcccaaaacctccctctgcttctacatcgtagaacgcgaatactgcaaatcctgcagcaaagaagacactcaaaaatgcgttaacaccaaactcgaacaaccccaaagtatactgatagaacacaagggaacgatcatcggcaaacaaaacaacacatgcaccgccaaagcatcatgttggctcgaaagcgtaaaatccttcttctacggactcaaaaacatgctaggaggcatcttcggcaacgtattcatcggcattttcacctttctgaccccattcatactactaatactcttcttcatgttcggatggcgcatcctcttctgcttcaaatgctgccgaagaacacgcggactcttcaagtaccgccacctcaaagacgacgaagaaaccggctaccgcaaaatcatcgaacgactaaacaataaaaagggcaaaaaccggctactcgacggagaacgactcgcggacagaaaaatcgccgaactattctccacgaaaacacacatcggg

SEQ ID NO: 15719 - RNA, 1932 nt, synthetic construct
  misc_feature 1..1932: note = derived and/or modified CDS sequence (opt11) from CCHFV(Sudan Al-Fulah 3-2008)__HQ378184.1__Gc
  source 1..1932: mol_type = other RNA
ttcctagactcaatagtcaagggaatgaaaaacctcctaaactcgacatcattagaaacctcactgtcgatagaagccccatggggcgccatcaacgttcaaagtacctacaaaccaacagtgtcaaccgccaacatcgcactttcctggtcgtcagtcgaacaccggggcaacaagatcctcgttagcggccgtagcgaatcaatcatgaaactagaggaaaggaccgggatctcatgggacctcggcgtcgaagacgcgtccgagagcaaactactaacagtctccgtaatggacctctcacaaatgtactctcccgtattcgaatatctatccggggaccgccaagtggaagaatggcccaaagccacctgtacaggagactgccccgaacgctgcggctgcacatccagtacctgcctgcacaaggaatggccgcacagccgcaactggcgctgcaaccccacctggtgctggggagtgggcacaggctgcacctgttgcggattagacgtcaaagacctattcaccgactacatgttcgttaagtggaaagtcgagtacatcaaaacagaggcaatagtatgcgtagaactcacctcgcaagaacggcagtgctcactcatcgaagccggaactagattcaacctgggacccgtcaccatcaccctgtccgagccgcgaaacatccaacaaaaactcccacccgagatcataaccctacacccccgcatagaagagggcttctttgacctcatgcacgttcagaaggtccttagcgcctccaccgtatgcaaactccaatcctgcacccacggagtcccaggcgacctccaagtttaccacatcggcaaccttctaaaaggcgacaaagtcaatggccacctaatccataaaatcgagcctcacttcaacaccagctggatgtcctgggacgggtgcgacctagactactactgtaacatgggagattggccctcctgcacatacacgggcgtaacacagcacaaccacgccagcttcgtcaacctcctcaacatcgagacggactacaccaaaaacttccacttccactcaaaacgagtcacagcacacggtgacacaccccaactagatctaaaagcccgacccacgtacggcgccggcgaaatcaccgtccttgtcgaagttgcagacatggaactccacacaaagaaaatcgaaatctcaggactaaaattcgcctcgctaacatgcaccggctgctacgcctgctcaagcggcatctcatgcaaagtacggatccacgtcgacgaaccagacgaactcacggtccacgtaaaaagcgacgaccccgacgtagtcgcggcatcctcatctctcatggcccggaaactcgagttcggaactgactccacatttaaagccttctccgccatgcccaaaacctcactctgcttctacatagtggaaaaggaatactgcaaatcctgctccgaggaagacacaaagaagtgcgtcaacacaaaactcgaacaaccccaatctatcctaatagagcacaaaggaacgatcatcggcaaacaaaactccacttgcacagccaaagtctcgtgctggctagagagcgcgaaatcattcttctacggcctcaaagacatgctctccggaatcttcggaaacgtcttcatcggcatattcctctttctggcccccttcgtcctactcgttctcttctttatgttcggctggcggatcctcctttgcttcagatgctgccgacgaacccgtggacttttcaaataccgccacctcaaggacgacgaagaaaccggataccgccgcataatcgagcgtctaaacaacaagaaaggcaaaaacaagctactggacggcgagcgactagctgacagaaaaatcgccgaactcttcagcaccaaaacacacatcggc

SEQ ID NO: 15720 - RNA, 1932 nt, synthetic construct
  misc_feature 1..1932: note = derived and/or modified CDS sequence (opt11) from CCHFV(Sudan AB1-2009)__HQ378187.1__Gc
  source 1..1932: mol_type = other RNA
tttctcgattcaatcgccaaaggtatgaaaaacctactcaactcaacctccctcgagacctctctatccatcgaggccccgtggggcgcgataaacgtccagtcgacctacaaaccaacagtctctaccgcaaacatagccctctcctggtcctcagtcgaacaccgcggcaataaaatcctcgtctcaggccgctccgaatccatcatgaaactagaggaacgcaccggcatctcctgggacctaggcgtcgaagacgcctctgaaagcaaactcctaacagtatctgtaatggacctcagccaaatgtactcccctgtcttcgaatacctctccggggacagacaagtcgaggagtggcccaaagccacatgcacaggagactgccccgagcgatgcggctgcacatcaagcacatgcctccacaaagaatggccacacagccgcaactggagatgcaaccccacatggtgctggggagtaggtaccggctgtacctgctgcggcctagacgtcaaagacctattcactgactacatgttcgtcaaatggaaagtcgagtacatcaaaacagaagcaatcgtctgcgtcgagctgacatcccaagagcgccaatgctccctcatcgaagctggcacccgattcaacctaggacccgtcacaatcacactctcagaaccccgcaacatccaacaaaaactacccccagaaatcatcaccctccacccacgaatcgaagaaggatttttcgacctcatgcacgtccaaaaagtactcagcgcctcaaccgtatgcaaactacagtcctgcacccacggagtacccggcgacctacaggtctaccacatagggaacctcttaaaaggcgacaaagtgaacggacatctcatccacaaaatcgagccccacttcaacacttcctggatgtcatgggacggctgcgacctcgactactactgcaacatgggagactggccatcatgcacatacaccggcgtcacacaacacaaccacgcatcattcgtaaacctccttaacatcgagaccgactacaccaaaaacttccactttcactctaaacgcgtcaccgcacacggcgataccccgcaactagacctcaaggctcgccccacctacggagccggcgaaataacagttctcgtagaagtcgccgacatggaactccacaccaagaaaatcgaaatctccggccttaaattcgccagcctcacatgcacaggatgctacgcatgttcttccggaatctcctgcaaagtccgcatccacgtagacgagccggacgaactcaccgtacacgtaaaaagcgacgacccagacgtagtcgcagcctcaagctccctcatggcccgaaaactcgagttcggcaccgactcaacattcaaagccttctcagccatgcccaaaacatcactctgcttctacatcgtcgagcgcgaacactgcaaatcctgcaacgaagaagacacaaagaaatgcgtaaacaccaaactagaacaaccccaatcaatcctcatcgaacacaaaggcactatcatcggcaaacaaaactcaacgtgcaccgcacgcgcctcatgctggctcgaaagcgtgaaatccttcttctacggcctcaaaaacatgctttccggcatcttcggcaacgtattcatgggcatcttcctgtttctagctcccttcatcctcctgatactcttcttcatgttcggctggagaatactattctgcttcaaatgctgcaggcgcacacgcggcctcttcaaatatcgacacctaaaagacgacgaagaaacaggctaccgccgaatcattgaacgactcaacaacaagaaaggcaaaaacaaactcctagacggagagagactagcagacagacgcatcgccgaactcttcagcaccaaaacacacatcggc

SEQ ID NO: 15721 - RNA, 1932 nt, synthetic construct
  misc_feature 1..1932: note = derived and/or modified CDS sequence (opt11) from CCHFV(NIVA 118595)__JN572083.1__Gc
  source 1..1932: mol_type = other RNA
ttcctagactcaatagtaaaaggcatgaaaaacctcctcaactccacttcactcgagacctccctctccatcgaagcaccatggggcgcaataaacgtgcaatccacatacaaaccaacagtgagcgccgcaaacattgccctctcctggtcctctgtcgaacaccgagggaacaaaatcctcgtctccgggcgatctgaaagcataatgaagctcgaagaaagaaccggcatctcctgggacctcggcgtagaagatgcttcagaatcaaagctactgaccgtctccgtcatggacctctctcaaatgtactcaccagtattcgagtacctctcaggcgaccgacaagtagaagaatggcccaaggcaacttgcaccggcgactgccccgaacggtgcggctgcacctcgagcacatgcctccacaaagaatggccacactcccgaaactggcgatgcaaccccacctggtgctggggcgtaggaacaggatgcacatgctgcggcctagacgtcaaagacctattcaccgactacatgttcgtcaagtggaaagtagaatacataaaaaccgaagccattgtctgcgtcgaactgacctctcaagaaaggcagtgcagcctcatcgaagcgggaacccggtttaacctaggatcggtcaccataaccctctcagaacctcgcaacatccaacaaaaactcccgcccgaaatcatcacactacacccccgcatcgaagaaggattcttcgacctcatgcacgtacagaaagtcctaagcgcgagcacagtgtgcaaactccaatcctgcacccacggggtccccggcgacctacaggtataccacatcggaaacctcctgaaaggagaccgagttaacggacacctaatacacaagatcgagcaacacctcaacacctcctggatgtcctgggacggctgcgacctcgactactactgcaacatgggcgattggcctagctgcacctacaccggtgtcacccaacacaaccacgcttccttcgtcaaccttctcaacatagaaacagactacacgaaaacattccacttccactcgaaacgagtcaccgcccacggagacaccccacaactggacttaaaagcccgacccacgtacggcgcgggcgaaatcacggtcctcgtcgaggtggccgatatggaactccacaccaaaaagatcgaaatctccggcctgaaattcgcatccctctcctgcaccggctgctacgcctgctcctccggcatatcctgcaaagtcagaatacacgtagacgaacccgacgaactaacagtccacgtcaagtccgacgatcccgacgtggtagccgcctcgtcaagcctcatggcacgaaaactcgaatccggaaccgactccacgttcaaagccttctccgcaatgcccaaaacctcgctctgcttctacatagtcgaacgagaatactgcaaaggatgcagtaaagaagacacccaaaaatgcgtcaacaccaaactagagcaaccccaatccatactcattgaacacaagggcaccataataggcaagcaaaataatacctgcaccgccaaagcctcctgctggctagaatccgtaaaatccttcttctacggcctcaagaacatgctctctggaatcttcgggaacgtctttctaggaatcttctcattccttgccccattcgtcctcctaatcctattcttcatgttcggatggcgcatcctattctgcttcaaatgctgccgacgaacacgcggcctattcaaataccgccacctcaaagacgacgaagaaaccggataccggaaaatcatagaacgactcaacaacaagaaaggcaaaaacaaattactcgacggagaacgactcgcagaccgaaaaatcgcggaactcttctccacgaaaacccacatcggc

SEQ ID NO: 15722 - RNA, 1932 nt, synthetic construct
  misc_feature 1..1932: note = derived and/or modified CDS sequence (opt11) from CCHFV(NIV 112143)__JN572085.1__Gc
  source 1..1932: mol_type = other RNA
ttcctagactcaatcgtcaaaggcatgaaaaacctccttaactcgacctcactagagacctccctaagcatcgaagcaccctggggcgccataaacgttcaatccacctacaaacccacagtgagcgcggcaaacatcgccctatcgtggagctcagtcgaacaccgcggcaacaaaatcctagtatcgggaagaagcgaatccataatgaaactcgaagaacgcacagggatatcctgggacctcggggtcgaagacgcctctgaatccaaactactcaccgtctcagtcatggacctatcccaaatgtactcccccgtattcgagtacctcagcggcgaccgccaagtcgaagaatggccaaaagccacctgtaccggtgactgcccagagcgctgcggctgcacaagcagtacctgcctacacaaagaatggccacactcccgcaactggcgctgcaaccccacatggtgctggggagtaggcactggctgcacatgctgtggcctagacgttaaagacctattcacagactacatgttcgtaaaatggaaagtcgaatacataaaaaccgaagccatcgtatgcgtagaactaacctctcaagagcgccaatgcagcctgatcgaagccggcacccgtttcaacctcggatcagttacgatcaccctctccgagccgcgtaacatccaacaaaaactcccacccgaaatcataaccctccacccccgcatcgaggaaggcttcttcgacctaatgcatgtacaaaaggttctgtcagcatccacagtctgcaaactgcaaagctgcacccacggcgtccccggcgacctacaagtataccacatcggcaacctcctcaaaggggaccgagtcaacggccaccttatccacaaaatcgaacaacacctaaacacatcctggatgagctgggacgggtgcgacctcgactattactgcaatatgggcgactggccctcctgcacctacaccggcgtcacccaacacaaccacgcgagcttcgtcaacctactaaacatcgaaaccgactacaccaaaacgttccacttccactcaaaaagggtcaccgcacacggcgacacaccccaactcgacctgaaagcacgccccacctacggagcaggcgaaatcaccgtcctcgtggaagtcgccgacatggaactccacaccaagaaaatagaaatttccggcctcaaattcgcctcactctcctgcaccggctgctatgcatgctcgagcggcatatcatgcaaagtgcgcatccatgtggatgaacccgacgagctaacggtccacgtcaaatccgacgaccccgacgtcgtcgccgcaagttcctccctcatggcccggaaactcgagttcggaaccgactcaacatttaaagccttctcagccatgcccaaaacctccctctgcttctacatcgtagaacgcgaatactgcaaaggatgctctaaagaagatacccagaaatgcgtaaacacaaaactcgaacagccgcaatcaatcctgatcgaacacaaaggtacaattatcggcaaacaaaacaacacgtgcaccgccaaagcctcctgctggctagagagcgtcaaatccttcttctacggactcaaaaacatgctatcgggcatattcggcaacgtgttcctcggcatattctccttcctcgcccccttcgtactactcatcctcttctttatgttcggctggcgcatactattctgcttcaaatgctgcaggcgcacacgcggcctattcaaataccgccacctcaaagacgacgaagaaaccggctaccgaaaaatcatcgaacgcttaaacaacaagaaaggcaaaaacaaactattagacggagaaagactagcggaccgcaaaatcgctgaactctttagcaccaaaacccacataggc

SEQ ID NO: 15723 - RNA, 1932 nt, synthetic construct
  misc_feature 1..1932: note = derived and/or modified CDS sequence (opt11) from CCHFV(SCT ex Afghanistan)__KC344856.1__Gc
  source 1..1932: mol_type = other RNA
tttctcaactcaatagtcaaaggaatgaaaaacctcctcaactccaccaaccttgagaccagcctctccatcgaggcaccgtggggcgccattaacgtccagtccacctttaaacctaccgtctctacagccaacatcgccctgtcctggagcagcgtcgaacaccggggcaacaaaatcctagtttcaggccgatccgaaagcataatgaaactcgaggaacgaaccggcatctcgtgggacctaggagtcgaagatgctagcgagtccaaaagcctaaccgtcagcgtcatggacctctcccagatgtactcacccgtcttcgaatacctgtccggcgaccggcaagtagaagagtggcccaaagccacatgcaccggcgactgcccagaacgctgcggctgcacctcatccacgtgcctccacaaagagtggccacacagccgaaactggcgctgcaaccccacctggtgctggggagtcggcaccggctgtacctgctgcggactagacgtcaaggacctgttcacagactacatgttcgtcaaatggaaagtcgagtacatcaaaacagaagccatagtctgcgtcgaattgacttcgcaagaacgccaatgctcactaatagaagcgggcacccgtttcaacctaggccccgttacaatcacactctccgaaccccggaacatccaacaaaaactaccaccagaaatcatcaccctgcacccccgcatagaggaaggcttcttcgacctcatgcacgtccagaaagtactcagtgcatcaacagtatgcaaacttcaaagctgcacccacggggtcccaggagacctccaggtctaccacataggcaacctactcaaaggagacaagctaaacggtcacatgatacacaaaatcgagccccacttcaacacgtcatggatgagctgggacggctgcgacctcgactactactgtaacatgggggactggccctcgtgcacatacaccggagtaacacaacacaaccacgcagccttcgtcaacctcctaaacatcgaaacagattacaccaagaacttccactttcactcaaaaagagtcaccgcccacggcgacacaccccaactagacctaaaagcccgacccacctacggcgccggcgagatcacagtattggtagaagtcgcagacatggaattacatacgaagaaaatcgacatatcgggactcaaattcgcctcactcacatgcgcaggctgctacgcctgctcatccggcatctcttgtaaagtccgcatccacgtcgacgaacccgacgagctaacagtccacgtaaaatccgaagaccccgacatcgttgccgcctccacttccctcatagcccgaaaactagaactcggaacggactcaaccttcaaagcgttttcagccatgcccaaaacttccctctgcttctacatcgtggaacgagaatactgcaaatcctgctccaaagaagacacacaaaaatgtgtcaacaccaaactcgaacacccccaaggcatcctaattgaacacaaaggaaccatcatcggcaaacaaaacgacacatgcaccgccaaagccggctgctggctagaatcggtcaaatcgttcttctacggactcaagaacatgctctcaggaatattcggcaacgtcttcatcggtatcttcctattcctagcccccttcgtactcctcatactcttcttcatgttcgggtggcgactactattctgcttcaaatgctgccgaagaactagaggactcttcaaataccgccacctcaaagaagacgaagaaagtggataccgccggatcatcgaacgattaaacaacaaaaaggggaaaaataagctcctagacggagaacgactggccgaccgccgtatcgccgagctgttctccaccaaaacacatatcgga

SEQ ID NO: 15724 - RNA, 1932 nt, synthetic construct
  misc_feature 1..1932: note = derived and/or modified CDS sequence (opt11) from CCHFV(Zahedan 2007)__KC867273.1__Gc
  source 1..1932: mol_type = other RNA
ttcctcgactctatagtaaaagacatgaaaaacctgctcaacagcacatcacttgaaacatccctcagcatagaggcaccctggggcgccatcaacgttcagtccacctacaaaccgacagtcagcaccgctaacatcgccctcagttggtcaagcgtcgaacaccgcggcaacaaagtccttgtctccggccgctccgaatccataatgaaactcgaagaaaggacaggcatttcatgggacctaggcgtcgaagacgccagcgaaagcaaactgctaactgtgagcgtaatggacctgtcccaaatgtacagccccgtcttcgagtacctcagcggagaccgccaagtcgaagaatggcccaaagctacctgcaccggagactgccccgaacgatgcggctgcacctcctccacttgcctgcacaaagaatggccccactcacgtaactggaggtgcaaccccacctggtgctggggagttggcaccggatgtacctgttgcggcctggacgtcaaagacctattcaccgactacatgttcgtcaaatggaaagtcgagtacataaagaccgaagcaatcgtctgcgtggaactaacctcgcaagaacgccagtgctccctcatcgaagccggcacacgcttcaacctgggctctgtcaccatcaccctctcggaacccagaaacattcaacaaaagctcccaccagaaattatcaccctccaccccaaaatagaggagggcttcttcgacctaatgcacgtgcagaaagtactttccgcgtccacagtttgcaagctccaatcatgcacacacggagttcccggcgacctccaagtctaccacatcggcaacctactcaaaggcgaccgcgtcaacggccacctaatccacaagatcgaacagcacttcaacaccagctggatgtcatgggacggatgcgacctcgactactactgcaacatgggagactggccatcatgcacttacaccggcgttacccaacacaaccacgctagcttcgtcaacctccttaacatcgaaacggactataccaaaaccttccacttccactccaaacgagtcaccgcccatggcgacacacctcaactggacctaaaagcccggcccacatacggagcaggcgaaatcactgtcctagtagaagtagccgacatggaactacataccaaaaagatcgagatctccggcctcaaattcgcaggcctcacatgcaccggctgctacgcatgttcgtctggaatctcatgcaaggtgcgtatacacgtagacgaacccgatgaactaactgtacatgtcaagagcgacgaccccgacgtcgtcgccgcttcctcctccctaatggccagaaagctcgagttcggaacggactccaccttcaaagccttcagtgccatgccaaaaacatcactctgcttctatatcgtcgaacgcgaatactgcaaatcatgctcaaaggaagacacccaaaaatgcgtcaacactaaactcgaacaaccccaatctatcctaatcgaacacaagggaaccatcatcggcaaacagaacaatacctgcactgccaaagcatcctgctggctggaaagcgtgaaatccttcttctacggcctcaaaaacatgctgggaggcatcttcggcaacgtcttcataggaatcttcaccttcctcacccctttcatcctcctaatcttcttctttatgttcggatggcgaatcctattctgtttcaagtgctgccgacgcacccgcggcctcttcaaatacagacacctcaaagacgacgaagaaaccggataccgaaaaataatcgaacgactcaacaacaagaaaggtaaaaacagactactagacggagaacggctagccgaccgcaaaatcgccgaactattctccaccaaaacccacatcgga

SEQ ID NO: 15725 - RNA, 1932 nt, synthetic construct
  misc_feature 1..1932: note = derived and/or modified CDS sequence (opt11) from CCHFV(SPU 44/08)__KJ682805.1__Gc
  source 1..1932: mol_type = other RNA
ttcctagactccatcgtcaaaggcatgaagaacctactcaacagcacatccctagagacctccctcagcatcgaagccccctggggagccatcaacgtccaaagcactttcaaaccaaccgtctccgcagccaacatcgcgctctcatggtcctccgtcgaacacagaggaaacaaaatcctagtctcgggacgctccgagagcatcatgaaactagaagaacgcaccggcatctcctgggacctcggcgtcgaggacgcatccgaatcaaagctgctgacagtcagtgtgatggatctatcccaaatgtactcaccagtcttcgaatacctctcaggcgaccggcaagtagaagaatggccaaaagcaacctgcaccggagactgcccagaacgatgcggctgcacctcctcaacttgcctacacaaggaatggccccactcacgaaactggcgctgtaacccgacctggtgctggggcgtgggcaccggctgcacgtgctgcggcctcgacgtcaaggacctattcacagactacatgttcgtcaaatggaaagtagactatatcaaaaccgaagccatagtgtgcgtagagctcaccagccaagaacggcaatgctccctcatcgaagccggcacccgattcaacctaggaccagtcaccatcactctttcagaaccacgaaacatacagcaaaaactaccacccgaaatcgtcaccctgcacccccgcatagaagaaggtttcttcgacctcatgcacatacaaaaagtactctccgcgtccaccgtctgcaaactccaatcatgcacccacggtgtccccggagacctccaaatctaccacatcggcaaccttttaaaaggagacaaggtcaacggacacctcatccacaaaatagagccccatttcaacacctcgtggatgtcgtgggacggctgcgacctagactactactgcaacatgggcgactggccctcatgctcctacaccggcgtcacccaacacaaccacgccgcattcgttaacatgctcaacatcgagacagactacaccaaaaatttccacttccactccaagcgcgtcacggcacacggcgacacaccccagctcgacctcaaagccagacccacctacggcgccggcgaaatcaccgtcctcgtcgaagttgcggacatggaactccacaccaaaaagattgaaataagcggcctaaagttcgcgtcgctaacctgcaccggctgctacgcctgcagctccggcatttcatgcaaagtccggatccacgtcgacgaaccagacgagctcacagtccacgtcaaaagcgaagacccagacatcgtcgctgcctctagctcgctcatggcccggaaacttgagttcggcacagactccaccttcaaagcattctccgccatgcccaaaacctcactctgcttctacatcgtcgaacgagaatactgcaaatcctgctccaaagaagacacacagaaatgcgtcaacaccaaactagaacaaccccaatccatcttaatcgaacacaaaggaaccattatcgggaaacaaaacgacacatgtaccgcaaaagcctcctgctggctagaatcaatcaagagcttcttctacggacttaaaaacatgctgtcaggcatctttggcaacgtcttcataggtatcttcctattcctagcccctttcatcatgctcatccttttcttcatgttcggctggcgcatcttattctgcttcaaatgctgccgccgcacccgcggccttttcaaataccgccatctcaaagatgacgaagaaatcggctacagaaaaataatagaacgtctcaacaacaagaaaggcaaaaacaaactcctcgacggggaacgactagcagatcgaaaaatagccgaactattctcaaccaaaacacacattggc

SEQ ID NO: 15726 - RNA, 1932 nt, synthetic construct
  misc_feature 1..1932: note = derived and/or modified CDS sequence (opt11) from CCHFV(SPU 383/87)__KJ682806.1__Gc
  source 1..1932: mol_type = other RNA
ttcctcgactccatagtcaaaggcatgaaaaacctccttaactccacatcccttgaaaccagcctctccatcgaagccccctggggagccatcaacgtccaatcgacgttcaaacccaccgtcagcgctgcaaacatcgccctatcatggagcagcgtcgaacacagaggcaacaaaatcctcgtcagcggccgaagcgagtccataatgaaactcgaggaacgcaccggaatctcctgggatctaggagtcgaagacgcgagcgaatccaaactccttaccgtaagcgtcatggacctctctcaaatgtactcgcccgtcttcgaatacctaagtggcgaccgccaagtcgaagaatggcctaaggcgacctgcaccggcgactgcccagaacgctgcggatgcacctcctccacatgcctccacaaagaatggccacacagccgaaactggcgctgcaatcccacatggtgctggggcgtcggcacaggctgcacttgctgcggcctcgacgtcaaagacctcttcaccgattacatgttcgtaaaatggaaagtagactacatcaaaaccgaagccatagtctgcgttgagctcacctcccaagaacgtcaatgctccctcatcgaagcgggcacccgattcaatttaggaccagtaacgatcaccctaagtgagccacgcaacatccaacaaaagctaccgcccgaaatcgtcacactccacccccgcatcgaggaaggctttttcgaccttatgcacatccaaaaagtcctcagcgcctccactgtctgcaaactccagtcctgcacccacggagtccccggagacctccaaatctaccacatcggcaacctacttaaaggcgacaaagtaaacggccacctgatccacaaaattgagccccatttcaacacctcatggatgtcctgggacggctgcgacctcgactactactgcaacatgggagactggccctcctgctcctacacaggagtcacccaacacaaccacgccgcctttgtcaacatgctaaacatagaaacagactacaccaaaaacttccactttcacagcaaaagagtcaccgctcacggcgacacaccccaactggacctcaaagcccggccaacctacggggccggagaaataacggtcctggtcgaggtcgcagacatggaactccacaccaagaaaatagaaatatcaggcctcaaattcgcatcgctaacctgcacaggctgctacgcatgctccagcggcatctcctgcaaagtacgaatccacgtcgacgaaccagacgaactcacagtacacgtcaaaagcgaggaccccgacatagttgccgcctcctcatccctcatggcccgcaagctcgagttcggcaccgactcaaccttcaaagccttctcagccatgcccaaaacatcactgtgcttctacatcgtcgaaagagaatactgcaagtcctgctccaaagaagatacccaaaagtgcgtaaacaccaaactggaacaaccccaatcaatactcatcgaacacaaaggcacgatattcggcaagcaaaatgacacatgcacagccaaagcctcctgttggctcgaaagcgtcaaatccttcttctacggactaaagaacatgctaagcggaatattcggtaacgtcttcatcggcgtcttcctcttcctggcacccttcatcatgctaatcctctttttcatgttcggctggcgaatactattctgcttcaagtgctgcaggcgcacccgcggcctcttcaaataccgccacctcaaagacgacgaagagataggataccgcaagatcatcgaacgtctgaacaataagaaaggcaaaaacaaactacttgatggagaacgcctcgcagacagaaaaatcgccgaactattctccaccaaaacccacatcggc

SEQ ID NO: 15727 - RNA, 1932 nt, synthetic construct
  misc_feature 1..1932: note = derived and/or modified CDS sequence (opt11) from CCHFV(SPU 130/89)__KJ682807.1__Gc
  source 1..1932: mol_type = other RNA
agcctagactccatagtaaagggcatgaagaacctcctgaactccacctccctagaaacctcactctccatagaagccccctggggcgcaatcaacgtccaaagcacattcaaacccactgtctcagccgcaaacatcgccctgagctggtcatccgttgaacaccgcggcaacaaaatactcgtctctggacgctcagaatccatcatgaaactagaagaacgcacaggcatatcatgggacctaggagtcgaagacgcgtccgagtcaaaactcctcacagtgtcagtaatggacctatcccagatgtactcacccgtattcgagtacctctccggcgaccgtcaggtcgaagagtggccgaaagcaacctgcactggcgattgccccgaacgctgcggctgcacatccagcacatgcctgcacaaagaatggccccacagccgcaattggcgatgcaaccccacgtggtgctggggcgtcgggaccggatgcacttgctgcgggctggacgtcaaagacctcttcacggactacatgttcgtaaaatggaaagtagactacatcaaaaccgaggccatagtatgcgtggaactaacatcccaggaacgccagtgctccctgatcgaagccggtacccgcttcaacctaggccccgtcactataacactctcagagccccgtaacatccaacaaaaactcccacccgaaatagtcacgcttcacccgcggatcgaagaaggcttcttcgacctcatgcacatccaaaaagtcctcagcgcctccacagtctgcaagctccaaagctgcacccacggcgtaccgggagacctccagatctaccacatcggtaacctactaaaaggagacaaagtcaacggccacctgatacacaagatcgaacctcacttcaacacatcctggatgtcatgggacggatgtgacctagactactactgcaacatgggcgactggccgtcctgctcatacacgggagtcactcaacacaaccacgccgcattcgtcaacatgctcaacatcgaaacagactacactaagaatttccacttccactcaaaacgcgtcaccgcccacggcgacactccccaacttgacctcaaagcaagaccaacgtacggagcaggcgaaatcacggtcctcgtcgaagtcgcggacatggaactccacaccaaaaaggttgaaataagcggcctcaaattcgcatccctaacatgcaccggctgctacgcctgctcatccggcatcagctgcaaagtccgcatccatgtcgacgaacccgacgaactaacggtacacgtaaaatccgaagacccagacatcgtcgccgcaagctcctcgctaatggcacgcaagctggagttcggcaccgacagcaccttcaaagcgttcagcgccatgcccaaaacctcactctgcttctacatcgtagaacgagaacactgcaaaagctgctccaaagaagacacccaacgctgtgtcaacaccaaactcgaacaaccgcaatcaatcctcatagaacacaaaggcaccatcatcgggaaacagaacgacacctgtacagccaaagcatcctgctggctagaatctataaagagcttcttctacggacttaaaaatatgctctcaggcatcttcggcaacgtcttcatcggagtattcctcttcctagctccctttatcatcctaatccttttcttcatgttcggatggagaatcctgttctgcttcaaatgctgccgccgaacccgcggcctactcaaataccgacacctcaaagacgacgaagagattggctaccggaaaatcatcgagcgactcaacaacaagaaaggcaaaaacaaactactagacggagaacgcctggccgaccgcaaaatcgcagaactattcagcacaaaaacccacataggc

SEQ ID NO: 15728 - RNA, 1932 nt, synthetic construct
  misc_feature 1..1932: note = derived and/or modified CDS sequence (opt11) from CCHFV(SPU 497/88)__KJ682808.1__Gc
  source 1..1932: mol_type = other RNA
tttctggacagcatagtcaaaggaatgcgaaatcttctaaactctacatcactcgaaacatcactaagcatcgaagcaccctggggcgccataaacgtacagtcaaccttcaaacccaccgtctccgcagccaacatcgccctctcctggtccagcgtagaacaccgaggcaataaaatattagtctcgggccgctccgagtcaattatgaaactcgaagaacgcacaggcatctcttgggacctcggggtagaagacgcctcagagtcaaagctcctaaccgtcagcgtcatggacctatcacagatgtacagccccgtattcgaatacctttccggcgaccgccaagtcgaagaatggcccaaagcaacctgcacaggagactgccccgaacgatgcggatgcacctcaagcacatgcctccacaaagaatggccacactcacgaaactggcgctgcaaccccacctggtgctggggagtcggcacgggctgtacctgctgcggcctagacgtcaaggacctcttcacagactacatgttcgtcaagtggaaagttgactacatcaagaccgaagccatagtctgtgtcgagctcacaagccaagaaagacaatgttccctcatagaagccggcacccgattcaaccttggcccagtaaccattacactttccgaaccaagaaacatccagcaaaagctaccacccgaaatcgtcactctccacccacgcatagaagagggcttcttcgacctcatgcacatacaaaaggttctatccgcctccacagtctgcaaattacaatcctgcacacacggcgttcccggagacctacaaatctaccacataggtaacctcctaaaaggggacaaagtaaacggccacctcatccacaaaatcgaaccccacttcaatacttcttggatgtcctgggacggatgcgacctagactactactgcaacatgggcgactggccaagctgttcatacacgggcgtcacccaacacaatcacgccgccttcgtcaacatgctcaacatcgaaaccgactacaccaaaaactttcacttccactcaaaacgcgtcaccgcacacggcgatacaccccaactagatctaaaagcccgcccaacctacggcgcgggagaaatcaccgtcctagtcgaagtcgccgacatggagctccatacaaagaaaatagagatctccggactcaaattcgcctccctcacatgcacgggctgctatgcctgcagctccggtatctcctgcaaagtccgcatacacgtggacgaacccgatgaactcaccgtccacgtcaaatcagaggacccggacatcgtagccgcctcctcctcgctaatggcacgaaaactagagttcggaaccgactccaccttcaaagccttctccgccatgccaaaaacctcgctatgcttctacatcgtagagcgagaatactgcaaatcctgtagcaaagaagacactcaaaaatgcgtcaacacaaaactggaacaaccccaatccatactaatagaacacaaaggcacaattataggcaaacaaaatgatacctgcaccgcccgagcaagctgctggctagagtccatcaaatcgttcttctatggcctcaaaaacatgctatcgggaatcttcggtaacgtcttcatcggaatcttcctattcttcgcaccctttattatgctcatcctcttcttcatgttcggatggcgcatactattctgctttaaatgctgccgccgaacccgaggcctatttaaataccgtcacctaaaagacgacgaagaggtggggtaccgcaaaatcatagagcgactcaacaacaagaaaggcaaaaacaaactcctcgacggagaacgcctcgccgacaggaaaatcgccgaactattcagcacaaaaacccacatcgga

SEQ ID NO: 15729 - RNA, 1932 nt, synthetic construct
  misc_feature 1..1932: note = derived and/or modified CDS sequence (opt11) from CCHFV(SPU 18/88)__KJ682810.1__Gc
  source 1..1932: mol_type = other RNA
ttcctcgactcaatcgttaaaggcaagaaaaacctactaaactcgacctccctcgaaacctccctatccattgaggccccttggggtgccataaacgtccaatccactttcaaaccaaccgttagcgcggccaacatcgcactctcctggtcttccgtcgaacaccgcggaaacaaaatcctcgtctccggccgctccgaaagcatcatgaaacttgaagaaagaaccggaatcagttgggacctaggagtcgaagacgcgagtgagtccaaacttctaaccgtctcagtaatggacctatcccaaatgtactccccagtcttcgaatacctctccggtgaccgacaagtcgaagaatggcccaaagcaacctgcacaggcgactgcccggagcgctgcggatgcacctcctccacatgtctccataaagaatggccacacagccgcaactggcgctgcaaccccacctggtgctggggcgtcggcacaggatgcacctgttgcggactcgacgtcaaagaccttttcacagactacatgtttgtcaaatggaaggtggactacataaaaacggaagccatcgtgtgcgtagaactaacaagccaagaacgccaatgctcactcatcgaagccggaacccgtttcaatctcggaccagtcacaataacgctctcagaaccacgcaacatccagcagaaactgcccccagaaatcgtcaccctccacccacggatagaagaaggattcttcgacctaatgcacattcaaaaagtactgagcgcctccacggtctgcaaactccaaagctgcacacacggcgtaccaggcgacctccagatctaccacatcggtaacctcctaaaaggcgacaaagtaaacggccacctgatacacaaaatcgaaccccacttcaacacatcctggatgtcctgggacgggtgcgacctcgactactactgcaacatgggggactggccatcctgttcctacaccggagtcacccaacacaaccacgccgccttcgtaaacatgcttaacatagagaccgactacaccaaaaacttccacttccactccaaacgagtgacagcacacggtgacacaccgcaactagacctcaaagcacgccccacatacggtgcaggcgaaatcaccgtactcgtcgaagtcgcggacatggaactacacacaaagaaaatcgagatatcaggactcaaattcgcatccctcacctgtaccggctgctacgcctgctcatccgggatctcatgcaaagtccgcatccacgtagacgaaccggacgaacttaccgtacacgtaaagtcagaggaccccgacatagtcgccgcctcctcttcactaatggcacgcaaactcgagtttggcaccgactccaccttcaaagcattctccgccatgccaaaaacatcactatgcttctacattgtggaacgcgaatactgcaaaagctgcagcaaagaagacacccaaaaatgcgtcaacaccaaactcgaacaaccgcaatcaatcctcattgaacacaaaggaaccataatcggcaagcaaaacgatacctgcaccggcaaagccgggtgctggctagaatcaatcaaatcattcttctacggactcaaaaacatgctctccggaatatttggaaacgttttcatcggcatattcctcttcctggccccctttatcatgctaatcctattcttcatgttcgggtggcgcattctcttctgcttcaaatgctgccgccgtacgcgcggcctcttcaaataccgccacctaaaggacgacgaagaaatcggctaccgcaaaatcatcgagcgccttaaaaataagaaaggcaaaaacaaactacttgacggagaacgcctcgccgaccgcaaaatagctgaactcttctctaccaaaacccatatcgga

SEQ ID NO: 15730 - RNA, 1932 nt, synthetic construct
  misc_feature 1..1932: note = derived and/or modified CDS sequence (opt11) from CCHFV(SPU 431/85)__KJ682812.1__Gc
  source 1..1932: mol_type = other RNA
ttcctcgacagcatcgttaaaggccgcaaaaacctactgaactccacctcactcgagacctcgctcagcatagaagccccgtggggcgccataaacgtgcaatcaacattcaaacccacggtcagcgctgccaatatcgccctatcctggtccagcgtagaacaccgcggcaacaagatcctcgtatcaggaagatcagaatccatcatgaagctcgaagaacgcactggaatctcatgggaccttggtgtagaagacgcatccgaaagcaagctcctcaccgtgtccgtcatggatctctctcaaatgtattccccagtattcgaatacctcagcggagaccgccaagtagaagaatggcccaaagctacctgcacgggagactgccccgagcgctgcggctgcacttcaagcacatgccttcacaaagaatggccccacagccgcaactggagatgcaatccgacatggtgctggggagtcggcaccggctgtacctgctgcggcctcgatgtcaaagacctattcaccgactacatgttcgtcaaatggaaagtagaatacatcaaaaccgaagccatcgtatgcgtagagctcacctcacaagagcgccaatgcagcctcatcgaagccggaacgcgattcaacctgggccccgtaaccatcaccctatcagagccccgcaacatacaacaaaagctgcccccagaaatcataaccctccacccacgcatcgaagagggattcttcgacctcatgcacgtccaacgagtactaagcgcctcaaccgtctgcaaactgcaatcatgcacacacggtgttccgggagaccttcaagtctaccacataggcaacctcctcaaaggggacaaggtcaacggacacctaatacacaagatagaaccacacttcaacaccagctggatgagctgggacggatgcgacctcgactactactgcaacatgggggactggccatcatgcacctacacgggcgtgactcagcacaaccacgccgccttcgtcaatctcctcaacatcgaaaccgactacactaaaaacttccacttccactccaaacgcgtcacagcacacggcgataccccgcaattagacctcaaggcacgccccacctacggcgccggcgaagtcactgtactcgtcgaggtagccgacatggaactccacaccaagaaaatcgaaatatccggactaaaattcgcttcactaacctgcacaggctgctacgcgtgctcctccggcatctcatgcaaagtaaagatccacgtagacgaaccagacgaactaacagtccacgttaaaagcgaagacccggacatcgtagccgccggcagctcgctcatggcccgtaaactagagttcggcgcggactcgaccttcaaggccttctctgccatgcccaaaacctctctctgcttctacatagtggaacgcgaatactgcaaatcatgcagcagggaagacacacgcaagtgtgtaaacaccaaactagaccgcccacaatcgatactcatcgaacataaaggcactataatcggcaagcaaaacaacacatgcacagcaaaagcctcatgctggctcgaaagcgtaaaatcattcttctacggcctcaaaaacatgctttcaggaatattcggcaacgtcttcatcggcatattccttttcatagccccattcgtactcctcatcctgttctttatgttcggctggcgaatcctattctgcttcaaatgctgccggcgcacacgaggcctttttaaatatagacacctaaaggacgacgaagaaaccggttaccgaaagatcatcgagcgtctcaacaacaagaaaggcaaaaacaaactgctcgacggtgaaaggctagccgatcgcaaaatagcagagctattctccaccaaatcacacatcggc

SEQ ID NO: 15731 - RNA, 1932 nt, synthetic construct
  misc_feature 1..1932: note = derived and/or modified CDS sequence (opt11) from CCHFV(SPU 48/90)__KJ682813.1__Gc
  source 1..1932: mol_type = other RNA
tttcgcgacagtatagtcaagggaatgaaaaacctcctaaactccacatcgctagaaacctcgctttcgatagaagccccctggggagccataaacgtacaatcaacatataaaccaaccgtcagcacagccaacatcgccctttcctggtcatccgtggaacaccgaggcaacaaaatcctcgtctcaggccgatcagagagtataatgaaactagaggaacgcaccgggatctcgtgggacctaggcgtcgaggatgcgagcgaaagcaagctactaaccgtaagtgtcatggacctctcgcaaatgtattcacccgtcttcgaatacctatcaggagaccgacaagtagaggaatggcccaaagccacatgcacaggggactgccctgaacgctgtggctgcacatcgagcacttgcctgcacaaggaatggccccattcccgaaactggcgttgcaacccaacctggtgctggggcgtcggcacgggctgcacatgctgcgggctcgacgtcaaggacctcttcactgactacatgttcgtcaagtggaaagtcgaatatatcaaaacggaagccatcgtatgcgtcgaactaacatcccaagaacgtcaatgctccctgatagaagccggaacccgcttcaacctaggaccagtcaccatcaccctcagcgaaccacgcaacatccaacaaaaactaccgccggagatcataacgttgcacccccgaatcgaagagggctttttcgacctcatgcacgtacaaaaggtactgagcgcttcaacggtctgcaaactgcaatcctgcacgcacggcgtccccggcgacctccaagtctatcatataggcaatttactgaaaggcgacaaggtaaacggacatctcatacacaagatcgaaccccacttcaacacctcatggatgagctgggacggatgtgacctcgactactactgcaacatgggagactggccctcatgcacatacacaggcgtcacccaacacaaccgagcgtccttcgtaaacttactcaacatcgaaacagactacaccaagaacttccacttccactccaaacgcgtcactgcccacggtgacaccccacaactcgacctcaaagccagaccaacctacggtgcaggggaaatcaccgtcctggttgaggtcgccgacatggaactccacacaaagaaaatcgaaatctccgggctcaaattcgcgtcgctaacatgcaccggctgttacgcctgctcctcaggcatctcatgcaaagtccgaatccacgtcgacgagcccgacgagctcacggtccacgtcaaatcagacgaccccgacgtcgtcgccgcttcatcatcactcatggcaagaaaactcgagttcggtacagactccaccttcaaggccttcagcgccatgccaaaaacctccctctgcttctacatcgtagaaaaagaatactgcaaatcctgcagcgaagaagacaccaagaaatgcgttaacaccaaactagaacaaccccagtcaatactgatcgaacacaaaggcaccatcataggcaaacaaaactccacatgcaccgccaaagtctcctgctggctcgaatccgccaaatccttcttctacggcctcaaggatatgctatccggcatattcggcaacgtctttataggaatcttcctcttcctagcacccttcatcctgctgatcctgttcttcatgttcggatggcgcatactactatgcttcaaatgctgccgccgcacacgcggcctatttaaataccgccacctcaaagacgacgaagaaaccgggtacagacgaataatcgaacgcctcaacaacaagaaaggcaaaaacaagctcctagatggagaacgactcgccgacaggcgcatagccgaactcttcagcacgaaaacccacatcgga

SEQ ID NO: 15732 - RNA, 1932 nt, synthetic construct
  misc_feature 1..1932: note = derived and/or modified CDS sequence (opt11) from CCHFV(SPU 187/90)__KJ682814.1__Gc
  source 1..1932: mol_type = other RNA
ttcttagactccatcgtcaagggcatgaaaaacctactcaactcgacctccctagaaacctctttgtccatcgaagccccctggggcgccataaacgtccaatccacctacaagccaaccgtatcaacagcgaacatcgcactctcctggtcatccgtcgaacatcgaggcaacaagatactcgtatctggccgcagcgaaagcatcatgaagctcgaagaaagaaccggaatctcatgggacctcggagtcgaagacgcttccgaaagcaaactcctcaccgtcagcgtcatggacctctcccaaatgtactcccccgtcttcgagtacctctccggcgatagacaagtggaagaatggccaaaagctacctgcacaggcgactgccccgaacgctgcggctgcacatcctcaacatgcctccacaaggaatggccccatagccgaaattggcgatgcaaccctacatggtgctggggcgtaggaacaggctgtacctgctgcggactcgacgtcaaagatctcttcacagactacatgttcgttaagtggaaagtcgagtacataaaaaccgaagccatcgtctgcgtggaactcacttcccaagagcgccaatgctccctaatcgaagccggcacccgcttcaacctcggcccagtaaccatcacgctctcggaaccacgtaacatccaacaaaaactcccacccgaaattatcaccctacacccccgaatcgaagaaggcttcttcgacctaatgcacgtccaaaaggtactctcagccagcacagtctgcaaactacaaagctgcacacacggagtccccggcgacctacaggtataccacatcggcaaccttctcaaaggagacaaggtaaacggccacctgatccataaaatagagccccacttcaacacctcttggatgtcgtgggacggctgcgacctcgactactactgcaacatgggcgactggccatcatgcacctacaccggcgtaacacagcacaatcatgccagcttcgtcaatctcctaaacatagaaaccgattatacaaagaacttccacttccactctaaacgcgtcactgcccacggagacacaccacaacttgacctcaaagcccgccccacctacggcgccggggaaatcacagtcctagtagaagtcgcagacatggaactacacacgaagaaaatcgagatctcgggactaaaattcgcatcgctaacctgcacaggatgttatgcctgcagtagtggcatatcatgcaaagtccgaatccacgtcgacgaaccagatgaactcaccgtccacgtgaaatccgacgatcccgacgtcgtagcagcatcctcctccctcatggccaggaaactcgagttcggcactgactcaatattcaaagcattctcggccatgccaaaaacctcactatgcttctacatcgtagaacgcgaacactgcaaatcctgctccgaagaagacaccaagaaatgcgtcaataccaaacttgaacaaccgcaaagtatcttgatcgaacacaaaggaacgataatcggcaaacaaaacagcacctgtaccgccaaaacctcctgctggctagaatccgtaaaatccttcttctacggactcaaaaacatgctctcaggcatcttcggcaacgtattcatcggcatcttcctgttcctagcccccttcatcctactcatcctcttcttcatgttcggctggcgaatcctcttctgcttcaaatgctgccgccgtacccgcggactcttcaaatatcgccacctcaaagacgacgaagaaaccggataccgacgaatcatcgagcgcctcaacaataagaaaggcaaaaataaactcctggacggcgaacgcctggccgaccgccgaatcgcggaactcttcagcaccaaaacacacatcggc

SEQ ID NO: 15733 - RNA, 1932 nt, synthetic construct
  misc_feature 1..1932: note = derived and/or modified CDS sequence (opt11) from CCHFV(Haskovo-V46/13)__KR092379.1__Gc
  source 1..1932: mol_type = other RNA
tttcttgactccatcgtcaaaggaatgaagaacttactaaattcaacatccctcgaaaccagcctatcaatcgaagccccatggggtgcaatcaacgtacaatcaacattcaaaccaaccgtctcaaccgccaacatcgccctctcctggagctccgttgaacaccgaggcaacaaaatcctcgtaaccggccgcagcgagtccattatgaaattagaggaacgcaccggcgtctcatgggacctaggcgtcgaagacgccagcgagtcaaagctactcaccgtaagcatcatggacctatcccaaatgtactcacccgtcttcgaatatctatcaggcgaccgccaagtcgaagaatggcctaaggcaacctgcactggcgactgccccgagcgatgtggctgcacctccagcacctgtctacacaaagaatggccacactcccgaaactggcgctgcaaccccacctggtgctggggcgtcggcaccggctgcacatgctgcggcgtcgacgtcaaagacctattcaccgatcacatgttcgtcaaatggaaagtcgaatacatcaaaacagaagccatagtctgcgtcgagctgacctcccaagaacgtcaatgcagcctcatagaagccggcaccaggttcaacctcggccccgtcaccataaccctgtccgaaccccgcaacatacaacaaaaactgcccccagaaataataactctccaccccaagatcgaagaaggtttcttcgatctcatgcacgtccaaaaagtcctcagcgcgagcaccgtctgcaagctccaatcctgcacacacggcataccaggcgacctccaagtataccacatcggcaaccttctaaaaggagatcgagtaaacggccacctcatccacaaaatcgaaccccacttcaacacctcctggatgtcttgggatggctgcgacttagactactactgcaacatgggagactggccctcctgcacatacacgggcgtcactcaacataaccacgctgccttcgtaaaccttctaaatatcgaaacagactacaccaaaacattccacttccactccaaacgagtcaccgcccacggggacactccacaactcgacctcaaagcaagacctacatacggcgccggcgagattacagtcctcgtagaagtcgccgacatggaactccacaccaagaaagtcgaaatcagcggcctaaaattcgcatcactcacatgcaccggctgctacgcatgtagcagcggcatctcatgcaaagtccgcatccatgtcgacgaaccagacgaactcaccgtacacgtaaaatcctccgaccccgacgtggttgccgcgggaacctcactcatggcccgaaaactagagttcggaacagactcaaccttcaaagccttctccgccatgcctaaaaccagcctatgcttctacatcgtcgaacgcgaatactgcaaatcctgctcagaagatgacacccaaaagtgcgtcgacaccaaactcgaacaaccccaatccattctgatagagcacaaaggcaccataatcggcaaacaaaacgacacatgcaccgcccgtgcgtcctgctggctagagtccgtcaaatcctttttctacggactcaaaaacatgctcggctcagtcttcgggaacttcctaatcggtatactcctatttctcgccccattcgtcctcctagtgctattcttcatgtttggctggaaaatcctattctgcttcaagtgctgccgccgcacccgcggccttttcaagtaccgccacttaaaggacgacgaagaaactggataccggcgaatcatcgaacgcctcaactccaagaaaggcaaaaaccggctcctcgacggagaacgactggccgaccgcaaaatagcagagctattctcaacgaaaacccacatcgga

SEQ ID NO: 15734 - RNA, 1932 nt, synthetic construct
  misc_feature 1..1932: note = derived and/or modified CDS sequence (opt11) from CCHFV(24-R-2012)__KR814856.1__Gc
  source 1..1932: mol_type = other RNA
ttcctcgacagcatagtcaaaggcatgaaaaacctccttaacagcacttccctcgagacctcactctccatcgaagcgccctggggtgctatcaacgtacaatccaccttcaaacctaccgtctcaaccgcaaacatagcactctcgtggtcctccgttgagcaccgcggaaacaaaattctagtcaccggacgctcagagtccatcatgaagctcgaagaacgcaccggggtctcctgggacctcggcgtcgaggacgcatcagaaagcaagttactcaccgtcagcattatggacctatcacaaatgtactcccccgtcttcgaatacttatcaggagaccggcaagtcgaagaatggcctaaagccacttgtaccggcgactgccccgaacgctgcggatgcacaagctcaacctgccttcacaaggaatggccacactcccgtaactggcgatgcaaccccacatggtgctggggagtcggcacaggctgcacttgctgcggagtagacgtgaaagacctctttaccgaccacatgttcgtaaagtggaaagtagaatacataaaaacagaagccatcgtctgcgtagagctaacctcccaagaacgacaatgctccctcatcgaagccggcacccgcttcaacctgggccccgtcaccattaccctctccgagcccagaaacatccaacaaaaactcccacccgaaatcatcaccctccatcctaaagtcgaggagggcttcttcgatctaatgcacgtacaaaaagttctcagtgcatcgaccgtatgcaaactccaatcctgcacacacggcatacctggcgaccttcaagtataccacatcggcaacctcctcaaaggagaccgcgtcaacggccacctcatccacaaaattgaaccacacttcaacacctcctggatgtcctgggacggctgcgacctagactactactgtaacatgggtgactggccctcatgcacctacaccggagtgacacaacacaaccacgctgcattcgtcaacctcctcaacatcgaaacagactacaccaagacattccacttccactcgaaacgcgtcaccgcccacggcgacacaccccagctcgacctcaaagctcggcccacctacggagcaggagaaataaccgtcctagtagaagtagccgacatggaactccacactaagaaagtagaaatctccggcctcaaatttgcctcactagcgtgcaccggctgctacgcatgctcctccggaatctcctgcaaagtcagaatacacgtagacgaaccagacgaactcacagtccacgtcaaatccaacgacccagacgtggtcgcagcgtccacatcactgatggcccggaaactagagttcggcacagactccacattcaaagcgttctcggctatgccaaagacatcgctctgcttctacatcgtcgagcgcgaatactgcaaatcttgctccgaagaggatacccaaaaatgcgttgacactaaactcgaacaaccacaaagcatcctcatcgaacacaaaggaacaatcatcggaaaacagaacgacacctgtaccgccaaggcatcatgctggctcgagtccgtcaaatcattcttctacggcctcaagaacatgctcggcagcgtattcggcaacttcttcataggcatcctcctattcctggcccccttcgttcttctcgtcttattcttcatgttcggctggaaaatcttattctgcttcaaatgctgccgcaggacccgcggcctactaaaatatcgcctcctcaaagacgacgaagaaactggctacagacgaatcatcgaacgccttaacaacaagaaaggcaaaaatcgacttctggacggcgaacgactagccgaccgcaaaatcgcggaactattcagcacaaaaacccacatcggc

SEQ ID NO: 15735 - RNA, 1932 nt, synthetic construct
  misc_feature 1..1932: note = derived and/or modified CDS sequence (opt11) from CCHFV(36-ST-2014)__KR814857.1__Gc
  source 1..1932: mol_type = other RNA
ttcctcgactccatcgtcaaaggcatgaaaaaccttctaaactccacctctctcgaaacctcactctccatcgaagccccatggggagctatcaacgtacaatccaccttcaaacccacagtcagcaccgcgaacatcgcactttcctggtcatccgtcgaacacagggggaacaaaatcctcgtaaccgggcgctcagaaagcataatgaaactagaggaaagaactggcgtctcatgggaccttggcgtagaagacgcatcggaaagcaaactactaacggtgagcatcatggacctttcacaaatgtactccccagtcttcgaatatctaagcggcgaccggcaagtagaagaatggcctaaagccacatgcactggggactgccccgaacgctgcggatgcacctcctccacatgcctccacaaggaatggccccacagccgaaactggcgctgcaaccccacttggtgctggggtgtcggcacaggctgtacctgctgcggcgtagatgtcaaggacctctttaccgaccacatgttcatcaaatggaaagtcgaatacatcaaaactgaagccatagtctgcgtcgaactgacatcccaagaacgacaatgctccctaatagaagcaggcacacgattcaacctcggcccagtcactatcaccctatccgaaccacgcaacatccaacaaaaactcccacccgaaataatcactctacaccccaaaattgaagaaggtttcttcgacctcatgcacgttcaaaaagtactctccgccagcaccgtctgcaaactacaatcctgcacccacggcatacccggcgacctccagatctaccacatcggaaacctactgaaaggggatcgactaaacggacacctcatccacaaaatagaaccccacttcaacacctcctggatgagctgggacggctgcgacctcgactactactgcaacatgggggactggcccagctgcacgtacaccggagttacacagcacaaccacgccgccttcgtaaacctcctcaacatagaaacagactacacaaaaaccttccacttccactccaaacgcgtcacagcacacggagatacgccccaactagacctcaaagcccgcccaacctacggcgccggcgagataaccgtcctcgtggaagtcgcagacatggaactgcacaccaaaaaggtagaaatcagcggactaaaattcgcatctctagcctgcacaggctgctacgcctgctcgtcaggtatctcatgcaaagtccgaatccacgtagacgaacccgacgaactaacagttcacgtcaaatcctccgaccccgacgtcgtggccgcctccacatcattaatggccagaaaactggagttcggcaccgacagcaccttcaaagccttctcagctatgccaaagacatcactatgcttctacatagtagaacgcgaatattgcaaatcctgcagcgaagacgacaccaagaaatgcgtagacaccaaactcgaccaaccgcaatccatcctaatagaacataaaggaaccataataggcaagcaaaacgatacctgcactgccaaggcctcctgctggctcgagtcagtcaaatccttcttctacggccttaaaaacatgctaggcagcgtatttggcaacttcttcgtgggcatactcctcttcctggcacccttcgtactactcgtactcttcttcatgtgcggctggaaattcctcttttgcttcaagtgctgccgccgaacacgaggactcttcaagtaccgccaccttaaggacgacgaagagaccggataccgccgtatcatcgagcgcctcaactcgaagaaaggcaaaaacagactactagacggggaaaggctcgccgaccgcaaaatcgccgaactattctccaccaaatcccacataggc

SEQ ID NO: 15736 - RNA, 1932 nt, synthetic construct
  misc_feature 1..1932: note = derived and/or modified CDS sequence (opt11) from CCHFV(37-R-2013)__KR814858.1__Gc
  source 1..1932: mol_type = other RNA
ttcctcgacagcatcgtcaaaggaatgaaaaacctcctaaactcaacatcactagaaacatcactttccatcgaggccccttggggcgccatcaacgtacaatcaacattcaaacccaccgtctccaccgccaacatcgcactatcctggtcctccgtagaacaccggggcaacaaaatccttgtcaccggacgctccgagtccataatgaaattagaggaacgcaccggcgtctcctgggacctcggcgtcgacgacgcatccgaaagtaaactgctcacagtcagcatcatggacctctcccaaatgtactctcctgtattcgagtacctctccggggacagacaggtcgaagaatggcctaaagcgacctgcaccggcgattgccccgaacgctgcggctgcacctcatcaacgtgccttcacaaagaatggccccactcccggaactggcgctgcaaccccacatggtgctggggagtaggcaccggctgcacatgctgcggcgtcgacgtaaaagacctattcacggaccatatgtttgtcaaatggaaagtcgaatacatcaaaaccgaagccattgtatgcgtagaactcacctcgcaagaaagacaatgctccctcatcgaggccggcactcgtttcaatcttggaccagtcaccataactctctcggaaccgcgcaacatccaacaaaaactcccacccgaaatcatcacgctgcaccctaaagtcgaagaaggcttcttcgacctaatgcacgtccagaaagtcctcagcgcctcaaccgtctgcaaactccaatcctgcacgcacggtatcccaggcgacctccaagtctaccacatcggaaacctcctgaaaggcgacagagtcaacggacacctcatccacaagatagaaccccacttcaacacatcttggatgtcctgggacggctgcgacctcgactactactgcaacatgggagattggccaagttgcacctacaccggcgtcacccaacacaaccacgccgcattcgtcaacctcctcaatatagaaactgattacacaaaaacattccacttccattcaaaacgcgtcaccgctcacggagacacaccccaactagacctaaaagcacgccccacctacggggcaggcgaaataaccgtcctcgtggaggttgcagacatggaactacataccaagaaagtcgaaatatcaggcctcaaattcgcgtcgctcgcctgcacaggatgctacgcatgttccagcggcatcagctgcaaagttaggatccatgtagacgaaccagatgaactaaccgtccacgttaaatccaacgaccctgacgtggtcgcagcctccaccagcctcatggcccgtaaactagagttcggcactgactccaccttcaaggctttttctgccatgcccaagacctcgctatgcttctacatagtcgaaagagaatactgcaaatcatgcagcgaagaagacacacagaaatgcgtcgacacaaaacttgaacaaccccaatcaatccttatcgaacacaaaggcaccatcatcggcaaacaaaacgtcacatgcacagcaaaagcctcatgctggctcgagtccgtcaaatccttcttctacggcctcaaaaacatgctaggatccgtctttggcaacttcttcatcgggatactactcttcctcgcgcccttcgtcctactggtcctattcttcatgtttggctggaaaatcctcttctgcttcaaatgctgccgccgaacccggggcctcttaaaataccgactcctaaaagacgacgaagaaaccggctaccgcagaatcatcgaacgactcaacaacaagaaaggcaaaaaccgcctactcgatggcgagaggcttgccgaccgcaaaatcgcagaacttttctccaccaaaacccacatagga

SEQ ID NO: 15737 - RNA, 1932 nt, synthetic construct
  misc_feature 1..1932: note = derived and/or modified CDS sequence (opt11) from CCHFV(44-ST-2010)__KR814859.1__Gc
  source 1..1932: mol_type = other RNA
ttcctggactcaatcgtaaaaggcatgaaaaacctcctcaacagcacaagccttgagacatcgctatcaatcgaagccccatggggcgccatcaacgtccaatcgacgttcaaacccacagtcagcaccgccaacatcgcactctcttggtcctccgtagaacaccgcgggaacaaaattctcgtcaccggccgctcagagtccatcatgaaactcgaagaacgcacgggcgtcagctgggacttaggagtcgaagacgcctcagaaagcaagctactaacagtctcaatcatggacctatcacaaatgtactccccagtattcgaatacctatcaggcgatcggcaagtggaggaatggccaaaggcaacctgcacaggcgactgcccagaacgatgcggctgcacctcatcaacatgcctacacaaagaatggccccacagccgcaactggcgctgcaaccccacctggtgctggggcgtaggcaccggctgcacatgctgcggcgttgacgtaaaagacctcttcactgaccatatgttcatcaaatggaaagtagaatacataaagaccgaagccatcgtctgtgtagaactcacgtcccaagaacgacaatgctcactcatcgaagccggcacgcgcttcaatctaggccccgtcacaatcaccctctctgagccccggaacatccaacaaaaactacccccagagatcatcacactccatccaaaaatcgaagaaggtttcttcgaccttatgcacgtccaaaaagtccttagcgcctccactgtatgcaaactccagtcctgtacccacggcatccccggggacctacaaatataccacatcggaaacctactaaaaggcgaccgccttaacggccacctcatccacaaaatcgagcctcacttcaacacctcctggatgtcatgggacggctgcgacctcgactactactgcaacatgggcgactggccctcctgcacctacacaggagtcacccaacacaaccacgccgccttcgtaaacctcctcaacatcgaaacagactacacaaagaccttccacttccactctaaacgcgtcacggcacacggcgacaccccacaactcgaccttaaagcacgtccaacctacggcgccggcgaaatcacagtactcgtagaagtggccgacatggaactccacaccaaaaaggtggaaatatcaggcctaaaattcgcctcccttgcctgcaccggatgctacgcctgctcgtccggcatctcgtgcaaagttcggatacacgtcgacgaaccagacgaactcactgtccacgtcaaaagctccgacccagacgtcgtcgccgccagcactagcctcatggcccgaaaactcgagttcggcaccgacagcacattcaaagccttctcagctatgcccaaaacctctctttgcttctacatcgtggaacgcgaatactgcaagtcatgctcagaagacgacaccaaaaagtgcgtcgacaccaaactcgaccagccccaaagcatcctcatcgaacacaagggtaccatcatcggcaaacaaaacgacacatgcacagccaaagcctcatgctggctcgaaagcgttaaatccttcttctacggactcaaaaacatgttaggctccgtattcggaaacttcttcgtaggcatcctactattcctagcccccttcgtcctgctagtactattctttatgtgcggctggaaaatccttttctgtttcaaatgctgccgtcgcacccgcggcctattcaaatacagacacctcaaagacgacgaagaaaccggctaccgaagaataatcgaaagactcaacagcaagaagggcaaaaaccgcctccttgatggagaaaggctcgccgacagaaaaatagcagaacttttctccaccaaatcacacatcgga

SEQ ID NO: 15738 - RNA, 1932 nt, synthetic construct
  misc_feature 1..1932: note = derived and/or modified CDS sequence (opt11) from CCHFV(46-ST-2012)__KR814860.1__Gc
  source 1..1932: mol_type = other RNA
ttcctagacagcattgtcaaaggcatgaaaaacctcctcaactccacctcactcgaaaccagcctatcaatcgaagccccctggggcgccatcaacgtacaatctaccttcaaacccaccgtgagcaccgcaaacatagcactcagctggtcttcagtcgaacaccgaggcaacaaaatcctagtgaccggacgcagcgaatcaatcatgaaacttgaggaacgaaccggcgtctcctgggacctcggcgtcgaagacgcttccgaatccaaactcctaacagtctccatcatggacctctcccaaatgtacagcccagtcttcgagtacctttccggcgaccgacaagtcgaagaatggccaaaagcaacctgcactggcgactgccccgaacgctgcggctgcacctcaagtacctgcctccacaaagaatggccccactcccgcaactggcgctgcaacccaacctggtgctggggtgtcggcaccggctgcacatgctgcggcgtggacgtcaaagacctattcaccgaccacatgttcgtaaagtggaaggtcgaatacataaaaaccgaggccatagtctgtgtcgagctcacctcccaagagagacaatgctcactcatcgaggccggcacccgctttaacctcggccccgtaacgatcaccctaagcgaaccccgcaacatacaacaaaagctcccacccgaaataatcacactacaccccaaagtagaggaaggcttcttcgaccttatgcacgtacagaaagtactatcagcctcaaccgtctgcaaactccaatcatgcacacatggcattcccggagacctacaggtctaccacatcggcaacctcctcaaaggcgacagaatcaacggccacctcatccacaaaattgaaccccacttcaacacgtcctggatgtcctgggacggatgcgacctcgactactactgcaacatgggggactggccctcctgcacctacactggcgtaacacaacacaaccacgccgcctttgtcaacctcctcaacatagaaacggattacactaagaccttccatttccactcaaaacgcgtcacagcccacggggacacgccccaactcgatctaaaagcccgaccgacatatggcgccggagaaatcaccgtactcgtcgaagtagccgacatggaactccacaccaagaaagtcgaaatctcaggcctcaagttcgcctccctagcttgcactggctgctacgcctgttctagcggcatctcatgcaaagtcaggatacacgtggacgaaccagacgaactcacagtccacgtcaaatcctccgacccagacgtcgtcgccgcctcgacctccctcatggcgcgtaaactggagttcggaactgactccaccttcaaagccttctccgctatgcccaaaacttcactctgcttctacatcgtcgaaagagaatactgcaaatcttgctcagaagaagacacgcaaaagtgtgtcgacacacgccttgaacaaccccaaagcatactaatcgaacacaaaggcacaatcatcggcaaacaaaacgatacctgcactgcaaaagcctcctgctggctcgaatcagtaaaatcattcttctacggccttaaaaacatgctcggctccgtattcggtaacttcttcatcggcatcctcctcttcctcgcccccttcgtactactcgtcctcttctttatgttcggctggaaaatcctcttctgcttcaaatgctgcagacggacccgaggccttctcaaataccggcacctaaaagacgacgaagaaaccggttatcgccgaatcatcgaaagactgaacaacaaaaagggaaagaaccgcctcctcgacggcgaaagattagccgaccgaaagatcgcagaactattctccacaaaaacacacatcgga

SEQ ID NO: 15739 - RNA, 1932 nt, synthetic construct
  misc_feature 1..1932: note = derived and/or modified CDS sequence (opt11) from CCHFV(47-ST-2013)__KR814861.1__Gc
  source 1..1932: mol_type = other RNA
ttcctagactccatcgtcaaaggaatgaaaaacctcctcaacagcacctcactcgaaacgtccctttccatcgaagcaccctggggagccatcaatgttcaatcaaccttcaaaccaaccgtctccaccgccaacatcgcactcagctggtcgtcagtagaacaccgaggcaacaaaatactggttacaggacgcagcgaatccataatgaaactagaagaacggaccggcgtatcatgggacctaggcgtagaagacgccagtgaatccaaactcctcacagtaagcatcatggacctttcacaaatgtactccccagtcttcgagtacctatcaggcgaccgccaagtcgaagaatggccaaaggctacctgcacaggagaatgccccgaacgctgcggctgcaccagcagcacatgcttacacaaggagtggccccactcccgaaactggcgatgcaaccccacgtggtgctggggagtcggaaccggatgcacatgctgcggcgtcgacgtcaaagacctctttaccgaccacatgttcatcaaatggaaagtcgaatacatcaaaaccgaagccatagtatgcgtagaactcacctcacaagaacgccaatgcagcctcatcgaggccggtaccagattcaacctcggccccgtcaccatcaccctaagcgaaccccgcaacatccaacaaaagctacccccagagatcatcacactccaccccaaaatcgaagaagggttcttcgaccttatgcacgtacaaaaagttctatcagcgtccaccgtatgcaaacttcaatcatgcacccacggaatccccggcgacctacaaatataccacatcggcaacttactcaaaggagaccgagtaaatggccacctcatccacaaaatcgagccccacttcaacaccagctggatgagctgggacggctgtgacctagactactactgcaacatgggcgactggcccagctgcacctacacaggcgtcacacaacacaaccacgcggccttcgtcaacctgctaaacatcgaaacagactacaccaaaaccttccacttccacagcaaacgcgtcaccgcacacggcgacacaccccaacttgacctcaaggcccgcccaacctacggcgccggcgaaatcacagtcctagtagaggtagccgacatggaactccacacgaagaaagtcgaggtcagcggtctaaaatttgcatccctcgcctgcaccggctgctacgcctgctcatcggggatctcatgcaaagttcggattcacgtagacgaaccagacgaactcaccgtccacgtcaaaagctcagacccagacgtcgtagccgccagcacatcactaatggcccgaaaactagagttcggaaccgactccaccttcaaagccttctccgccatgcctaaaacaagcctctgcttctacatcgttgaacgcgaatactgcaaatcctgctcggaagacgacaccaagaaatgcgtagacactaaactagaacaaccgcaatcaatactaatcgaacacaaaggaactatcatcggcaaacaaaacgacacatgcacagccaaagcatcctgctggctcgaatccgtaaaatcattcttctacggcctcaaaaacatgctcggatccgtattcggaaacttcttcgtcggcatactgctgttcctcgctcccttcgtcctcctagtcctattcttcatgttcggctggaaaatcctattttgcttcaaatgctgccgacgcacgcgcggcctcttcaaataccgacacctgaaagatgatgaagaaacaggataccgccgcatcatcgaacgcctcaattcgaagaaaggcaaaaaccgactcctagacggagaacgacttgcagaccgaaaaatagccgaactattctctaccaaaacgcatatcggc

SEQ ID NO: 15740 - RNA, 1932 nt, synthetic construct
  misc_feature 1..1932: note = derived and/or modified CDS sequence (opt11) from CCHFV(52-R-2014)__KR814862.1__Gc
  source 1..1932: mol_type = other RNA
ttcctggacagcatagtcaaaggaatgaaaaacctcctcaactcaacctctctcgagacctccctctcgatcgaagccccgtggggcgccataaacgtgcaaagcaccttcaaacccaccgtcagcaccgcaaacatcgcactaagctggtcgagtgtagagcacagaggcaacaaaatcctggttacaggaagaagcgaatccatcatgaaactagaggaacggaccggcgtctcgtgggacctcggagtcgacgacgcctcagaatccaaactccttacagtgagcataatggacctcagtcaaatgtactcacccgtcttcgaatatctatctggagaccgccaagtcgaagaatggcccaaagccacatgcacaggcgactgtccagaacgctgtggatgcacctcctccacatgccttcacaaggaatggccccacagccgaaactggagatgcaacccaacttggtgctggggcgtaggcacgggatgcacgtgctgcggagtcgacgtcaaggacctctttacagaccacatgttcgtaaagtggaaagtagaatacataaaaaccgaagccatcgtttgcgtcgaactcacctcccaggaacgacagtgcagcctaatcgaagcaggcacacgcttcaacctaggcccagtaactataactctatccgaaccacgcaacatacagcaaaaactcccacccgagataataaccctacaccccaaagtagaggaaggcttcttcgacctcatgcacgtccaaaaggtactctccgcaagcacagtctgcaaactccaatcgtgcacccacggcatccccggagacctacaagtataccacatcggaaacctactgaagggagacagagtaaacggccatctcatccacaaaatcgaaccccacttcaacacctcctggatgtcctgggacgggtgtgacctcgactactactgcaacatgggcgattggccctcgtgcacctacaccggggtcacccaacacaatcacgccgccttcgtcaacctcctcaacatagaaaccgactacaccaaaaccttccacttccacagcaaacgcgtcacagcccacggcgacaccccacaactagacctcaaagcccgaccaacatacggcgccggcgaaatcaccgtcctagtagaagtcgctgacatggaactccacacgaagaaagtagaaatcagcggcctcaaattcgcctcactagcttgcaccgggtgctacgcctgctcctccggtatatcctgcaaagtacgcatacacgttgacgaacccgacgaactcacagtccacgtaaagagcaacgacccagacgtcgtcgccgcttcaacatccctaatggcccggaagctagagttcggcaccgactcaactttcaaagccttctccgccatgccaaaaacctcactatgcttctacatcgtcgaacgcgaatactgcaaatcctgctccgaagaagacacccagaaatgcgtcgacaccaaactcgagcaaccacaatcgatactcatcgaacacaaaggaaccatcataggaaaacaaaacgatacctgcacggcaaaggcaggatgctggctcgaatcggtaaaatccttcttctacggccttaagaacatgctagggtctgtgttcggcaacttcttcatcggcatcctcctgttcctagcccccttcgtgctcctcgtcctattcttcatgttcggatggaaaatcctcttctgcttcaaatgctgccgccgcacacgcggactcctcaaataccgcctcctaaaggacgacgaagaaaccggctacaggcgaataatcgagcgcctcaacaacaagaaagggaaaaaccgcctactcgacggcgagcgcctggcagaccgcaaaatagcagaactcttctcaacaaaaacccacataggc

SEQ ID NO: 15741 - RNA, 1932 nt, synthetic construct
  misc_feature 1..1932: note = derived and/or modified CDS sequence (opt11) from CCHFV(75-R-2012)__KR814863.1__Gc
  source 1..1932: mol_type = other RNA
ttcctcgacagcatcgtcaaaggcatgaaaaacctcctaaacagcacatcactcgaaacatcactatctatcgaagccccctggggcgccatcaacgtccaaagcacattcaaacccactgtgtccaccgccaacatcgccctctcctggagcagcgtcgaacaccgtggcaacaagatattagtcacgggccgttccgaatccatcatgaagctcgaagaacgcactggcgtcagctgggatctgggagtcgaagacgcatccgaatcaaaactactcacggtaagcatcatggacctcagccaaatgtactcccccgtgttcgaatacctcagcggagaccgacaagtggaagagtggcccaaagcaacctgcaccggggactgccccgaacgatgcggatgcacatcatcaacctgcctgcacaaagaatggccccactctcgaaactggcgatgcaaccccacatggtgctggggcgtgggcaccggctgtacctgctgcggggtggacgtaaaggacttattcacagatcacatgttcgtaaagtggaaagtagaatacatcaaaaccgaagccatcgtatgcgtcgaactcacctcacaggaacgacagtgctcactcatcgaagccggaacccgattcaacctaggcccagtaacaatcacgctctccgaacctcgcaacatacaacaaaagctcccacccgaaatcataaccctacaccccaaagtcgaggaaggtttcttcgaccttatgcacgtacaaaaagtactctccgcatccaccgtctgcaagctgcaatcctgcacacacggcatccccggcgacctccaagtctaccacataggaaaccttctaaaaggagaccgcgtgaacggacacctcatccacaaaatcgaaccacacttcaacacatcctggatgtcctgggacggctgcgacctagactactactgcaacatgggagactggccatcatgcacctacaccggcgtcacccaacacaaccacgccgccttcgtcaacctactaaacatcgagaccgactacacaaagaccttccacttccattcaaaacgcgtcaccgcccacggcgacacaccccaactcgacctcaaagcacgcccaacctatggcgccggcgagatcaccgtactggtagaggtcgcagacatggaacttcacaccaagaaagtagagataagcggcctcaaatttgcctcactagcctgcaccggctgctacgcatgctcctcaggcatatcatgcaaagtacgcatacacgtcgacgaacccgacgaactcaccgttcacgtcaaatcatccgatcctgacgtcgtcgctgcctcaacctcactaatggcccgcaaactggagttcggcacagactcaaccttcaaagcattctcagccatgccaaaaacttccctctgcttttacattgtagaacgcgaatactgcaaatcctgctccgaggaagacacccaaaaatgtgtcgacaccaaactagagcaaccccaatcgatcctaatagaacacaaaggcacaatcatcggaaaacagaacgacacatgcacagctaaagcctcatgctggctagaaagcgtaaaatcgttcctgtacggtcttaagaacatgctcggctcagtatttggcaacttcttcataggcatcctcctgttcctcgcacccttcgtcctccttgttctcttcttcatgttcggatggaaaatattattctgcttcaagtgttgtcggcgtacccgaggactcctgaagtaccgcctcctaaaagacgacgaagaaaccggataccgccgcatcatcgagcggctcaacaacaagaaaggcaaaaaccgactcctcgacggagaaagactcgccgaccgtaaaatagccgaacttttctccaccaaaacacacatcgga

SEQ ID NO: 15742 - RNA, 1932 nt, synthetic construct
  misc_feature 1..1932: note = derived and/or modified CDS sequence (opt11) from CCHFV(75-ST-2010)__KR814864.1__Gc
  source 1..1932: mol_type = other RNA
ttcctcgacagcatcgtcaagggcatgaagaacctactcaactcaacctccctagaaacaagcctttccatcgaggccccgtggggagcaataaacgtccaatccactttcaaaccgactgtaagcacagcaaacatcgcactaagctggtcctcggtagaacaccgtggcaacaaaatcctcgtcacaggccgatccgagtccatcatgaaacttgaagaacgaaccggcgtatcctgggacctaggagtcgaggacgcctccgaatcaaaactcctcacggtcagcataatggacctttcgcaaatgtactcacccgtcttcgaatacctaagcggcgaccgccaagttgaagaatggcccaaggcaacatgcaccggcgactgccccgaacgctgcggctgtacctcctcaacctgcctccacaaagaatggccccactcaagaaactggcgatgcaacccaacctggtgctggggcgtcggaaccggctgtacctgctgcggcgtcgacgtcaaagacttattcacggaccacatgttcgtcaaatggaaagttgagtacatcaagacggaagcaatagtatgcgtggagctcacatcccaagaacgacaatgctccctcatagaagccggtacgcgcttcaacctgggaccagttacaataaccctatccgaaccacgtaacatccaacaaaagctcccacccgagataataaccctccatccaaaagtggaagaaggattcttcgacctcatgcacgtccaaaaagtcctatcagccagcactgtatgcaaactccaatcatgcacccacggcatccccggcgacctccaagtataccacatcggcaacctactaaaaggcgaccgggtcaatggacacctcatacacaagatcgaaccacacttcaacacctcctggatgagctgggacggctgcgacctcgactactattgcaacatgggcgactggccctcatgcacctacaccggcgtcacacagcacaaccacgcagcattcgtcaacctcctaaacatcgagaccgactataccaaaaccttccatttccattcaaagcgtgtcacagcccacggcgacactccccaattagacctcaaagcacgcccaacctacggagcgggcgaaatcacagtgctcgtagaggtcgccgacatggagctgcacaccaagaaagtcgaaatcagtggcctcaaatttgctagcctcgcttgcaccggctgctacgcatgctccagtggaatatcatgcaaagtacgaatacacgtcgacgagcccgacgaacttaccgtacatgtcaagtccagcgacccagacgtcgtagcagcatcaacctccctcatggcccgaaagctcgagttcggaaccgactccaccttcaaggccttttcagccatgcccaaaacctccctctgcttctacatcgtagaacgagaatactgcaagtcatgcagcgaggaggacacacaaaaatgcgtcgacactaagctcgaacaaccccaatccatcctcatagaacacaagggaaccatcattggaaagcaaaacgatacctgcacggccaaagcctcatgttggctagaatccgtaaaatcattcttttacggactcaaaaatatgctagggagcgtcttcggcaacttctttatcgggatcctcctgttcctagccccgttcgtcctcctagtcctattcttcatgttcggctggaaaatactcttctgcttcaaatgttgccgtcgcgcccgcggactcctcaaataccgacacctcaaggacgacgaagaaaccggctaccgaaaaatcatcgaaagattgaacaacaagaaaggaaagaacaggctactagacggcgaacggctcgccgaccgcaaaatcgccgaactcttcagcaccaaaacccacataggc

SEQ ID NO: 15743 - RNA, 1932 nt, synthetic construct
  misc_feature 1..1932: note = derived and/or modified CDS sequence (opt11) from CCHFV(3756-ST-2007)__KR814866.1__Gc
  source 1..1932: mol_type = other RNA
ttcctcgacagcatagtaaaaggcatgaaaaacctcctaaactccacatcgcttgaaacctccctaagcatagaagccccctggggcgcgatcaacgttcaatcaacattcaaacccaccgtaagcacagccaatatcgcactctcctggtcatcagtagaacaccgtggcaacaaaatcctagtcaccggccgaagcgaaagcatcatgaaactagaagaacgaaccggcgtctcctgggacctcggcgtagaggacgccagcgaaagcaaactactcaccgtcagcataatggacctatcgcagatgtattcccccgtatttgaatatctctcaggcgaccgccaagtggaagagtggcccaaagcaacctgcaccggcgactgcccagaacgttgcggctgcaccagctctacctgcctccataaagaatggccccactccagaaactggcgatgcaaccccacctggtgctggggtgtcggaaccggctgtacctgctgcggagtcgacgtcaaagacctcttcaccgaccacatgtttatcaaatggaaagtcgagtacatcaaaaccgaagcaatagtctgcgtcgaactcacctctcaagaacgacagtgctccctcatcgaagccggaacacgattcaatctaggcccagtcacgataacactctccgaaccccgcaacatacagcagaaactcccacccgaaatcatcaccctacaccccaaaatcgaggaaggcttcttcgaccttatgcatgtccagaaggtcctctccgccagcacagtctgcaaactacaaagctgcacacacggcatcccaggagacctccaaatataccacatcggcaacctactcaaaggcgaccgagtcaacggccacctcattcacaaaatcgaaccccacttcaacacatcgtggatgagctgggacggctgcgacctcgattactactgcaacatgggcgactggccctcatgcacctacaccggcgtgacccagcataaccacgccgcatttgtcaatctcctcaacatagaaaccgactacaccaagaccttccacttccacagcaagcgcgtcaccgcccatggagatacccctcaactcgacctgaaggctcgcccgacatacggagcaggagaaatcaccgtacttgtcgaagtcgccgacatggaactccacaccaagaaagtagagatctcaggcctcaaattcgcctcccttacctgcacaggctgctacgcatgctcgtctggtatcagctgcaaagtacgcattcacgtcgacgaacccgacgaactaacagtccacgtcaaaagctctgacccagacgttgtagcagcatcgacctcactcatggcccgaaaactagagttcggcaccgactccacctttaaggctttctccgccatgccaaaaacttccctctgcttctacatcgtggaacgcgaatactgcaaaagctgctcagaagacgacaccaagaaatgcgtcgacactaaactagaacaaccccaatccatactgatcgaacacaaaggcaccataatcggcaaacagaacgatacctgcacggccaaagccagctgctggctcgagtcagttaaatcattcttttacggcctcaagaacatgctaggctcagtgttcgggtcattcttcgtgggcatcctcctattcctaacccccttcgtgctactcgtcctcttcttcatgttcggttggaaaatcctattctgcttcaaatgctgccgtcgcacccgaggactcttcaaataccgacacctcaaagacgacgaagagacaggttaccgccgcataatcgaacgtctaaactccaagaaagggaaaaaccgcctcctagacggtgaacgcctcgccgaccgcaaaatcgctgagctcttttcaacgaaaacgcacattggc

SEQ ID NO: 15744 - RNA, 1932 nt, synthetic construct
  misc_feature 1..1932: note = derived and/or modified CDS sequence (opt11) from CCHFV(3809-ST-2007)__KR814867.1__Gc
  source 1..1932: mol_type = other RNA
ttcctcgatagcatcgtaaaaggcatgaaaaaccttctaaactctacatccctcgaaacctccctctcaatagaagccccatggggcgccatcaacgtccaatccaccttcaaacccacagtctccaccgcaaacatagccctctcatggtcctccgtcgaacacagaggaaacaaaatcttagtaaccggccgctccgaaagcatcatgaaactagaagaaagaaccggagtatcctgggacctgggcgtcgaagacgcctccgagtcaaaactcctaacagtctccataatggacctctcccaaatgtactcccccgttttcgagtatctctccggcgaccgtcaagtcgaagagtggcctaaagcaacctgcaccggagactgcccggaacgctgcggatgcacctcaagtacctgcctacacaaagaatggccgcactcccgcaactggcgctgcaaccccacctggtgctggggcgtcggcaccggatgtacctgctgcggcgtagacgtcaaggacctcttcaccgaccacatgttcgtcaaatggaaagtagaatacatcaaaacggaagccatagtatgcgtcgagcttacctcccaagaacgccaatgctccctcattgaggccggaacccgcttcaacctcggccccgtcaccataaccctatccgaaccccgaaacatccaacaaaaactcccacccgaaataataacattgcaccccaaagtcgaagagggattcttcgatctaatgcacgtacagaaagtactttccgccagcaccgtctgcaaactacaatcctgcacccacggcatacccggggaccttcaagtgtaccacatcggtaacctcctcaagggtgaccgcgtcaacggacacctcatccacaagatcgaaccccacttcaacaccagctggatgagctgggacggttgcgacctagactactactgcaacatgggcgactggccctcctgcacatacacaggagtcacccagcataaccacgccgctttcgtaaacctactaaacatcgaaacggactacacaaaaacattccacttccactcaaaacgggtcaccgcccacggcgacaccccacaacttgacctaaaagcacgacccacctacggtgcaggagaaataacagttctggtagaagtcgccgacatggaactccacacgaagaaagtagaaatttcaggactcaaattcgccagcctagcatgcactggctgctacgcctgctcgagcggtatctcgtgtaaagtacgcatccacgtcgacgaaccagatgaactaacagtccacgtcaaatcatccgacccggacgtagtagccgcctcgacatccctcatggcccgcaaactggagttcggcacagactcaacattcaaagcattctcagcaatgcccaaaaccagcctctgcttctacatcgtggaaaaggaatattgccgatcatgttccgaggaagacacacagaaatgcgtagacacaaaactcgaacaaccacaaagcatcctgatcgaacacaaaggaactataataggcaagcaaaacgatacctgcaccgcaaaagcctcatgctggctggaatccgtgaaatcctttttctacggcctcaaaaacatgctaggctcggtcttcggcaatttcttcatcggcatcctactcttcctaacccccttcgtactcctcgtactattcttcatgttcggatggaaaatcctattctgcttcaagtgctgccgccgcacacgcggactcctaaaataccgacaccttaaagacgacgaagaaacgggctatagacgcatcatcgaacggctcaataacaagaaaggcaaaaaccggctcctcgacggagaacgcctagcagaccgcaagattgcagaactcttctcaacaaagacccacatcggc

SEQ ID NO: 15745 - RNA, 1932 nt, synthetic construct
  misc_feature 1..1932: note = derived and/or modified CDS sequence (opt11) from CCHFV(3820-ST-2007)__KR814868.1__Gc
  source 1..1932: mol_type = other RNA
ttcctcgactcaatagtgaaaggaatgaaaaacctcctcaactccaccagcctcgaaacgtccctctcaatcgaagcaccctggggcgcaataaacgtgcagagcaccttcaagccaacagtaagcactgccaacatcgcactctcatggtccagcgtcgagcaccgcggaaacaaaatcctcgtaacgggacgatccgaaagcatcatgaaactagaagaacgcaccggcgtctcgtgggacctaggcgtcgaagacgcatcagaatcgaaactactaacagtaagcataatggacctctcccaaatgtactcgccagtattcgaatacctatccggcgacagacaagtagaagagtggcccaaagcaacctgcaccggcgactgcccggaacgctgcggctgcacctcctctacctgcctccacaaagagtggccccactcccgcaactggcgctgcaaccccacctggtgctggggagtcggcaccggctgcacatgctgcggcgtcgacgttaaagacctctttaccgaccacatgttcatcaagtggaaagtcgagtacataaaaaccgaagccatcgtatgcgtagagctcacctcccaagaacgacagtgctcgctcatcgaagccggtaccagattcaacctagggcccgtaacgatcaccctgagcgagccacggaacatccagcaaaaactcccgccagaaatcataactctccacccgaagattgaggaaggcttcttcgacctgatgcacgtacaaaaagtactctcagcctcaaccgtttgcaaactccaatcgtgcacacacggcatccccggcgacctacaaatctaccacataggcaacctactcaaaggagacagagtcaacggccacctcatccacaagatcgaaccccacttcaacacctcctggatgtcctgggacggctgcgacttagactactactgcaatatgggcgactggccctcctgcacatacaccggtgtaacccagcacaaccacgccgccttcgttaacctcctcaacatcgaaaccgactacaccaaaacattccacttccactcgaaacgcgtaactgcccacggcgacactccccaactcgacctaaaagcccgacccacctacggcgcaggagaaataacggtcctcgtcgaagtcgccgacatggaactccacactaagaaagtcgaaatatccggcctaaaattcgcctccctcacctgtactggctgctacgcctgctcgtccgggatcagctgcaaagttcgcatacatgttgacgaacccgacgaactcaccgtccacgtgaaatcctcagaccctgatgtagtcgccgcctccacctccctaatggcccgcaaactagagttcggcaccgactccaccttcaaggccttttccgcaatgcccaaaacatccctctgtttctacatagtcgaacgcgaatactgcaaatcctgctccgaagacgacacaaagaaatgcgtcgacaccaaactcgagcagccccaatcaatcctaatcgaacacaaagggaccatcatcggaaaacaaaatgacacatgcaccgccaaagcctcctgctggctcgaatcagtcaagtccttcttctacggactcaaaaacatgcttggatcagtattcgggagctttttcgtcggaatcctactcttcctagcacccttcgtcttacttgtcctcttcttcatgttcggatggaaaatcctcttctgcttcaaatgctgccgccggacccgcggccttttcaaataccgacacctcaaggacgacgaagaaaccggctaccgccgcatcatcgaacgactcaattccaagaaaggcaaaaaccgcctcctcgacggcgaacgcctcgccgaccgcaaaatcgccgagctattcagcacgaaaactcatataggc

SEQ ID NO: 15746 - RNA, 1932 nt, synthetic construct
  misc_feature 1..1932: note = derived and/or modified CDS sequence (opt11) from CCHFV(4495-ST-2008)__KR814869.1__Gc
  source 1..1932: mol_type = other RNA
ttcctagacagcatagtcaagggtatgaaaaatctcctcaattcaacctctctggaaacatcactatcaatcgaagccccctggggcgccatcaatgtccaatccacattcaaacccaccgtctccaccgcaaatatagccctctcgtggtcaagtgtggaacaccgagggaacaaaatcctagtaaccggcagaagcgaatcaataatgaaactagaggaacgaacaggcatctcatgggacctaggcgtcgaagatgcaagcgaaagcaaactcctcaccgtctccatcatggacctttcacaaatgtactcccccgtcttcgagtacctaagcggcgatcgacaagtagaagaatggcccaaagcaacctgcactggcgactgccccgaaagatgcggctgtacctccagtacatgccttcacaaagaatggccacacagccgcaactggcgctgcaaccctacctggtgctggggcgtaggcaccggctgtacctgctgcggcgtagatgtcaaagacctattcacagaccacatgtttgtgaaatggaaagtcgagtatataaagaccgaagccatcgtctgcgtcgaactcacatcccaagaacgccaatgctccctcatcgaagccgggacccgattcaacctcggccccgtaaccatcacactctcagaaccccgcaacatccaacaaaaactacctcccgaaatcatcacccttcatcccaaagtcgaagaaggcttcttcgacctcatgcacgtccaaaaagtactatcagcctccaccgtctgcaaactacaaagctgcacccacggcatcccaggcgacctccaagtataccacataggcaacctactgaaaggggaccgagtaaacggccatttaatccacaaaatcgaaccccacttcaacacatcatggatgtcctgggacggctgcgacctagactactactgtaacatgggcgactggccctcatgcacctacaccggcgtaacacaacacaaccacgccgctttcgtcaacctcctcaacatcgaaacggactacaccaaaacattccacttccacagcaaacgtgtcacagcccacggcgacaccccacaacttgacctcaaagctagaccaacatacggagcaggcgaaatcacagtcctggtcgaagtcgcagacatggaactgcacacgaagaaagttgaaatcagcggcctcaaattcgcatcactcgcttgcaccggctgctacgcctgttcgagtggcatctcctgcaaagtacggatccacgtcgacgaaccagacgaactaaccgtccacgttaaaagttccgacccggacgtcgtcgccgcctccacctcactaatggcccgcaaactcgagttcggcaccgactcaaccttcaaggccttctccgccatgcccaaaacctccctctgcttttatatcgtggaacgagaatactgcaaaagctgcagcgaagaagacacacaacgatgcgtcgacaccaaactggaacaaccgcaatcaatactaatagaacacaagggcacaatcatcggcaaacaaaacgatacctgcacagccaaagcctcatgttggctagaaagcgtcaaatcgttcttctacggactcaaaaacatgctaggctccgtattcggcaacttcttcatcggaatcctcctcttcctcgccccgttcgtcctactggtcctatttttcatgttcggctggaaaatcctcttctgcttcaagtgttgccgtcgtgcccgcggcctcctcaaataccgacacctaaaagacgacgaagaaaccggctatcgaaaaatcatcgaacgcctcaacaacaagaaaggtaaaaacagactactcgacggagaacgcctagccgaccgaaaaatagccgaactcttctcaacaaaaactcacattggc

SEQ ID NO: 15747 - RNA, 1932 nt, synthetic construct
  misc_feature 1..1932: note = derived and/or modified CDS sequence (opt11) from CCHFV(4691-ST-2009)__KR814871.1__Gc
  source 1..1932: mol_type = other RNA
ttcctagactcaatcgtaaaaggtatgaaaaacctcctcaactcaacctctctagaaacatccctatccatcgaagcaccctggggagcaataaatgtgcaaagcaccttcaaacccgccgtctcaacagccaacatcgccctctcgtggtcctccgtagagcaccgcggcaacaaaatactcgtcaccggcaggtcagaaagcatcatgaaactagaagaaagaacgggagtatcctgggacctaggagtcgaggacgcatccgaaagcaaactcctaaccgtatccattatggatctctcgcaaatgtactcgccagtcttcgagtatctctctggagaccgacaagtcgaagaatggcccaaagccacatgcacaggcgactgccccgaacgatgcggatgcacgtcatccacttgccttcacaaagaatggccacacagccgcaactggcgttgcaaccccacctggtgctggggcgtgggcaccggatgcacatgctgcggcgtagacgtaaaagacctctttactgaccacatgtttatcaaatggaaagtcgaatacatcaaaacagaagccatcgtatgcgtagaattaacctcccaagaacgacaatgctccctcatcgaagccggcaccagattcaacctcggccccgtcaccatcaccctctcggaaccccgaaacatccagcaaaaactcccacccgaaatcataaccctccaccccaaaatcgaagagggcttcttcgacctcatgcacgtccaaaaagtactttcagcaagcaccgtttgcaaactccaatcctgcacacatggcatacccggtgaccttcaaatctaccacatcggcaacctactcaagggcgacagggtaaacggacacctcatacacaaaatagaaccgcacttcaacacaagctggatgtcctgggacggctgcgacctcgactactactgcaacatgggagactggccctcatgcacctacaccggcgtcacacaacacaaccacgccgcatttgtcaatctcctcaacatcgaaaccgactacactaaaaccttccacttccacagcaaacgggtcacggcccacggcgacacaccccaactagacctcaaagcccgccctacctatggagcgggcgaaataaccgtcctcgtcgaagtcgctgacatggaactccacaccaagaaagtagaaatctcaggcctcaaattcgcgtctctcgcctgcaccggctgctacgcctgctcgagcgggatctcctgcaaagtacggatccacgtagacgagccagatgaactcacagttcacgtcaaatcgtcagaccccgacgtagtcgccgccagcacctccctcatggcacgcaagctcgagttcggaaccgacagcaccttcaaagccttctcagccatgcccaagacctcactctgcttctacatagtcgaacgcgaatactgcaaatcctgctccgaagacgacaccaagaaatgtgtcgatacaaaactcgaacagccccagtccatactcatcgaacacaaaggtaccataatcggaaaacaaaacgatacctgcaccgcaaaggcctcatgctggctcgaatcagtcaaatccttcttctacggcctgaaaaacatgctaggctcagtcttcggcaacttcttcgtcggcatcctacttttcctcgcccctttcgtcctcctcgttctcttcttcatgttcggttggaaaatcctcttctgcttcaagtgctgccgacgtacccgcggcctcttcaagtaccggcacctaaaggacgacgaagaaaccggataccgacgcatcatcgaacgattgaactccaagaaaggcaaaaacagactcctcgacggagagcggctagcagaccgcaaaatcgcagaactattctcaaccaaaacccacatcggc

SEQ ID NO: 15748 - RNA, 1932 nt, synthetic construct
  misc_feature 1..1932: note = derived and/or modified CDS sequence (opt11) from CCHFV(4701-ST-2009)__KR814872.1__Gc
  source 1..1932: mol_type = other RNA
ttcctagactcaatagtcaaaggcatgaaaaacctactaaactcaacatcactcgaaacctcactttccatcgaagcaccatggggcgcaataaacgtccaatccaccttcaaacccacagtatccaccgcaaacatcgcactcagctggtcatccgtagagcaccgaggcaacaaaatcctagtcaccggccgatcagaaagcatcatgaaactcgaagaacgcacaggtgtttcatgggacctcggagtcgaagacgcatcagaaagcaagctactcaccgtctccatcatggacctctcccaaatgtattcaccagttttcgagtacctctcaggcgacagacaagtcgaagagtggccaaaagcgacctgcacaggagactgccccgaacgatgcggatgcacaagctcaacctgcctacacaaggaatggccccactcccgcaactggcgatgcaacccaacatggtgctggggtgtcggcaccggctgcacatgctgcggcgttgacgtcaaagacctcttcaccgaccatatgttcataaaatggaaagtcgaatacatcaagactgaagccatagtatgcgtcgaactgacttcccaagagcgacaatgcagcctcatcgaagccggaacacggttcaacctcggccccgtcacaataacgctctcagagcccagaaacatccaacaaaaactcccacccgaaataatcacgctccaccccaaaatcgaagaaggcttcttcgacctcatgcacgtacaaaaggtactttctgcttccaccgtatgcaaactacaatcttgcacccacggcatccccggagatctccagatctaccacatcggcaacctcctcaaaggcgaccgcgttaacggccacctcatccacaaaatagagccccacttcaacaccagctggatgtcctgggacggctgcgacctagactactactgcaacatgggtgactggccatcatgcacctacaccggcgttacccaacataaccacgccgccttcgtaaacctactcaacatagaaacagactacacaaagacctttcacttccactcaaaacgcgtcaccgcacacggagacacccctcaactcgacctaaaagcacggccgacctacggcgccggcgaaatcacagtcctggtagaggtagccgacatggaactgcacaccaagaaagtcgagatatccggcctcaaattcgccagcctcacctgtactggctgctacgcctgctcctccggcataagctgcaaagtccgtatccacgtcgatgaaccagacgaactaaccgtccacgtcaaatccagcgacccagatgtcgtagccgcctctacatccctcatggcacgcaagctcgagttcggaaccgactctacattcaaagcgttctccgcaatgcccaaaacctcgctctgtttctacatagtcgaaagggaatactgcaaatcctgctccgaagacgacaccaagaaatgcgtcgacacaaaactagaacagccccagtcaatcctcatcgaacataaagggaccatcatcggaaaacagaacgacacgtgcaccgccaaagcaagctgctggctcgaaagcgtcaagagcttcttctacggcctcaaaaacatgctaggctccgtgttcgggggtttcttcgtaggtatcctcctattccttgcccccttcgtccttctcgtccttttcttcatgttcggctggaaaatactattttgcttcaaatgctgccggagaacccgaggactattcaagtaccgacacctcaaggacgacgaagaaaccggctaccggcgcatcatagaaagactcaacagcaagaaaggcaaaaaccgactgctagacggcgaacgcctcgcagaccgcaaaattgccgagctattcagcaccaaaacccacatcgga

SEQ ID NO: 15749 - RNA, 1932 nt, synthetic construct
  misc_feature 1..1932: note = derived and/or modified CDS sequence (opt11) from CCHFV(Oman-199809166)__KR864901.1__Gc
  source 1..1932: mol_type = other RNA
ttcctcgactcaatcgctaaaggcatgaaaaatctactcaactcaacaagcctcgagacctctctctccatcgaagccccctggggcgccatcaacgtacaatccacattcaaaccaaccgtaagcacagccaacatagctctctcctggagcagtgtggaacaccgcggaaacaaaatactcgtcagcggacgcagcgaatccatcatgaaactcgaagaacgcacaggcatatcctgggacctaggagtcgaggacgcctccgagagcaaactcctgaccgtcagcgtcatggacctctcccagatgtactcacccgtgttcgaatacctcagcggagaccgacaagtagaggaatggccgaaagcaacctgcaccggagactgtcccgaacgatgcggctgcacctcatcaacatgcctccacaaggaatggccccactcccggaactggcgttgcaaccccacatggtgctggggcgtcggcaccggatgcacttgctgcggactcgatgtaaaagacctattcaccgactacatgttcgtcaaatggaaagtagagtacatcaaaacggaagccatcgtgtgcgtagaactgacttcccaagagcgccaatgctccttaatcgaagccggaactcgctttaacctaggccctgtcactataacgctttcagaacctcggaacatccagcaaaagctacccccagaaatcgtaaccctccatccgcgcatagaagaaggcttcttcgacctcatgcacgtccaaaaagtactaagcgcctccaccgtatgcaaactacaatcctgcacccacggcgtcccaggcgacctacaagtctaccacatcggtaatctactcaaaggagacaaagtcaacggccacctcatccacaaggtcgaaccacacttcaacacttcctggatgtcctgggacggctgcgacctagattactactgcaatatgggagactggccctcatgcacctataccggggtgacacaacacaaccacgccgccttcgtaaacctcctcaacatagaaaccgactacaccaaaaatttccacttccactccaaacgagtcaccgcccacggagacacaccccaactagacctcaaagcacgcccaaactacggcgctggcgaaataacagtactggtcgaggttgccgacatggaactacacaccaagaaaatcgaaatctccggcctcaaattcgcctcgctaacctgcaccggatgctacgcctgctctagcggaatctcctgcaaggtccgcattcacgtcgacgaaccggacgaactcaccgtccacgtcaaatccgaggacccggacatcgtcgccgcctcatcctccttaatggcccgcaaactagagttcggcaccgactcaacctttaaagcattctccgccatgcctaaaacctcgctctgcttctacatagttgaaagagaatactgcaagtcctgctcaaaagaagacacccaaaaatgcgtcaacgccaaactagaacgaccccaatcgatcctcatcgaacataaaggaaccattatcggcaaacaaaacgatacatgtaccgccaaggcatcatgctggctcgaatccgtaaaatcattcttctacggactcaagaacatgctctcaggaatcttcggaaacgtcttcataggtatcttcttatttctggccccattcatcctcctaatcctgttcttcatgttcggatggcgaatcctattctgcttcaaatgctgccggcgcacccgcggcctcttcaaataccgccatctcaaagacgacgaagaaaccggctaccgcaaaataatcgaacgcctcaacaacaagaaaggcaaaaacaaactcttagatggcgaacggctcgccgacagaaaaatagccgagctattcagtacaaaaacacatatcggc

SEQ ID NO: 15750 - RNA, 1932 nt, synthetic construct
  misc_feature 1..1932: note = derived and/or modified CDS sequence (opt11) from CCHFV(200406546-Turkey)__KR864902.1__Gc
  source 1..1932: mol_type = other RNA
tttctcgactccatcgtcaaaggcatgaaaaacctactcaactccacaagcctagaaacatccctgagcatagaagccccctggggcgccatcaacgtccaatcaacattcaaacccaccgtaagcaccgccaacatcgctctcagctggtcctccatcgaacaccgcggcaataaaatcctcgtcaccggccgctctgaatccatcatgaaactagaagaacgaaccggcgtctcctgggacctaggagtagaagacgcaagtgagtccaaactcctcacagtgtcaataatggacctctcgcagatgtactccccggtgttcgaatacctctccggagaccgccaagtcgaagaatggcccaaagcaacctgcaccggagactgtcccgaaagatgcggctgcacctcctcaacatgcctacacaaagaatggccccattcccgaaactggcgatgtaaccccacctggtgctggggagtaggcacgggctgtacctgctgcggagtcgacgtcaaagacctcttcaccgaccacatgttcgtcaaatggaaggtggaatacatcaaaaccgaagccatcgtttgcgtcgaactcacctctcaagaacgtcaatgcagtctcatcgaagcaggcacgcgattcaacctcggccctgtaaccatcaccctctccgaaccccgaaacattcaacaaaagttacccccagaaatcataacccttcaccccaaagtagaagaaggcttcttcgacttaatgcatgtgcaaaaagtcctcagtgcctctacagtatgcaaactccaatcctgcacccacggaatcccaggcgacctccaagtataccacatcggaaacctactaaagggcgatcgcgttaacggacatctaatccacaaaatcgaaccccacttcaacactagctggatgagttgggacggctgcgacctcgactactactgcaatatgggtgactggccctcctgcacatacaccggagtaacccagcacaaccatgccgcctttgtaaacctattgaacatagaaacagactacaccaaaaccttccatttccattcaaaacgagttaccgcccacggcgatacaccccaactagacctcaaagcacgacccacctacggcgccggcgagataaccgtcctagtcgaagtagcagacatggaactccacaccaagaaagtcgaaatttccggcctcaaattcgcttccctggcctgcacaggctgctacgcatgctccagcggcatatcttgcaaagtccgcatacacgtagacgaaccagacgaactcacagtccacgtaaaatcctcagaccccgacgtcgtagccgcctcaacttcgctaaccgcccgcaaactggagttcggcaccgactcaaccttcaaagcattctcggcaatgcccaaaacctccctatgcttctacatcgtggaaaaagaatactgcaaaagctgcaacgaagatgacacacaaaaatgcgtagacaccaagctcgagcaaccacaatcaatcctaatcgagcacaagggcacgatcatcggcaaacaaaacgacacgtgcaccgccaaagcctcctgctggctggaaagcgtaaaatcgttcttctacggtcttaaaaacatgctcggctccgtatttggtaacttcttcatcggaatcctactgttcctagccccattcgtactcctagtcctcttcttcatgttcggctggaaaatactcttctgcttcaaatgctgcagacgcacccgaggactattcaaataccgacacctaaaagacgacgaagaaacaggctataaacgcatcatagaacgcctaaacaacaagaaaggcaaaaatcgcctcctcgacggcgaacgactagccgaccgcaaaatagccgaactattctccaccaaaacacacatcggc

SEQ ID NO: 15751 - RNA, 1932 nt, synthetic construct
  misc_feature 1..1932: note = derived and/or modified CDS sequence (opt11) from CCHFV(1-CR/HU-2015)__KU161584.1__Gc
  source 1..1932: mol_type = other RNA
ttcttagacagcatagtaaaaggaatgaaaaacctactaaattcaacgagcctagaaaccagcctctcaatcgaagcaccgtggggagctataaacgttcaatcaacgttcaaaccaaccgtctctacggccaacattgcactctcctggtccagcgtcgagcaccgcggcaataaaatactcgtcaccggacgctcagagtcaataatgaaactagaggaacgaactggagtatcctgggacctaggcgtcgaagacgcctcagaatccaaactcctaaccgtgtcaatcatggacctctcccaaatgtactcgcccgtattcgaatatctaagcggggaccgccaagtcgaagaatggccaaaagcaacctgcacaggcgactgccccgaacgctgcggatgcacaagcagcacctgtctgcacaaagaatggcctcattcacgcaactggcgctgtaaccccacatggtgttggggcgtcggtaccggatgcacatgttgcggcgtagacgtcaaagacctctttacagaccacatgttcgtcaaatggaaagtcgaatacattaaaaccgaagcaatcgtctgcgtggaactgacctcccaagaacgccaatgcagcctaatagaagctggcacacgcttcaacctcggacccgtaacaataaccctctccgaaccacgcaacatccagcaaaaacttcctcccgaaatcatcacactacaccccaaaatcgaagaaggcttcttcgacctaatgcacgtacaaaaggtcctgtcagcatccacggtatgcaaactgcaatcgtgcacacacggcatacccggagacctacaggtctaccacatcggaaacctactaaaaggtgaccgagtcaacggacacctaatacacaaaatcgaaccccacttcaacacctcctggatgagctgggacgggtgcgacctcgactactactgcaacatgggggactggccgagctgtacatacacaggagtgacccaacacaatcatgcagcctttgtcaacctcctcaacatcgaaacagactacacaaaaaccttccacttccacagcaaacgcgtcaccgcacacggagacacgccccaacttgacctaaaagcccggcccacctacggagcaggcgaaataaccgtgctggtcgaggttgcggacatggaacttcacacgaagaaagtcgaaatctccggactcaaattcgcctcactcgcttgcacaggctgctacgcctgctcctccggcatctcatgcaaagtgcgtatccacgtagacgaacccgacgagctaaccgtccacgtcaaaagctcagaccctgacgtagtagctgcatccacatcgctcatggccagaaaactcgagttcggcacagactcaactttcaaagccttcagcgccatgccaaaaacttccctctgtttctacatcgtcgaacgggaatactgcaaaagctgcagcgaagacgacacaaagaaatgcgtcgacaccaaactggagcaaccccagagcatactcatagaacacaaaggaaccatcatcggcaagcaaaacgatacctgcacagccaaggcttcatgctggctggagtccgtcaaatcattcttctacggcctgaaaaacatgctcggctccgtcttcggcaacttcttcattggaatactcctattcctcgccccgttcgtcctactggtcctattcttcatgttcggctggaaaatcctattctgtttcaaatgctgccgacgaacacgaggcctcttcaaataccgccacctgaaggacgacgaagaaacaggctaccgtcgcatcatagaacgcctcaacaacaagaaaggcaaaaaccgactattggacggcgaaagactcgcagaccgcaaaatagccgaactcttcagcacaaaaacccacatcggc

SEQ ID NO: 15752 - RNA, 1932 nt, synthetic construct
  misc_feature 1..1932: note = derived and/or modified CDS sequence (opt11) from CCHFV(Gaib)__KX013445.1__Gc
  source 1..1932: mol_type = other RNA
ttcagtgactccatagtcaaaggcatgaaaaatctactcaattcaactagcctcgagacctcactatcgattgaagcaccctggggcgcaatcaacgtccaatccactttcaaacccaccgtcagcactgccaatatcgcactatcctggagctccatcgaacaccgaggcaacaaaatcctggtctccgggcgcagcgaaagcatcatgaaactcgaagaacgaaccggcatatcttgggatctgggagtcgaagacgcaagcgagtccagactcctcacagtcagtgtaatggacctctcgcaaatgtactcgcccgttttcgagtacctctccggcgaccgccaagtcgaagaatggcccaaagcaacatgcaccggggactgccccgaacgctgcggctgcacctcctcaacctgcttacacaaagagtggccacactcccgcaactggagatgcaacccgacctggtgctggggcgtaggcaccggttgcacatgctgcggcctagacgtcaaggacctcttcacggactatatgttcgtcaagtggaaagtcgagtacatcaaaacggaagccatcgtctgcgtcgaactcacttcccaagaacgccaatgctctctcatagaagcaggcacacgcttcaacctcggccccgtcacgattactctatccgaaccccgaaacatccaacaaaaactcccacccgaaatcataaccctacacccccgcatcgaagaaggcttcttcgacctaatgcacgtccaaaaagtcctctccgcctccaccgtctgcaaactacaatcatgtacacacggagtaccgggcgacctccaagtctaccacataggcaacctcctcaaaggcgacaaagtaaacggacacctcatccacaagatagagccccacttcaacacatcctggatgagctgggacggctgcgacctcgactactactgcaacatgggcgactggccctcatgcacctacaccggcgtcacacaacacaaccacgcggccttcgtaaacctcttaaacatcgaaaccgactacaccaagaacttccacttccactcaaaacgagtaactgcacacggtgacactccccagctcgacttgaaagccagaccgacctacggcgccggcgaaatcaccgtgctcgtcgaggtcgccgacatggaattgcacaccaaaaagatcgagatctcaggactcaaatttgcctccctaacgtgcactggatgctacgcctgttcctccggaatcagctgtaaagtacgcatccacgtcgacgaaccggacgaactcacagtccatgttaaaagcgaagacccagacatagtcgcagcctcctcatcactcatggcccgcaaacttgaatttggcacggactccaccttcaaagccttctcggccatgccaaaaacatctctttgcttctacatcgtagaacgcgaatactgtaaatcctgctccagagaagacacccaaaaatgcgtatcaaccaaactggaacaaccccaatccatcctcattgagcacaagggcacgatcatcggtaaacaaaacaatacctgcaccacaaaaacaacatgctggctcgagagcgtgaaatccttcttctacgggcttaaaaacatgctctcctccatcttcggcaacgtcttcgttggcatcttctcctttctcgccccattcatcctcctcatccttttcttcatgttcggctggcgcatattattctgcttcaaatgctgccgacgcacacgaggcctgttcaaataccgccaccttaaagacgacgaagagaccgggtaccgacgcataattgagcgtctaaacaacaagaaaggcaaatccaaactgctggacggcgaacgcctagccgaccgaaaaattgctgaactcttctcaacaaaaacccatatcggc

SEQ ID NO: 15753 - RNA, 1932 nt, synthetic construct
  misc_feature 1..1932: note = derived and/or modified CDS sequence (opt11) from CCHFV(Hodzha)__KX013448.1__Gc
  source 1..1932: mol_type = other RNA
ttcctcgactccattgtaaaaggcaagaaaaacctactaaactcaacatccctcgaaacctccctttccatcgaagccccatggggagccatcaacgtccaatccacctacaaaccaaccgtcagtaccgccaacatagccctatcgtggtcctctgtcgaacaccgcggcaacaaaatcctggtatccggcagatccgaatccataatgaaactagaagaacgaaccggcatctcgtgggacctcggcgtcgaagacgcctcagagagcaaactactcaccgtttccgtcatggacctatcacaaatgtactcgccagtattcgaatacctatcaggagaccgacaggtagaagaatggcccaaggcgacatgcaccggggactgcagtgaacgctgcggctgcacctcctcaacatgccttcacaaagagtggccccactcacgcaactggcgatgtaaccccacctggtgctggggcgtaggaacaggctgcacctgttgcggtctcgacgtcaaagatctatttacggattacatgttcgtcaaatggaaagtcgattacatcaaaacggaagcaatcgtctgcgtcgaattgacctcgcaagaacgccagtgctcactcgtcgaagccggcacacgattcaacctcggcccagtaacaatcacgctctccgaaccacgcaacatccaacaaaaactaccccctgaaatcataaccctccacccccgaatagaagaaggctttttcgacctcatgcacgtccaaaaggtactctccgcaagtaccgtatgcaaacttcaaagttgcacacacggagttccaggagaccttcaagtgtatcacatcggaaacctcctaaaaggagacaaagtcaacggccatctaatccacaaaatagaaccccacttcaacacctcgtggatgtcatgggacggctgcgacctcgactattactgcaacatgggagactggccctcctgcacctacacgggagtcactcaacacaaccacgcctcattcgtcaacctactgaacatcgaaacagactacacaaaatccttccacttccactccaaacgagtcaccgcccacggtgacaccccacaactcgatctaaaagcccgccccacgtacggcgccggcgaaatcaccgtcctagtagaagtcgcggacatggaactccacactaagaaaatcgagatcaccggcctcaaattcgcctcactgacctgcaccgggtgctacgcctgttcctcaggcatatcatgcaaagtccgaatccacgtcgacgaaccagacgaacttaccgtccacgtaaaaagcgacgaccccgacgtagttgccgccagctcatccctaatggcccgtaaactcgagttcggcacagacagcaccttcaaagcattttccgccatgcccaaaacctctctctgcttctacatagtcgaacgagaatattgcaaatcctgctccaaagaagacacccaaaaatgcgttaacacaaaactagaacaaccacaatccatccttatcgaacaaaaaggaacaatcattggcaaacagaacaatacctgcacagccaaagcctcctgctggcttgaaagtgtcaaatccttcttctacgggcttaaaaacatgctatccggcatatttggcaacgttttcgtaggaatcttcctattcctagcaccattcatactactcatactgtttttcatgttcggttggcgtatccttttctgctttaagtgctgccgacgcacacgcggcctttttaaatacaagcacctgaaggacgacgaagagaccggttaccgccgcatcatcgaacgcctaaacaacaagaaaggcaaaaacaaactcctcgacggagaaagactcgccgaccgccgcatcgcagaactcttcagcaccaaaacacacatcgga

SEQ ID NO: 15754 - RNA, 1932 nt, synthetic construct
  misc_feature 1..1932: note = derived and/or modified CDS sequence (opt11) from CCHFV(IbAn7620)__KX013451.1__Gc
  source 1..1932: mol_type = other RNA
tttctcgactcaatcgcaaaaggcatgaaaaaccccctcaactctactagcctcgaaacctccctctccatcgaggccccgtggggagccatcgacgtacagtcaacatacaaaccaaccgtaagcaccgcaaatatcgccctctcttggagcagcgtggaacaccgcggcaacaaaatcctggtctcaggccgatccgaatcaataatgaaactcgaagaacggacagggatctcttgggacctaggagtcgaagacgcgagcgaatccaaactactcaccgtctccgtcatggacctctcgcaaatgtactcgccagtcttcgaatacctcagcggcgaccgacaagtcgaagagtggccgaaagcgacctgcaccggcgactgtcccgaacgctgcggatgcacttcgtccacctgtctacacaaagaatggccacacagtcgcaactggcgctgcaatcccacctggtgctggggcgtaggaacaggatgcacatgctgcggcctcgacgttaaagatctattcacagattacatgttcgtcaaatggaaagtcgagtacatcaaaaccgaagccatcgtgtgcgtcgaactcacatcccaagagagacagtgctcactaatagaagcaggcactcgcttcaaccttggacccgtcaccatcaccctctctgaacctcgaaacatacaacaaaaactaccgccggagatcatcacactacacccacgcatcgaggaaggcttcttcgaccttatgcacgtccagaaagtcctctcagcatccaccgtctgcaaactacaatcctgcacccacggcgtacccggcgacctccaagtataccacatcggcaatctactaaaaggcgacaaagtcaacggccacctcatccacaaaatcgaaccccacttcaacacctcgtggatgagctgggacggatgcgatctcgactattactgcaatatgggcgactggccctcatgcacgtacacaggagtaacccagcacaaccacgcgagctttgtcaacctcctaaacatcgaaacagactacaccaaaaatttccacttccactccaaacgagtcacagcccacggcgatacaccccaattagacctaaaagcccgcccaacctatggagccggagaaataaccgtcctcgtagaagtcgccaacatggagctgcacaccaagaaaatcgaaatttccggcttaaaattcgcctccctgacctgcaccggctgctatgcctgctcatccgggatctcatgcaaagtcaggatccacgtcgacgaacccgacgaactcacggtccacgtaaagtcagacgatcctgacgtcgtcgccgccagctcctcactcatggcccgcaaactcgagttcggcaccgactcgacatttaaagcattctccgccatgcccaagacctccctatgcttttacatcgtagaacgcgaacactgcaagagctgtagcgaagaagacaccaaaaagtgcgtaaacaccaaactcgaacaaccccaaagcattctaatagagcacaaaggcaccatcatcggcaaacaaaattcgacctgcaccgccaaggcctcctgctggctagaatccgtaaaatccttcttctacggcctcaagaacatgctctcaggcatcttcgggaacgtattcatgggcatctttctcttcctcgccccattcatcctcctaatcctgttcttcatgttcggctggcgcatactcttctgcttcaaatgctgccggcgcacacgcggactttttaaataccgccatctcaaagacgacgaagaaaccggataccgacgcatcattgagcgcctaaacaacaagaaaggcaaaaacaaactcctcgacggcgaacgcttagcggaccggcgaatcgccgagttattctcaacaaaaacacacatagga

SEQ ID NO: 15755 - RNA, 1932 nt, synthetic construct
  misc_feature 1..1932: note = derived and/or modified CDS sequence (opt11) from CCHFV(K128_76)__KX013454.1__Gc
  source 1..1932: mol_type = other RNA
ttccaagactccatcgtaaaaggcatgaaaaacctcctgaactcaacctcactcgagaccagtctcagcatcgaagccccatggggcgccataaacgtccaaagcacctacaaacccgccgtaagcgccgccaacatcgccctctcctggtcatccgtagaacaccgagggtctaagatactcgtatcaggtcgatcagagtccataatgaaactcgaggaacgaaccggaatctcgtgggatctaggagtagaagacgcaagcgaaagcaaactccttaccgtcagcgtaatggacctctcccaaatgtacagccccgtattcgaatacctgagcggggaccgccaagtcgaggaatggccaaaagcaacttgtaccggggactgcccggaacgctgcggctgcacctcttccacttgcctccacaaggaatggccacactccaggaactggcgatgcaaccccacatggtgctggggcgtcggcactggctgtacctgctgcggactcgacgtcaaggacctattcacggactacatgttcgttaaatggaaagtcgaatacataaaaaccgaagccatcgtgtgcgtagaactcacatcacaggaacgccaatgctcactaatagaggcgggcacacgattcaacctaggacctgtaaccatcaccctctccgaaccaagaaacatccaacaaaagctccctcccgaaatcataacactgcacccacgaatcgaagaaggattcttcgacctcatgcacgtgcaaaaagtcctaagtgcgagcacagtctgcaaactacaatcctgcacccacggagtcccaggcgacctccaggtctatcacataggcaacctcctaaagggcgaccgagtcaacggccacctaatccataagatcgaaccccacttcaacacctcctggatgtcctgggacggatgcgacctcgattactactgcaacatgggagactggcccagctgcacgtacaccggcgtcacccagcacaaccatgccagctttgtaaacctactaaacatcgaaaccgactacaccaagagcttccacttccactccaaaagggtaacagcacacggagacacccctcaattagacctcaaagcacggccgaactacggtgcaggcgaaataaccgtcctggtagaagtcgcagacatggaactacacacgaagaaaatcgagatctcgggtctcaaattcgcttcactaacctgcacgggctgctacgcatgctcaagcggaatctcctgcaaagtacggatccacgtcgacgaaccggacgagctaaccgttcacgtaaaaagcgacgacccggacgtagtcgcagcttcctcaagcctcatggcccgcaaactagagttcggaacggactcaacattcaaagccttctccgccatgcccaaaaccagcctatgcttctacatcgtcgaaagggaatactgcaagagctgctccaaagaagacacccagaaatgcgtcaacacaaaactcgaacaaccacaatccatcctcatcgaacacaagggcacaatcatcggcaagcaaaacaatacctgcacggcaaaaacttcctgctggctagaaagtgtgaaatcattcttctacggactgaaaaacatgctctcaggaatattcggcaacgtcttcgtcggaatatttctcttcctcgccccattcatactcctaatcctattcttcatgttcggctggcgaatactcttctgcttcaaatgctgccggcgcacacgcggtctcttcagatacaaacacctcgaaaacgacgaagaaaccgggtaccggagaataatagaacgactgaacaacaagaaaggcaaaaacaaactcctagacggcgaacgcctagcggacaggcgaatagcagaacttttctccacgaaaacccacatcggc

SEQ ID NO: 15756 - RNA, 1932 nt, synthetic construct
  misc_feature 1..1932: note = derived and/or modified CDS sequence (opt11) from CCHFV(K168_40)__KX013457.1__Gc
  source 1..1932: mol_type = other RNA
ttcctcgacggcatagtcaaaggtatgaaaaacctcctcaactctacctccctagagacaagcctctccatcgaagccccctggggcgcaatcaacgtccaatccacttacaaaccaaccgtaagcgcagccaacatagcactttcctggtccagcgtagaacaccgcggaaacaaaatcctcgtaagtggcagaagcgaaagcatcatgaaactcgaggaacgcacagggatatcctgggacctcggcgtcgaggacgcatccgaaagcaaactattaacagtctcagtcatggacctctcacaaatgtactcacccgtcttcgagtacctatcaggcgaccgccaagtagaggaatggcccaaagccacatgcactggagactgccccgaaagatgcggctgcaccagcagcacatgcctacacaaagaatggccccactcacggaactggagatgtaaccccacatggtgctggggtgtaggcaccggctgtacctgctgcggcctagacgtaaaagacctattcacagactacatgttcgtaaaatggaaagtagaatacatcaaaaccgaagcaatcgtctgcgtagaactcacaagccaagagcgccagtgctcgctcatcgaagccggaacacgtttcaacctaggccccgtcaccataacactctccgaaccacgcaacattcagcaaaagctcccacccgaaatcataaccctacacccccgaatcgaagagggtttcttcgacctcatgcacgtccaaaaagtactatctgccagcacagtatgcaaactccaatcatgcacccacggcgtcccaggcgatctccaggtctaccacatcggaaatctcctaaaaggcgacaaagtcaatggtcacctcatccacaagatcgaaccgcacttcaacacctcctggatgtcgtgggacggctgcgacctagactactactgcaacatgggagattggccctcatgcacctacactggcgtgacccaacacaaccacgcctccttcatcaacctactcaacatagaaaccgactacaccaaatccttccacttccactccaaaagagtaacggcccacggcgacaccccgcaactcgacctcaaagcccgaccgaactacggagcaggcgaaatcacggtcctcgtcgaagtcgccgacatggaactacacacgaagaaaatagaaatctcaggcctgaaattcgcctcgcttacatgcaccggatgctatgcctgctcctcaggaatcagctgcaaagtcaggatccacgtcgacgaaccagacgaactaaccgtccacgtgaaaagcgacgatcccgacgtggtcgccgcctcaagctccctcatggcgagaaaactcgagtttggcacggactcaaccttcaaggctttctcggccatgcccaagacatccttgtgcttctacatcgtcgaacgagaatactgcaaaagctgctccaaagaagacacccaaaaatgcgtcaacaccaagctagagcaccctcaatcaatcctaatcgaacacaaaggtacaatcataggcaaacaaaataacacgtgcactgcaaaaacatcatgctggctcgaaagcgtcaaatccttcttctacggactcaaaaacatgctcagcggaatattcggcaacgtctttgtgggaatctttctattcctcgcccccttcatcctcctcatcctcttcttcatgttcggttggcgcatcctattctgcttcaaatgctgccgacgaacccgaggcctattccgctacaaacacctcgaggacgacgaagagaccggctaccgacgcatcatcgagagacttaacaacaagaaaggtaaaaacaaacttctagacggagaacgcctcgccgaccgtcgaatcgccgaactcttcagcacaaaaacacatataggc

SEQ ID NO: 15757 - RNA, 1932 nt, synthetic construct
  misc_feature 1..1932: note = derived and/or modified CDS sequence (opt11) from CCHFV(K168_125)__KX013460.1__Gc
  source 1..1932: mol_type = other RNA
ttcctcgactcaatcgtcaaaggcaagaagaacctcctcaactccacctccctcgaaaccagcctctccatcgaagccccgtggggcgcaatcaacgtccaatccacctacaaaccaaccgtatctgccgcaaacatcgcactctcctggtccagcgtcgaacaccgcggcaacaagatacttgtctccggtcgcagcgaaagcataatgaaactcgaagaacgcacaggcatcagttgggacctaggagtcgaggacgcaagcgagagtaaactcctgaccgtatccgtcatggacctatcacaaatgtactccccagtcttcgaatacctctctggcgacagacaagtcgaagaatggcccaaagcaacctgcaccggcgactgtcctgaacgatgcggctgcacctcatcaacctgcctacacaaagaatggccccactcccgaaactggcgatgcaaccccacatggtgctggggcgtcggcaccggctgcacatgctgcgggctcgacgtaaaagatcttttcaccgactatatgttcgtaaaatggaaagtagaatacatcaaaacagaagcgatcgtctgcgtggaactaacctcccaagaacgccaatgctcactcatagaagcgggcacccgcttcaacttaggcccggtgaccattaccctatccgagcccagaaacattcaacaaaaattacccccagaaatcatcacactccacccacgaatcgaagaaggcttcttcgacctcatgcacgtccaaaaggtcctaagcgcatcaaccgtctgcaaactacaatcctgcacacacggagtccctggcgacctccaggtgtaccacatcggaaacctcctaaaaggcgacaaagtcaacggacacctcatccacaaaattgagccccacttcaacacaagttggatgagctgggatggatgcgacctcgattactactgcaacatgggagactggccctcctgcacatacaccggagtcacccagcacaaccacgccagctttatcaacctccttaacatcgaaacagactacaccaagagcttccacttccactccaaacgggtcaccgcacacggcgacacgccccaactagacttgaaagcccgcccaaactacggcgcaggcgaaatcaccgtcctcgtcgaagtagcagacatggaactgcacaccaaaaagatcgagatctccggcctcaagttcgcctccctaacgtgcacgggctgttacgcgtgctcaagcggcatctcgtgcaaagttagaatccatgtcgacgaacccgacgaactcaccgtacatgtcaaatccgatgaccccgacgtagtagcagcctcgtcatccctaatggcccgcaaactcgagttcgggaccgactcgaccttcaaagccttcagcgcaatgccaaaaacctccctctgcttctacatcgtagaacgggaatactgcaaaagctgctccaaagaagacacccaaaaatgcgtcaacaccaagctcgaacacccccaatccatcctcatcgaacataagggaaccatcatcggcaaacaaaacaatacctgcacagcgaagacctcgtgctggctcgaatccgtaaaatcgttcttctacggacttaagaacatgctctcaggcatcttcggcaacgtattcgtcggcatcttcctattccttgcaccattcatccttctcatcctcttcttcatgttcggctggcgaatactattctgcttcaaatgctgccgccgcacacgcggcctcttccgctacaaacacctcgaagacgacgaagaaacgggataccgacgcatcatcgaacgcctgaacaacaagaaaggcaaaaacaaactcctagacggcgaacgcctcgcggaccgccgaatcgcagaactcttcagcacgaaaacccacatcggc

SEQ ID NO: 15758 - RNA, 1932 nt, synthetic construct
  misc_feature 1..1932: note = derived and/or modified CDS sequence (opt11) from CCHFV(K229_194)__KX013463.1__Gc
  source 1..1932: mol_type = other RNA
tttctcgacagcatcgtcaaaggcaagaaaaatcttctgaacagcacctccctcgaaaccagcctctccatcgaagccccatggggcgcaataaatgtccagtccacatttaaaccaacagtcagcacagccaacatcgccctatcctggtcctccgtagagcaccgcgggaacaagatcctagtaactggacggtccgaaagcatcatgaaattagaagaacgaaccggcgtctcctgggacctcggggtcgaagacgcctccgagtcaaaactcctcaccgtctcaataatggacctcagccaaatgtactcccccgtcttcgaatacctctcaggcgatcgccaagtcgaagagtggcccaaagcaacctgcactggcgactgccccgaaagatgcgggtgcacatcctcaacatgcctacacaaagaatggccccactcaaggaactggcgatgcaaccccacatggtgctggggcgtaggaaccggctgtacctgctgcggcgtagatgtaaaagacctgttcaccgaccacatgttcatcaaatggaaagtagagtatatcaagacagaagccatagtctgcgtagaactcacctcccaagaaagacagtgcagcctcatcgaggccggcacccgattcaacctcggccccgtcacaatcactctaagcgaacccagaaacatacaacaaaaattacccccagaaataatcacactccaccccaaaatcgaagagggcttcttcgacctcatgcacgtccagaaagtcctcagcgcctccactgtctgcaaacttcaaagctgcacccacggcatccccggcgacctacagatatatcacataggaaacctcctaaaaggcgaccgactcaacggccacctcatccacaagatcgaaccacacttcaacaccagttggatgtcatgggacggctgcgacctagactattattgcaacatgggagactggccctcctgcacctacaccggcgtcacccaacacaaccacgccgcattcgtcaacctcctcaacatcgaaaccgactatacaaaaacattccacttccactcgaaacgagtgactgcacacggagacactccccagctagacctaaaagcccgccccacctacggagccggcgaaatcacagtcctcgtagaagtagcagacatggaattacacacgaagaaagtcgaaatctccggactcaaattcgcgtccctagcctgcaccggctgctactcctgctcctctggcatttcttgcaaagtcaggatccacgtagacgaacccgacgaactaaccgtccacgtcaaaagttccgacccagacgtagtcgctgccagcacatcactcatggcccgcaaactcgagttcggcaccgactccaccttcaaagccttctcagcaatgcctaaaacatctctctgcttctacatcgtcgaacgcgaatactgcaaatcctgctccgaagacgacactaagaaatgcgtcgacactaaactagaacagccccaatccatcctcatcgaacacaaaggcaccatcatcggcaaacaaaacgacacgtgcacagccaaagcctcctgctggctagaaagcgtcaaatccttcttttacggactcaaaaacatgctaggctcagtcttcggcaacttcttcgtcggcatcctcctgttcctcgctcccttcgtcctactcgtcctgttctttatgttcggctggaaaatcttattctgcttcaaatgctgccgacgcacccgaggcctcttcaaataccgccacctcaaggacgacgaagaaacaggctaccgaaaaatcatcgaacgcctcaactcaaagaaaggcaaaaatcgcctactcgacggtgaaagattagcagaccgaaaaatagccgaactcttcagcaccaaaactcacatcggc

SEQ ID NO: 15759 - RNA, 1932 nt, synthetic construct
  misc_feature 1..1932: note = derived and/or modified CDS sequence (opt11) from CCHFV(K229_243)__KX013466.1__Gc
  source 1..1932: mol_type = other RNA
ttcctagactcaatcgtaaaaggaatgaaaaacctcctcaatagcacatcactcgaaacatccctaagtatcgaagccccctggggcgccatcaacgtccaaagcaccttcaaacccaccgtctcaaccgccaacatcgcgctcagctggtcctccgtcgaacaccgtggcaacaagatcctggtcacaggacggagcgaatccataatgaaactcgaggaacggacgggcgtatcgtgggacctcggcgtagaagacgcatccgaaagcaagctcctcacagtctccatcatggacctctcacaaatgtactcgccagtattcgaatatctctcaggcgacagacaggtcgaagagtggcccaaagcgacctgcactggtgactgcccagaacgctgcggctgcacttcctcaacctgcctgcacaaagaatggccacacagtcgcaactggcgctgcaatcccacctggtgctggggagtagggacaggctgcacatgctgcggcgtcgacgtcaaagacctcttcaccgaccacatgttcgtaaaatggaaagtagaatacatcaaaaccgaagccatagtctgcgtcgaactcacctcccaagagagacaatgctcactcatcgaggccggcacccgcttcaacctaggccccgtaacgatcacactctcggaacctcggaatattcaacaaaagctacccccagaaataattaccctccacccaaaagtcgaagaaggcttcttcgacctcatgcacgtacaaaaagtcctctcagcatcgacagtctgcaaactccaatcctgcacccacggcattccaggcgacctccaggtttaccacatcggcaacctactcaaaggagaccgcgtaaacggccatctaatccacaaaatagaaccccacttcaacacctcatggatgtcgtgggacggctgcgacctagactattactgcaacatgggcgactggccatcctgcacctacaccggcgtcacacaacacaatcacgccgccttcgtcaacctcctgaacatagaaaccgactacacaaagacctttcacttccactccaaacgcgtaaccgcccacggagacacaccccaactagacctaaaagctcgcccgacctacggcgccggcgaaatcaccgtactcgtcgaagtcgcagacatggaactacacaccaagaaagtcgagatctcaggactcaaatttgcatcactcgcttgcaccggctgctacgcctgctcctccggcatcagctgcaaagtgagaatccacgttgacgaaccagacgaactcaccgtacacgtcaaatcatccgatcccgacgtcgtagcagcctcaacctcactaatggctcgcaaactagagttcggtacggactcaacattcaaagccttctcagccatgccaaaaaccagcctctgcttctatatcgtagaaaaagaatactgcaaatcctgctccgaagaagacacacaaaaatgcgtcgacaccaaattagaacaaccccaatccatcctcatcgaacacaaaggaacaatcatcggcaagcaaaacgacacctgtacagccaaagcctcgtgctggctagaaagcgtcaagtcattcttttacggcctcaaaaacatgctcggctcagtgttcggcaactttttcatagggatcctcctcttcttaaccccattcgttctcctcgtgctattcttcatgttcggatggaaaatactcttctgcttcaaatgctgccgccgaacacgcggactgctcaaatacagacatctaaaagacgacgaagaaaccggataccgccgaatcatcgaacgcctgaacaacaagaaaggcaaaaaccgcctcctcgacggagaacgccttgccgaccgaaaaatcgccgaactcttcagcaccaaaacccacatcgga

SEQ ID NO: 15760 - RNA, 1932 nt, synthetic construct
  misc_feature 1..1932: note = derived and/or modified CDS sequence (opt11) from CCHFV(K315_14)__KX013469.1__Gc
  source 1..1932: mol_type = other RNA
tttctagacagtatcgtcaagggtatgaagaaactccttaacagcaccagtctcgagacctcgctatccatcgaagccccgtggggagcaatcaacgtccaatcaactttcaaacccaccgtaagcacggccaacatcgccctaagttggtccagcgtagagcaccgaggcaacaaaatcctcgtcaccggccgatccgaatctatcatgaaattagaagaacgcacaggcgtatcctgggacctcggcgtcgaagacgcttcagaatccaaactcctcaccgtctcgatcatggacctaagccaaatgtactcacccgtattcgaatacctatccggagaccgacaagtagaagaatggcccaaagcaacctgcaccggcgactgcccagagcgatgcggatgcacttcatccacatgcctacacaaagaatggccccactcccgcaactggagatgcaaccctacctggtgctggggagtgggaaccggctgtacctgctgcggagtcgacgtcaaggacctcttcacagaccacatgttcatcaaatggaaggtcgagtacatcaaaaccgaggccatagtttgcgtcgaactcacgtcccaagaaagacaatgctcgctcatcgaagccggcacacggttcaacctaggccccgtaaccatcaccctctccgagccccgaaacatacagcaaaaattaccgcccgagataatcaccctacaccccaaaatagaagaaggcttcttcgacctcatgcacgtccaaaaagtactctccgcctccacggtatgcaaactccaatcatgcacccacggcatccccggggacctacaaatataccatataggaaacctactcaaaggcgaccgcgtaaacggccacctaatccacaagatcgaaccccacttcaacacgagctggatgagctgggacggatgcgacctagattactactgcaacatgggcgactggcccagctgcacctacaccggtgtcacacaacacaaccacgccgccttcgtaaacctcctcaacatcgaaaccgactacacaaaaacatttcacttccactccaaacgcgtcactgcccacggcgacacaccccaactcgacctcaaagcccgaccaacctacggcgccggcgagatcaccgtcctagtcgaagtagccgacatggaactccacaccaagaaagttgagatcagcggcctaaaattcgcctcactaacctgcacaggctgctacgcatgctcctcaggcatctcatgtaaagtccgcatccacgttgacgaaccagacgaactaaccgtccacgtcaaaagctccgacccagacgtcgtggctgcctccacctccctaatggcacgcaaacttgagttcggcaccgactctacgttcaaagcattctcagctatgcccaaaaccagcctctgcttttacattgtggaacgagaatactgcaaaagctgttccgaagacgatacaaagaaatgtgtcgacactaaactcgaacaaccccagtccatactcatcgaacataaaggcacaataatcggcaagcaaaacgatacctgcacagcgaaagcctcctgctggttagaatccgtcaaatcattcttctacggactcaaaaacatgctaggcagcgtcttcggttcgttcttcgtaggcatcctactattcctcgccccattcgtcctcctcgtcctcttctttatgttcggctggaaaatactcttctgcttcaaatgctgccgccgcacccggggcctcttcaaataccgccacttaaaagacgacgaagaaactggttaccgccgaataatagaacgcctaaactcaaagaaaggcaaaaaccgactcctagacggcgaacgcctcgcggaccggaaaatcgccgagctgttttcaaccaaaacacacattggc

SEQ ID NO: 15761 - RNA, 1932 nt, synthetic construct
  misc_feature 1..1932: note = derived and/or modified CDS sequence (opt11) from CCHFV(K323_27)__KX013472.1__Gc
  source 1..1932: mol_type = other RNA
tttcttgacagcatcgccaagggtatgaagaaccttctaaactcaacctcactcgaaacctcactaagcatcgaagccccctggggggccatcaacgtacaatcaaccttcaaacctacagtctccacggccaacatcgccctctcatggtcctccgtcgaacaccgtggaaacaaaatccttgtcacaggacgctccgaatccataatgaagctcgaagaacggaccggcgtatcctgggacctcggcgtcgaagacgccagcgaatcgaaactcctgaccgtaagcatcatggacctctctcaaatgtactcgccggtcttcgaatacctatctggcgaccgacaagtcgaagagtggcccaaagccacctgcaccggcgactgccccgaacgctgcggatgcacatcctccacatgcctacataaggaatggccacactcacgcaactggcgatgcaatcccacctggtgctggggcgtcggcaccggctgcacctgctgcggagtcgacgtgaaagacctattcacagatcacatgttcatcaaatggaaagtcgaatacataaaaactgaagcgatagtctgcgtcgaactcacgggccaagaacgccaatgcagcctaatcgaagcaggcacccgcttcaacctcggcccggtcaccatcacactctcagaaccccgcaacatacagcaaaagctcccacccgaaatcatcaccctccaccccaaaatcgaagaaggatttttcgacctcatgcacgtacagaaggtactatcggccagcactgtatgtaaacttcaatcctgcacacacgggatacccggagacttgcagatctaccacatcggaaacctcctgaaaggtgaccgtgttaatggacacctcatccacaaaatcgaaccacacttcaacacatcgtggatgtcctgggacggatgcgacctcgactactactgcaacatgggcgactggccctcctgcacctatacgggcgtcacccaacacaaccacgcagctttcgtcaacctactgaacatcgaaacagattacaccaagacattccacttccactcaaaacgcgtcaccgcacacggcgacaccccacaattagacctgaaagccagacccacttacggcgcaggcgaaataaccgtcctcgtcgaagtcgccgacatggaactccacaccaaaaaagtcgaaatctcgggcctcaaattcgcctcgctaacatgcaccggctgttatgcgtgctcctccggaatatcgtgcaaagtcaggattcacgtagacgaaccagacgagctcaccgtacacgtaaaatcatccgacccagacgtcgtcgccgcatccaccagcctaatggcccgcaaactggaattcggaaccgactcgaccttcaaagccttctcagcaatgcccaaaacctccctatgcttctacatcgtagaacgcgaatactgcaaatcatgctccgaagacgacacaaagaaatgcgtagacaccaaactcgaacaaccacaatccatactaatcgaacacaaaggcaccatcatcgggaaacaaaacgacacctgcaccgccaaagcctcctgctggctcgaaagcgtaaaatccttcttctacggactaaagaacatgttaggatcagtcttcggatcattcttcgtcggcatcctgctattcctcgccccattcgtcctcctagtactctttttcatgttcggctggaaaatacttttctgcttcaaatgctgccgacgaacgcgcggcctcttcaaatatcgccacctcaacgacgacgaagaaaccggctaccgccgcatcatcgaacgactcaactccaaaaagggcaagaatcgcctcctagatggtgaacgcctcgccgaccgaaaaatagccgaactattctccaccaaaacacacatcggg

SEQ ID NO: 15762 - RNA, 1932 nt, synthetic construct
  misc_feature 1..1932: note = derived and/or modified CDS sequence (opt11) from CCHFV(K340_6)__KX013475.1__Gc
  source 1..1932: mol_type = other RNA
tccctagattcaatcgtcaaagggatgaaaaacctcctcaacagcacatccctagaaacctccctcagcatcgaagccccatggggcgcaatcaacgtgcaatctaccttcaaacccacagtctcaaccgctaacatagcactttcctggtcgtccgtggaacaccgcggaaacaagatcctggtaacaggccgttctgagagcataatgaaactcgaagaacgaaccggggtgtcttgggacctgggcgtagaagacgccagcgaatcaaaactactaaccgtctccatcatggacctatcccaaatgtactcccccgtcttcgagtacctttccggtgacaggcaagtcgaagaatggcccaaagcaacctgcaccggcgattgccccgaacgctgcggctgcacctccagcacgtgcctccacaaagaatggccccattcccgcaactggcgctgcaaccccacgtggtgctggggcgtcggcaccggatgcacatgctgtggggtcgacgtcaaagacctgttcaccgaccacatgtttataaaatggaaagtcgaatacataaaaactgaggccatcgtctgcgtagaattaacctcccaagagcgccaatgctcactaatcgaagccggaacccgattcaacctaggccccgtcaccataacactctccgaaccccgcaacatccaacaaaaactccctcccgagatcatcaccttgcaccccaagatagaagaaggcttcttcgacctcatgcacgtgcagaaagtactatccgccagcacagtttgtaaactacaatcctgcacacacggaatccccggcgacctccagatatatcacatcggaaacctactcaaaggcgaccgcgtcaatggccacctcatacacaaaatcgagccccacttcaacacctcatggatgtcctgggacggctgcgacctcgactactactgcaacatgggcgattggccctcgtgcacgtacaccggcgtaacccaacacaaccacgccgccttcgtaaaccttctgaacatagaaaccgactacaccaaaaccttccacttccactctaaacgtgtgaccgcccacggagacacaccccagctcgacctgaaagcacgccccacctacggcgccggcgaaatcaccgtcctagtggaggtcaccgacatggaactacacacaaagaaagtcgaaatatccgggctcaaatttgcctccctcacatgcaccggatgctatgcctgctcatccggaatctcatgcaaagtccgcatccacgttgacgagcccgacgaactaaccgtacacgtaaaaagcagcgacccagacgtcgtcgccgcctccacctcactaatggcccgcaaactcgagttcggaaccgacagcactttcaaagccttcagcgccatgcccaaaacctccctctgcttctacatagttgaacgcgaatactgcaaatcatgcagcgaagacgacaccaagaaatgcgtagacaccaaactcgaacagccgcaatccatcctgatagagcacaaaggcaccatcatcggcaaacaaaacgatacttgcaccgccaaagcctcatgctggctagaaagcgtaaaatccttcttctacggactcaagaacatgctgggctcagtcttcggcagcttcttcgtcggaatactcctcttcctagcacccttcgtcctcctagtccttttcttcatgttcggatggaaaatcctcttctgtttcaaatgctgccgcagaacccgcggactcttcaaatatcgacacttcaaagacgacgaggaaaccggatacaggcgcatcatcgaacgactgaactccaagaaaggcaaaaaccgcctcctagacggagaacgactagccgaccgaaaaatcgcagaactattctccacaaaaacgcacataggc

SEQ ID NO: 15763 - RNA, 1932 nt, synthetic construct
  misc_feature 1..1932: note = derived and/or modified CDS sequence (opt11) from CCHFV(Mamon)__KX013478.1__Gc
  source 1..1932: mol_type = other RNA
ttcctggacagcatcgtcaaaggcatgaaaaacctactcaactctacatccctcgaaacctccctctcaatagaagccccatggggcgcaatcaacgtccaatccacctttaaacccaccgtcagcaccgcaaacatagcactttcatggtcatccgtcgaacaccgcggaaacaaaatcctcgtaaccggccgttcagaatccataatgaagctcgaagaacgaacaggcgttagctgggacctaggcgtagaagacgccagtgaatccaaactattgacagtatccatcatggatctatctcaaatgtactccccagtattcgaatatctgagcggcgatcggcaagtcgaagaatggcccaaagctacctgcacaggcgactgccccgaaagatgcggctgcacaagtagtacctgcttacacaaagaatggccccacagccgcaactggcgctgcaaccccacatggtgctggggagtaggcaccggttgcacgtgctgcggcgtcgacgtaaaagacctattcaccgaccacatgttcgtcaaatggaaagtagaatacattaaaaccgaagcaatcgtctgcgtcgagctaacttctcaagaacgccagtgcagcctaatcgaagcaggcacccgcttcaacctaggcccagtaacgatcaccctaagcgaaccccggaacatacagcaaaaactacccccagaaatcataaccctccaccctaaagtagaagaaggattcttcgaccttatgcatgtccagaaagtactatcagcctccacagtttgcaagctacaatcctgcacccacggcatacccggagacctccaagtctaccacatcggcaacctcctcaaaggggaccgcgtcaacgggcacctcatacacaaaatcgaaccccacttcaacacctcatggatgagttgggatggatgcgacctcgactattactgtaacatgggcgactggccatcctgcacgtacaccggcgttacccaacacaaccatgccgccttcgtaaacctactaaacatcgaaacagactacaccaaaaccttccacttccactctaaacgagtcaccgcccacggcgacaccccgcaactcgacctaaaagcccgacccacctacggcgcaggagaaatcaccgtcctagtggaagtagccgacatggaactacacacaaagaaagtagaaatcagcggcctcaaattcgcctcactcgcgtgcacgggctgctacgcatgcagctcaggcatctcatgcaaagtccgcatccacgtcgacgaaccggacgagctcacagtccatgtcaaatcctccgacccagatgtagtagccgcaagcacatccctcatggcgaggaaactcgagttcggaactgattccaccttcaaggccttctcggcaatgccaaagacgtccctctgcttctacatagtcgaacgagaatactgcaagagctgcagcgaagaagacacccaaaaatgcgtcgacaccaaactggaacagccccaatccatcctaatcgaacacaagggtactatcatcggaaaacagaacgacacgtgcacagctaaaacctcctgctggctcgaatccgtgaaatccttcttctacggcctcaagaacatgctcggcagcgtgttcggcaacttctttatcggaatactcctcttcctcgcgccattcgtactcctcgtcctattcttcatgttcggatggaaaatcctattttgcttcaaatgctgccgccgcaccaggggccttctcaaataccgccacctcaaagacgacgaagaaacaggatacagacgaatcatagaacgcctcaacaataagaaaggcaaaaaccgcctcctcgacggcgaacgcctggctgaccgtaaaatcgccgaactattcagcacgaaaactcacatcgga

SEQ ID NO: 15764 - RNA, 1932 nt, synthetic construct
  misc_feature 1..1932: note = derived and/or modified CDS sequence (opt11) from CCHFV(Min)__KX013481.1__Gc
  source 1..1932: mol_type = other RNA
ttcctggactccatcgtcaaaggcaccaaaaacctcctcaacagcacgtcacttgaaacatcactctccatcgaggccccctggggcgccatcaacgtccaatcaaccttcaaaccaaccgtatccaccgcaaacatagccctctcatggtccagcgtcgaacaccgcggcaacaaaatcctggtcaccggccgctccgaatctatcatgaaactagaagaacgcaccggcgtctcgtgggacctaggagtagaagacgcttcagaatctaaactcctaacagtaagcatcatggacctatcgcagatgtacagcccagtgtttgaatatctttcgggcgaccgccaagtggaagaatggcccaaagcgacatgcaccggagactgccccgagcgctgcggctgcacatcaagcacatgcctccacaaagagtggccccactcacgaaactggcgatgcaacccaacctggtgctggggcgtcggcaccggctgcacatgctgcggcgtagacgtgaaggacctgttcaccgaccacatgttcgtaaaatggaaagtcgaatatataaaaacagaagccatcgtatgcgtagaactcacctcccaagaaagacaatgcagcctaatcgaagccggcacacgattcaacctaggccccgtcaccatcaccctttcagaacctagaaacattcaacaaaaactaccacccgaaataatcaccctccaccccaaagtagaagaaggcttcttcgacctcatgcacgtccaaaaagtacttagcgcaagcacggtctgcaaactccaatcatgcacacacggcatccccggcgacctccaagtataccacatcggcaaccttctgaagggtgaccgcatcaatggacacctcatacataaaatagaaccacacttcaacacctcctggatgagctgggacggctgcgatctcgactactactgcaacatgggcgactggccttcctgcacctacaccggcgtcacacaacacaaccacgccgccttcgtcaaccttctcaacattgaaaccgactacaccaagaccttccacttccacagcaagcgagtaaccgctcacggcgacacgccccagctcgaccttaaagcccgaccgacctacggagccggcgaaataaccgtcctcgtagaagtcgccgacatggagctccatacgaagaaagtcgaaatctcaggcctcaaattcgcctccctcgcctgcacgggctgctacgcctgctcctctgggatctcctgcaaagtccgcatccacgtcgacgaacccgatgaactgacagtccacgtaaaaagctccgaccccgatgtagtcgccgcctcaacctccctcatggcacgaaaactagagttcggaaccgactccaccttcaaagccttttcagcaatgcccaagacctcactatgcttctacatcgtcgaacgtgaatactgcaagtcatgctccgaagaagacacacaaaaatgcgtagacaccaaactcgaacaaccacaatccatcctcatagaacacaaaggaacaataatcggcaaacaaaacgatacctgcacagccaaagcctcgtgctggctagaatccgtgaaatccttcttctacggcctcaaaaacatgctaggatctgtattcggcaacttcttcatcggcatacttctcttcctagcaccgttcgtcctcctggtcctctttttcatgttcggatggaaaatccttttctgctttaaatgctgccgccgcacgcgtggcctcctgaaatatcgccacctcaaggacgacgaagaaactggataccgacgaatcatcgaacgcctgaacaacaagaaaggcaaaaaccgactcctagacggagaaaggctcgcagaccgcaaaatcgccgaactcttctccacaaaaacccacataggc

SEQ ID NO: 15765 - RNA, 1932 nt, synthetic construct
  misc_feature 1..1932: note = derived and/or modified CDS sequence (opt11) from CCHFV(Nakiwogo)__KX013484.1__Gc
  source 1..1932: mol_type = other RNA
tacctcgactctatagcaaaaggaatgaaatcactactcaactcaaccaacctcgaaacatcactctccatagaggccccctggggcgcaatcaacgtccaatccacattcaaaccaaccgtctccgccgccaacatcgcactatcttggtcctcagttgaacaccgcggaaacaaaatcctcgtcagcggacgaagcgagagcatcatgaaactcgaagaacgcaccggcatctcctggtctctcggcgtcgaagacgcgagcgaatccaaaaccttgacagtatccgtcatggacctatcacaaatgtactcccccgtcttcgaatacctcagcggcgaccgacaagtggaagaatggcccaaagcaacatgcaccggagactgccccgaacgctgcggctgcacctcctcaacctgcctccacaaagaatggccccactcccgtaactggcgatgcaaccccacctggtgttggggagtcggcacgggttgcacatgctgcggcctcgacgtaagagacctgttcacagactacatgatggtaaaatggaaagttgaatacgtcaaaactgaagccatcatgtgcgtcgaactaacgagccaagaacgacaatgctccctcatagaagcgggcacgagattcaatctaggacccgtcaccattacgctatcagaaccacgcaacgtacaacaacggctaccatccgaaatagttaccctccaccctaaaatagaagaaggcttcttcgacctcatgcacgtacaaaaagtcctattctgcaaacactccctacaggccaccagctgcactcacggcgtccccggcgacctccaagtctaccacgtcggcaacctcctgaaaggcgacaaagtcaacggtcactctatacacaagatagaaagccacttcaacacctcctggatgtcctgggatgggtgcgacctagactacttctgcaacatgggagactggccaagctgcacatacactggagtcacccaacacaaccgcgccgcattcgtcaacatgctcaacattgaaacagattacaccaaaacattccactttcactccaaacgcgtcacagcacacggagacacaccccaactggacctgaaagcccgacccacctacggcgcaggcgaagtcaccgtcctcgttgaagtggccgacctcgaactccacacaaagaaaatcgaagtctcgggtctaaaattcgccagtctcacatgcagcggatgctacgcctgctctagcggcatctcatgcaaagtgcgaatccatgtcaacgaaccagacgaatttacggtccacgtaaaaagcaacgaccccgacgtagtcgccgccggaagcagcctcatggcccggaaaatagaactcggcgcagactcaacattcaaagcattcagcagcatgcccaaaaactccctatgcttctacatcgtcgaacgggactactgctcatcctgcactgatgacgacacccaaaaatgcgtcaacaccaaactcgagcacccacaatcgatcctcatcgaacacaaaggcacgatcataggcaaacagaacgacacatgtccaaccaaaacctcttgctggctagaaagcgtaaaatccttcttctacggcctcaaaaacatgctcgggggcatcttcggcaacgtcttcctcggcatcttcctcttcttagccccattcgcactcctcatcctgttctttttcttcggttggcgcctactcttctgcctgaaatgctgccgccgaacccgaggactcctgaaatacaaacaactcaaggacgaggaagaagccggctacaagaaaattatcgagcgcctaaacgacaagaaaggcaaatcccgcctattcgacggcgaacgactcgccgaccgaaaaatagcagagctattctccacgaaaacccatataggc

SEQ ID NO: 15766 - RNA, 1932 nt, synthetic construct
  misc_feature 1..1932: note = derived and/or modified CDS sequence (opt11) from CCHFV(Saf)__KX013487.1__Gc
  source 1..1932: mol_type = other RNA
ttctccgactccatcgtcaagggcatgaaaaacctactgaactccaccagcctcgaaacctcactctcaatagaagcaccctggggcgcaataaacgtacaatccacattcaaaccgacagtctcaaccgccaatatcgcgctctcttggtcatccgtcgaacaccgcggaaacaaaatactcgtcaccggccgctccgaaagcatcatgaaactcgaggaacgcaccggcgtatcctgggacctcggagtcgaagacgcctccgaaagcaagctactgaccgtcagcataatggatctctcacaaatgtactcacccgtcttcgaatacctatccggcgacagacaggtcgaggaatggcccaaagccacctgtacgggcgactgtcccgaacgctgcggttgcacatcctccacatgcctacacaaggaatggccacatagccgcaactggcgctgcaacccgacctggtgctggggtgtcggaaccggatgcacatgctgcggggtagacgtcaaagacctcttcaccgaccatatgttcgtcaagtggaaagtagaatacatcaaaaccgaggctatcgtatgcgtagaactcacctcccaagaacgacagtgctccctgatcgaagccggcacccgcttcaacctgggcccagtcaccatcaccctgtcagaaccacgcaacatccaacaaaaactcccacccgaaatcatcaccctccaccccaaagtagaagaaggattcttcgatctcatgcacgtccaaaaagtactctccgccagcaccgtctgcaaactacaatcatgcacccatggcatccccggagacctccaggtttaccacatcggcaacctcctaaagggggaccgcgttaacggccacctcatccacaaaattgaaccacacttcaacacctcatggatgtcctgggacggctgcgacctagactactactgcaatatgggcgactggccctcatgcacttatacaggcgtcacccagcacaaccacgccgccttcgtcaaccttctgaacatcgaaaccgactacatgaaaaccttccacttccacagcaaacgcgtcacagcacacggagacaccccacaactcgaccttaaagcacgcccaacttacggagcaggcgagataacggtcctcgtcgaagtcgccgacatggaactccacacaaagaaagtagaaatctctggactcaaattcgtctctctagcctgcaccggctgctatgcctgctcctcaggcatctcctgcaaagtacgaatccacgtcgacgaacccgacgaactcacagtccacgtcaaatcctccgaccctgacgtagtcgcagcctcaacctccctcatggcccgaaaactggagttcggcacagacagcaccttcaaagccttctccgcaatgccaaaaacatccctctgcttctatatcgtagaacgcgaatactgcaagtcatgcagcgaagaagacacccagaagtgcgtcgacaccaaactcgaacaaccacagagcatcctgatcgaacacaaaggaaccattataggcaaacaaaacgacacctgtaccgccaaagcatcctgctggctagaaagcgtaaaatcctttttctacggactcaaaaacatgctagggtccgtcttcggaaacttcttcatcggcatactcctcttcctcgcccctttcgtactcttggtcctcttcttcatgtttggatggaaaatcctcttctgcttcaaatgctgcagacgcacccgcggattactcaaataccgacatctgaaagacgacgaagaaacagggtaccggcgcataatcgaacgcctaaacaacaagaaaggcaaaaaccgactcctcgatggcgaacgcctcgctgaccgcaaaatagccgaactcttttcgaccaagacacacatagga

SEQ ID NO: 15767 - RNA, 1932 nt, synthetic construct
  misc_feature 1..1932: note = derived and/or modified CDS sequence (opt11) from CCHFV(Ast199)__KX056051.1__Gc
  source 1..1932: mol_type = other RNA
ttcctcgatagtatcgtcaagggcatgaaaaacctccttaactccacaagcctagagacctcactatcaatagaagccccgtggggcgccatcaacgtacaatcaaccttcaaacccacagtcagcaccgccaacatcgcactatcctggtcatcagtagaacacagaggcaacaaaatactcgtaacgggccggtccgaaagcatcatgaaacttgaagaaagaactggcgtatcctgggaccttggagtagaagacgccagcgaatcaaaactactgaccgtcagcatcatggacctatcacaaatgtactcccccgtattcgaatacctgagcggagaccgccaagtcgaagaatggcccaaagcaacctgcaccggcgactgcccagaaagatgcggctgcacgtcctccacgtgcctacacaaagaatggccccactcccgcaactggcgatgcaatcctacatggtgctggggcgtcggcaccggctgcacatgctgcggcgtcgacgtcaaagacctcttcaccgaccacatgttcataaaatggaaagtcgaatacatcaaaacagaagccatcgtctgcgtcgaactaacctcccaagaaagacaatgctcactcatagaagccggtacccgattcaacctgggaccggttaccataaccctttcagaaccccgcaacatacaacaaaaactcccacccgaaataataaccctacaccccaaaatcgaagaaggcttcttcgatctcatgcacgtccaaaaggtcctctccgcatccacagtctgcaaactacaatcctgcacgcacgggatccccggagaccttcaaatataccacatcggaaacctcctcaaaggagaccgcctaaacggccaccttatccacaaaatagagccacacttcaacacctcctggatgtcatgggacggatgcgacctcgactattactgcaacatgggcgactggccaagctgcacatataccggcgtcacccaacacaaccacgccgccttcgtaaacctcctcaacatagaaaccgactataccaagaccttccatttccacagcaaacgagtgactgcccacggcgacacaccccaactcgaccttaaagcacgccccacctacggagccggagaaataaccgtactcgtcgaagtcgcagacatggaactccacaccaaaaaggtcgaagtatcgggactcaaattcgcctccctcgcgtgcaccggatgttacgcctgctcctcaggcatctcatgcaaagtaaggatacacgtagacgaacccgacgagctgaccgtccacgtaaaatcatcagacccagacgtggtggcagccagcacctcactcatggcccgcaaactagagttcgggaccgactcaacctttaaagccttttccgcaatgcccaaaacctcactttgcttctacatcgtcgaacgagaatactgcaagagctgcagcgaagacgacaccaagaaatgcgtcgacaccaaactcgaacagccccaatcaatcctaatagagcacaaaggcacgatcatcggcaaacagaatgacacatgcacagcaaaagccagttgctggctcgaaagcgtcaaatccttcttctacggtctcaaaaacatgctaggatctgtattcggaaacttcttcgtaggtatacttctcttcctagccccgttcgtgctactcgtcctgttcttcatattcggctggaaaatactattctgcttcaaatgctgccgtcgcacgcgcggtctcttcaaatacagacacctaaaagacgacgaagaaaccggataccgcaaaataatcgaacgcctgaactccaaaaagggcaaaaatcgactactagacggcgaacgcttagccgaccgcaaaatcgcggaactcttctcaaccaaaacacacataggc

SEQ ID NO: 15768 - RNA, 1932 nt, synthetic construct
  misc_feature 1..1932: note = derived and/or modified CDS sequence (opt11) from CCHFV(Ast149)__KX056054.1__Gc
  source 1..1932: mol_type = other RNA
ttcctcgacagcatcgtaaaaggcatgaaaaacctcctaaactccacctcccttgagacctccctatccatagaggccccctggggagccatcaacgtccaatcaaccttcaaacccaccgtctccaccgcgaacatcgcgctttcctggagcagcgtagaacatcgcggcaacaaaatcctagtaaccggacgatcggaatccataatgaaactcgaagaacgaaccggagtaagctgggacctaggagtcgaagacgcatccgaatccaaactactaacagtcagcatcatggacctatcccaaatgtactcgcccgtattcgaatacctcagcggcgacagacaagtcgaggagtggcccaaagctacctgcacaggcgactgcccagaacgctgcgggtgcaccagctcaacctgcctgcacaaagaatggccccattcccgaaactggcgctgcaaccccacctggtgctggggagtcggcacgggctgtacctgctgcggagtagacgtcaaagacttattcacagaccacatgttcataaaatggaaagtcgaatacatcaaaaccgaagcaatcgtctgcgtcgaactaacctcccaagaacggcagtgctccctcattgaggcgggaacgcgattcaacctaggacccgtaaccatcacactctccgaaccacgaaacatccaacaaaaactgcccccagagatcataaccctccacccaaaaattgaagaaggcttcttcgacctcatgcacgtacaaaaagtcctctccgcaagcactgtctgcaagctacaatcctgcacccacggtatcccgggcgacctccaaatctatcacataggcaacctgctcaaaggggaccgcctgaacggacatctaatacacaaaatagaaccacacttcaacacctcatggatgtcctgggacggatgcgatctcgactattactgcaacatgggcgactggccctcctgcacctacaccggtgttacccaacacaaccacgccgccttcgtcaatctcctcaacatcgaaactgactacaccaagaccttccacttccactcaaaacgagtaaccgcccacggcgacaccccacagctagacctcaaagcccgaccaacatatggcgctggagaaatcacggtcttagtcgaggtcgccgacatggagctccacactaagaaagtcgaagtctccggcctaaaatttgcttcgctcgcgtgcacaggctgctacgcctgctcctccggcatctcatgcaaagtccgcatccacgtcgacgaacccgatgagctcacagtacacgtcaaaagcagcgaccccgatgtcgtagccgcatccacctccctcatggcccgaaaactcgagttcggcacagactcaacattcaaagccttctccgccatgccaaaaacctccctctgcttctacatcgtcgaacgagaatactgcaaatcatgcagcgaagacgacacaaagaaatgcgtcgacaccaaactcgaacaaccccaaagcatcctcatcgaacacaaaggaaccatcataggcaaacaaaacgatacctgcaccgcaaaagcatcctgctggctagagtccgttaaatccttcttctacggactcaaaaacatgcttggctccgtgttcggcaacttcttcgtaggcatcctactattcctcgccccatttgtcctcctagccctattcttcatcttcggctggaaaatcctcttctgctttaaatgctgccggcgcacgagaggcctcttcaaatatagacacctcaaagacgacgaagagacaggttaccgaaagataatcgaacgcctcaactcaaagaaaggcaaaaatcgacttctcgacggcgaacgcctagcggaccgcaaaatagccgaactattctccacgaaaacccacattggc

SEQ ID NO: 15769 - RNA, 1932 nt, synthetic construct
  misc_feature 1..1932: note = derived and/or modified CDS sequence (opt11) from CCHFV(Ast137)__KX056057.1__Gc
  source 1..1932: mol_type = other RNA
ttcctggacagtatcgtaaagggtaccaaaaacctactaaactccacctcactcgaaacatccctatccatcgaagccccatggggagccataaacgttcaatctaccttcaaacccacagtaagcaccgccaacatagcgctcagctggtcgagcgtggaacaccgcggcaacaagattttggtcaccggacgctccgaaagcataatgaagctagaagaacgtacaggggtctcgtgggacctcggtgtcgaggacgcaagcgaaagcaagctactaacagtcagcatcatggacctcagccaaatgtactcaccagtatttgaatacctcagcggcgaccggcaagtagaagagtggcccaaagctacctgcacaggtgactgccccgagcgatgcggctgcacatcctccacgtgcctccataaagaatggccccatagccgcaactggcgctgcaaccccacctggtgctggggcgtcggcaccggatgtacctgctgcggcgtagacgtcaaggacctcttcacagaccacatgttcataaaatggaaagttgagtacatcaagacggaagcaatcgtatgcgtcgaactaacctcccaagagcgccagtgctcccttatagaagcgggcacacgattcaacctgggcccagtcacgatcaccctctcagaaccccgaaacatacaacaaaaactacctccagaaatcatcaccctacatccaaaaatcgaagaaggattcttcgacctaatgcacgtccagaaagtcctttccgcgagcacggtctgcaaactacaatcctgcacacacggtatacccggcgacctccaaatataccacataggcaacctgctcaaaggcgaccgactaaacggccacctcatacacaaaatcgaaccccacttcaacacctcctggatgtcctgggacggatgcgaccttgactactactgcaacatgggagactggcccagctgcacgtacaccggagtcacccaacacaaccacgcagccttcgtcaacctactaaacatcgaaaccgactacaccaaaacattccacttccactcaaaacgtgtcacggcccacggtgacacaccccaactggacctaaaggcgcgaccaacctacggcgccggcgaaatcaccgtcctagtagaagtcgcggacatggaactgcacacgaagaaagtcgaagtctccggacttaaattcgcctcgctagcatgcacaggatgctatgcatgcagctccggcatatcctgcaaagtacgcatccacgtagacgaaccagacgagctgaccgtccacgtcaaatcctcagaccccgacgtcgtcgcggcatccaccagcctcatggcccgcaaacttgagttcggaacagactccacctttaaagcgttctcagccatgccaaaaacctcactctgcttctacatcgtcgaacgcgaatactgcaaaagctgcagcgaagacgacaccaagaaatgcgtcgacacaaaactcgaacaaccacaatcgatcctaatagagcacaaaggaaccatcattggaaaacaaaacgacacatgcaccgccaaagcctcctgctggctcgagagtgtcaaatccttcttctacggactgaaaaacatgctaggttccgtcttcggcaacttcttcgtaggaatactcctgttcctcgccccgttcgtccttctcgtactcttcttcatattcggctggaaaatcctcttctgcttcaaatgctgccgacgcacccggggccttttcaaataccgccaccttaaggacgacgaagaaacaggctatcgcaaaataatcgagcgcctgaactcaaagaagggcaagaatcgcctactagacggggaacgcctcgccgaccgcaaaatagccgaactatttagcaccaaaacacatatcggc

SEQ ID NO: 15770 - RNA, 1932 nt, synthetic construct
  misc_feature 1..1932: note = derived and/or modified CDS sequence (opt11) from CCHFV(Ast133)__KX056060.1__Gc
  source 1..1932: mol_type = other RNA
ttcagcgacagcatagtcaaaggaatgaaaaacctcctcaattccacttccctcgaaacctcgctctccatcgaagccccctggggcgccatcaacgtacaatccaccttcaaaccgaccgtgtccaccgctaatatcgccctttcttggtccagcgtggaacaccgaggaaacaaaatcctggtaacaggacgaagcgaaagcatcatgaaactcgaggaaagaaccggagtttcctgggacctcggagtcgaagacgcaagcgaatccaaactactgaccgtctcaatcatggacctaagccaaatgtactcgcctgtattcgagtacctcagcggcgaccgccaagtagaagagtggcctaaggccacatgcaccggcgactgcccagaacgctgcgggtgcacctcatcaacatgcctacacaaggagtggccccactcccgaaactggcgctgtaacccaacatggtgctggggcgtcgggacaggctgtacctgctgcggagtcgacgtaaaggacctattcacagaccacatgttcataaaatggaaagtcgagtacataaaaaccgaagcgatcgtctgcgtcgaactaacaagccaagagagacaatgctcactcatcgaagccgggacacgattcaacctaggcccagtcactataaccctctccgaaccccgcaacattcaacaaaaactccctcccgaaataataaccctccaccccaaaatcgaagaaggcttcttcgacttaatgcacgtgcagaaagtattatcagccagcaccgtatgcaaactacagtcctgcacacacggaatacccggcgacctccaaatctaccacataggcaacctcctcaaaggcgaccgcgtaaacggccatctaatccacaaaatcgaaccccatttcaatacctcatggatgagctgggacggctgcgatctagactactactgcaatatgggcgactggccctcatgcacctataccggcgtaacccagcacaaccacgccgcattcgtcaacctcctcaacatcgaaacagactacaccaagaccttccacttccactctaagcgggtaacggcacacggcgacactccccaactagacctaaaagcacgccccacctacggagcaggcgaaatcaccgtgctagtcgaagtcgcggacatggaactacacaccaagaaagtcgaaatctccggcctaaaattcgcatcccttacatgcaccggctgctacgcctgcagtagcggcatcagctgtaaagtccgcatacacgtcgacgaaccagacgaactcacggtccacgtaaaatcaagcgaccccgacgtcgtcgccgcctcaacctcactaatggcacgaaaactagagttcggcaccgacagcacattcaaagccttcagcgccatgccaaaaactagcctctgtttctacattgtcgaacgagaatactgcaaaagttgcagcgaagacgacaccaaaaagtgtgttgacacaaaactagaacaaccgcaatccattctgatcgaacacaaaggcacgatcatcggcaagcaaaacgatacctgcacagctaaggcatcatgctggctcgaaagcgtcaaatccttcttctacgggctcaaaaacatgctcggcagcgtattcggatcattcttcgtcggaatcctattgttcctcgcacccttcgtactcctagtcctcttctttatgttcggctggaagatactcttctgcttcaaatgctgccgccgaacacgaggcctcttcaaataccgccacctaaaagacgacgaagagaccggataccgcagaatcattgaacgcctaaacagcaaaaagggcaaaaaccgactactggacggagaacgcctagccgaccgaaaaatagccgaactattcagttccaaaacacacataggg

SEQ ID NO: 15771 - RNA, 1932 nt, synthetic construct
  misc_feature 1..1932: note = derived and/or modified CDS sequence (opt11) from CCHFV(SK/2015/human)__KX458183.1__Gc
  source 1..1932: mol_type = other RNA
ttcctcgacagcatagtgcgaggaatgaaaaacctccttaacagcacctcactggaaacttccctctccatcgaagctccctggggcgccatcaacgtccaatcaacctacaaacccaccgtctccacggccaacatcgccctctcctggtcaagcgtcgaacatcgcggaaacaaaatcctagtatcaggtagatcagaatccataatgaaactcgaagaaagaaccggcgtctcttgggacctaggcgtcgaagacgcctccgaatccaaactactcaccgtcagcgttatggacctttcccaaatgtactcacccgtcttcgaatacctctccggcgaccgccaagtcgaagaatggcccaaagcaacctgcacaggcgactgccccgaaaggtgcgggtgcacaacttccacttgcctccataaagaatggccccactcacgtaactggcgctgtaaccccacctggtgctggggtgtgggcacgggatgtacctgctgtggactagacgtaaaggaccttttcaccgactacatgttcgtcaaatggaaagtcgaatatatcaagaccgaagccatcgtctgcgtcgagctcacctcccaaggcagacaatgctccctaatcgaagccggcacccgcttcaacctgggttccgtcaccatcaccctatcagaaccacgaaacatacaacacaaactcccgcccgagattatcacactccacccccgaatcgaagaaggcttcttcgacctcatgcacgtccaaaaagtgctatccgcctcaacagtttgcaaactccaatcctgcacacacggggtacccggcgacctccaagtataccacatcggcaacctccttaaaggcgacaaagttaacggccacctaatccacaaaatcgaaccccactttaacacttcgtggatgtcttgggacggctgtgatctggactactactgcaacatgggcgactggccatcttgcacctacaccggagtcacccaacacaaccacgccagcttcgtaaaccttctcaacatcgaaacagattacaccaaaaacttccacttccacagcaaacgggttacagcccacggcgacactcctcaactggacctcaaagcccgcccaacttacggagccggcgaaatcaccgtactggtcgaagtcgcagacatggaactccacaccaagaaaatcgaaatttcaggcctcaaattcgcctcgctaacctgtaccggttgctacgcatgttcaagcggcattagctgcaaagtacgcatacacgtcgacgaaccagacgaactaaccgtccacgtcaaatccgacgacccagacgtagtagccgcctcctcctcactaatggcacgcaaactcgagttcggcaccgactctaccttcaaagccttctccgctatgcccaaaaccagcctctgcttctacatcgtagaacgcgaatactgcaagtcatgcagcaaagaagacacccaaaaatgcgtcaacaccaagctcgaacaaccccaatccatcctaatcgaacatcgcggcactattattggcaaacaaaacaatacctgcatcgctaaagcctcctgctggctagaatccgtaaaatcattcttctacgggctcaaaaacatgctctcaggcatcttcggcaacctattcctaggcatcttcctcttcctcgcaccattcatcctcctcatcctcttcttcatgtttggatggcgcatcctcttctgcttcaaatgctgccgccgtacacgcggactcttcaaataccgtcacctaaaagatgacgaagaaaccggctacagacgaatcatcgaacgcctaaacaacaagaaaggcaaaaacaaacttctcgacggagaacgattagcagaccgccgcatcgccgaattattctccaccaaaacacacatcggc

SEQ ID NO: 15772 - RNA, 1932 nt, synthetic construct
  misc_feature 1..1932: note = derived and/or modified CDS sequence (opt11) from CCHFV(YL16070)__KY354081.1__Gc
  source 1..1932: mol_type = other RNA
ttcctcgactcaatcgctaaaggaatgaaaagcctactcaactcgacctccctagaaacaagcctgtccatcgaggcaccctggggcgcaatcaacgtacagagcacattcaaaccaaccgtctccgccgctaacatagcactcagctggtcctccgtcgaacatcgaggcaacaaaatcctcgtatcaggacgctccgaaagcatcatgaaactagaagaacggaccggcgtcagctggaacctcggagtcgaagacgcctccgaaagcaaaaccctgaccgtaagcgtcatggacctctcccaaatgtactcccccgtcttcgaatacctcagcggagaccgacaagtagaagaatggcccaaagcaacctgcaccggcgattgccccgaacgctgcggttgtacctcatctacctgccttcacaaagaatggccacacagccgaaactggcgctgcaacccaacatggtgctggggcgttggcaccggctgtacctgctgcggcctcgacgtcaaagacttcttcaccgactacatgctcgtaaaatggaaagtagaatacatcaaaacagaagccatcgtatgcgtcgaactaaccagccaagaacgacaatgcagcctaatcgaagccggcacccgcttcaacctgggaccagttacaattaccctctctgaaccccgcaacgtacaacaacgcctaccgcccgaaatagtgacactacaccccaaaatagaagaaggattcttcgacctaatgcatgtacaaaagatcctcagcgccagcacagtctgtaaactccaatcgtgcacccacggggtaccgggcgacttccaagtctaccacgtcggaaacctccttcgaggcgacaaagtaaatggccacagcatccacaagatagaaccccatttcaacaccagctggatgagctgggacgggtgtgacttagactacttctgcaatatgggggactggcccagctgtacatacaccggcgtaacacaacacaaccgcgccgccttcattaacatgctcaacatcgaaaccgactacacaaaaaccttccacttccactcgaaacgcgtaacagcacacggagacacaccgcaactcgaccttaaggcacggcccgcctacggcgccggagaagttacggttctagtagaagtagccgacctcgaactgcacacgaagaaattagaggtatccggactcaaaatcgcaagcctaacctgctccggatgctacgcatgcagttccggcatttcctgcaaagtccgcatacatgtcaacgaacccgacgagttcacggtacacgtacgcagctccgacccagacgtagtagcagcaggatcttctctcatggcacgcaaaattgagttcggcgccgactcgacctttaaagccttctcatccatgccaaaagactccctatgcttctacatcgtcgaaaaggactactgctcatcctgcaccgacgacgacactcaaaaatgcgtcaacaccaagctcgaccatccacaatccatactcatagaacacaaaggcaccatcatcggaaaacaaaatgacacatgctccaccaaaacttcctgctggctcaagtccttcaaaggcttcttttacggactcaaaaacatgctctcaggcatcttcggcaacgtcttcctcggaatccttctattcctcgcacccttcgtactactcatcttcttcttcttcttcggctggcggctcctcttctgcctgaaatgctgcaagaaaacaaaaggcctactcaaatacaaacacctcaaagataaagaagaagccggatacaagaaaatcatcgaacgcctcaacggaaagaaaggcaaaagccaactcttcgacggcgagcgactcgccaatcgcaaaatagccgaactcttttccacaaaaatacacatcggc

SEQ ID NO: 15773 - RNA, 1932 nt, synthetic construct
  misc_feature 1..1932: note = derived and/or modified CDS sequence (opt11) from CCHFV(Oman_812956)__KY362518.1__Gc
  source 1..1932: mol_type = other RNA
ttcttcgacagcatcgccaaaggcatgaagaacctgctgaactcaacctccctcgaaacatccctgtccatcgaagccccctggggcgccataaacgtacaatccaccttcaaacccaccgtcagcacagcaaacatagccctatcctggtcctccgtagaacatcgagggaacaaaatcctcgtaagcggtcgctccgaatccatcatgaaactcgaagaaagaaccggcatatcatgggacctaggcgtcgaagacgccagcgaatcaaaactcctaaccgtttccgtcatggacctctcccaaatgtactcgcccgtcttcgaatacctctcaggggacagacaagtagaagaatggcccaaagctacctgcaccggcgactgccccgaacgctgcggctgcacctccagcacatgcctccacaaggaatggccacacagccgaaactggcgctgcaacccgacctggtgctggggtgtgggaaccggctgtacctgctgcggcctcgacgtcaaggacctcttcacagactacatgttcgtaaaatggaaggtcgaatacatcaaaaccgaagccatcgtctgcgtagaactcacttcccaagaaagacagtgctccctcatcgaagccggcacccgcttcaacctaggacccgtcacaataaccctatccgaacctcgcaatatccaacaaaaactcccacccgaaatcgtaaccctacacccccgcatcgaggaaggcttcttcgacctcatgcacgtccaaaaagtcctttccgcctccaccgtatgcaaactccaatcctgcacccacggcgtccccggggacctccaagtctaccacatcggcaacctacttaaaggagacaaggtcaacggccacctcatccacaaagtggaaccacacttcaacacatcatggatgtcctgggacggatgcgacctcgactactactgcaacatgggagactggccctcctgcacatacacaggcgtcacccaacacaaccacgccgcctttgtcaacctcctaaacatcgaaacagactacaccaaaaacttccacttccacagcaaacgagtcaccgcccacggcgacacaccccaattagacctgaaagcacgccctaactacggagccggagaaatcacggtccttgtcgaagtcgccgacatggaactacacacaaagaaaatcgaaatatcaggcctcaaattcgcctcccttacctgcaccggctgctatgcatgctcaagcggaatctcctgcaaagtccgaatccacgttgacgaacccgacgaactcaccgtccacgtcaaaagcgaagatccagacatagtggcagccagcagttcactcatggcccgaaaactcgaatttggcacggactcaacattcaaagcattctccgccatgcccaaaacatcgctctgcttctatatcgtagaacgagagtactgcaaatcctgcagcaaagaagacactcagaaatgtgtcaacgcaaagctagagcggccgcagtcaatcctaatagaacacaagggcacaatcatcggcaaacaaaacgacacatgcactgccaaagcctcctgttggctagagagcgtaaaatccttcttctacggccttaagaacatgctatcgggcatcttcggaaacgtattcatcggcatattcctattcctcgccccgtttatcctactcatactcttcttcatgttcggatggcgaatcctattttgcttcaaatgctgccgccgtacccgcgggcttttcaagtaccgccacctaaaagacgacgaagaaaccggatacagaaaaatcatcgaacgcctcaacaacaagaaaggcaaaaacaagctcctagacggcgaacgcctcgccgaccggaaaatcgcagaactattcagcacaaaaacccacatcggc

SEQ ID NO: 15774 - RNA, 1932 nt, synthetic construct
  misc_feature 1..1932: note = derived and/or modified CDS sequence (opt11) from CCHFV(UCCR4405)__KY484029.1__Gc
  source 1..1932: mol_type = other RNA
ttcctcgactccactgtcaaaggaatgaaaaacctacttaactccacttccctcgaaacaagcctatccatcgaagccccctggggcgcaatcaacgtccaaagcaccttcaaacccacagtatccaccgccaacatcgccctctcctggtcctccgtcgaacaccgaggaaacaaaatcctggtaaccgggcgaagtgaatcaatcatgaaactcgaggaacgaaccggagtcagttgggacctcggtgtcgaagacgcctccgaaagcaagctactaaccgtcagtatcatggacctctcccagatgtactcaccagtattcgaatacctatccggcgaccgacaagtcgaagagtggcccaaagcaacctgcaccggagactgcccagaacgctgcggatgcacctcaagcacatgcctacacaaagaatggccacacagccgcaactggcgctgcaacccaacctggtgctggggcgtcggcaccggctgtacctgctgcggcgtcgacgtcaaagatctcttcaccgaccatatgttcgtcaaatggaaagtagaatacatcaaaaccgaagccattgtctgcgtcgagctcacctctcaagaacgacagtgcagcctcatagaagcaggcacccgtttcaacctcggacccgtcaccatcacactctcagaaccccgtaacatacaacaaaaactaccacccgaaatcatcaccctccaccccaagatcgaagaaggtttcttcgacctcatgcacgtacagaaagtgctctccgcgagcaccgtctgcaaactccagtcctgcacccatggcatacccggcgacctacaaatataccacatcggcaacctcctcaaaggggaccgtgtcaatggccacctcatccacaaaatagaaccccatttcaacacctcctggatgtcttgggacggctgtgaccttgattactactgcaacatgggcaactggccaagctgcacttacaccggagtcacccaacacaaccacgccgccttcgttaacctcctcaacatcgaaaccgactacactaaaaccttccacttccactcaaaacgcgttaccgctcacggcgataccccacaactcgatctcaaagcccgcccaacctacggagccggagagatcaccgtcctagtcgaagtcgccgacatggaactccacaccaagaaggtcgagatatctggcctcaagttcgcatcgctagtctgcaccggctgttacgcatgctcaagcggaatatcatgcaaagtccgcattcacgtcgatgaacccgacgaactcaccgtccacgtaaaatcctccgatcccgacgtcgttgcagcctccacctccctaatggctcggaaactggagttcggcaccgactctattttcaaagcattctcagccatgccgaaaacctcgctctgcttctacatagtcgaacgagaatactgcaagagttgctccgaagacgacacaaagaaatgcgtcgacactaaacttgaacaaccgcaaagcatattaatagaacacaaaggcaccataatcggaaaacagaacgacacatgcaccgccaaagccagctgctggctagaatccgtcaaatccttcttctacggcctgaaaaacatgctaggctcagtcttcggaaactttttcgtcggaatcctactctttctcgccccattcgtacttctcgtcctcttcttcatgtttggctggaaaatcctcttttgcttcaaatgctgcagaagaacccgcggcctcttcaagtaccgacacttaaaagacgacgaagaaacaggctaccgccgcatcatcgaacgactcaactccaaaaagggcaaaaaccgcctcctcgacggcgaacgactcgcggaccgcaaaatagccgaactattctccacaaaaacacacatcggc

SEQ ID NO: 15775 - RNA, 1932 nt, synthetic construct
  misc_feature 1..1932: note = derived and/or modified CDS sequence (opt11) from CCHFV(UCCR4401)__KY484035.1__Gc
  source 1..1932: mol_type = other RNA
ttcctcgacagcaccgccaaaggcatgaaaaaccttctaaactccaccagcctagaaacatcgctttcgatcgaagccccatggggagccatcaacgtccagtcaacctacaaacccactgtatctaccgcaaacatcgctctctcatggtcaagcgtagaacacagagggaacaaaatcctagtctcagggaggtccgaaagcatcatgaaacttgaagaacgcacgggcatctcatgggacctaggcgtcgaagacgcgtctgagtccaaactcctaaccgtatccgtcatggacctctcgcaaatgtactcccccgttttcgaatatctaagcggggaccgccaagtagaggaatggccgaaagcaacctgcacgggcgactgcccggaacgctgcggctgcacaagctccacgtgcctacataaagaatggccccacagccgcaactggcgctgcaacccgacgtggtgctggggcgttggcacaggctgtacctgctgcggactcgatgtcaaagacctattcaccgactacatgttcgtcaaatggaaagtcgaatacatcaaaaccgaggcgatcgtatgcgtagaactcacctcccaagaacgacagtgctcgcttatcgaagccggaacgcgcttcaacctcggtccggtaacaatcacgctaagcgaaccgcgaaacatccagcaaaagctcccacccgaaatcataactctccaccccagaatcgaagagggcttcttcgacctcatgcacgtgcaaaaagtactatccgcatcgacggtatgcaaacttcaatcctgcacacacggcgtcccaggtgacctccaagtctatcacatcggcaacctacttaaaggcgacaaggtcaatggccacctaatccacaaaatcgagccccacttcaacaccagctggatgtcctgggacggatgcgacctagactactactgcaacatgggagactggcccagctgcacctacaccggcgtaacccagcacaaccacgctagcttcgtaaacctactcaacatcgaaaccgactataccaaaaacttccacttccattcaaaacgcgtcaccgcccacggcgacacgccccaactcgacctaaaagcccgaccgacctacggcgcaggcgaaatcacagtcctagtcgaagtagccgacatggagctacacaccaagaaaatcgagatctccggtctcaaattcgcttcactcgcctgcaccggctgttacgcctgctccagcggaatttcctgcaaagtccgcattcacgttgacgaaccggacgaattaaccgtccacgtcaaaagcgacgacccagacgtcgtagcggcgtcctcatccctcatggcccgcaaactcgagttcggaactgactccaccttcaaagcgttctcggccatgccaaaaacttcactctgcttttacatcgtagaacgagaacactgcaaatcctgctccgaagaagataccaagaaatgcgtcaacaccaaactagaacaaccccaatcgatactgatcgagcacaagggcaccatcatcggcaagcaaaacagcacatgcaccgccaaagcatcctgctggctagaaagcgtaaagagcttcttctacggactcaaaaacatgctatccggcatcttcggcaacgtcttcatgggcatcttcctcttcctcgcccccttcatcctcctcatcctcttcttcatgttcggctggcgcatcctcttctgcttcaaatgctgccgacgcacccgcggcctcttcaaatatcgacacctaaaagacgacgaagagaccggctaccgacgcatcatcgagaaactaaacaacaagaaaggtaaaaacaaactactcgacggcgaacgcctagcagacagacgcatcgcagaactcttctccaccaaaacccacataggc

SEQ ID NO: 15776 - RNA, 1932 nt, synthetic construct
  misc_feature 1..1932: note = derived and/or modified CDS sequence (opt11) from CCHFV(UCCR4448)__KY484042.1__Gc
  source 1..1932: mol_type = other RNA
ttcctagacagcatagtcaagggcatgaaaaacctcctcaactccacaagcctcgaaacatcactcagcatcgaggccccatggggcgccattaacgtgcaatccacctacaaacccacagtcagcaccgccaacatcgcactctcatggtctagcgtggaacaccgaggcaacaaaatcctcgtctccggacgaagcgagagcatcatgaagctcgaggagaaaaccggcatctcatgggacctcggcgtagaagatgcatccgaaagcaagctactaaccgttagcgtaatggacctatcccaaatgtactcacccgtattcgaatacctcagcggagaccgacaagtcgaagaatggccaaaagcaacctgcaccggagactgcccagagcgctgtggctgcacctccagcacgtgcctacacaaagaatggccccacagccggaactggagatgcaaccctacctggtgctggggcgtcggaaccggctgtacctgctgcggactagacgtcaaagacctattcacggactacatgttcgtaaaatggaaagtagaatacataaaaaccgaagccatagtctgcgtcgaactcacctcacaagaacgccagtgctccctcatcgaagccggcacacggttcaacctcggcccggtcacaatcacgctctccgaaccccgaaacatccagcaaaaactaccacccgaaatcatcactctccacccccgaatcgaagaagggttcttcgacctcatgcacgtccaaaaagtactcagcgcgagcacagtctgcaagctccaaagctgcacccacggcgtacccggagatctacaagtctaccacatcggcaaccttctaaagggggacaaagttaacggacatctcatccacaagatcgaaccccactttaacacctcctggatgagttgggacggctgcgacctcgactactactgcaacatgggcgactggccctcgtgcacctacacaggcgtcacccaacacaatcacgccagcttcgtcaacctgctaaatatagaaaccgactataccaagaacttccacttccattcgaaacgcgtcaccgcacacggagacaccccacaactagacctcaaagcccgcccaacctacggcgccggcgagatcacagttcttgtcgaggtggctgacatggaactccacaccaaaaagatcgaaatatccggccttaaattcgcctccctgacctgcaccggatgctacgcttgctcaagcggcatctcatgcaaagtcagaatccacgtggacgaaccagacgaactcacggtacacgtcaaaagcgacgaccccgacgtcgtcgcggcctcatcatcactaatggccagaaaacttgagttcgggacagactcaaccttcaaagccttctcagcaatgcccaagacctccctctgcttctacatcgtagaaagagaacactgcaaaagctgcagcgaagaagacacaaagaagtgcgtaaacaccaaactcgaacaaccccagtcaatactcatcgaacacaaaggaacaatcataggcaaacaaaactcaacgtgcacagccaaggctagctgctggcttgagagcgtaaaatcattcttctacggcctcaaaaacatgctatctggcatattcggaaacgtcttcataggaatattcctattcctagcaccattcatactccttatcctattcttcatgttcggctggaaaatcctcttttgcttcaaatgctgccgacgaactcgcggcctattcaaataccgtcaccttaaggacgacgaagagacaggataccggcgcatcatcgaacgcctcaacaacaaaaagggcaagaacaaactactcgacggagaaattctcgccgacagacgtatagccgaactattcagcacaaaaacacacatcggg

SEQ ID NO: 15777 - RNA, 1932 nt, synthetic construct
  misc_feature 1..1932: note = derived and/or modified CDS sequence (opt11) from CCHFV(U2-2-002/U-6415)__AY900144.1__Gc
  source 1..1932: mol_type = other RNA
ttccaagactcaatcgtaaaaggaatgaaaaacctactaaactccacatccttagagacttcgctatccatcgaagccccttggggcgccatcaacgtacaatccacctacaaacccaccgtaagcgccgccaacatagccctctcctggtcctccgtcgaacaccgaggaaataaaatcctagtctccggccgctccgaatcaataatgaaactcgaagaaaggaccggcatctcctgggacctcggtgttgaggatgcaagcgaaagcaaacttctgacagtaagcgtcatggatctatcacaaatgtactcgccagtcttcgaatacctctccggagaccgccaagtagaagaatggccaaaagcaacctgcacaggtgactgccccgagcgatgcggctgcacctcatcaacctgcctccacaaagaatggccgcattcccgcaactggcgctgcaaccccacctggtgctggggagtcggcaccggatgtacctgctgcggcctagatgtaaaagacctcttcaccgactacatgtttgtaaagtggaaggtcgagtacatcaagaccgaagccattgtctgcgtcgaactcacctcccaagaacgacagtgctccctcatagaagccggcactagattcaacctgggacccgtaaccatcacgctctccgaaccacgcaacatccaacaaaaacttccgccagaaatcataaccctccacccacgcatcgaagaaggcttcttcgacctcatgcacgtgcaaaaagtactctccgccagcaccgtatgcaaactccaatcatgtacccacggcgttccaggagacctccaggtataccacatcggcaacctactcaaaggcgacaaagtcaacggccatctcatccacaaaatcgaaccccacttcaacacatcctggatgtcctgggacggctgcgacctagactactactgcaacatgggcgactggcccagctgtacatataccggcgtcacccaacacaaccacgcatccttcgtaaacctcctaaacatcgagacagactacaccaagagcttccacttccactccaaacgagtaaccgcacacggcgacaccccgcaacttgacttaaaagcccgcccgtcctacggcgccggcgagataaccgtcctcgtagaagtagcagacatggaactacacaccaagaaaatcgaaatctccggcctcaaattcgcaagtctaacctgcaccggctgctacgcatgctccagcggcatctcctgcaaagttcgcatccacgttgacgaacccgatgagttcacagtccacgtcaaatcggacgaccccgacgtagtcgcagcctccagctccctaatggcacgcaaactagaatttggcaccgactccactttcaaagcattctcggccatgcccaaaacatcactctgcttctatatcgtagaacgagagtactgcaaatcctgctccgaagaagacacccaaaaatgcgtcaacaccaaactcgagcaaccccaatccatcctgatcgaacacaaaggaacaatcatcggcaaacaaaacaatacctgcaccgccaaggcctcctgctggctagaatccgtaaaatccttcttctacggcctcaaaaacatgctctctggaatctttggaaacgtcttcgtcggcatattcctgttcctggccccattcatcctcctgatcctgttcttcatgttcggctggcgcatactattctgcttcaaatgctgccgacgaacccgtggattattccgctacaaacacctcgaaaacgacgaagaaacaggataccgacgtatcattgaacgactcaacaacaagaaaggcaaaaacaaactcctagacggcgagcgactagcagacagacgcatcgccgaactcttcagcacaaaaacccatatcgga

SEQ ID NO: 15778 - RNA, 1932 nt, synthetic construct
  misc_feature 1..1932: note = derived and/or modified CDS sequence (opt11) from CCHFV(SPU 45/88)__KJ682809.1__Gc
  source 1..1932: mol_type = other RNA
ttcctagactcaatagtcaaaggcaagaaaaacctcctcaactccacctccctcgagacctcactcagcatagaggctccttggggcgctataaacgtacagtccacctttaaacccaccgtctcggccgctaacatagccctctcatggtcctccgtcgaacaccgcggaaacaaaatcctcgtctccggccgctctgaatccataatgaaactagaggagcgaaccgggatctcctgggacctcggggtcgaggacgcatccgagtcaaaactactcaccgtctccgtgatggacctttcacaaatgtactccccagtattcgagtacctatcaggagaccgccaagtggaagagtggcccaaagcaacctgcaccggggactgtcccgagaggtgcggatgcacctcatccacatgcctacacaaagaatggccacatagcaggaactggcgctgtaacccaacctggtgctggggcgtcggaaccggctgcacatgctgcgggctcgacgtgaaagatctattcacagactacatgttcgtcaaatggaaagtagattacataaaaaccgaagccatagtatgcgtagaactaacatcccaagaacgccaatgttctctaatcgaagcaggcaccagattcaacctcggccccgtcaccataaccctctcggaaccccgcaacatccaacaaaaactcccacccgaaatcgtaacccttcacccccgcatcgaagaaggtttcttcgatctaatgcacgtccagaacgtactctccgcgtcaacggtctgcaaactacaatcgtgcacgcacggagtacccggcgacctacaaatctaccacataggcaacctactcaaaggcgacaaagtcaacggccacctcatccacaaaatagaacctcactttaatacctcctggatgtcctgggacggctgcgacctcgactactactgcaacatgggcgactggccctcctgctcgtacacaggcgtcacccagcacaaccacgcagccttcgtcaacatgctcaacatcgaaaccgactataccaaaaactttcacttccactcgaaaagagtcaccgctcatggcgacacaccacaactcgaccttaaagcacgtccaacctacggagccggcgagataacggtacttgtcgaagtcgccgacatggaactacacaccaagaaaatcgaaatatcaggtcttaaattcgcctccctaacatgcaccggatgctacgcctgtagcagcggaatatcgtgcaaagtccggatccacgtagacgagcccgacgagctcacggtccacgtaaaatccgaagacccagatatcgtagccgcctccagctccctcatggcccgaaaactcgagttcggcacagactccaccttcaaggcattctcagctatgcccaaaacatccctctgcttctacatcgtcgaacgggaatactgcaaaagctgctcaaaggaagacactcaaaaatgcgtcaacaccaaactcgaacaacctcaaagcatcctgatcgagcacaaaggcacaatcatcggaaaacaaaacgacacatgcaccgctaaagccagctgctggctagaaagcgtcaaatccttcttctacggcctcaaaaacatgttaagcggcatcttcggtaacgttttcataggcatcctcctcttccttgccccgttcataatgcttatcctattctttatgttcggctggcgcatactattttgcttcaaatgctgccgccgcacacgcggactcttcaaataccgccacctaaaagacgacgaagaaatcgggtaccgaaagatcatcgagcgtttaaacaacaagaaaggcaaaaacaaactcctagacggtgaacgcctagccgacagaaaaatcgccgaactcttctcaacaaaaacccacatagga

SEQ ID NO: 15779 - RNA, 1932 nt, synthetic construct
  misc_feature 1..1932: note = derived and/or modified CDS sequence (opt11) from CCHFV(SR3)__AJ538199.1__Gc
  source 1..1932: mol_type = other RNA
ttcctcgactcaatagtaaagggcatgaaaaaccttctaaactctaccagcctagaaacctccctctccatcgaagccccctggggcgccatcaacgtccaatcaacctacaaacctacggtcagcaccgccaacatagccctatcctggtcgtcagtggagcaccgaggaaacaaagtactcgtctcgggcagatccgaatccatcatgaaactagaggaacgcacaggaatctcctgggaccttggtgtcgaagacgcctccgaatcaaaactactcaccgtcagcgtgatggacctaagccaaatgtactccccagtctttgaatacctctcaggcgaccgtcaggtcgaggagtggcccaaagccacctgtaccggcgactgcccagaaagatgcggttgcacctcaagtacctgcctacacaaagaatggccccacagccgcaactggcgctgcaacccgacctggtgctggggagtaggcactggatgcacatgttgcggcctggacgttaaagacctcttcaccgactacatgttcgtcaaatggaaagtcgaatacatcaaaaccgaagccatcgtatgcgtcgaactaacatcccaagagcgccagtgcagcctaatcgaagcaggcacccgtttcaacctgggctccgtcaccataacactatccgagcccagaaacatccaacaaaaactacccccagagatcataactctacacccaaaaatagaagaaggattcttcgacctcatgcatgtacaaaaagtcctcagtgccagcaccgtttgcaaactccaaagctgcactcacggcgtccccggcgacctccaagtctaccacatcggcaacctcctcaaaggcgaccgagtcaatggccacctcatccacaaaatcgaacaacacttcaacacaagctggatgagctgggacggatgcgacttagactactactgcaacatgggagactggccatcctgcacatacacaggagtaacccaacacaaccacgccagcttcgtcaaccttctcaatatcgaaaccgattataccaaaaccttccacttccactccaaacgagtcaccgctcacggagacaccccgcaactggacctaaaagcccgccccacctacggtgccggcgagataacagtcctcgtggaggtcgccgacatggaattacacaccaagaaaatagagatatccggcctaaaattcgccggcctcacgtgcaccggctgctacgcatgctcatccggcatcagctgcaaagtccgcatccacgtcgacgaaccagacgaactcaccgtccacgtcaaatccgacgaccccgacgtagtcgcggcatcctcctcactaatggccagaaaactcgagttcggaaccgactccactttcaaagcattctcagccatgcccaaaacatccctatgcttctatatcgtagaacgcgaatactgcaaatcatgcaacaaagaagacacccaaaaatgcgtcaatacaaaactcgaacaaccgcaatcgatcctgatcgaacacaaaggaaccatcatcggcaaacaaaacaatacctgcaccgcaaaggcatcgtgctggctagaaagcgtcaaatcgttcttttacggactcaaaaacatgctcggcggaatcttcggcaacgtattcatcggtatcttcacattcctcactcccttcatactactaatactattcttcatgttcgggtggagaatactcttctgtttcaaatgctgccgccgcacccgcggtctcttcaaatacagacacctgaaagacgacgaagagacaggctaccgcaagatcatagaacgtctcaacaacaagaaaggcaaaaacagactactagacggcgaaagactggccgaccgaaaaatcgccgaactattctcaaccaagacccacatcgga

SEQ ID NO: 15780 - RNA, 4656 nt, synthetic construct
  misc_feature 1..4656: note = derived and/or modified CDS sequence (opt11) from DUGV(ArD44313)__NC_004158.1__GP
  source 1..4656: mol_type = other RNA
atgagcaagcgcgtgctaatcatcgccgtcgtcgtgtacctcgtcttcaccacccagaaccagattaccggcaaccacacgaccatcaactccagctccccctcaaccacggaggcctccagcaccccgaccgtatcccggacgccccagaccaccaccactagcacggcggtttccaccacaatcaccgccacgaccacgcccaccgccagctggaccacccagagccaatacttcaacaagaccacccagcaccactggcgcgaggaaacgatgatatcccggaaccccaccgtccttgaccgccagtcccgggccagctcggtgcgcgagctgctcaacaccaaattcctgatgctactcgggttcatcccgaagggcgaggtgaaccatctggagaacgcctgcaatcgggaaggcaagaactgcaccgagctgatcctcaaggagcgcatcgcgcggtttttcagcgaaacggagaaggagtcctgctacaatacctacctggagaagcacctccgttcagtctcccccgaggtctcgttaaccccgtaccgggtgcttggcctgagagaggacattctcctgaaagagattgaccggcgcataatccggttcgagaccgactcccagcgcgttacgtgcctgtccgcaagcctcctgaagcccgacgtgtttattcgggagcagcgcatcgatgccaagcctagtaacggtcccaagatcgtccccgttgacagcgtggcctgcatgaacctggaggcgaacgtggacgtacggtccaacaagctcgtgattcagagcctgatgactaccgtcaagatctcccttaagaactgcaaggtcgtcgtgaatagccgccaatgcattcaccaacagaccggatccggcgtcattaaggtgccaaagttcgagaaacagcagggcgggacttggtcttcctacatcgccggcgtctataccgccacgatcgacctattggacgagaacaaccagaactgcaaactcttcaccgagtgtatcgtgaagggccgggagcttgtaaaggggcagagcgagctaaagtccttcaatatcgaggtcctgctcccgcgcgtgatgaagaccagacgcaagctgctggccgtgacggacggcagcaccgaatgcaactccggcacccagctcatcgaggggaaatccatcgaggtccataaacaggacattggcgggcccggtaagaagctgaccatctgtaacggcacgagcgtgctggacgtgcccctcgacgaggggcacggctgctacaccatcaacgtcatcacctcaaagcgcgcctgccggcccaaaaactccaagctacagtgctctattgacaaagagctgaagccttgcgacagcgggaagtgtctctccatcagccagaagggcgctggacacatcaaggtgtcccgcgggaaaaccatcctgatcactgagtgcaaggagcattgccagatcccggtgccaactggcaagggtgacattatggtcgactgcagcggcgggcggcagcactatctggaggtgaatattgtggacatccactgccccaacactaagtttcttggcggcatcatgctgtacttctgccgcatgagcagccggccgaccgtcgcgttactcctgggcatatggatcggctgtgggtacattctgacgtgcatcttctcattcctcctgtaccacctgatcctcttctttgccaactgcatcaagcagtgccgcaagaagggcgagcggttaggagagatctgcgtaaagtgtgagcagcagacggtgaacctgatggaccaggagctgcacgacctcaactgtaactttaacctgtgtccctactgctgcaaccgcatgagcgacgaagggatgtccaggcatgtagggaagtgcccgaagcgcctggaacggctcaacgagatcgagctgtacctgaccaccagcgaatgcctctgcctctcggtatgctaccagctgctcatctcagtgggcatcttcctgaaaaggaccacctggctggtcgtgctcctcgtgttgctcggcctagccatctcgccagtccagggggcccctacagaagtgagcaacgtgaagcaggacggcgactactccatctgctacttcatattcgggtgcctggtaaccgcggctctcctgctgaaggtgaaacggacgaactccaacggcatagtggtggtcgtggattccttcggccgctgcccctactgtaacgagttcacagatagcctcttcgaggaggtcctgcacgacaccctgtgctcactctgcgtgtgcccattctgcgaaaaacaggccctggacttggtgacccttgaggaacacgtcaaggagtgctacaaggtagccactcggaaggacatcttcaagatccttgggcgcaagtttaccaatgccttggtgcggcgcgagaagctgttcacgaccggtttgcaactgttcatcaataagacgaacgttgtggtgttcgcgctcatcatgtgcttcctgctgctgctaaccgggcataatgcctccgcgttcgatagcggcgacctgcccgacggggtttgggaggagtccagccagctcgtgaagagttgcacccagttctgttatatcgaggaagacgtgtgctactgcccggccgaggacggcgtcggccgtaagctcctgttcttcaacgggctccaaaactcggtaaagcggctctccgacagccacaagctgctcacatccgtgagcatcgacgccccatggggccgcatcaacgtagagtccacgtggaagcccaccctggcggctagcaacatcgccatgtcctggagctccaccgacatcaagggggagaaagtgatcctgtccggccggtctaccagcatcatcaagctcaaggaaaagacaggggtgatgtggaagctggtcggctcaggcctagccagcgagaagaagaagccattccgattccccattatggacttcgcacaggtgtacaacagcgtctttcagtacatcacgggggaccggctactgtccgagtggcccaaagcggtctgcaccggcgactgcccccaccgctgcgggtgccagaccagcacgtgcatggccaaggaatgccatacccaggagtgtgtgagtacccacatggtcctgggcatcgggaccggctgcacttgctgcggcatggacgtggagaggccgttcaacaagtacctcggtgtgaagtggagcaccgagtatctgcgcaccgaggtcctggtttgcgtggaggtaaccgaggaggagcggcactgcgaaatcgtggaggccggcacacgcttcaacatcgggcccatcacgatcaccatctccgacccccagaacatcggcagcaagctaccggagtcactaatgaccgtgcaagagatcgacgacagcaacttcgtcgatatcatgcacgtgggtaacgtgatctccgctgataacagctgccggctgcagtcctgcacccacggttctgcagtcaccacccgcttcaccgccctcaccgcccttatcaaggacgaccactcctccggtctcaacctcgccgtactagacccgaaggtgaactccagctggctgtcgtgggaggggtgcgacatggactactactgcaacgtcggcgactggccgacgtgtacctacactggggtggtcacacagaagctacgggagtttctcaagctggaccagcaccgaaagcgcctccacactacactgtcattctccctgaagaagaatctcagcaagcgcagccacacctccgtccggctggaaggcaagactgtgacgcgcatggaggtgaaggtcaccgccctgatcgaagttgacggcatggagctccacagcaaaaccatccggctgtccgggatccgcctcaccggtctcaagtgcagcgggtgcttttcctgcacgagcggcatctcctgctcggtgaacgcaaaactgacatcccccgacgagttcaccctgcacctcagatcaacctcccccaacgtcgttgtggctgagacgtcgatcatcgcccgcaaggggccgtccgccaccaccagccgcttcaaggttttctcagtccgggacaccaagaagatatgcttcgaggtggtcgagcgcgagtactgtaaggactgcacgcccgacgagctgactacttgtaccggggtggagctggagcccaccaaagacatcctgctggagcatcgggggaccatcgtgcagcaccagaacgatacttgtaagagcaaaatagactgctggtccaacagcatcagcagcttcgccagcgggatcggcgacttcttcaagcattatatcgggagtatcgcggtcggcgtgcttgggacagtgctccccttcgctctgctgattctcttcttcatctatggtgacaagatgctgtggccgtttaaggtcttctgcaggccttgccggcgctgctgccgcaagaacgaaggctacaataagctggccgaggaggaagaactgcgcgacatcatccggaagttcagcaagtccggggagctcatcaacaaggacgccaaagacaagcgcaccctggcgcgtctgttcatgagcgacaaccctaagctcaaaaaggagaagaagctgtccgagatcgcctaa

SEQ ID NO: 15781 - RNA, 4656 nt, synthetic construct
  misc_feature 1..4656: note = derived and/or modified CDS sequence (opt11) from DUGV(IbAr1792)__KU925456.1__GP
  source 1..4656: mol_type = other RNA
atgagcaagcgggtgctaatcatcgccgtcgtggtgtgcctcgtcttcacgacccagaaccagatcgccggcaaccataccaccgcgaactccgggagcccctccaccaaggaggccagctccatgccgaccgtgagcgacacgcctcagaccaccaccacgtccaccgcggtgagcaccaccatcacggccaccaccacccccacggcctcctggaccacccagagccagtacttcaacaagacgacgcagcaccactggcgggaggagaccatggtctcccgcaaccccaccgtgctgaaccggcagcgccgggcgagctccgtgaaggagctgctcaacaccaagttcctgatgctgctcggcttcatcccgaagggggaagtcaaccacctggagaacgcctgcaaccgcgagggtaagaactgcacggagctgatcttaaaggagcggatcgcccgcttcttcagcgagaccgagaaggagtcctgctacaacacctacctggagaagcacctgtgcagcgtgtcccccgaggtgagcctcaccccctaccgggtcctggggctgcgcgaggacattttactgaagaagatcgaccggcgcatcatccggttcgaggccgactcccagcgcgtgacgtgcctgagcgcgagcctcctgaagcccgacgtgttcatccgggagcagcgcatcgacgccaagccgagcaacggccccaagatcgttcccgtggacagcgtgcggtgcatcaacctggaggccaacgtcgacgtgcgctccaacaagctcgtgatccagagcctgatgaccaccgtcaagatctccctgaagaactgtaaggtggtggtcaacagccggcagtgcatccaccagcagaccggctccggggtgatcaaggtccccaagttcgagaagcagcagggcgggacgtggagctcctacatcgccggggtgtacaccgccaccattgacctcctggacgagaagaaccagaactgcaagctgttcaccgagtgcatcgtgaaggggcgcgagctcgtcaagggccagagcgagctgaaatccttcaacatcgaggtgctgctcccgcgggtgatgaagacgcgccgcaagctgctggcggtcaccgacggctctaccgagtgcaactccgggacccagctcatcgaaggcaagagcatcgaggtgcacaagcaggacatcgggggccccggcaagaagctgacgatctgcaacgggacgtccgtgctggacgtccccctcgacgagggccacggttgctacaccatcaacgtgatcaccagcaaacgtgcctgccgccccaagaactccaagctgcagtgcagcatcgacaaggagctgaagccgtgcgactctggcaaatgtctcagcatcagccagaagggggccggccacatcaaggtgtcccggggcaagaccatcctgatcacggagtgcaaagagcactgccagattcccgtccccacagggaagggcgacatcatggtggactgcagcgggggccgccaacactacctggaagtgaacatcgtcgacatccactgccccaacaccaagttcctcgggggcatcatgctgtacttctgcaggatgtccagccgcccgaccgtggccctgctcctgggcatctggatcgggtgcggttacattctgacgtgcatcttctccttcctcctgtaccacctgatcctgttcttcgccaactgcatcaagcagtgccggaagaagggggagcgcctcggcgagatctgcgttaagtgtgaacagcagaccgtcaacctgatggaccaggagctgcacgacctcaactgcaacttcaacctgtgcccctactgctgcaaccggatgagcgacgaggggatgtccaggcacgtgggcaagtgccccaagcggctggagcgcctcaacgagatcgagctgtacctgaactacaagcgggtgcccagctgcctccgctgcatgttatccaccagcatctccgtcggcatcttcctgaagagaaccacgtggctcgtggtgctgctggtcctcctggggctggcgatcagcccggtgcagggggcccccgccgaggtgtccaacgtcaagcaggacggggactacagcatctgctacttcatcttcggctgcctcgtgaccgccgccctgctgttaaaggtgaagcgcaccaactccaacggcatcgtcgtagtggtcgacagcttcgggcggtgcccctactgcaacgagttcaccgactccctgttcgaggaggtgctgcacgacacgctctgcagcctgtgcgtgtgccccttctgcgagaagcaggcgcttgacctcgtcaccctggaggagcacgtgaaggagtgctacaaggtgaccacccgcaaggacatcttcaagatcctgggccggaagttcacgaacgcccttgtccgccgtgagaagctgttcaccaccgggttacagctgttcatcaacaagaccaacgtggtggtcttcgccctgatcatgtgcttcctgctcctcctcacgggtcacaacgccagcgccttcgatagcggggacctcccggacggaatctgggaggagagctcccagctggtcaagagctgcacccagttctgctacatcgaggaggacgtgtgctactgccccgcggagaacggcgtggggcggaagctcctcttcttcaacggccttcagaactccgtgaagcgcttaagcgactcccacaaactcctaaccagcgtgtccatcgacgccccctggggtgcgatcaacgtcgagagcacctggaagccgacgctggccgcgtccaacatcgccatgagctggtccagcaccgacatcaagggtgagaaggtgatcctctccgggcggagcacctccatcatcaagctgaaggaaaagaccggcgtgatgtgggagctgggtagcgagctcgcctccgagaagaagaagctgctggtcagcatcatggacttcgcccaggtgtacaacagcgtcttccagtacattactggggaccgcctcctgtccgagtggcccaaggccgtgtgcaccggcgactgcccccaccggtgtgggtgccagaccagcacgtgcatggcgaaggagtggccccacacccgcaactggcggtgcaacccaacctggtgctggggcatcgggaccggctgtacgtgctgcggcatggacgtggagcgccccttcaacaagtaccttggggtcaagtggtccaccgagtacctccggaccgaggtgctggtgtgcgtcgaggtgaccgacgaggagaggcactgcgagatcgtggaggccggcaccagattcaacatcgggccaattaccatcacgatcagcgacccgcagaacatcggctccaagctgccggagagcctcatgaccgtccaggaaatcgacgactccaatttcgtggacatcatgcacgtggggaacgtcattagcgccgataactcctgcagactgcagagctgcacccacggctccgccggcgactaccaaatctacagcaccgactccctgatcaaggacgaccacagctccgggctcaacctggccgtgctggaccccaaggtgaacagcagctggctcagctgggagggctgcgacatggactactactgcaacgtcggggactggcccacgtgcacctacaccggtgtggtgacccagaactccgagagcttcagcaacctgataaacatcgagaaggactacacgcagcggttccatttccactccaagcgcatcagcgcgaagggccacaccctgcagctcgacctgaaggcccggcccaaccaggacgggggcgaggtcaccgccctgatagaggtggacgggatggagctccacagtaaaactatccgcctgtccggcatccggctgacggggctcaagtgctccgggtgcttcagctgcacctccggcatcagctgctccgtgaacgccaagctgaccagcccggacgagttcaccctgcacctccggtccacgagcccgaacgtcgtggtggccgagacctccataatcgcgcggaaggggcccagcgccaccaccagcaagttcaaggtcttctcggtgcgcgacaccaagaagatctgcttcgaggtggtcgagcgggagtactgcaaagactgctcccccgacgagctgacgacctgcaccggcgtggagctggagccacccaaggacatcctcctggagcaccgcgggaccatcgtgcagcaccagaacgacacgtgcaagagcaaaatcgactgctggtccaacagcatcagctccttcgccagcggcatcggggacttcttcaagcactacatcggctccatcgccgtcggcattctggggaccgtgctccccttcgcgctgctgatcctcttcttcatctacggcgataagatgctgtggcccttcaaggtgttttgccgcccgtgtcgccgctgctgccggaagaacgaggggtacaacaagctggccgaggaggaggagctccgcgacatcatacggaagttcagcaaatccggcgagctgatcaacaaggacgccaaggacaagcgcaccctggcccgcctcttcatgagcgacaaccccaagctgaagaaggagaagaaactttccgagatcgcctaa

SEQ ID NO: 15782 - RNA, 4884 nt, synthetic construct
  misc_feature 1..4884: note = derived and/or modified CDS sequence (opt11) from NSDV(Jilin)__NC_034391.1__GP
  source 1..4884: mol_type = other RNA
atggttagcttggagaagggcctcatcctgttgctcctgatgcacatcgccatcgcctccaccgggggctctcttgggctccccggcctgaacggggaggaccacaccgacgacccggaggtcggcggcgacggccccacggaggagtacaccgaggacgaccccgaatccactacggtgtcgatccccacgaccccgccagtgctgggccaggggactgaagaggtccccgcaacatcgggcgaggccgaggcggggtatagcacgaccgacgtgcccgacaccgtgtccgagaaagtcgaggacgagcaggacaccacgccgagcacccaggtaacccccgaccagcccgagcagtccactacgagtctgcccgacccgtggaccgccatctccacccgcataggccgggagctgctgagcgtggagtccgacaccaccaagagctccctcgtcaccgtgggccacccccagcaacccatcttcctggacgggcagcccgtggaggaagtaacccaccccgtgaacgaacgcgacgtgaccgaggcgctgcggaagtatgacaagatgaagaagctcctgagccagcgcatcctgtccaagatgggcatggcgcgggacttcacggacgaggagctcgacgtctggtgtcacgagcggttcgacaactgcagctccaacgacatcgagaatcggatacgcgacttcttcctaatatcagaccagaccgagtgcttcgacgaggtgctggtgaaacggctctgtgaatctaccaaccccatcgtcggtgagccctggcaggttgccggcatcaaggaggagatcgtacgccgtgagatgggccgccgaatcttccgcttctttacccccacgctgaaagtgacctgcgtgtccgggtccctgaacccgtccgaccagttcgtgagattctacgaccctgtcatcgagcgcaccagcggccccaccatccagaactatgactccatgcactgcctcaacatcgagaacgggctggccaagcccagcaagatggtggtcttaaacgtgctcatgactacagtggaggtccggttggagtcctgccgcgccttcatcaacgctcaccagtgcatctacactcagcacgccgacggccaggtgatggtgccgacattcgtcgaccactccgggacgcgccgcaccattggggcctacaccatgagcttcaacctcaccgacgagcggaatcgcgcctgcatcatacgtacgacctgcgtggtgaaaggcaaggaggtcaaaaaggggcagagccaactccggggattccccacctccattcgcctgttcaagagcgtgaccgggaagaggcggctgatggccgaagagggcgactggaccgactgcgggtccggaacccagctggacatgaccatggccgtgagcgtccacaacgacaagaagggcgggcccggcaagaaactgaccatctgtaacgggaccacggtgtccgatagcaccctgaacgagggcctcgggtgctacaccatcaacaaggtgatcaccgggaaggcttgcaaggtcggcaattccacggggtcctgcgaggtgcaaaccgagttgcagaagtgcgagaccggaaagtgcatcctggtgaagcagaagtccaagggcgtcgtgaagttaaagcggggaaagaccgtgatcatcacggagtgccagggcagttgcctgttcgccatcccccaggacactggggacatcactatcgactgcagtggcgggcgccagcactatctggaaatcaacatcgtcgacattcactgccctggcaaggacaagtggaaggggttcatgctctacatctgccgggtttcctcacgccccctgatcgccctgaccttcggcctctggctggccgcgggttacctcataacatgcctcgtgtccttcatcatctataacgccgtcctgctgctgagcatcgccatcaagaaagtgaggcaggggcgcgagaaaaagggcgacctctgcatcaagtgcgagcagcactgcatgaacctgtacgaccaggaactgcacgagctcaactgctccttcaacctgtgcccatactgcgccaaccggctgtcggacgaggggctccctcgtcacgtgccccggtgccccaaaaagtccgaacgcctggaagagatcgagctatacattaactatacccgcgtgccctgcatcttgcgctggatcctgagcacatccgtccaggtgggcaccgccgtgaagcggctcagctggttctccgtgctcgtgacgctgttcattctcaccatcagcccggtccaagggttccccctcgagtcgccgccaatcggggcggccaccgacagtcgcatcatgtacggcgttgtagggttcatgttcgcgctgatcatgatgctgaacctcaaaaagtcccactacggcagcatcttccacgtcatcgacgggttcggccggtgtaacctgtgcgacacccgcatcgattccctgatggaggagacggcgcacgacctctgctgtatgttcgactgctgcccctactgccaccgtgtgagcgagagcaacggttcccactgcttccacgtgcggatctgcgtcgcgaaggagatcagcaaaaagatgctgaaggcgggcggccgcctgttcaccaacaagctcgtgtcccgggaggggaccttcgccaaccgtatccagctgctgtaccggcgcagcaaggtggtctccaccctcgtggtgacggtcctgctgctcctggtgctgctcaagcccaccaccgccttcgacagcggccccctgcccgatgggacctgggaggaggaggagaagctggtgcggaactgtgggcaggagtgcatactcgaccagggagagtgcctgtgcccgggcgagcacagagcaggccggaaactgctgttcctgaacgggctgcaggacgcggcccgccgtatgacggagtcccaccgcctcctgaccagcgtctccatcgacgccccttggggcgccatcaacattgagtccacattcaagccggtgcttgccgcgtccaacatcgacctcagctggaactccgccgaggagcagggggacaaaatcatcctaagcggccgatccaccgggatcatcaagctccaggaacgaaccgggctcatgtggaagatgagctccgagaaggccagcgagtccaagaacttactggtgagcgtcatggacttcagccagctctacaattccatcttccagtatatcacgggtgaccggagcctgtccgagtggcccaaggccgtgtgcaccggggactgcccggaccgctgcggctgtcagaccagcacgtgttaccacaaggagtggcctcacacgaggaactggcgctgcaaccccacctggtgctgggggatcggaaccggctgcacgtgctgcgggatggacgtagaacggtacttcaacaagtacttcggcgtcaagtgggccctggagtacgtacgcaccgacgtcgtggtgtgcgtcgagttgaccaacgaggagcggcactgcgatctggtgcaggcggggtctcgcttcagcatcggcccggtttccgtcacgctaagcgacccgcaaaacgtggtaaaccgcctctccagcaatataatgaccatccaggagatcgccgacaacgggatcctggacttgatgcacgtatccaaggtgattagcgccgagaacgcctgcaagctccagtcctgcacgcacggcagccccggcgacctgcaaatcttacacaccgacaacctcatcaagggcgatatgtccggcgggatcaacctggcccacttagacccccaggtaaacaccagctggatgtcctgggaaggctgcgacctcgactactactgcaccgtgggcgactggccctcttgcacgtacaccggcgtaaactcgattaacaccgacagcttcaccaacctgattaacaccgagaccgactacaccggcaagttccacttccacagcaagcgtatctccgcgcgcgacgacaccctgcagatggacctcaaggcccggcccaatagcgggggcggtgaaatgacggtgctggtggaggtgaacggtctggagctccactcgaagcgtatcagcctgaagggcctgcggctcactaacctgaagtgtgacggttgcttcgcatgctcccagggcctgacctgtacaatcacggccaagctcgagagccccgacgagttcaccatccacctccgctccaccagccgggacgtggtcgtggcggagacatctgtaacggctcgcaaggtcgagacgggggcacgaagcggcttccgcgcgttcgcagtgcgggacgtgaagaagctgtgcctcgaggtcgtagagaaggattactgcccttcctgcaccgtggaggacctaaaaatttgcgtcgatgtgtctctggagccgcccaaggacatcctcatcgagcacaaggggaccatcatccagcactacaacaagtcctgcgacgaggggtacaactgctgggtgggcagcgtctccggattctttgtcggcgtgaaggacttcttcgagaagaacctagggggcgtcctgatcggtctggtgagcacgattctgcccctggtcctgacggtcctgttctttatctacggcaagaagctgttctgcctctgtcgcctatgccacaagaagtgttgccgcgggtccgggcgcggccgggatggatatagcagattgtcccaggaggaagaaatcaaggagatcatcaagaagttcagccgcaacggcgaactgctcgggaagggcgagaacgacaagcgcaccgtcgcgcgcatgttcatggacggccagagcaccaagaaggccatcaaggaggtggcttga

SEQ ID NO: 15783 - RNA, 4884 nt, synthetic construct
  misc_feature 1..4884: note = derived and/or modified CDS sequence (opt11) from NSDV(708)__EU697952.1__GP
  source 1..4884: mol_type = other RNA
atggtgtcgctggaaaagggattctttttcctcctgctgctgcacatagtcaccgcctccaccgggggcccgcccgggctgcccggccccaacgggaaagaccaaacggacggaccagagggaggtggggacggacccaccgaggagtacaccgaggatgacttcgagagcacgacgttctccatccccacgaccccgcccgtgagcgagcaggatgccaaagaggtgtccgcgaccagcgaggaggccgaagtcgaggacagcacgctgattgtgcccaagaccatgagcgagaaggtcggggacgagcagtccaccaccagcaatatgcaggttacgacctcacagcccgaacagagcaccaccgggatgccgggcccctggatggcaagttccattaagatcggccgcgagctcctttccgtggagtcggacacgaccaagtcgagcctggtgacggtcgggtacccgcagcagccgatcttcctcgacggccagcccgtggaggaggtgacccacccagtgtccgagcgggacgtggccgaggccctgcgcaaatacgacaaaatgaagaagctcctcagccagaggatcctgagcaaaatggggatggcgcgcgacttcacggacgacgaactagatgcctggtgtcacgagcggttcgacaactgctcctccaacgacatcgagaaccgaatcaaagacttcttcctcatctccgaccagaccgagtgcttcgacgaggtcctagtcaagcggctgtgcgagtccaccaatccgatcatcggcgaaccctggcaagtcgcgggcataaaagaggaagtcgtgcgcagggagatggggcgccggatcttccgcttcttcacccccacgttgaaggtgacctgcgtatccgggagcttaaacccctccgaccagttcgttcggttctataacccggtgatcgaacgcacgagcgggcctaccatccagaactatgactctatgcactgcctaaacatcgagaacggcctcatcaagcccagcaaggtggtaatcctgaacgtgttaatgacgacagtcgaggtgcgactcgagtcctgccgtgccttcgtgaacgcgcatcagtgcatctacacgcagcacgccgacgggcaggtccgggtgcccaccttcgtggaccacagcggcaccaagcgcaccatcggtgcctacaccatgtccttcaatctgaccgacgagcgtaataaagcctgcataatccgcacgacgtgcgtagtgaagggtaaggaagtgaagaagggccagagccagctgcggggtttcccgacctcaatccgcctcttcaagagcgtgacaggcaagcgccgcctgatggcagaagagggggactggacagactgcggctccggtacgcagctggacatgaccaccgcggtgagcgtgcacaacgatcgcaagggcgggcccgggaaaaagttaaccatctgcaacggcacgaccgtctccgacagcaccttgaacgaggggctgggctgctacacaatcaataaggtgatgaccggcaaagcctgcaaggtggggaacagcaccggctcctgtgaggtccagcccgaattacagaaatgcgagacgggaaagtgcatcctggtgaagcagaagaataagggcgtggtcaaactgaaaaggggcaaaaccgtgataatcacggagtgtcagggtagctgcctcttcgctatcccccaagacactggcgacatcacaatcgactgctcagggggccgccaacattaccttgaggtgaacatcgtcgatatccactgtccgggaaaggacaagtggaaaggctttatgctgtatatgtgccgtgtgtcaagccgacccctcatcgctctgacattcggcctatggctcgccgcggggtacctgatcacgtgtctggtttcattcatcatatacaacgccgtcctgctgctctccatcgccatcaagaaggtgagacagggccgcgagcggaagggggacctctgtattaagtgcgaacagcactgcatgaacttatatgaccaggagcttcatgagctgaattgctctttcaacctgtgcccctactgcgccaaccgcctgtccgacgagggcctgcctcggcacgtgccacgctgccccaagaaaacggaacggctcgaggagattgagctgtacataaactacacccgcgttccctgcatcctgcggtggatcctctctacatccgtccaggtggggactgctgtcaagcgcctgtcgtggttctccgtgttagtgatcctgtttgtcctgaccatcagcccggtacagggcttccccctggagaacacccccatcggctccaccacggacagcagaatcatctacggggtggtaggcttcatcttcgctctcatcatgatgctgaacctcaaaaagagccactacgggagcatcttccacgtgatcgacgggtttggtcgctgcaacctctgcgacaccaggatagacagcctgatggaggagactgcacatgacctgtgctgcatctttgactgctgcccctactgccaccgcgtgtcggagagcaacggctcccattgcttccacgtgcgcatgtgcgtcgccaaggagatcagcaaaaagatgctcaaggccgccgggaggttattcacgaacaaactggtgtcccgcgaggggattttcgcgaaccgggtccagctcctttaccgccggagcaaggtggtgtccacgttcgtcgtgaccgttctgcttctgctggtcttcctgcgcccggccaccgcgttcgatagcggcccactgccggacgggacatgggaggaggaggaacgtctggtgcgaaactgcggccaggagtgcgttcttgaccaggacgagtgcctgtgcccgggggagaacagagccggccgcagactgctgttcctgaacggcctacaggacgcggtccgtagaatgacggagtcccatcgcctccttaccagcgtgtcaatcgacgccccgtggggcgctatcaacatcgagtctaccttcaagccggtgctggccgcctccaacatcgacctctcttggaactccgcggaggaacaaggagataagatcatcctgagcggtcgatccaccggcataatcaagctgcaggaacgcaccggactcatgtggcggatgagctccgagaaggcgagcgagtccaagaacctgctggtgtccgtcatggactttagccagctctacaactccatcttccagtacatcaccggggaccgcagcctaagcgagtggcccaaggcggtttgcaccggcgattgccccgaccggtgcgggtgccagacctcgacctgctaccacaaggaatggccacacacacgtaactggcggtgcaaccccacctggtgttggggtatcgggaccggctgcacgtgttgcggcatggacgtagagaagtacttcaacaagtatttcggggtgaagtgggccctggagtatgtccgcaccgacgtggtggtctgcgtggagctcaccaacgaggaacgccactgcgacctggttcaagcaggcagccggttcagcatcgggcccgtctcagtgaccctgtcggacccccagaatgtggtcaaccgcctctcctcaaacatcatgaccatccaggagatcgcggacaacggcattctggacctaatgcacgtgtccaaggtgatcagcgccgagaacgcctgcaagctccagtcgtgtacgcacgggagcccgggcgacctgcagatactgcacaccgacaacctcatcaagggcgacatgtccggaggcatcaacctagcccacctggaccctcaagtcaacaccagctggatgtcctgggaggggtgcgacctcgactactactgcaccgtgggcgactggcccagctgcacgtacaccggggtgaacagcattaacaccgattcgtttaccaacctgattaacacggagaccgactacaccagcaagttccacttccactccaagcggatcagcgctagagatgacaccctgcaaatggacctcaaggcacggccaaacaccggcggcggggagatgactgtcctggtggaggtaaacggcctggagctccactccaagcgcatcaatctgaagggactgcggctcaccaatctcaaatgcgacggttgcttcgcttgctcacagggcctgacatgtacggtgatcgccaagctcgtttccccggacgagttcaccatccacctacgcagcaccagccgggacgtggtggtggccgagaccagcatcacggcgcgcaaggtggataccggagcccggagtagcttccgcgccttcgccgttcgggacgtgaagaaactgtgcctcgaggttgtcgagaaggactactgtccatcctgcacagtggacgatctgaaaatgtgtgtggacgtcagcctggagccgcccaaagacatcctcatcgagcacaagggaaccatcattcagcactacaacaagtcctgcgacgaagggtacaactgctgggtgggcagcgtgtccgggttcttcgttggcgtgaaggactttttcgagaagaatctgggaggggtgctgataggcctcgtcgggacaatcctgcccctggttctaaccatcctgttcttcatctacggcaagaagctgttctacctctgtcgcctgtgccacaagaaatgctgcaaggggagcggccggggccgcgacgggtacagccggatttcccgcgaggaggagatcaaggagatcatcaaaaagttcagccggaacggcgaactgttggggaagggtgagaacgacaagcgcacggtggctcgaatgttcatggacggtcagtccaccaagaaggcgatcaaggaggtcgcctag

SEQ ID NO: 15784 - RNA, 4875 nt, synthetic construct
  misc_feature 1..4875: note = derived and/or modified CDS sequence (opt11) from NSDV(779)__HQ286599.1__GP
  source 1..4875: mol_type = other RNA
atggccctggtggccaaaggactcatccttatgctgctcttgtacatgttcaaggcgagcgaggtcaacctggagctcccctcctggaacagcaccgaggggaccgagtacgccgacgagctgccgacggagccgccctcggaggaggagcccaagctagccgctgtgagcacagtgaccaccccggccccgcccaaggagtccacggaggacaccatagagagccccgacggcggggagaccatggcgcccaccacgcccgcccccgtcaccgactccgccagcaagctcgaggaggagcccgggaccacccagcaggcccaatccacgcagatgcagaacagccaggcgccgatcgggatgcccgaggcctggtccaccagcccctcccgcgtgggccgcaagcccctgagcgcctccccggacgtgagcgagcccgaccagaacaccgaggcccagacccacccgcccgtcttcctggacggccgccccgtggaggaggaggagcactccgtggggacgcgggacgtcgccagcgacctccgcgagtacaaccagatgaagcagctgctgtcccagcggatcctcgcgaaaatgggcatggccgttgacttcaccgacgacgagttagacacctggtgctaccgccggtacagcaactgcagctccaacgacatcgaaagccgcatccgggacttcttcctgatcaccgaccgttccgagtgcttcgacgaggtgctcgtcaagcggctgtgcgagacgaccagccccatcatcgaccgcgcctggaagatcgccgggctgaaggaggaggtggtgctgcgggagatgggccgccggatcttccgcttcttcacccccgctctgaaggtgacctgcatgtccgggagcctgaacccctccaaccagttcgtgcggttctacaacccgacgctcgagcgcaccagcggccccaccatccagaactacgacggcatgcactgcctgaacatcgagaacgggctgatcaagccgtccaaggtggtcgtgatcaacgtgctcatgaccacggtcgacatccggttagagagctgtcgcgcgttcatcaacgcccagcagtgcacctacacacagcacgccgacggcctggtgcgggtgcccaccttcgtcgggccgcacggggagaagcgcatcatcggcgcctacacgatgtccttcaacctcaccgacgagaagaacaaggcctgcaccatcaagaccacgtgcgtggtcaagggtaaggaggtgaaaaagggccagagccagctgcgcgggttccccaccaccatccggctgttcaagtccgtgaccggcaagcgccggttgatgagcaacgaggaggagtggaccgagtgcgggtccggcacgcagctgaacatggcgaccgccgtcagcgtgcataacgacaagctgggcgggcccggcaagaagctcactatctgcaacgggaccacggtgtccgacatcgccttaaatgagggcctggggtgctacacaatcaacaagatcatcaccggcaaggtctgcaagaccggcaacacgaccgggagctgcgaggtgcagccggagctccagaagtgcgagaccggcaagtgcatcctgatcaagcagaagaacaagggggtggtcaagctgaagcgcggcaagaccgtgatcatcacggagtgccaggggtcctgcctcttcgccatcccccaggacaccggcgacatcaccatcgactgcagcggcgggcggcagcactacctggagatcaacatcgtggacatccactgccccggcaaggacaagtggaaggggttcatgctgtacatctgccgcgtcagctcccggcccctcgtggccctgaccttcggcatctggctgacggcgggctacctcatcacgtgcctcgccagcttcatcctgtacaatgccatcctgctcatctccatcgctatcaagaagctgaagcagaagcgcgagaagaagggggacctgtgcatcaagtgcgagcagcactgcatgaacctctacgaccaggagctgcacgagctgaactgtagctttaacctctgcccgtactgcgcaaacaggctatccgacgacggcctgccacgccacgtgccccggtgccccaagcgcggggagcggctcgaggagatcgagctgtacattaactacacccgcgtcccgtgcttgttacggtgggccctgagcacttccgtccaggtgggcaccgtcatcaagcgcctgagctggttcggggtgctcctaaccctgttcttcctcaccatctcccccgtgcagggcttccccctggagaacccgcccatcggcaccgccacggacagcaacatcatctacgggctggccggcttcatcttcgccctcgtcctgatgctgaacctcaagaagacccactacgggtccgtgttccacgtgatcgatggcctggggctgtgcagcctctgcgacacccggatcgactccctgatggaggagaccgcgcacgagctgtgctgcgccttcgactgctgcccctactgtcaccaggtcagcgagtccaacggcagccactgcttccacatgcgcatctgcgtgtccaaggagatcagcaagaagatgctcaaggccgccggcaagctgttcacgaacaagctggtgagccgggaggggtttttcgccaacaagatacagctcctgtaccagcgctccaaggtcgtaagcaccctgatcctcacggtgctgctgctcctgatcatcctgaagcccgcagccgccttcgattcaggcccactcccggacgggacctgggaggaggaggagagcctgatccgctcctgcgaccaggagtgcgtcctggagcaggacgagtgcctctgccccggcgagcaccgggccgggcgccggctgctgttcctcagcggcctgcaggacgccgcgcgccggatgacggaatcccaccgcttgttaacctctgtgtccatcgacgccccctggggcgccatcaatatagagagcaccttcaagcccctgctggccgcgtccaacatcgacctcagctggaactccgccgaggagcagggtgacaagatcgtgctgagcgggcggtccaccgggatcatcaagctgcaggagcgcacgggcctcatgtggaagatgagctccgagaaggccagcgagtccaagaacctgttagtcagcatcatggacttctcgcagctctacaactccatcttccagtacatcaccggggaccggagcctgtccgagtggccgaaggccgtctgcaccggcgagtgccccgaccgctgcggctgccagaccagcacgtgctatcacaaggagtggccccacaccaggaactggcgctgcaaccccacctggtgctgggggatcggcaccgggtgcacgtgctgcggcatggacgtggagcggtacttcaacaagtacttcggcgtcaagtgggccctggagtacgtgcgcaccgacgtggtcgtgtgcgtggagctcaccaacgaggagcggcactgcgacctggtccaggcggggtcccgcttcagcatcggcccggtgtccgtgaccctcagcgacccccagaacgtcgtgaaccggctctccagctccataatgaccatccaggagatcagcgacaacgggatcctggacgtgatgcacgtctccaaggtgatcagcgcggagaacgcctgcaagctgcagtcctgcacgcacggcagccccggggacctccagatcttacacaccgacaacctgatcaagggcgagatgtccagcggcatcaacctcgcccacctggacccccaggtgaacacctcctggatgagctgggaggggtgcgacctggactacttctgcaccgtcggcgactggcccagttgcacgtacaccggggtgaactccatcaacaccgacagcttcaccaatctcatcaacacggagaccgactacacctccaagttccacttccacagcaagcgcatctccgcccggggagacaccctgcagatggacctgaaggcccgcccaaacgtcgggggcggcgagatgacggtgctcgtggaggtcaacgggctggagctgcacagcaagaagatctccctcaagggcctgaagctgagcaacctcaagtgctccgggtgctttgcctgcagccccggcctgtcctgcaccgtgatcgcccggctggagagccctgacgagttcaccatccacctccgctccaccagccgcgacgtggtcgtggcagagacgtccgtgaccgcccggaaggcggagaccggggccaagagctccttccgggccttcgccgtcaaggacgtgaaggagatctgcctggaggtggtcgagaaggagtactgccccagctgctccatcgaggacctgaagatctgcatcagcgtgaccctcgagccgcccaaggacatcctgatcgagcacaagggcacgatcgtgcagcactacaacaagagctgcgatgaaggctacaactgttggatcgggtccgtctcaggcttcttcgtgggggtgaaggacttcttcgagaagaacttcggctccgtcatcatcggcatcgtgagcaccgtgctgcccctcatcctgaccgtcctgttcttcgtgtacgggcggcgcctgttctgtctctgtcggctgtgccacaagaagtgttgccgcggctcctcccgggggcgcgacggctactcccggctgagccaagaggaggagatcaaggagatcatcaagaagttcaaccgcaacggggagctcctgggccggggcgagaacgacaagcgtaccgtggcgcggatgttcatggactcccagagcgcccgcaaggccgtcaaggaggtggcctga

SEQ ID NO: 15785 - RNA, 4302 nt, synthetic construct
  misc_feature 1..4302: note = derived and/or modified CDS sequence (opt11) from BUNV__NC_001926.1__GP
  source 1..4302: mol_type = other RNA
atgcgcatactgatcctcctgctggccgtgacccagctcgccgtcagctcccccgtgatcacccggtgcttccacggagggcagctgatcgcggagcgcaaatctcagacttccatcagcgagttctgcatcaaggacgacgtgtccatgctcaaatcagagatcgtctacactaaaaacgacacaggcattttcgggcactccaaggtgttccggcactggaccatcacggactggaaggcctgcaacccggtggtcaccgccggcgggagcatcaacgtgatcgaagtggacaagaaccttaacttggtcacccgcaactacgtgtgcaccggcgactgcaccatcaccgtcgatcggaagaatgcccagataatcttccagaccgacaaactgaaccacttcgaggtcaccggcacaaccatctccaccgggtggtttaagagcaaggccagcgtgaccctcgaccgcacgtgcgagcacatcaaggtgagctgcggcaagaagaccctgcagttccacgcgtgcttcaagcagcacatgtcttgcgtccggttccttcaccgcagcatcctccccgggtcgatggccatcagcatctgccagaacatcgagctgataatcatcaccatcctggcgttgtgcatcttcatcatcatgatcatcctgaccaagacgtacatctgctacgtgctgatccccgtgttcatgcccatcgcgttcgcttacggctgggcatacaaccgatcctgcaagaagtgcacgtgttgcgggcttgcctaccacccgttcaccaactgcggcagctactgcgtctgcggctcaaagttcgagaccagcgaccgcatgcggatgcaccgtgagagcgggctgtgccagggcttcaagtccctgcgcgtggcccgccggctctgcaagagcaaggggtccagcctgatcatctccattctcctcagcgtgctgatcctgtccttcgtcacacccatcgagggcaccctcacgaattaccccaccgaccagaagtacacgctggacgagatcgccgacgtgctgcaggcgaagacccacgaggacagcaccaaatattacatcatcctctacacctccctgttcggcgccgggctgacgatcatcttcgccggcgtggccctcgggctgactattatcctggaagtcctcaccaagatcaacgtgatcttctgcaacgaatgcaacatgtaccacagtaagaagtccatcaagtacgtcggcgacttcaccaacaagtgcgggttctgcacgtgcggcctgctggaggaccccgagggcgtggtggtccacaaggccaagaagtcctgcacctacagctaccaaatcaattgggtccgcgggataatgatattcgtggcgttcttgttcgtcatccagaacaccatcatcatggtggccgccgaggaggactgctggaagaacgaggagctgaaggaggactgcgtgggcccgctgatcgcccccaaggactgcaccgacaaggaccacaagacctacctcagcgaggccagtctgctggctacggccaagaagatcacccaggtcgacgccgagaacgtggagatcctagggaagaccatggagagcgccatacgggtgatcgagcgccaaaagacctaccaccgaatgcacctcctggaggccgtattcctgaataagcactgcgactactacaagatgttcgagcacaattccggctacagccaggttaagtggcgcatgatgatcaagacgcagcacttcgacatctgcgcgctgcaggcgaactccccattctgcgcgcagtgtatcgccgacaacagctgcgcgcagggaagctgggagttcgacacccacatgaactccacctacagctccaaggtggacaacttcaagcacgacttcagcctgttcctgcggatcttcgaggccgccttccccggcaccgcttacgtccacctcctgaccaacatcaaggagaagaagccctaccaggccgtgtccatgatcgagaaaatcaagaagaaattccccaacaacaagctgctcatcggctaccttgacttcgggaagtacctgctcggcctgagccacgccagtacctacgagctgcagcagcgccagctcgacaagctgtatcagcccaccgagctgacccgcagcgggggtcagcagacgtcactagccaactcagtggttgggcaggccaccaaggagtgcaagaagtacaaggacgtgtcctgcctgagtccccggttcggcatcccgttggaagacctcatctcctgctgcgaccagcccaactacaacatctacaagaagcccaaaaaggtgtacaaggcccacgacaaggaggagacctggtgtatcaacgaccagcactgcctggtcgacttcgttcccgccgaggcggataccgtggagaagttaaagccaatgaagtgctggctcgtcgaccccggcaagaacgacgacgtctacagcatcgccatcaaaacgtgcagagtggtcgacaagggggtgtgcaccgtgaacagccagaaatggaacatcatcaagtgcgacagcggcccactgtactactccgaccacatccccggggaggacacaggtaacgacatcggccactactgcgtcagcgccgggtgcaagaccgaccggtacccgatcaatcccgacgtggtgacggactgcgtctgggagttcaccagccgcaaaagtcagtacatcggcaagatcagcatgcagtccctggaggactatgagaaggccctcaccgaccggctgacccacacgctggagacatacagcttcgcgcccctcgagaacctgccccacatcaagccggtgtacaagtacatcacagctcagggggtggagaactccgatggcattgagggggccttcatcaccgccagcatccccgccgcgggcggcacgtccattgggtacaacgtccgcagcaaggatggctttcccctgctcgacctgatcgtattcgtgaagtccgccgttatcaagagcacctacaaccacatctacgacaccgggccgaccatctccatcaacacgaaacacgacgagcattgcaccggccagtgccccagcaacatcgaacacgaggccaactggctgaccttctcccaggagcgaaccagtcgctggggttgcgaggagttcggctgcctcgctgtgaacacgggctgcgtgttcggctcatgccaggacgttatccggccagagaccaaggtgtaccgcaaggccgtggacgaggtcgtgatcttgaccgtgtgcatcacttaccccggccacaccttctgcacggaaatcaacgccattgagccgaagatcaccgaggagatcgagctgcagttcaagaccgtcgacaccaagacgctcccctacatcgtggccgtgaataaccacaagctgtacagcgggcagatcaatgacctaggcaccttcggtcagatgtgcggcaacgtccaaaagaccaactccagcatcctcggcaccgggacgcctaagttcgactacacgtgtcacggcgcctcccggaaggacatcatcgtgcgccggtgctacaacaataacttcgacagctgcaagctgctgaaggaagagacccagctcatcttcaacgacgaccacgacacaataaccgtctacaacaccaaccacctgataggggagctggccatcaagctcatcctgggcgacatccagtacaagctgttcaccgagaccctagacttacagatcgacgccaagtgcgtcgggtgccccgactgcttcgagagctactcctgcaacttccagatagtgagtaacatcgacacgatctgctccctggaaggcccgtgcgacaccttccacaaccgcatcagcatcaaggcgatgcagcaaaattacgccgtcaagctctcctgccagaaggacccccggcccagcggcactttcaagatctgcaaccgcgagtacaccgtggtgttccacaccgtcgccaaggacgacaagatcgagatcaatgtgggagaccagaccagcttcatcaaggagaaggacgaccggtgcaagacatggctgtgccgcgtgcgggacgagggcataagcgtcatcttcgagcctatcaaggccttcttcgggtcctacttcagcatcttcttctacatcatcgtagtggtcgtggtgggcttcctgattatctacatcttcatgccgatgttcatgaagctcaaggaggtcctcaaggccaacgagaagctgtatctccaggagatcaagcagaagtga

SEQ ID NO: 15786 - RNA, 4311 nt, synthetic construct; identical to SEQ ID NO: 12500
  misc_feature 1..4311: note = derived and/or modified CDS sequence (opt11) from BUNV(SFCrEq231)__KP063893.1__GP
  source 1..4311: mol_type = other RNA

SEQ ID NO: 15787 - RNA, 4302 nt, synthetic construct; identical to SEQ ID NO: 12501
  misc_feature 1..4302: note = derived and/or modified CDS sequence (opt11) from BUNV(GSA/S4/11232/WT)__KM507339.1__GP
  source 1..4302: mol_type = other RNA

SEQ ID NO: 15788 - RNA, 4302 nt, synthetic construct; identical to SEQ ID NO: 12502
  misc_feature 1..4302: note = derived and/or modified CDS sequence (opt11) from BUNV(MGD/S1/12060/WT)__KM507340.1__GP
  source 1..4302: mol_type = other RNA

SEQ ID NO: 15789 - RNA, 4308 nt, synthetic construct
  misc_feature 1..4308: note = derived and/or modified CDS sequence (opt11) from Ab-BUNV(Cu20-XJ)__KJ710423.1__GP
  source 1..4308: mol_type = other RNA
atggccatcagcatcgtgctgatgatcatattctcaaccaccagctgtctcgcccgcgcggcgccctccatcagcaagtgcttccaggacggagttctgatcgccgagaagaagtccagctccgggatttcagagttctgcatcaaggacgacatctccatcctcaagagcgagatcaattactccaagaacgacacgggaatcttcatgcacagcaaggtgttccggcactggaccgtggccgattggaagcagtgccagccgataccctccgccgggggcagcatcaatgtcctcgaggtggacaagaacctgaacctggtggcgaagaactacatgtgcacccgcccctgcgtgatcaccatcgataaggagaacgcccagctcctgttccagacggaacagctcaaccaattcgaggtcactgggaccaccatctccacgggctggttcaaaagcaagacctccgtgagcctcgacaacacatgcgagcacatcaaggtgacctgcggaaagaagtccctgcaattccacgcctgcttcaagcagcatatgagctgcgtcagattcctgcaccgcagcgtcctccccgggtacatggccaactccatctgccagaacatcgagctgatcatcatcatcaccctgacccttgcgatcttcatcttcatgtgcatcatcaccagaacctacatctgctacatcatgctgccgctgttcgcccccatcgcctacatctacggctggctctacaaccgctcgtgcaagaagtgcatctgctgcgggctagcctaccaccccttcacgaactgcggctcctactgcgtctgtgggtcccgattcgagacctccgacaggatgcggctgcaccgcgagagcggcctctgccagggcttcaagtccctgcgggtggcccgtaccctgtgcaaaagcaaggggtcctcccttgtgatatccgtcttaaccgcgatgctgatcctgagtttcgtgacgccgctggaggccatctccaccaactacccgaccgaccggaaatacaccctgaacgaggtgaacgacatcgtcctcggcaaggggacggagaacgagctgaagaccagcatcctggcccttgtgtccatatgcggcatcggcatcataatcattttcatcgccctgaccatgctgctcgacatcgtgctggaggccatcgcgaagcgcagcaccatcttctgtacggaatgcaacctgatccacgacaagaaggccatgaagttcgtcggggacttcaccaacaagtgcggcttctgcccctgcggggagctcgaggaccccgagggcctggtgatccacaccacccggaagtcctgcacatactacatcaagatccgcaacctgaaactcatcatgctggtgttcagcattgccatcctgatgcagaacaccgccatgctcgttgtggccgatgagaactgctggaccaacaccgagatcaaggcggactgcgttgggcccctgatcgggccgacaacgtgcaccaacaagggctcaaagacctacaaggccgtggcccaggagctggtaacgagcaacaaaatcacgcagctcgacgccgacaagtacactctgttaggggacaccatcgagagcgccttatccgcgatcaccgagcagaagcactacagcgccatccacctcctggagacaatcttcctcatgaaacactgcgactactacaaggtctacgagcacaactccggctacagccagactaagtggcggctcatcgccaagaccaactccttcgacatctgcagcatcccctcaacccccaatttttgcaagtgcctgagcgactccagctgctccacgagcaccctgaactttgccacctccatgaatagcacctacacgtccaaggcggagtactttaatcacgacttcaccctcttcttgaacatcttcgaagccgccttccccggtagcgccaccgccttcctgttcaagaagataaaagagaaggcgccgtaccaggccttcgagatgatgggcaagatcgccaacaagtaccccaacaacaagctcctggtggtgttgctcaagtatggccagtacatggtcggcctgtcccacgccagcacctaccagctgaagcaggagtggatcgcaaagagcctctccctggtgcgcagcacgaagaccggcctgaagatggcgatgaccaacgccgagcccgggccggcgaccaaggagtgttccgatgccaagacgatagcgtgcctcaccccgaagttccaggtggaggtcaacaatctgatgagctgcggcgcatcccccaacttcaagatctacatgaagtccggggagctgtacaaggcccacgaccggaacagcgtgtggtgcctcaacgacatgcattgcctgaccccctacacccccgccaacgccgagctggtcgcgacgatgaagaagatggagtgctggcaggacaacccgaagcaacccaccaacgactacgccacaccccgccggagctgccagatgaaagaccgcggcctatgcaacgtcggtgccgacaagtggaaggtgataaagtgcgacgacgacctaatgttctacaccgacgccctggagtcccccgacccggccgcggacatcgggcagtactgtttcagcgagaagtgccagatcgaacgctaccccatcaaccccacctccctcaccaactgcgagtggctgtaccgggccgtgaagccgcagtacatcaaacgcctgagcctccagaccatcgaagaatacaagaaggccatcaccgacaagctgacgcacacgctgcagctctatcacttcgcgcccctggagaatctgccccacatccggcccacctacgagtacatcaccgcccaaggcacatacaccgccgacggcatcgagggcgcctccatcattacgagcatcccggccctctccgggaccagcgtcggctttaagatcaacgccaaggacgggaccgccctgctggacatcgtggtgtacatcaagtccagcgtcgtcaaatccgtgtacaaccacatctacgacacggggcccaccatcaacatcaactctaagcacgacgagctctgcaccggtcagtgccccaagcgaatccccgcggacccgaactggctgaccttcagccaggagcgcacgtcccgctgggggtgcgaagagttcggctgcctggccatcaacacagggtgcgtctacggcagctgccaggacgtgatcagaacagagaccaaggtgtaccgcaaggccaacgaggagacggtcatgctcaccgtgtgcatcacctaccccggacacaccttctgcacggacgtgaacgccctggagcccaagatcacggacgagctggagctccagttcaagaccatagacatcaagtccctgcccaatctggtcgcaataaccaaccacaagctctacacggggcaaatcaacgacctgggcaccttcgggcagatgtgcggcaacgtgcagaagaccaacaccagcatcctgggggcgggcacgccgaaatttgactacacgtgctactccgccagccggaaggacatcatcatccgccggtgctataacaacaactacgactcctgccgcctcctgaagcaggagggagacctgctgttcgacgacaaccacgagaccctgattgtgtacaataacaagcggctgaacggggagctcaccatgaagttgctgctcggcgacatccagtacaagctgtataccgagaacatggagctggagctcgaggccaagtgcgtcgggtgcgtgggctgcttcgagagctaccagtgcaacctacaaatcacctccagcctggacgggaactgcgccatctccggcccctgcgagaccttccacgaccgcatccagatcaaaaccacgaagaaagactatgcgctcaagctggcgtgcaccaaggaccccggcgacaaggccacattccgggtgtgcgggaaggactacgacttcaacttccacaccgtcgtgaagaatgacaagatcgaggtgaacgtcggcgacgagacgagctacatcaaggaaaaggacgcgcgctgcggcacctggctgtgccgtgtacgcgacgagggcctctccgtgatcttcgagcccctgaagaacttcttcggtaactacctgaatatgttcctctacattttgggcggcgtcctattgctgttcttgtcgctctacattatcatgccggtatgcgcccggctgcgcgacgagctgaagaaaaacgagaagctccaccagatggagatgaagaagcggtaa

SEQ ID NO: 15790 - RNA, 4305 nt, synthetic construct; identical to SEQ ID NO: 12504
  misc_feature 1..4305: note = derived and/or modified CDS sequence (opt11) from ANADV(EIV-13128Kam)__KT313718.1__GP
  source 1..4305: mol_type = other RNA

SEQ ID NO: 15791 - RNA, 4305 nt, synthetic construct; identical to SEQ ID NO: 12505
  misc_feature 1..4305: note = derived and/or modified CDS sequence (opt11) from ANADV(EIV-13130Kam)__KT313721.1__GP
  source 1..4305: mol_type = other RNA

SEQ ID NO: 15792 - RNA, 4305 nt, synthetic construct
  misc_feature 1..4305: note = derived and/or modified CDS sequence (opt11) from ANADV(EIV-13395Mg)__KU159765.1__GP
  source 1..4305: mol_type = other RNA
atgttcctgatcctcgtcctgctgatccccttctacatcaccgccacccctgtcacgacccgctgcttccacggcgggcagctcatcgccgaaagcaagtccctgaccgcgatcagcgagttctgcctgaaggacgacgtgtccaccgtcaagagcgagatcacgtacctaaagaacgacacaggcatcttcgcccactccaaggtgctgcggaactggatcatcaaggactggaagaactgcaaccccgtgcccactgccgggggcagcatcaacgtgatcgaggtcaacgccgacctgagtctcagcaccaagacctacgtgtgctcccgcgactgcaccatcaccgtggacaaggaggacgcccagatcatcttccagaccgacaagctgaaccatttcgaggtctcggggacgaccctgtccagcggctggttcaagaccaaggcgagtgttaccctcgaccggacgtgcgagcacatcaaggtgacctgtggcaagaagaccctgcagttccacgcctgcttcaagcaccacatgagctgtatccgcttcttccacaacaccatcctgcccgggacgatggccgtctccatctgccagaacatcgagctcataatcatcaccagcctgactctgatcatcttcatcctcatggtgatcctgaccaagacgtacatctgctacgtgctgatgccgctgttcatgccggtcgcctatctatacggctgggcgtacaaccggtcctgcaagaagtgcagctgctgcgggctcgcctaccaccctttcaccaactgcggctcccactgcgtgtgcgggctcaagtttgaggccagcgaccgcatgcggatccaccgcgagagcggcctgtgccagggctacaagtccctgcgggtggcccgcctcctatgcaagagcaaggggtccagcctgatcatctccatcctcctgagcgtcctgatcctctccttcgtgacccccatcgagggcaccctgacgaactacccggagagcaagaagtactccctggaggaaatcgccgacgtgatcgagggcttcattgcggagaaaggcatcaaggagtacatcgtgctctataccagcatcttcggcgccctgctcctcctgatcgccctgattatcaccgtgtccctcaaccggatcaccgagtacctgacgaacctgaacgtgatctactgccacgagtgcagcatgtaccactccaagaagaacatcaagtacatcggggacttcaccaataagtgcggcttctgcacgtgcggggagctcgaggaccaggagggtctgaacatgcacaaggtcagcaagaagtgcatctaccgctaccagctgacctggtccaaggtgatcatgaccatcctcgtgtgcctgctgatcgcccagaacaccgtgctgatcgtggctgcgaacgacgactgctgggccaagcagagcctcgagatcgagtgcgtcggacccctgcagcaggtcgacgcctgcgaggacaagtccagccggtcctacaacggcgaggccaagaagctggtgggcaccagcaaggtgaccgagctcgacgccggccaagtgaacctgctggggcagaccatcgagagcgcgatcatagccatccgcaagcagcggacgtacgccaccatgcacttcctcgagtccgtgttcctggggcgccactgcgactactacaaggtcttcgagcacaacagcggctactcccaggccaagtggcggctgctcgccaagaccaaccacttcgacatctgcagccgccactccacccaccacttctgccggtgcatgagcgacgggacgaagtgcgagaacggcaaccgcgactttgcgggcgagatgaacaccacctaccactcgaagcgggacttcttcaagcacgacttcaacctgttctgcaccctgctcgagaacgccttccccgggacgaccgagagcctgtactaccagttactctccaagcgcaacaccaccggcgccagcaagctgctggggaagctcatcacgaagttcggcaacaacaatctcttcgtggggatctggaagttcggccagttcctgctctccctgccctacgtgaacaacaccgagcttagcgccctccagtccagcaagatcctggagtccccggagcccttactacggagcgcgtccggccggcaggagagcctgagctccgccacccccggggaggccagcaaggagtgccgcaacgccaagaagatctcctgcatctcaccccggttcggcgtcccgatggaaaacctgaccgcctgcggggagtcccccaactacaagatctacaagacgcccacccgcatctacaagagcaacaacaagggcgagatctggtgcgcgggcgacgtgcactgcttccaggagttcacccccgtgctccaggaggtcgtggacaagctgaagaagatgacctgcttcctgacggagccggaggccgaggaagacgccttctccatcgccatcgccatgtgcaagatcctcgacaagggggtgtgcactatcaacagcgagcggtggaacatcatcaagtgcgactccggcctgatgtactacaccgaccagcgcgacgggcaggacaccggcaatgacttcggggagtactgcatcagccacaactgcaagacggagaggttccccatcaacccctccatcataagcgactgtatctgggagtaccactcccgcaaaagccggtacatctccaccctgaacctcgagagcctggaggagttcaagcgcgcgatctccgagaagctgagccacaccctcgttgtctaccaattcaagcccacttccaacctgccgcacatgaagcccgtgtacaagtatatcacggcccagggcgtcgagaatagcgacggcatcgacagcgccttcatcaccgcctccatgcccgccctgagcgggacctccatcggctacaacgtgatgagcaaggacaactttccactcttcgacatcatcatcttcatcaagtccgcggtgatcaagaccacgtacaaccacatctacgacaccgggccgaccatcggcatcaatgtcatgcacgacgagcattgcaccgggcagtgccccatcgagatcccccacaaggagaactggctgacgttcagccaggagcggacctcccgctggggctgcgaggagttcggctgcctggccatcaacaccgggtgcgtattcggcagctgccaggacatcatccggccggagaccaaggtctaccgcaaagccatcgaggagtccgtcctcctgaccgtgtgcgtgacgtaccccgggaacaccttctgcaccgagatcaacgccatcgagcccaagatcaccgacgagctggagctccagttcaaaacggtcgacaccaagaccctgcccaacctcctcgcggtgcagaaccacaaactgtacagcggtcagatcaacgacctggggtccttcgcccaggggtgcggaaacatccagaagaccaacctctccgtgatcgggacgggcaccgccaaattcgactacatctgccacggggcctcccggaaggacatcgtcgtgcgccggtgctacaacaacaactatgagagctgcaagctgctgaaggaggagccgtccctcatcttcagcgacaaccatgagaccatcgaggtcgccaacatccgccacctcctgggggagctccagttcaagctgatgctgggggacctccggtacaaatccttcgcggagaaccccgagctggagatcgaggccaagtgcgtcggctgccctagctgcttctccagctacagctgcaacttccgcatctccagctccatcgacaccgtgtgcgcaatcgacggcccctgcacgatcttccacaaccgcctgatcatcagctccaccaagcaggactacgggatcaagatgagctgcaaggagaagccgaaccccgtggagaagttcaacatctgcaagcgggtgtactccgtcctcttcaccaccatcgacaagaacgacaagatcgagatcaatacgggcgaccagaccagcttcatccaggagaaggacgaccgctgcaagacctggctgtgccgggtgcgcgacgaggggatctccgtgattttcgagcccatcaaggccttcttcggcagctacttctccatcgccttctacgtggtgatcggcatcatcgcgctgttcatcaccatctacatcttcctccccatggtcttcaagctgaaggacatcctgaagaagaatgagctcctgtacctgcaggagatgaagtacaagtga

SEQ ID NO: 15793 - RNA, 4305 nt, synthetic construct; identical to SEQ ID NO: 12507
  misc_feature 1..4305: note = derived and/or modified CDS sequence (opt11) from ANADV(EIV-16002Mg)__KT313724.1__GP
  source 1..4305: mol_type = other RNA

SEQ ID NO: 15794 - RNA, 4305 nt, synthetic construct; identical to SEQ ID NO: 12508
  misc_feature 1..4305: note = derived and/or modified CDS sequence (opt11) from ANADV(EIV-16199Mg)__KT313730.1__GP
  source 1..4305: mol_type = other RNA

SEQ ID NO: 15795 - RNA, 4305 nt, synthetic construct
  misc_feature 1..4305: note = derived and/or modified CDS sequence (opt11) from ANADV(EIV-16208Mg)__KT313733.1__GP
  source 1..4305: mol_type = other RNA
atgttcttgatcctcgttctgctgatcccattctacatcaccgccacccccgtcaccacccgctgcttccacggcgggcagctcatcgccgagagcaaatccctgaccgctatcagcgagttttgcctgaaagacgacgtgtccaccgtaaagagcgagatcacgtatttaaagaacgacaccggcatcttcgcccactccaaggtgctgcggaactggatcatcaaggactggaagaactgcaaccccgtgcccacagccgggggcagcatcaacgtgatcgaggtcaacgccgacctgtccctcagcacaaagacgtatgtgtgctcccgcgactgcaccatcaccgtggacaaggaggacgcccagataatcttccagaccgacaagctgaaccacttcgaggtcagcgggacgaccctgtccagcggctggttcaagaccaaggcctctgtgaccctcgaccggacgtgcgagcacatcaaggtgacctgcggcaagaagaccctgcagttccacgcctgcttcaagcaccacatgagctgcatccgcttcttccacaacaccatcctccccgggacgatggccgtctccatatgccagaacatcgagctcatcatcataaccagcctaactctgatcatcttcatcctcatggtgatcctgaccaagacctacatctgttacgtgctgatgccgctgttcatgcccgtcgcctacctgtacggctgggcgtacaacaggtcctgccgcaagtgcagctgttgcggactggcctaccaccccttcaccaattgcggctcccactgtgtgtgcgggctcaagttcgaggccagcgaccggatgcgcatccaccgggagagcggcctgtgccagggctacaagtccctgagagtggcccgtctcctgtgcaagagcaagggctccagcctgatcatctccatcctgctcagcgtgctgatcctctccttcgtgacccccatcgagggcaccctgacaaactacccggagagcaagaagtactccctggaggaaatcgccgacgtgatcgaggggttcatcgcggagaagggcatcaaggagtacatcgtcctctacacaagcatcttcggcgccctgctgctcctgatcgccctgatcatcaccgtgtcactcaaccgcatcaccgagtaccttacgaacttaaacgtgatctattgccacgagtgcagcatgtaccacagcaagaagaacatcaagtacatcggggacttcaccaacaagtgcggcttctgtacgtgcggggagctcgaggaccaggagggcctgaacatgcacaaggtcagcaagaagtgcatctaccgctaccagctgacatggtccaaggtgatcatgaccatcttaatctgcctgctgatcgcccagaacgccgtcctgatagtggcggccaacgacgactgctgggccaagcagagcctcgagatcgagtgtgtggggcccctgcagcaggtcgacgcctgcgaggacaagtccagccgctcctataacggcgaagccaagaagctggtgggtaccagcaaagtgacagagctcgacgcggggcaggttaacctgctgggccagaccatcgaaagcgcgatcatagccatccggaagcagcgcacctatgccacgatgcacttcctcgagtccgtgttcctggggcggcactgcgactactacaaggtgttcgaacacaacagcggttactcccaggccaagtggcgcctgctcgcgaagaccaaccacttcgacatctgcagccggcactccacccaccacttctgccgctgcatgagtgacgggaccaagtgtgaaaacggcaactgggatttcgccggcgagatgaacacgacctaccactccaaacgggacttcttcaagcacgacttcaagctgttctgcaccctattggaaaacgccttccccgggacaacggagagcctgtactaccagctgctctcgaaacgcaacaccaccggcgccagcaaacttctggggaagctcatcaccaagttcggcaacaacaacctgttcgtcgggatctggaagttcggtcaattcctgctgtccctcccctatgtgaacaacacggagctgagcgcgctccagtccagcaagatcctggagtccccggaacccctgctccgcagcgcctccggacggcaggagagcctgagctcagccacccccggggaggccagcaaggaatgccgcaacgccaagaagatctcctgtatcagcccccggttcggcgtgccgatggagaacctcaccgcgtgcggggagtctcccaactacaagatctacaaaacccccacgcgcatatacaagagcaacaacaagggcgagatctggtgcgcaggcgacgtccactgcttccaggagttcacccccgtgcttcaggaggtggtcgacaagctgaagaagatgacatgcttcctgaccgagcccgaggccgaggaggacgccttctccatcgccatcgcgatgtgcaagatcctcgacaagggggtgtgcacgatcaacagcgaacggtggaatattatcaagtgcgactccggcctgatgtactacaccgatcagcgagacgggcaggacaccggcaacgacttcggggagtactgcatcagccacaactgtaaaaccgagcggtttcccattaacccctccatcatcagcgactgcatatgggagtaccactcccgcaagagcaagtacatctcaacgctgaacctcgagagcctggaggagtttaagcgcgccatctccgagaagctgagccataccctcgtggtctaccagttcaagcccacctccaacctgccgcacatgaagcccgtgtacaagtacatcaccgcccagggcgtggagaacagcgacggcatcgacagcgccttcatcaccgccagcatgcccgcgctgagcgggacctccatcggctacaacgtcatgagcaaggacaacttccccctcttcgacatcatcattttcatcaagtccgccgtgatcaagaccacctacaaccacatctacgatacggggccgaccatcggcataaacgtgatgcatgacgagcactgcaccgggcaatgccccatcgagatcccccataaggagaactggctaaccttcagtcaggagcgcacgtcccggtggggctgcgaggagttcggctgcctagccataaacaccgggtgcgtcttcggaagctgccaggacatcatccgcccggagaccaaggtgtaccggaaggccatcgaggagtccgtgctcctgactgtctgcgtgacctaccccgggaacacgttctgcaccgagatcaacgcgatcgaacccaagatcaccgacgagctggagctccagttcaaaaccgtggacacgaagaccctgcccaacctgctagccgtccaaaaccacaagctgtacagcggacagatcaacgacctggggtccttcgcccagggctgcggcaacatccagaagaccaacctgagcgtgatcgggaccggcacggcgaagttcgactacatctgccacggggcctcccgcaaggacatcatcgtgcggcgctgctacaacaataactacgagagctgcaagctgctgaaggaggagccgtccctcatcttcagcgacaaccacgagaccatcgaggtcgcgaacatccggcacctcctgggcgagctccagttcaagctgatgctgggggacctccgatacaagtccttcgccgagaatcctgagctggagatcgaggcaaagtgcgtgggctgccccagctgcttctcgagctatagctgcaacttccggatctccagctccatcgacaccgtgtgcgccatcgacggcccctgcaccatcttccacaaccgcctcatcatctcatccacgaagcaggactacgggatcaagatgagctgcaaggagaaaccgaactccgtcgagaagttcaacatctgcaagcgcgtgtacagcgtcctcttcaccacgatcgataagaacgacaagatcgagatcaacaccggcgaccagacgtccttcatccaggagaaggacgaccggtgcaagacctggctgtgccgagtgcgggacgaggggatctccgtgattttcgagcccattaaggcattcttcggctcctacttcagcatcgcgttctacgtggtcatcggcataatcgccctgttcatcatcatctacatcttcctcccgatggtgttcaagctgaaggacatcctgaagaagaatgaactcctttacctgcaggagatgaagtacaagtga

SEQ ID NO: 15796 - RNA, 4305 nt, synthetic construct; identical to SEQ ID NO: 12510
  misc_feature 1..4305: note = derived and/or modified CDS sequence (opt11) from ANADV(EIV-16356Mg)__KT313736.1__GP
  source 1..4305: mol_type = other RNA

SEQ ID NO: 15797 - RNA, 4305 nt, synthetic construct; identical to SEQ ID NO: 12511
  misc_feature 1..4305: note = derived and/or modified CDS sequence (opt11) from ANADV(EIV-17769Yak)__KT313739.1__GP
  source 1..4305: mol_type = other RNA

SEQ ID NO: 15798 - RNA, 4305 nt, synthetic construct; identical to SEQ ID NO: 12512
  misc_feature 1..4305: note = derived and/or modified CDS sequence (opt11) from ANADV(EIV-18098Yak)__KT313742.1__GP
  source 1..4305: mol_type = other RNA

SEQ ID NO: 15799 - RNA, 4305 nt, synthetic construct; identical to SEQ ID NO: 12513
  misc_feature 1..4305: note = derived and/or modified CDS sequence (opt11) from ANADV(EIV-18136Yak)__KT313745.1__GP
  source 1..4305: mol_type = other RNA

SEQ ID NO: 15800 - RNA, 4305 nt, synthetic construct; identical to SEQ ID NO: 12514
  misc_feature 1..4305: note = derived and/or modified CDS sequence (opt11) from ANADV(EIV-18146Yak)__KT313748.1__GP
  source 1..4305: mol_type = other RNA

SEQ ID NO: 15801 - RNA, 4305 nt, synthetic construct
  misc_feature 1..4305: note = derived and/or modified CDS sequence (opt11) from ANADV(EIV-18353Yak)__KT313751.1__GP
  source 1..4305: mol_type = other RNA
atgtttctgatcctcgtgctgctgatccccttctacatcaccgccaccccggtcacgacccgctgcttccacggcggtcagctcatcgccgagagcaagtccctgaccgcgatcagcgagttctgcctgaaggacgacgtgtccaccgtcaagagcgagatcatctacctcaagaacgacacgggcatcttcgcccactccaaggttctgcggaactggatcatcaaggactggaagaactgcaaccccgtgcccacagccgggggcagcatcaacgtgatcgaggtcaacgccgacctgagtctcagcaccaagacctacgtgtgctcccgcgactgcacgatcaccgtggataaggaggacgcccagatcatcttccagaccgacaagctgaaccacttcgaggtcagcgggaccacgctgtccagcggctggttcaagaccaaggcgtccgtgaccctcgaccggacatgcgagcacatcaaggtgacgtgcggcaagaagaccctgcagttccacgcctgcttcaagcaccacatgagctgcatccgcttcttccacaacaccatcctgcccgggaccatggccgtttccatctgccagaacatcgagctcatcatcatcacgagcctgaccctgatcatcttcatcctcatggtgatcctgaccaagacctacatctgctacgtgctgatgccgctgttcatgcccgtcgcctacctgtacggctgggcgtacaaccggtcctgcaagaagtgcagctgttgcgggctggcctaccaccccttcacgaactgcggctcccactgcgtgtgcgggctcaagttcgaggccagcgaccgcatgcggatccaccgcgagagcggcctgtgccagggctacaagtccctgcgggtggcccgcctcctgtgcaagagcaagggatccagcctgatcatctccatcctcttaagcgtcctgatcctttctttcgtgacccccatcgagggcaccctgaccaactacccggagtcaaagaagtactccttagaagagatcgccgacgtgatcgaggggttcatcgcggagaagggcatcaaggagtacatcgtcctctacacgagcatcttcggcgccctgctgctcctgatcgccctgatcatcaccgtgtccctcaacagaatcaccgagtacctgaccaacctgaacgtgatctactgccacgagtgcagcatgtaccactccaagaagaacatcaagtacatcggggacttcacgaacaagtgcggcttctgcacgtgcggggagctcgaggaccaggagggcctgaacatgcacaaggttagcaagaaatgcatctaccgctaccaactgacctggtccaaggtgatcatgaccatcctcgtctgcctgctgatcgcccagaacacggtgctgatcgtggcggcgaacgacgactgttgggccaagcagagcctcgagatcgagtgcgtcggacccctgcagcaggtcgacgcctgcgaggacaagtccagccggtcctacaacgaggaggccaagaaactggtgggcaccagcaaggtgaccgagctcgacgccggccaggtgaacttgctggggcagacaatcgagagcgcgatcatcgccatccgcaagcagcggacctacgccacgatgcacttcctcgagtccgtgttcctgggccgccactgcgactactacaaggtcttcgagcacaactcagggtactcccaggccaagtggcggctgctcgccaagactaaccacttcgacatctgcagccgccactccacccaccatttctgtaggtgcatgagcgatggcacgaagtgcgagaacgggaactgggacttcgcgggcgagatgaacacgacctaccactccaagcgcgacttcttcaagcacgacttcaacctgttctgcaccctcctcgagaacgccttccccggcacgacggagagcctgtactaccagctgctctccaagcggaacaccaccggggccagcaagctgctgggcaagctcataaccaagttcgggaacaacaacctgttcgtgggcatctggaagttcgggcagttcctgctctccctgccctacgtgaacaacacggagctgagcgccctccagtcctcaaagatcctggagtcgccggagcccctgctccgcagcgcatccggccgccaggagagcctgagctccgccacccccggcgaggccagcaaggagtgccggaatgccaagaagatctcctgcatcagcccccgcttcggggtcccgatggagaacctgaccgcctgcggcgagtcccccaactacaagatctacaagacccccactcggatctacaaaagcaataacaagggggagatctggtgcgcgggcgacgtgcactgcttccaagagttcactcccgtgctccaggaggtcgtggacaagctgaagaagatgacctgcttcctgaccgagccggaggccgaggaggacgccttttccatagccatcgccatgtgcaagatcctcgacaagggcgtgtgcacgatcaacagcgagcgctggaacatcattaagtgcgactccgggctgatgtactacacagaccagcgggacggccaggacaccgggaacgatttcggcgaatactgcatcagccacaattgcaagaccgagcgcttccccatcaacccctccatcatctcggactgcatctgggagtaccactcccgcaagagccggtacatctccacgctgaacctcgagagcctggaggagttcaagcgggcgatctccgagaagctgagccacaccctcatcgtctaccaattcaagcccacctccaacctgccgcacatgaagcccgtgtacaagtacatcacggcccagggggtggagaacagcgacggcatcgacagcgcattcatcacggcctccatgcccgccctgagcggcacctccatcgggtacaacgttatgagcaaggacaacttccccctcttcgacatcatcatcttcatcaagtccgcggtgatcaagaccacctacaaccacatatacgacacgggcccgaccatcgggatcaacgtgatgcacgacgagcactgcaccggccagtgccccatcgagatcccccacaaggagaactggctgaccttcagccaggagcgcacgtcccggtggggttgcgaggagttcggctgcctggccatcaacaccggctgcgtattcgggagctgccaggacatcatccgcccggagacaaaggtctaccggaaggccatcgaggagtccgtgctcctgaccgtctgcgtgacctaccccggcaacacgttctgcaccgagataaacgccatcgagcccaagatcaccgacgagctggagctccagttcaagaccgtggacacgaagacactgcccaacctgctcgcggtccaaaaccacaagctgtactccgggcagatcaacgaccttggctccttcgcccaggggtgcggcaacatccagaagaccaacctcagcgtgatcggcaccgggacggccaagttcgactacatctgccacggcgcctcccgcaaggacatcgtggtcagacgctgctacaacaacaactacgagagctgcaagctgctgaaggaggagccgtccctcatcttcagcgacaaccacgagaccatcgaggtggccaacatccggcacctcctgggggagctccagttcaagctcatgctgggagacctccgctacaagtccttcgcggagaaccccgagctggagatcgaggcccggtgcgttgggtgccccagctgcttctccagctacagctgcaacttccgcatctccagctccatcgacaccgtctgcgccatcgacggcccctgcaccatcttccacaaccgcctgatcatcagcccgacgaagcaggactacggcatcaagatgtcctgcaaggagaagcccaaccccgtggagaagttcaacatctgcaagcgggtgtacagcgtcctcttcaccaccatcgacaagaacgacaagatcgagatcaacaccggggaccagacgtccttcatccaagagaaggacgacaggtgcaagacctggctgtgccgggtgcgcgacgaggggatcagcgttatcttcgagcccatcaaggccttcttcgggtcctacttcagcatcgccttctatgtcgtgatcggcataattgcgttattcatcatcatctacatcttcctccctatggtgttcaagctgaaggacatcctgaagaagaacgagctcctgtacctgcaggagatgaagtacaagtga

SEQ ID NO: 15802 - RNA, 4305 nt, synthetic construct
  misc_feature 1..4305: note = derived and/or modified CDS sequence (opt11) from ANADV(EIV-18560Yak)__KT313754.1__GP
  source 1..4305: mol_type = other RNA
atgttcctgatcctcgtgctgctgatccccttctacatcaccgccaccccggtcacgacccgctgcttccacggcgggcagctcatcgccgagagcaagtccctgaccgcgatcagcgagttctgcctgaaggacgacgtgtccaccgtcaagagcgagatcatctacctcaagaacgatacgggcatcttcgcccactctaaggtgctgcggaactggatcatcaaggactggaagaactgcaaccccgtacccaccgccgggggcagcatcaacgtgatcgaggtcaacgccgacctgtccctcagtaccaagacctacgtgtgctcccgcgactgcacgatcaccgtggacaaggaggatgcccaaatcatcttccaaaccgacaagctgaaccacttcgaggtcagcgggaccacgctgtcctcaggctggttcaaaaccaaggcgtccgtgaccctcgaccggacctgcgaacacatcaaggtgacgtgcggcaagaaaaccctgcaattccacgcctgcttcaaacaccacatgagctgcatccgcttcttccacaatacaatcctgcccgggaccatggccgtctccatctgccagaacatcgagctcatcatcatcacgagcctgaccctgatcatcttcatcctcatggtgatcctgaccaagacctacatctgctacgtgctgatgccgctgttcatgcccgtcgcctacctgtacggctgggcgtacaaccggtcctgcaagaagtgcagttgctgcgggctggcctatcaccccttcacgaactgcggctcccactgcgtgtgcgggctcaagttcgaggccagcgaccgcatgcggatccaccgcgagagcggcctgtgccaaggctacaagtccctgcgggtggcccgcctcctgtgcaagagcaaggggtccagcctgatcatctccatcctcctgagcgtcctgatcctctccttcgtgacccccatcgagggcaccctgaccaactacccggagagcaagaagtactccctggaggagatcgccgacgtgatcgaggggttcatcgcagagaagggcatcaaggagtacatcgtcctctacaccagcatcttcggggccctgctgctcctgatcgccctgatcatcaccgtgtccctcaatcggatcacggagtacctgaccaacctgaacgtgatctactgccacgagtgcagcatgtaccactccaagaagaacatcaagtacatcggggacttcacgaacaagtgcggcttttgcacgtgcggggaactcgaagaccaggagggcctgaacatgcacaaagtctcgaagaagtgcatctaccgctaccagctgacctggtccaaggtgatcatgaccatcctcgtctgcctgctgatcgctcagaacaccgtgctgatcgtagccgcgaacgacgactgctgggccaagcagagcctcgagatcgagtgcgtcgggcccctgcagcaggtcgacgcctgcgaggacaagtccagccggtcctacaacgaggaggccaagaagctggtcggcaccagcaaggtgaccgagctcgacgccggccaggtgaacctgctggggcagaccatcgagagcgcgattatcgccatccgcaagcagcggacctacgccacgatgcatttcctcgagtccgtgttcctgggacgccactgcgactactacaaggtcttcgagcataacagcgggtactcccaggccaagtggcggctgttggccaagaccaaccatttcgacatctgcagccgccactccacccaccacttctgccggtgcatgagcgacggcaccaagtgcgagaacgggaaccgcgatttcgcgggcgagatgaacacgacctatcactccaagcgggacttcttcaagcacgacttcaacctgttctgcaccctgctggagaacgccttccccggcaccacggagagcctgtactaccagctgctctccaagcgcaacaccaccggggccagcaagctgctgggcaagctcatcacaaaattcgggaacaacaacttattcgtgggcatctggaagttcgggcagttcttactctccctgccctatgtgaacaacacggagctgagcgccctccagtcctccaagatcctggagtccccggagcccctgctccgcagcgcgtccggccggcaagagagcctgagctccgccacgcccggcgaggccagcaaggagtgcagaaacgccaagaagatctcctgcatcagcccccggttcggggtcccgatggagaacctgaccgcctgcggagagtcccccaactacaagatttacaagacgcccacgcgcatctacaagagcaacaacaagggggagatctggtgcgcgggcgacgtgcactgcttccaggagtttacccccgtgctccaggaggtcgtggacaagctgaagaagatgacctgcttcctgaccgagccagaggccgaggaggacgccttctcgatcgccatcgccatgtgcaagatcctcgacaagggcgtgtgcacgatcaacagcgagcggtggaacatcatcaagtgcgactccgggctgatgtactacaccgaccagcgcgacggccaggacaccgggaacgacttcggcgagtactgcatcagccacaactgcaagaccgagcggttccccatcaacccctccatcatcagcgactgcatctgggagtaccattcccgcaagagccggtacatctccacgctgaacctcgaaagcctggaggagttcaagcgcgccatctccgagaagctgagccacaccctcatcgtctaccagttcaagcccacctccaacctgccgcacatgaagcccgtgtacaagtacatcaccgcccagggggttgagaacagcgacggaatcgacagcgccttcatcactgcctccatgcccgccctgtcgggcacctccatcgggtacaacgtcatgagcaaggacaacttccccctcttcgacatcatcatcttcatcaagtccgcagtgatcaagaccacctacaaccatatctacgacacgggtccgaccattgggatcaacgtgatgcacgacgagcactgcacgggccagtgccccatcgagatccctcacaaggagaactggctgaccttctctcaggagcggacgtcccgctggggatgcgaagagttcggctgtctggccatcaacaccggctgcgtctttgggagctgccaggacatcatccggccggagaccaaggtataccgcaaggcgatcgaggagtccgtgctcctgaccgtatgcgtgacctaccccggcaacacgttctgcaccgagatcaacgccatcgagcccaagatcaccgacgagctggagctccagttcaagaccgtggacacgaaaaccctgcccaacctgctcgcggttcagaaccacaagctgtactcggggcagatcaacgatctgggctccttcgcccaggggtgcggcaacatccagaagaccaacctcagcgtgatcggcaccgggacggccaaattcgactacatctgccacggcgcgagtcgaaaggacatcgtggtccgccggtgctacaataacaactacgagagctgcaagctgctgaaggaggaaccgtccctcatcttcagcgacaaccacgagaccatcgaggtggccaacatccgccacctcctgggggagctccagttcaagctgatgctgggcgacctccggtacaagtccttcgcggagaaccccgagctggagatcgaggcccgctgcgtggggtgccccagctgcttttccagctacagctgcaacttccgcatctccagctccatcgacacagtttgcgcgatcgacggcccctgcaccatcttccacaaccggctgataatctctccgacgaagcaggactacggcatcaagatgtcctgcaaggagaaacccaaccccgtggagaagttcaacatctgcaagcgcgtgtacagcgtcctcttcaccaccatcgacaagaacgacaagatcgagatcaacaccggggaccagacgtccttcatacaggagaaggacgaccggtgcaagacctggctgtgccgcgtgcgggacgagggcatcagcgtgatcttcgaacccatcaaggccttcttcgggtcctacttcagcatcgccttctacgtcgtgatcggcatcatcgcgctgttcatcatcatctacatcttcctcccgatggtgttcaaacttaaggacatcctgaagaagaacgagctcctgtacctgcaggagatgaagtacaagtga

SEQ ID NO: 15803 - RNA, 4305 nt, synthetic construct
  misc_feature 1..4305: note = derived and/or modified CDS sequence (opt11) from ANADV(EIV-18715Yak)__KT313757.1__GP
  source 1..4305: mol_type = other RNA
atgttcctgatcctcgtgctgctgatccccttctacattaccgccaccccggtcacgacccgctgcttccacggcgggcagctcattgccgagagcaagtccctgaccgcgatcagcgagttctgcctgaaggacgacgtgtccaccgtcaagagcgagatcacgtacctcaagaacgacaccggcatctttgcccactccaaggtgctgcggaactggatcatcaaggactggaagaactgcaatcccgtgcccaccgccgggggcagcatcaacgtgatcgaggtcaacgccgacctgtccctcagcaccaagacgtacgtgtgctcgcgcgactgcaccatcacggtggacaaggaggacgcccagatcatcttccagaccgataagctcaaccactttgaggtcagcgggacgaccctgtccagcggctggttcaagaccaaggcgtccgtgaccctcgaccggacgtgcgagcatatcaaggtgacctgcggcaagaagaccctgcagttccacgcctgcttcaagcaccacatgagctgcatccgcttcttccacaacacgatcctgcccgggacgatggccgtctccatctgccagaacatagagctcatcatcattaccagcctgaccctgatcatcttcatcctcatggtgatcctgaccaagacgtacatctgctacgtgctgatgccgttattcatgcccgttgcctacctgtacggctgggcgtacaaccggtcctgcaagaagtgcccctgctgcgggctggcctaccaccccttcactaactgcggcagccactgcgtgtgcgggctcaagttcgaggcctccgaccgcatgcggatccaccgcgagagcggcctgtgccagggctacaagagcctgcgggtagcccgcctcctgtgcaagtccaaggggagctccctgatcatcagcatcctcctgtccgtcctgatcctcagcttcgtgaccccgatcgagggcaccctgacgaactaccccgaatccaagaagtactcactggaggagatcgccgacgtgatcgaggggttcatcgcggagaagggcatcaaggagtatatcgtcctctacacctccatcttcggcgccctgctgctcctgatcgccctgatcatcaccgttagcctcaaccggatcaccgagtacctgacgaacctgaacgtgatctactgccacgagtgctccatgtaccacagcaagaagaacatcaagtacatcggggacttcaccaacaaatgcggcttctgcacgtgtggggaacttgaggaccaggagggcctgaacatgcacaaggtctccaagaagtgcatctaccgctaccagctgacctggagcaaggtgatcatgaccatcctcatctgcctgctcatcgcccagaacaccgtcctgatcgtggccgcgaacgacgactgctgggccaagcagtcccttgagatagagtgcgtggggcccctgcagcaggtcgacgcctgcgaggacaagagctcccggagctacaacggcgaggccaagaagctggtgggcacctcccgcgtgaccgagctcgacgccgggcaggtcaacctactgggccagaccatcgagagcgcgatcatcgccatccggaagcagcgcacgtacgccaccatgcacttcctcgaaagcgtgttcttagggcggcactgcgactactacaaggtgttcgagcacaactccggctacagccaggccaagtggcgcctgctcgccaagaccaaccacttcgacatctgctcccggcacagcacacaccacttctgccgctgcatgtccgacgggacgaagtgcgagaacggcaactgggactttgcgggcgagatgaacaccacctaccacagtaagcgggacttcttcaagcacgacttctccctgttctgcaccctgctcgaaaacgcctttcccgggacgaccgaaagcctgtactaccagctgctctccaagcgcaacacgaccggcgccagcaagctgctggggaagctcatcacgaagttcggcaacaacaacttgttcgtcgggatctggaaattcggccagttcctgctctccctgccgtacgtgaacaacaccgagctgagcgccctccagtccagcaagatcctggagtcccccgagcccctgctccgcagcgcgtccggccgacaggagagcctgagctccgccacccccggggaggccagcaaggagtgccgcaacgccaagaagatctcctgcatcagcccgcggttcggcgtgcccatggagaacctgaccgcctgcggggagtcccccaactacaagatctataagacgcccacccgcatctacaagagcaacaacaagggcgagatctggtgcgcgggcgacgtccactgcttccaggagttcaccccagtgctccaggaagtggtcgacaagctgaagaagatgacctgcttcctgacggagcccgaggccgaggaggacgccttctccatcgccatcgccatgtgcaagatcctcgacaagggagtgtgcactatcaacagcgaaaggtggaacataatcaagtgtgactccggcctgatgtactacaccgaccagcgcgacggtcaggacaccggcaacgacttcggggagtactgcatcagccacaactgcaagacggagcggttccccatcaacccctccatcatcagcgattgcgtgtgggagtaccattcccgcaagagccggtacatctccaccctgaacctcgagagcttagaggagttcaagcgcgcgatctccgagaagctgagccacaccctcgtcgtgtaccaattcaagccgacctccaacctgccccacatgaagcccgtgtacaagtacataacggcccaaggcgttgagaacagcgacggcatcgatagcgccttcatcaccgcctccatgcctgccctgagcgggacctccatcggctacaacgtgatgagcaaggacaacttccccctcttcgacatcatcatcttcattaagtccgcggtgatcaagaccacgtacaaccatatctacgacaccgggccgaccatcggcatcaacgtcatgcacgacgagcactgcaccgggcagtgccccatcgagataccgcacaaggagaactggctgacgttcagccaggagcggacctcccgctggggctgcgaagagttcggctgcctggccatcaataccggctgcgtgttcggcagctgccaggacatcatccggcccgagaccaaggtgtaccgcaaggccatcgaggagtccgtcctcctgaccgtgtgcgtgacgtaccccgggaacaccttctgcaccgagatcaacgccatcgagcctaagatcaccgacgagctggagctccagttcaagacggtcgacaccaaaaccctgccgaacctgctcgcggtgcagaaccacaagctgtacagcggccagatcaacgacctggggtccttcgcccagggctgcggcaacatccagaaaaccaacctcagcgtgatcgggacgggcacagccaagttcgactacatctgccacggggcctcccggaaggacattgtcgtgcgccggtgctacaacaacaactacgagtcgtgcaagctgctgaaggaagaaccctccctcatcttcagcgacaaccacgagaccatcgaggtggccaacatccgccacctcctgggtgagctccagttcaaacttatgctgggggacctccggtacaagtccttcgcggagaaccccgagctggagatcgaggcccgctgcgtcggctgccccagctgcttctcctcatacagctgcaacttccgcatctccagctccatcgacaccgtgtgcgccatcgacggcccgtgcacgatcttccacagccggctgatcatctccagcaccaagcaggactacgggatcaagatgtcctgcaaggagaagcccaaccccgttgagaagttcaacatctgcaagcgcgtctacagcgtcctattcaccaccatcgacaagaacgacaagatcgagatcaacacgggcgaccagacctccttcatccaggagaaggacgaccggtgcaaaacctggctgtgccgcgtgcgggacgaggggatcagcgtgatcttcgagcccatcaaggccttcttcggctcctacttcagcatcgccttctacgtggtgatcggcatcatcgcgctgttcatcatcatctacatctttcttccgatggtcttcaagctgaaagacatcctgaagaaaaacgagctcctgtacctgcaggagatgaagtacaagtga

SEQ ID NO: 15804 - RNA, 4305 nt, synthetic construct
  misc_feature 1..4305: note = derived and/or modified CDS sequence (opt11) from ANADV(EIV-23263Tyum)__KT313760.1__GP
  source 1..4305: mol_type = other RNA
atgttcctgatcctcgtgctgctgatccccttctacatcaccgccaccccggtcacgacccgctgcttccacggcgggcaactcatcgccgagagcaagtccctgaccgcgatcagcgagttctgcctgaaggacgatgtgtccaccgtcaagagcgagatcacttacctcaagaacgacaccggcatcttcgcccactccaaggtgctgcggaactggatcatcaaggactggaaaaactgcaatcccgtgcccaccgccgggggcagcatcaacgtgatcgaggtcaacgccgacctgtccctcagcaccaagacgtacgtgtgctccagagactgcaccatcaccgtggacaaggaggacgcccagatcatcttccagaccgacaagctgaaccacttcgaggtcagcgggacgaccctgagcagcggctggttcaagaccaaggcgtccgtgaccctcgaccggacgtgcgagcacatcaaagtgacctgcggcaagaaaaccctgcagttccacgcctgtttcaagcaccacatgagctgtatcaggttcttccacaacaccatcctgcccgggacgatggccgtctccatctgccagaacatcgagctcatcatcatcaccagcctgaccctgatcatcttcatcctcatggtgatcctgaccaagacctacatctgctacgtgcttatgccgctgttcatgcccgtcgcctacctgtacggctgggcgtacaaccggtcctgtaagaagtgcagctgctgcgggctggcctaccaccccttcaccaactgcggctcccactgcgtgtgcgggttgaagttcgaggccagcgaccgcatgcggatccaccgcgaaagcggcctgtgccagggctacaagtccctgcgggtggcccgcctcctgtgcaagagcaaggggtccagcctgatcatctccatcctcctgagcgtcctgatcctctccttcgtaacccccatcgagggcaccctgacgaactacccggagagcaagaagtactccctggaggagatcgccgacgtgatcgaggggttcatcgcggagcggggcatcaaggagtacatcgtactctacaccagcatcttcggcgccctgctgctcctgatcgccctgatcatcaccgtgagtttaaacagaatcaccgagtacctgacgaacctgaacgttatctactgtcacgagtgctccatgtaccactccaagaagaacatcaagtacattggggacttcaccaacaagtgcggcttctgcacgtgtggggagctcgaggaccaggagggcctgaacatgcacaaggtcagcaagaagtgcatctaccggtaccagctgacctggtccaaggtgatcatgacaatcctcgtctgcctgctgatcgcccagaacaccgtgctgatcgtggccgcgaacgacgactgctgggccaagcagagcctcgagatcgagtgcgtcgggcccctgcagcaggtcgacgcctgcgaggacaagtccagccgctcctacaacggcgaggcccggaagctggtgggcaccagcaaggtgaccgagctcgacgccggccaagtgaacctgctggggcagaccatcgagagcgcgatcatcgccatccgcaagcagcggacgtacgccaccatgcacttcctcgaatccgtgttcctggggcgccactgcgactactacaaggtcttcgagcacaacagcggctactcccaggccaagtggcggctgctcgccaagaccaaccacttcgacatctgcagccgccactccacccaccacttctgtcggtgcatgagcgacgggacgaagtgcgagaacggcaactgggacttcgccggcgagatgaataccacctaccactccaagcgagacttcttcaagcacgactttaagctgttctgcaccctgctcgagaacgccttccccgggacgaccgagagcctgtactaccagttgctctccaagaggaacaccaccggcgccagcaaactgctggggaagctcatcacgaagttcggcaacaacaacctgttcgtggggatctggaagttcggacagttcctgctctccctgccctacgtgaacaacaccgagctgagcgccctccagtccagcaagatcctggagtccccggagcccctgctccggtcggcgtccggccgccaggagagcctgagctccgccacccccggggaggccagcaaggagtgccggaacgcgaaaaagatctcctgcataagcccccgcttcggcgtcccgatggagaatctgaccgcctgcggggagtcacccaactacaagatcttcaagacgcccacccggatctacaagagcaacaacaagggcgagatctggtgcgcgggcgacgtgcactgcttccaggagttcacccccatcctccaggaggtggtcgacaagctgaagaagatgacctgcttcctcacggagccggaagccgaggaggacgccttctccatcgccatcgccatgtgcaagattctcgacaagggggtgtgcaccatcaatagcgagaggtggaacatcatcaagtgcgactccggcctaatgtactacacggaccagcgggacggacaggacaccggcaacgacttcggggagtattgcatcagccacaactgcaagacggagcgcttccccatcaacccctccatcatcagcgactgcatctgggagtaccacagtcgcaagagccggtacatctccaccctgaacctcgagagcctggaggagttcaagcgcgcgatctccgagaagctgtcacacaccctcgtggtctaccagttcaagcccacctccaacctgccgcacatgaagcccgtgtacaagtacatcacggcccagggggtggagaacagcgacggtatcgacagcgccttcatcaccgcttccatgcccgccctgagcgggacctccatcggctacaacgtcatgagcaaggacaacttccccctcttcgacatcatcatcttcatcaagtccgcggtgatcaagaccacgtacaaccacatttacgacaccgggccaaccataggcatcaacgtgatgcacgacgagcattgcaccggacagtgccccatcgagatcccccacaaggagaactggctgacgttcagccaagagcgcacctcccggtggggctgcgaggagttcggctgcctggccattaacaccgggtgcgtcttcggcagctgccaggacatcatccgcccggaaaccaaggtgtaccggaaggccatcgaggagtccgtgctcctgaccgtctgcgtgacctaccccgggaacactttctgcaccgagatcaacgccatcgagccgaagatcaccgacgagctggagctccaattcaagaccgtggacaccaagaccctgcccaacctgctcgcggtccagaaccacaagctgtacagcggccagatcaacgacctggggtccttcgcccagggctgcggcaacatccagaagaccaacctcagcgtgatcgggacgggcaccgccaagttcgactacatttgccacggggcctcccgcaaggacatcgtggtccggcgctgctacaacaacaactacgagagctgcaagctgctgaaggaggagccgtccctcatcttcagcgacaaccacgagaccatcgaagtggccaacatccggcacctcctgggcgagctccagttcaagctgatgctgggagacctccgctacaagtctttcgcggagaaccccgagctggagatcgaggctcgctgcgtgggctgccccagctgcttctccagctacagctgcaatttccggatctccagctccatcgacaccgtctgcgcgatcgacggcccctgtacgattttccacaaccgcctgatcatcagctccaccaagcaggactacgggatcaagatgagctgcaaggagaagccgaaccccgtggagaagttcaacatctgcaagcgggtgtactccgtcctcttcaccaccatcgacaagaacgacaagatcgagatcaacacgggcgaccagaccagcttcatccaggagaaggacgaccgctgcaagacctggctgtgcagagtgcgcgacgaagggatctctgtgatcttcgagcccatcaaggccttctttggcagctacttctccatcgccttctacgtcgtgatcggcatcatcgcgctgttcatcatcatatacatattcctccccatggggttcaagctgaaggacatactgaagaaaaacgagctcctgtacctgcaggagatgaagtacaagtga

SEQ ID NO: 15805 - RNA, 4305 nt, synthetic construct
  misc_feature 1..4305: note = derived and/or modified CDS sequence (opt11) from BATV(804992)__FJ436801.1__GP
  source 1..4305: mol_type = other RNA
atgctgctcctgctggtgctcctgatcccctgctgcgtctcagcctccccggtgatcacccgctgcttccacggcgggcagctgatcgccgagcgaaagagccaggcggccatctccgagttctgcctcaaggacgacgtgagcaccatcaagtccgagattatctacgagaagaacgacacgggcctattcgcccacaataaggtcctgcgcaactggattatcaaggactggaagaactgcaaccccgtgcccaccgccgggggcagcatcaacgtgatcgaggtcaacaccgacctctccctgaccacgaagacttacgtgtgcagccgggactgcaccatcaccgtggacaaggaggacgcccagatcatcttccagacggagaagctgaaccacttcgaggtctccgggaccaccctcagctccggctggttcaagaccaaggcgagcgtgacgctggaccggacctgcgagcacatcaaggtgacctgcggcaagaagaccctgcagttccacgcctgcttcaagcaccacatgtcctgcatccggttcttccacgggacgatcctccccggcaccatggccacctctatctgccagaacatcgagctgatcatcatcatctccctgaccctcatcatcttcattctcatggtcattctgacgaagacctacatctgctacctcctgatgccgctgttcatgcccatcgcctacttctacgggtggagctacaacaagtcctgcaagaagtgcccctgttgcggcctcgcgtaccaccccttcaccaactgcgggagccactgcgtgtgcggcctgaagttcgaggcctccgaccgcatgcggatccaccgcgagagcggcctgtgccaggggtacaagagtctccgggtggcccgcctgctgtgcaagtccaagggcagctccttaatcatcagcatcctgctgtccatgctcatcctgagcttcgtcaccccgatcgaggggacgctgaccaactaccccgagtcccggaagtacgacctcgaggagatcgccgacgtgctggagggcttcgtggtcgagaagggcattaaggagtacgtggtgttttacaccagcatcttcggtgccctgttcctcctgatggcgctgatagtcatcatcgcactcaaccgcgtgaccgagtacctgacgaacatcaacgtgctgtactgccacgagtgctccatgtaccacagcaagaagaacatcaagtacatcggcgacttcaccaacaaatgcgggttctgcacgtgcggcgagcttgaagaccaggaggggctaaagatccacaaggtctcccggaagtgcatctacaagtaccagctgacctggagtaaggtgatcatgatgatcctcgtctgcctgctgatcgcccagaacaccatactaatcgtggccgcctccgacgactgctggaccaaaaagtccctcgagatggagtgcatcggccccctgcagcaagtcgatacgtgcgatgacaagacctcccgcagctactccggcgaggcgaagaagctggtgcgggccagcaagatctccgacctcgacgccgcccaggtggggctgctgggcagcaccatcgagtcagccatcgcgtccatccgccggcagcgcacctacagcaccatgcacctcctggagtccgtgttcctggggaagcactgcgactactacaaggtcttcgagcacaacagcggctactcccaggccaagtggcgtctcaccgccaagacacaccacttcgacatctgcagtcgccactccacgcaccacttctgccggtgcatctctgacgggaccaagtgccagaacggcgactgggacttcgccggcgagatgaactccatctaccagagcaagaaggacttcttcaagcacgacttcaagctgttctgcaccctggtggagaacgcctttcccgggaccacggagtccctcttctacgagatgctgagcaagaaaaacaccaccggcatcaccaagctgctcgacaaactgacgaagaagttcggcaacaacaacatgttcgtgggcatctggaagttcgggcagtacttaatgtccctcccgtacgtcaatgagaccagcctgtcccccatccagctggcgaaggtgctcgaggtgaccgaccaacaccaccgcagcgtctccggccgccaggagagcctggccagcgccacccccggctccaagagctccgagtgcgaccacgccaagaaggtgagctgcatcagcccccggttcggggcgccgatggagggcctgatggcctgcgggaacagccccaactacaagatctacaagacgcccgccaagctctacaagtccaacaacaagggcgaggtgtggtgcagcggcgacgtccactgcttccaggagctgacccccgcctcccaggagagcgtggaccgcatcaagcagatgacctgcttcctgaccgagccggaggtgaacgacgacgtcttctccatcgccatcgcgatgtgcaaggtgcaggacaagggggtgtgcacgatcaacgaggaccggtggaacatcatcaagtgcgatagcggcctcatctactacaccgaccagagggaggggcaggacaccggcaacgactttggggagtactgtctgtcccacagctgcagaatcgagcgcttccccatcaaccccgcgatcatctccgactgcctgtgggagtaccacagccggaagtccaagtacatcaccagcctcgacctggagtccctggaggagttcaagcgcgccatcagcgagaagctcagccacacgctggtcgtctacaacttcaagcccaccgccaacctgccgcacatcaagcccgtgtataagtacatcaccgtccagggcgtggagaactccgacggcgtggacagcgcctacatcaccgcgtccatgcccgcattaagcgggacgtcgatcggctacaacatcatgagccgggacaacttccccctgttcgacatcatcatcttcatcaagtccgccatcatcaaggccacctacaaccacatctacgacaccgggcccaccatcggcatcaacgtcatgcacgacgagcactgcacaggccagtgtcccaccgacatcccccacaaggagaactggatcaccttcgcccaggagcgcaccagccggtggggctgcgaggagttcggctgcctggcggtgaacacggggtgcgtgttcggatcctgccaggatatcatccgcccggagaccaaggtctaccggaaggccgtggaggagagcgtgctcctgaccgtctgcatcacttaccccgggaagacgttctgcaccgagatcaacgccatcgagcccaaaatcaccgacgagctggagctccagtttaagacagtggacaccaagacgctgcccaacatcctggctgtgcagaaccacaagctctactccggccagatcaacgacctgggtagcttctcccagggctgcggcaacatccagaagaccaacagctccataatcgggactggcaccgcgaagttcgactacgtctgccacggggccagccgaaaggacatcatcgtgcggcgctgctacaacaacaactacgagagttgcaagctgctcaaggaggaacagagcctgatgttcgccgacaaccatgagaccatcgacgtggccaacgtccgtcacctcctgggcgacctgcagttcaagctgatgctcggggacctgcgctataagtccttcgccgagaatccggacctggagatcgaggccaagtgcgtgggctgccccagctgcttcaccagctactcctgcagcttcaagatcgtgtccaacatcgacaccgtctgcagcatcgagggcccatgcaccacgttccacaaccggctcatgatcacctccacaaagcaggactacgggatcaagatgagctgcaagaccaagcccggcctgacggaagagttccagatttgcaagaagacctacaccgtgctgttcgccaccgtggagaagaacgacaagatcgagatctccacgggggaccagaccagcttcatccaagagcgcgacgaccgctgcaagacctggctctgccgggtccgcgacgagggcatctccgtgatcttcgagccgatccgggccttcttcgggagctacttctccatagccttctacatcgtgatcgggatcatcgtcctgttcctggtgatctacatcttcctccccatgatgtttaagctgcgtgacgtgctgaaacggaacgagtacttatacctacaagagatcaagcacaagtga

SEQ ID NO: 15806 - RNA, 4305 nt, synthetic construct; identical to SEQ ID NO: 12520
  misc_feature 1..4305: note = derived and/or modified CDS sequence (opt11) from BATV(8627-11)__FJ436799.1__GP
  source 1..4305: mol_type = other RNA

SEQ ID NO: 15807 - RNA, 4305 nt, synthetic construct; identical to SEQ ID NO: 12521
  misc_feature 1..4305: note = derived and/or modified CDS sequence (opt11) from BATV(Chittoor/IG-20217)__JX846599.1__GP
  source 1..4305: mol_type = other RNA

SEQ ID NO: 15808 - RNA, 4305 nt, synthetic construct; identical to SEQ ID NO: 12522
  misc_feature 1..4305: note = derived and/or modified CDS sequence (opt11) from BATV(41.3)__KM507322.1__GP
  source 1..4305: mol_type = other RNA

SEQ ID NO: 15809 - RNA, 4305 nt, synthetic construct; identical to SEQ ID NO: 12523
  misc_feature 1..4305: note = derived and/or modified CDS sequence (opt11) from BATV(EIV-1217Astr)__KT313699.1__GP
  source 1..4305: mol_type = other RNA

SEQ ID NO: 15810 - RNA, 4305 nt, synthetic construct; identical to SEQ ID NO: 12524
  misc_feature 1..4305: note = derived and/or modified CDS sequence (opt11) from BATV(EIV-12497Bl)__KT313692.1__GP
  source 1..4305: mol_type = other RNA

SEQ ID NO: 15811 - RNA, 4305 nt, synthetic construct; identical to SEQ ID NO: 12525
  misc_feature 1..4305: note = derived and/or modified CDS sequence (opt11) from BATV(EIV-12845Ms)__KT313690.1__GP
  source 1..4305: mol_type = other RNA

SEQ ID NO: 15812 - RNA, 4305 nt, synthetic construct; identical to SEQ ID NO: 12526
  misc_feature 1..4305: note = derived and/or modified CDS sequence (opt11) from BATV(EIV-2077Astr)__KT313702.1__GP
  source 1..4305: mol_type = other RNA

SEQ ID NO: 15813 - RNA, 4305 nt, synthetic construct; identical to SEQ ID NO: 12527
  misc_feature 1..4305: note = derived and/or modified CDS sequence (opt11) from BATV(Italy-2009)__KC168047.1__GP
  source 1..4305: mol_type = other RNA

SEQ ID NO: 15814 - RNA, 4305 nt, synthetic construct; identical to SEQ ID NO: 12528
  misc_feature 1..4305: note = derived and/or modified CDS sequence (opt11) from BATV(MM2222)__AB257763.1__GP
  source 1..4305: mol_type = other RNA

SEQ ID NO: 15815 - RNA, 4305 nt, synthetic construct; identical to SEQ ID NO: 12529
  misc_feature 1..4305: note = derived and/or modified CDS sequence (opt11) from BATV(MM2222)__AY772534.1__GP
  source 1..4305: mol_type = other RNA

SEQ ID NO: 15816 - RNA, 4305 nt, synthetic construct; identical to SEQ ID NO: 12530
  misc_feature 1..4305: note = derived and/or modified CDS sequence (opt11) from BATV(MM2222)__JX846596.1__GP
  source 1..4305: mol_type = other RNA

SEQ ID NO: 15817 - RNA, 4305 nt, synthetic construct; identical to SEQ ID NO: 12531
  misc_feature 1..4305: note = derived and/or modified CDS sequence (opt11) from BATV(MS50)__JX846605.1__GP
  source 1..4305: mol_type = other RNA

SEQ ID NO: 15818 - RNA, 4305 nt, synthetic construct; identical to SEQ ID NO: 12532
  misc_feature 1..4305: note = derived and/or modified CDS sequence (opt11) from BATV(NM/12)__KJ187039.1__GP
  source 1..4305: mol_type = other RNA

SEQ ID NO: 15819 - RNA, 4305 nt, synthetic construct; identical to SEQ ID NO: 12533
  misc_feature 1..4305: note = derived and/or modified CDS sequence (opt11) from BATV(ON-1/E/94)__AB257764.1__GP
  source 1..4305: mol_type = other RNA

SEQ ID NO: 15820 - RNA, 4305 nt, synthetic construct
  misc_feature 1..4305: note = derived and/or modified CDS sequence (opt11) from BATV(ON-7/B/01)__AB257765.1__GP
  source 1..4305: mol_type = other RNA
atgctgctgctgctggtcctcctgatcccctgctgcgtcagcgcctccccggtgatcaccagatgcttccacggcgggcagctgatcgccgaacgtaagagccaggcggccatctccgagttctgtctcaaggacgacgtgagcaccatcaagtccgagatcatttacgaaaagaacgacacgggcctgttcgcccacaacaaggtcctgcgcaactggatcatcaaggactggaagaactgcaacccagtgcccaccgccgggggcagcatcaacgtgatcgaggtcaataccgacctctccctgaccacgaagacctacgtgtgtagccgggactgcaccatcaccgtggacaaggaagatgcccagatcatctttcagacggagaagctgaaccacttcgaggtctccgggaccaccttaagctccggctggttcaagaccaaggcgagcgtgacgctggaccggacctgcgagcacatcaaggtgacctgcggcaaaaagacactgcagttccacgcctgcttcaagcaccacatgtcctgcatccggtttttccacgggacgatcctccccggcaccatggccacctccatctgccagaacatcgagctgatcatcatcatctccctgaccctcatcatcttcatcctgatggtcatcctaacgaagacctacatctgctacctgctgatgcctctgttcatgcccatcgcctacttctatggatggagctacaacaagtcctgcaagaagtgcccctgctgcggcctcgcgtaccaccccttcacgaactgcgggagccactgcgtttgcggcctgaagttcgaggcctccgaccgcatgcggatccaccgcgagagcggcctgtgccaggggtacaagagcctccgggtggcccgcctactgtgcaagtccaagggcagctccctcatcatcagcatcctgctgtccatgttgatcctgagcttcgtcacccccatcgaggggacgctgaccaactaccccgagtcccggaagtacgatctcgaagagatcgccgacgtccttgagggattcatcgtggagaaaggcatcaaggagtacgtcgtgttctacaccagcatcttcggggccctgttcctactgatcgcgctgatcgtaatcattgccctcaaccgcgtcaccgagtacctcacgaacatcaacgtgctatactgccacgagtgctccatgtaccacagcaagaagaacatcaagtacatcggcgactttaccaacaagtgcgggttctgcacgtgcggcgagctcgaggatcaggagggactcaagatccacaaggtgtcccggaaatgcatatacaagtaccagctgacgtggtcgaaggtcatcatgatgatcctcgtgtgcctgctgattgcccagaatacaatcctgatcgtcgccgcatccgatgactgctggaccaagaagtccctcgagatgggctgcatcgggcccctgcagcaggtcgacacgtgcgacgacaaggcgtcccgcagctactcgggggaggccaagaagctggtaagagccagtaagatctccgacctcgacgccgcccaggtgggccaactggggagcaccattgagagcgcgatcgcctccatccgccggcaacgcacctacagcaccatgcacctcctggagtccgtgttcctgggcaagcactgcgactactacaaggtgtttgagcacaatagcgggtactcccaggcgaagtggcggctgaccgccaagacgcaccacttcgacatctgtagccgccactccacccaccacttctgccggtgcatcagcgacggcacgaaatgccagaacggcgactgggatttcgctggggagatgaactccacatatcaaagcaagcgcgacttcttcgagcacgacttcaatctcttctgtaccctcatcgagaacgcgttccctggcaccacggagtccctattctacgagatgctcagcaagaagaacaccaccgggatcaccaagctgctggacaagctcacgaagaagttcggcaacaacaacatgttcgtcgggatttggaagttcggccagtacctgatctccctgccgtacgtgaacgagaccagcctctcccccacccagctggccaaggtgctggtcgtgaccgaccagcaccatcgcagcatctccgggcggcaggagagcttagccagcgccacgcccggatccaagtcctccgagtgcgggcacgctaagaaagtgagctgcatcagcccccgcttcggggtcccgatggagggcctgatggcctgcggcagctcccccaattacaagatctacaagacccccgccaagctgtacaagagcaacaacaagggggaagtgtggtgctcaggcgacgtgcactgcttccaggacctcatccccgccagccaggagtccgtcgaccggattaagcagatgacttgcttcttgacggagccggaggtgaacgacgacgtgttcagcatcgccatcgcgatgtgcaaggtccaggacaagggggtgtgcacaatcaacgaggaccgctggaacttgatcaagtgcgactccggcctcatctactacacagaccagcgggaggggcaggacaccggcaacgacttcggcgagtactgcctgagccacaactgcaagatggagcgcttccccatcaaccccgccatcatctccgactgcctgtgggagtaccactcgagaaagtccaagtacatcaccagcctcgacctggagtccctggaggagttcaagcgcgccatcagcgagaagctcagccacacgctggtggtctacaacttcaagcccaccgccaacctgccgcatatcaaacccgtttacaagtacatcaccgtgcagggggtcgagaatagcgacggcgtggacagcgcctacatcaccgcgtccatgcccgccctcagcgggacgtccatcggctacaacatcatgagccgggacaacttccccctgttcgacataatcatcttcattaagtcagccatcatcaaggcaacctacaaccacatctacgacaccgggccgaccatcggcatcaacgtcatgcacgacgagcactgcacgggccagtgccccaccgacatcccccacaaggagaactggatcaccttcgcccaggagcgcacctccaggtgggggtgcgaggagtttggctgcctggcggtgaacacgggatgcgtgttcggctcctgccaggatattatccgcccggagaccaaggtgtaccggaaggccgtcgaggagagcgtgctcctgaccgtatgcatcacctaccccgggaagacgttctgcaccgagatcaacgccatcgagcccaagatcaccgacgagcttgaactccagttcaagaccgtcgacaccaagacgctgcccaacatcttggccgtacagaaccacaagctctactccggccagattaacgacctgggcagcttctcccaagggtgcgggaacattcagaaaaccaatctgagcatcatcgggaccggcaccgcgaagttcgactatgtgtgtcacggggcctcccgcaaagacatcatcgtccggcgatgctacaacaacaactacgagagctgcaagctcctgaaggaggagcagtccctgatgttcgccgacaaccacgagacgatcgacgtggcaaacgtgcggcatctcctgggcgacctgcagtttaagctcatgcttggcgacctgcgctacaagagcttcgccgagaacccggacctcgagatcgaggctaagtgcgtcggctgcccctcctgcttcaccagctacagctgcaacttcaagatcgtgtccaacatcgacaccgtgtgcagcatcgagggcccctgcaccacgtttcataaccgcctgatgatcacttccgccaagcaggactacgggatcaagatgtcctgcaagaccaagcccggcctgaccgaggagttccaaatctgcaagaagacgtacaccgtcctctttgccaccgtggagaagaacgacgagatcgagatctctaccggcgaccagacgagcttcatccaggagcgcgatgaccgttgcaagacctggctgtgccgcgtgcgcgacgaggggatctccgtaatcttcgagccgatccgggccttcttcggcagctacttctcaatcgccttctacatcgtgatcgggatcatcgtgctgtttctcgtcatctacatcttcctgcccatggtgttcaagctgagagacgtgctcaagcgaaacgagtacctgtacctgcaagaaattaagcacaagtga

SEQ ID NO: 15821 - RNA, 4305 nt, synthetic construct; identical to SEQ ID NO: 12535
  misc_feature 1..4305: note = derived and/or modified CDS sequence (opt11) from BATV(UgMP-6830)__DQ436460.1__GP
  source 1..4305: mol_type = other RNA

SEQ ID NO: 15822 - RNA, 4305 nt, synthetic construct; identical to SEQ ID NO: 12536
  misc_feature 1..4305: note = derived and/or modified CDS sequence (opt11) from BATV(ZJ2014)__KU746870.1__GP
  source 1..4305: mol_type = other RNA

SEQ ID NO: 15823 - RNA, 4305 nt, synthetic construct; identical to SEQ ID NO: 12537
  misc_feature 1..4305: note = derived and/or modified CDS sequence (opt11) from CVV__AF082576.1__GP
  source 1..4305: mol_type = other RNA

SEQ ID NO: 15824 - RNA, 4305 nt, synthetic construct; identical to SEQ ID NO: 12538
  misc_feature 1..4305: note = derived and/or modified CDS sequence (opt11) from CVV(Montgomery County/VA/2015 4b)__KX583998.1__GP
  source 1..4305: mol_type = other RNA

SEQ ID NO: 15825 - RNA, 4305 nt, synthetic construct; identical to SEQ ID NO: 12539
  misc_feature 1..4305: note = derived and/or modified CDS sequence (opt11) from CVV(Montgomery County/VA/2015 K)__KX583999.1__GP
  source 1..4305: mol_type = other RNA

SEQ ID NO: 15826 - RNA, 4305 nt, synthetic construct; identical to SEQ ID NO: 12540
  misc_feature 1..4305: note = derived and/or modified CDS sequence (opt11) from CVV(1156)__EU583730.1__GP
  source 1..4305: mol_type = other RNA

SEQ ID NO: 15827 - RNA, 4305 nt, synthetic construct; identical to SEQ ID NO: 12541
  misc_feature 1..4305: note = derived and/or modified CDS sequence (opt11) from CVV(6V633)__KX100134.1__GP
  source 1..4305: mol_type = other RNA

SEQ ID NO: 15828 - RNA, 4305 nt, synthetic construct; identical to SEQ ID NO: 12542
  misc_feature 1..4305: note = derived and/or modified CDS sequence (opt11) from CVV(807270)__AF186243.1__GP
  source 1..4305: mol_type = other RNA

SEQ ID NO: 15829 - RNA, 4305 nt, synthetic construct; identical to SEQ ID NO: 12543
  misc_feature 1..4305: note = derived and/or modified CDS sequence (opt11) from CVV(856 clone 1)__EU583732.1__GP
  source 1..4305: mol_type = other RNA

SEQ ID NO: 15830 - RNA, 4305 nt, synthetic construct; identical to SEQ ID NO: 12544
  misc_feature 1..4305: note = derived and/or modified CDS sequence (opt11) from CVV(856 clone 3)__EU583731.1__GP
  source 1..4305: mol_type = other RNA

SEQ ID NO: 15831 - RNA, 4305 nt, synthetic construct; identical to SEQ ID NO: 12545
  misc_feature 1..4305: note = derived and/or modified CDS sequence (opt11) from CVV(CK102)__AF186242.1__GP
  source 1..4305: mol_type = other RNA

SEQ ID NO: 15832 - RNA, 4305 nt, synthetic construct; identical to SEQ ID NO: 12546
  misc_feature 1..4305: note = derived and/or modified CDS sequence (opt11) from CVV(CK-102)__KX100146.1__GP
  source 1..4305: mol_type = other RNA

SEQ ID NO: 15833 - RNA, 4305 nt, synthetic construct; identical to SEQ ID NO: 12547
  misc_feature 1..4305: note = derived and/or modified CDS sequence (opt11) from CVV(MI80-1-450)__AF186241.1__GP
  source 1..4305: mol_type = other RNA

SEQ ID NO: 15834 - RNA, 4305 nt, synthetic construct; identical to SEQ ID NO: 12548
  misc_feature 1..4305: note = derived and/or modified CDS sequence (opt11) from CVV(MI80-1-450)__KX100149.1__GP
  source 1..4305: mol_type = other RNA

SEQ ID NO: 15835 - RNA, 4305 nt, synthetic construct; identical to SEQ ID NO: 12549
  misc_feature 1..4305: note = derived and/or modified CDS sequence (opt11) from CVV(MNZ-92011)__KC436107.1__GP
  source 1..4305: mol_type = other RNA

SEQ ID NO: 15836 - RNA, 4305 nt, synthetic construct; identical to SEQ ID NO: 12550
  misc_feature 1..4305: note = derived and/or modified CDS sequence (opt11) from CVV(MPB1-1551)__KX100143.1__GP
  source 1..4305: mol_type = other RNA

SEQ ID NO: 15837 - RNA, 4305 nt, synthetic construct; identical to SEQ ID NO: 12551
  misc_feature 1..4305: note = derived and/or modified CDS sequence (opt11) from CVV(W308-67)__KX100140.1__GP
  source 1..4305: mol_type = other RNA

SEQ ID NO: 15838 - RNA, 4305 nt, synthetic construct; identical to SEQ ID NO: 12552
  misc_feature 1..4305: note = derived and/or modified CDS sequence (opt11) from CVV(W728-67)__KX100137.1__GP
  source 1..4305: mol_type = other RNA

SEQ ID NO: 15839 - RNA, 4305 nt, synthetic construct
  misc_feature 1..4305: note = derived and/or modified CDS sequence (opt11) from CVV(WI-03BS7669)__KX100152.1__GP
  source 1..4305: mol_type = other RNA
atgctgttcctcctgatcctggccttcctcggcttcagcacttccaatcccatagccacccgctgcttccatggcggccaactcatcgctgaaagcaagtccgccacgagcatctccgagttctgcctgaaggacgacgtgagcatgctcaagagcgaggtagtctacatcaagaacgacaccgggctgttcggccacaacaaggtgttccggagctggaccatcaaagactggaagctgtgcaaccctatccccaccgccgggggcacgatcaacgtcatcgaggtgaacaaggacctctccctgatgaccaagacctacatttgctcgcgcgactgcaccatcacgatcgacaaagaggaggctcagatcatcttccagaccgataagctgaaccacttcgaggtctccggcaccacgctcagctccgggtggttcaagagcaaagcctccgtcacgctggaccggacgtgcgagcacgtgaaggtgacctgtggcaagaagtccctgcagttccacgcgtgcttcaagcaccacatgagctgcgtccgcttcttccacaacactatcctccccgggaacatgatcacgagcatgtgccaaaacatcgagctgattatcatcctgggcctcaccctcgccatcttcatccttatggtgatcctcaccaagacctacatctgctacctcctgatgcccatcttcatgccgatcgcctacctctacgggtgggcctacaacaagtcctgcaagaaatgcaactgctgcggcctggcgtaccaccccttcacgaactgcggcagccactgcgtgtgcgggctgaagttcgaggcctccgaccggatgagaatccaccgggagtccggcctctgccaggggtacaagtcactgcgcatcgcccggctgttatgcaagtccaagggcagctccctcgtcatcagcggcctgttatccatgctgatccttagcttcgtgacccccatcgaaggcaccattacctcctaccccgagagcagaaaatacacgctcgaggagatcaccgatgttgtcgagggcctggtgtccgagcagaatatcaaggagtacatcgtcttctacaccagcctgttcggctccctcatcctgctgctcgccttcatcatgagcatcaccctgtcgaagatcacgagcatcctggccaagcggaacgtcatctactgcgaggagtgttccatgtaccacagcaagcgcgggatcaagtacaacggggacttcaccaacaagtgcggcttctgcacgtgcaacgagcaggaggacaccgagggcctcgtgatccacaaggtgtccaagcggtgcacctacaaataccagctgaagtgggcgaaggtcctgatgataaccctcgtgcttctgctgatcgcccaaaacaccatccttatcgttgccgccgagaccgactgctggatcaagaagtccctggacattgactgcatcgggccgatgctggacatcggcagctgcacgaacaagaacacccgcagctacgacacagaggcccaaaaacttgtctcccagtcaaagatcagccagctggacgcggaccaggtgtccctgctcgggaacagcatcgactccgccatcaaggccatacgggcccagaagacctacagcacaatgcacctcctagagactatcttcctgatgaagaactgcgactactacacctccttcaaccacaactccggctactcccaggccaagtggagactgatcgcgaagaccgggcacttcgacatctgcagcaggcactccacccaccacttctgccgctgcatcaacgacggcacgaagtgccagaacggcgactgggacttcgcgggggagatgaacgagacctacaacagcaagaacgacttctactcccacgacctgaacctcttctacaccatcttcgagaacgcattccccggcaccacggagagcctgttctaccagctgatccagaagaagaacaccaccggcgcttccaaggtcctcggcaagctgatcaccaagtacgggaataacaacatgttcgtgggtgtgtggaagttcggccagtacctgctcacgctgccctacatcaacaataccgagctgagccagaaccggcgcctcaccatcctgaccacgcaggagctgctcagccggtcccacagcgggcgccaggagtccatgagcaacgccatccagggctccatcaccaaggagtgtcacaacgcgaagggggtgggctgcatcagcccacgcttcggcattccgatagggaacctgaccgcatgcggcgactcccccaactacaaaatctacaagacccccgagaagctgtacaagagcaacaacaagggggaagtgtggtgctccaatgacgtgcactgcctcaacgactttgagcccgccgatgaggaggtcgtgaataagatcaagaagttaacgtgcttcctgactgacgtgagcgtcgaggtggacatattctccgtcgccgccagcacgtgcaagatggccgacaagggggtctgtaccgtgaacggggcgaagtggaacatcatcaagtgcgactccggcctctactacttcaccgaccaccgggagggccaggacaccgggaacgacttcggcgagtactgcatcagccactcttgcaacaccgagcgcttcccgataaaccccgacatcctgaaggactgcacctgggagttccacagccggaagtccaagtacatcagcacgatttccctggagagcctcgaggagttccgccgtgccatggccgagaagctgagccataccctgaccatctacaacttcaagcccaccgcgaacctcccccatatccgcccgacgtacaagttcatcaccgccaacggggtggaaaactccgacggcatcgagagcgcctacatcctgtcatcgatcccggccctcgggggcatctccgtcggctacaacgtgcagaccaaggacaacttccccctgctggacatcatcgtgttcatcaagagcgccgtcatccggaccacgtacaaccacatctacgacaccgggcccaccatcggcatcaacactcagcacgacgagcactgcaccgggccgtgccccgcggtggtgccccacaaggagaactggatgacgttctcccaagagcgaaccagccggtgggggtgcgaggagttcggttgcctggccatcaacaccggctgtgtcttcggctcctgccaggatatcatccacccggagaccaaagtgtatcgcaaggccgtggaggaggaggtcgtgctcacggtctgtatcaactttccggggaacaactactgcactgagatcaacgccatcgagcccaagatcaccgacgaaatcgagctgcagttcaagacggtcgacacgaagaccctccccaatctcctggccgtgcagaaccacaagctgtacagcggccagatcaacgacctcgggtccttctcccagggctgcgggaacgtgcagaagaccaaccacagcatcctgggcatgggcaccgtcaaattcgactacgtgtgccacggcgcgagccgcaaggacgtgatcgtccgccggtgctacaacaacaacttcgactcctgcaaattgctcaaggaggagacgagcctgatcttcgccgacaaccacgagaccctggaggtggcacacaccaagcacctcatcggtgagctgcagtttaagatcatgctgggggacatccgctacaagtccttcgccgaatctccggagctcgagatcgatgcgaagtgcgtgggctgcccctcctgcttcgagagctacagctgcaacttccagatagtcaccaacatcgacacggtgtgctccgtggaaggcccctgcactctgttccacaatcggatcatcatcagcgccaacaagcagtcctacggtctgaagatgagctgccagaccaagcccaaccagaacgaggagttcatcatctgcaaccgcaagtactccgtcctcttcaccacgatcgacaagaatgacaagatagaggtgaacaccggcgaccagaccagctacatctatgagaaggactcccggtgcaaaacctggctgtgccgcgtgcgggacgaggggattagcgtcctgtttgagccgctcaaagccttcttcggctcctacttcagcatcatcttctacgtggtggtcgggatcatcgtgctgttcctgatcatctacatcttcctgcccatgttcttcaagctgaaggacgtcctaaagcgcaacgagtacctctatctgcaggaactgaagcacaagtga

SEQ ID NO: 15840 - RNA, 4317 nt, synthetic construct; identical to SEQ ID NO: 12554
  misc_feature 1..4317: note = derived and/or modified CDS sequence (opt11) from CHLV(CHLV-Mex07)__JN808310.1__GP
  source 1..4317: mol_type = other RNA

SEQ ID NO: 15841 - RNA, 4305 nt, synthetic construct
  misc_feature 1..4305: note = derived and/or modified CDS sequence (opt11) from FSV(86MSP18)__KX100131.1__GP
  source 1..4305: mol_type = other RNA
atgctgagcctcctgatcctggccctcctgggcctgagcacctcaaatcccatcgccacccgctgcttccacgggggccagctcatcgcggagtccaagagcgcgacgtcaataagcgagttctgcctgaaggacgacgtgtccatgctcaagagcgaggtcatctacaccaagaacgacaccgggctgttcgggcacaacaaggtgttccgatcctggaccatcaaggactggaaactgtgcaacccgattcccacggccgggggcaccatcaacgtgatcgaggtcaacaaagacctgagcctcatgaccaagacctacatctgctcccgcgactgcacgatcaccatcgacaaggaggaggcccaaatcatcttccagaccgacaagctcaaccacttcgaggtgagcggcactacgctgtcaagcgggtggttcaagtccaaagccagcgtgaccctcgaccggacctgtgagcacgtgaaggtgacctgcggcaagaagtccctgcagtttcacgcgtgcttcaagcaccacatgagctgcgtgcgctttttccacaacacgatcctgcccgggaacatgatcacctccatgtgccagaacatagagttaatcatcatcctgggcctgaccctcgccatcttcatcctgatggtaatgataaccaagacgtacatctgctacctgctcatgcccatcttcatgccgatcgcctatctgtacggttgggcgtacaacaagagctgcaagaagtgcaactgctgcggcctggcgtaccaccccttcaccaactgcggcagccactgcgtgtgtgggctcaagttcgaggcctccgaccggatgcgcatacacagagagagcggcctgtgccaggggtacaagtccctgcgcatcgcccggctcctgtgcaagagcaagggctccagtctggtcatcagtggactcctgagcatgctgatcctctccttcgtcacccccatcgaagggaccataacgaactacccggacagccgcaagtataccctggaggagataaccgacgtggtggagggactgatatccgagcagaacatcaaggagtacatcgtcttctacaccagcctcttcgggtccctgatcctgctcctggccttcatcatgagcatcacgctttccaagatcaccagcatcttggcccgtcgcaacgtgatctactgcgaagagtgttccatgtaccacagcaagcggggcatcaagtacaacggggactttaccaacaagtgtggcttctgcacgtgcaacgagcaggaggacgcagagggcgtggttatccacaaggtgtccaagcgctgcacctacaagtaccagctgaagtgggccaaagtgcttatgatcacactcgtcctgctgctaatcgcacagaacacaatcctcatcgtggccgccgaaaccgactgctgggcgaagaagtccctggacatcaactgcatcggtccgatgctgaacatcggcagctgcacgaacaagaacaccaggagctacgacactgaagcccagaagctcgtgagccagtccaaggtcagccaactggacgccgaccaggcctccttgctcgggagcagtattgacagcgccataaaggcgatccgcgcccagaagacctaccccgccatgcacctcctggagaccatcttcctcatgaagaactgcgactactacacgtccttcaatcacaacagcgggtacagtcaggccaagtggcggctgatagccaagaccgggcacttcgacatctgcagccgccactccacccaccacttctgccggtgcatcaacgacggtaccaagtgccagaacggcgactgggacttcgcaggggagatgaacgagacgtacaactcaaagaacgacttctacctgcacgacctcaatctgttctataccatcttcgagaacgccttccccggcaccaccgagtccctgttctaccagcttatccagaagcgcaacaccatcggggccagcaaggtgctgggcaagctgatcaccaagtacggggacaacaacatgttcgtcggcgtgtggaagtttggccagtacctcctgactctcccctacatcaacaacaccgagctctcccagaatcggcgccagactatcttggccgcgcaggagctgagcagccgctcccacccgggtcggcaagagagcatgtccagcgccatccagggctccgtgaccaaggaatgccacaacgccaaggatgtcgggtgcatcagcccccgattcggaatccccatcggcaacctcaccgcctgcggggactcccccaactacaagatctacaagactccggagaagctgtacaagagcaataacaaaggcgaggtatggtgctccaacgacgtgcactgcctgaacgacttcgaacctgccgacgaggaggtcgtgaacaaggtgaagaagctgacctgcttcctcaccgacgtcagcgtgaagaccgacatcttctccgtggcggcaagcacgtgcaagatggccgacaagggggtctgcaccgttaacgacgccaagtggaacattatcaagtgcgactccggcctgtactacttcaccgaccaccgggagggtcaggacaccggcaacgacttcggcgagtactgtatcagccactcctgcaacaccgagcgcttccccatcaaccccgacatcctcaaggactgcacctgggagttccacagccggaaatccaagtacatctcaaccatctccctggagagcctggaggagtttcgccgggccatgaccgagaaactcagccacaccctgacgatctacaacttcaagccgaccgcgaacttgcctcacatccgccccacctacaagttcatcaccgcgaacggggtggagaactccgacggtatcgaatccgcctacatcctctccagcatcccggccctcgggggcatctccgtcgggtacaacgtgcaaacgaaagacaacttcccgctgctagacatcatcgtgttcgtcaagagcgccgtgatccggaccacctacaaccacatctacgacaccggccccacgatcggcatcaacacccagcacgacgagcactgcacgggcccctgccccgccgtggtaccgcacaaggagaactggatcaccttctcccaggagcgcacctcacggtggggctgcgaggagttcgggtgcctggccatcaacacaggctgcgtgttcgggtcctgccaggacatcatccaccccgagaccaaggtgtaccgcaaggctgtcgaagaggaggtggtcctgaccgtctgcatcaacttccccggaaacaactactgcaccgagatcaacgccatcgagccgaagatcacggatgagatcgaactccagttcaagaccgtcgacaccaagaccctgcccaacctactcgcggtgcaaaatcacaagctgtacagcggccagatcaacgacctagggtccttcagccaggggtgcgggaacgtccagaagacgaaccactccattctcggaatggggaccgccaagttcgactacgtgtgccacggtgccagccggaaggacgtgatagtccgccggtgctacaataacaacttcgactcctgcaagctgctgaaggaggagaccagcctcgtgttcgccgacaaccacgaaaccctggaggtggcccacacgaagcacctgatcggcgagctacagttcaagatcatgctgggggacatccgctacaagtccttcgcggagagccccgagttagagatcgacgccaaatgcgtcggctgcccctcctgcttcgagagctacagctgcaacttccaaatcgtgaccaacatcgacaccgtgtgctccgtcgaaggaccgtgcaccctcttccacaaccggatcattatcagcgcctccaagcagagctacggcctgaagatgtcctgtcagacgaagccaagccagaacgaggagttcatcatctgcaatcgcaagtattcagtgctgttcaccaccatcgacaagaacgacaagatcgaggtaaacaccggcgaccagactagctacatctacgagaaggactcccggtgcaagacctggctctgcaaggtccgcgacgaggggatcagcgtgctgttcgagcccctgaaggccttctttggatcctacttcagcatcatcttctatgttgtcgtggggatcatcgtgctgtttctggtcatctacatcttcctgcccatgttcttcaagctcaaggacgtgctgaagaagaacgagtacctgtacctccaggagctgaagcatcgctga

SEQ ID NO: 15842 - RNA, 4314 nt, synthetic construct; identical to SEQ ID NO: 12556
  misc_feature 1..4314: note = derived and/or modified CDS sequence (opt11) from GERV__M21951.1__GP
  source 1..4314: mol_type = other RNA

SEQ ID NO: 15843 - RNA, 4260 nt, synthetic construct; identical to SEQ ID NO: 12557
  misc_feature 1..4260: note = derived and/or modified CDS sequence (opt11) from IACOV(BeAn314206)__JN572066.1__GP
  source 1..4260: mol_type = other RNA

SEQ ID NO: 15844 - RNA, 4305 nt, synthetic construct; identical to SEQ ID NO: 12558
  misc_feature 1..4305: note = derived and/or modified CDS sequence (opt11) from ILEV(KO/2)__AY859372.1__GP
  source 1..4305: mol_type = other RNA

SEQ ID NO: 15845 - RNA, 4305 nt, synthetic construct; identical to SEQ ID NO: 12559
  misc_feature 1..4305: note = derived and/or modified CDS sequence (opt11) from ILEV(R5964)__KF234074.1__GP
  source 1..4305: mol_type = other RNA

SEQ ID NO: 15846 - RNA, 4305 nt, synthetic construct; identical to SEQ ID NO: 12560
  misc_feature 1..4305: note = derived and/or modified CDS sequence (opt11) from MAGV__AY286443.1__GP
  source 1..4305: mol_type = other RNA

SEQ ID NO: 15847 - RNA, 4305 nt, synthetic construct; identical to SEQ ID NO: 12561
  misc_feature 1..4305: note = derived and/or modified CDS sequence (opt11) from MAGV(ts8)__AY286444.1__GP
  source 1..4305: mol_type = other RNA

SEQ ID NO: 15848 - RNA, 4311 nt, synthetic construct; identical to SEQ ID NO: 12562
  misc_feature 1..4311: note = derived and/or modified CDS sequence (opt11) from MAGV(AG83-1746)__KX100113.1__GP
  source 1..4311: mol_type = other RNA

SEQ ID NO: 15849 - RNA, 4305 nt, synthetic construct
  misc_feature 1..4305: note = derived and/or modified CDS sequence (opt11) from MAGV(BeAr 7272)__KX100104.1__GP
  source 1..4305: mol_type = other RNA
atggagctgctcatcatcatcctgctgctcggcagcgccgcctccagccccatctccacccgctgcttccacggcgggcagctgatagcggagagcaagtccgccaccagcatctcggagttctgcctgaaggacgacgtgagcatgatcaaatcagaggttacgtacatcaagaacgacaccgggatctacgggcacaacaaagtgttccggagctggacaatcaaggactggaagctctgcaacccgatccccaccgccgggggctccatcaacgtgatcgaggtcaacagcgacctgtccctggccacgcgcgcctacgtgtgtagccgggactgcaccatcacaatcgacaaggaggacgcgcagatcatcttccagaccgacaagctcaaccacttcgaggtgtccggcacgaccctgagctccggctggttcaagaccaaggccagcgtcaccctggaccgcacgtgcgagcacatcaaggtgacctgcggcaaaaagtccctccagttccacgcctgcttcaaacaccacatgtcgtgcatccggttcttccaccacaccatcctgccggggaccatggtgagctccatgtgccagaacatcgagctgatcatcatcatcggcctcacgctggtcatcttcatcctgatggtgatcctcaccaagacctacatctgctacctgctgatgcccgtttttatgccagtcgcctacatctacgggtgggcgtacaacaagagctgcaagaagtgcaactgctgcggcctcgcctatcaccccttcaccaactgcggctcccactgcgtgtgcgggctgaagttcgaggccagcgaccgcatgcggttacaccgcgagtccggcctctgccaggggtacaagagcctgcggatcgcccgcatgctgtgcaagtccaagggcagctccctagtgattagcggactgctgtccatgctcctgctgagcttcatcacgcccatcgaggggaccttgaccaactaccccaacgagaagcagtacactctggaagagatcgccgacgtcgtggagggcatcatcacggagcagcacctgaaggagtacgtggtcttctacacctccctcttcgggggcctgatcctgctcctgaccctgatcctcagcatcaccatcaacaaggtgacggacctgctggcgtccaccaacgtgatctactgcgaggagtgcagcatgtaccactctaagaaggggatcaagtacaacggcgacttcaccaacaagtgcggcttctgcacgtgcagcgagcaggaggacgtcgagggggtgatcatccacaaggtgtcccggaagtgcacgtacaagtaccagctcaagtgggtccgcgtgatcatgatcatcctggccctcctcctgaccatacagaacaccgtcctgatcgtggccgccgaggtggactgctggaccaagaagtccatcgaaatcgactgcatcgggccgctgctcaacatcgggagctgcactgacaagagcagccggacctacgagaccgaggtcaacaagctggtgcgccagtccaaggtaacccacgccgacgccgagcagatcagcattctcggctccaccctcgacaatgccatcaaggccgtccggagccagaagacgtacgagaccatgcacttcctggagaccgtattcctgatgaagaactgcgattactacaactccttcgagcacaacagcggatactcccaaaccaagtggaggctcatcgccaagacgagccacttcgatatctgcagccggcacagcacgcaccacttctgccgctgcgtgaacgagggcaccaagtgccagaacggcgactgggacttcgccggggagatgaacgacacctacaactccaagaatgacttctacctgcacgacctggacctcttctacacgctgctggagaacgcgttccccggcaccaccgagagcctcttctaccagctgctgcagaagaagaacaccacgggggcctccaagctcctgggcaagctgatcaccaagtacgggaacaacaacatgtttgtcgagatctggaagttcggccagtacttactgaagctgccctacatcaacgacaccgagctcagcaccgaccggaagtccacgatcatcaagagccaacaggtcctgagccgctcccagaccggccggcaggagagcctgtccagcgccacccctgggaccgccacgaaggagtgctccaacgccaaggacatcggctgcatcagcccgcgcttcgggatacccatcggcaacctcaccgcgtgcggcgactcccccaactacaaggtgtacaagacccccgagaagatctacaagagcaacaaccgaggggaggtgtggtgttccgacgacgtgcactgcctgaccgacttcgagccggccgaagaggaggtggtcaacagaatcaagcagatgacgtgcttcttgaccgacgtgaccaccaagacggacgtgttcagcgtcgccatctccacgtgcaagatggtggacaagggcgtgtgcaccgtcaacgacgccaagtggaacatcctcaagtgcaacagcgggctgtactatttcaccgaccaccgcgacggccaggacaccgggaacgacttcggcgagtactgcatctcccacagctgcaacaccgagcggttccccatcaaccccgacgtgttgaaggactgcatctgggagtaccactcccgcaagagcaagtacatctccaccgtgagcctcgagtccctggacgagttccgtcgcgcgatgagcgacaagctgagccacaccctcatgatctacaacttcaagcccacggccaatctgccgcacatcaagcccacctacaagttcatcaccgccaacggcatcgagaactccgacgggatcgacagcgcatacatcctgtccagcatccccgccctcggcgggatgtccgtcggctacaacatccagaccaaggacaacttccccctgctggacatcatcgtgttcatcaaaagcgcgatcatcaagaccacatacaaccatatctacgacaccgggcctaccatcggcatcaacacacagcacgacgagcactgcactggcccctgccccaccctcatcccccacaaggagaactggctgaccttctcccaggagcggaccagccgctgggggtgcgaggagttcggctgcctagccatcaacacggggtgtgtgttcggctcctgccaggacatcatccacccggaggccaaggtctaccggaaggccatcgaggaggaggtggtgctcaccgtctgcatcaccttccccgggaacacctactgcacggagatcaacgccatcgagcccaagatcaccgacgagatcgagcttcagttcaagaccgtggacaccaagacgctgccgaacctcctgatggtgcagaaccacaagctgtattctggccagataaacgacctcggctccttcagccaggggtgcggcaacgtccagaagaccaaccagtccgtgatcggggcgggcaccgccaagttcgactacgtgtgccacggggccagcaggaaagacgtcatcgtgcgtcgctgctacaacaacaactacgagtcctgcaagctgctgaaggaggagaccagcctcattttcgccgacaaccacgagacgctggaggtggccaacaccaagcacctgatcggcgagctccagttcaagatcatgctgggcgacatccggtacaagtccttcgccgagagccccgagctggaggtcgacgccaagtgcgtggggtgcccctcctgcttcgagagctacagctgcaacttccagatcgtgaccaacatcgacaccgtctgctccgtagacgggccctgcaccctcttccacaaccgcctgatcatcagcgccaccaagcagtcctacgggttcaagatgagctgcccccggaagcccgagcccaccgaggagttccagatctgcaaccgcaagtacaacgtgctgttcaccacgatcgacaagaacgacaagatcgagatcaacaccggcgaccagacctcctacatctacgagaaggacaaccggtgcaagacctggctctgccgcgtccgggacgagggcatcagcgtgatcttcgagcccctgaaggccttcttcgggtcctacttcagcatcatcttctacgtggtcgtgggcatcatcgtgctgttcctcacaatctacatcttcctgccgatgtttttcaagctgcgcgacatcctcaagcgcaacgagtatctgtacctgcaggagctcaagcacaagtga

SEQ ID NO: 15850 - RNA, 4311 nt, synthetic construct
  misc_feature 1..4311: note = derived and/or modified CDS sequence (opt11) from MAGV(CbaAr 426)__KX100110.1__GP
  source 1..4311: mol_type = other RNA
atgaagatgatcctgctcatcatcatcctgtgtgtgaacctggccgccgcgaaccccgtcgccacccgctgcttccacggtgggcagctcatcgccgagacccggagcgccacgtccatcagcgagttctgcctgaaggacgacgtctccatgatcaagagcgagatcacctacaccaagaacgacaccggcatcttcgggcactccaagatctacaagagctggctaatcaaggactggaagctctgcaacccggtgcccactgccggcgggtccatcaacgtcatcgaggtgaacagcgacctgtccctgaccaccaaggcgtacgtgtgcagccgcgactgcaccatcacaatcgataaagaggaggcccagatcatcttccagaccgacaagctcaaccacttcgaggtctccggaaccaccctgagctccggctggttcaagacgaaggccagcgtgaccctggaccggacttgcgagcacatcaaggtgacctgcgggaagaagacgctccagttccacgcctgcttccgccaccacatgtcctgcgtccggttctttcacaacaccatcctgcccggcaccatggtgaacagcatgtgccagaacatcgagctgatcatcatcctcgggctgacactgatcatcttcactctcatggtgatcctgaccaagacctacatctgctacatcctgatgcccctcttcatgccgatcgcgtacgcctacggctgggcgtacaacaagtcctgcaagaagtgcaactgctgcgggctggcctaccaccccttcaccaactgcggcagccactgcgtctgcggcctgaagttcgaggcctccgaccgcatgcggatccaccgcgagagcgggctctgccagggctacaagagcctgcggatcgcgcgcctgctctgcaagtccaaggggagctccctgatcatcagcacgctgctctccatgctgctgctcagcttcatcacccccatcgagggcaccatgaccaactaccccgagacgcggcagtactccctggaggaaatcgccgacgtggtggagggcctgctcagcgagcagaacatcaaggagtacgtcgtgttctacacctccctgttcggaagcctgatcctcctgctggccttcatcctctccatcaccctgaccaaggtgacgaacgccctggcccgcaccaacgtcatctactgcgaggagtgtagcatgtaccacgcgaagaagggcataaagtacaacggggacttcaccaacaagtgcggattctgtacgtgcgacgagcaggaggacgaggaggggatcatcatccacaaggtgagtaagaagtgcacctaccggtaccagctccagtgggccaaaatcatcatgatcatcctggtgatgctgctcatgatgcagaacaccatcctgatcgtcgccgccgagaccgactgctggaccaagaacagcctagagctggactgcatcggcccgctcctgaccatctccgactgcagcaacaaggaatccaagaactacgaggaggaggccgcgaagctggtgagccagtccaagatcacgcaggccgacgccgagcaggtcaccatccttggcaacaccatcgacaccgcactgaaggcaatccgcagccagaagacgtaccagaccatgcacctcctcgagagcgtgttcctgatgaagaactgcgactactactccagcttcgagcacaacagtgggtacagccaggcgaagtggcggctgatcgccaagacctcccacttcgacatctgcagccgacactccatgcaccacttctgccggtgcgtggccgacggcaccaagtgccagaacggggactgggacttcgccggcgagatgaacaacacgtacagcaccaagaacgacttctacctccacgacctgaacctgttcttcaccctccatgagaccgccttccccgggacgaccgagtccctcttctaccagctgattgccaagaagaacaccaccggcgccagcaagctcctgggcaagctgatcacgaagtacgggaactccaagctgttcgtcggcatctggaagttcggtcagtacctgctgaccctcccctacgtgaacaccaccgagctgagcaagacgcgccgggagaccatcctgaagacccaccagatcctcacccgctcccagggcgggcggtcagagtccatgagctccgccgaggtgggccagatcgccaaggagtgcgcgaacgccaagaacgtgggctgcatcagcccccgcttcgggatcccgatcgggaacctgacggcctgcgggaacagccccaactacaagatatacaagacacccaacaagatctacaagtccaacaaccgcggcgaagtgtggtgtagcgaggacgtgcactgcctggccgatttcgagcccgccgacaccgaggtcgtgaacaaggtgaagaaaatgacctgcttcctctccgacgtcaatacgcgggcggacatattcagcatcgccatctccgcctgcagaatggtggacaagggcgtgtgcaccgtcaacggggccaagtggaacatcctgaagtgcgagtcaggcctgtattacttcactgaccaccgggaggggcaagacaccggcaacgacttcggggagtactgcatctcccacagctgtaacacggaacgctacccgatcaaccctgacatcctcaaggagtgcatctgggagtaccactcccgcaagtcgaagtacatctccaccatcaacctggagagcctggaggagttcaagcgggccatgtcggacaagctcagccacaccctgatggtgtataacttcaagcccaccgcgaacctaccccacatcaaaccgtcctacaagtttatcactgccaacggaatcgaaaacagcgacggcctggagtcagcctacatcctgagctccatccccgccatcgggggcatgagcatcgggtacaacatccagaccaaggacaacttccccctgttagacctgatcgtgttcgtcaagagcgcggtgatcaagaccacctacaatcacatctacgacaccggccccacgatcgggatcaacaccaaccacgacgagcactgcaccggcccttgccccaccatcatcccccacaaggagaactggctgacgttctcccaagagcggaccagccggtggggctgcgaggagtttgggtgcctcgcgatcaacaccggctgcgtgttcggatcctgccaggacgtcatccaccccgagaccaagatctaccggaaggccgtggaggaggaggtggtcctgacggtgtgcataaacttcccgggcaacaccttctgcaccgagatcaacgccatcgagcctaagatcaccgatgagatcgagctgcagttcaagacggtggacacaaagaccctccctaacctgctggccgtccagaaccacaagctctacagcgggcagatcaacgacctgggctccttcagccagggctgcgggaacgtgcagaagaccaatcagtccatcctgggcgcggggacggtgaagttcgactacgtctgccacggcgcctcccgcaaggacatcatcgtgcgacgctgctacaccaacaactacgactcctgcaagctcctgaaggaggagcggagcctgatcttcgccgacaaccatgagaccctcgaggtggccaacacccgccacctgatcggggagctacaattcaagatcatgctcggcgacatccggtacaaggccttcgcggagaagccggagctggagatcgacgccaagtgcgtcggctgcccctcctgcttcgagagctactcctgcaacttccaaatcgtgacgagcatcgacaccgtgtgcagcgtcgaggggccctgcaccctgttccacaaccgcatcatcatcaccgccgccaagcaaagctacggcgtgaagatgtcctgcaagacgaaacccgggccggtggaggagttcaccatctgcaaccggaactaccgcgtcagcttcgccaccatcgacaagaacgacaagatcgagatcaacaccggcgaccagacgtcctacatcgtggaaaaggacagccggtgcaagacctggctctgccgcgtgcgcgacgagggcatcagcgtcatcttcgagcccctgaaggcgttcttcgggtcctacttcagcatagccttctacatcatcatcggaatcgcagccctgttcctcattatctacatctttctgcccatgttcttcaagctgcgggacgtgctcaagaagaacgagtacctgtacctacaggagctcaagcacaagtga

SEQ ID NO: 15851 - RNA, 4305 nt, synthetic construct; identical to SEQ ID NO: 12565
  misc_feature 1..4305: note = derived and/or modified CDS sequence (opt11) from MAGV(CoAr 3363)__KX100107.1__GP
  source 1..4305: mol_type = other RNA

SEQ ID NO: 15852 - RNA, 4305 nt, synthetic construct; identical to SEQ ID NO: 12566
  misc_feature 1..4305: note = derived and/or modified CDS sequence (opt11) from MAGV(OBS 6657)__KX100116.1__GP
  source 1..4305: mol_type = other RNA

SEQ ID NO: 15853 - RNA, 4302 nt, synthetic construct; identical to SEQ ID NO: 12567
  misc_feature 1..4302: note = derived and/or modified CDS sequence (opt11) from NORV(0234)__EU004188.1__GP
  source 1..4302: mol_type = other RNA

SEQ ID NO: 15854 - RNA, 4305 nt, synthetic construct; identical to SEQ ID NO: 12568
  misc_feature 1..4305: note = derived and/or modified CDS sequence (opt11) from PLAV(75V3066)__KX100122.1__GP
  source 1..4305: mol_type = other RNA

SEQ ID NO: 15855 - RNA, 4305 nt, synthetic construct; identical to SEQ ID NO: 12569
  misc_feature 1..4305: note = derived and/or modified CDS sequence (opt11) from PLAV(75V5758)__KX100128.1__GP
  source 1..4305: mol_type = other RNA

SEQ ID NO: 15856 - RNA, 4317 nt, synthetic construct; identical to SEQ ID NO: 12570
  misc_feature 1..4317: note = derived and/or modified CDS sequence (opt11) from POTV(89-3380)__EU004189.1__GP
  source 1..4317: mol_type = other RNA

SEQ ID NO: 15857 - RNA, 4311 nt, synthetic construct; identical to SEQ ID NO: 12571
  misc_feature 1..4311: note = derived and/or modified CDS sequence (opt11) from TENV(TSV-FE3-66FB)__FJ943508.1__GP
  source 1..4311: mol_type = other RNA

SEQ ID NO: 15858 - RNA, 4311 nt, synthetic construct; identical to SEQ ID NO: 12572
  misc_feature 1..4311: note = derived and/or modified CDS sequence (opt11) from TENV(TSV-FL06)__FJ943506.1__GP
  source 1..4311: mol_type = other RNA

SEQ ID NO: 15859 - RNA, 4305 nt, synthetic construct
  misc_feature 1..4305: note = derived and/or modified CDS sequence (opt11) from TLAV(61D240)__KX100119.1__GP
  source 1..4305: mol_type = other RNA
atgctgttcctcctgatcctggccttcctcggcttcagcacctccaaccccatcgccacccgctgcttccacgggggccagctgatcgcggagagcaagtcagccaccagcatctccgagttctgcttgaaggacgacgtgagcatgctcaagtccgaggtcgtgtacaccaagaacgacaccgggctgttcggccacaacaaggtgttccggagctggaccatcaaggactggaagctgtgcaacccgatccccacagccgggggcaccatcaacgtcatcgaggtgaacaaggacctctccctgatgaccaagacctacatctgtagccgcgactgcacgatcaccatcgacaaggaggaggcccagatcatcttccagaccgacaagctgaaccacttcgaggtgtccggcaccactctcaacagcgggtggttcaagtccaaggccagcgtcaccctggatcggacctgcgagcacgtgaaggtaacctgcggcaagaagtctctgcagttccatgcgtgcttcaagcaccacatgagctgcgtccgcttcttccacaacacgatcctccccgggaacatgatcacctccatgtgccagaacatcgagctgatcatcatcttaggcctcaccctggccatcttcatcctgatggtgatgctcaccaagacgtacatctgctacctgctgatgcccatcttcatgccgatcgcttacctctacgggtgggcctacaacaagagctgcaagaagtgcaactgctgtggcctggcgtaccaccccttcacgaactgcggctcccactgcgtgtgcgggctgaagttcgaggcctctgaccggatgcgcatccaccgggagagcggcctctgccaggggtacaagtccctgcgcatcgcccggctgctctgcaagtcgaagggctccagcctggtcatctccggcctgctcagcatgctgatactgtccttcgtcacccccatcgaagggaccatcacgagctaccccgagtcccgcaagtacaccctcgaggagatcaccgacgtcgtcgagggcctggtgagcgagcagaatatcaaggaatacatcgtgttctacacctccctgttcggaagcctcatcctgctgctcgccttcatcatgtccatcacgctgagcaagatcacatccatcctggcccggcgcaacgtcatctactgcgaggagtgcagcatgtaccactccaagcgtggcatcaaatacaacggggacttcaccaacaagtgcggcttctgcacttgcaacgagcaggaggacgcggagggcctcgtgatccacaaggtgagcaagcgctgcacctacaagtaccagctgaagtgggccaaggtcctgatggtgaccttagtgctgctgctgatcgcccagaacaccatcctcatcgtcgccgccgggaccgactgctggacgaagaagtccctcgacatcgactgcatcggcccgatgctggacatcggtagctgcaccaacaagaacacccgaaactacgacaccgaggcgcagaaactcgtgagccagtctaaggtcagccagctggacgccgaccaggcctccttgctcggcaacagcatcgactccgccatcaaggccatccgcgcgcagaagacctaccccacgatgcacctcctggagaccatcttcctcatgaagaactgcgactactacaccagcttcaaccacaactccgggtacagccaggccaagtggcggctgatcgccaagaccggccacttcgacatctgctcccgccacagcacgcaccacttctgccggtgcatcaacgacggcaccaagtgccagaatggggactgggacttcgccggcgagatgaacgagacctacaactccaagaacgacttctacagccacgacctgaacctcttctacaccatcttcgagaacgccttccccgggacgaccgagtccctgttctaccagctgattcagaagaagaacaccaccggcgccagcaagatcctcgggaagctgatcacgaagtacggcaacaagaacatgttcgtgggcgtctggaagttcgggcagtacctgctcaccctgccctacatcaacaacaccgagctgtcccagaatcgccggcagaccatcctcgccacgcaggagagcctttcccgctctcacagcggtcgccaggaaagcatgagctccgccatccagggcagcgtcaccaaggagtgccacaacgccaaggacgtgggctgcatatccccgcggttcggcatacccatcgggaacctgaccgcgtgcggcgacagccccaactacaagatctacaagacccccgagaagctgtacaagtccaacaacaagggggaagtgtggtgcagcaacgacgtccactgcctgaacgacttcgagccagccgacgaggaggtggtcaacaaggtcaagaagctgacgtgcttcctcaccgacgtgtccgtgaagaccgacatctttagcgtcgccgcctccacgtgcaagatggccgacaagggcgtgtgcaccgtgaacgacgcgaagtggaacatcatcaagtgcgacagcgggttgtactacttcaccgaccaccgcgagggccaggacaccggcaacgacttcggggagtactgcatctcccacagctgcaacaccgagcggttccccatcaaccccgacatcctgaaggactgcacgtgggagtttcactcccgcaagagcaagtacatctccaccatcagcttagagtccctggaggagttccggcgcgccatgaccgagaagctgagccacaccctcacgatctacaacttcaagcccaccgccaacctgccgcacatccggcccacctacaagttcatcaccgccaacggcgtcgagaacagcgacgggatagagtccgcctacatcctgagctccatccccgcgctcggcgggatcagcgtggggtacaacgtgcagacgaaggacaacttccccctgctggacatcatcgtcttcatcaagtccgccgtgatccgcaccacctataaccacatctacgacaccggcccgaccatcgggatcaacacgcagcacgacgagcactgcaccggcccatgccccgccgtggtccctcacaaggagaactggatcaccttcagccaggagcggacctcccgctggggctgcgaggagttcggctgcctcgccatcaacacggggtgcgtgttcggaagctgccaggacatcatccacccggagaccaaggtgtaccggaaggccgtcgaggaggaggtgatcctgaccgtgtgcatcaacttccccggcaacaactactgcaccgagatcaacgcgatagagcccaagatcacggacgagatcgagttgcagttcaagaccgtcgacaccaagaccctcccgaacctactggccgtgcagaaccacaagctctactccgggcagatcaacgacctgggtagcttctcccaggggtgcggcaacgtgcagaagacgaaccacagcatcctggggatgggcaccgccaagtttgactacgtctgccacggcgcctcccgcaaggacgtgatcgtgcggcgctgctacaacaacaacttcgacagctgtaaactcttgaaggaggagacctccctgatcttcgcggataaccacgagaccctcgaggtcgcccacacgaagcacctgatcggcgagctgcagttcaagatcatgctcggcgacatccggtacaagagcttcgccgagtcccccgagctggagatcgacgccaagtgcgtggggtgccccagctgctttgagtcgtacagctgcaacttccagatcgtgaccaacatcgacaccgtctgcagcgtggagggcccctgcaccttgttccacaaccgcataatcatctccgccaataagcagagctacggcctcaagatgtcctgccagacgaagccgaaccagaacgaggagttcatcatctgcaaccggaagtacagcgttctgttcaccaccatcgacaagaacgacaagatcgaagtcaacaccggggaccagacgtcctacatctacgagaaggacagccgctgcaagacctggctgtgccgggtgcgcgacgaaggcatctccgtgctgttcgagccactgaaggcgtttttcgggagctacttctccatcatcttctacgtcgtggtgggcattatcgtcctgttcttaatcatctacatcttcctgcccatgttcttcaagctgaaggacgtgctcaagcgcaacgagtacctgtacctgcaggagctcaagcacaagtga

SEQ ID NO: 15860 - RNA, 4305 nt, synthetic construct
  misc_feature 1..4305: note = derived and/or modified CDS sequence (opt11) from NRIV(9800535)__AY593725.1__GP
  source 1..4305: mol_type = other RNA
atgctgttactgctggtgctcctgatcccctgctacgtcagcgcctccccggtggtgacccgctgcttccacggcgggcagctgatcgccgagaagaagtcccagaccgcggtctccgagttctgcctcaaggatgacgtcagcacaatcaaatcggagatcacgtacgagaagaacaacaccggactgttcgcccacagcaaggtgctgcggaactggataatcaaggactggaagaattgcaaccccgtccccaccgccgggggctccatcaacgtcatcgaggtgaacacggacctcagcctgaccaccaagacttacgtctgctcccgcgactgcacgatcaccgtggacaaggaggacgcccagatcatctttcaaaccgagaagctgaaccacttcgaagtgagcgggaccacgctatccagcggctggttcaagaccaaagcctccgtcaccctggaccggacctgcgagcacatcaaggtgacgtgtgggaagaagaccctgcagttccacgcctgcttcaagcaccacatgagctgcatccgctttttccacgggaccatcctccccgggacgatggccacgtccatctgccagaacatcgagctgatcatcatcatcagcctgaccctcatcatcttcatcctgatgatcatcctgactaaaacctacatctgctacctcttaatgccgctgttcatgccaatcgcctacttctacgggtggtcctacaacaagagctgcaagaagtgcagctgctgcggccttgcctaccaccccttcacgaactgcgggagccactgcgtgtgtggcctcaagttcgaggcgagcgaccggatgcgcatccatcgggagtccggcctgtgccaggggtacaagagcctccgcgtcgcccggctgctgtgcaagtccaagggcagctccctcgtgatctccatcctgctgtccatgctcatcctgagcttcgtgacccccatcgaggggaccctgaccaactacccggagtcccgaaagtacgacctcgaggagattgccgatgtcctggagggcttcatcgtggaaaagggcatcaaggaatatgtggtcttctacacaagcatcttcggggctctgctcctgctgatcgccctcgtgattacaatcaccctgaacaaggtgaccgaatacctgacgaacatcaacgttctctactgctacgagtgctccatgtatcacagcaagaagaacatcaagtacatcggcgactttaccaacaagtgcgggttctgcacgtgcggcgagctggaggaccaggaggggctgaagatccacaaggtgtcccgaaagtgcatctacaagtaccagctcacctggagcaagatcatcatgaccatcctggtttgtctgttgatcgcgcagaacacaattctcatcgtggccgccagtgacgactgctggaccaagaagtcgctggagatggagtgcatcggccccctgcagcaggtcgacacgtgcgacgacaaggcttcgcgcagctactccggtgaggcccgaaagctcgtgagagcgagcaagatcagcgacctggacgccgcccaggtcgggttgctcggctccaccatcgagagcgccatcgcctccatcagaaaacagcgcacctaccccaccatgcaccttctggagagcgtattcctcgggaagcactgtgactactacaagaccttcgagcacaactccggctacagccaggctaagtggcggctgaccgccaaaacgcaccatttcgacatctgctcccgccatagcacccaccacttctgccggtgcatctccgacgggaccaagtgccagaacggcgacctggacttcgcaggggagatgaacagcacctaccagtccaagaaggacttcttcgagcacgacttcaagctgttttgcaccctagtcgagaacgccttccccgggacaaccgagagcctgttctacgagatgctgagtaagaagaacaccacgggcatcaagcagctgctggacaagctcacacgcaagttcgggaacaacaacatgttcgtgggcatctggaagttcgggcagtacctgatgagcctgccttacatcaacgaaacctccttgacccccgcccagatcagcaagatcctggaggtgacggaccagcaccaccggtccatcagcggccgccaggagagcctggcgtccgccaccccaggcagcaagtccaaggaatgcgggcatgccaaaaaggtcagctgcatcagcccccgtttcagcgttccgatggagggcctcatggcgtgcggggacagccccaactacaagatctacaagacacccaccaagctgtacaagtcgaacaacaagggcgaggtgtggtgctccggcgatgtccactgcagccaggagctgtcccccgcgtcacaggagtccgtggaccggatcaagcagatcacttgcttcctcaccgagccggaggtgtctgacgacgtcttctcaatcgccatcagcacttgcaaggttcaagacaagggggtatgcaccgtcaacgaggaccgctggaacgtgatcaagtgcgactccggcctaatctactacaccgaccagcgggacggacaggacaccggcaacgacttcggcgagtactgcctgagccactcttgccgcatcgagcggttccccatcaatcccgccatcatccgcgactgcctctgggagtaccacagccgcaagtcaaagtacatcacctccctggacctagagaacctcgaagagttcaagcgggctatcagcgagaagctgagccacaccctgatcgtgtacaacttcaagccgactgccaacctcccgcacatcaagcccgtctacaagtacataaccgtgcagggcgtggaaaacagcgacggcgtggactccgcctacattgccgccagcatgcccgccctaagcgggacgagcatcggctacaacatcatgtccagggacaatttccccctattcgacatcatcatcttcatcaagtcagccataataaaagcgacctacaaccacatctacgacacggggccgaccatcggcattaatgtgatgcacgacgagcactgcaccgggcagtgcccgaccgacatcccccacaaggaaaactggatcacgttcgcccaggagcgaacctcccggtggggctgcgaggagttcggttgcctcgccgtgaacaccgggtgtgtcttcggcagctgccaggacatcattcgccccgagaccaaggtgtaccggaaggccgtggaggagtccgtcctcctgaccgtgtgcatcacgtaccccgggaagaccttctgcactgagatcaacgccatcgaacccaaaatcaccgatgagcttgagttgcagttcaagacggtggacaccaagaccctgcccaacatcctcgcggtccaaaaccacaaactgtatagcggccagatcaacgacctgggatccttcagccagggctgcggcaacatacagcgcaccaactccagcatcatcgggacgggcaccgccaagtttgactacgtgtgccacggggcctcccggaaggacatcatcgtgcgccggtgctacaacaacaactacgagagctgtaagctcctgaaggaggagcagagcctgatgttcgccgacaaccacgagaccatcgacgtcgcgaacgtgcgccacctcctgggcgacctgcagttcaagctcatgctgggcgacctgcggtacaaatccttcgccgagaatccggacctcgagatcgaggccaagtgcgtgggctgcccctcctgcttcacctcctacagctgttccttcaagatcgccagcaatatcgacacggtctgctcaatcgagggcccctgcaccaccttccacaaccgcctgatgatcaccagcacgaagcaggactacggcatcaagatgtcttgcaagaccaagcccaaggagaccgaggagttccagatctgcaagaagacttacacggtgctgttcaccaccgttgagaagaacgacaagatcgagatctcaaccggcgaccagacgtccttcatccaggagcgcgatgaccggtgcaagacctggctctgccgcgtccgggacgaggggatcagcgttatcttcgaaccaatccgcgccttcttcggttcctacttcagcatcgcgttctacgtggtcatctccatcatcgtgctgttcctggccatctacatcttcttacccatggtgttcaaactgcgggacgtcctgaagcgcaacgagtacctctacctgcaggagatcaagcacaagtga

SEQ ID NO: 15861 - RNA, 4305 nt, synthetic construct; identical to SEQ ID NO: 12575
  misc_feature 1..4305: note = derived and/or modified CDS sequence (opt11) from NRIV(GSA/TS7/5170/WT)__KM514677.1__GP
  source 1..4305: mol_type = other RNA

SEQ ID NO: 15862 - RNA, 4305 nt, synthetic construct; identical to SEQ ID NO: 12576
  misc_feature 1..4305: note = derived and/or modified CDS sequence (opt11) from NRIV(TND/S1/19801/WT)__KM514679.1__GP
  source 1..4305: mol_type = other RNA

SEQ ID NO: 15863 - RNA, 4305 nt, synthetic construct; identical to SEQ ID NO: 12577
  misc_feature 1..4305: note = derived and/or modified CDS sequence (opt11) from NRIV(9800521)__JX857326.1__GP
  source 1..4305: mol_type = other RNA

SEQ ID NO: 15864 - RNA, 4305 nt, synthetic construct
  misc_feature 1..4305: note = derived and/or modified CDS sequence (opt11) from NRIV(Adrar)__KJ716849.1__GP
  source 1..4305: mol_type = other RNA
atgctgctcctgctggtgctcctgatcccctgctacgtcagcgcctccccggtggtgacccgctgcttccacggtggtcagctgatcgccgagaagaagtcccaaaccgccgtctccgagttctgcctcaaggacgacgtgagcacgatcaagtccgagatcacctacgagaagaacaacaccggcctgttcgcccacagcaaggtgctgcgcaactggattatcaaggactggaagaactgcaaccccgtccccaccgccgggggctccatcaacgttatcgaggtgaacacggacctcagcctgaccaccaagacctacgtctgctcccgcgactgcacgatcaccgtggacaaggaggacgcacagatcatctttcagaccgagaagctgaaccacttcgaggtgagtgggaccacgctctccagcggctggttcaagaccaaggcctccgtcaccctggaccggacctgcgagcacatcaaggtgacgtgcggcaagaagaccctgcagttccacgcgtgctttaagcaccacatgagctgcatccgcttcttccacgggaccatcctccccggcaccatggccacgtccatctgccagaatatcgagctgatcatcatcatcagcctgaccctcatcatcttcatcttgatggtgatcctgaccaagacgtacatctgctacctcctgatgccgctgttcatgcccatagcctacttctacgggtggtcctacaacaagagctgcaagaagtgctcctgctgcggcctcgcctaccaccccttcactaactgtgggagccactgcgtctgcggcctgaagttcgaggcgagcgaccggatgcgcatccaccgggagtccggcctgtgccaggggtacaagagcctccgcgtggcccggctgctgtgcaagtccaagggcagctccctagtgatcagcatcctgctgtccatgctcatcctgagcttcgtcacccctatcgaggggaccctgaccaactacccggagtcccgcaagtatgacctcgaggaaatcgccgacgtgctggagggcttcatcgtggagaagggcatcaaggagtacgtcgtgttctacacgagcatcttcggggccctgctcctgctgatggccctcgtaatcaccatcaccctgaacaaggtcaccgaatacctgacgaacatcaacgtgctctactgccacgagtgctccatgtaccactcaaagaagaacatcaagtacatcggcgacttcaccaacaagtgcgggttctgcacgtgcggcgagctggaggaccaggaggggctgaagatccacaaggtctcccggaagtgcatctataagtaccagctcacctggagcaagatcatcatgaccatcctggtgtgcctgctgatcgctcagaacaccatcctcatcgtggccgcctccgatgactgctggacgaagaagtccctggagatggagtgcattggacccctgcagcaggtcgacacgtgcgacgacaaggccagccgcagctactcaggcgaggccaaaaagctcgtgcgggcgtctaaaatcagcgacctggacgccgcccaggtgggactgctcggctccaccatcgagagcgccatcgcttccattcgcaagcagcggacctatcccaccatgcacctcctggagagcgtcttcctggggaagcactgcgactattacaagactttcgagcacaacagtggctacagccaggcgaagtggcgcctgaccgccaagacgcatcacttcgacatctgctcccggcacagcacccaccacttctgccgctgcatctccgacgggaccaagtgccagaacggcgattgggacttcgccggcgagatgaacagcacctaccagtccaagaaggacttctttgagcacgacttcaaactattctgcacgctcgtggagaacgccttccccgggaccaccgagagcctgttctacgagatgctgagtaagaagaacaccacgggcatcaagaagctcctggacaaacttacccggaagttcgggaacaacaacatgttcgtgggcatctggaagttcgggcagtacctcatcagcctgccgtacgtcaacgagacctccctgacccccgcccaagtgagcaagatcctcgaggtgacggaccaacaccaccgctccatcagcggccggcaggagagcctggcgtccgccacccccggcagcaagtccaaggagtgcgggcacgccaagaaggtcagctgcatcagcccccgcttcagcgtgccgatggagggcctgatggcctgcggggactcccccaactacaagatctacaagacccccgcgaagctctacaaaagcaacaacaagggcgaggtgtggtgctccggcgacgtccactgcagccaggagctgtcccccgccagccaggagtccgtggaccgcatcaagcagatcacgtgcttcctgaccgagcccgaggtgagcgacgacgtcttctccatcgccatcagcacgtgcaaggtgcaggacaagggggtgtgcaccgtcaacgaggaccggtggaacgtgatcaagtgcgactccggcctcatctactataccgaccagcgcgaagggcaggacaccggcaacgacttcggggagtactgcctgagccactcctgccggatcgagcgcttccccattaaccccgccatcattagcgattgcctgtgggagtaccacagcaggaagtccaagtacatcacaagcctcgacctggaaaacctggaggagttcaagcgcgccatctccgagaagctcagccacacactgatcgtgtacaactttaagcccaccgcgaacctgccgcacatcaagccaatctacaagtacatcacggtccagggcgtggagaacagcgacggcgtggacagcgcctacatcgccgcctccatgcccgccctcagcgggacctccatcggctacaacatcatgagccgggacaacttccccctgttcgacatcatcatcttcatcaagtccgcgatcatcaaggccacctacaaccacatctacgacaccgggccgacgatcggcatcaacgtcatgcacgacgagcactgcaccgggcagtgccccaccgacatcccccacaaggagaactggatcaccttcgcccaggagcgcacgtcacggtggggctgcgaggagttcggctgcctggccgtgaacaccgggtgcgtgttcggctcctgccaggacatcatccgcagcgagaccaaggtctaccggaaggccgtcgaggagtccgtgcttctgaccgtctgcatcacctacccggggaaaacgttctgcaccgagatcaacgcgatcgagcccaagattaccgatgagctggagctccagttcaagaccgtggacacgaagaccctgcccaacatcctggccgtgcagaaccacaagctctacagcggccagatcaacgacctggggtccttcagccagggctgcggcaacatccagaagaccaacctgtccatcatcgggaccggcacggccaagttcgactacgtctgccacggggccagccgcaaggacatcatcgtgcggcgctgctacaacaacaactacgagagctgcaaactcctgaaggaggagcagtccctgatgttcgcggacaaccacgagaccatcgacgtggccaacgtccggcacctcctgggcgacctgcagttcaagctcatgctgggggatctgcgctacaagagctttgccgagaaccccgacctcgagatcgaggccaagtgcgtgggctgcccgtcctgcttcaccagctactcctgcagcttcaagatcgcctccaacatcgacaccgtctgcagcatcgagggcccctgcacgaccttccacaaccggctgatgatcacctccaccaagcaggactacgggatcaagatgagctgtaagacgaagcccaaggagaccgaggagttccagatctgcaagaagacctacaccgtcctgttcacgaccgtggagaagaacgacaagatcgagatctccaccggcgaccagactagcttcatccaggagaaggacgaccgctgcaagacctggctctgccgggtgcgcgacgagggcatctccgtcatcttcgagccgatccgcgcgttcttcggcagctacttctccatcgccttctacgtggtgatcagcatcatcgtcctgttcctggccatctacatcttcttaccgatggtgttcaagctgcgggacgtgctgaagcgtaacgagtacctctacctgcaggagatcaagcacaagtga

SEQ ID NO: 15865 - RNA, 4305 nt, synthetic construct
  misc_feature 1..4305: note = derived and/or modified CDS sequence (opt11) from NRIV(DakArD28542)__JX857317.1__GP
  source 1..4305: mol_type = other RNA
atgctgttactgctggtactattaatcccctgctacgtcagcgcctccccggtggttaccagatgcttccacggcggacagctgatcgccgagaagaagtcccagaccgcggtctccgagttctgcctcaaggacgacgtgagcacgatcaagtccgagatcacctacgagaagaacaacaccggcctgttcgctcacagcaaggtgttgcggaactggatcatcaaggactggaagaactgtaaccccgtccccaccgccgggggctccatcaacgtgatcgaagtgaacacggacctcagcctaacaaccaaaacctacgtatgctcccgtgactgcacgatcaccgtggacaaggaggacgcccagatcatcttccagaccgagaagctcaaccacttcgaggtgagcgggaccacgctctccagcggctggttcaagaccaaggcctccgtaaccctggaccggacctgcgagcacatcaaggtgacctgcggcaagaaaacccttcagttccacgcgtgcttcaagcatcacatgagctgcatccgcttcttccacgggaccatcctccccggcaccatggccacgtccatctgccagaacatcgagctgatcatcatcatcagcctgaccctcatcatcttcatcctcatggtgatcctgaccaagacctacatctgctacctcctgatgccgctgttcatgcccatcgcctatttctacgggtggtcctacaacaagagctgcaagaagtgctcctgctgcggcctcgcctaccaccccttcactaactgcgggagccactgcgtctgcggcctgaagttcgaggctagcgaccggatgcgcatccatcgggagtccggcctgtgccaggggtacaagagcctccgcgtagcccggctgctgtgcaagtccaagggcagctccctcatcatcagcatcctgctgtccatgctcatcctgagcttcgtgacccccatcgaggggaccttgaccaactacccggagtcccgcaagtacgacctcgaggagatcgccgacgtcctggagggcttcatcgtggagaagggcatcaaggagtacgtggtcttctacacgagcatcttcggggcgctgttcctcctgatggccctggtgatcaccatcaccctcaacaaggtgaccgagtacctgacgaacatcaacgtcctgtactgccacgagtgctccatgtaccacagcaagaagaacatcaaatacatcggcgacttcacaaacaagtgtgggttctgcacgtgcggcgagctcgaggaccaggaggggctgaagatccacaaggtgagccggaagtgcatctacaagtaccagctgacctggagcaagatcatcatgaccatcctcgtctgcctgctgatcgcgcagaacaccatcctgatagtggccgcctccgacgactgctggaccaagaagtccctcgagatggaatgcatcggccccctgcagcaggtcgacacgtgcgacgacaaggccagccgcagctactccggcgaagccaaaaagctggtccgggcgagtaagatcagcgacctcgacgccgcccaggtggggctgctggggcccaccatcgagtccgccatcgccagcatccgcaagcagcggacctactccaccatgcatctgctggagagcgtgttcctggggaagcactgcgactactacaagaccttcgagcacaactccggctacagtcaggcgaagtggcgtctcaccgcgaagacgcaccacttcgacatctgctcccggcacagcacccaccatttctgccgctgcatatccgacgggaccaagtgccagaacggcgactgggacttcgccggcgagatgaacagcacctaccagtccaagaaggacttcttcgagcacgacctgaagctgttctgcacgctcgtcgagaacgccttccccgggaccacggagagcctgttctacgagatgctgtccaagaagaacaccacgggcgtgaagaagctcctggacaagctgacccggaaattcgggaacaacaacatgttcgtgggcatctggaagttcgggcagtacctcatgagcctgccgtacgtcaacgagacctccctgacccccgcccaggtggcgaagatcctcgaggtgacggaccagcaccaccgcagcatctccggccggcaggagagcctggccagcgcaacccccggctccaagagcaaggagtgctcccacgccaagaaggtcagctgcatcagcccccgcttcagcgtgccgatggaggggctgatggcgtgcggcgattccccgaactacaagatctacaagacccccgccaagctctacaagagcaacaacaagggagaggtgtggtgctccggcgacgtccactgcagccaggagctgtcccccgccagccaggagtccgtggaccgtatcaagcagatcacgtgcttcctgaccgagccggaggtgagcgacgacgtcttctccatcgccatcagcacgtgtaaggtgcaggacaagggggtgtgcaccgtcaacgaggaccggtggaacgtcatcaagtgcgactccggactcatctactacaccgaccagcgcgacggccaggacaccgggaacgacttcggcgagtactgcctgagccactcctgccggattgagcgcttccccatcaaccccgcaatcatcagcgactgcctgtgggagtaccactcccggaagtccaagtacatcaccagcctcgacctggagaatctggaggagttcaagcgcgcgatctccgagaagctcagccacaccctgatcgtgtacaacttcaagcccaccgccaatctcccgcacatcaagccggtctacaagtacatcacggtgcagggggtggagaactccgacggcgtcgacagcgcctacatcgccgcctccatgcccgcgctcagcggcacctccatcgggtacaacatcatgagccgggacaacttccccctgttcgacatcatcatcttcatcaagtccgccatcatcaaggccacctataaccacatatacgacaccggcccgacgatcgggatcaacgtgatgcacgacgagcattgcaccggccagtgccccaccgacatcccccacaaggagaactggatcaccttcgcccaggagcgcacgagccggtgggggtgcgaggagttcggctgcctggccgtgaacaccggctgcgtcttcgggtcctgccaggatatcatccgcccggagaccaaggtgtaccggaaggcggtggaagagagcgtcctcctaaccgtgtgcatcacctaccccggcaagacgttctgcaccgagatcaacgctatcgagcccaagatcaccgacgagctggagctccagttcaagaccgtggacacgaaaaccctgcccaatatcctggccgtccagaaccacaagctctactccgggcagatcaacgacctgggcagcttctcccaagggtgcggcaacatccagaagaccaacagctcgatcatcggcaccgggacggccaagttcgactacgtgtgtcacggcgcgagccgcaaggacatcatcgtgcgccgctgctacaacaacaactacgagtcgtgcaagctgctcaaggaggagcagtcgctgatgttcgccgacaaccacgagacgatcgacgtcgccaacgtgcggcacctcctcggcgacctgcagttcaagctgatgctcggcgacctgcgctacaagagcttcgccgaaaacccggacctggaaatcgaggccaagtgcgtggggtgcccctcctgcttcaccagctactcctgcagcttcaagatcgcgtccaacatcgacacagtctgcagcatcgagggcccctgcacgaccttccacaatcggctcatgatcacctccaccaagcaggactacggcatcaagatgagttgcaagacgaaacccaaggagaccgaagagttccagatctgcaagaagacctacaccgtgctgttcacgaccgtggagaagaacgacaagatcgagatatccaccggggaccagaccagcttcatccaggagcgggacgaccggtgcaagacgtggctgtgccgcgtccgcgacgagggcatctccgtgattttcgagccgatccgggccttcttcgggagctacttctccatcgccttctacgtggtcgtgagcatcatcgtgctgttcctggccatctacatcttcctgcccatggtcttcaagctccgcgacgtgctgaagcggaacgagtacctgtacctccaggagatcaagcacaagtga

SEQ ID NO: 15866 - RNA, 4305 nt, synthetic construct; identical to SEQ ID NO: 12580
  misc_feature 1..4305: note = derived and/or modified CDS sequence (opt11) from NRIV(SUD-HKV141)__JX857323.1__GP
  source 1..4305: mol_type = other RNA

SEQ ID NO: 15867 - RNA, 4305 nt, synthetic construct; identical to SEQ ID NO: 12581
  misc_feature 1..4305: note = derived and/or modified CDS sequence (opt11) from NRIV(SUD-HKV66)__JX857320.1__GP
  source 1..4305: mol_type = other RNA

SEQ ID NO: 15868 - RNA, 4344 nt, synthetic construct
  misc_feature 1..4344: note = derived and/or modified CDS sequence (opt11) from BWAV(M459)__NC_034490.1__GP
  source 1..4344: mol_type = other RNA
atggccatgttcgagctgatcgtgctcctggccttcagctacgtcaccggcgtgccccaggagctgacccgctgcttcaccgggggctccgtggtccggcagcactggagcaagaacgcgatcagtgagctctgcctgaaggacgacgtgagcatcatcaagtccgagatcgagtacaagaagaacgagaccgggaccttcgccctgagcaagatctaccgcaagtggatcaccacggactgggagaagtgccagccgcagaagtccaccggcgggcacatcagcgtgcttgaggtccggcacgacctgaccctggcctccgccacctacatctgcggcaacccctgcaccatcaacgtggaccgcgagatggcccaggtgcatctccagaccgagggcgtcaaccacttcgagatcagcgggaccaccatcaagtccggctggtttaagacgaccacctacatcaccctggaccagacgtgcgagcatctgaaggtgagctgcgggaagcagtcagtgcagttccacgcatgcttcaagcagcacatggcctgcgtccggttcctccaccgcaccatcctgcccggcaacatggccaacagcatctgccagaacatcgagatcatcatcctgctcgccctgaccctgtccatcttcatcctcctgtgtatcctgacaaagacgtacatctgctacatcctcctgcccattttcatcccgatcagctacatctacgggtatttctacaaccggtcctgcaagaaatgcagccagtgcggcctggtgtaccaccccttcaccgagtgcggccgcaactgcgtgtgcggggcgcggtacgacacgtccgagcgcatgaagctccaccggctgagcggcctgtgccccgggtacaagagcctcaaagccgcccgcgtcctgtgtaagtccaagggcagcgcctccatcctgagcatcctcatctccctgctgatcctcaccttcgtgacgcccatcaacggcctgatgctgaaggacaccgacattacaaacctcaagatcgacaccctgcctgacgacatgctggagctcatccataacgtggactacctgaagctgatcctcgagatcaacatcacgatcttcgggttcatcctgatcataatcctgttcatgctcctgatgttctaccggtaccaacacatcttcatcagcatctacgtcatcgactgcaaggagtgcaacatgtaccactccaagagcggcctgagatacaacggggacttcaccaacaagtgcatgacctgcacgtgcggcgaggtggacgacatggaggggctcaacaagcacaagaagcggtacaactgcctgatcaagtacaagacgaccatcctgcagcacttcttcctgtccatcctcgtgtgcctgatcctgaaggagagcgtcctcttcgccgcggcccagtctgaggagatcatcaagtgcctggagcaggagagcctgacctccaagtgcaccggccccctcctgaagacgccccagtgcaccgagcagcagaagaacctactcttcatcgagatcgccaagcagatggagaaggacaacatcatcaccagcctggacaacgccctgatcgccaagctccccaacgagatcgcgggttccatggctatcctggacaccaagaagtactaccacgagcagatcaccctggagtacgccatactcagcaagtactgcgactactacaagaagtacgaggggaatacgggctactcccagaccacctggcgcacctacctgcggagccaagacctggagatctgcctcatcctgccgtaccagttcttctgccgctgctttaagtccgggacaggctgcatcgacaccaagatggagataaaaagcaccatggacacctactacagctcccaccagacgaagttcgacagcgacctgaactacatgctccacgtgatccacctggccttccgggggtccgccaccagctacatcgcgaagtgcctgatcgagaagaactacaccgagaccatctcctacctcacgaagatccaggagaagtaccccaacaaccagctgctgaaggtggccatcttcttcaccaaccacctcctgaaccagagcctggtcgagaacttcgaggtgtccaccgagtggagccgctacaagcactccaccgcccagcccgaacacgagtggaagaagggcagcgagctcaagatgctcgaccccaacaaactgaagacgggcccggccatccagacctgcctccacatcaaggacctgcactgcatcagcccccggagcagggcccctacatccggcatcatcacgtgcggcctgaacgaccaggcgtgcgtctaccgcaaacccgacaagaagatctacgccagccacatgacccagcacgggttctgcgtgatggatggccactgcctcaagccgttcgagcccatctccggggagatgctgcagatcatcaagaagtccaagtgctggaccgaggatatcgaggatctgatcaccgagggccaggacaagggccggatctcctgccagcccatcgacgtggggaactgcaacgtcagcggcaacctctggaccatcacactgtgcagcgacaaaaagttctactacaccgacaacaagcacgtgcacgacaactccaaggacatcgggtactactgcatggaggagaactgcaagatcccccgcttcccgatccaccccgacttcgtgaaggactgtgagtgggacctgaaccacatcaagatcgaccacctcaagcagatcaacatcgaggacatcaacagctacaagaagatcctgaccgagaagctgaccacggccctcaactccttcaaatacaagggcaacgagaacctgccccacagcatccccaagtacaagtacatcaccatccagggtacccagaccatcgacgggatcgagaacgccttcatcgaggtcgagatcccggcgctgtccggcagcgccacggggttcaagatctccagccgggacggcatcgagctgttcgacgccattctgtacgttaagcaggcctccttcagctccgtgtacaagaagctgtacgtcaccgggcccaccatcggcatcaacaccaagcatgacgagcgctgcacgggcgcctgccccatgaccctcccgcacagctacgggtggctgaccttctccaaggagcggaccagccagtggggctgcgaggagtacgggtgcctggcgatctccgacggctgcgtgttcgggagctgccaggacatcatcaaggacgacctcaccatctatcgcaaggagacggaggagctgtccctggccgagatctgcatcaccttcatgcacaacaccttctgcaccagcatcgactcaacgacccccaccatcaccgacattctcgaggcccagttcaagactgtggagagcttcaagctgcccaacaccgtcggcctgaagatgcacaagctctacatcggcaccatcaacgacatcggggtgtacaaaaaggcctgcggcaacgtgcaaaagtacaataacaccatcctggggagcggctcccccaagttcgactacgtctgccacctggccaagcggaaggacgtgatcctccgcaagtgcttcgacaacgactacaacagctgcaagctgctgaaggtagcgaacgacttacggatcgaggaggacggggagaagctgaaggtcatcaactacaagaaggtgatgggcacgctgaagttcaaggccatcttcggcgacatcaagtacaaatcattcacccaggacgtggacatcgacgccgaagcgacctgcgtcgggtgcctcaactgcttcgagaacatcaactgcgagatcaaggtgcagagcccgctggagaccacgtgcgaggtggagagcagctgcgacctgttcaccacccgcatcctcttccaccaggacatccacaagtacgccctgaagctgatctgctccaaggaggccagctccaagttctggatccggttctgcaacaaggagatcaaaagctcgatcagcctcatcaacgccgcccccatcctggagctggcccccatcgaccagacctcctacgtcaaggaggaggacgagcgctgcggcacatggatgtgccgggtggcgcaggagggaatcggcgtgatcttcgagcccttcaagaatctcttcgggagctacctgggcatcttctacatcatcatcatcgtcatcatcctgctcgtgctgttcgtgtacatcttcctgccgatgatcctcaagctgaaggagatcctgcaaaagaacgaggtagcctaccagcgcgacatgaagatacggtga

SEQ ID NO: 15869 - RNA, 4344 nt, synthetic construct; identical to SEQ ID NO: 12583
  misc_feature 1..4344: note = derived and/or modified CDS sequence (opt11) from BWAV(UgAr1888)__KJ867186.1__GP
  source 1..4344: mol_type = other RNA

SEQ ID NO: 15870 - RNA, 4332 nt, synthetic construct
  misc_feature 1..4332: note = derived and/or modified CDS sequence (opt11) from BWAV/PGAV(SAAr1)__KJ867177.1__GP
  source 1..4332: mol_type = other RNA
atgatctgcatctgcatcttcgtggccatcttccccgccatctacgctataccggacagctactcccgctgcttcaccggcgggaccgtagtgaaggagatgtggagcaaggatgccgtgacggagctgtgcatcaaagatgacgtctccatcgtcaagaccgagaccagctacaagaagaacgggaccgggacgttcgccctcaacaaggtgacacggaagtggctgatgaccgactgggagaagtgcaagccccagaagtccagctccggacacatcaacgtcatcgaggtgcgcgacgacctgaccctcgccacgagcacctacatctgctccagctcctgcaccatcaacgtggaccgggagaccgcccagatccagctgaacacggacagcatcaaccacttcgagatcgcggggaccaccatcaagaccggctggttcaagtccacgaccctggtcgccctcgaccagacctgcgagcacctgaaggtgagctgcggcaagcagtccgtgcagttccacgcctgcttcaaccagcacatgagctgcgttcgtttcctgcaccggaccatcctccccgggaacatggcaaagtccatctgccaaaacatcgagatcatcatcctggtgggtctgatcatcctcatcttcctgctgctctgcatcctgacgaagacctacatctgctacatccttctccccatcttcatcccgctgagctacgcgtacgggtacttctacaacaaggcctgcaagaagtgctcccagtgcggcctggtctaccaccccttcaccgagtgcgggagcaactgcgtctgcggagcccgctacgacaccagcgagcggatgaagctccaccgcatctccggcctgtgccccgggtacaagtctctgcggacggcccgcgtgctctgcaagtccaagggcagcgcctccatcctgagcatcctgatctccatcctcatactgatgttcgtgacccccatcaacgggtacatgatcaccaacgagttcgacgagggcaagctgaccgtcgacagcctgccggacgacatgctgtccatgatcagtcgtctgtccgcgctccagttcatcttcactctgaacatcgcctgtagcgttctggtgaccctcctgacctgcctgttcctcatcatcttctaccgcttccagcaccggttcctgtccaagtacgccatcaactgcaccgagtgcgacatgtaccaccagaagaagggcctgatctataatggggacttcaccaacaagtgcatgacctgcacgtgcggcgaggtcaacgacatggaggggctcaacaagcacaagaagcgctacaactgcctgatcaagtacaaggccgcctggttcctgaacctcaccatcaccatcatctgcctgatgctgatcaaggacggcagcatgatggcggccgccgagaccaacatcgagacctgcatggccaagccctccctcacaaccgactgcacggggcccttcctgaagatcaccaagtgcgacgaaagtcagaaggccctgcccttccaggagatcgcgaagcagctggtgaagtccaacgtcctcaccctgctggacaagcacatcgtcgagaagctcccgaacgagatcgccggcagcctgtccatcctagacaagaagcagcactaccacgagcaactggcagtggagtacgggatcctgagcaagtactgcgactactacgagctgtacaagagcaactccgggtacagccagtccacctggggcacgtacctccggagccacgacttcgagatctgcttactgctcccctaccaatacgtctgccgctgcttcaagtccgggaccggctgcaccgacaccaagttcgagttcgagcagaagatgaacgagacgtacaacagcaagaacgacatgtacaactccgacttcaccctggccctgaccgtcttgcacctggccatgcgggggaccgcgagcacgtacatcatcgacaacgtgctgcagaagaactactccaacgtcatcgagtacctcaacaccaccaagaacaactttaagagcaaccaagtgttcggtgtgctggtcgacttcaccatctacctgctccgccacgcctcctacgccaagtacaacctgccacagagcctgaagaagttccggtccgtgagctccgacctcacgaccatcagcggccgctccagcgggcagaacatcgtatcagacctgcaccagggcgacgtcatcaagacttgcctgaacatcaagcagctcaactgcatctcccccaagagccggaccacgaccaccaatctgatcacgtgcgggtccagccagatctccgtgtacaacctgccgcgcggccagctctacgagagcgttaccaccgagcacgggacatgcgccggcgacggccactgcctgaccgacttcatgcccatcaactccgacttcctggcgacgctcaagaagtccaagtgctggaccaccgacatccccaacatcatcaagctggtcgagtcagacgggaagatcagctgccaacccatcgacgtgggctcctgcaacgtgagcgggaacatctggaccatcacgaagtgcagcgacaacaagtactactacaccgacaacaagcacgtccacgacgacgagaaggacatcggccactactgcatggaggagacctgcaagttcgtgcgcttcccgatcaacgacaagttcgtgagcaactgcgagtgggacctgaaccacatcgagatcaacaagctcaaccaggtcgagctggacaacatcaatgcctacaagaaggtgctgaccgagaagctcacgtccagcctgtccgtgttcaaatacaagctcacacagaacctcccccacgtcatccccaagttcaagtacatcaccatccagggcacccagaccgtggacgggatcgagaacagtttcatcgaggtggagatccccgccctgtccggcgccgcgagcggatttaaaatcatgacaaaggagaacaacgagctgttcgacgccatcctctacgtcaagcaggccagcttctcctccatctacaagaagatctacaccaccggcccgaccatcgggatcaacacgaagcacgacgagaagtgtaccggcgcctgccccgtgaacctgccccactccaccgggtggctgaccttcgccaaggagcggacgagcacctgggggtgcgaggagtacggctgcctcgccatcaacgatgggtgcgtgttcggctcttgccaggacataatcaaggacgagatgtacatcttcaagaaggagaccgaagaggtcgcgctggtggagatctgcatcagcttcaaccacaagaccttctgcacggacgtggactcaaccacccccatcatcaccgacacgctggaggcccagttcaagaccgtggagagctacaagctcccgaaccacgtggccttaaagcagcacaagctgtacgtggggcaaatcaatgacttcggggtttacaagaaggcctgcggcaacgtgcagaagatcaacaacacaatctacggggagggcacgccccgcttcgactacctctgccacctggccaagcggaaggacgtgctggtccgcaagtgcttcgacaacgactacaactcctgcagcctcctgaccatcgcggacgacctgcggctcgaggaggacggggagaagctgaaggtgatcaactaccgcaaggtgctgggatccatgaagttcaaggccctcttcggggacatccggtacaagagcttcaccgaggacatcgagctggacgtcgaggcctcctgcgccggctgcatcaactgctttgacaacatccactgcgagatcaagctgaccaacggcctcgacacctcgtgctccttcgagagctcctgcgatgcgttcaacagccgcatcctgttcaactccaaccagcacgtctacagcacgaagctgatctgcaccaaggagcagaccaaggccttcgagatcaagatctgcgggaagaccatcaaggcagacctcgtggtcacggaggccaagcccatcctggagctgaccccgatcgaccagaccagctacatcaaggaggaggacacccggtgcggcacgtggttctgccgcctcaccaaagaggggttctccgtgctgctggagcccttcaagaacctcttcggcagctacctcgggattgcctacaccatcataatcgcgctgctctgcctgttcgtgttcatctatatcatcctgcccatgatcatgaagctcaaggaggtcctgaagcagaacgagatcgcctaccagaaggagcagaaaaagcggtga

SEQ ID NO: 15871 - RNA, 4332 nt, synthetic construct; identical to SEQ ID NO: 12585
  misc_feature 1..4332: note = derived and/or modified CDS sequence (opt11) from BWAV/PGAV(191B-07)__KJ867180.1__GP
  source 1..4332: mol_type = other RNA

SEQ ID NO: 15872 - RNA, 4326 nt, synthetic construct
  misc_feature 1..4326: note = derived and/or modified CDS sequence (opt11) from CEV(283)__KX817313.1__GP
  source 1..4326: mol_type = other RNA
atgatcttcatgctgatcctcttcgccgtggccgcggccagccccgtctaccagcgctgcttccaggacggcgccatcgtgaagcagaacccgtccaaggaggccgtgaccgaggtctgcctgaaggacgacgtgagcatgatcaagaccgaggcccggtacacgaagaactccaccggggtgttcagcaataacgtcgcgatccgcaaatggctggtgtccgactggcacgattgccggccccgcaaagtggtcggcgggcacatcaacgtgatcgaggtgggcgacgacctcaccctgcacaccgaaagctacgtctgctccgccgactgcacgattggggtggacaaggagaccgcccaggtgcggctgcagaccgacaccacgaaccacttcgagatcgctggcaccaccgtcaagagcggctggttcaagtccaccacgtacatcagcctcgaccagacctgcgagcacctgaaggtgtcctgcggccccaagagcatccagttccacgcgtgcttcaaccagcacatgtcctgcgtgagattcctgcaccggaccatcctccccggcagcatcgccaactccatctgccagaacgtcgagatcatcatcctggtgaccctggccctcctgatcttcatcctgctcagcatcatctccaagacgtacatctgctacctgctgatgccgatcttcatccccatcgcctacatctacgggctcatctacaacaagagctgcaagaaatgcaagctgtgcggcctggtgtaccaccccttcaccgagtgcgggacccactgcgtctgcggcgcccgctacgacacctccgaccggatgaagctccaccgcgcgagcggcctgtgccccgggtacaagtctctgcgggccgcccgcgtgatgtgcaagagtaagggcccggcctccatcctctccataatcacggccgtgctgatcctgacctttgtcacccccattaacgcaatgatggtgggggagagcaaggagacctttgagctagaggagctgcccgacgacatgctggagatggccaacaacctcaacacgtactacatgctgtgcgtcgccaactacgccgtgacctggtccctgctcatcgtggccctgatcattggcctgctgttcaagaagtaccagcaccgattcctggacatctacgcgatgtactgcgaggagtgcgacatgtaccacgaccgcagcggaatcaagtggaacggggacttcaccaacaagtgcggccactgcacgtgcgggcagtacgaggacgcctccggcctgctcgtccaccgtaagacctacaattgcctgatccaatacaagagcaagtggattatgaacttcttggtgacctacgtgatcctcgtcctgctgaaggactccgtggtgatcgtccaagccaaaggcgtggacttcagcgagtgcatcgaggccgagaaggtgcgctggaactgcaccggccccttcgtcaacctcggcaactgtgagaagaagcagaagaaggagccgtactccaacatcgccgcgcagctgaaggggctgggcgccatcagcatcttggacgtgcccatcatcgcctctatccccgaggacatcgccggggcgctccggtacatcgaggaccagcgcagctaccactcccagctgaccgtagagtacgccatgctgacgcggtactgcgactactacacacagttctccgacaacagtggctacagccagaccacctggcgcgtctacctcaggtcccacgacttcgaggcctgcgtactgtaccccaaccagcacttctgccgctgcgtgaagcacggggacaagtgcagcagctccaactgggacttcgccagcgagatgaagaactattactccggcaagcagtcgaagttcgacaaggacctgaacctcgccctgacgtccctgcatcacgcgttccgcggcaccagctccagctacatcgccgggctcctgtccagcaaggccaacgacgagctggtccagtacacctccaagatccgggagaagttcccgggcaacgccctcctgaaggccgttatcgactacatcgcgtacatgaaggggctgaccgagatgagcaacttcaagaaggacgagttctgggacgagctcgtgtacgtccccgaccccaccaagcccccgaagctgtcccgcagctccggcacggtgtacgacttcaagagcgccacctccaacctgggggagaagaactgcaaggacgtgaaaggcgtcgtgtgcctcagcccccggtcgggcgtgacctacgactccattatcgcctgcggcgagggcagctcccccaacatctaccgcatccccaagaccggggtctaccagagcaactccgagccgagcaactactgcgtgtccgacagccactgcctggaggacttcgaggtgatcaaccaggaggagctggacgcaatcaagaagtcccggtgttgggaggtagactacctctacgccaacccctccaagcagtccgacggcatccgcagctgccggatgcgcgatgcgggacattgcaacgtgacgaccaaccggtggcccatcatccagtgcgacgacaacaagtactattactcagagctgcagcgcgactacgacaaggagcaggacatcgggcacttctgcctgagcccgcggtgcaccaccgtgcgtttcccgatccaccccaagcacgtctccaactgcgactggcaggtcagccattccacggtggacaaggtagacgtgcacaacctcgaggacatcgagcagtaccggaaggccattacccagaagctgcagaacagcctgtccatcttcaagtacgcccgcaccaagaacctcccccacatcaagccgatctacaagtacattaccatcgagggcacggagaccgccgaggggatcgagagcgcgtacatcgagagcgagatccccgccctggccggcacctccatcgggtttaagatcaacaccaaggagggcaagcacctcctcgacgtgatcgcctacgtcaagcaggctagctactcctctctgtacaacaagatgtacgtgacgggccccaccgtggggatcaacaccaagcacgacgagctgtgcaccggcccctgcccggtcaacgtgccccactcggacgggtggctcacgttcgcgcgggagcgcacctcttcctggggctgcgaggagttcgggtgcctggccatcagcgacggctgcgttttcggctcgtgccaggacctgatcaaggaggagctcgccgtctaccggaaggagaccgaggaggccaccaacgtggagctttgcctgacgttcagcgataagacctactgcaccgagctcaaccccatcacccccatcatcacgaatctgttcgaggtgcagttcaagaccgtcgagacctactccctgccacgcgtggtggccgtccagaaccacgagatccggatcgggcagatcaacgacttgggaatctactcaaagggttgcggcaacgtgcagaaggtcaataacaccatctacgggaacggcgtgcccaagttcgactacctgtgccacctggcgtcccgcaaggaagttatcgtccgcaagtgcttcgacaacgacttccaggcctgcaagttcctccagagcccgccctcctaccggctggaggaggacgacggaagcatcacggtgatcgactacaagaagatcctggggaccatcaagatgaaggccatcctcggcgacgtgaagtacaagaccttcgccgagaacatcgacatcaccgccgagggagtctgcacgggctgcgtgaactgcttcgagaacatccactgcgagctgacgatccacaccaccatcgaggcctcctgccccgtgaccagcccctgcacgctgttccacgaccgcatcctgatcacccccgacgagcacaagtacgccatgaaggtcatctgcaccgagaaacagaccggtacgctgcccttcaagatatgcaactccaaggtggacgccaccctgaccctcgtggaggccaagccgatcctggagctagcgagcgtcgaccaaacagcctacatccgggagaaagacgagcgctgcaagacgtggatgtgccgggtgcgcgacgagggcatccaggtgatccttgagcccttcaagaacctgttcggcagctacatcgggatcttctacacctccatcctgatcgtcatcaccatcttcatcatcatctacgtaatcctccccatctgtttcaagctgaaggacaccctgcagaagcacgaggacgcctacaagcgggagatgaagatccgctga

SEQ ID NO: 15873 - RNA, 4326 nt, synthetic construct; identical to SEQ ID NO: 12587
  misc_feature 1..4326: note = derived and/or modified CDS sequence (opt11) from CEV(BFS283)__AF123483.1__GP
  source 1..4326: mol_type = other RNA

SEQ ID NO: 15874 - RNA, 4329 nt, synthetic construct; identical to SEQ ID NO: 12588
  misc_feature 1..4329: note = derived and/or modified CDS sequence (opt11) from CHATV(Mohko ILO8-3)__KF719222.1__GP
  source 1..4329: mol_type = other RNA

SEQ ID NO: 15875 - RNA, 4329 nt, synthetic construct; identical to SEQ ID NO: 12589
  misc_feature 1..4329: note = derived and/or modified CDS sequence (opt11) from CHATV(Mohko M07-1)__KF719225.1__GP
  source 1..4329: mol_type = other RNA

SEQ ID NO: 15876 - RNA, 4329 nt, synthetic construct; identical to SEQ ID NO: 12590
  misc_feature 1..4329: note = derived and/or modified CDS sequence (opt11) from CHATV(Mohko M07-2-83)__KF719228.1__GP
  source 1..4329: mol_type = other RNA

SEQ ID NO: 15877 - RNA, 4326 nt, synthetic construct; identical to SEQ ID NO: 12591
  misc_feature 1..4326: note = derived and/or modified CDS sequence (opt11) from CHATV(LEIV-15854)__HQ734820.1__GP
  source 1..4326: mol_type = other RNA

SEQ ID NO: 15878 - RNA, 4326 nt, synthetic construct; identical to SEQ ID NO: 12592
  misc_feature 1..4326: note = derived and/or modified CDS sequence (opt11) from CHATV(LEIV-17756)__EU621834.1__GP
  source 1..4326: mol_type = other RNA

SEQ ID NO: 15879 - RNA, 4326 nt, synthetic construct; identical to SEQ ID NO: 12593
  misc_feature 1..4326: note = derived and/or modified CDS sequence (opt11) from CHATV(LEIV-18733)__HQ734821.1__GP
  source 1..4326: mol_type = other RNA

SEQ ID NO: 15880 - RNA, 4326 nt, synthetic construct; identical to SEQ ID NO: 12594
  misc_feature 1..4326: note = derived and/or modified CDS sequence (opt11) from CHATV(LEIV-22712)__HQ734822.1__GP
  source 1..4326: mol_type = other RNA

SEQ ID NO: 15881 - RNA, 4332 nt, synthetic construct; identical to SEQ ID NO: 12595
  misc_feature 1..4332: note = derived and/or modified CDS sequence (opt11) from INKV(KN3641)__U88059.1__GP
  source 1..4332: mol_type = other RNA

SEQ ID NO: 15882 - RNA, 4332 nt, synthetic construct
  misc_feature 1..4332: note = derived and/or modified CDS sequence (opt11) from INKV(SWAR83-161)__U88060.1__GP
  source 1..4332: mol_type = other RNA
atggaggtgctgaacctcatctggctgctgaccctctgtagcgcctcccccgtcttccagcgctgcttccaggacggcgccatcgtaaagcagaacccaagcaaggaagcggtgaccgaggtctgcctgaaggacgacgtgtccatgatcaagacggaggccaagtacatcaaaaacgccaccgggaccttcgccaacaacatcgccatgcggaaatggctggtggcggactggcacgactgccgcccccagaagtcctccggcgggcacatcaacgtcatcgaggtgggcgacgatctcagcctgcacaccgagagttacatctgcagcgccgactgcgtgatcacggtcgacaaggagaccgcccagatccgcctgcagaccgacaacaccaaccacttcgaagtggcagggacgaccgtgaagtctggctggtttaagagcaccacctatatcacgctcgaccagacctgcgagcacctgaaggtctcctgcggccccaagagcatccagtttcacgcgtgcttcaaccagcacatgtcctgcgtgcgctttctgcacaggaccatcctccccgggagcatcgccaattccatctgccagaacatcgagatcatcatcctggtgaccctgagcctcgccatcttcatcttcctgacgatcgtctccaagacctatgtgtgctacctgctcatgccgatcttcatcccgatcgcctacatctacggctggatctacaacaagagctgcaagaagtgcaagctgtgcgggctggtgtaccaccccttcaccgagtgcggcacccactgcgtctgcggggcccgctacgagacgtccgaccggatgaagctccaccgcgctagcggcctgtgccccggctacaagaacctgcgggccgcgcgcgtgatgtgcaagagcaaggggccggcatccgtgctcagcatcatgaccgccatcctgatcctgaccttcgtcacccccatctccgcgatggtgatcggcgagagctccgaggtgtacacgctcgacgagctgcctgacgacatggtccagatggccgagagggtgaacatctactaccagatcatcatcatcaattacagcatcacctgggccttcctcctgttcgggctggtcctggcctacttcttcaagaagtaccagcaccgcttcttgtccttctacgccatgtactgcaaggagtgcgacatgtaccacgagcgggcgggcctgacctactggggcgacttcaccaacaagtgccgccagtgtacgtgcgggcagttcgaggacgtgaccggcctgatggtgcacaagaagtcctacaactgcatcatcaagtacaaggccaagtggatccgggacatcctgatcacctacctgatcatcatgctgatcaaggactccctcctgttcgtcggggccaccggcacggacttcgccgcgtgcatcgacgagaagaccgtgacctggaactgcaccgggccctttctgaacctcggaaagtgcgacaagagccagaagaagatcggctacgcggacatcgccgaccaactgaaggggctgggcgccatctccgtactcgatatcccgatgatcaagcgcatgcccgacgagatcagcgggtccctgaagtacatcgacggccttgagacgtaccacgagcagctcaccgccgagtacgcgttcctgacccggtactgcgactactacacccagtacaccgacaacagcgggtactcccagacggtctggcgcacctacctgcggtcacacgacttcggcgcctgcgtggtgtacccaaaccagcacttctgccgctgcgtcaagcacggcgacaagtgcaactccgcaaagtgggacttcgccaacgagatgaagaccttctacaccgggcagaaggcaaagttcaacaaggacctgaacctcgcgctgctggtgctccacaaggccttccggggcacggggacctcatacatcgccgagtccatggcccgcaaggacaaccgcagcatgacccacttcgccctggagatcaagaagaagttccccaccaacgcgctgctcacggccctgatcgactacatcagctacctgcagtccctcgccgagatgagcaccttcgagctggacgaggactgggaggacttcaaatacaagccggagcccaccgaagcgccccagctgcggtcccaccgcaccgaccagtacaacttcaagaacgccgacagcaactccaacgtgaaggtctgcaagaacatccagaaggtgagctgcatctctccccggagccgcgccaagtttgagaacatcatcgcctgcggcgagcacgccaacccgtccgtgtacatgatgcccaacgtcagcatctaccagtccaacagcgagcggtcccactactgcatcgccgacagccactgcctcgaggaatacgaggtggtggagtccgagctgctgaacgcgctcaagaagtccaagtgctgggccaaggagatggacgacatcgtcctgcacaaacagagcgacgggctgcgcagctgccggatgaaggacacgggcaactgcaacgtgcaggagaacgactggaccatcgtgctctgcgagaacggcaactactactactccgaggcccaccgcgactacgacaaggaccaggacgtcgggcacttttgcctgagcccccggtgcagcaccatccgctaccccatcaacaagcggcacatccgcaactgcgactggcagatctcccatagcaccatcgacaagatctccgtgcaggagctggccgacatagagcagtacaagaaggccatcagccagaagttacagacgtccctgagcatcttcaaatacgtgaagaccaagaacctgccgcacatcaagcccgcgtacaagtacatcaccgtcgagggcatcgagaccgttgaggggatcgagaacgccttcatcgagtccgagatccccgccctcgccggcacggccatcggcttcaagatcaacagccgggaagggaactacctgatggacgtaattggctatgtcaagtccgcgagctactccgccacctacaccaagctgtacaccacggggcccaccatcggcgtgaacaccaagcacgacgagaagtgcaccgggccatgcccacccataatcgaccacaaggagggctggctcacgttcgccaaggagcgcaccagcacctggggctgcgaggagttcgggtgcctcgccgtttccgacggctgcgtcttcggaagctgccaagacatcatcaaggacgaacttgccgtgtaccggaagaccacggaggagctcaccaccgtggagctatgcctgaccttctccgataagacgtactgcaccaacctcaacgcgatcacccccatcatcaccgacaagttcgaggtccagtttaagaccgtggagagctacacgctgccccgcatcatcgcgatcaagaaccacgagatcaaggttggccagatcaacgacctgggggtgtactccaagggctgcggaaacgtgcagaagatcaacgggaccaactacggcaacggggtgcccaagttcgactacctctgccacctggccagccggaaggaggtcatcattcgcaagtgcttcgacaacgattaccaggcctgcaagttcctgcagagcccgccctcctaccggctcgaggagcaccagggcaccgtgaccgtgatcgactataagaagatcctggggatcatcaagatgaaggcgatcctgggcgacgtcaaatacaagaactaccagagcaacatcgagatcaacgccgagggcacgtgcgccgggtgcatcaactgcttcgagaacatccactgcgagttcacaatccataccaccgtggaggcctcctgccccatcgtgacggactgcgtcagcttccacgaccgcatcctcatcacccccgacgagcataagtacgccctgaaggtggtgtgccaggagaagcccaaactgtcccttaagttcaagatctgcaacaccaacatcgacgcgagcatgaccatcgtcgactccaagccgatcctggagctggcccccgtggaccagacgacctacatccgcgaaaaggacgagcggtgcaagacctggatgtgccgcgtgcgggacgagggtttccaggtcatcctcgagcccttcaagaacctgttcgggagctacataggcatcttctacaccgggatcctgtgcatcatctgcctcctgatcgtgatctacatcatcctgcccatctgcttcaaactccgcgacacgctgcggcagcacgaggacgcctacaagaaggagatgaagatccgctga

SEQ ID NO: 15883 - RNA, 4332 nt, synthetic construct
  misc_feature 1..4332: note = derived and/or modified CDS sequence (opt11) from INKV(Lovanger)__KU681435.1__GP
  source 1..4332: mol_type = other RNA
atggaggtgctgaacctcatctggctgctgaccctctgcagcgcctcccccgtcttccagcgctgctttcaggacggcgccatcgtgaagcagaacccgtcgaaggaggcggtgacggaggtctgcctgaaggacgacgtatccatgatcaagacggaggccaagtacatcaagaacgccaccgggaccttcgccaacaacatcgccatgcggaagtggctggtggcggactggcacgactgccgcccccagaagtcctccggcgggcacatcaacgtcatcgaggtgggcgacgacctcagcctgcacaccgagtcctacatctgcagcgccgactgcgtgatcacggtcgacaaggagaccgcccagatccggctgcagaccgacaacaccaaccacttcgaggtggccgggacgaccgtgaagtccggctggttcaagagcaccacctacatcacgctcgaccagacctgcgagcacctgaaggtctcctgcggccccaagagcatccaattccacgcgtgcttcaaccaacacatgtcctgtgtgcgcttcctgcaccggaccatccttcccgggagcatcgccaactccatctgccagaacattgagatcatcatcctggtgaccctgagcctcgccattttcatcttcctcacgatcgtctccaagacctacgtttgctacctgctcatgccgatattcatccccatcgcctacatctacgggtggatctacaacaagtcttgcaagaagtgtaagctgtgcgggctggtgtaccaccccttcaccgagtgcggcacccactgcgtatgcggggcccgctacgagacgtccgaccggatgaagctccaccgcgcgagcggcctgtgccccggctacaagagcctgcgggccgcccgcgtgatgtgcaagtcccgggggccggccagcgtcctctccatcatgaccgccattctgatcctgaccttcgtcacccccatcagcgcgatggtgataggcgagtccagcgaggtgtacacgctcgacgagctgcccgacgacatggtccagatggccgagcgcgtgaacatctactaccagatcatcatcatcaactactccatcacctgggccttcctcctcttcgggctggtcctggcctacttcttcaagaagtaccagcaccggttcctcagcttctacgccatgtactgcaaggagtgcgacatgtaccacgagcgcgcgggcctcacctactggggcgacttcaccaacaagtgccggcagtgcacgtgcgggcagttcgaggacgtgaccggcctgatggtgcacaagaagtcctacaactgcatcatcaagtacaaggccaagtggatccgcgacatcctcatcacctacctgatcataatgctgatcaaggacagcctcttattcgtcggggccaccggcacggacttcgccgcctgcatcgacgagaagaccgtgacctggaactgcaccgggcccttcctgaacctcggccggtgcgacaagtcccagaagaagatcggctacgcggacatcgccgaccagctgaaggggctgggcgccatcagcgtgctcgacatcccgatgatcaagcgcatgcccgacgagatctccgggagcctgaaatacatcgacggcctggagacgtaccacgagcagctcacagccgagtacgcgttcctgacccggtactgcgactactacacccagtacaccgacaactccgggtacagccagacggtctggcgcacctacctgcggtcccacgacttcggcgcctgtgtggtgtaccccaaccaacacttctgtcgctgcgtaaagcacggcgacaagtgcaacagcgccaagtgggacttcgccaatgagatgaagaccttctacaccgggcagaaggccaagttcaataaggacctcaacctcgcgctgctggtgctccacaaagccttccgcggcacgggtacctcctacatcgcggagagcatggcccggaaggacaaccgcagcatgacacacttcgccctggagatcaagaagaagttccccaccaacgcgctgctcacggccctgatcgactacatctcctacctgcagagcctcgccgagatgtccaccttcgagctggacgaggactgggaggacttcaagtacaagccggaacccaccgaggcgccccagctgcggagccaccgcacggaccagtacaacttcaagaacgccgactccaacagcaacgtgaaggtctgcaagaacatccaaaaggtgtcctgcatcagcccccggtcccgcgccaagttcgagaacatcatcgcctgcggcgagcacgccaacccgagcgtgtacatgatgcccaacgtctcaatctaccagagcaactccgagcggagccactattgcatagccgactcccactgcctcgaggagtacgaggtggtggagagcgagctactgaacgcgctcaagaagtccaagtgctgggccaaggagatggacgacatcgtcctgcacaagcaggctgacgggctgcgcagctgccggatgaaggacacgggcaactgcaacgtgcaggagaacgactggaccatcgtgctgtgcgagaacggtaactactactacagcgaggcccaccgcgattacgacaaggaccaggacgtggggcacttctgcctgagcccccgttgcagcaccatccgctacccgatcaacaagcggcacatccgcaactgcgactggcagatctcccacagcaccatcgacaagatctccgtgcaggagctggccgacatcgagcaatacaagaaggctatctcacagaagctccagacgtcgctgagcatcttcaagtacgtgaagaccaagaacctgccgcacatcaagcccgcctacaagtacatcaccgtcgagggcgtggagaccgtggaggggatcgagaacgccttcatcgagtccgagatccccgccctcgccggcacggcgatcggcttcaagatcaacagccgggaggggaactacctgatggacgtcatcggctacgtgaagtccgccagctattccgccacctacaccaagctgtacaccacggggcccaccatcggcgtgaacaccaagcacgacgagaagtgcaccgggccgtgcccgcccatcatcgaccacaaggagggctggctcacgttcgccaaagagcgcaccagcacctggggctgcgaggagttcgggtgcctggccgtctccgacggctgcgtgtttgggagctgtcaggacatcatcaaggacgagctggtggtctacaggaagaccacggaggagctcaccaccgtggagctgtgcctgaccttctccgacaagacgtactgcaccaacctcaacgcgatcacacccatcatcaccgacaagttcgaggtgcagttcaagaccgtcgagagctacacgctgccccgcatcatcgccatcaagaaccacgagatcaaggtaggccagatcaacgacctgggtgtgtactccaaaggctgcggcaacgtccaaaagatcaacgggaccaactacggcaacgggtggcccaagttcgactacctctgccacctggccagccggaaggaggtgatcatccgcaagtgcttcgataacgactacaaggcctgcaagttcctgcagagcccgccctcctaccgcctcgaggagcaccagggcaccgtaaccgtcatcgactacaagaagatcctggggacgatcaagatgaaggcgatcctaggcgacgtgaagtacaagaactaccagtctaacatcgagatcaacgccgaggggacctgcgccggctgcatcaactgcttcgagaacatccactgcgagttcaccatccacaccacggtggaagcctcctgccccatcgtcaccgactgcgttagcttccacgaccggatcctcatcacccccgacgagcacaagtacgccctgaaggtggtctgccaggagaagcccaagctgtccctcaagttcaagatctgcaataccaacatcgacgcgagcatgacgatcgtggactccaagccgatcttggagctggcccccgtggaccagaccacctacatccgcgagaaggacgagcggtgcaagacctggatgtgccgcgtccgagacgagggcttccaggtgatcctcgagcccttcaagaacctgttcgggagctacatcggcatcttctacacggggatcctgtgcattatttgcctcctgatcatcatctacatcatactgcccatctgtttcaagctcagggacaccctgcggcagcacgaggacgcatacaagaaggagatgaagatccgctga

SEQ ID NO: 15884 - RNA, 4332 nt, synthetic construct; identical to SEQ ID NO: 12598
  misc_feature 1..4332: note = derived and/or modified CDS sequence (opt11) from INKV(Lovanger)__KX554936.1__GP
  source 1..4332: mol_type = other RNA

SEQ ID NO: 15885 - RNA, 4335 nt, synthetic construct; identical to SEQ ID NO: 12599
  misc_feature 1..4335: note = derived and/or modified CDS sequence (opt11) from JSV__AF123487.1__GP
  source 1..4335: mol_type = other RNA

SEQ ID NO: 15886 - RNA, 4335 nt, synthetic construct; identical to SEQ ID NO: 12600
  misc_feature 1..4335: note = derived and/or modified CDS sequence (opt11) from JSV(BFS 4474)__KX817319.1__GP
  source 1..4335: mol_type = other RNA

SEQ ID NO: 15887 - RNA, 4323 nt, synthetic construct; identical to SEQ ID NO: 12601
  misc_feature 1..4323: note = derived and/or modified CDS sequence (opt11) from LUMV__AF123484.1__GP
  source 1..4323: mol_type = other RNA

SEQ ID NO: 15888 - RNA, 4323 nt, synthetic construct; identical to SEQ ID NO: 12602
  misc_feature 1..4323: note = derived and/or modified CDS sequence (opt11) from LUMV(SAAr 1881)__KX817325.1__GP
  source 1..4323: mol_type = other RNA

SEQ ID NO: 15889 - RNA, 4329 nt, synthetic construct
  misc_feature 1..4329: note = derived and/or modified CDS sequence (opt11) from MELV__U88057.1__GP
  source 1..4329: mol_type = other RNA
atgatcgccttaatcttcctcatcgccatcgcggccgccagccccgtgtaccagcgctgcttccaggacggcgggatcgtcaagcagaatccgtccaaggacgccgtgaccgaggtgtgcctgaaggacgacgtcagcatgatcaaaaccgaggccaaatacatgaagaacgacacgggcaccttctccaacaacgtggcgatgcggaagtggctggtggccgactggcacgactgccgcccccaaaagtccagtgggggccacatcaacgtcatcgaggtgggggacgacctcagcctgcacacagaggcctacatctgctctgccgactgcatgatcagcgttgataaagagaccgcgcagatccggcttcagacggactccaccacccacttcgagattgccggcaccacggtcaagagcggttggttcaagtccaccacctacatcaccctcgaccagacgtgcgagcacctgaaggtgtcttgcgggcccaagtccatccagttccacgcctgcttcaaccagcacatgagctgcgtgcgcttcctgcaccgcaccatcctccccggctccatcgcaaacagcatctgccagaacatcgagatcatcatcctggtcaccctgaccctcctgatcttcatcttcctgtcgatcctgagcaaaacgtacatctgctacatcctgatgccgatgttcatcccagtggcctacatctacgggtggatctacaacaagtcctgcaagaagtgcaagctgtgcggtctcgtgtaccaccccttcaccgagtgcgggacccactgcgtctgcggcgcgcgctacgagaccagcgaccgaatgaagctgcaccgcagctccggcctgtgccccgggtacaagagcctccgggccgcccgcgtgatgtgcaagtccaagggcccggcctcaatcctgtccgtgctgacggccgtcctcatcctgaccttcgtgacgcccatgaacgcgctgaccctcgggagctccgaggagaactacaagctggagaacctgcccgacgacatgctcgacatggccgagcggatcgacatctactacctttcgatcatcctgaactactccatcacgtggggcctcgtgatcctgctgggcctcaccttcatcctgttccgccggttccagcaccgcttcctgaactgctacgccatgtactgcagcgagtgcgacatgtaccacgacaagaacgggctcgtccggaacggcgacttcaccaacaagtgccgccagtgcacttgtgggcagtacgaggacgccgccggcctgatcatacaccaaaagtcctacaactgcctgatcaagtacaaggccaagtggatccggaacatactcctgacctacataatcctgatcctcatcaaggacagcgtgctgctgacctccgccgaggggcccgacttcagcgtgtgcatagagcagaaggccatctcctggaactgcaccggcccgttcctcaacctggggcgctgcgagaagacccagaagaaggccagctacgctacgatcgcgacccagctgcggtccatcgacgccatcagcgtcctggacatccccatgatcgccaagatccccgaggacatctccggggccctaaagtacatcgagagcctgaagacctaccacgagcagctgaccgcggagtacgccatgctcacgcgctactgcgactactacacccagttcagcgacaactccggctatagccagacctcctggcggaagttcctgcgcagccacgatttcgagtcctgcatcatctaccccaaccaacacttctgtcgctgcgtgaagcaggatgagaagtgcagctccgccaagtgggacttcgccagcgagatgaaggggttctacctgaacaagcaagccaagttcaacaaggacctcaacctggcgctgtccaccttccacaaggccttccggggcaccccgatcagctacgtcacggagctcatctccaagaacaagaacagctcccttctaatgtacgtgagtgagatcaagcgcaagtttcccgggaacgccctcctggtggccctcctcgacttcatcatgtacctgcagtccctgagcgagatctccggcttcgagctcggcgacgagtgggaggacttcaagtacgaccccgagcccacggagccggccctaatgccccggagccaccgcagcgaccagtacaacttcaagaacgcggcctccgtctcaaagaccaagacctgcgagaacatcaagcgggtgctgtgcctcagcccccgcagccgggccacgttcgacgacgtggtcgcctgcggggagttcgccaacccctctgtgtacatgctgccgaacatcaccatctaccagagcaacatcgagcgctcgcactactgcatcgcggacagccactgcctggaggagttcgagctcgtgaagcccgagctgctgaccgccctcaagaagtccacgtgctgggccggcgagatcgacgacatcgtcctgcacaagcagagcgacgggctgcggtcctgccgcatcaaggacaccgggacctgcgacgtgctcggcaacgagtggaccatcgtgctatgcgagaacaacaacttctactacagcgaggtccaccgggactatgacaaggaccaggacatcggccacttctgcctgagcccccgctgcaatatcatccggtaccccatcaaccctcgccacatccggacctgcaagtggcagatcagccactccacgattgacaagatcaccgtgcacgagctcgccgacatcgagcagtacaagaaggcgattacccagaagctgcagaacagcctgtccatcttcaagtacaagcgcaccaagaacctcccccacatcaagcccatctacaaatacatcgccatcgagggcacggagaccgtggaggggatcgagaacgcctacatcgagagcgagatcccggccctggccggcacagcgatcgggttcaagatcaactccaaggacggcaaccacctgatggacgtcatcggctacgtgaagtccgccagctactccagcacctacacgaagctctacaccaccgggcccaccatcggcatcaacacaaagcacgacgagaaatgcaccgggtcctgccccacccaggtgaagcacaaaaccggctggctaacgttcgccaaggagcggacaagcacatgggggtgcgaggagttcggctgcctggccatctccgacggctgcgtcttcgggagctgccaggacatcatcaaggacgagttgaccgtgtaccgcaagacgaccgacgaggtgaccgagctggagctgtgcctcaccttcgccgacaagacgtactgcaccaacctgaacgcggtcacccccatcatcaccgacaagttcgaggtgcagttcaagaccgtggaatcctacagcctgccgcggatcatcgccgtcaagaaccacgagatcaaggtgggccagatcaacgacatcggggtgtactccaaaggctgcgggaacgtccagaaggtgaacggcacgagctacggcaacggggtgcccaagttcgactacctctgccacctggcctcccgcaaggaagttaccatccgcaagtgcttcgacaacgactaccaggcatgcaagttcctgcagacccccagctcctaccggctcgaggagcaccagggcacagtgacgatcatcgactacaagaagatcctggggagcatcaaaatgaaggccatcctgggcgacgtgaagtacaagaactacgcgtccaacatcgacatcaacgccgaggggagctgcgccggttgcatcaactgcttcgagaacatccactgcgagttcaccatccactccaccgtcgagaccagctgccagatagagtccgactgcacgagcttccacgaccgcgtgctcatcacccccaacgagcacaagtacgccctgaagctgatctgtcacgacaagccggcgagctccctcaagttcaagatctgcaacaccaaggtagaggcagccatgaccctggtcgacgcccggcccatcatcgagctggcccccgtggaccagacggcgtacatccgcgagaaggacgaacggtgcaagacctggatgtgccgcgtacgggacgagggcatccaggtcatcttcgagcccttcaagaacctcttcgggagctacatcggcatcttctacgccatcgtgatctgcatcatcgtgctgttcctgatcgtctacatcgtgctaccgatctgcttcaagctgaaggacaccctgaagcagcacgaggacgcctacaagcgcgagatgaagatccggtga

SEQ ID NO: 15890 - RNA, 4326 nt, synthetic construct
  misc_feature 1..4326: note = derived and/or modified CDS sequence (opt11) from SAV__AF123486.1__GP
  source 1..4326: mol_type = other RNA
atgatccccctcctgttcctggtgaccctggtcagcgccgggccggtgttccagcgctgcttccaggacggggccatcgtgaagcagaacccctccaaggaggcggtcaccgaggtgtgcattaaggatgacgtgagcatgatcaagacggaggcccggtacgtccgcaactccagcggcgtgttctccaacaacgtggccctccggaagtggctggtcagcgactggcacgactgcaagcccaagaaggtgtccgggggccacatcaacgtgatcgaggtcgggaacgacctgaccctccacaccgagtcgtacgtgtgctccgccgactgcaccatcggcattgacaaggagacggcccagatccgcctgcagaccgacaccaccaaccacttcgaggtggcgggcacgaccgtcaagagcgggtggttcaagtctaccacatacatcacactggaccaaacctgcgagcaccttaaggtgagctgcggccccaagtccatccagttccacgcctgcttcaaccagcacatgagctgcgtgcggttcctgcatcgaaccatcctgccggggagtatggccaacagcatctgccagaacatagagataatcatcctcaccacgctggccctgctcatcttcctgctgctcaccatcctgtccaagacctacatctgctacctgctcatgcccatcttcatccccatcgcgcacctgtacggcctgatctacaacaagagctgcaagaagtgccagctctgcgggctggtctaccaccccttcaccgagtgcggcacgcactgcgtgtgcggcgcccggtacgagacctccgaccgcatgaagctgcaccgggccagcgggctctgcccaggctacaagagcctgcgcgccgcccgggtgatgtgcaagtccaaggggcccgcaagcaacctgtccatcatcaccgccgtcctcaccttgacgttcgtgacccccattaacggcctgaccatcggcgacagcaaggaagtgctcaacccagatgagctgccggacgatatgctggagatggcccagaagctcaacatgtaccagctgatctgcatcatcaactacaccgccacgtggtccatcatcatcatcgggctggccgtcttctacatcttcaagaagtaccagcaccgcttctacaactactacgcgatgtactgccaggagtgcgacatgtaccacgagcggagcggcctcaagtggaacggggacttcaccaacaagtgccgccagtgcacgtgcggcgagtacgaggacgccgccgggctgatctcccaccgcaagagctacaactgcttgctccagtacaaggtgaagtgggtcatgaacttcctgaccatctacgtggccctgatcatcctcaaggactccaccctcatcgtgcaggccgcgggcaccgacttcagcgactgtatcgagaccgaggaactgaactggaactgcaccggccccttcctcaacctggggaactgtgagaagaagcagaagaaggagtcctacagcaacatcgccgagcagctgaagggcctgcaggccatctccgtcctcgacatccccctgatcgcccggatccccgaggacatcagcgggggcctgcggtacatcgagtccatccgcacgcaccacgcccagctcaccgcggagtacgccatgctgacccggtattgcgactaccacaagctgttcggggacaacagcggctactcccagaccacctggcgcatgtacctccggagtcacgacttcggcgcctgcatcctgtacccgaaccagcacttctgccgatgcgtgaagcacggggagaagtgctccagcagctcctgggacttcgcctcggagatgaagaactactactccggcaagcaggggaagttcaacaaggacctgaacctcgcgctgcagagcatccaccacgccttccgcggcacgtccagctcctacatcgccaccatcttatcagagaagcggaacgaccagctcgtggagtacatggagaagctgcgcgagaagttcatcgggaacgcactgctccgggccgtcctggacttcatcacctacatgaagtccctgaccgagatgacgaacttcaagcacgacgagttctgggacgagttcgtgcacctccccgcgcccaccaaggcccccagcatgcgccggtccggcaacgagaactacgacttcaaggccccgacctcacccgccggcacgaagtcctgcaagaacatcaagaacgtggtctgcctgtctccccgctccggggccagctacgagggcatcgtggcgtgcggggagccctccgctccgcagatcttcaagatgcccagcgagagcatttaccacaacaacgccgaccagtccatgtactgcatcgccgacacgcactgcctgcaggactacagccccgtggaggacgaggagctcaacgccatcaagaagtccaaatgctgggaaaccgagttcaccaacgcggtccccttcaagcaaagcgacggcatccggtcctgccgcatgcgggacagcggtaactgcaacgtgaccacgaacctttggccggtgatgcagtgcgacgacgggaagttctactactccgagcaccagaaggactacgacaaggaccaagacatcggccacttctgcttgagcccccgctgcaacatggtccggttccccatctccgagaagaacatcctcgcctgcgactggatcgtgagccacccgaacatcgacaagatagacgtgcactccctggaggacctggagcagtacaagaaggcaatcacccaaaagctccagaccagcctgtccatcttcaagtacgccaagaccatgaacctcccccatgtcaagcccatctacaagtacatcagcatcgaggggacggagaccgcggagggcgtggagaacgccttcatcgagtccgagatccccgccctcgccgggaccagcatcggcttcaaggtgaactccaaggacggcaaacacatcatggacatcatcgggtacgtcaagaccgccagctactccagcgtgtacacgaagctgtacaccaccagcccgaccacgggcgtgaacaccaagcacgacgagctgtgcacagggccctgccccaaacagatcgagcacaagaacggctggatcaccttctccaaggagcgcacgagctcctgggggtgcgaggagttcggctgcctcgcgatttctgacggctgcgtcttcgggagttgccaggacatcatcaaggacgagatgagcgtgtaccggaaggagaccgaggagaccaccatcgtggagctgtgcctgacgttctccgacaagacctactgcgtcgagctcaaccccgtgaccccgatcatcaccgacctgttcgaggtgcagttcaagacggtcgagagttacaccctgccccgcatcgtggccgtgaagaaccacgaggtcatggtgggccagatcaacgacctcggggtgtacagtaagggctgcgggaacgtccagaaggtgaacggcaccgtgtacggcaacggtgtccccaagttcgactacctgtgccacctggccagccggaaggaggtgatcatccgcaagtgcttcgacaacgactaccaggcctgcaagttcctccagtcccctagctcctaccggctagaggaggacgccagcaccgtgtctatcatcgactacaaaaagatcctgggcaccattaagatgaaggcgatcctcggggacgtccgctataagactttcagcgagtccatcgacatcagcgccgaggggacctgcaccggctgcgtgaattgcttcgagaacatccactgcgagttcaccatccactccacggtggaggccagctgcccggtcgtaagcacgtgcaccctgttccacgaccggatccttatcggccccgacaaccacaagtacgccatgaaggtgatctgcaccgaggcccccaagacctccctcagcttcaagatctgcaacaccaaggtcgacgcggccatcaccattgtggattccaagcccatcgtggaactagccccggtcgaccagaccgcctacatccgcgagaaggacgaccgctgcaagacgtggatgtgtcgggtgcgcgacgagggcatgcaggtcctgagcgagcccttcaagaacctattcgggagctacatcggcatcttctacaccgggcttgcggtgctgatcatcgcactcatcgccgtgtacatcgttatgcccatctgcttcaaggtgaaggacatcttgaagaagcacgacgacgcctaccgtcgcgagctgaagatccggtaa

SEQ ID NO: 15891 - RNA, 4326 nt, synthetic construct
  misc_feature 1..4326: note = derived and/or modified CDS sequence (opt11) from SAV(20230)__KX817331.1__GP
  source 1..4326: mol_type = other RNA
atgatccccctcctgttcctggtgaccctggtcagcgccggcccggtgttccagagatgcttccaggacggggccatagtgaagcagaacccatccaaggaggcagtcaccgaggtatgcatcaaggacgacgtgagcatgatcaagacggaggcccggtacgtccggaactccagcggcgtgttctccaacaacgtggccttgaggaagtggctggtcagcgattggcacgactgcaagcccaagaaggtctccgggggccacatcaacgtgatcgaggtcgggaacgacctgaccctccacaccgaaagctacgtgtgctccgccgattgcacaatcggcatcgacaaggagacagcacagatccgcttgcagaccgataccaccaaccacttcgaggtggcaggcacgactgtcaagagcgggtggttcaagtccaccacctacatcacgctggatcagacctgcgagcacctcaaagtgagctgcggccccaagtctatccagttccacgcatgcttcaaccagcacatgagctgcgtgcggttcctgcaccgcaccatcctgcccgggtctatggccaactctatatgccagaacatcgagattatcatcctcaccacgctggccctgctcatcttcctgctgctcactatcctgtccaagacctacatctgctacctgctcatgcccatcttcatccccatcgcctacctgtacggtctgatctacaacaagtcatgcaagaagtgccagctctgcgggctggtttaccaccccttcaccgagtgcggcacccactgcgtgtgcggagcccgatacgagacctcggaccgcatgaagctgcacagagccagcggattgtgtccgggctacaagagcctgcgcgccgcccgggtgatgtgcaagtccaagggacccgcgagcatcctgtctatcatcaccgccgtcctcatcttaaccttcgtaacgccgattaacggcctgaccatcggcgacagcaaggaggtgttcaacctcgacgagctgcccgacgacatgctggagatggcccagaagctcaacatgtaccagctgatctgcatcatcaactacaccgcaacgtggtccatcatcataatcgggttagccgtcttttacatcttcaagaagtaccagcaccgcttttacaactactacgcgatgtactgccaggagtgcgacatgtaccacgagcggagcggcctcaagtggaacggggacttcacgaacaaatgccgccagtgcacgtgcggcgagtacgaggacgccgccgggctgatctcccacaagaagagttataactgcctactccagtacaaggtgaagtgggtcatgaacttcctgaccatctacgtggccctgatcatcctcaaggacagcaccctgatcgtccaggccgcgggcacagattttagcgattgcatcgagaccgaggagctgaactggaactgcaccggcccgttcctcaacctggggaactgtgagaagaagcaaaagaaggagtcatactcaaatatagccgagcagctgaagggcctgcaggccatatccgtcctagacatccccctgatcgcccggatccccgaggacatcagcgggggcctgcgctacatcgagtctatccggacccaccacgcccagctcacggcggagtacgccatgctgacccgctactgcgactactacaagctgttcggggacaacagcggctactcccagaccacctggcgaatgtacctccgcagccacgacttcgaggcctgcatcctgtaccccaaccggcacttctgtcgctgtgtgaagcacggcgagaagtgctccagcagctcctgggacttcgccagcgagatgaagaactactactccgggaagcagggcaagttcaacaaggacctgaacctagcgctgcagagcatccaccatgccttcaggggtacctccagctcctacatcgccacgattctgagcgaaaagcggaacgaccagctcgtggagtacatgaagaagctgcgcgagaagtttatcggcaacgccctgctccgggccgtcctggactttatcacctacatgaagtcgctgaccgagatgaccaacttcaaacacgatgaattttgggacgagttcgtgcacctcccggcgcccactaaggcccccagcatgcgccggtccgggaacgagaactacgacttcaaggcccccaccagcccggccggtaccaagtcctgcaagaacatcaagaacgtggtctgtctaagcccacgctccggcgcctcgtacgagggcatcgtggcgtgcggcgagccctccgcgccccagatcttcaagatgcctagcgagagcatctaccacaacaacgccgaccagtccatgtactgcatcgccgacacccactgcctgcaggactacagccccgtggaggacgaggagctcaacgccatcaagaagtccaagtgctgggagacggagttcaccaacgccgtccccttcaagcagagcgacgggatccgatcctgccgcatgcgggatagcggaaactgcaacgtgaccaccaacctgtggcccgtgatgcagtgtgacgacggcaagttctactactccgagcaccagaaggactacgacaaggaccaggatatcgggcacttctgcctgagcccgcgctgcaacatggtacggttccccatctcggagaagaacatcctcgcctgcgactggatcgtgagccaccccaacatcgacaaaatcgacgtgcactccctggaggacctggaacagtacaagaaggccatcacgcagaagctacagaccagcctgtccatcttcaagtatgccaagaccatgaacctgccgcacatcaagcccatctacaagtacatcagcatcgagggcaccgagacagctgaaggggtcgaaaacgccttcatcgagtcggagatccccgcgctcgccggcacaagcatcggattcaaggtgaactccaaagacggcaagcacatcatggacatcatcggctacgttaagacggccagctactccagcgtctacaccaagctgtacacgaccgggcctaccacgggcgtgaatacgaagcacgacgagctgtgcaccgggccgtgccccaagcagattgagcacaaaaacggctggatcaccttcagcaaggagagaacctccagctgggggtgcgaggagttcgggtgcttggcgatctccgacggctgcgtgttcgggagctgccaagacatcatcaaggacgagatgtccgtgtaccggaaggagacggaggagaccaccatcgtggagctgtgcctaaccttcagcgacaagacgtactgcgtggagctaaaccccgtcacccccatcatcaccgacctgttcgaggtgcagttcaagaccgtggagtcctacacgctgccgagaatcgtcgccgtgaaaaaccacgaggtgatggtcggccaaatcaacgacctcggggtttacagcaagggctgcgggaacgtgcaaaaggtcaacggcaccgtgtacggcaacggggtacccaagttcgactacctgtgtcacttggcctcgcggaaggaggtcatcatccgcaagtgcttcgacaacgactaccaggcctgcaagttcctccaaagcccctccagctaccggctggaggaggacgcctccaccgtgagcattatcgactacaagaaaatcctgggtaccatcaagatgaaagcaatcctcggcgacgtgcgctacaagacgttctccgagagcatcgacatctccgccgagggcacgtgcaccgggtgcgtcaactgcttcgagaacatccactgcgagttcaccatccacagcacggtcgaggcctcctgccccgtggtcagcacgtgcaccctgttccacgaccggatcctgatcggcccggacaaccacaagtacgccatgaaggtgatctgcaccgaggcccccaagaccagcctgtccttcaaaatctgcaacacgaaggtggacgcggccatcaccatcgtcgacagcaagcccatcgtggagctggcccccgtggaccagaccgcctacatccgcgagaaggacgaccgctgcaagacctggatgtgcagagtccgcgacgagggcatgcaggtcctgctcgagccgttcaagaacctgttcgggtcctatatcggcatattctacactgggctggcggtgctcataatcgccctgatcgccgtgtatatcgtgatgcccatctgcttcaaggtcaaggacatcctgaagaagcacgacgacgcctaccggcgcgagctcaagatccggtga

SEQ ID NO: 15892 - RNA, 4329 nt, synthetic construct
  misc_feature 1..4329: note = derived and/or modified CDS sequence (opt11) from SDNV__AF123490.1__GP
  source 1..4329: mol_type = other RNA
atgatctgtatcctgctcctgatcgccctggccagcgcttcccccgtgtaccagcgctgcttccaggacggcgccatagtcaagcagtacccggccaaggacgccgtgaccgaggtgtgcctcaaggacgacgtcagcatgataaagacccaggccaattacatgaagaatacgaccgggaccttctccaacaacgtggcgatgcggaagtggttggtggccgactggcacgactgccgcccccagaagtcctccggcgggcacatcaacgtcatcgaggttggcgacgacctgagcctccacaccgaggcctacatatgctccgctgactgcgtgatcagcatcgacaaggagacggcgcagatccggctgcagaccgattccaccaaccactttgaggtcagcgggaccacggtgaagtccggctggttcaagagcaccacctacatcaccctggaccagacgtgcgagcatctcaaggtgtcctgcggccccaagagcatccagttccacgcctgtttcaaccagcacatgtcgtgcgtccgcttcctgcaccggaccatcctgcccgggagcatggccaactccatctgccagaacatcgagatcatcatcctcgtgaccctgaccctgatgatcttcatcctcctgacgatcatcagcaagacctacatctgctacatactgatgccgatcttcatccccatcgcctacatctacgggtggatctacaacaaatcctgcaagaagtgcaagctctgcgggttagtgtaccaccccttcaccgaatgcggcacccactgcgtctgcggggcccgctacgaaacgtctgaccggatgaagctgcaccgcagctccggcctctgccccggctacaagagcctgcgggcggcccgcgtgatgtgcaagtcccgggggccggcgagcatcctgtccatcctcaccgccgttctgatcctgaccttcgtcacccccatgtcggccctcgtgatcggctcctctgaggagctgtacaagctggacgagctccccgacgacatgatcgacatggcggagaaggtgaacctgtactacctggtcatcgtgctcaactactccgccacctgggggctgctgctcctgatgggcatcctggccctcctgttcaagaagtaccagcacatcttcctgaactactacgccatgtactgcacagagtgcgacatgtaccacgataagaaagagctcacctacaacggcgacagccccaccaacgcctggcagtgcacgtgcgggcagtacgaagacgcgaccgggctgatcgtgcaccagaagtcgtacaactgcctggtcaagtataaggtgaagtggatcaagaacatcttaatcatgtacatcgtcctgaccctgatcaaagacagcgtgctcatcgcctccgccgaggggccggacttcgcgacctgcatcgaggagaagacgatcacctggaactgcaccggccccttcctgaacctggggcgctgcgacaagacccaaaagaaaacggactacgctaccatcgccagccagctgaaggggatcgacgccatctccatcctcgacgttcccatgatcagcaagattcccgaggacatctccggcgccctgaagtacattgagagcctgaagacctaccacgagcagctcaccgccgagtacgcgatgttcacccggtactgcgactactacacgcagttctccgacaacagcgggtacagccagaccacctggcgcacctacctgcggtcccacgacttcgaggtatgcatcgcctacccgaaccagcacttctgccgctgcgtgaagaacggcgagaagtgcagctccgcccagtgggactttgccacggagatcaaggggtactacaccggccggcagaacaaattcaacaaggacctgaacctcgccctgatgaccttccacaccgcgttccgcgggacggccaccagctacgtgaccgagctgatctccaaagggaagaacagctccctcctgatgtacgccagcgccatcaagtccaagttcaacggcaacgcgctgctcaaggcgctgctggacttcatgatgtacctccagagtctaggggagatctccggcttcaaactgaccgacgagtgggaggacttcaagtacgaggaggagcccacggagcagaccctcatgccccgggggcaccgcggcgggcagtacaacttcaagaacgccgccagcaacggcaagaccaaggtctgcaagaacgtgaagaaggtgctgtgcctgagcccccggagccgcgccaccttcgacgacgtcatcgcctgcggcgaacacgcgaacccgtccgtgtacatgatccctaacacgaccatctaccagagcaacaccgagcgctcccactactgtatcgccgacagccactgcctcgaggagtacgagctggtgaagcccgagctgctcaccgccctgaagaagtcccggtgttgggccggggacatcgacacgatagtcctgcacaaacagtccgacggcctccgcagctgccggatcaaggacaccggctcctgcaacgtgatgggcaacgactggaccatcgtgctgtgcgaggacaacaagtactactacagcgaggtccaccaggactacgacaaggaccaggacgtgggccacttctgcctgagcccccgctgcaacaccatccggtacccaatcagcccccgccacatcaactcctgcaagtggcagatcagccactccacgatcgggaagatcagcgtgcacgagctcgcggacatcgagcagtacaagaaggccatctcccagaagctgcagaccagcctatccatcttcaagtacgccaagaccaagaacctcccccacatcaagcccgtctacaagtacatcgccatcgagggcaccgagaccgttgagggggtggagaacgccttcatagagagcgagatcccggcgcttgccggcacggccatcgggttcaagatcaactccaaggagggctaccacctgatggacatcatcggctacgtcaagagcgcctcctacagctccacctacaccaagctctacacgaccgggcccaccatcggcatcaacaccaagcacgacgagaagtgcacggggagctgccccggcaccatccaccacaagaccgggtggctgaccttcagcaaggagcggacctccacgtggggctgcgaggagttcggctgcctggccgtgagcgacgggtgcgtgtacggctcctgccaggacatcatcaaggacgagctcaccgtctaccgtaagatcagcgacgaggtgaccgaagtggagctgtgcctgaccttctccgacaagacgtactgcaccaacctcaacgcggtcaccccgatcatcaccgacaagttcgaggtgcagttcaagacggtggagagctactccctgccccggatcgtcggggtgcgaaaccacaagattcaaatcggccagatcaacgacatcggggtgtacagcaagggctgcggcaacgtccagaaggtgaacgggaccaactacggcaacggggtgcccaagttcgactacctgtgccacctcgcctcccggaaggaggtcatcatccgcaagtgcttcgacaacgactaccaggcctgcaagttcctgcagacccccgccagctaccggctggaggagcaccaaggcaccgtgacgatcatcaactacaagaagatcctcgggtccatcaagatgaagccgtactgggtgatgctgcgctacaagaactacgccaacagcctggacatcaacgcagaggggacatgctctggctgcgtcggctgcttcgagaacatccactgcgagttcaccatccacaccacgatcgaggcctcttgccagatcgagtccgactgcaccaccttccacgaccggatcctcgtgacccccaacgagcacaagtacgctctgaaggtgatctgtcatgacaaacccaagacgatctttaacttcaagatctgcaacaccgagatcgaggccgcgatcgccatcgtcgacgccaagcccatcatcgagctggccccggtcgaccagaccgcctacatccgtgagaaggacgagcggtgcaaaacctggatgtgccgcgtgcgggacgagggcatccaggtcctcctggagcccttcaagaacctgttcgggagctacatcggcatcttctacacgatcctcatcgtgatcttcatcctggtgatcatcatctacatcatcctgcccatctgcttcaagctccaggacaccctgaagcagcacgaggacgcgtataagcgcgagatgaagatccgctga

SEQ ID NO: 15893 - RNA, 4329 nt, synthetic construct; identical to SEQ ID NO: 12607
  misc_feature 1..4329: note = derived and/or modified CDS sequence (opt11) from SDNV(BeAr103645)__KX817334.1__GP
  source 1..4329: mol_type = other RNA

SEQ ID NO: 15894 - RNA, 4326 nt, synthetic construct
  misc_feature 1..4326: note = derived and/or modified CDS sequence (opt11) from SSHV__EU262553.1__GP
  source 1..4326: mol_type = other RNA
atgatctgcatcctgatcctcttcgccgtgaccgccgcgtcacccgtctaccagcgctgcttccaagacggcgccatcgtgaagcagaacccgtccaaggaagccgtgaccgaggtctgcctgaaggacgacgtgagcatgatcaagacggaggcccggtacatcaagaacgccaccggggtgttctccaacaatgtcgcgatccgcaagtggctggtgagcgactggcacgactgccggcccaagaagatcaccggtgggcacatcaacgtgatcgaggtcggcgacgatctctccctgcacaccgagagctacgtatgctccgccgactgcacgatcggggtggacaaggagaccgcccaggtccgcctgcagaccgacaccacgaaccacttcgagatcgcgggcaccaccgtcaaaagcggctggttcaagtccaccacgtacatcaccctcgaccagacctgcgagcacctgaaggtgagctgcgggcccaagtccatccaattccacgcgtgctttaaccagcacatgagctgcgttcgcttcctgcaccgcaccatcctccccggttccatcgccaacagcatttgccagaacatcgagatcatcatcctggtgacactgaccctcctgatcttcatcctgctctccgtgctgagcaagacctacatctgctacctgctaatgccggtcttcatccccatcgcctacgcctacgggatcatctacaacaagtcctgcaagaaatgcaagctgtgcggcctggtgtaccaccccttcaccgagtgcgggacgcactgcgtgtgcggcgcccggtacgacaccagcgaccgcatgaagctccaccgggcgtccggcctgtgccccggatacaagagcctgcgcgccgcccgggtcatgtgcaagagcaagggcccggcctccatcctcagcgtgatcaccgccatcctgatcctgaccttcgtgacgccgatcaactccatggtcgtgggggagtcgaaggaggtcttcgagctcgagcagctgcccgacgacatgctggatatggcgctccgcatcaatttctactactttgtgtgcatcatgaactacgccgtcacctggggcctgatcatcatcggcctgctcatcgggctgctgttcaagaagtaccagcaccggttctccaacctctacgccatgtactgtgaggagtgcgacatgtaccacgacaggagcggcctgaagcggaacggggacttcaccaacaagtgccgtcagtgcacatgtggccagtacgaggacgccaccgggctgatgacccaccggaagacctacaactgcctcgtccgctacaaggccaagtgggtgatgaacttcctgatcgcgtacatgctgctcaccctgatcaaagactccgccatcgtggtccaggccgccggcaccgacttcacaacatgcctggagaccgagaacatcaattggaactgcaccggccccttcctcaacctggggaactgccagaagcagcagaaaaaggagccgtacgccaacatcgcgacccagctgaagggcctccaggccatcagcgtgctggacatgcccatgatcgcctccatccccgaggacattgccggggcgttacggtacatcgaggagaaggagaccttccacgtgcaactgaccgccgagtacgccatgctcagccgctactgcgactactacgcccagttctccgacaacagcggctactcccagaccacgtggcgggtctacctgcgcagccacgacttcgacgcctgcatcctgtaccccaaccagcacttctgccgctgcgtgaagcacggggacaaatgctccagctccaaccgggacttcgcgaacgagatgaagaactactacagcggtaagcagaacaagttcgacaaggacctcaacctggccctgatggccctccaccacgccttccgcggcacatccagcgcctacatcgcgaccatgctgagcaagaagtccaacgacgacctgatcgcctacaccaacaagatcaaggagaagttcccggggaacgccctcctgaaggccatcgtggactacatcgcgtacatgaagtccctgagcgagatgagctccttcaagtacgacgagttctgggacgacctcctgtacaagagcgcgcccacgaaagccccctccctgagccggggcagcgagcccagctacaacttcaagctcgtcgtgtccagccgctccatcaagagctgcaagaacgtgaagtccgtcgtgtgcctgagcccgcggtcgggggtgagctacgacagcatcatcgcctgcggcgaccccaacgggccctccgtctaccgcaagcccagcgacggcgtgttccagtccaacgccgatcagagcacctactgcctggcggactcccactgcctcgaggacttcgaggtggtcagccaggaggagctggacgccataaagaagtccaagtgctgggaggccgagtacccggacgtgaagctgagcaagctgaccgacggcgtgaagtcctgccggatgaaggacagcgggaactgcaacgtcgccgccaaccgctggcccatcatccagtgcgagaacgacaagttctactactccgagctgcaaaaggactacgacaaaacccaggacatcggccacttctgcctgagccccgggtgctccacggtgcggtttcccatcaacccgaagcacatcagcaactgcaactggcaggtctcccgcagctccatcgcgaagatcgacgtgcataacatcgaggacatcgatcagtaccggaaggccatcacccagaagctccagaccagcctgtccctgttcaagtacgccaagaccaagaacctcccccacatcaagcccatctacaagtacatcacgatcgagggcaccgagaccgccgagggcatcgagagcgcctacatcgagagcgagatcccggcgctggccgggacctccatcggcttcaagatcacgagcaaggaggggaagcatctgctggacgtgatcggctacgtgaagtccgccagctactccagcatctacaccaagctgtacaccaccgggcccacgtccggcatcaacaccaagcacgacgagctgtgcaccggcccctgccccgccaagatcaatcaccagaccgggtggctcacgttcgccaaggagcgcaccagctcatggggctgcgaggagttcgggtgcctggcgatcagcgacggctgcgtcttcggctcctgccaggacatcatccgggacgagctgaccgtgtaccgcaaggagaccgacgaggtgacggacgtcgagctctgcctgactttcagcgacaagacctactgcaccaacctgaaccctatcacgcccatcatcaccgacctcttcgaggtgcagttcaagaccgtggaaacctactccctgccccggatcgtcgccatccagaaccacgagatcaagatcggccaggtgaacgacctgggcgtgtacagcaaggggtgcggcaacgtccagaaggtgaacgggacggtgtacggcaacggggtccccaagttcgactacctctgccacctggcctcccgcaaggaggtcatcgtgcggaagtgcttcgacaacgactaccaggcctgcaagttcctgcagtcaccggcgtcctaccggctcgaggaggacagcggcaccgttaccgtgatcgactacaagaagatccttggcaccatcaagatgaaagccatcctgggggacgtgaagtacaagaccttcgccgacaacgtcgacatgacggccgagggctcctgcaccgggtgcatcaactgcttcgagaacatccactgcgagctcaccctgcacaccacgatcgaggccagctgccccatcgtgagcacgtgcaccgtgttccacgaccggatcctggtcacccccaacgagcacaagtacgcactcaaggtggtctgcaccgagaagcccggcaacaccctgaccatccgcatctgcaacaccaaggtggaggccagtctggcactcgtggatgccaagccgatcctggagctggcccccgtcgaccagacggcgtacatccgcgagaaggacgagcggtgcaagacctggatgtgccgcgtgcgggacgaggggctccaggtgatcctggaacccttcaagaacctgttcggcagctacatcggaatcttctacaccttcatcatctccatcatcgccctcctgatcatcatctacatcgtcctgcccatctgcttcaagctccgcgacaccctgcggaagcacgaggacgcctacaagcgcgagatgaagatccggtga

SEQ ID NO: 15895 - RNA, 4326 nt, synthetic construct; identical to SEQ ID NO: 12609
  misc_feature 1..4326: note = derived and/or modified CDS sequence (opt11) from SSHV__K02539.1__GP
  source 1..4326: mol_type = other RNA

SEQ ID NO: 15896 - RNA, 4335 nt, synthetic construct
  misc_feature 1..4335: note = derived and/or modified CDS sequence (opt11) from SORV__AF123488.1__GP
  source 1..4335: mol_type = other RNA
atggaggtgctgtccctcatctggctgctgaccctctgctccgccagccccgtcttccagcgctgcttccaggacggcgccatcgtgaagcaaaacccgtccaaggaagcggtgaccgaggtctgtctgaaggacgacgtgagtatgatcaagaccgagaccaagtacgtgaagaacaccaccgggacgttcgccaataacatcgccatgcggaagtggctggttgccgactggcacgactgccgcccccaaaagtccagcggagggcacatcaacgtgatcgaggtgggcgacgacctctccctgcataccgagagctacatctgctccgccgactgcgtcatcaccgtggacaaggagaccgcgcagatccggctgcagacggacaacaccaaccacttcgaggtggccgggaccaccgtcaagagcggctggttcaagtccacgacctacatcaccctcgaccagacctgcgagcacctgaaggtgtcatgcggcccgaagtccatccagttccacgcctgcttcaaccagcacatgagctgcgtgcgcttcctgcaccggacgatcctccccgggtccatcgccaactctatctgccagaacatcgagattatcatcctggtcaccctgtccctcgtgatcttcatcttcctgaccatcgtgagcaagacctacatctgctacctgctcatgccgattttcatccccatcgcgttcatctacggctggatctacaacaagtcttgcaagaagtgcaagctgtgcgggctggtctaccaccccttcacggaatgcggcacccactgcgtgtgcggggcccgctacgagaccagcgaccggatgaaactccaccgcgccagcggcctgtgccccggctacaagtccctgagggccgcccgcgtgatgtgcaagagcaaggggccggcgtcaatcctcagcatcctcaccgccatcctgatcctcacgttcgtcacccccatctccgcaatggtggtgggcgagagcaacgagatctacaccctggatgacctgcccgacgacatggtccaaatggccgagcggatcaacatctactaccagatcctcatcatcaactacggggtgacctgggccttcctgctgctcggcttagtcctggcgtacttcttcaagaaataccagcacaagttcctcgactactacgccatgtactgcgaggagtgcgacatgtaccacgagaagtccggcatgacgtactggggcgacttcaccaacaagtgccgacagtgcacgtgcgggcagttcgaagacgccaccgggctgatggtgcacaagaagtcctacaactgcctggtgaagtataaagccaagtggatccggaacatcctcatcgcctacctgatgatcatgctggtcaaggacagcctcctgttcgtgggcgcgacccgcgccgacttcgccagctgcgtggacgagaagactgtcacctggaactgcaccgggcccttcctgaacctcggccggtgcgataagacgcagaagaagaccggctacaaggacatcgccaaccagctgaaggggctgggcgtgatctccatcctcgacataccgatgatcgagaagatgcccgacgagatcagcgggtccctgaagtacatcgacagcctggagacctaccacgagcagctgacggccgagtacgcgttcctcacccgctattgcgactactacacgcagtacaccgacaactccggctacagccagaccgtgtggcggacctacctgcgctcccacgacttcggggcctgcgtcgtgtaccccaaccagcacttttgccggtgcgtgaagtacgacgacaagtgcaactctgcaaagtgggacttcgccaacgagatgaagacgttctacaccggccgcaaggtcaagttcaacaaggacctgaacctcgcgttactggtgctccacaaggccttccggggcacagggaccgcctacatcgccgaggccatggcgcgcaaggacaacggctcgatggcccacttcgccctggagatccgcaagaagttccccacgaacgccctgcttgccgcgctgatcgactacatcgtgtacctgcagagcctcgccgagatcagcaccttcgagcttgaggaggactgggaggacttcaagtacaagccggagcccaccgagtccaccctgcagccccggagccaccgctccgaccagtacaacttcaagaacgccgacagcaactccaacgtcaaggtgtgcaagaacgtgaagaaggtcctctgcgtgagcccccggtcccgcgccaagttcgagaacatcatcgcctgcggggagcacgcgaacccgagcgtgtacatgatgcccaacatctccatctaccagagcaactccgaacggagccactactgcatcgccgactcccactgcctggaggagtacgaaatcgtcaacacggagttattaaccgccctaaagaagtcccgctgctgggccaaggaaatggacgacgtggtgctgcacaagcagagcgacggcctccggagctgccgcatcaaggacacggggtcctgcaacgtcctgggaaatgactggaccatcgtgctgtgcgagaacggcaactactactacagcgagatccacaaggactacgacaaggaccaggacgtggggcacttctgcctcagcccccggtgctccacgatccgctaccccatcaaccggcgccacatccggaagtgcgactggcagatcagccactccaccatcgacaagatcagcgtccaggagctggcggacatcgagcagtacaagaaggccatctcccagaagctgcagaccagcctctccatcttcaagtacgtgaagaccaagaacctgccgcacatcaagcccgcctacaagtacatcacggtggaaggaaccgagacaatcgaggggatcgaaaacgccttcatcgagagcgagatccccgccctggcgggcaccgccatcggcttcaagatcaactcccgcgaggggaactacctcatggacgtcatcggctacgtcaagagcgcctcctactcggccacgtacaccaagctgtacaccacagggcccacgattggtatcaacacccggcacgacgagaagtgtaccgggccgtgccccgtgaccatcgaccacaaggacggctggctgacgttctccaaagagcgcaccagcacctggggctgcgaggagttcgggtgcctcgccgtgtccgacggctgcgtgttcggcagctgccaggacatcatcaaggacgagctggcggtgtaccggaagactacggaggagctgaccaccgtcgagctctgcctgaccttctccgacaagacctactgcacgaacctgaacgccatcacccccatcatcaccgacaagtttgaggtgcagttcaaaaccgtggagagctacacgctcccgcgcatcatcgccgtcaagaatcacgagatcaaggtgggccagatcaacgacctcggggtgtactccaaggggtgcggcaacgtccagaaagtgaacggaaccaactacggcaacggggtgcccaagttcgactacctgtgccacctcgccagccggaaggaggtcatcctgcgcaagtgcttcgacaacgactaccaggcctgcaagttcctgcagagccccgcgtcctaccgcctcgaggagcaccagggcaccgtgaccgtgatcgactacaagaaaatcctggggagcatcaagatgaaggccatcctgggcgacgtcaagtacaagaactaccagtccaacatcgagatcaacgccgagggcacgtgcgccgggtgcgtgaactgcttcgagaacatccactgcgagttcaccatccacaccaccgtggagacgagctgccccatcgtcaccgactgcgtgtccttccacgaccggatcctcatcacccccgacgagcacaagtacgcgctaaagatcgtctgccaggacaagcccaaggtgagcctgaagttcaagatctgcaacaccaacattgacgcatccatgacgatcgtggacagcaaacccatcctcgagttggcccccgtcgaccagaccgcctacatcaaggagaaggacgagcgctgcaagacctggatgtgccgggtgcgcgacgaggggttccaagtgatcctggagccgttcaagaacctcttcgggtcctacatcggaatcttctacaccgggatcctgagcgttatctgcctgctcatcgtcatctacatcgtgctgcccatctgcttcaagctgcgggacacgctcaagcagcacgaggacgcctacaagaaggagatgaagatccgctga

SEQ ID NO: 15897 - RNA, 4335 nt, synthetic construct; identical to SEQ ID NO: 12611
  misc_feature 1..4335: note = derived and/or modified CDS sequence (opt11) from SORV(SORV-252)__JN815081.1__GP
  source 1..4335: mol_type = other RNA

SEQ ID NO: 15898 - RNA, 4335 nt, synthetic construct; identical to SEQ ID NO: 12612
  misc_feature 1..4335: note = derived and/or modified CDS sequence (opt11) from SORV(NJO-94F)__KX817337.1__GP
  source 1..4335: mol_type = other RNA

SEQ ID NO: 15899 - RNA, 4323 nt, synthetic construct
  misc_feature 1..4323: note = derived and/or modified CDS sequence (opt11) from TAHV__AF123485.1__GP
  source 1..4323: mol_type = other RNA
atgatgttcgtgctgttcttcatcgccctcagcgccgcgtcccccgtctaccagcgctgcttccaggacggcgccatcgtgaagcagaacccgagcaagcaggccgttaccgaggtctgcctgaaggacgacgtgtccatgatcaagaccgaggcccggtacttccgcaacgccacggggacatacgcgaacaacgtggccatccggaagtggctggtcagcgactggcacgactgtcgccctaagaaggtgtccggagggcacatcaacgtgatcgaggtcggcgacgacctcaccctccacaccgaggcctacgtgtgcaacgccgactgcacgatcggggttgacaaggagaccgcgcaggtccggctgcagacagacaccacgaaccacttcgagatcgccggcaccaccgtgaagtccggctggttcaagtccaccacgtacatcaccctcgaccagacctgcgagcacctgaaggtgagctgcgggcccaagtccatccagttccatgcctgcttcaaccagcacatgagctgtgtccgcttcctgcaccggaccatcctccccggctccatcgccagctccatctgccagaacgtggagatcatcatcctgacggtgctgaccctcctgatcttcatcctgctcagcatcctgtccaagacctacatctgctacatcctgatgccgatcttcatccccctcgcatacatctacggggtcatctacaacaagagctgcaagaagtgcaagctgtgcggcctggtgtaccaccccttcaccgagtgcgggacgcactgcgtatgcggcgcgcgctacgagacctccgatcggatgaagctccaccgcgcctcgggcctgtgccccgggtacaagagcctgcgggccgcccgtgtcatgtgcaagagcaagggcccggctagcatcctctccatcatcaccgcggtgctgatcctgaccttcgtcacgcccatcaacgccatggtcgccggggacacccaggagaccttcaagctcgaggacttgcccgacgacatgctgagcatggccatgaaggtgaacatgtactacatcatgtgcatgatcaactacgccgtcacctggtccttcatcctctgcgcgctgttaatcgccctcctgttcaagaagtaccaacacagattcctaaacttctacgccatgtactgccacgagtgcgacatgtaccacgaccgcagcggcctcaaatacaacggcgacttcacgaacaagtgccggcagtgcacctgtgggcagtatgaggacgccgccggcctgctaacccaccgaaagacctacaactgcctcgtgcagtacaagtccaagtggctgacgaacttcctgatcgtgtacatcatcctcatgctaatcaaggacagcgtcctgatcgtgcacgcggacgggaccgacttcgagaagtgctccggggaggtggacatcacctggaactgcaccgggcccttcctcaacctcgggaactgcgagaagaagcagaagaaggagagctacaacaacatcgccacgcagctgaagggcctcgacgctatctccgtcctggacatcccgatgatctctaagatccccgaggacatcgccggggcgctgcggttcatcgaggagcagcgctcctaccacgtgcagctgaccgccgagtacgccatgctcacccggtactgtgactactacacccagttcaccgacaacagcggctactcccagacgacctggagagtgtacctgcggagccacgacttcaaggcctgcatcctgtaccccaaccagcacttctgccgctgcgtcaagcacggggacaagtgttccagctccaactgggacttcgccaacgagatgaagaactactacagcggcaagcagtccaagttcgacaaggacctcaacctggcgctgatgagcctccaccacgccttccgcggcaccagctccttctacatcgccaaactgctgaaggagaagaagaacgaggacctcgtgacctacgccgagaagatcaagggcaagtaccccggcaacgccctgctgaaggcgatcatcgactacatcaagtacatggaggacctcacggagatgaacaacttcaagcacgacgaaatgtgggacgacttcatcttcgaggtgccgcccaccaagagcccctccatccggcggttagagagctcctacgacttcaagaccaacgtcaacagcaacccctcccacatctgcaagaacatcaagaccgttgtgtgcctgagcccgaaatccggggtgagctacgacagtatcatcgcctgcggtgagcccagccagccctccatctaccggaagcccgacagccaggtcttccagtccaacgccgaccagacgcacttctgcctcagcgacacccactgcctggagaactacgagaccgtgggggaggagatcatcgacgccataaagaagtccaagtgctgggagaccgagttcacagagtatatccagttcaagcagagcgacggcgtccggagctgccggatgaaagactccggggagtgcaccgtgactactaacagatggccgatcatcctgtgcgacaacgacaagttctactacagcgagctccagaaggactacgacaaggaccaggacatcggccacttctgcctgagcccccgttgcaacacgatccgccaccccatcaaccggaagcacatcagcaactgcacctggcaagtctcccacaacaacattgacaagattgaggtgcacgagctggaggacctcgagcagtacaagaaggccatcacccagaagctgcagaccagcctgaccctcttcaagtactccaagaccaagaacctgccccacatcaagcctatgtacaagtacatcaccatcgagggcaccgagacggcggaggggctggagagcgcctacatcgagtccgagatccccgccttagccggcaccagcatcgggttcaagatcacctccaagagcggcaagcacctcctggacgtgatcggctacgtgaagtccgcgagctactccgcagtctacaccaagctgtacacgaccgggcccaccatcggcgtgaacaccaagcacgacgagctgtgcacggggccttgccccgtgaacgtcccccacggcaccgggtggctgaccttcgccaaggagcgcaccagctcctggggctgcgaggagttcggctgcctcgccatcagcgacgggtgcgtgttcggctcctgccaggacatcatcaaggacgagatcacggtgtaccggaaggaaaccgaggagaccaccgacgtcgagctgtgcctgaccttcgccgacaagacgtactgcaccaacctcaacgcgatcacccccatcataaccgaccagttcgaggtgcagttcaagaccgtggaggcctacagcctgccgcgcatcatcgccgtccggaaccacgagatcatggtggggcaaatcaacgacatcggcgtgtacagcaaggggtgcggcaatgtccagaaggtgaacaacaccaactacggtaacggggtgcccaagttcgactacctgtgccacctcgcctcccgcaaggaggtcatcgtgcggaagtgcttcgacaacgactaccaggcctgcaaattcctgcagacccccgcgagctaccgcctggaggaggaaggcgggtccgtaaccgtcatcgactacaagaagatcctcggcacgataaagatgaaggccatcctgggggacgtgaagtacaagaccttcgccgacaacgtggacctgaccgtcgagggcgtatgcacaggctgcatcaactgcttcgagaacattcactgcgagctgacgattcacagcaccgtggaggcctcttgccccgtcgtgagctcctgcaccgtgttccacgaccggatcctgatcaccccgaacgagcacaagtacgccatcaaggtaatttgcaacgagaagcccgggccaacgctgcccttcaagatctgcagcgcgaagaccgacgccgccatgaccctcgccgacgcgaagccgatcctggagctggcccccgtggaccagaccacgtatatcaaggagaaggacgagcgctgcaagacctggatgtgccgcgtccgcgacgaaggctttcaggtgattttcgagccctttaagaacctcttcgggtcctacatcggcatcttctacaccttcatcatcagcctgatggccatcttcatcgtgatctacatcgttctgcccatctgcttcaagctacgcgacaccctgcggcagcatgaggacgcctacaagcgcgagatgaagatccggtga

SEQ ID NO: 15900 - RNA, 4323 nt, synthetic construct
  misc_feature 1..4323: note = derived and/or modified CDS sequence (opt11) from TAHV__AF229129.1__GP
  source 1..4323: mol_type = other RNA
atgatgttcgtgctgttcttcatcgccctcagcgccgcgtcccccgtataccagcgctgcttccaggacggcgccatcgttaagcagaacccgagcaagcaggccgtgaccgaggtctgcctgaaggacgacgtgtccatgatcaagaccgaggcccggtacttccgcaacgccacggggacctacgcgaacaacgtggccatccgtaagtggctggtcagcgactggcacgactgccgccccaagaaggtatccggcgggcacatcaacgtgatcgaggtcggcgacgacctcaccctgcacaccgaggcgtacgtgtgcaacgccgactgcacgatcggggtggacaaggagaccgcgcaggtccggctgcaaaccgacaccacgaaccacttcgagatcgccggcaccacagtcaagagcggctggttcaagtccaccacgtacatcaccctcgaccagacctgcgagcaccttaaggtgagctgcgggcccaaatccatccagttccacgcctgcttcaaccagcacatgagctgcgtgcgctttctgcaccggaccatcttacccggctccatagcctcttccatctgccagaacgtggagatcatcatcctgacggtgctgaccctcctgatcttcatcctgctcagcatcctgtccaagacctacatctgctacatcctgatgccgatattcatcccgctcgcctacatctacggggtcatctacaacaagtcttgtaagaagtgcaagctgtgcggcctggtgtaccaccccttcaccgagtgcgggacgcactgcgtgtgcggcgcgcgctacgaaacctccgaccggatgaagctccaccgcgccagcggcctgtgccccgggtacaagtccctgcgggccgcccgcgtcatgtgcaagagcaagggcccggccagcatcctctccatcatcaccgcggttctgatactgaccttcgtgacgcccatcaacgccatggtcgcgggagacacccaggagaccttcaaacttgaggacctgcccgacgacatgctgagcatggccatgaaggtgaacatgtactacatcatgtgcatgataaactacgccgtcacctggtccttcatcctctgcgcactactgatcgccctcctgttcaagaagtaccagcaccggttcctgaacttttacgccatgtactgccacgagtgtgacatgtaccacgaccgcagcggcctcaagtacaacggcgacttcacgaacaagtgccggcagtgcacgtgcgggcagtatggcgacgccgccgggctgctgacccaccgcaagacctacaactgcctagtccagtacaagtccaagtggctgaccaatttccttatcggctacatcatcctcatgctgatcaaggacagcgtgctgctagtccacgcggacgggaccgacttcgagaagtgctccggcgaggccgatatcacctggaactgcaccggcccgttcctgagcctggggaactgcgagaagaagcaaaagaaggagtcatacaacaacatcgccacgcaactcaagggcctggacgccatcagcgtgctggacatcccgatgatctccaagatccccgaagacatcgctggggccctgcggttcatcgaggaacagcgcagctaccatgtgcagctcaccgccgagtacgccatgctgacccggtactgcgactactacacccagttcaccgacaactccggctacagccagacgacctggcgcgtctacctgcggtcccacgacttcgaggcctgcatcctctaccctaaccgccacttctgccgctgcgtgaagcacggggacaagtgcagctccagcaactgggacttcgcgaacgagatgaagaactactactccggcaagcagagcaagttcaacaaggacctgaacctggccctcatgagcctgcaccacgcattccggggcacctccagcttctacatcgccaagctgctcaaggagaagaagaacgaggacctggtgacctacgccgagaagatcaaggggaagtaccccggcaacgccctgttaaaggccatcatcgactacatcaagtacatgaaggggctgacggagatgaacaacttcaagcacgacgagatgtgggacgacttcatcttcgaggtcccgcccaccaagtcccccagcgtgcgccggctggagtccagctacgacttcaagaccaacgtgaactccaaccccagccacatctgcaagaacatcaagaccgtcgtgtgcctctcacccaagagcggcgtgtcctacgacagcatcatcgcctgcggggagccgtcccagcccagcatctaccgcaagcccgacagccaggtcttccagagcaacgccgaccagacgcacttctgcctgtccgacacccactgcctggagaactacgagacagtgggcgaggagatcatcgacgccatcaagaagtccaagtgctgggagaccgagttcacggagtacacccagctcaagcagagcgacggcgtgcggagctgccgcatgaaggacagcggggagtgcactgtcaccacgaaccggtggccgatcatcctgtgcgacaacgacaagttctactactccgagctgcagaaggactacgacaaggaccaggacatcggccacttctgcctcagcccccgctgcaacaccatccggcaccccatcaaccgcaagcacatctccaactgcacctggcaggtcaaccacaacaacatcgacaagatcgaggtgcacgagctggaggacctggagcagtacaagaaggcgatcacccagaagctccagacgagcctgaccctgttcaagtactccaagaccaagaacctcccccacatcaagccgatgtacaagtacataaccatcgagggtacggagaccgccgagggcatcgagagcgcctacatcgagtccgagatccccgccctggcgggcaccagcatcgggttcaagatcacctccaagagcggcaagcacctcctcgacgtgatcggctacgtgaagtccgccagctactccgccgtgtacacgaagctgtacaccaccggccccaccatcggggtcaacacgaagcatgacgagctgtgcaccggcccgtgccccgtgaacgtgccccacggcaccgggtggctcaccttcgccaaagagcggacgagctcctggggatgcgaggagttcgggtgcctggccatcagcgacggctgcgtcttcgggtcctgccaggacataatcaaggacgagatcaccgtgtaccgcaaggagaccgaggagaccaccgacgtggagctgtgcctcacgtttgcggacaagacgtactgcaccaacctgaatgccatcacccccatcatcacggaccagttcgaggtccagttcaagaccgtggaggcctacagcctgccgcggatcatcgccgtgaggaaccacgagatcatggtcggccagatcaacgacatcggcgtatacagcaaggggtgcggcaacgtgcagaaggtcaacaacaccaactacgggaacggcgcccccaagttcgactacctctgccacctggcgtcccggaaggaggtgatcgttcgcaagtgcttcgacaacgactatcaggcatgcaagttcctgcagacgcccgccagctaccggctcgaggaggagggcgggtccgtcacggtgatcgactacaagaagatcctgggcaccattaagatgaaggccatcctgggggacgtgaagtacaagaccttcgccgacaacgtcgacttgaccgtggagggcgtgtgcacggggtgcgtcaactgctttgagaacatccactgcgagagcacaatccactccaccgtggaggcgagctgccccgtgatctccagctgcaccgtcttccacgaccgcatcctgatcacgccgaacgagcacaagtacgccatcaaggtgatctgcaacgagaagcccggccccaccctgcccttcaagatctgctccgccaagaccgacgccgcgatgaccctcgccgacgccaagccgatcctggagctggcccccgtggaccagacgacctacatcaaggagaaggtcgagcggtgcaagacctggatgtgccgcgtgcgcgacgaggggttccaggtcatcttcgagcccttcaagaacctcttcggcagctacatcggcatcttctacaccttcatcatctccctgatggccatcttcatcgtgatctacatcgtgcttcccatctgcttcaagctccgggacacgctgcgccagcacgaggacgcgtataagcgggagatgaagatccgctga

SEQ ID NO: 15901 - RNA, 4323 nt, synthetic construct; identical to SEQ ID NO: 12615
  misc_feature 1..4323: note = derived and/or modified CDS sequence (opt11) from TAHV(22595-6)__HM036218.1__GP
  source 1..4323: mol_type = other RNA

SEQ ID NO: 15902 - RNA, 4323 nt, synthetic construct; identical to SEQ ID NO: 12616
  misc_feature 1..4323: note = derived and/or modified CDS sequence (opt11) from TAHV(92' Bardos)__HM036209.1__GP
  source 1..4323: mol_type = other RNA

SEQ ID NO: 15903 - RNA, 4323 nt, synthetic construct; identical to SEQ ID NO: 12617
  misc_feature 1..4323: note = derived and/or modified CDS sequence (opt11) from TAHV(92' Bardos)__HM036212.1__GP
  source 1..4323: mol_type = other RNA

SEQ ID NO: 15904 - RNA, 4323 nt, synthetic construct
  misc_feature 1..4323: note = derived and/or modified CDS sequence (opt11) from TAHV(Souche D C14019-29)__HM036215.1__GP
  source 1..4323: mol_type = other RNA
atgatgttcgtgctgttcttcatcgccctctctgccgcgtctcccgtctaccagcgctgcttccaggacggcgccatcgtgaagcagaaccctagcaagcaggccgtgaccgaggtctgcctgaaagacgacgtgtccatgatcaagaccgaggccaggtacttcaagaacgccacggggacctacgcgaacaacgtggccatccgcaagtggctggtgagcgactggcacgactgccggcccaagaaggtatccggcgggcacatcaacgtgatcgaggtcggcgacgacctcaccctgcacaccgaggcctacgtttgcaacgccgactgcacgatcggggtggacaaggagaccgcgcaggtccgcctgcagaccgacaccacgaaccacttcgagatcgcgggcactaccgtgaagtccggctggttcaagtccaccacgtacatcaccctcgaccagacctgcgagcacctgaaggtgagctgcgggcccaagtccatccagttccacgcctgcttcaaccagcacatgagctgcgtccggttcctgcaccgcaccatcctccccggctccatcgccagctccatctgccagaacgtggagataatcatcctgacggtgctgaccctcctgatcttcatcctcctcagcatcctttccaagacctacatctgctacatcctgatgccgatcttcatccccctcgcctacatttacggggtcatctacaacaaatcctgcaagaagtgcaagctgtgtggcctggtgtaccaccccttcaccgagtgcgggacgcactgcgtgtgcggcgcgcggtacgagacctctgaccgcatgaagctccaccgagccagcggcctgtgccccggatacaagtccctgcgcgccgcccgggtcatgtgcaagagcaagggcccggccagcatcctctccatcatcaccgcggtgctgatcctgaccttcgtgacgcccatcaacgccatggtcgccggggacacccaggagaccttcaagctcgaggacctgcccgacgacatgctgagcatggccatgaaggtgaacatgtactatatcatgtgcatgatcaactacgccgtcacctggtcctttatcttatgcgcgctgctgatcgccctcctgttcaagaagtaccagcacagattcctgaacttctacgcaatgtactgccacgagtgtgacatgtaccacgaccggagtggcctcaaatacaacggcgacttcacgaacaagtgccgccagtgcacgtgcgggcagtacgaggacgccgctggcctgctgacccaccggaagacctacaactgcctcgtgcagtacaagtccaagtggctgaccaacttcctaatcgtgtacatcatcctcatgctgatcgaggacagcgtcctgatcgtgcatgcggacgggaccgactttgagaagtgctccggcgaggccgacatcacctggaactgcaccgggcccttcctcaacctgggcaactgcgagaagaagcagaagaaggagagctacaacaacatcgccacgcagctgaagggcctcgacgccatctccgtgctggacatcccgatgatcagcaagattcccgaggacatcgcaggggccttacgcttcatcgaggagcagcggtcctaccacgtccagctgaccgccgagtacgccatgctcacccgctactgcgactactacactcagttcaccgacaacagcggctactcccagacgacctggcgggtgtacctgcgcagccacgacttcgaggcctgcatcctgtaccccaaccggcacttctgccgctgcgtcaagcacggggacaagtgctccagctccaactgggacttcgcgaacgagatgaagaactactacagcggcaagcagtccaagttcaacaaggacctcaacttagccctgatgagcctccaccacgccttccgcgggaccagctccttctacatcgccaagctgctgaaggagaagaagaacgaggacctcgtcacctatgccgagaagatcaagggcaagtaccccggcaatgcgctgctgaaagccatcatcgactacatcaagtacatgaaggacctcacggagatgaacaacttcaagcacgacgagatgtgggaggacttcatcttcgaggtgccgcccaccaagagcccgtccgtgcggcgactggagagctcttacgacttcaagaccaacgtcaacagcaacccctcccacatctgcaagaacatcaagaccgtggtgtgcctgagcccgaagtccggggtgagctacgactccatcatagcctgcggcgaacccagccagccctccatctaccggaagcccgacagtcaggtgttccagtccaacgccgaccagacgcacttctgcctcagcgacacccactgcctggagaactacgagactgtgggggaggagatcatcgacgccatcaagaagtccaagtgctgggagaccgagttcacggagtacatccagttcaagcagagcgacggcgtcaggtcatgccggatgaaggactccggggagtgcaccgtggcgaccaaccgctggccgatcatcctgtgcgacaacaataagttctactacagcgagctccaggaggactacgacaaggaccaggacataggccacttctgcctgagcccccggtgcaacaccatccgccaccccatcaaccgtaagcacatcagcaactgcacttggcaggtcagccacaacaacatcgacaagatcgaggtgcacgagctggaggacctcgagcagtacaagaaggccatcacccagaagctgcagaccagcctgaccctcttcaagtactccaagacgaagaacctgccacacatcaagccgatgtacaagtacatcaccatcgagggcaccgagaccgccgaggggatcgagagcgcctacatcgagtccgagatccccgcgctggccggcacgagcatcgggttcaagatcacatccaagagcggcaagcacctcctggacgtgatcggctatgtgaagtccgccagctactccgccgtctacaccaagctgtacaccacggggcccaccatcggcgtgaacaccaagcacgacgagctctgcaccgggccttgccccgtgaacgtcccccacggcacggggtggctaaccttcgccaaggagcgcaccagctcctggggctgcgaggagttcggttgcctggcgatcagcgacgggtgcgtgttcggctcctgccaggacatcatcaaggacgagattaccgtataccggaaggagacggaggagaccaccgacgtcgagctctgcttgaccttcgccgacaagacctattgcaccaacctgaacgcaatcacccccatcattaccgaccagttcgaggtgcagttcaagaccgtggaggcatacagcctgccgcgcatcatcgccgtccgtaaccacgagatcatggtggggcagatcaacgacatcggcgtttacagcaaggggtgcggcaacgtccagaaggtgaacaacacgaactacggcaacggggtgcccaagttcgattacctgtgccatctggcgtcccgcaaggaggtcatcgtgcggaagtgcttcgacaacgactaccaggcctgcaagttcctccagacccccgccagctaccgcctggaggaggagggcggctccgtgaccgtcatcgactacaagaagatcctgggcaccatcaagatgaaggccatcctcggggacgtgaagtacaagacgttcgccgacaacgtggacctgaccgtcgagggcgtgtgcaccggctgcatcaactgcttcgaaaacatccactgcgaactgaccatccacagtacggtggaggcgtcttgccccgtcgttagctcctgcaccgttttccacgaccggatcctcatcaccccgaacgagcacaagtacgccatcaaggtcatctgcaacgagaaacccgggcccatcctgccctttaagatctgcagcgccaaaaccgacgccgcgatgacgctggccgacgccaagccgatcctcgaactggcccccgtggaccagaccacctacatcaaggagaaggacgagcgctgcaagacctggatgtgccgggtccgcgacgagggcttccaggtgatcttcgagcccttcaagaacctgttcgggtcgtacatcggcatcttctacacgttcatcatcagcctcatggccatatttatcgtgatctacatagtcctgcccatctgcttcaaaatccgcgacacactgcggcagcacgaggacgcgtacaagcgcgagatgaagatccggtga

SEQ ID NO: 15905 - RNA, 4323 nt, synthetic construct; identical to SEQ ID NO: 12619
  misc_feature 1..4323: note = derived and/or modified CDS sequence (opt11) from TAHV(1014)__GQ386833.1__GP
  source 1..4323: mol_type = other RNA

SEQ ID NO: 15906 - RNA, 4323 nt, synthetic construct; identical to SEQ ID NO: 12620
  misc_feature 1..4323: note = derived and/or modified CDS sequence (opt11) from TAHV(105)__GQ386829.1__GP
  source 1..4323: mol_type = other RNA

SEQ ID NO: 15907 - RNA, 4323 nt, synthetic construct; identical to SEQ ID NO: 12621
  misc_feature 1..4323: note = derived and/or modified CDS sequence (opt11) from TAHV(106)__GQ386830.1__GP
  source 1..4323: mol_type = other RNA

SEQ ID NO: 15908 - RNA, 4323 nt, synthetic construct
  misc_feature 1..4323: note = derived and/or modified CDS sequence (opt11) from TAHV(181)__GQ386831.1__GP
  source 1..4323: mol_type = other RNA
atgatgttcgtgctgttcttcatcgcactcagcgccgcgtcccccgtctaccagcgctgcttccaggacggcgccatcgtgaagcagaacccgagcaagcaggccgtgaccgaggtctgcctgaaggacgacgtgtccatgatcaagaccgaggcccggtatttccgcaacgccacggggacctacgcgaacaacgtggccatccggaagtggctggtcagcgactggcacgactgccgccccaagaaggtctccggcgggcacatcaacgtgatcgaggtcggcgacgacctcaccctgcacaccgaggcctacgtgtgcaacgccgactgcacgatcggggtggacaaggagacggcgcaggtccggctgcagaccgacacaacgaaccacttcgagatcgccggcaccaccgtaaagtccggctggttcaagtccaccacttacatcacactcgaccagacctgcgagcacctgaaggtgagctgcgggcccaagtccatccagttccacgcctgcttcaaccagcacatgagctgcgtccgcttcctgcaccgaaccatcctccccggctccatcgccagctccatctgccagaacgtggagatcatcatcctgacggtgctgaccctcctgatcttcatcctgctcagtatactgtccaagacctacatctgctacatcctgatgccgatcttcatccccctcgcctacatctacggggtcatttacaacaagagctgcaagaagtgcaagctgtgcggcctggtgtaccaccccttcacagagtgcgggacgcactgcgtgtgcggcgcgcgctacgagacctccgaccggatgaagctccaccgcgccagcggcctgtgccccggttacaagtccctgcgggccgcccgcgtcatgtgtaagagcaagggcccggctagcatcctctccatcatcaccgcggtactgatcctgaccttcgtgacgcccatcaacgccatggtcgccggggacacccaggagaccttcaagctcgaggacctgcccgacgacatgctcagcatggccatgaaggtgaacatgtactacatcatgtgcatgatcaactacgccgtcacctggtccttcatactctgcgcgctgctgatcgccctcctgttcaagaagtaccagcaccggttcctgaacttctacgccatgtactgccacgagtgcgacatgtaccacgaccgcagcggtctgaaatacaacggcgacttcacgaacaagtgccggcagtgcacgtgcgggcagtatggcgacgccgccgggctgctgacccaccgcaagacctataactgcctcgtgcaatacaagtccaagtggctgacgaacttcctgatcggctacatcatcctcatgctgatcaaggacagcgtgctgatcgtccacgcggacgggaccgacttcgagaagtgctccggcgaggccgacatcacctggaactgcacaggcccattcctcaacctggggaattgcgagaagaagcagaagaaggagagctacaacaacatcgccacgcagctgaagggcctcgacgcaatcagtgtgctggacatcccgatgatcagcaagatccccgaggacatcgcgggggccctgcggttcatcgaggagcagcgctcctaccacgtgcagctgaccgccgagtacgctatgctcacccggtactgcgactactacacccaattcaccgacaacagcggctactcccagacgacctggcgcgtctacctgcggagccacgacttcgaggcctgcatcctgtaccccaaccgccacttctgccgctgcgtgaagcacggggacaagtgctccagctccaactgggacttcgctaacgagatgaagaactactacagcggcaagcagtccaagttcgacaaggacctcaacctggccctgatgagcctccaccacgccttccggggcaccagctccttctacatcgccaaactgctgaaggaaaagaagaacgaggacctcgtgacctacgccgagaaaatcaaggggaagtaccccggcaacgcgctgctcaaggccatcatcgactacatcaagtacatgaaggggcttacggagatgaacaacttcaagcacgacgagatgtgggacgacttcatcttcgaggtcccgcccaccaagagcccctccgtccgccggctggagagctcctacgacttcaagaccaacgtgaacagcaatccctcccacatctgcaagaacatcaagaccgtcgtgtgtctgagcccgaagtccggcgtgagctacgacagtatcatcgcctgcggggagcccagccagccgtccatctaccgcaagcccgacagccaggtcttccagtccaacgccgaccagacgcacttctgcctcagcgacacccactgcctggagaactacgagaccgtgggcgaggagatcatcgacgccatcaagaagtccaaatgctgggagacggagttcacggagtacatccagttcaagcagagcgacggcgtgcggagctgccgcatgaaggactccggggagtgcaccgtcaccaccaatcggtggccgatcatcctgtgtgacaacgacaagttctactacagcgagctccagaaggactacgacaaggaccaggacattggccacttctgcctgagcccccgctgcaacacgatccgccaccccatcaaccgcaagcacatcagcaactgcacctggcaggtcaaccacaacaacatcgacaaaatcgaggtgcacgaactggaggacctcgagcagtacaagaaggcgatcacacagaagctgcagacctccctgaccctcttcaagtacagcaagactaagaacctgccccacatcaagccgatgtacaagtacatcaccatcgaggggaccgaaacggccgagggcatcgagtccgcctacatcgagagcgaaatccccgccctggcgggcacctccatcgggttcaagatcaccagcaagtccggcaagcacctcctggacgtgatcgggtacgtcaagagcgcctcctacagtgccgtgtacaccaagctgtacacgaccggccccaccatcggggtgaacaccaagcacgatgagctctgcactggcccgtgccccgtgaacgtgccccacggcaccgggtggctgaccttcgccaaggagcggacctccagctggggctgcgaggagttcgggtgcctggccatctccgacggctgcgtcttcgggagctgccaggacatcattaaggacgagatcacggtgtaccgcaaagagaccgaggagacaaccgacgtggagctctgcctgaccttcgcggacaaaacgtactgcaccaacctgaacgcaatcacccccatcatcaccgaccagttcgaggtccagttcaagaccgtggaggcctactccctcccgcggatcatcgccgtacgcaaccacgagatcatggtcggccagataaacgacatcggcgtgtacagcaaggggtgcggcaacgtgcagaaggtcaacaacaccaactatggtaacggcgtgcccaagttcgactacctgtgccacctggccagccggaaggaggtcatcgtccgcaagtgcttcgacaacgactaccaagcgtgcaagttcctccagacccccgcctcctaccggctggaggaggagggcgggagcgtgacggtgatcgactacaagaagatcctgggcacgattaagatgaaggccatccttggggacgtcaagtacaagaccttcgccgacaacgttgacctgaccgtggagggcgtctgcaccgggtgcatcaactgcttcgagaacatccactgcgagctgacgatccactccaccgtggaggccagctgccccgtggtctccagctgcaccgtgtttcacgaccgaatcctcatcaccccgaacgagcacaagtacgcgatcaaggtgatctgcaacgaaaagcccggccccacgctgcccttcaagatttgctccgccaagaccgacgccgccatgaccctggcggacgccaagccgatcctcgagctggcccccgtcgaccagaccacgtacatcaaggagaaggacgagcggtgcaagacctggatgtgccgcgtgcgcgacgaggggttccaggtcatcttcgaacccttcaagaacctgttcggcagctacatcggaatattctacaccttcatcatctccctcatggccatcttcatcgtaatctacatcgtgctgcccatctgcttcaagctgcgggacaccctccgccagcacgaggacgcctacaagcgggagatgaaaatccgctga

SEQ ID NO: 15909 - RNA, 4323 nt, synthetic construct
  misc_feature 1..4323: note = derived and/or modified CDS sequence (opt11) from TAHV(236)__GQ386832.1__GP
  source 1..4323: mol_type = other RNA
atgatgttcgtgctgttcttcatcgccctcagcgccgcgtcccccgtctatcagcgctgcttccaagacggcgccatcgtgaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtgtccggtgggcacatcaacgtgatagaggtgggcgacgacctcaccctgcacaccgaggcctatgtgtgcaacgccgactgcacgatcggcgtggacaaggagaccgcccaggtgcggctgcagaccgacaccacgaaccacttcgagatcgcgggcaccaccgtgaagtccggctggttcaaatccaccacgtacattaccctcgaccagacctgcgagcacctgaaggtgtcctgcgggcccaagtccatacaattccacgcctgcttcaaccagcacatgagctgcgtccgcttcctgcaccggaccatcctccccggctccatcgccagctccatctgccagaacgtggagatcatcatcttgacggtgctgaccctcctgatcttcatcctgctcagcatcctgtccaagacctacatctgctacatcctgatgccgatcttcatccccttagcctacatctacggggtcatctacaacaagagctgcaagaagtgcaagctgtgcggcctcgtgtaccacccattcaccgagtgcgggacgcactgtgtgtgcggcgcgcggtacgagacctccgaccggatgaagctccaccgcgcgtcaggcctgtgtccggggtacaagtccctgcgggccgcccgcgtcatgtgcaagagcaagggcccggccagcatcctcagcatcatcaccgcggtgctgatcctgaccttcgtgacgcccattaacgccatggtcgccggggacacccaagagaccttcaagctcgaggacctgcccgacgacatgctgagcatggccatgaaggtgaacatgtactacatcatgtgcatgatcaactacgccatcacctggtccttcattctctgcgcgctgctgatcgccctcctgttcaagaagtaccagcaccggttcctgaacttctacgccatgtactgccacgagtgcgacatgtaccacgacaggagcggcctcaaatacaacggcgacttcacgaacaagtgccggcagtgcacgtgcgggcagtacgaggacgccgccggcctgctgacccaccgcaagacctacaactgcctggtccagtacaagtccaagtggctgaccaacttcctgatcgtgtacatcatcctcatgctaatcaaggacagcgtgctgatcgtccacgcggacgggaccgacttcgagaagtgctccggcgaggccgacatcacctggaactgcactgggcccttcctcaacctgggcaactgcgagaagaagcagaagaaggagtcctacaacaacatcgccacgcagctgaagggcctcgacgcgatctccgtgctggacatgccgatgatcagcaagatccctgaggacatagcgggggccctgcggttcatcgaggagcagcgctcctaccacgttcagctgaccgccgaatacgccatgctcacccggtactgcgactactacacccagttcaccgacaacagcggctactcccagacgacctggcgcgtctacctgcggagccacgacttcgaggcctgcatcctgtaccccaaccagcacttctgccgctgcgtgaaacacggggacaagtgctccagctccaactgggactttgcgaacgagatgaagaactactacagcggaaagcagtccaagttcgacaaggacctcaacctggccctgatgagcctccaccacgctttccgggggaccagctccttctacatcgccaaactgctgaaggagaagaagaacgaggacctcgtgacctacgccgagaagatcaaaggcaagtaccccggcaacgcgctgctgaaggccatcatcgattacatcaagtacatgaaggacctcacggagatgaacaacttcaagcacgacgagatgtgggacgacttcatattcgaggtcccgcccaccaagagcccatccgtgcggcgcctggagagctcctacgactttaagaccaacgtgaacagcaacccctcccacatctgcaagaacatcaagaccgtcatctgccttagcccgaagagtggggtgagctacgactccatcatcgcctgcggcgagcccagccagccctccatctaccgaaagcctgacagccaggtgttccagtccaacgccgaccaaacgcacttctgcctaagcgacacccactgcctggaaaactacgaaaccgtcggggaggagatcatcgacgccatcaagaagtccaagtgctgggagaccgagctgacggagtacatccagttcaagcagagcgacggcgtgcgcagctgccggatgaaggactccggggagtgcaccgtgaccaccaatcgctggccgatcatcctctgcgacaacgacaaattctactactctgaactgcagaaggactacgacaaggaccaggacatcggccacttctgcctgagcccccggtgcaacacgatccgccaccccatcaaccggaagcacatcagcaactgcacctggcaggtctcccacaacaacatcgacaagatcgaggttcacgagctcgaggacctggagcagtacaagaaggcgatcacccagaaactgcagaccagcttgacgctgttcaagtactccaagaccaagaacctgccccacatcaagccgatgtacaaatacatcaccatcgagggcaccgaaacggccgaggggatcgagagcgcctacatcgagtccgagatccccgccctcgcgggcaccagcatcgggttcaagatcacctccaagagcggcaagcacctcctggacgtcatcggctacgtcaagtccgccagctactccgcagtgtacaccaagctgtacacgaccgggcccaccatcggcgtgaacactaagcacgacgagctgtgtacggggccgtgccccgtcaacgtgccccacggcactgggtggctgaccttcgccaaggagcgcaccagctcctggggctgcgaggagttcggctgcctcgccatcagcgacgggtgcgtgttcggctcctgccaggacatcatcaaggacgagatcacggtctaccggaaggagaccgaggagaccaccgacgtggaactgtgcctgaccttcgcggacaagacgtactgtaccaacctcaacgccatcacccccatcatcaccgatcagttcgaggtgcagttcaagacggtcgaggcctacagcctgccgcgcatcatcgccgtgcggaaccacgagatcatggtagggcagatcaacgacatcggcgtctacagcaaggggtgcggcaacgtgcagaaggtgaacaacaccaactatggcaacggggttcccaaattcgactacctgtgccacctcgcctcccgcaaggaggtgatcgtgcggaagtgcttcgacaacgactaccaggcgtgcaagttcctgcagacccccgccagctaccgtctggaggaggagggctccagcgttaccgtgatcgactacaagaagatcctcgggacgatcaagatgaaggccatcctgggcgacgtgaagtacaagaccttcgccgacaatgtcgacctgaccgtggagggggtgtgcaccggctgcataaactgtttcgagaacatccactgcgagctcacgatccactccaccgtcgaggccagctgccccgtggtatccagctgcaccgtcttccacgaccggatcctgatcaccccgaacgagcacaagtacgcgatcaaggtgatatgcaacgagaagcccggccccacgctgcccttcaaaatctgctccgccaagaccgacgccgccatgaccctcgcggacgccaagccgatcctggagctggcccccgtggaccagactacgtacatcaaggagaaggacgagcgctgcaagacctggatgtgccgggtccgcgacgaggggttccaggtgatcttcgagccattcaagaacctcttcggcagctacatcgggatcttctacaccttcatcatctccctgatggccatcttcatcgtcatctacatcgtgctgcccatctgcttcaagttacgcgacgccctgcggcagcacgaggacgcgtacaagagagagatgaagatccggtga

SEQ ID NO: 15910 - RNA, 4323 nt, synthetic construct; identical to SEQ ID NO: 12624
  misc_feature 1..4323: note = derived and/or modified CDS sequence (opt11) from TAHV(29)__GQ386823.1__GP
  source 1..4323: mol_type = other RNA

SEQ ID NO: 15911 - RNA, 4323 nt, synthetic construct; identical to SEQ ID NO: 12625
  misc_feature 1..4323: note = derived and/or modified CDS sequence (opt11) from TAHV(4019)__GQ386834.1__GP
  source 1..4323: mol_type = other RNA

SEQ ID NO: 15912 - RNA, 4323 nt, synthetic construct; identical to SEQ ID NO: 12626
  misc_feature 1..4323: note = derived and/or modified CDS sequence (opt11) from TAHV(4020)__GQ386835.1__GP
  source 1..4323: mol_type = other RNA

SEQ ID NO: 15913 - RNA, 4323 nt, synthetic construct; identical to SEQ ID NO: 12627
  misc_feature 1..4323: note = derived and/or modified CDS sequence (opt11) from TAHV(4030)__GQ386836.1__GP
  source 1..4323: mol_type = other RNA

SEQ ID NO: 15914 - RNA, 4323 nt, synthetic construct; identical to SEQ ID NO: 12628
  misc_feature 1..4323: note = derived and/or modified CDS sequence (opt11) from TAHV(4033)__GQ386837.1__GP
  source 1..4323: mol_type = other RNA

SEQ ID NO: 15915 - RNA, 4323 nt, synthetic construct; identical to SEQ ID NO: 12629
  misc_feature 1..4323: note = derived and/or modified CDS sequence (opt11) from TAHV(4034)__GQ386838.1__GP
  source 1..4323: mol_type = other RNA

SEQ ID NO: 15916 - RNA, 4323 nt, synthetic construct; identical to SEQ ID NO: 12630
  misc_feature 1..4323: note = derived and/or modified CDS sequence (opt11) from TAHV(4057)__GQ386839.1__GP
  source 1..4323: mol_type = other RNA

SEQ ID NO: 15917 - RNA, 4323 nt, synthetic construct; identical to SEQ ID NO: 12631
  misc_feature 1..4323: note = derived and/or modified CDS sequence (opt11) from TAHV(4060)__GQ386840.1__GP
  source 1..4323: mol_type = other RNA

SEQ ID NO: 15918 - RNA, 4323 nt, synthetic construct; identical to SEQ ID NO: 12632
  misc_feature 1..4323: note = derived and/or modified CDS sequence (opt11) from TAHV(5060)__GQ386841.1__GP
  source 1..4323: mol_type = other RNA

SEQ ID NO: 15919 - RNA, 4323 nt, synthetic construct; identical to SEQ ID NO: 12633
  misc_feature 1..4323: note = derived and/or modified CDS sequence (opt11) from TAHV(76)__GQ386824.1__GP
  source 1..4323: mol_type = other RNA

SEQ ID NO: 15920 - RNA, 4323 nt, synthetic construct
  misc_feature 1..4323: note = derived and/or modified CDS sequence (opt11) from TAHV(83)__GQ386825.1__GP
  source 1..4323: mol_type = other RNA
atgatgttcgtgctgttcttcatcgccctcagcgccgcgtcccctgtctaccaacgctgcttccaagacggcgccatcgtgaagcagaacccgagcaagcaggccgtgacggaggtctgcctgaaggacgacgtgtccatgatcaagaccgaggcccggtacttccgcaacgccacgggtacctacgcgaacaacgtggccatacggaagtggctggtcagcgactggcacgactgccgccccaagaaggtgtccggcgggcacatcaacgtcatcgaggtcggcgacgacctcaccctgcataccgaggcctatgtgtgcaacgccgactgcacgatcggggtggacaaggagaccgcgcaggtccggctgcagaccgacaccacgaaccatttcgagatcgccggcaccacagtgaagtccggctggttcaagtccaccacatacatcaccctcgaccagacgtgcgagcacctgaaggtgagctgcgggcccaagtccatccagttccacgcatgcttcaaccagcacatgagctgcgtccgcttcctgcaccggaccatcctccccggctccatcgccagctccatctgccagaacgtggaaatcatcatcctgacagtgctgaccctcctgatcttcatcctgctcagcatcctgtccaagacctacatctgctacatcctgatgccgatcttcatccccctcgcctacatctacggggtcatctacaacaagagctgcaagaagtgtaagctgtgcggcctggtgtaccaccccttcaccgagtgcgggacgcactgcgtgtgcggcgcgcgctacgagacctccgaccggatgaagctccaccgcgccagcggcctgtgccccgggtacaaatccctgcgggccgcccgcgtcatgtgcaagagcaagggcccggccagcatcctctccatcatcaccgcggtgctgatcctgaccttcgtgacgcccatcaacgccatggtcgccggggacacccaggagaccttcaagctcgaggatctgcccgatgacatgctgagcatggcgatgaaggtgaacatgtactacatcatgtgcatgatcaactatgccgtcacctggtccttcatcctctgcgcgctgctgatcgccctcctgttcaagaagtaccaacaccggttccttaacttctacgccatgtactgccacgagtgcgacatgtaccacgaccgcagcggcctcaagtacaacggcgacttcacgaacaagtgccggcagtgcacgtgcgggcagtacgaggacgccgccggcctgctgacccaccgcaagacgtacaactgcctcgtgcagtacaagtccaagtggctgacgaacttcctgatcgtgtacatcatcctcatgctgatcaaggatagcgtcctgatcgtgcacgcggacgggaccgacttcgagaagtgctccggcgaggccgacatcacctggaactgcactgggcccttcctcaacctgggcaactgcgagaagaagcagaagaaagaaagctacaacaacatcgccacgcagctgaagggcctcgacgccatctccgtgctagacatcccgatgatcagcaagatccccgaggacatcgcgggggccctgcggtttatcgaggagcagcgctcctatcacgtccagctgaccgccgagtacgccatgctcacccggtactgcgactactacacccagttcaccgacaacagcggctactcccagacgacctggcgcgtgtacctgcggagccatgacttcgaggtgtgcatcctgtaccccaaccagcacttctgccggtgcgtcaagcacggggacaagtgctccagctccaactgggacttcgccaacgagatgaagaactattacagcggcaagcagtccaagttcgacaaggacctcaacctggcactgatgagcctccaccacgcattccgcgggaccagctccttctacatcgccaaacttctgaaggagaagaagaacgaggacctcgtgacctacgccgagaagatcaagggcaagtaccccggcaacgctctgctgaaggcgatcatcgactacatcaagtacatgaaggggctcacggagatgaacaacttcaaacacgacgaagtgtgggacgatttcatcttcgaggtcccacccaccaagagcccttccgtgcggcgcctggagagctcctacgacttcaagaccaacgtgaatagcaacccctcccacatctgcaagaacatcaagaccgtcgtgtgcctgagcccgaagtccggggtgagctacgactccataatcgcctgtggggagccctctcagccctccatctaccggaagcccgacagccaggtcttccagtccaacgccgaccagacgcacttctgcttaagcgacacccactgcctggagaactacgagaccgtgggggaggagatcatcgacgccatcaagaagtccaagtgctgggagaccgagttcacggagtacatccagttcaagcagagcgacggtgtgagaagctgccggatgaaggactccggagagtgcaccgtcaccaccaaccgctggccgatcatcctgtgcgacaacgacaagttctactacagcgagctccagaaggactacgacaaggatcaggacatcggccacttctgcctgagcccccggtgcaacacgatacgccatcccatcaaccggaagcacatcagcaactgcacctggcaggtctcacacaacaacatcgacaagatcgaggtgcacgaactggaggacctcgagcaatacaagaaggccatcacccagaagctgcagaccagcctgaccctcttcaagtactccaagaccaagaacctgccccacatcaaaccaatgtacaagtacatcaccatcgaggggaccgagacggcggagggcatcgagagtgcctacatcgagtccgagatccccgccctagccgggaccagcatcggcttcaaaatcacatccaagagcggcaagcacctcctggacgtgatcgggtacgtgaagtccgcgtcatactccgccgtgtataccaagctgtacacgaccggccccaccatcggggtcaacaccaagcacgacgagctatgcacgggcccgtgccccgtgaacgtgccccacgggaccggctggttgaccttcgccaaggagcgcaccagctcctggggctgcgaggagttcgggtgcctggccatcagcgacggctgcgtcttcgggtcctgccaggacatcatcaaggacgagatcacggtgtaccggaaggagaccgaggagaccaccgacgtggagctctgcctgaccttcgccgacaagacgtactgcaccaacctgaacgcaatcacccccatcatcaccgaccagttcgaggtccagttcaagacggtggaggcctacagcctgccgcgcatcatcgccgtccggaaccacgaaatcatggtcggccagatcaacgacatcggagtgtacagcaagggctgcggcaacgtgcagaaagtcaacaacaccaactacgggaacggcgtgcccaagttcgattacctgtgccacctggcctcccgcaaggaggtgatcgtccggaagtgcttcgacaacgattaccaagcctgcaagttcctccagacccccgcgagctaccggctggaggaagagggcggctccgtgaccgtgatcgactacaagaagatcctggggacgatcaagatgaaggccatcctcggcgacgtcaagtacaagaccttcgccgacaacgtggacctgaccgtggagggcgtctgcaccgggtgcatcaactgcttcgagaacatccactgcgagctgacgatccacagcaccgtggaggcctcctgccccgtggttagctcctgcaccgtgttccacgaccggatccttatcaccccgaacgagcacaagtacgccatcaaggtcatctgcaacgagaagcccggccccacgctgcccttcaagatctgcagcgcgaaaacagatgccgccatgaccctggccgacgcgaagccgatcctcgagctggcccccgtggaccagaccacgtacatcaaggagaaggacgagcgctgcaagacctggatgtgccgggtgcgggacgaggggtttcaggtcatctttgagcccttcaagaacctgttcggctcctacatcgggatcttctacaccttcatcatcagcctcatggccatcttcatcgtgatctacatcgtgctgcccatctgcttcaagctgcgcgacaccctccggcagcacgaggacgcctacaagcgcgagatgaagatccggtga

SEQ ID NO: 15921 - RNA, 4323 nt, synthetic construct; identical to SEQ ID NO: 12635
  misc_feature 1..4323: note = derived and/or modified CDS sequence (opt11) from TAHV(89)__GQ386826.1__GP
  source 1..4323: mol_type = other RNA

SEQ ID NO: 15922 - RNA, 4323 nt, synthetic construct
  misc_feature 1..4323: note = derived and/or modified CDS sequence (opt11) from TAHV(90)__GQ386827.1__GP
  source 1..4323: mol_type = other RNA
atgatgttcgtgctgttctttatcgccctcagcgccgcctcccccgtctaccagcgctgtttccaggacggcgccatcgtaaagcagaacccgagcaagcaggccgtgaccgaggtctgcctgaaggacgacgtgtccatgatcaagaccgaggcccggtacttccgcaacgccacggggacctacgcgaacaacgtggccatccggaagtggctggtcagcgactggcacgactgccgccccaagaaggtggccggcggccacatcaacgtgatcgaggtcggcgacgacctcaccctgcacaccgaggcctacgtgtgcaatgcggactgcacgatcggggtggacaaagagaccgcccaggtcagactgcagaccgacaccacgaaccacttcgaaatcgccggcaccaccgtgaagtccggctggtttaagagcaccacgtacatcacactcgaccagacctgcgaacacctgaaggtttcctgcgggcccaagagcatccagttccacgcctgcttcaaccagcacatgtcctgcgtccgcttcctgcaccggaccatcctccccggcagcatcgcctccagcatctgccagaacgtagagatcataatactgacggtgctgaccctcctgatctttatcctgctctccatcctgagcaagacctatatctgctacatcctgatgccgatcttcatccccctcgcgtacatctacggggtcatctacaacaagtcctgcaagaagtgcaagctgtgcggcctggtgtaccaccccttcaccgagtgcgggacgcactgcgtgtgcggcgcccgctacgagaccagcgaccggatgaagctccaccgcgcctccggcctgtgccccgggtacaagagcctgcgggccgcccgcgtcatgtgtaagtccaagggcccggcgagtatcctcagcatcatcaccgccgtgctgatcctgaccttcgtgacgcccatcaacgccatggtcgccggggacacccaggagaccttcaagctcgaggacctgcccgacgacatgctgagcatggccatgaaggtgaacatgtactacatcatgtgcatgatcaactacgccgtcacctggagcttcatcctctgcgccctgctgatcgccctcctgttcaagaagtaccagcaccgtttcctgaacttctacgccatgtactgccacgagtgcgacatgtaccacgaccgctccggcctaaagtacaacggcgacttcacgaacaagtgccggcagtgcacgtgcgggcagtacgaggacgccgcgggcctgctgacccatcgcaagacctacaactgcctcgtgcagtacaagagtaagtggctgaccaacttcctgatcgggtacatcatcctcatgctgatcaaggactccgtgctgatcgtccacgccgacggcaccgacttcgagaagtgctcgggggaggcagacatcacctggaactgcaccggccccttcctcaatctgggcaactgcgagaagaagcagaagaaggagtcctacaacaacatcgccacgcagctgaaggggctcgacgcgatcagcgttctggacatcccgatgatctcgaagatccccgaggacatagccggcgccctgcggttcatcgaggagcagcgcagctaccacgtgcagctgaccgccgagtatgccatgctcacacggtactgcgactactacacccagttcaccgacaactccgggtacagccagacgacctggcgcgtctacctgcggtcccacgacttcgaggcgtgcatcctgtacccaaaccagcacttctgccgctgcgtgaagcacggcgacaagtgcagctccagcaactgggacttcgccaacgagatgaaaaactattactccgggaagcagagcaagttcgacaaggacctcaacctggccctcatgtccctccatcacgccttccgcgggaccagcagcttctacatcgccaagctgctgaaggagaagaagaacgaggacctcgtgacctacgcagagaagatcaaggggaagtatcccgggaacgccctgctgaaggccatcatcgactatatcaagtacatgaagggcctcacggagatgaacaacttcaagcacgacgagatgtgggacgacttcatcttcgaggtcccgccgaccaagtcccccagcgtacggcgcctggagtccagctacgacttcaagaccgacgtgaactccaaccccagccacatctgcaagaacatcaagaccgtcgtgtgcctgtcccccaagagcggggtgtcctacgacagcatcatagcctgcggcgaaccgtcccagccctcgatctaccggaagcccgactcccaggtcttccagagcaacgccgaccagacgcacttctgcctatccgacacccactgcctggagaactacgagacggtgggggaggagatcatcgacgcgatcaagaagtccaagtgctgggagaccgagttcacggagtacatccagttcaagcagagcgacggtgtgcgcagctgccggatgaaggacagcggcgagtgcaccgtcaccaccaaccgctggccgatcatactgtgcgacaacaacaaattctactacagtgagctccagaaggactacgacaaggaccaggacatcgggcacttctgcctgagcccccggtgcaacacgatccgccaccccatcaaccggaagcacatctccaactgcacctggcaggtcaaccacaacaacatcgacaagatcgaggtgcacgagctggaggacctcgagcagtacaagaaagccatcacccagaagctacagaccagcctgaccctcttcaagtactccaaaaccaaaaacctgccccacatcaagccgatgtacaagtacatcaccatcgagggcaccgagacggccgaggggatcgagtctgcctacattgagtccgagatccccgctctggccggcaccagcatcggcttcaagatcacctccaagagcgggaagcacctcctggacgtgatcggctatgtgaagtccgccagctactccgccgtgtacaccaagctgtacacgaccgggcccaccatcggcgttaacaccaagcacgacgagctctgcacggggccgtgccccgtgaacgtgccacacggcaccggctggctgaccttcgccaaggagcgcactagctcctgggggtgcgaggagttcggctgcctggcgatcagcgacgggtgcgtcttcggctcatgccaagacatcatcaaggacgagatcacggtgtaccggaaggagaccgaggagaccaccgacgtggaactgtgcctgaccttcgccgacaagacgtactgcaccaacctgaacgccgtcacccccatcatcaccgaccagttcgaggtgcagttcaagacggtggaagcctacagcctcccgcgcatcatcgccgtccggaaccacgagatcatggtggggcagatcaacgacatcggcgtgtactccaagggctgcgggaacgtccagaaggtgaacaacaccaactacggcaacggggtgcccaagttcgactacctgtgccacctggcgagccgcaaggaggtcatcgtgcggaagtgcttcgacaacgactaccaggcctgcaagttcctccagacccccgccagctaccgcctggaggaggagggcgggtccgtgaccgtcatcgattacaagaagatcctgggcacgatcaagatgaaggccatcttgggcgacgtgaagtacaagaccttcgctgacaacgtggacctgaccgtcgagggggtgtgcaccggctgcatcaactgcttcgagaacatccactgcgagctgacgatccatagcaccgtcgaggcgtcctgccccgtcgtgagctcctgcaccgccttccacgaccggatcctcatcaccccgaacgagcacaagtatgccatcaaggtgatctgcaacgagaagcccggccccacgctgccatttaagatctgcagcgccaagaccgacgcggccatgaccctggccgacgccaagccgatcctcgagctggcccccgttgaccagaccacgtacatcaaggagaaggacgagcgctgcaagacctggatgtgccgggtgcgcgacgagggcttccaggtcatcttcgagcccttcaagaacctgttcgggtcctacatcggcatcttctacaccttcatcatcagcctcatggcgatcttcatcgtgatctacatcgtgctgcccatctgcttcaagctgcgcgataccctccggcagcacgaggacgcctacaagcgcgagatgaagatccggtga

SEQ ID NO: 15923 - RNA, 4323 nt, synthetic construct; identical to SEQ ID NO: 12637
  misc_feature 1..4323: note = derived and/or modified CDS sequence (opt11) from TAHV(94)__GQ386828.1__GP
  source 1..4323: mol_type = other RNA

SEQ ID NO: 15924 - RNA, 4323 nt, synthetic construct; identical to SEQ ID NO: 12638
  misc_feature 1..4323: note = derived and/or modified CDS sequence (opt11) from TAHV(XJ0625)__EU622819.2__GP
  source 1..4323: mol_type = other RNA

SEQ ID NO: 15925 - RNA, 4323 nt, synthetic construct; identical to SEQ ID NO: 12639
  misc_feature 1..4323: note = derived and/or modified CDS sequence (opt11) from TAHV(XJ0708)__HM243138.1__GP
  source 1..4323: mol_type = other RNA

SEQ ID NO: 15926 - RNA, 4323 nt, synthetic construct; identical to SEQ ID NO: 12640
  misc_feature 1..4323: note = derived and/or modified CDS sequence (opt11) from TAHV(XJ0710)__HM243141.1__GP
  source 1..4323: mol_type = other RNA

SEQ ID NO: 15927 - RNA, 4326 nt, synthetic construct; identical to SEQ ID NO: 12641
  misc_feature 1..4326: note = derived and/or modified CDS sequence (opt11) from TVTV__AF123491.1__GP
  source 1..4326: mol_type = other RNA

SEQ ID NO: 15928 - RNA, 4335 nt, synthetic construct
  misc_feature 1..4335: note = derived and/or modified CDS sequence (opt11) from TVTV(AR42)__KX891322.1__GP
  source 1..4335: mol_type = other RNA
atgcggaacatgatcgtgttcgccctgctcaccatcgtcgccgcgagcccggtgtacaagcggtgcttccaggatggcgccatcgtgcgccaggagtactccaagaacgccgtcaccgaggtgtgcctgaaagacgacgtgagcatgatcaagacggaggccgagtacttcaagaactccaccggggtcttcagcaagaacatcgcctaccggaagtggttagtatccgactggaacgagtgcagaccgcagaagtccgcgaacggccacatcaacgtgatcgaggtccagcccgacctctccctgcagaccaacagctacgtttgcgccgcgacctgcgtgatctccatcgacaaggagacggcccaagtcaggctgcagaccgacaccaccaaccacttcgaaatcagcgggacgaccgtgaagtccggctggttcaagagcaccacctacctcacgctggaccagacctgcgagcacctgaagatctcatgtgggagcaagtctgtgcagctccacgcctgcttcaaccagcacatgagctgcgtacgcttcctgcaccggaccatcctgcccggaaatatcgccaactcaatctgccagaacatcgagatcatcatcctcaccagcctgtccctgttcatcttcctcttcctgacgatcatcagcaagacctacatctgctacgttctgatccccatcttcatcccgatcgcctacgtgtacggcttcatctacaacaagagctgcaaaaagtgcaagctctgcgggctggtctatcaccccttcaccgagtgcggctcccactgcgtgtgcggggccaagtacgacaccagcgaccgcatgaagatgcaccggtccagcggcctgtgccccgggtacaagtccctccgcgccgcgcggagcatgtgcaagtccaagggccccgccagcatcctgtccctgttaagcgccgtgctgatcctgacgttcgtcaccccgatcaccgccatctccctcaaggacgaggagaaagagacctacaagctgagcgagctgcccgacgacatggtgaacctcgagaacaagatcgacctgtacttccagatgtgcctgatcaattacgccacgacctgggcgctcatcttctgcgccctgatcaccgcctgcctgttcaagaagctccagcacaagttcctggactactacgccgtgtactgccacgagtgcgacatgtaccacgagcgccgtggcctgaagtataacggggacttctccaacaaatgccgccagtgcacgtgcggccagtacgaggacgccactgggctcctgacccaccgcaagagctacaactgcctggtccagtacaaggcgaagtggatgctcaacttcctgatcacctacgccatcctggtgatcataaaggattccgtcatgatcgtgggcgcgagcgacaccgacgtaaaggactgcctcgaccaggaggagatcacgtggaactgcaccggccccttcctgaatatggggtcctgcacccggccccagaagaaggagaactacggcaacatagccacccagctcaaggggctcgacgtcctgagcgccctggacatgccggcggttggcaagatccccgaggacatcgccggggccctgtcctacatcgagagcaagaagacgtaccacgagcagctcaccctggagttcgccatgctgacccggtactgcgacttctacaagcagtacgcggacaacagcggctactcccagaccacctggcgcgcctacatcaggagccacgacttcggcgtgtgcatcatgtaccccaaccagcacttctgccgctgcgtcaagatgggggagaagtgcacgtccagcaactgggactttgccaaccagatggccaactactataacggcaagcagaaccggttcaacaaggacctcaacctggccctgtacaccatgcaccacgcgttccgcgggtccaccagctacctcatctccaaggtgctgcacgagaagaagtacgaccagcttaccaacctcctgacgcagctgaagaccaagtaccccggcaacgccctcctgaaggccttaatcgactaccagatctacctcaagagcctgtccgagatgagctccttcaccccggacgagctgtgggacgacctccagtacgtgcccgcccccacattcaagcccaacctggggcgcagcgaggacaacgagtataagttcgacaagtcccggatcgtcgacccgcagacgacctgcaccagcctgaagggcgtgaactgcctcagcccccgcagccgggcctccgtgagcgacatcatcgcgtgcggccaggccacccagcccgccctgttctacgtccccaacgacaagatccaccagagcaacacggaccagaaccagtactgcatcggggattcccactgcctgaccaagttcaccccgatcaccgaggagctcctggccgccgtgaagaagtccaagtgccaggcattcgacctggacgacatcgtgaaaacgtcccccagcaccggcgtccgctcctgcctcgtgaagaagttcggcaactgcaacaccaccaaccaggtgtggcccatcacgatctgcagcgacgaccagtactactacacggacaccaagcagtcctacgactcgaaccaggatatcggccacttctgcctgagccccagatgcagcaccatccgctatccggtcaaccccaagcacctatccgcctgtacatggaccgaggagtacacccccgtagacaagatcagcgtgaccaacatcgaggagatcgagcagtacaagaaggccctgctgcagaagctgcagactgggctcaacatcttcaagtacaagaagacctccaacctgccacacatcaagcccatgtacaagtacatcaccgtccagggcaccgagacggccgagggggtggagaacgcgtacatcgagagcgagatgcccgccctggccgggtccagctcgggcttcaaggtgctcagcaaagaggggaaccacctgttcgacgtcgtggcctacatcaagtccgccagctacagctccgtgtacaataagctgtacagcaccggcccaactctcgggatcaacgtcaagcacgacgagaagtgcaccgggccgtgcccggcgaacatcccccacaagacgggctggctgaccttcgcccgggagaggacctccacctgggggtgcgaggaatacggctgcctggccatcagcgacgggtgcgtgttcggctcctgccaggacatcattaagcccgagatgaccgtgtaccggaagcagacggacgagatcgtcaccgtggagttatgcctgaccttcgtggacaagacctactgcacggaactcaacgccgtcaccccgatcatcagcgacctcttcgaggtgcagttcaaaaccgtggagtcctacagcctgcccaagatcgtcgcgatcaagaaccaccagatcttcgtgggccagatcaacgacatcgggacctactccaagggctgcgggaacgtgcaggttttcaacggcacgaactacgggagcggcacgccccgcttcgactacctgtgccacctcgcgtcccggaaggaggtgatcatgcgcaagtgcttcgacaacgactaccaggcctgcaagttcctgcagcagccaagctccttccggctggaggaggagggcgagaccgtgaccatcatcgactacaagaagatcctcgggaccatcaagatgaaggccatcttcggcgatgtcaagtacaagaccttcagcgagaaggtagacatcaacgccgagggggtgtgcgccggctgtatcaactgcttcgagtccatcaactgcgagttcaccatccacagcacagtcgagacgtcctgcccgctggtggccgactgccagctgttccacgaccgcctcctgatcacccccaacgagcacaagtacgccatcaaggccatctgcaaggacaagcccagcaacaccctgcggttctccatctgtaacaccaaggtcgaggccacggtcaccatcatcgacgcgaagcccatcctcgaactggccccggtggaccagaccgcctacatcaaggagaaggacgagcgctgcaagacctggctgtgccgggttaaggacgagggggtcgccgtgctcctggagcccttcaagaacctgttcggcagctacatcggcatcttttacgggatcatcctcgtcgtgctggccatcctggtgtgcatctacatcgtcctccccgtgtgcttcaagatccgcgacacgctgaagaagcacgaggacgcgtacaagcgggagatgaagatccgctga

SEQ ID NO: 15929 - RNA, 4335 nt, synthetic construct; identical to SEQ ID NO: 12643
  misc_feature 1..4335: note = derived and/or modified CDS sequence (opt11) from TVTV(Eklund)__KR149248.1__GP
  source 1..4335: mol_type = other RNA

SEQ ID NO: 15930 - RNA, 4335 nt, synthetic construct; identical to SEQ ID NO: 12644
  misc_feature 1..4335: note = derived and/or modified CDS sequence (opt11) from JCV(3324-04)__HM007357.1__GP
  source 1..4335: mol_type = other RNA

SEQ ID NO: 15931 - RNA, 4335 nt, synthetic construct
  misc_feature 1..4335: note = derived and/or modified CDS sequence (opt11) from JCV(61V2235)__U88058.1__GP
  source 1..4335: mol_type = other RNA
atggaggtgctaaacctcatctggctgctggccctatgctccgcctcccccgtcttccaacgctgcttccaggacggcgcgatcgtgaagcagaacccaagcaaggaagccgtgaccgaggtgtgcctgaaggacgacgtttccatgatcaaaaccgaggctaaatacgtaaagaacacgaccggtaccttcgccaacaacatagctatgcggaagtggctggtcgcggattggcacgactgccgcccccagaagtcctccggcgggcacatcaacgtgatcgaggtgggcgacgacctcagcctgcacaccgagtcctacatatgcagcgccgattgtgtgatcacggtggacaaagagaccgcccaaatccggctgcagaccgacaacaccaaccacttcgaggtggccgggacgaccgtcaagtccggctggttcaagagcaccacctacatcacgctcgaccagacctgcgaacacctgaaggtgtcctgcggccccaagagcatccagttccacgcgtgcttcaaccagcacatgtcctgtgtgcgcttcctgcaccgcaccatcctccccgggagcatcgccaactccatctgccagaacatcgagatcatcattctggtaaccctgagcctcgtcatcttcatctttctgtccatcgtgagcaagacatacgtctgctacctgctcatgccgatcttcacccccatcgccttcatctacggctgggtgtacaacaagtcctgcaagaagtgcaagctgtgcgggcttgtgtaccatcccttcaccgagtgcggcacccactgcgtctgcggggcccgctacgaaaacagtgaccggatgaagctccaccgcgccagcggtctgtgccccggctacaagagcctgcgggcagcccgcgtgatgtgcaagagcaaggggccggcctccattctctctatcatgacggccatactcatcctgaccttcgtgacccccatcagcgccatggtcatcggcgagagctccgagctctacaccctggacgacctgcccaacgacatggtgcaaatggcggagcgggtcaacatctactaccagatcacgatcatcaactacggggtcacctgggccttcttttgcctcggcctgatactggcctactttttcaagaaataccaacacaagttcctcgacttctacgccatgtactgcgaggagtgcgacatgtaccacgagaagtccggcctgacccactggggcgacttcaccaacaagtgccgccagtgcacgtgcgggcagttcgaggatgtggccgggctgatgatccacaagaagtcctacaactgcctcgtcaagtacaaggcgaagtggatccgggacatactgattatctacctggctatgatcctcatcaaggacagcctgctgttcgtgggcgccagcgggaccgacttcgccgcctgcatcgacgagaaggtggtcacctggaactgcaccggccccttcctgaacctcggacgctgcgacaaaagccagaagaaggcgtcctacgccgggatcgccgaccaactgaagggcctcggggtgatctctgtgctggacatcccgatgatcaagaacatgccggacgagatctccggcagcctgaagtacatcgattcactcgagacgtaccacgagcagctgaccgccgagtacgccttcctgacccggtactgcgactactacacccagtacacggacaagagcgggtactcccagaccgtctggcgcacctacctgcggagccacgatttcggggcatgcgtggtgtaccccaaccagcacttctgccgctgcgttaagtacggcgacaagtgcaacagcgccaagtgggatttcgccaacgagatgaagaccttctacaccgggcagaaggtgaagttcaacaaagacctcaacctggccctgttggtgctgcacaaagcgttcagaggcacggggaccgcctacgtcgccgaggccatggcccgcgaagataacggctccatggcgcacttcgccctggagatccggaagaagttccccaccaacgccctcctggccgccctgatcgattacatcgtgtacctccagagcctgggggagatcgcgaccttcgagctggacgaggactgggaggacttcaagtacaagccggagcccacggagtccacgccccaggtgcgcagccaccgtaacgaccagtacaacttcaagaacgccgagtccaacagcgacaccaaggtctgcaagaacgtgcagaaggtgctctgcatcagcccccggagcaaggccaaattcgagaacatcatcgcctgcggcgagcacgcgaacccgtccgtctacatgatgcccaacgtgagcatctaccaatccaacagcgagcgctcccactactgcatcgctggcagccactgcctggagaagtacgaggtggtcgagaccgagctgcttaacgccctaaagaagtccaagtgctgggccaaggagatggacgatatcatcctgcataagcagagtgacgggctccggtcctgccgcatcaaagacaccggcaactgcaacgtccaggagaacgactggaccatcgttctgtgcgagaacgggaactactactacagcgaggttcacaaggactacgacaaggaccaggacgtgggccacttctgcctgagcccccggtgcaccaccattcgctaccccattagcaagcggcatatcaagaagtgcgagtggcagatcagccactccacgatcgacaagatcagcgtgcaggagctcgcggacatcgagcagtacaagaaagcgatctcccagaagctgcagaccagcctgtccatcttcaagtacgtcagaaccaagaacctcccgcacatcaagcccgcctacaagtacatcaccgtggagggcgtggagacgatcgaggggatcgagaacgcattcattgaaagcgagatccccgccctggcgggaacggctatagggttcaagatcaactcccgggagggcaactacctgatggacgtcatcgggtacgtcaagagcgcctcctactccgccgtgtacaccaagctctacaccaccggccccaccatcggcatcaacaccaaacatgatgagaagtgcaccgggccgtgccccgccatcatcgaccacaaggacggctggctgacgttctccaaggagcgtaccagcacctggggttgcgaggagttcggctgccttgccgtctccgacgggtgcgtgttcggctcgtgccaggacattatcaaggacgagctcgcggtctaccggaagaccacggaggagctgaccaccgtcgagctgtgcctaaccttctccgacaagacgtactgcaccaacctgaacgcaatcacccccatcatcactgataagttcgaggtgcagttcaagacggtggagagctacaccctgccgcgcgtaatcgcaatcaagaaccacgagatcaaggtgggccagatcaacgacctcggggtgtactccaagggctgcgggaacgtccaaaaggttaacggcacgaactacgggaacggcagccctcggttcgactacctgtgccacctggctagccgtaaggaggtgatcctgcggaagtgcttcgacaatgactaccaggcgtgtaagttcctccagtcacccagctcctatcgcctggaggagcaccagggcaccgtcaccgtgattgactacaagaagatcctcggtacaatcaagatgaaagccatcctgggcgacgtgaagtacaagaactaccagaacaacatcgagatttccgccgaggggacctgcgcaggctgcatagactgcttcgagaacatccactgcgagttcaccatccacaccacggtcgaggcctcctgccccatcaccactgagtgcgtgagcttccacgaccggatcctgataaccccggacgagcacaagtacgcgctcaagattgtctgccacgacaagcccaaggtgtccctgaagttcaagatctgcaacacgcacgtggacgccgccatgaccattgtagacagcaagcccatcctggagctcgcccccgtggaccagacgacctacatccgcgagaaggacgagcggtgcaagacgtggatgtgccgcgtgcgcgacgagggctttcaggtcatcctggagccgttcaagaacctgttcggctcctatatcggcatcttctacactgggatcctcagcatcatctgcctgctgattgtcgtatacatcatcctacccatctgcttcaagctgcgggacaccctgcgccagcatgaggacgcctacaagaaagagatgaagatccggtga

SEQ ID NO: 15932 - RNA, 4335 nt, synthetic construct; identical to SEQ ID NO: 12646
  misc_feature 1..4335: note = derived and/or modified CDS sequence (opt11) from JCV(61V2235)__HM007351.1__GP
  source 1..4335: mol_type = other RNA

SEQ ID NO: 15933 - RNA, 4335 nt, synthetic construct
  misc_feature 1..4335: note = derived and/or modified CDS sequence (opt11) from JCV(61V2235)__KX817316.1__GP
  source 1..4335: mol_type = other RNA
atggaggtgctgaacctcatctggctgctggccctctgcagcgccagccccgtcttccagcgctgctttcaggacggcgcgatcgtgaagcagaacccgagcaaggaggccgtgaccgaggtctgcctgaaggacgacgtgtccatgatcaagaccgaggccaagtacgtgaagaacacgaccgggaccttcgccaacaacatcgccatgcggaagtggctggtcgcggactggcacgactgccgcccccagaagtcctccggcgggcacatcaacgtgatcgaggtgggcgacgacctcagcctgcacaccgagtcctacatctgctcggccgactgcgtcatcacggtggacaaggagaccgcccagatccggctgcagaccgacaacaccaaccactttgaggtggccggcacgaccgtcaagtccggctggttcaagagcaccacctacatcacgctcgaccagacctgcgagcacctgaaggtgtcctgcggccccaagagcatccagttccacgcgtgcttcaatcagcacatgagctgcgtgcgcttcctgcatcggaccattctccccgggagcatcgctaactctatctgccagaacatagagatcatcatcctggtcaccctgagcctcgtgatcttcatcttcctgtccatcgtgagcaagacgtacgtctgctacctgttgatgccaattttcatccccatcgccttcatctacggttgggtgtacaacaagtcctgcaagaagtgcaaactgtgcgggctggtgtaccaccccttcaccgagtgcggcacccactgcgtctgcggggcccgctacgagaccagcgaccggatgaagctccaccgcgccagcgggctctgccccggctacaagtccctgcgggcggcccgcgtcatgtgcaagagcaaggggccggcctccatcctcagcatcatgacggccatactgatcctgaccttcgtgacccccatctccgcgatggtcatcggcgagagctcggaggtgtacaccctcgacgacctgccaaacgacatggtccagatggcggagcgggtgaacatctactaccagatcatcatcatcaactacggtgtgacgtgggccttcctgctcctgggcctgatcctcgcctacttcttcaagaagtaccagcacaagttcctggacttctacgccatgtactgcgaggagtgcgacatgtaccacgagaaatccgggctgacccactggggcgacttcaccaacaagtgccgccagtgcacgtgcgggcagttcgaggacgtcgccggactcatgatccacaagaagtcctacaactgcctggtgaagtacaaagcgaagtggatccgggacatcctgatcatctacctcgccatgatcctgatcaaggacagcctgctgttcgtaggcgccagcggtaccgacttcgccgcctgcatcgacgagaaggtcgtgacctggaactgcaccggccccttcctgaacctgggccgctgcgacaaaagccacaagaaggcatcctatgccgggatcgccgaccagctcaagggcctgggggtgatcagcgtcctggacatcccgatgatcaagaacatgcccgacgagatctccggcagcctcaagtacatcgactccctggagacctaccacgagcagctgacggccgagtatgcgttcctgacacggtactgcgactactacacccagtacaccgacaacagcgggtactcccagacggtgtggcgcacctacctccggagccacgacttcggcgcctgcgtggtctaccccaaccagcacttctgtcgctgcgtgaagtacggcgacaagtgcaacagcgccaagtgggacttcgccaacgagatgaagaccttctataccgggcagaaggtgaagttcaacaaggatctgaacctggccctcctggtcctgcacaaggcgttccggggcaccgggacggcctacgtggccgaggccatggctcgcaaggacaacggctccatggcgcacttcgccctcgagatccggaagaagttccccaccaacgccctgctggccgccctcatcgactacattgtctacctgcagagcctgggggagatcgcgaccttcgagctcgacgaggactgggagggcttcaaatacaagccggaacccaccgagtccacgccccaggtccgcagccaccgcaacgaccagtacaacttcaagaacgccgagtccaacagcgacaccaaggtgtgcaagaacgtgcagaaggtcctgtgcatcagcccccggagcaaggccaagttcaagaacatcatcgcctgcggcgagcacgcgaacccgtccgtgtacatgatgcccaacgtgagcatctaccagtccaacagcgagcgctcccactactgcatcgccgacagccactgcctggagaagtatgaggtcgtggagacggagctcctgaacgccctgaagaagtccaagtgctgggccaaggagatggacgacatcatcctccacaagcagagcgacgggctgcggtcctgcagaatcaaggacaccggcaactgcaacgtgcaggagaacgactggacgatcgtcctgtgcgagaacgggaactactactacagcgaggtgcacaaggactacgacaaggaccaggacgtgggccacttctgcctcagcccccggtgcaccactatccgctaccccatctccaagcggcacatcaagaagtgcgagtggcagatcagccactccactatcgacaagatctccgtccaggagctggccgacatcgagcagtacaagaaggcaatctcccagaagctgcagacgagcctctccatcttcaagtacgtgcgcacgaaaaacctgccgcacatcaagcccgcctataagtacatcaccgtggagggcgtcgagactatcgaggggatcgagaatgccttcatcgagagcgagatccccgccctggccggcacggcgatcgggttcaagatcaactcccgggagggcaactacctcatggacgtgatcgggtacgtcaagagcgcctcctacagcgccgtgtacaccaagctgtacaccaccggccccacgatcggcatcaacaccaagcacgacgagaagtgcaccgggccgtgccccgccatcatcgaccacaaggacggctggctgaccttctccaaggagcgcacgagcacctgggggtgcgaggagttcggctgcctcgccgtgtccgacggctgcgtgttcggcagctgccaagacatcatcaaggacgagctggcggtctaccggaagaccaccgaggagctgacgaccgtggaactctgcctgaccttctccgacaagacctactgcacgaacctgaacgccatcacccccatcatcaccgacaagttcgaggtgcagttcaagaccgtcgagagctacacgctcccgcgcgtgatcgccatcaaaaaccacgagatcaaggtgggccagatcaacgaccttggggtctactccaagggctgcgggaacgtgcagaaggtgaacggcaccaactacgggaacggcagcccccggttcgactacctgtgccacctcgccagccgcaaggaggtcatcctgcggaagtgcttcgacaacgactaccaggcgtgcaagttcctacagtcccccagctcctaccgcctcgaggagcaccagggcaccgtgaccgtgatcgactacaagaagatcctggggaccatcaagatgaaggccatcctgggcgacgtcaagtacaagaactaccagaacaacatcgagatcaacgccgaagggacgtgcgccggctgcatcgactgcttcgagaacatccactgtgagttcaccatccacaccaccgtggaggccagctgccccatcacgaccgagtgcgtctccttccacgaccggatcctgatcaccccggacgagcacaagtacgcgttgaagatcgtttgccacgacaagcccaaggtgagcctgaagttcaagatctgcaacaccaacgtcgacgccgccatgacgatcgtagactccaaacccatcctggagctggcccccgtggaccagaccacctacatccgcgagaaggacgagcggtgcaagacctggatgtgccgcgtccgcgacgaggggttccaggtgatcctggagccgttcaaaaacctcttcggcagctacatcggcatcttctacacggggatcctgtccatcatctgcctgctcatcgtggtctacatcatcctgcccatatgcttcaagctgcgggacaccctccgccagcacgaggacgcctacaagaaggagatgaagatccggtga

SEQ ID NO: 15934 - RNA, 4335 nt, synthetic construct; identical to SEQ ID NO: 12648
  misc_feature 1..4335: note = derived and/or modified CDS sequence (opt11) from JCV(3573-03)__HM007354.1__GP
  source 1..4335: mol_type = other RNA

SEQ ID NO: 15935 - RNA, 4335 nt, synthetic construct; identical to SEQ ID NO: 12649
  misc_feature 1..4335: note = derived and/or modified CDS sequence (opt11) from KEYV(KEYV/Ochlerotatus atlanticus/USA/KEYVLK01/2005)__KT630289.1__GP
  source 1..4335: mol_type = other RNA

SEQ ID NO: 15936 - RNA, 4332 nt, synthetic construct; identical to SEQ ID NO: 12650
  misc_feature 1..4332: note = derived and/or modified CDS sequence (opt11) from KEYV(KEYV/Ochlerotatus atlanticus/USA/KEYVLK01/2005)__KT630289.1__GP
  source 1..4332: mol_type = other RNA

SEQ ID NO: 15937 - RNA, 4332 nt, synthetic construct
  misc_feature 1..4332: note = derived and/or modified CDS sequence (opt11) from KEYV(KEYV/Ochlerotatus atlanticus/USA/KEYVLK02/2005)__KT630292.1__GP
  source 1..4332: mol_type = other RNA
atgatctggatcctgctcaccgtggtcaccgccacgatcgccaaccccgtgtaccagcgctgcttccaggacggcgcgatcgtgaagcagaacccgtcaaaggaggccgtcaccgaggtttgcctgaaggacgacgtgtccatgatcaagaccgaagccaagtacgtgaaaaacctgaccgggacgttcagcaacaacgtggcaatgcggaagtggctcgtggccgactggcacgactgccgcccccagaagcgggcgggagggcacatcaacgtaatcgaagtgggcgacgacctgtccctgcacaccgagtcatacatctgctccgcagactgcgtgatcagcgtcgacaaggagaccgcccagatccgcctccagaccgacacgaccaaccacttcgaggtggccgggaccaccgtgaagtccggctggttcaagagcacgacctacatcaccctggaccagacctgcgagcacctgaaggtctcctgcggccccaagagcatccagttccacgcgtgcttcaaccagcacatgtcctgcgtgcggttcttacaccgaacgatcctgcccggaagcatcgccaactccatctgccagaacatcgagatcataatcctggtgaccctcaccctgctgatcttcatcctcctgagcatcctgtccaagacctacatctgctacatccttatgccgatcttcatccccatcgcctacatctacggctgggtctacaacaagagctgcaagaagtgcaagctgtgcggactggtgtaccaccccttcacggagtgcggcacccactgcgtgtgcggggcccggtacgagacatccgaccgaatgaagctccacagagcctcaggcctgtgccccggctacaagtccctgcgcgcggcccgggtcatgtgcaagagcaaggggccggccagcatcctttcgatcctgaccgccgttctgatcctcaccttcatcaccccaatgaacgccatggtgctgggcagctccgaggaggtctacaagctggaggacctccccgacgacatgctgaacatggcggagaagatcgacatctactacctgagcatcgtactgaactactccaccacctgggggctgctgatcctcctgctgatcgtcagctgcctcttcaagaagtaccagcacgtgttcctgaactactacgccatgtactgccacgaatgcgatatgtaccacgagaagaagaacctggtgtacaacggcgacttctccaacaagtgccgccagtgcacgtgcggccagtacgaggacgccaccgggctcatcgtccaccagaagtcctacaactgcctgatcaagtacaaggccaagtggttcatcaacatcttaatcatctacaccatcctcgttctgctgaaggactccgtgctcatggccgcggccgagggccccgacttcaacacgtgcatcgaacagcggtctatctccctgaactgcaccggtccgttcatcaacctgggcgggtgcgagaaaccccagaagcgcgccagctaccagtccatcgccgagcagctgaaggccatcaacgcgatcagcatcctcgacatgcccatgatctccaagatccccgacgacatcagcggcgccctgcggcacatagagaacctgaagacctaccacgagcagctcaccgccgagttcgccatgcttacccgctactgcgactactacacgcagttctccgacaacagcggctactctcagaccagctggcggacctacctgcgcagccacgacttcgaggtctgcatcgcgtacccgaaccagcacttctgccggtgcgtgaagaacggggagaagtgcacctccgccaactgggacttcgcaaacgagatgaagaactactacaccggcaagcaaatccgcttcgacaaggacctcaacctggcccttacgaccctccacaccgccttccgggggaccagcacgtactacatgtccgacatcctggcggagaccaaggccaacagcctgcgcgactacgctctcgccctgaagagtaagtaccccggcaacgccctgctcaaggcgatcctggacttcatcatgtacctgcagagcctcaacgaggccaccaagttcaagctgtccagtgactgggaggacttcaagtacaactccgagcccgaggcccgcgccctgatgccccgagcccggagctccggggactacaacttcagcaacgcggagtccaccaacaaggccaaggtatgcaagaacatccagcgggtcatgtgcctcagcccgcgctccaaggccacggtggaggacattatcgcctgcggcgagcacgagcaccccagcgtgtacatggtccccaacaccaccgtgtaccagtccaacatcgagcggagccactactgcatcgcggacagccactgcctggaggaatacgagctggtgcagaacgagctactgaccgccctgaagaagtccacgtgctggaccggcgagctcgagaacgtcatcccccacaagcagtctgacgggacccgctcctgccggaccaagaacacgggccgctgcaacgtgaagggggaggactggaccgttatcctgtgcgagaacgacaagtactactacagcgagctgaacaaggactacgataaggaccaggacatcggccacgtctgcctctcaccgcggtgcaacagcatccgctaccccattagcccccggcacatcaccaactgcaagtgggagaaccccgccgggaccatcagccgcatcgagacgcactccctggccgacatcgagcagtacaagaaggccatcagccagaagctgcagaactccctcaccatcttcaagtacgagaagaccaagaacctgccgcatatcaagcccatctacaagtatatcaccatcgagggcacggagacagtggagggcgtggagaacgcgttcatcgaggccgagatccccgccctggccgggaccagcatcggcttcaaggtcaactcccgggacggggaccacctcatggacatcatcgcctacatcaaggtggcgagctactccagcacctacacgaagctgtacaccaccggcccgaccatcggcatcaacacgaagcacgacgagaagtgcaccgggaactgccccgcccgcctggagcacaaggtgggctggctcaccttcgccaaggagcggacctccacgtggggctgcgaggagttcggctgcctggccgtcagcgacgggtgcgtgttcggctcctgccaggacatcatcaaggaggagctgagcgtgtaccgcaaggacaccgaggaggtcaccaacgtggaactctgcctgacctttgccgacaagacctactgcacgagcctgaatgcgatcacccccatcatcaccgagaagttcgaggtgcagttcaagaccgtcgagtcctacagcctcccacggatcgtgggcatccgcaaccacgaaatccggatcgggcagatcaacgacctgggctcctacagcaagggttgcggcaacgtgcagcgcgtcaacgacacgaactacggttccggccagccgaagttcgactacctgtgccacctcgccagccgcaaggaggtgatcgtgcggaagtgcttcgacaacgactaccaggcctgcaagttcctgcagaccccctctagctaccgcctggaggagcacgaaggcaccgtcaccatcatcgactacaagaagatcctcgggacgatcaagatgaaggcaatcctgggcgacgtgcggtataagaactacgcgtccgccatcgacatcaacgccgagggggtgtgcgccggctgtatcaactgcttcgagaacatccactgcgagttcaccatccacaccaccatcgaggccagctgccccatcgagtccgactgcgtcagcttccacgaccgcatgctggtgacgcccaacgagcacaagtacgcgctcaagctgatctgcgaggacaagccggggtccaccctgaaattcaagatctgcaacaccaagatcgacgccgccatgaccctcgtggacgccaagccaatcctggagctggcccccgtcgaccagacggcgtacatccgtgagaaggacgagcgctgcaagacctggatgtgccgggtgcgcgacgaaggcatcaaggtgctcctggagcccttcaaaaacctgttcggcagctacatcgggatcgtctactccatcatcctcatcatcatcgccgccatcatcatcatctacgtaatcctgccgatctgcttcaagctgcgggacaccctcaagaagcacgaggacgcttaccgcaaggagatgaagatccggtga

SEQ ID NO: 15938 - RNA, 4332 nt, synthetic construct; identical to SEQ ID NO: 12652
  misc_feature 1..4332: note = derived and/or modified CDS sequence (opt11) from KEYV(C14031-33)__AF123489.1__GP
  source 1..4332: mol_type = other RNA

SEQ ID NO: 15939 - RNA, 4326 nt, synthetic construct; identical to SEQ ID NO: 12653
  misc_feature 1..4326: note = derived and/or modified CDS sequence (opt11) from LACV(Human/78)__NC_004109.1__GP
  source 1..4326: mol_type = other RNA

SEQ ID NO: 15940 - RNA, 4326 nt, synthetic construct
  misc_feature 1..4326: note = derived and/or modified CDS sequence (opt11) from LACV__KP271111.1__GP
  source 1..4326: mol_type = other RNA
atgatccgcatcctggtgctcatcgccgtcaccgccgcgagccccgtataccagcggtgcttccaggacggcgccatcgtgaaacagaacccgtccaaggaagccgtcaccgaggtgtgcctgaaggacgacgtgagcatgatcaagaccgaggccaggtacgtccggaacgccaccggggtgttctcgaacaacgtggctatccgcaagtggctggtcagcgactggcacgactgccggcccaagaagatcatcggcgggcacatcaacgtgatcgaggtgggcgacgacctctccctgcacactgagtcctacgtctgttcggccgactgcagcatcggggtggacaaggagaccgcccaggtgcgcctgcagacggacaccaccaaccacttcgagatcgccggcaccacggtcaagtccggctggttcaagagcaccacctacatcaccctcgatcagacgtgcgagcacctgaaagtgtcctgcgggcccaagagcgtgcaattccacgcgtgcttcaaccagcacatgtcctgcgtccggttcctgcaccgcaccatcctccccggcagcatcgccaactccatctgccaaaacatcgagatcatcatcctggtgaccctgaccctcctgatcttcatcctgctcagcatcctgtccaagacgtacatctgttacctgctcatgccgatctttatcccaatcgcctacatgtacgggatcatctacaacaaatcgtgcaagaagtgcaagttgtgcggcctggtgtaccaccccttcaccgagtgcgggacccactgcgtctgcggcgcccggtacgacacctccgaccgcatgaagctccaccgggccagcggcctgtgccccgggtacaagagcctgcgcgcggcccgggtgatgtgcaagtccaagggcccggccagcatcttgtccatcatcacggccgtgctggtcctgactttcgtgacccccatcaacagcatggtcctcggggagtccaaggaaaccttcgagctggaggagctgcccgacgacatgctcgagatggccagccgcatcaactcctactactttacctgcatcctgaactacgcggtgagctggggcctggtgatcatcggcctgctgactgggctcctgttcaagaagtaccagcaccggttcctgaatgtctacgccatgtactgcgaggagtgcgacatgtaccacgacaagtccggcttgaagcgccacggggacttcaccaacaagtgccggcagtgtacgtgcggccagtacgaggacgccgccgggctcatggcacaccgcaagacctacaactgtctggtgcagtacaaggcgaagtggatgatgaacttcctgatcatctatatcttcctcatcctgatcaaggacagcgccatcgtggtccaggccgccggcaccgacttcacgacctgcctggagaccgagtccatcaactggaactgcaccggccccttcctcaacctggggaattgccagaagcagcagaagaaggagccgtacaccaacatcgccacccaactgaaaggcctcaaggcgatcagcgtgctggacatccccataatcacggggatacccgacgacatcgccggagctctgcggtatatcgaggagcgcgaggacttccacgtgcagctgaccatcgagtacgccatgctctccaagtactgcgactactacactcagttcagcgacaactccgggtactctcagaccacctggcgggtctacctgcgctcccacgacttcgaggcgtgcatcctgtaccccaaccagcacttctgccgctgcgtgaagaacggcgagaagtgcagctccagcaactgggacttcgccaacgagatgaaggactactacagcggcaagcagaccaagttcgacaaggacctcaacctagccctgaccgccctccaccacgccttccgggggacttccagcgcgtatatcgccaccatgctgtccaagaagtccaacgacgacctgatcgcctacacgaacaaaattaaggccaagttcccgggcaacgccctcctgaaggcgataatcgactacatcgcctacatgaagtccctgcccgggatggccaacttcaaatacgacgagttctgggacgagctcctgtacaagcccaaccccgccaaggccagcaatctggcgcgcggcaaggagagcagctacaacttcaagctcgccatctccagcaagtccatcaagacctgcaagaacgtgaaggacgtcgcctgcctgagcccccggtccggggccatctacgcgagcatcatcgcctgcggcgagcccaacggcccctccgtgtaccgcaagcccagcgggggcgtgttccagtccagcaccgatcggagcatctactgcctgctcgactcccactgcctggaggagttcgaggccatcaaccaggaggagctggacgccgtcaagaagtccaagtgctgggagatcgagtacagcgacgtgaagccgctccaggagggggacggcaccaaaagctgccgcatgaaggactccggcaactgcaacgtggccacgaaccggtggcccgtcatccagtgcgaaaacgacaagttctactacagcgagctgcagaaggactacgacaagacccaagacatcggtcactactgcctgtcccctggctgtaccaccgtgcgctaccccatcaacccaaagcacatcagcaactgcaactggcaggtctcccggagctccatcgcgaagatcgacgtgcacaacatcgaggacatcgagcagtacaagaaggccatcacgcaaaagctgcaaaccagcctgtccctgttcaagtacgccaagaccaagaaccttccccacatcaagccaatctacaagtacatcaccatcgagggtacggagaccgccgagggcatcgagagcgcctacatcgagtccgaggtgccggcgctagccgggaccagcatcggcttcaagatcaactccaaggagggcaagcacctcctggatgtgatcgcttacgtcaagagcgcgtcctacagcagcgtgtacgccaagctgtactccaccgggcccacgagcggcataaacaccaagcacgacgagctgtgcaccgggccctgccccgcgaacatcaaccaccaggtgggctggctcaccttcgccaaggagcgcacgtccagctgggggtgcgaggagttcggctgcctggccgtctccgacggctgcgtgttcgggagctgccaggacatcatcaaggaggagctgtccgtgtaccggaaggagaccgaggaggtcaccgacgtggagctctgcctgaccttctccgacaagacgtactgcaccaacctgaacccggtgacccccatcatcaccgacctcttcgaggtccagttcaagacggtggagacctactccctgccccgcatcgtggccgtccagaaccacgagatcaagatcggccagattaacgacctgggtgtgtacagcaagggctgcgggaacgtgcagaagattaacggcacggtctacggcaacggggtgccccggttcgactacctctgccacctggcgtcccgcaaggaggtgatcgtcaggaagtgcttcgacaacgactaccaggcctgcaagttcctgcagagcccggcctcctaccgcctcgaggaggacagcggcaccgtgacgatcatcgactacaagaagatcctggggaccatcaagatgaaggccatcctgggcgacgtgaagtacaagaccttcgccgactctgttgatatcaccgcggaggggagctgcaccggctgcatcaactgcttcgaaaacatccactgcgagctcacgctgcacaccaccatcgaggcctcctgccccatcaagagctcctgcaccgtcttccacgaccggatcctggtgacgcccaacgaacacaagtacgccctcaaaatggtttgcactgaaaagcccggcaacaccctgaccatcaaggtgtgcaacacgaagatcgaggccagcatggccctggtggacgcgaagccgatcatcgagcttgcccccgtcgaccagaccgcctacatacgcgagaaggacgagcgctgcaagacctggatgtgccgcgtgcgcgacgaggggctgcaggtcatcctggagcccttcaagaacctcttcggcagctacatcgggatcttctacaccttcatcatctccatcgtggccctgctggtgatcgtctacgtgctcctgcccatttgcttcaagctgcgggacacgctccgcaagcacgaggatgcctacaagcgggagatgaagatccgctag

SEQ ID NO: 15941 - RNA, 4326 nt, synthetic construct
  misc_feature 1..4326: note = derived and/or modified CDS sequence (opt11) from LACV__M87664.1__GP
  source 1..4326: mol_type = other RNA
atgatctgcatcctcgtgctcatcaccgtcgccaccgccagccccgtcctgcagcgctgcttccaggacggggcgatcgtgaagcagaatccatccaaggaggccttcacggaggtctgcctgaaggacgacgtgagcatgatcaagaccgaggcccggtacgtgcgcaacgccaccggggtcttctccaacaacgtggccatccggaagtggctcgtgagcgcgtggcacgactgccgccccaagaagattgtcggcgggcacatcaacgtgatcgaggtgggcgatgacctgtccctgcacaccgagagctacgtctgctccgccgactgcacgattggggtggacaaggagaccgcccaggtgcggctccagaccgacaccacgaaccacttcgagatcgccggcaccaccgtcaagagcggctggttccgctccaccacgtacatcaccctggaccagacctgcgagcacctgaaggtgagctgcgggcccaagtccgtgcagttccacgcgtgcttcaaccagcacatgagctgcgtccggttcctccaccgcaccatcctgccccgctccatcgcgaactccatctgccagaacatcgagatcatcatcctagtgacgctcaccctgctgatcttcatcctactgtccatcctgagcaagacctacatctgctacctcctgatgccaatcttcatccccatcgcctacatctacggcaccatctacaacaagtcctgcaagaagtgcaagctgtgcgggctagcccaccaccccttcacggagtgcggcacccattgcgtgtgcggggcccgctacgacaccagcgaccggatgaagctgcaccgcgcgtccggcctatgccccggctacaagagcctccgggccgcccgcgtcatgtgcaagagcaagggcccggcctccatcctgagcatcatcaccgccgtgctggtgctcacgttcgtcacccccatcaactcgatggtgctgggcgagagcaaggagaccttcgagctggaggaccttcccgacgacatgctggagatggcgtccaggatcaactcatactacccgacctgcatccttaactacgccgtctcctgggggctcgtgatcatcggcctgctgatcggcctcctgttcaagaagtaccagcaccgcttcctgaacgtgtacgccatgtactgcgaggagtgcgacatgtaccacgacaagtccggggtcaagcggcacggcgacttcacgaacaagtgccgccagtgcacgtgcgggcaatacgaggacgccgccggcctcatggcgcaccggaagacctacaactgcctggtgcagtacaaggccaagtggatgatgaacttcctgatcatctacatcttcctcatcctgatcaaggactccgccatcgtggtccaggcggccgggaccgactttacgacctgcctggagaccgagagcatcaactggaactgcaccggccctttcctcaacctgggcaactgccagaagcagcagaagaaggagccctacaccaacatcgcgacccagctgaaggggctcaaggccatatccgtgctggacatccccatcatcaccggcatccccgacgacatcgccggtgccctgcgctacatcgaggagaaggaggacttccacgtgcagctgaccatcgagtacgcgatgctcagcaagtactgcgactactacacccagttctccgacaacagcggctactcccagacgacctggcgggtctacctgcgtagccacgacttcgaggcctgcatcctgtacccgaaccagcacttctgccgctgcgtgaagaatggggagaagtgctcctcatccaaccgggacttcgccaacgagatgaaagactactacagcggcaagcagaccaagttcgacaaggatctcaacctggccctgaccgccctccacagccaggtgatgcactgctccagcgcgtacatcgccacgatgctgtccaagaagtccaacgacgacctgatcgcctacaccaacaagatcaagaccaagttccccggcaacgccctcctgaaggccatcatcgactacatcgcgtacatgaagtccctgcccgggatggccaacttcaagtacgacgagttctgggacgagctcctgtacaagcccaacccggccaaagccagcaacctggcccgcggcaaggagagcagctacaacttcaagctcgcgatctccagcaagtccatcaagacctgcaagaacgtcaaggatgtggcttgcctgagcccccggtccggggccatctatgcctccatcatcgcgtgcggcgagcccaacgggccctccgtgtaccgcaagccgagcggcggcgtcttccagtccagcacggaccggagcatctactgcctgttagactcccactgcctggaggagttcgaggctatcagccaggaggaactggatgccgtgaagaagtccaagtgctgggagatcgagtaccccgacgtgaagctcatccaagagggggacggaaccaagagctgccgcatgaaggactccgggaactgcaacgtcgcgaccaaccggtggccagtgacccagtgcgagaacgacaagttctactacagcgacctgcagaaggactacgacaaaacgcaggacatcggccactactgcctgtcccccggctgcaccaccgtgcgctacccgatcaaccccaagcacatcagcaactgcaactggcaggtctcccggagctccatcgccgagatcgacgtgcacaacatcgaagacatcgagcagtacaagaaggcgatcacccagaagctccagacgagcctgtccctgttcaagtacgccaagaccaagaacctcccccacatcaagccgatctacaagtacatcaccatgaaggggaccgagacggcagagggcatcgagagcgcctacatcgagtccgaggtgcccgccctggcggggaccagcatcggcttcaagatcaactccaaggaagggaagcacctcctggacgtcatcgcctacgtcaagagcgcctcctatagcagtgtgtacaccaagctgtactccaccggccccacgagcggcatcaacaccaagcacgacgagctgtgcaccgggccctgcccggccaacatcaatcaccaggtgggctggctcaccttcgcccgcgagcggacgtctagctgggggtgcgaggagttcggctgcctggcggtgtcggacggctgcgtcttcggcagctgccaggatatcatcaaggaggagctgtccgtctaccgcaaggagaccgaggaggtgaccaacgtggagctctgcctgaccttcagcgacaagacgtactgcaccaacctgaaccccgtcacccccattatcaccgacctcttcgaggtgcagttcaagacggtggagacctactccctgccccggatcgtcgccgtgcagaaccatgagataaagataggccagatcaacgacctgggggtgtacagcaaaggctgcgggaacgtccagaaggtgaacggcaccatctacgggaacggcgtgccgcgcttcgattacctctgccacctggcctcccggaaggaggtcatcgtgcgtaagtgctttgacaacgactaccaggcctgcaagttcctgcagagccccgcgtcctaccggctcgaggaagacagcggcaccgtgaccatcatcgactacaagaagatcctggggacgatcaagatgaaggccatcctgggcgacgtcaagtacaagaccttcgccgactccgtggacatcaccgccgaggggagctgtaccggctgcattaactgtttcgagaacatccactgcgagctcacgctgcacacgaccatcgaggcctcctgccccataaagagctcttgcaccgtgttccacgaccgcatcctggtcacgcccaacgagcacaagtacgccctcaagatggtgtgcaccgagaagccggggaacaccctgaccatcaaggtgtgtaacacgaagatcgaggccagcatggccctggtcgatgccaagcccatcatagagctcgcccccgtggaccagaccgcgtacatccgggagaaggacgaacgctgcaagacctggatgtgccgcgtcagagacgagggcctccaggtgatcctggagccctttaagaacctgttcggcagctacatcggaatcttctacaccttcatcatctccatcgtggccctgctggtcatcatctacgtgctcctgccgatttgcttcaagctgcgcgacacgctccggaagcacgaggatgcatacaagcgcgagatgaagatccggtga

SEQ ID NO: 15942 - RNA, 4326 nt, synthetic construct
  misc_feature 1..4326: note = derived and/or modified CDS sequence (opt11) from LACV__KP271105.1__GP
  source 1..4326: mol_type = other RNA
atgattcgcatcctggtgctcatcgccgtcaccgccgcgagccccgtgtaccagcggtgcttccaggacggcgccattgtgaagcagaacccgtccaaggaggccgtcaccgaggtgtgcctgaaggacgacgtgagcatgatcaaaacggaggcccgctacgtccggaacgccaccggggtgttctccaacaacgtggcgatacgcaagtggctggtcagcgactggcacgactgccggccaaagaagatcatcggcgggcacatcaacgtgatcgaggtgggcgacgacctctccctccacaccgagagctacgtctgttccgccgactgcagcatcggggtggacaaggagaccgcccaggtgcgcctgcagacggacaccaccaaccactttgagatcgccggcaccacggtcaagtccggctggttcaagagcaccacctacatcaccctcgaccagacgtgcgagcaccttaaggtttcctgcgggcccaagagcgtgcagttccacgcgtgcttcaaccagcacatgtcctgcgtccggttcctgcaccgcaccatcctccccggcagcatcgccaactcaatctgccagaacatcgagatcatcatcctggtgaccctgaccctcttaatcttcatcctgctcagcatcctgtccaaaacgtacatctgctacctgctcatgccgatcttcatccccatcgcctacatgtacgggatcatctacaacaagtcctgcaagaaatgcaagctgtgcggcctggtgtaccaccccttcaccgagtgcgggacccactgcgtctgcggcgcccggtacgacacctccgaccgcatgaagctccaccgggccagcggcctgtgccccgggtacaagagcctccgcgcggcccgggtgatgtgcaagtccaagggcccggccagcatcctctccatcatcacggccgtgctggtcctgaccttcgtgacccccatcaacagcatggtcctgggggagtccaaggaaaccttcgagctggaggagctgcccgacgacatgctcgagatggcaagccgcatcaattcctactacttcacgtgcatcctgaactacgcggtgagctggggcttggtgatcatcggcctcctgaccgggctcctgttcaagaagtaccagcaccggttcctgaacgtttacgccatgtactgcgaggagtgcgacatgtaccacgacaagtccggcctgaagcgccacggggacttcaccaacaagtgccggcaatgcacgtgcggccagtacgaggacgccgccgggctcatggcccaccgaaagacctacaactgcctggtgcagtacaaggcgaagtggatgatgaacttcctgatcatctacatcttcctcatcctgatcaaggacagcgccatcgtggtccaggccgccggcaccgacttcacgacctgcctggagaccgagtccatcaactggaactgcaccggccccttcctcaacctgggcaactgccagaagcagcagaagaaggagccatacaccaacatcgccacccagctgaagggcctcaaggcgatcagcgtgctggacatccccatcatcacggggatccccgacgacatcgccggcgccctgcggtacatcgaggaacgcgaggatttccacgtacagctgaccatcgagtacgccatgctctccaagtactgcgactactacacccagttcagcgacaactccgggtacagccagaccacctggcgggtctacctgcgctcccacgacttcgaggcgtgcatcctgtaccccaaccagcacttttgccgctgcgtgaagaacggcgagaagtgcagctccagcaactgggacttcgcgaacgagatgaaggactactatagcggcaaacagacgaagttcgacaaggacctcaacctggccctgaccgccctccatcacgccttccgggggacctccagcgcgtacatcgccaccatgctgtccaagaagtccaacgacgacctgatcgcctacacgaacaagatcaaggccaagttcccgggcaacgccctcctgaaggcgatcatcgactacatcgcctacatgaagtccctgcccgggatggccaacttcaagtacgacgagttctgggacgagctcctgtacaagcccaaccccgccaaggccagcaaccttgcgaggggcaaggagagcagctacaatttcaagctcgccatctccagcaagtccattaagacctgcaaaaacgtgaaggacgtcgcctgcctgagcccgcggtccggggcaatctacgcgtccatcatcgcctgcggcgagccctccggccccagcgtgtaccgcaagccctcgggtggcgtgttccagagctcgaccgaccggtcaatctactgcctgctcgacagccactgcctggaggagttcgaggccatcaaccaggaggagctggacgccgtcaagaagtccaagtgctgggagatcgagtacagcgacgtgaagccgctccaggagggggacggcaccaagtcctgcaagatgaaggacagcggcaactgcaacgtggccacgaaccgctggcccgtcatccagtgcgagaacgacaagttctattactccgagctgcagaaggactacgacaagacccaggacatcgggcactattgcctgagccccgggtgcaccaccgtgcggtaccccatcaacccgaagcacatctccaactgcaactggcaggtcagccgctcctctatcgcgaagatcgatgtgcacaacattgaggacatcgagcagtacaagaaggccatcacgcagaagctccagacctccctgagcctgttcaagtacgccaaaaccaagaacctcccccacatcaagcccatctacaagtacatcaccatcgaggggacggagaccgccgagggcatcgagtccgcctacatcgagagcgaggtgccggcgctggccgggacctccatcggcttcaagatcaacagcaaggagggcaagcacctcctggacgtgatcgcctacgtcaagtccgccagctacagctccgtgtacgccaagctgtacagcactgggcccacgtccggcatcaacaccaagcacgacgagctgtgcaccggcccctgccccgcgaacatcaaccaccaggtgggctggttgaccttcgccaaggagagaacgagctcctgggggtgcgaggagttcggctgcctggccgtcagcgacggctgcgtgttcgggtcctgccaagacatcataaaagaggagttgagcgtgtaccgcaaggagaccgaggaggtcaccgacgtggagctctgcctgaccttctccgacaagacgtactgcaccaacctgaacccggtgacccccatcatcaccgacctcttcgaggtccagttcaagacggtggagacctacagcctgccccggatcgtggccgtccaaaaccacgagatcaagatcggccagatcaatgacctgggggtgtactccaagggctgcgggaacgtgcagaaggtcaacggcaccgtgtacggcaacggggtgccccgcttcgactacctctgccacctggcgagccggaaggaggtcatcgtgcgcaagtgcttcgacaacgactaccaagcctgcaagttcctgcagtccccggccagctaccggctcgaggaggactccgggaccgtgacgatcatcgactacaagaagatactggggaccatcaagatgaaggccatcctgggcgatgtcaagtacaagaccttcgccgacagcgtggacatcaccgcggaggggtcctgcaccggctgcatcaactgcttcgagaacatccactgcgagctaacgctgcacaccaccattgaggccagctgccccatcaagtccagctgcaccgtgttccacgaccgcatcctggtcacgcccaacgagcacaagtacgccctcaagatggtgtgcaccgagaagcccggcaacaccctgacgatcaaggtgtgcaacacgaagatcgaggccagtatggccctggtcgacgcgaagccgatcatcgagctcgcccccgtggaccagaccgcctacatccgggagaaggacgagcgctgcaagacctggatgtgccgggtccgcgacgaagggttacaggtgatcctcgagcccttcaagaacctgttcggcagctacatcgggatcttctacaccttcatcatcagcatcgtggccctgctggtcatagtgtacgtgctcctgcccatctgcttcaagctgcgcgacacgctccggaagcacgaggacgcctacaagcgtgagatgaagatccggtga

SEQ ID NO: 15943 - RNA, 4326 nt, synthetic construct; identical to SEQ ID NO: 12657
  misc_feature 1..4326: note = derived and/or modified CDS sequence (opt11) from LACV(74-32813)__D10370.1__GP
  source 1..4326: mol_type = other RNA

SEQ ID NO: 15944 - RNA, 4326 nt, synthetic construct; identical to SEQ ID NO: 12658
  misc_feature 1..4326: note = derived and/or modified CDS sequence (opt11) from LACV(Craig County/VA/2009)__KP226848.1__GP
  source 1..4326: mol_type = other RNA

SEQ ID NO: 15945 - RNA, 4326 nt, synthetic construct
  misc_feature 1..4326: note = derived and/or modified CDS sequence (opt11) from LACV(Dallas/TX/2009)__GU591165.1__GP
  source 1..4326: mol_type = other RNA
atgatccgcattctggtgctcatcgttgtgaccgccgccagccccgtgtaccagcggtgcttccaggatggcgcgatcgtcaagcagaacccgtccaaggaggcggtgaccgaggtgtgcctgaaggacgacgtcagcatgatcaaaacggaggcccgctacgtgaagaacgccaccggggtgttctccaacaacgtcgcgatccggaagtggctggtgagcgactggcatgactgccgccctaagaagatcgtgggcgggcacatcaacgtcatcgaggtgggggacgacctctccctgcacaccgagagctacgtgtgctccgcggactgcaccatcggagtcgacaaggagacggcccaggtgcggctgcaaaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcctgcttcaaccagcacatgagctgcgtgcgcttcctgcaccgaaccatcctgcccggctccatcgcgaacagcatctgccagaacatcgagatcatcatcctggtcactctgacgctactgatcttcatcctgctctccatcctgagcaagacctacatctgctacctgctcatgccgatcttcatccccatggcctacatgtacggggtgatctacaacaagtcctgcaagaagtgcaagctgtgcggcctggtgtaccaccccttcaccgagtgcgggacccactgcgtctgcggcgcccgctacgacacgtctgaccggatgaagctccaccgcgcctccggcctgtgccctgggtacaagagcctgcgggccgcgagggtgatgtgcaagagcaagggcccggcctctatcctcagcatcataaccgccgtcctggtgctgaccttcgtgacccccataaactccatggtcctcggggagagcaaggagacgttcgagctggaggagctgcccgacgacatgctcgagatggccctgcggataaactcctactacttcacgtgcatcttaaactacgccgtgagctggggcctcatcatcgcgggcctgctggtggggctaatcttcaagaagtaccagcaccgcttcctgaatatttacgccatgtactgcgaggagtgcgacatgtaccacgacaagtccgggcttaagcggcacggggacttcaccagcaagtgccgccagtgcacgtgcggccagtacgaggacgccaccggcctcatcacccaccggaagacctacaactgcctggtccagtacaaggccaagtggatgatgaacttcctgatcatctacatcttcctcatcctgatcaaggactccgccatcgtggtgcaggcgaccggcactgacttcacgacctgcctggagaccgagagcatcaactggaactgcaccggccccttcctcaacctggggaactgccagaagcagcagaagaaggagccgtacaccaacatcgccacccagctgaagggcctcaaggccatctccgtcctggacatccccatcatcaccgggatccccgacgacatcgccggcgccctgcgctacatcgaggagaaggaggacttccacgtgcagctgaccacagagtacgcgatgctcagcaagtactgcgactactacacccagttctccgacaacagcgggtattcccagaccacctggcgggtgtacctgcgcagccacgacttcgaggcctgcatcctgtaccccaaccagcacttctgccggtgcgtcaagaacggcgagaagtgctccagctcgaactgggactttgcaaacgagatgaagaactactacagcggcaagcaggccaagttcgacaaggacctcaacctggcgctgacggccctccaccacgccttccgcgggaccagctccgcctacatcgcaaccatgctgagcaagaagtccaacgacgacctagtggcgtacaccaacaagatcaaggccaagttcccgggtaacgccctcctgaaggccatcatcgactacatcgcctacatgaagggtcttcccgacatggcgaacttcaagtacgacgagttctgggacgagctcctttacaagcccaaccccgccaaggccagcaacctggcccgcggcaaggagtccagctacaacttcaagctcgcagtgtccagcaagtccatccggacgtgcaagaacgtcaaggacgtggcgtgcctgagtccgcgctccggggccatctacagctccatcatcgcctgcggcgagcccaacggccccagcgtgtaccggaagccctccgggggcgtctttcagagctccaccgaccgcagcatctactgcctgctcgatagccactgcctggaggagttcgaggccatctcccaggaggagctcgacgcggtgaagaagtccaagtgctgggagatcgagtacccggacatccggcccctccaggagagcgacgggagcaagtcctgccgcatgaaggacagcggcaactgcaacgttgccaccaaccggtggcccgtcatgcagtgcgagaacgacaagttctattactccgagctgcagaaggactacgacaagacccaggacataggccactactgcctgagccccgggtgcacaaccatccgctacccgatcaaccccaagcacatctccaactgcaactggcaggtcagccggtccagcatcgcgaagatcgacgttcacaacgtagaggacatcgagcagtacaagaaagccatcacccagaagctccagacctccctgagcctgttcaagtacgccaagacgaagaacctcccccacatcaagccgatatacaagtacatcaccatagagggcaccgagaccgcggaggggattgagtccgcctacatcgagagcgaggtgcccgccctggccggcacgtccatcgggttcaagatcaacagcaaggagggcaagcacctcctggatgtgatcgcctacgtcaagtccgcgagctacagctcagtgtacgccaagctgtacagcaccggccccacctccgggatcaacaccaagcacgacgagctgtgcacgggcccctgcccggccaacatcaaccaccaggttgggtggctcaccttcgcccgcgagcggaccagctcctggggctgcgaggagttcgggtgcctggccgtcagcgacggctgcgtgttcggctcctgccaggacatcatcaaggaggagctgagcgtgtaccgcaaggacaccgaggaggtcacgaacgtggagctctgcctgaccttctccgacaagacctactgcaccaacctgaaccccgtgacccccatcatcaccgacctcttcgaggtccagttcaagaccgtggagacctatagcctgccccggatcgtggcggtccagaaccacgagatcaaaatcgggcagatcaacgacctgggcgtgtactccaaggggtgcggcaacgtgcagaaggtcaacgggacggtgtacggcaacggcgtgccgcgcttcgactacctctgccacctggccagccggaaggaggtcatcgtgcgcaagtgcttcgacaacgactaccaggcctgcaagttcctgcagtcccccgccagctaccggttagaggaagactccgggacggtgaccatcatcgactacaagaaaatcctgggaaccatcaagatgaaagcgatcctgggggatgtcaagtacaagacttttgccgacagcgtggacatcacggccgagggctcctgcgccgggtgcataaactgcttcgagaacatccactgcgagctcaccctgcacaccaccatcgaggccagctgccccatcaaatccagctgcacggtgttccacgatcgcatcctggtcaccccgaacgagcacaagtacgcgctcaagatggtgtgcaccgagaagccgggcaacaccctgacgatcaaggtctgcaacacccggatcgaggtgagcatggcactggtggacgccaagcccatcatcgagctcgcccccgtcgaccagaccgcctacatccgcgagaaggacgaacgctgcaagacctggatgtgccgggtgcgcgacgagggcctccaggtgatcctggagcccttcaagaacctgttcgggtcctacatcggcatcttctacacgttcatcatcagcatcatcgcgctgctggtcatcatctacgtgctcctgccgatctgcttcaagctgcgggacaccctccgcaaacacgacgatgcctacaagcgggagatgaagatccgctag

SEQ ID NO: 15946 - RNA, 4326 nt, synthetic construct; identical to SEQ ID NO: 12660
  misc_feature 1..4326: note = derived and/or modified CDS sequence (opt11) from LACV(Fort Bend County/TX/2009)__GU591168.1__GP
  source 1..4326: mol_type = other RNA

SEQ ID NO: 15947 - RNA, 4326 nt, synthetic construct; identical to SEQ ID NO: 12661
  misc_feature 1..4326: note = derived and/or modified CDS sequence (opt11) from LACV(LAC22988-89)__U18980.1__GP
  source 1..4326: mol_type = other RNA

SEQ ID NO: 15948 - RNA, 4326 nt, synthetic construct; identical to SEQ ID NO: 12662
  misc_feature 1..4326: note = derived and/or modified CDS sequence (opt11) from LACV(LAC30928-31)__U18979.1__GP
  source 1..4326: mol_type = other RNA

SEQ ID NO: 15949 - RNA, 4326 nt, synthetic construct; identical to SEQ ID NO: 12663
  misc_feature 1..4326: note = derived and/or modified CDS sequence (opt11) from LACV(LAC76-40)__U70206.1__GP
  source 1..4326: mol_type = other RNA

SEQ ID NO: 15950 - RNA, 4326 nt, synthetic construct
  misc_feature 1..4326: note = derived and/or modified CDS sequence (opt11) from LACV(LAC79-283)__U70207.1__GP
  source 1..4326: mol_type = other RNA
atgatccgcatcctggtgctcatagccgttaccgccgcgtctcctgtgtaccagcggtgcttccaggacggcgccatcgtgaagcagaacccatccaaggaggcagtcaccgaggtgtgcctgaaggatgacgtgagcatgatcaagacggaggcccgctacatccggaacgccaccggggtcttctccaacaacgtggcgatccgcaagtggctggtgagcgactggcacgactgccggcccaagcgcatcatcggtgggcacatcaacgtcatcgaggtgggcgacgacctctccctgcacaccgagtcttacgtgtgctccgccgactgcacaatcggggtcgataaggagacggcccaggtgcggctgcagaccgacacgaccaaccacttcgagatcgccggcacgaccgtcaagagcggctggttcaagtccaccacctacatcaccctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgaaatcataatcctggtcaccctgacgctcctgatattcatcctgctctccatcttgagcaagacctacatctgctacctgctcatgccgatcttcatccccatcgcctacatctacgggatcatttacaacaagtcctgcaagaagtgcaagctgtgcggcctggtgtaccaccccttcacagagtgcgggacccactgcgtgtgcggcgcccgctacgacacgagcgaccggatgaagctccaccgcgcctccggcctgtgccccgggtacaagagcctgcgggcggcccgcgtcatgtgcaagagcaagggcccggcctccatcctcagcatcatcaccgccgtgctggtgctgaccttcgtcacccccatcaactccatggtgctcggggagtccaaggagacgttcgagctggaggaactgcccgacgacatgctcggcatggcgtcccggatcaacagctactacttcacgtgtatcctgaactacgcggtctcctggggccttgtgatcatcggcctcctgaccgggttactgttcaagaaataccagcaccgcttcctgaacgtatatgccatgtactgcgaggagtgcgacatgtaccacgacaagagcgggctgaagcggcacggcgacttcaccaacaagtgccgccagtgcacgtgcgggcagtacgaggacgccaccggcctcatggcccaccggaagacctacaactgcctggtccagtacaaggccaagtggatgatgaacttcctggtgatctacatcttcctcatcctgatcaaggactccgccatcgtcgtccaggccgccggcaccgacttcacgacctgcctggagaccgagagcatcaactggaactgcactgggcccttcctcaacctgggcaactgccagaagcagcagaagaaggaaccgtacaccaacatcgccacccagctgaaggggctcaaggccatctccgtgctggacatccccatcatcaccggcatccccgacgacatcgcgggggctctgcgctacatcgaggagcgggaggacttccacgtgcagctgaccatcgagtacgccatgctcagcaagtactgcgactattacacccagttctccgacaatagcggctactcccagacgacctggcgagtatacctgcgctctcacgatttcgaggcctgcatcctgtaccccaaccagcacttctgccggtgcgtgaagaacggcgagaagtgttcttcatccaactgggatttcgcgaacgagatgaaggacttctacagcgggaagcagaccaagttcgacaaggacctcaacctggccctgaccgccctccaccacgccttccgcggcacgagctccgcctacatcgcgaccatgctgagcaagaagtccaacgacgacctgatcgcctacaccaacaagatcaagaccaagttcccagggaacgccctcctgaaagccatcatcgactacatcgcctacatgaagtccctgcccggcatggccaacttcaagcacgacgagttctgggacgaactcctgtacaagcccaaccccgccaaggccagcaacctggcccgggggaaggagagctcctacaacttcaagctcgccatcagctccaagagtatcaagacgtgcaagaacgtgaaggacgttgcgtgcctgtccccgcgcagcggcgccatctacgcctccatcatcgcctgcggcgagcccaacgggcccagcgtgtaccggaagccctccggcggggtgttccagagctccaccgaccgcagcatctactgcctgctcgacagccactgcctggaggagttcgaggcgatctcccaggaggagctggacgccgtcaagaagtccaagtgctgggagatcgaatacccggacgtaaagcccctccaggagggcgatggcaccaagagctgccggatgaaggactctgggaactgcaacgtggccaccaaccgctggcccgtcatccagtgcgagaacgacaagttctactactccgagctgcagaaggactacgacaagacgcaggacatcggccactattgcctgagccccgggtgcaccactgtgcggtacccgatcaaccccaagcacatatccaactgcaactggcaggtcagcagatccagcatcgccaagatcgacgtgcacaacatcgaagacatcgagcagtacaagaaggccatcacccagaagctccagacgtccctgagcctgttcaagtacgcgaagaccaagaacttaccccacatcaagccgatctacaagtacatcaccatcgagggcaccgagacggccgaggggatcgagtccgcctacatcgagagcgaggtgcccgccctggccggcacctccatcggcttcaagatcaatagcaaggaggggaaacacctcctggacgtgatcgcgtacgtcaagtcggccagctactccagcgtgtacgccaagctgtacagcaccggccccacctccgggatcaacacgaagcacgacgagctgtgcactggcccctgcccggccaacatcaaccaccaggtggggtggctcaccttcgcccgggagcgcaccagctcctggggctgcgaagagttcggctgcctggcggtcagcgacggctgcgtgttcggctcctgccaggacatcatcaaggaggagctgagcgtgtaccggaaggagacggaggaggtcaccgacgtggagctctgcctgaccttctccgacaagacctactgcacgaacctgaaccccgtgacacccatcatcaccgacctcttcgaagtccagttcaacaccgtggagacgtacagcctgccccgcatcgtggccgtccagaaccacgagatcaagatcgggcagatcaacgacctgggcgtgtactccaaggggtgcggcaatgtgcagaaggtcaacggcaccgtgtacgggaacggcgtgccgcggttcgactacctctgccacttggccagccgcaaggaggtcatcgttcggaagtgcttcgacaacgactaccaggcctgcaagttcctgcagtcccccgccagctaccgcctcgaggaggactccgggaccgtgaccatcatcgactacaagaagatcctgggcaccataaagatgaaggccatcctgggggacgtcaagtacaagacgttcgccgacagcgtggacatcacggccgagggctcctgcaccggctgcatcaactgcttcgagaacatccactgcgagctcaccctgcacacgaccatcgaggccagctgccccatcaagtccagctgcaccgtgttccacgaccggatcctggtcacccccaacgagccgcagtacgcgctaaagatggtctgcaccgagcgccccggcaacaccctgaccatcaaagtgtgcaacactaagatcgaggcctccatggccctggtggacgccaagcccatcatcgagttggcccccgtggaccagacggcgtacatccgcgagaaagacgagcggtgcaaaacgtggatgtgccgcgtccgtgacgagggcctccaggtgatcctggagccgttcaagaacctgttcgggagctatatcggcatcttctacaccttcatcatcagcatggtggccctgctggtcatcatctacgtgctcctgcccatctgcttcaagctgcgcgacaccctccggaagcacgaggacgcctacaagcgcgagatgaagatccggtga

SEQ ID NO: 15951 - RNA, 4326 nt, synthetic construct
  misc_feature 1..4326: note = derived and/or modified CDS sequence (opt11) from LACV(LAC81-4)__U70208.1__GP
  source 1..4326: mol_type = other RNA
atgatccgcatcctggtgctcatcgccgtcaccgccgcgagccccgtgtaccagcggtgcttccaggacggcgccatcgtgaagcaaaacccgtccaaggaggccgtcaccgaagtgtgcctgaaggacgacgtgagcatgatcaagacggaggcccgctacattcggaacgccaccggagtcttctccaacaacgtggcgatcaggaagtggctggtgagcgactggcacgactgccggcccaagaagatcatcggcgggcacatcaatgtcatcgaggtgggcgacgacctctccctgcacaccgagagctacgtgtgttccgccgactgcaccatcggggtcgacaaggaaacggcccaggtgcgcctacagaccgacaccaccaaccacttcgagatcgccggcaccaccgtcaagagcggctggttcaagagtaccacctacatcacgctcgaccagacctgcgagcacctgaaggtgagctgcgggcccaagtccgtgcagttccacgcgtgcttcaaccagcacatgagctgcgtgagatttctgcaccggaccattctccccggctccatcgccaacagcatttgccagaacatcgagatcataatcctggtcaccctgacgctcctgatcttcatcctgctctccatcctaagcaagacctacatctgctacctgctcatgccgatcttcatccccatcgcctacgtgtacgggatcatctacaacaagtcctgcaagaagtgcaagctgtgcggcttggtgtaccaccccttcaccgagtgcgggacccactgcgtgtgcggcgcccgttacgacacgagcgatcgcatgaagctccaccgggcctctggcctgtgccccgggtacaagagcctgcgcgcggcccgggtgatgtgtaagagcaagggcccggcctcaatcctcagcatcatcaccgccgtgctcgtcctgaccttcgtgacccccatcaactccatggtcctcggagagagcaaggagacgttcgagctggaggagctgcccgacgacatgctcggcatggcctcccgcatcaactcttactacttcacgtgcatcctgaactacgcggtgtcctggggcctggtgatcatcgggctcctgaccggcctcctgttcaagaagtaccagcaccggttcctgaacgtctacgccatgtactgcgaggagtgcgacatgtaccacgacaaaagcgggctgaagagacacggcgatttcaccaacaagtgccggcagtgcacgtgcgggcagtacgaggacgcaaccggcctcatggctcaccgcaagacctacaactgcctggtgcagtacaaggccaagtggatgatgaacttcctggtgatctacatcttcctcatcctgatcaaggactccgcgatcgtggtgcaggccgccggcaccgacttcacgacctgcctggagaccgagagcatcaactggaactgcaccgggcccttcctcaacctgggcaactgccagaagcagcagaagaaagagccgtacaccaacatcgccacccagctgaaggggctcaaggccatctccgtgcttgacatccctatcatcaccggcatccccgatgacatcgcgggggccctgcggtacatcgaggagcgcgaggacttccacgtccagctgaccatcgagtacgccatgctcagcaagtactgcgactactacacccagttctccgacaacagcggctactcccagacgacctggcgggtgtacctgcgaagccacgacttcgaggcctgcatcctgtaccccaaccaacacttctgccgctgcgtgaagaacggcgagaagtgctccagctccaactgggacttcgcgaacgagatgaaggacttctacagcgggaagcagaccaagttcgacaaggacctcaacctggccctgaccgccctccaccacgccttccggggcacgagctccgcctacatcgcgaccatgctgagcaagaagtccaacgacgacctgatcgcctacaccaacaagatcaagaccaagttcccggggaacgccctcctgaaggccatcatcgactacatcgcctacatgaagtccctgcccggaatggcgaacttcaagcacgacgagttctgggacgagctcctgtacaagcccaaccccgccaaggccagcaacctggcccgcgggaaggagagctcatacaacttcaaacttgccatcagctccaagagcatcaagacgtgcaagaacgtcaaggacgtggcgtgtctgtccccgcggagcggcgccatctacgcctccatcatcgcctgcggcgagcccaacggccccagcgtgtaccgcaagcccagcggcggggtcttccagagttccaccgaccggagcatctactgcctgcttgacagccactgcctggaagagttcgaagcgatctcccaagaggagctggacgccgtgaagaagtccaagtgctgggagatcgagtacccggacgtgaagcccctccaggagggcgacggcaccaagtcttgccgcatgaaggacagcgggaactgcaacgtcgccaccaaccggtggcccgtgatccagtgcgagaacgacaagttctactattccgagctgcagaaagattacgacaagacgcaggacatcggccactactgcctgagccccgggtgcaccaccgtgcgctacccgataaacccaaagcacatctccaactgcaactggcaggtcagccggtccagcatcgccaagatcgacgtgcacaacatcgaggacatcgagcagtacaagaaggccatcacccagaagctccagacgtccctgagcctgttcaagtatgcgaagacgaaaaacctcccccacatcaagccgatttacaaatacatcaccatcgagggcacggagaccgccgagggaatcgagtccgcctatatcgaaagcgaggtgcccgccctggcaggcacgtccatcggcttcaagatcaacagcaaggaggggaagcacctcctggacgtcatcgcgtatgtgaagtccgccagctactccagcgtgtacgccaagctgtacagcaccggccccacctccgggatcaatacgaagcacgacgagctgtgtaccggcccctgcccggccaacatcaaccatcaggtcggatggctcaccttcgccagggagcggaccagctcctggggctgcgaggagttcggctgcctggcggtgagcgacgggtgtgtgttcggctcctgccaggacatcatcaaggaggagctgagcgtataccgcaaggagacggaggaggtcaccgacgtggagctctgcctgaccttctccgacaagacctactgcacgaacctgaaccccgtcacccccatcatcaccgacctcttcgaggtgcagttcaagaccgtggagacgtacagcctgccccggatcgtcgccgtgcagaaccacgagatcaagatcgggcagatcaacgacctgggcgtgtactccaaggggtgcggcaacgtccagaaggtgaacggcaccgtgtacgggaacggcgtcccgcgtttcgactacctctgccacctggcctcgcggaaggaggtgatcgtgcgcaaatgcttcgacaacgactaccaggcctgcaagttcctgcagtcccccgcgagctaccggctcgaggaggactccggaaccgtcaccattatcgactacaagaagatcctgggcaccatcaagatgaaggccatcctgggggacgtgaagtacaagacgttcgccgacagcgtggacatcaccgccgagggctcctgcaccggctgcatcaactgcttcgagaacatccactgcgagctcaccctgcacacgaccatagaggccagctgccccatcaagtcctcctgcaccgtcttccacgaccgcatcctggttacccccaacgagccgcagtacgcgctcaagatggtgtgcacggagcggcctgggaacaccctgaccataaaggtctgcaacaccaagatcgaggcctccatggccctggtggacgccaagcccatcatcgagctcgcccccgtcgaccagaccgcgtacatccgagagaaggacgagcgctgcaagacctggatgtgccgggtgcgcgacgagggcctccaggtgatcctggagccgttcaagaacctgttcggaagctacatcggcatcttctacaccttcattatcagcatggtcgccctgctggtgataatctacgtgctcctgcccatctgcttcaagctgcgggacaccctccgcaagcacgaggacgcctacaagcgggagatgaagatacgctga

SEQ ID NO: 15952 - RNA, 4326 nt, synthetic construct
  misc_feature 1..4326: note = derived and/or modified CDS sequence (opt11) from LACV(LACR56869)__U70205.1__GP
  source 1..4326: mol_type = other RNA
atgatctgcatcctggtgctcatcaccgtcgccgccgcgagccccgtgtaccagcgctgcttccaggacggcgccatcgtgaagcagaacccttccaaggaggccgttaccgaggtgtgcctgaaggatgacgtgagcatgatcaagacggaggcccggtacgtccgcaacgccaccggggtgttctccaacaacgtggcgatccggaagtggctggtcagcgactggcacgattgccgccccaagaagatcgtgggcgggcacatcaacgtgatcgaggtcggcgacgacctctccctgcacactgagagctacgtgtgctccgccgactgcaccatcggggtggacaaggagacggcccaggtccggctgcagaccgacaccaccaaccacttcgagatcgccggcacgaccgtcaagagcggctggttcaaatccaccacctacatcacgctcgaccagacctgcgagcacctgaaggtgagctgcgggcccaagtccgtgcagttccacgcgtgcttcaatcagcacatgagctgcgtgcgcttcctgcaccggaccatcctccccggctccatcgccaacagcatctgccagaacatcgagatcatcatcttggtaaccctgacgctcctgatcttcatcctgctctccatccttagcaagacctacatctgctacctgctcatgccgatcttcatccccatcgcctacatctacgggatcatctacaacaagtcctgcaaaaagtgcaagctgtgcggcctggtctaccaccccttcaccgagtgcgggacccactgcgtgtgcggcgcccgctacgacacgagcgaccggatgaagttacaccgcgcctccggcctttgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggagacgttcgagctggaggacctgcccgacgacatgctcgagatggcctcgcggatcaacagctactacctgacctgcatcctgaactacgccgtgtcctggggcctcgtaataatcggccttctgatcgggctcctgttcaagaagtaccagcaccgcttcctgaacatttacgccatgtactgcgaggagtgcgacatgtaccacgacaagagcggcctcaagcggcacggggacttcaccaacaagtgccgccagtgcacgtgcggccagtacgaggacgccgccgggctgatggcccacaggaagacttacaactgcctggtgcagtacaaggcgaagtggatgatgaacttcctcattatctacatcttcctgatcctgatcaaggactccgccatcgtggtccaggccgccggcaccgacttcacgacctgcctcgagaccgagagcataaactggaactgcaccggccccttcctgaatctggggaactgccagaaacagcagaagaaggagccgtacaccaacatcgcgacccagctaaagggcctgaaggcgatctccgtgctggacgtgcccatcatcacggggatccccgacgacatcgccggtgccctgcgctacatcgaggaaaaggaggacttccacgtccagctgaccatcgagtacgccatgctgagcaagtactgcgactactacacccagttctccgacaactccgggtactcccagaccacctggcgggtgtacctgcgcagccacgacttcgaggcgtgtatcctctatcccaaccagcacttctgccggtgcgtgaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatggccaccatgctttcaaagaagtccaacgatgacctcatcgcctacacgaacaaaatcaagaccaagttcccgggcaacgccctgctgaaggccatcatcgactacatcgcgtacatgaagtctctccccgggatggccaacttcaagtacgacgagttctgggacgaactgctgtacaagcccaaccccgccaaggccagcaacctcgcccgtggcaaggaaagctcctacaacttcaagctggcgatcagctccaagtctatcaagacctgcaagaacgtcaaggacgtggcctgcctgtccccgcggagcggggccatctacgcctccatcatcgcgtgcggcgagcccaacggccccagcgtgtaccgcaagccttccgggggcgtcttccagagctccaccgaccggagcatctactgcctcctggactctcactgcctggaggagttcgaggccatcgggcaggaggagctcgacgccgtgaagaagtccaagtgctgggagatcgagtacccggacgtgaagctgatccaggagggcgacggcaccaagagctgccgcatgaaggactccggtaactgcaacgtcgccaccaaccggtggcccgtgatccagtgcgagaacgacaagttctactactcggagctccagaaagactacgacaagacccaggacatcggccactactgcttatcccccgggtgcaccacggtgcgctaccccatcaacccgaagcacatcagcaactgcaactggcaggtctcccggagctccatcgccaagattgacgtgcacaacatcgaggatatcgagcagtacaagaaggcgatcacccagaagctgcagaccagcctgagtctcttcaagtacgccaagaccaagaacctgccccacatcaagcccatctacaagtacatcacgatcgagggcaccgagaccgccgagggaatcgaaagcgcctacatcgagtccgaggtgccggccctggcgggcaccagtataggcttcaaaatcaattccaaggaggggaagcacctcctggacgtcatcgcctacgtcaagagcgcctcctacagctccgtgtacacgaaattgtatagcaccggccccacctccgggatcaacaccaagcacgacgagctctgcacgggaccttgccccgccaacatcaaccaccaggacgggtggctgaccttcgcccgcgagcggacctccagctggggctgcgaggagttcggctgcctggcggtttccgatgggtgcgtgttcggcagctgccaggacatcattaaggaggagctctccgtgtaccgcaaggagaccgaggaggtcacggacgttgagctgtgcctgaccttcagcgacaaaacctattgcacaaacctcaacccggtgacgcccatcatcaccgacctgttcgaggtccagttcaagaccgtggagacctactccctgccccggatcgtggccgtccagaaccacgagatcaagatcgggcagatcaacgacctcggcgtgtacagcaaggggtgcggcaatgtgcagaaggtcaacggcacgatctacgggaacggcgtgccccgcttcgactacctgtgccacctggcctcccggaaggaggtgatagtccgcaagtgcttcgacaacgactaccaagcctgcaagttcctccagagcccggcgtcctaccggctggaggaggacagcgggaccgtgaccatcatcgactacaagaagatcctgggcaccatcaagatgaaggccatcctcggagatgtgaagtacaagaccttcgccgactccgtcgacatcacggccgagggcagctgcaccgggtgcatcaactgcttcgagaacatccactgcgagctgaccctgcacaccacgatcgaggcatcctgccccatcaagagctcctgcaccgtgttccacgaccgcatcctcgtgacccccaacgagcacaagtacgcgctgaagatggtctgcaccgagaagcccgggaacacgctgaccatcgaggtctgcaacaccaagatcgaggccagcatggccctcgtggacgccaagccgatcatcgagctggcccccgtcgaccaaaccacgtatatccgggagaaggacgagcgctgcaagacctggatgtgcagagtacgcgacgagggtctgcaggtcatcctcgagcccttcaagaacctgttcgggtcctacatcgggatcttctacacattcatcatcagcatagtggcgctgctcgtgatcatctacgtcctgctgcccatctgcttcaagctccgagacaccctgcggaagcacgaggacgcctacaagcgcgagatgaaaatccggtga

SEQ ID NO: 15953 - RNA, 4326 nt, synthetic construct; identical to SEQ ID NO: 12667
  misc_feature 1..4326: note = derived and/or modified CDS sequence (opt11) from LACV(NAT_Crawford_WI_2007)__GU596383.1__GP
  source 1..4326: mol_type = other RNA

SEQ ID NO: 15954 - RNA, 4326 nt, synthetic construct; identical to SEQ ID NO: 12668
  misc_feature 1..4326: note = derived and/or modified CDS sequence (opt11) from LACV(77)__DQ196119.1__GP
  source 1..4326: mol_type = other RNA

SEQ ID NO: 15955 - RNA, 4326 nt, synthetic construct
  misc_feature 1..4326: note = derived and/or modified CDS sequence (opt11) from LACV(LACV/00/NC-M (NC00-283))__GU206112.1__GP
  source 1..4326: mol_type = other RNA
atgattcgcatcctggtgctcatcgccgtgacagccgcgagccccgtgtaccagcggtgcttccaggacggcgccatcgtgaaacagaacccgtccaaggaggccgtcaccgaggtgtgtctgaaggacgacgtgagcatgatcaagacggaagcccgctacgtccgtaacgccaccggggttttctccaacaacgtggcgattcgcaagtggctagtcagcgactggcacgactgccgccccaagaagataatcggcgggcacatcaacgtcatcgaggttggcgacgacctctccctgcacacggagagctacgtctgctcggccgactgtaccatcggggtggacaaggaaacggcccaggtgcgcctgcagaccgacaccaccaaccactttgagatcgccggcacgaccgtcaagagcggctggttcaagtccaccacctacatcactctcgaccagacctgcgagcacttaaaggtgagctgcgggcccaagtccgtgcagttccacgcgtgcttcaatcagcacatgagctgcgtacggttcctccaccgcaccattctccccggatccatcgccaacagcatatgccagaacatcgagatcattatcctggtgaccctgacgctcctgatcttcatcttgctctccattctgagcaagacttacatctgctacttactcatgccgattttcatacccatcgcctatatgtacgggatcatctacaacaagtcctgcaagaagtgcaagctgtgcggactggtgtaccatcccttcaccgagtgcgggacccactgcgtatgcggcgcccggtacgacacgagcgatcgcatgaagctccaccgggcctccggactgtgccccgggtataagagcctgcgcgcggcgcgggtgatgtgcaagagtaagggaccggcctccatcctcagcatcatcaccgccgtgctggtcctgaccttcgttacccccattaactccatggtcctcggggagagcaaggagactttcgagctagaggagctgcccgacgacatgctcgagatggcctccaggatcaattcatattacttcacgtgtatcctgaactacgcggtctcctggggcctggtgatcatcgggctcctgacagggctcctgttcaagaaataccagcaccggttcttaaacgtatacgccatgtactgcgaggagtgcgacatgtaccatgacaagagcggcctaaagcgccacggggactttaccaacaaatgccgccagtgcacgtgcggccagtacgaggatgccgcgggcctcatggcccaccgcaagacctacaactgcctggtacagtacaaagcaaagtggatgatgaacttcctgattatctatatattcctcatcctgatcaaggactccgccatcgtggtccaggccgccggcaccgacttcacgacctgcctggagaccgagagcatcaactggaactgcaccggccccttcctcaacctggggaactgccagaagcagcagaagaaggagccgtacaccaacatcgccacccagctgaagggactcaaggccatcagtgtgctagacatccccatcatcacggggatccccgacgacatcgcaggcgccctgaaatacattgaggaacgggaggacttccacgtgcagctgaccatcgagtacgcaatgctcagcaaatactgcgactactacacccagttctccgacaacagcgggtactcccagaccacctggcgcgtctacctgcggagccatgacttcgaggcctgcatactgtaccccaatcagcacttttgccgctgcgtgaagaacggagagaaatgcagtagctccaactgggacttcgcgaacgagatgaaggactactacagcggcaagcagaccaagtttgacaaagacctcaacctagccctaaccgccctccaccacgccttccgcgggaccagctccgcgtacatcgccacgatgctgagcaagaagtccaacgacgacctgatcgcctacaccaacaagattaagaccaagtttccgggcaatgccctcctaaaagctatcattgactacatagcgtacatgaagtccctgcccgggatgacgaacttcaagtacgacaaattctgggacgagctcctgtacaagcctaaccctgccaaagccagcaacctggcccggggcaaggagagctcctacaactttaagctcgccatcagctccaagagcatcaagacgtgcaaaaacgtgaaagacgtcgcatgcctgtccccgcgcagcggggccatctatgcatcaataatcgcctgcggagagcccaatggcccctctgtgtacagaaagccgtccgggggcgtcttccagagctccaccgaccgcagcatctactgtctgctcgacagccattgccttgaggagttcgaggcgatcaaccaggaggaactggacgccgtcaaaaagagcaagtgctgggagatcgagtacagcgacgtcaagccgttacaggagggggacggcacgaagtcctgccggatgaaggactcgggcaactgcaacgtggccaccaaccgctggccagtgatccagtgtgaaaacgacaagttctactattccgagctgcagaaggactacgacaagacgcaggacatcgggcactactgcctcagccccggctgcacaaccgtgcggtaccccatcaacccgaagcacatctccaactgcaactggcaggttagccgctccagcatagccaagattgacgtgcacaatatcgaggacatcgagcagtacaagaaggctatcacccagaagctccagacgtccctgagcctgttcaagtacgcgaagaccaaaaacttaccccacatcaagcccatctacaagtacatcaccatcgaagggaccgagacggcggagggcatcgagtccgcctatatcgagagcgaggtgccggccctggccgggacgtccatcggcttcaagattaacagcaaggaggggaaacacctcttagacgtgatcgcctacgtcaagtccgccagctactcctcggtctacgcgaagctgtactcgactgggcctacctcgggcatcaacacgaagcacgacgagctgtgcaccgggccctgccccgctaacatcaaccatcaggtgggctggctcaccttcgccaaggagcgcaccagctcctggggatgcgaggagttcggatgcctggctgtcagcgacggctgcgtgttcgggtcctgccaggacatcatcaaggaggagctgagcgtgtatcgcaaagagacggaggaggtcaccgacgtggaactctgcctgacattctccgacaagacctactgtacgaacctcaacccggtgacccccatcatcaccgacctcttcgaggtccagttcaagaccgtggagacgtacagcctgccccggatcgtggccgtccagaaccacgagatcaaaattggccagatcaacgacctcggggtgtactccaagggctgcggtaacgtacagaaggtcaacggcaccgtatacggcaacggggtgccccgcttcgactacctatgccatctggctagcagaaaggaggtcatcgttcgcaagtgcttcgacaacgactaccaggcctgcaagttcctccagtcccccgcgagctaccggctcgaggaggactccggcactgtgaccatcatcgactacaagaagatcctggggaccataaagatgaaggccatcctaggcgacgtcaagtacaaaacgttcgccgacaacgtagatataaccgccgagggcagctgcaccggctgtattaactgcttcgagaacatccattgcgagctcaccctgcacacgaccatcgaggccagttgccccataaagtcgtcctgcaccgtattccacgaccgcattctggtcacccccagcgagcacaagtacgcgctcaaaatggtgtgcacggagaagccaggtaacactctaaccatcaaggtgtgcaataccaagattgaggccagcatggccctcgtcgacgccaagccgatcatcgagctcgcccccgtggaccagactgcgtacatccgagagaaggacgagcggtgtaagacctggatgtgtcgggtccgcgacgagggactccaggtaatcctggagccgttcaagaacctgttcggtagctacatcgggatcttctacacttttatcatcagcatcatggccctgttagttattatctacgtcctgctgcccatctgtttcaaactccgcgacacactccgcaagcacgaggacgcctacaagcgcgagatgaaaatccggtga

SEQ ID NO: 15956 - RNA, 4326 nt, synthetic construct
  misc_feature 1..4326: note = derived and/or modified CDS sequence (opt11) from LACV(LACV/00/WV-M (WV00-3178))__GU206148.1__GP
  source 1..4326: mol_type = other RNA
atgatccgcatcttagtgctcatcgccatcaccgccgcgagccccgtctaccagcggtgcttccaggacggtgccatcgtgaagcagaacccgtccaaggaggccgtgaccgaggtctgcctgaaggacgacgttagcatgatcaagacggaagcccgctacgtgcggaacgccaccggagtcttctccaacaacgtggcgatccgcaagtggctggtgagcgactggcacgactgccggcccaagaagatcataggcgggcatataaacgtcatcgaggtgggcgacgacctctccctgcacaccgagagctacgtgtgctccagcgactgcaccataggggtcgacaaggagacggcccaggtgcgcctgcagaccgacaccaccaaccacttcgagatcgccggcacgaccgtaaagtccggctggttcaagagcaccacctacatcacgctcgaccaaacctgcgagcacctgaaggtctcctgcgggcccaagagcgtgcagttccacgcctgcttcaaccagcacatgtcctgcgtgcggtttctacaccgcaccatcctgcccggctcgatcgccaattccatctgccagaacatcgagatcatcatcctggtcaccctgactctcctgatcttcatcctgctcagcatcctgtccaagacctacatctgctacctgctcatgccgatcttcatccccatcgcgtacatctacgggatcatctacaacaagagctgcaagaagtgcaagctgtgcggcctggtgtaccaccccttcaccgagtgcgggacccactgcgtgtgcggcgcccggtacgacacgtccgaccgaatgaagctccaccgggccagcggcctgtgccccgggtataagagcctgcgtgccgcgcgggtcatgtgcaagtccaagggcccggccagcatcctctccatcatcacggccgtgctggtgctgaccttcgtgacccccattaacagcatggtgttaggggagagtaaggagacgttcgagttagaggagctgcccgacgacatgctcgagatggccagccgcatcaactcctactacctgacctgcatcctgaactacgccgtcagctggggcctcgtgatcatcggcctgctgaccgggctcctgttcaagaagtaccagcaccgcttcctgaacacctacgcgatgtactgcgaggagtgcgacatgtaccacgacaagtccggcctcaagcgccacggggacttcacgaacaagtgcaggcagtgcacgtgcggccagtacgaggacgccgccggtctgatgacccaccgcaagacctacaactgccttgtgcagtacaaggccaaatggatgatgaacttcctcatcatctacatcttcctgatcctgatcaaagacagcgccatcatcgtccaggcggccggcacggacttcacgacctgcctcgagaccgagtctatcaactggaactgcaccggccccttcctgaacctggggaactgccagaaacagcagaagaaggagccgtacaccaacatcgccacccagttaaagggcctgaaggccatcagcgtgctggacatccccatcatcaccgggatccccgacgacatcgccggtgcgctgcggtacatcgaggagcgcgaggacttccacgtgcagctcaccacggagtacgccatgctgtcccggtactgcgactactacacccaatttagcgacaactcccgctacagccagaccacctggcgcgtctacctgcggtcccacgacttcgaggcctgcatcctctaccccaaccagcacttctgccgctgcgtgaaaaacggggagaagtgcagctccagcaactgggacttcgccaacgagatgaaggactactacagcggcaagcagacgaagtttgacaaggacctgaacctggcgctcaccgccctgcaccacgccttccggggcacctccagcgcatacatcgccaccatgctgtccaagaagtccaacgacgacctcatcacttacaccaacaagataaagaccaagttcccggggaacgcgctgctgaaggccatcattgattacatcgcctacatgaagtccctccccggcatggccaacttcaagtacgacgagttctgggacgagctgctgtacaagcccaaccccgccaagaccagcaacctcgcgcgcgggaaggagagcacgtacaacttcaagctggccatcagctccaagagcatcaagacctgcaagaacgtgaaggacgtcgcctgcctgtccccgcggagcggcgccatctacgcgtccatcatcgcgtgcggggagcccaacggcccaagcgtgtatcgaaagccctccggcggggtgttccagagctccaccgaccggagcatctactgcttgctggacagccactgcctggaggagtttgaggccatctcccaggaggaactcgacgccgtcaagaagtctaagtgctgggagaccgagtatccggaggtgaagcccctgcaggagagcgacggcaccaagagctgccgcatgaaggactccgggaactgcaatgtggccaccaaccggtggcccgtcatccagtgcgagaacgacaagttctactacagcgagctgcagaaggactacgacaagacccaggacatcggccactactgcctctcccccggctgcaccacggtgcgctacccgatcaaccccaagcacatcagcaactgcaactggcaggtctcccggagctccatagcgaagatcgacgtgcacaacatcgaggacatcgagcagtacaagaaggccatcacgcagaagctgcagaccagcctgtccctcttcaagtacgccaagaccaagaacctgccccacatcaagccgatctacaagtatatcacgatcgaggggaccgagaccgccgagggtatcgagagcgcctacatcgagtccgaggtgcccgcgctggccgggaccagcatcggattcaagatcaactccaaggaggggaagcatctcttggacgtgatcgcctacgtcaagagcgcctcctacagcagcgtgtacgccaagctgtactccacgggccccaccagcggcattaacaccaagcacgacgagctctgcaccgggccctgcccggcgaacatcaaccaccaaatcggctggctgacgttcgccaaggagcgcacctccagttgggggtgcgaagagttcggctgcctggccgtgtccgatgggtgcgtcttcggcagctgccaggacatcatcaaagaggagctctcggtgtaccggaaggagaccgaggaggtgaccgacgtcgagctgtgcctgacgttcagcgacaagacctactgcaccaacctcaaccccgtgacccccatcatcaccgacctgttcgaggtgcagttcaagacggtcgagacctactccctgccccgcatcgtggccgtgcagaaccacgaaatcaagatcggccagatcaacgatctcggggtctacagcaagggctgcggaaacgtgcagaaggtgaacggcacagtctacgggaacggcgttccgcggttcgactacctgtgccacctggcctcccgcaaagaggtgatcgtccggaagtgcttcgacaacgactaccaagcgtgcaagttcctccagagccccgccagttaccgcttggaggaagacagcggtaccgtgacgatcatcgactacaagaagatcctggggaccatcaagatgaaggccatcctcggcgacgtaaaatacaagacattcgccgagtccgtcgacatcaccgcggaagggagctgcacgggctgcatcaactgcttcgagaacatccactgcgagctaaccctgcacaccaccatcgaggcctcctgccccatcaagagctcctgcacggtgttccacgaccggatattagtgacccccaacgagcacaagtacgccctgaagatggtctgcaccgagcgcccggggaacaccctcacgatcaaggtgtgcaacaccaagatcgaggccagcatgaccctcgtggacgccaagcccatcatcgagctggctcccgtcgaccagaccgcctacatccgcgagaaggacgagcggtgcaagacgtggatgtgccgcgtgcgggacgagggcctccaggtgatcctggagcccttcaagaacctgttcggcagctacatcgggatcttctacaccttcatcatctccatcgtcgccctgctcgtgatcatctacgtcctgctgccgatctgcttcaagctccgcgacaccctgcggaagcacgaggacgcctacaagcgcgagatgaagatccgatga

SEQ ID NO: 15957 - RNA, 4326 nt, synthetic construct
  misc_feature 1..4326: note = derived and/or modified CDS sequence (opt11) from LACV(LACV/03/NY-M (41030016))__GU206130.1__GP
  source 1..4326: mol_type = other RNA
atgatctacatcctggttctcatcgccgtcaccgccgcgagccccgtgtaccagcgctgcttccaggacggcgccatcgtgaagcagaacccgagcaaggaggccgtcaccgaggtgtgcctgaaggacgacgtgagcatgatcaagacggaggcccggtacatccgcaacgccaccggggtcttctccaacaacgtggcgatccggaagtggctggtgagcgactggcacgactgccgccccaagaagatcgtcggcgggcacatcaacgtgatcgaagtgggcgacgacctctccctgcacaccgagagctacgtctgctccgccgactgcaccatcggggtggacaaggagacggcgcaggttcggctgcagaccgacaccaccaaccatttcgagatcgccggcacgaccgtcaagagcggctggttcaagagtaccacctacatcacgctcgaccagacctgcgagcacctgaaggtgagctgcgggcccaagtccatccagttccacgcgtgcttcaaccagcacatgagctgcgtacgcttcctgcacagaacaatcctccccggcagcatcgcaaactctatttgccagaacatcgagatcatcatcctggtcaccctgacgctcctgatcttcatcctgctctccatactgagcaagacctacatctgctacttactcatgccggtgttcatccccatcgcctacgtgtacgggatcatctacaacaagtcgtgcaagaagtgtaagctgtgcggccttgtctaccaccccttcaccgagtgcggaacccactgcgtgtgcggcgcaagatacgacacgagcgacaggatgaagctccaccgcgcctccggcctttgccccgggtacaagagcctgcgggcggcccgcgtgatgtgcaagagcaagggcccggcctccatcctcagcatcatcaccgccgtcctggtcctgacctttgtcacccccatcaactcaatggtgctcggggagagcaaggaggtgttcgagctcgaggagctgcccgacgacatgctcgagatggctctgcggatcaacttctactacttcacgtgcatcctgaactacgcggtctcctggagcctcgtgatcatcggcctgctgaccggcctcctgttcaagcgctaccagcacaagttcctgaacatctacgccatgtactgcgaagagtgcgacatgtaccacgacaagtccgggctcaagcggcacggcgacttcaccaacaagtgccgccagtgcacgtgcgggcagtacgaggacgcaaccggcctgatgacccaccggaagacctacaactgcctggtgcagtacaaggccaagtggatcatgaacttcctcatcatctacatcttcctggtcctgatcaaggacagcgccatcatcgtgcaggcggccgggaccgacttctccagctgcctcgagacggagtccataaactggaactgtaccggccccttcttgaacctcggcaactgccagaagcagcagaagaaggagccctacaccaacatcgccgcccagctcaaggggctgcgcgccatcagcgtgctggacatccccatgatcaccgagatccccgacgacatcgcgtccgctctgcggtacatcgaggagcgcgaggccttccacgtccagctcacggccgagtatgcgatgctgacccggtactgcgactactacacccagttcagcgacaactccggctacagccagaccacctggcgcgtgtacctgcgctcccacgacttcgaggcctgcatcatgtaccccaaccagcacttctgccggtgcgtgaagaacggggagaaatgcagctccagcaactgggacttcgccaacgagatgaaggactactacagcggcaagcaagccaagttcgacaaggacctcaacctggcactgacggcgctccaccacgccttccgcgggacctccagcgcctacatcgctgccatgctgtccaagaagtccaacgacgacctgatcacctataccaataaaattaagacgaaattcccgggcaacgcgctcctgaaggctatcatcgactacatcgcctacatgaagggcctgcccgggatggcctccttcaagcacgacgagttctgggacgagctcctttacaagcctacccccaccaaggccccgaacctggcgcgcggccgcgagtcatcctacaacttcaagctcgccatcagctccaagtctatcaagacctgcaagaacgtaaaggacgtggcctgcctgagcccccggagcggggccatctacgcgtccatcatcgcctgcggcgagcccaacgggcccagcgtgtaccgcaagccgtcgaacggcgtcttccagagctccaccgaccagagcatgtactgcctgctcgacagccactgcctggaggagttcgaggccatctcccaggaggaactggacgccgtgaagaagtccaagtgctgggagatcgagtacccggacatcaagcccctccaggagagcgacggcaccaagagctgccggatgaaggactccggcaactgcaacgtggccaccaaccgctggcccgtcatccagtgcgagaacgacaagttttactacagcgagctgcagaaggactacgacaagacccaggacatcggccactactgcctgtccccggggtgcacgaccgtgcggtaccccatcaaccccaagcacatcagcaactgcaactggcaggtctcccgcagctccatcgctaagatcgacgtgcacaacatagaggacatcgagcagtacaagaaggccatcacccagaagctccagaccagcctgtccctgttcaagtacgccaagacgaagaacctcccacacatcaagcccatctacaagtacatcaccatagagggcaccgagaccgcagagggcatcgagagcgcctacatcgagtccgaggtgcccgcgctggccgggacgagcatcggcttcaagatcaactccaaggaggggaagcacctcctggacgtgatcgcctacgtcaaaagcgcctcctacagcagcgtgtacaccaagctgtactccaccggccccacctcagggatcaacacgaagcacgacgagctgtgcaccggcccgtgccccgccaacatcaaccaccaggtgggctggctcaccttcgcgaaggagcggacctccagctgggggtgcgaggagttcggctgcctggccgtctccgacgggtgcgtgttcggcagctgccaggacatcatcaaggaggagctgtccgtgtaccgcaaggagacggaggaggtcaccgacgtggagctctgcctgaccttcagcgacaagacctactgcacgaacctgaaccccgtgacccccatcatcaccgacctcttcgaggtccagttcaagaccgtggagacttactcactgccgcgtatcgtggccgtccagaaccacgagatcaagatcgggcagatcaacgacctgggcgtgtacagcaaggggtgcgggaacgtgcagaaagtcaacggcaccgtgtacgggaacggcgtcccccgcttcgactacctctgccacctggcctcgcggaaggaggtcatcgtgcgcaagtgcttcgacaacgactaccaggcgtgcaagttcctgcagagccctgcgtcctacaggctcgaggaggacagcgggaccgtgaccgtcatcgactacaagaagatcctgggcaccatcaagatgaaggccatcctgggcgacgtgaagtacaagacgttcgccgacaacgtggacattaccgccgaggggtcctgcaccggctgcatcaactgcttcgagaacatccactgcgagctcaccctgcacacgaccatcgaggcgagctgccccatcaagtccagctgcaccgtcttccacgaccgcatcctggtgaccccgaacgagcacaagtacgccctcaaggtggtctgcacggagaagcccgggaacaccctgaccatcaaggtgtgcaacaccaagatcgaggcgtccatggccctggtcgacgccaagcccatcatcgagctcgcgcccgtggaccagacagcctacatccgggagaaggacgagcgctgcaagacctggatgtgccgcgtgcgggatgagggcctgcaagtcatcctggagccgttcaagaacctcttcgggagctacatcggcatcttttacacctttatcatcagcatcgtggccttactggtgattatctacattctcctgcccatctgcttcaagctgcgcgacaccctccggaagcacgaggacgcctacaagcgcgagatgaagatccggtga

SEQ ID NO: 15958 - RNA, 4326 nt, synthetic construct; identical to SEQ ID NO: 12672
  misc_feature 1..4326: note = derived and/or modified CDS sequence (opt11) from LACV(LACV/06/NY(1)-M (06MS2900303))__GU206118.1__GP
  source 1..4326: mol_type = other RNA

SEQ ID NO: 15959 - RNA, 4326 nt, synthetic construct; identical to SEQ ID NO: 12673
  misc_feature 1..4326: note = derived and/or modified CDS sequence (opt11) from LACV(LACV/06/NY(2)-M (06MS350140))__GU206109.1__GP
  source 1..4326: mol_type = other RNA

SEQ ID NO: 15960 - RNA, 4326 nt, synthetic construct; identical to SEQ ID NO: 12674
  misc_feature 1..4326: note = derived and/or modified CDS sequence (opt11) from LACV(LACV/06/NY(3)-M (06MS270036))__GU206121.1__GP
  source 1..4326: mol_type = other RNA

SEQ ID NO: 15961 - RNA, 4326 nt, synthetic construct; identical to SEQ ID NO: 12675
  misc_feature 1..4326: note = derived and/or modified CDS sequence (opt11) from LACV(LACV/65/OH-M (W17258))__GU206124.1__GP
  source 1..4326: mol_type = other RNA

SEQ ID NO: 15962 - RNA, 4326 nt, synthetic construct; identical to SEQ ID NO: 12676
  misc_feature 1..4326: note = derived and/or modified CDS sequence (opt11) from LACV(LACV/67/NY-M (67-8109))__GU206115.1__GP
  source 1..4326: mol_type = other RNA

SEQ ID NO: 15963 - RNA, 4326 nt, synthetic construct
  misc_feature 1..4326: note = derived and/or modified CDS sequence (opt11) from LACV(LACV/74/NY-M (74-32813))__GU206142.1__GP
  source 1..4326: mol_type = other RNA
atgatccgcatgctggtgctcatcgtcgtgaccgcagccagccccgtgtaccagcgatgcttccaggacggcgcaatcgtcaagcagaatccgtccaaggaggccgtgacggaggtctgcctgaaggacgacgtaagcatgataaagacggaggcccgctacgtgaagaacgccaccggggtgttctccaacaacgtcgccatccggaagtggctggtcagcgactggcacgactgcaggcccaagaagatcgtgggcgggcacatcaacgtcatcgaggtgggcgacgacctctccctgcacaccgagagctacgtgtgctccgcggactgcaccatcggggtggacaaggagacggcccaggtgcggctgcagaccgacaccaccaaccacttcgagatcgccggcacgaccgtcaagagcggctggttcaagtccaccacttacatcacgctcgatcagacctgcgagcacctgaaggtgagctgtgggcccaagtccgtgcagttccacgcctgcttcaaccagcacatgagctgcgtgcgcttcctgcaccggaccatcctccccggctccatagctaactccatctgtcagaacatcgagatcatcatcctggtcaccctgacgctcctgatcttcatcctgctatccatcctgagcaagacctacatctgctacctactcatgccgatcttcatccccatcgcgtacatgtacggggtgatctacaacaagtcctgcaaaaagtgcaagctgtgcggcctagtgtaccaccccttcaccgagtgcgggacccattgcgtctgcggcgcccgctacgacacgagcgaccggatgaagctccaccgcgcctccggcctgtgccccgggtacaagagcctgcgggccgcgcgcgtgatgtgcaagagcaagggcccggcctccatcctcagcatcatcacggctgtcctggtgctgaccttcgtgacccccatcaactccatggtcctcggggagagcaaggagacgttcgagctggaggagctgcccgacgatatgctagagatggccctgcggatcaactcctactacttcacgtgcatactgaactacgccgtgagctggggcctcatcatcgcgggcctgctggtggggctcatcttcaagaagtaccagcatcgcttcctgaacatctacgccatgtactgcgaggagtgcaacatgtaccacgacaagtccggcctgaagcgacacggggacttcaccaacaagtgccgccagtgcacgtgcggccagtacgaggacgccaccgggctcatcacccaccggaagacctacaactgtctggtccagtacaaggccaagtggatgatgaacttcctgatcatctacatcttcctcatactgatcaaggacagcgccatcgttgtgcaggcgaccggcaccgacttcacgacctgcctggagacggaatccattaactggaattgcaccggccccttcctcaatctggggaactgccagaagcagcagaagaaggagccgtacaccaacatcgccacccagctgaagggcttaaaggccatcagcgtcctggacatccccataatcacctccattcccgatgacatcgccggggcattacgctacatcgaggagaaggaggactttcatgtgcagctgaccacggagtacgccatgctcagcaagtactgcgactactatacccagttcagcgacaacagcggctactcccagacgacctggcgggtgtacctgcgcagccacgacttcgaggcatgcatcctgtaccccaaccagcacttctgcaagtgcgtcaagaatggggagaagtgctccagcagcaactgggattttgccaacgagatgaagaactactacagcggcaaacaggccaagttcgacaaggacctcaacctggcgctgacggccctccaccacgccttccggggtacctcgtccgcctacatcgccgcgatgctgagcaagaagtccaacgacgacctgatcgcctacaccaacaagatcaaggccaaatttccggggaacgccctcctgaaggccatcatagactacatagcgtacatgaagggcctgcctgagatggccaacttcaagtacgacgagttctgggacgagctcctgtacaagcccaaccccgccaaggccagcaacctggcccgtgggaaggagtcctcgtacaactttaagctcgctatctccagcaaatccatcaagacctgcaagaacgtgaaggacgtggcatgcctgagcccccgctccggcgccatctactcctccatcatcgcctgcggggagcccaatggccccagcgtctaccggaaaccctccggcggggtgttccaaagctccacggaccgcagcatctactgcctactcgactcccactgcctggaggagttcgaggcgatctcccaggaggagctggacgccgtgaagaagtccaagtgctgggagatagaatatccggacgtccggcccctccaagagagcgacggcgccaagagctgccgcatgaaggactccgggaattgcaacgtggccaccaaccggtggcccgtgatgcagtgcgagaacgacaagttctactacagcgagctgcagaaggactacgataagacccaggacatcggccactactgcctgtcccccggctgcaccactatccgctacccgatcaaccctaagcacatcagcaactgcaactggcaggtcagccggagcagcatcgcaaagattgacgtgcacaacgtggaggacatcgagcagtacaagaaggcgattacccagaaactccaaaccagcctgtccctgttcaagtacgccaagaccaagaacctgccccacatcaagccgatctacaagtacatcactatcgaggggaccgagaccgctgagggcatcgagagcgcctacatcgagtccgaggtccccgcgctagcggggacgagcgtgggcttcaagataaactccaaggaggggaagcacctcctggacgtgatcgcctacgtcaagagcgcctcctacagcagcgtgtacgccaagctgtactccacgggccccaccagcggcatcaacaccaagcatgacgagctgtgcactgggccctgcccggccaacatcaaccaccaggtgggctggcttacgttcgcgcgcgagcggacctccagctgggggtgcgaggagttcggctgcctggccgtctccgacgggtgcgtgttcggcagctgccaggacattatcaaagaggagctgtccgtgtaccgtaaggagaccgaggaggtcaccaacgtagagctctgcctgacgttcagcgacaagacatactgcaccaacctgaaccccgtaacccccatcatcacggacctcttcgaggtccagttcaagaccgtggagacctactccctgccccggatcgtcgccgtccagaatcacgagatcaagatcggccaaatcaacgacctgggggtgtacagcaagggctgcgggaacgtgcagaaggtcaacggcaccgtgtacgggaacggcgtgccccgcttcgactacctctgccatctggcctcccggaaggaagtcatagtgcgcaagtgcttcgacaacgactaccaggcctgcaagttcctgcagagccctgcctcctaccggctcgaggaggacagcggcacggtgaccatcatcgactataagaaaatcctggggacgatcaagatgaaggccatcctgggcgacgtcaagtacaagacctttgcggactccgtggacatcaccgccgagggcagctgcgctggctgcataaactgcttcgagaacatccactgcgagctaacgcttcacaccactatcgaggcatcctgccccatcaagtcttcctgcaccgtgttccacgatcgcatcctggtcacgccgaacgagcacaagtacgccctcaagatggtttgcaccgagaagccgggtaacaccctgaccatcaaggtctgcaacacgcggatcgaggccagcatggccctggtggacgcgaagcccatcatcgaactcgcccccgtggaccagaccgcctacatccgcgagaaagacgagcgatgcaagacgtggatgtgccgcgtccgcgacgagggcttgcaagtgatcctggaacccttcaaaaacttattcggcagctacatcgggatcttctacacctttatcataagcatcatcgccctgttagtgatcatctacgtcctcctgccgatctgcttcaagctgcgggacacgctccgaaaacacgacgatgcctacaaacgggagatgaagatccgctga

SEQ ID NO: 15964 - RNA, 4326 nt, synthetic construct
  misc_feature 1..4326: note = derived and/or modified CDS sequence (opt11) from LACV(LACV/93/MO-H)__GU206139.1__GP
  source 1..4326: mol_type = other RNA
atgatctgcatcctggtgctcatcaccgtcgccgccgcgagccccgtgtaccagcgctgcttccaggacggcgccatcgtgaagcagaacccttccaaggaagccgtgaccgaggtgtgcctgaaggacgacgtgtccatgatcaagacggaggcccggtatgtccgcaacgccaccggggtgttctcaaacaatgtggccatccggaagtggctcgttagcgactggcacgactgccgccccaaaaagatcgtaggcgggcacatcaacgtgatcgaagtcggcgacgacctctccctgcacactgagagctacgtgtgctccgccgattgcaccatcggggtggacaaggagacagcccaggtccggctgcagaccgacaccaccaatcactttgagatcgccggcacgaccgtcaagagcggctggttcaagtctaccacctacatcactctcgaccagacttgcgagcacctgaaggtgagctgcgggcccaagtccgtccagttccacgcgtgcttcaaccagcacatgagctgcgtgcgcttcctgcaccggaccatcctccccggctccatagccaacagcatctgccaaaacatcgagatcatcatcctggtgaccttgacgctcctgatcttcatcctactctccatcctgagcaagacctacatctgctacctgctcatgccgatcttcatccccatcgcctacatctatgggatcatctacaacaaatcctgcaagaagtgcaagctgtgcggcctggtctaccaccccttcaccgagtgcgggacccactgcgtgtgcggcgcccgctacgacacgagcgaccgaatgaagctccaccgcgcgtccggcctttgccccgggtacaagagcctacgggcggcccgcgtgatgtgcaagagcaagggcccggcctccatcctcagcatcatcaccgccgtcctggtgctgacgttcgtaacccccatcaactccatggtgctcggagagagcaaggagacgttcgagctagaggacctgcccgacgacatgctcgagatggcctcccggatcaacagctattacctgacctgcatcctgaactacgcggtgtcctggggcttagtcataatcgggttgctaatcgggctcttgttcaagaagtaccagcaccgcttcctgaacatctacgccatgtactgcgaggagtgcgacatgtaccacgacaagagcggcctcaagcggcacggagacttcaccaacaagtgccgccagtgtacctgcggccagtacgaggacgccgccgggctgatggcccaccggaagacgtacaactgcctggtgcagtacaaagcgaagtggatgatgaacttcctaatcatctacatctttctgatcctgatcaaggactccgccatcgtggttcaggccgccggcaccgacttcacgacctgcctcgagaccgagagcatcaactggaactgcaccggccccttcctgaacctggggaactgccagaaacagcaaaagaaagagccgtataccaacatcgcaacccagctcaagggccttaaggcaatctccgtgctggacgtgcccatcatcaccgggatccccgacgacatcgccggtgccctgcgctacattgaggagaaggaggacttccacgtccagctcaccatcgagtacgccatgctgagcaagtactgcgactactacacccagttcagcgacaacagcgggtactcccagaccacctggagagtgtacctgcgcagccacgacttcgaggcgtgcattctctatcccaaccagcacttctgccggtgcgtgaagaacggcgagaagtgctccagctccaactggggcttcgccaatgaaatgaaggactactatagcgggaaacagacgaagttcgacaaggacctgaacctggccctcaccgccctgcaccacgccttccgcggcaccagctccgcgtacatggccaccatgctcagcaaaaagtccaacgacgacctcatcgcctacacgaacaagatcaagaccaagttcccggggaacgccctgctgaaggccatcatcgactacatcgcgtacatgaagtccctccccggcatggcaaacttcaagtacgacgagttctgggatgagctgctgtacaagcccaaccctgccaaggccagcaacttagcccgcgggaaggagagctcctataacttcaagctggcaatcagctccaagagcatcaaaacctgcaagaacgtaaaggacgtggcctgcctgtccccgcggagcggcgccatctacgcctccatcatcgcgtgcggcgagcccaacggtcccagcgtgtataggaagccctccggcggagttttccagagctccaccgaccggagcatctactgcctcctggacagccactgcctggaggagttcgaggccatcggccaggaagaactggatgccgtgaagaagtccaagtgctgggagatcgagtacccggacgtgaagctgatccaggagggagatgggaccaagagctgccgcatgaaggactccggaaactgcaacgtcgccaccaaccgatggcccgtgatccaatgcgacaacgacaagttctactacagtgagcttcagaaggactatgacaagacccaggacatcgggcactactgcctctcccccggctgcaccacggtgcgctaccccatcaaccccaagcacatcagcaattgcaactggcaagtttcccggagctccatcgccaagatcgacgtgcacaacatcgaagacatcgagcagtacaagaaagcgatcacccagaagctgcagaccagcctatccctcttcaaatacgccaagaccaagaatcttcctcacataaagccgatctacaagtacatcacgatcgagggtaccgagacggccgaaggaatcgagagcgcctacatcgagtccgaggtgccggccctggcggggacaagcatcgggttcaagatcaactccaaggagggcaagcacctccttgacgtcatcgcctacgtcaagagcgcctcctacagctccgtgtacaccaagctctacagcaccgggccaacgagtggcataaacaccaagcacgacgaactctgcacggggccctgccccgccaacatcaaccaccaggacggatggctgaccttcgcccgcgagaggacctccagctggggctgcgaggagttcgggtgcctggcggtgtccgacggctgtgtgttcggaagctgccaggacatcatcaaggaggaactctccgtctaccgtaaggagaccgaggaggtcacggacgtggagctgtgcctgaccttcagcgacaaaacctactgcaccaacctcaacccggtgactcccatcatcactgacctgttcgaggtccagttcaagaccgtggagacctactccctgccccggatcgtggccgtccagaaccacgagatcaagatcggccagatcaacgacctcggggtgtacagtaagggctgcggcaacgtgcagaaagtcaacgggacgatctacggcaacggggtgccccgcttcgactacctgtgccatctggcctcccggaaggaagtaatcgtccgcaagtgcttcgacaacgactaccaggcctgcaagttcctccagagccccgcgagctaccggctggaggaggacagcggcaccgtgactataattgactacaagaagatcctggggaccatcaagatgaaggccatcctcggcgacgtgaagtacaagaccttcgccgactcagtcgacatcacggcagagggcagctgcaccgggtgcatcaactgcttcgagaacatccactgcgagctgaccctccacaccacgatcgaggcctcctgccccatcaaaagctcctgcaccgtgtttcacgaccgcatcctcgtgacccccaacgagcacaaatacgcgctgaaggttgtgtgcacggagaagcccggcaacactctgaccatcgaggtgtgcaacaccaagatcgaggccagcatggcccttgtcgacgccaaaccgatcatcgagctggcccccgtggatcagaccacgtacatccgggagaaggacgagcgctgcaagacatggatgtgccgggtccgcgacgaggggctccaggtgatcctggagcccttcaagaacctgttcggctcctacatcggcattttctacaccttcatcataagcatcgtggcgcttttagtaatcatctatgtgctgttacccatctgcttcaagctccgcgacaccctgcggaagcacgaggatgcctacaagcgcgagatgaagatccggtga

SEQ ID NO: 15965 - RNA, 4326 nt, synthetic construct; identical to SEQ ID NO: 12679
  misc_feature 1..4326: note = derived and/or modified CDS sequence (opt11) from LACV(LACV/95/OH-H (CCH-MB96))__GU206136.1__GP
  source 1..4326: mol_type = other RNA

SEQ ID NO: 15966 - RNA, 4326 nt, synthetic construct; identical to SEQ ID NO: 12680
  misc_feature 1..4326: note = derived and/or modified CDS sequence (opt11) from LACV(LACV/95/WV-H)__GU206133.1__GP
  source 1..4326: mol_type = other RNA

SEQ ID NO: 15967 - RNA, 4326 nt, synthetic construct
  misc_feature 1..4326: note = derived and/or modified CDS sequence (opt11) from LACV(LACV/96/WV-M (WV96-3955))__GU206145.1__GP
  source 1..4326: mol_type = other RNA
atgatctacatcctggtgctcatcgccgtcaccgccgcgtcacccgtgtaccagcgctgcttccaggacggcgccatcgtgaagcagaacccgagtaaggaggccgtcaccgaggtgtgcctgaaggacgacgtgagcatgatcaagacggaggcccggtacatccgcaacgccaccggggtcttctccaacaacgtggcgatccggaagtggttagtgagcgattggcacgattgccgccccaagaagatcaccggcgggcacatcaatgtcatcgaggtgggcgacgacctctccctgcacaccgagagctacgtgtgcagtgccgactgcacgatcggggtcgacaaggagaccgcccaagtgcggctgcagaccgacaccacgaaccacttcgagatcgccggcaccacagtcaagagcggctggttcaagtccaccacgtacatcaccctcgaccagacctgcgagcacctgaaggttagctgcgggcccaagtccgtgcagttccacgcatgcttcaaccagcacatgagctgcgtgcgcttcctgcaccggactatcctccccggctccatcgccaacagcatttgccagaacatcgagatcatcatcctggtcacgctgaccctcctgatcttcatcctgctttccatcctgagcaagacctacatctgctacctgctcatgccgatcttcatccccatcgcctacgtgtacgggatcatctacaacaagtcctgcaagaagtgcaagctgtgcggcctggtataccaccccttcaccgagtgcgggacgcactgcgtctgcggcgcccgctacgacacgagcgaccgaatgaagctccaccgcgcctccggcctgtgccccgggtacaagagccttcgggcggcccgcgtgatgtgcaagtcgaagggcccggcctccatcctcagcatcatcaccgccgtgctggtcctgaccttcgtgacgcccatcaactccatggtcctcggggagagcaaggaggtgttcgagctggaggagctgcccgacgacatgctcgagatggccctgcggatcaactcctactacttcacgtgcatcctgaactacgcggtgagctggggcctcatcatcatcggcctgctgacagggctcctgtttaagaagtaccagcaccgcttcctgaacatctacgccatgtactgcgaggagtgcgacatgtaccacgacaagtccggcctcaagcggcacggggacttcaccaacaagtgccgccagtgcacgtgcggccagtacgaggacgccgccgggctgatgacccaccgaaagacctataactgcctagtccagtacaaggccaagtggatcatgaatttcctcatcgtatacatcttcctgatcctgatcaaggacagcgcgatcatcgtgcgcgccgccggcacagacttctccagctgcctcgagaccgagatcatcaactggaactgcaccggccccttcctgaacctggggaactgccagcgtcagcagaaaaaggaaccctacgcaaacatcgccgcgcagctcaagggactgaaggccataagtgtcctggacatccccatgatcaccgagatccccgacgacatcgccagcgcacttcgctacatcgaggagcgagaagcgttccacgtgcagctcaccgccgagtacgccatgctttcccgctactgcgactactacacgcagttcagcgacaactccgggtacagccagaccacctggcgcgtgtacctgcggtcccacgacttcgaggcctgcatcctctaccccaaccagcacttctgccgctgcgtcaagaacggcgagaagtgtagctccgccaactgggacttcgcgaacgagatgaaggactactacagcggtaagcaggcgaagttcgacaaggacctgaacctggccctcaccgccatgcaccacgccttccggggaaccagctccgcgtacatggccgcaatgctgtccaagaagtccaacgacgacctgatcacgtacaccaacaagctcaagaccaagttcccgggcaacgccctgctgaaggccatcatcgattacatcgcgtacatgaaggggctcccaggcatggccaacttcaagcacgacgagttctgggacgagctgctgtacaagcccacccccacgaaggccccgaacctcgcccgcgggcgggagagctcctacaacttcgagctggcgatcagctccaagagcatcaagacctgcaagaacgtgaaggacgtggcctgcctgagcccccgcagcggcgccatctacgcctccatcatcgcctgcggggaacccaacggcccaagcgtctaccggaagccgtcaggcggggtgttccagagctccactgatcagagcatgtactgcctcctggactcccactgccttgaggagttcgaggcgataagccaggaggagctcgacgccgtgaagaagtccaagtgctgggagatcgagtaccccgacgtcaagctgttacaagagaacgacggcaccaagtcctgccgcatgaaggacagcgggaactgcaacgtggccacgaacagatggcccgtgatccagtgcgagaacgacaagttctactactccgagcttcagaaggactacgacaagacccaggacatcggccactactgcctgagccccggctgcgccaccatccgctacccgatcaaccccaagcacatctccaactgcaactggcaggtctcccggtccagcatcgccaagatcgacgtgcacaacatcgaggacattgagcagtacaagaaggcgatcacccagaagctgcagacgtccctcagcctgttcaagtatgccaagaccaagaacctgccccacatcaagccgatctacaagtacatcaccatcgaggggacagagaccgccgaaggcatcgagtcggcctacatcgagagcgaggtgcccgccctcgcggggacctccatcggcttcaagattaacagcaaggaggggaagcacctcctggacgtcatcgcctacgtgaaatccgccagctactccagcgtgtacaccaagctgtactccaccggccccaccagcggcgtcaacaccaagcacgacgagctgtgcaccgggccctgcccggccaacatcaaccaccaggtgggctggctgaccttcgcgcgcgaacggacgtcatcctgggggtgcgaggagttcggctgcctcgccgtgagcgacgggtgtgtcttcggctcctgccaggacatcatcaaggaggaactgagcgtgtaccgaaaggagaccgaggaggtgaccgacgtcgagctgtgcctcaccttctccgacaagacgtactgcaccaacctgaaccccgtgacccctatcatcaccgacctgttcgaggtgcagttcaagacggtcgagacctacagtctcccccggatcgtggccgtgcagaaccacgagatcaagatcggccagatcaacgacctgggggtctactccaaaggctgcgggaacgtgcagaaggtgaacggcaccatctacgggaacggcgtcccgcgcttcgactacctgtgccacctcgccagccggaaggaggtgatcgtgcgcaagtgcttcgacaacgactaccaggcctgcaagtttctgcagtcccccgcgagctaccggctggaggaggactccggcaccgtcacgatcatcgactacaagaagatcctcggaaccatcaagatgaaggccatcctgggcgacgtgaagtacaagaccttcgccgacaacgtagacatcaccgccgaggggagctgcaccggctgcatcaactgcttcgagaacattcactgcgagctgacgctccacaccaccatcgaggcatcctgccccatcaagagctcctgcaccgtcttccacgacaggatcctggtgacgcccaacgagcacaagtacgcgctgaaggtggtctgcaccgagaagcctgggaacaccctcaccatcaaggtgtgcaacacgaagatcgaggccgccatggccctggtggacgccaagcccatcatcgagctggcgcccgtcgaccagaccgcctacattcgcgagaaggacgagcggtgcaagacctggatgtgccgcgtgcgggacgagggcctccaagtcatcctggagcccttcaagaacctgttcggcagctacatcgggatcttttacaccttcatcatctccatcgtggccctcctggtgatcatctacatcctgctcccgatctgcttcaagctgcgcgacacgctgcggaagcacgaggacgcctacaagcgcgagatgaagatccggtga

SEQ ID NO: 15968 - RNA, 4326 nt, synthetic construct; identical to SEQ ID NO: 12682
  misc_feature 1..4326: note = derived and/or modified CDS sequence (opt11) from LACV(LACV/97/NC-M (NC97-7306))__GU206127.1__GP
  source 1..4326: mol_type = other RNA

SEQ ID NO: 15969 - RNA, 4326 nt, synthetic construct
  misc_feature 1..4326: note = derived and/or modified CDS sequence (opt11) from LACV(LACV/human/1960)__EF485031.1__GP
  source 1..4326: mol_type = other RNA
atgatctgcatcctggttctgatcaccgtcgccgccgcgagccccgtgtaccagcgctgcttccaggacggcgccatcgtgaagcaaaatccgtccaaggaggccgtcaccgaggtgtgcctgaaagacgacgtgagcatgatcaagacggaggcccggtacgtacgcaacgcaaccggggtcttctccaacaacgtggcgatccgtaaatggcttgtcagcgactggcacgactgccgacccaaaaagatcgtgggcggccacatcaacgtcatcgaggtcggcgacgacctctccctgcacaccgagagctacgtgtgcagtgccgactgcaccatcggggtggacaaagagacggcacaggtgcggctgcagaccgacacaaccaaccacttcgagatcgccggcacgaccgtcaagagcggttggttcaagtccaccacctacatcacgctcgaccagacttgcgagcacctgaaggtgagctgcgggcccaagtccgttcagttccacgcgtgcttcaatcagcacatgagctgcgtgcgcttcctgcaccggaccatcctcccaggctccatcgccaacagcatctgccagaacatcgagatcataatcctggtgaccctgacgctactgatcttcatcctgctctccatcctgagcaagacctacatctgttacctgctgatgccgatcttcatccccatcgcctacatctacgggaccatctacaacaagtcctgcaagaaatgcaagctgtgcggcctggtctaccaccccttcaccgaatgcggcacgcactgcgtgtgcggcgcccgctacgataccagcgatcggatgaaacttcaccgcgcctctggcctctgccccgggtacaagagcctccgggcggcccgcgtgatgtgcaagagcaagggcccagcctccatcctcagcatcatcaccgccgtcctggtgctgacctttgtcacgcccatcaactcaatggtgctcggggagagcaaggagactttcgaactagaagacctgcccgacgacatgctagaaatggcctcccggataaacagctactacttaacctgcatactgaactacgcggtgtcctggggcctcgtcatcatcggcctgctgatcgggctcctgttcaagaagtaccagcaccgcttcctgaacgtatacgccatgtactgcgaggagtgcgacatgtaccatgacaagagcggcctgaaggggcacggcgacttcaccaacaagtgccggcagtgcacgtgcgggcagtacgaggacgccgctggcctaatggcccaccgcaagacctataactgcctggtgcagtataaggcgaagtggatgatgaacttcctcatcatctacatcttcctgatcctaatcaaggactcagccatcgtcgtgcaggccgccggcaccgacttcaccacgtgcctcgagaccgagagcatcaactggaactgcaccgggcccttcctgaacctgggcaactgtcagaagcagcagaagaaagagccctacaccaacatcgccacgcagctcaaggggcttaaggcgatctccgtgctggacgtccccatcatcaccggcatccccgacgacatcgccggggccctgcggtacattgaggagaaggaggacttccacgtgcagctcaccatcgagtacgccatgctgagcaagtactgtgactactacacccagttctccgacaacagcggctactcccagaccacgtggcgcgtgtacctgcggagccacgacttcgaggcttgcatcttataccccaatcagcacttctgccgctgcgtcaagaacggcgagaaatgctccagctccaactgggacttcgccaacgagatgaaggactactactccggcaagcagaccaagttcgacaaggatctgaacctcgcactcaccgccctccatcacgccttccggggcacaagctccgcgtacatcgccacgatgctgagcaagaagtcgaacgacgacctcatcgcctacaccaataagatcaagaccaagttcccgggggatgccctgctgaaggccatcatcgactacatcgcgtacatgaagtccctgcccggcatggcgaacttcaagtacgacgagttctgggacgagctgctctacaaacccaacccggccaaggccagcaacctcgcccgcgggaaagagagctcctacaacttcaagctggcgatcagctccaagagcatcaagacctgcaagaacgtgaaggacgtggcctgcctgtccccgcgcagcggcgccatctacgcctccatcatcgcgtgcggtgagccgaacgggcccagcgtctatcggaaaccctccggcggggtgttccagagctccacggaccagagcatctactgtctcctggacagccactgcctggaggagttcgaggccatcggccaggaggagcttgacgccgttaagaagtctaagtgctgggagatcgagtacccggacgtgaagctgatccaggagggcgacgggaccaagagctgccgcatgaaggactccggcaactgcaatgtggccacgaaccggtggcccgtgatccagtgcgagaacgacaagttctactatagcgagctgcagaaggattacgacaagacccaggatatcgggcactactgcctctcccccggctgtacgaccgtccgctaccccatcaacccgaagcacatcagcaactgtaactggcaggtctcccggtcgagtatcgccaagatcgacgtgcacaacatcgaggacatcgagcagtacaaaaaggccattacccagaagctgcagaccagcctctccctcttcaagtacgccaagacgaagaacctaccacacatcaagcccatctacaagtatatcaccatcgaggggaccgagacagccgagggcatcgagagcgcctatatcgagtccgaggtgccggccctggcgggtacaagcatcgggttcaagataaactctaaggagggcaagcacctcctggacgtgatagcctacgtcaagagcgcctcctacagctccgtgtacaccaagctgtacagcaccgggcccaccagcggcattaacacgaagcacgacgagctctgcactgggccctgccccgccaatatcaaccaccaggtgggctggctgaccttcgcccgcgaacgaacctccagctggggctgcgaggaatttgggtgcctagcggtatccgacggttgcgtcttcgggagctgccaggacatcatcaaggaggagctaagtgtataccgcaaggagacggaggaggtgaccgacgtcgagctgtgcctgaccttcagcgacaagacctactgcaccaacctcaaccccgtgacccccatcatcaccgacctgttcgaggtgcagttcaagaccgtcgagacgtactctctgccccggatcgtggccgtgcagaaccatgaaatcaagatcggccagatcaacgacctcggggtttacagcaagggctgtggcaacgtgcagaaggtgaacgggaccatctatggcaacggggtcccccgcttcgactacctgtgccatctagcctcccggaaagaggtgatcgtgcgcaagtgcttcgacaacgactaccaggcctgcaagttcctccagagcccggcgtcctaccggctggaggaggatagcggcaccgtcaccatcatcgactacaagaagatcctggggacaatcaagatgaaggccatcctcggcgacgtgaagtacaagaccttcgccgactccgtggacatcaccgcagagggcagctgcaccgggtgcattaactgcttcgagaacatccactgtgagctgacgttacacacgaccattgaggcctcgtgccccatcaagtcctcctgcaccgtcttccacgacaggatcctcgtgacccccaacgagcacaagtacgcgctgaagatggtgtgcacagagaagcccggcaacacccttaccatcaaagtctgcaacacgaagatcgaggcgagcatggccctcgtcgacgccaagccgataatcgagctggcccccgtagatcagacggcgtacatccgggagaaagacgagcgctgcaagacctggatgtgccgggtgcgcgacgaggggctccaggttatcctcgagcccttcaagaacctgttcggctcctacatcggcatcttctacaccttcatcatctcaatcgtcgccttactcgtgatcatctacgtgctgctgcccatttgcttcaagctccgggacactctacgtaagcacgaggacgcctacaagcgcgaaatgaagatccggtga

SEQ ID NO: 15970 - RNA, 4326 nt, synthetic construct; identical to SEQ ID NO: 12684
  misc_feature 1..4326: note = derived and/or modified CDS sequence (opt11) from LACV(LACV/mosquito/1978)__EF485037.1__GP
  source 1..4326: mol_type = other RNA

SEQ ID NO: 15971 - RNA, 4326 nt, synthetic construct
  misc_feature 1..4326: note = derived and/or modified CDS sequence (opt11) from LACV__KP271111.1__GP
  source 1..4326: mol_type = other RNA
atgatccgcatcctggtgctcatcgccgtcaccgccgcgagccccgtgtaccagcggtgcttccaggacggcgccatcgtgaagcagaacccgtccaaggaggccgtcaccgaggtgtgcctgaaggacgacgtgagcatgatcaagacggaggcccgctacgtccggaacgccaccggggtgttctccaacaacgtggcgatccgcaagtggctggtcagcgactggcacgactgccggcccaagaagatcatcggcgggcacatcaacgtgatcgaggtgggcgacgacctctccctgcacaccgagagctacgtctgctccgccgactgcagcatcggggtggacaaggagaccgcccaggtgcgcctgcagacggacaccaccaaccacttcgagatcgccggcaccacggtcaagtccggctggttcaagagcaccacctacatcaccctcgaccagacgtgcgagcacctgaaggtgtcctgcgggcccaagagcgtgcagttccacgcgtgcttcaaccagcacatgtcctgcgtccggttcctgcaccgcaccatcctccccggcagcatcgccaactccatctgccagaacatcgagatcatcatcctggtgaccctgaccctcctgatcttcatcctgctcagcatcctgtccaagacgtacatctgctacctgctcatgccgatcttcatccccatcgcctacatgtacgggatcatctacaacaagagctgcaagaagtgcaagctgtgcggcctggtgtaccaccccttcaccgagtgcgggacccactgcgtctgcggcgcccggtacgacacctccgaccgcatgaagctccaccgggccagcggcctgtgccccgggtacaagagcctgcgcgcggcccgggtgatgtgcaagtccaagggcccggccagcatcctctccatcatcacggccgtgctggtcctgaccttcgtgacccccatcaacagcatggtcctcggggagtccaaggagaccttcgagctggaggagctgcccgacgacatgctcgagatggccagccgcatcaactcctactacttcacgtgcatcctgaactacgcggtgagctggggcctggtgatcatcggcctcctgaccgggctcctgttcaagaagtaccagcaccggttcctgaacgtctacgccatgtactgcgaggagtgcgacatgtaccacgacaagtccggcctgaagcgccacggggacttcaccaacaagtgccggcagtgcacgtgcggccagtacgaggacgccgccgggctcatggcccaccgcaagacctacaactgcctggtgcagtacaaggcgaagtggatgatgaacttcctgatcatctacatcttcctcatcctgatcaaggacagcgccatcgtggtccaggccgccggcaccgacttcacgacctgcctggagaccgagtccatcaactggaactgcaccggccccttcctcaacctggggaactgccagaagcagcagaagaaggagccgtacaccaacatcgccacccagctgaagggcctcaaggcgatcagcgtgctggacatccccatcatcacggggatccccgacgacatcgccggcgccctgcggtacatcgaggagcgcgaggacttccacgtgcagctgaccatcgagtacgccatgctctccaagtactgcgactactacacccagttcagcgacaactccgggtacagccagaccacctggcgggtctacctgcgctcccacgacttcgaggcgtgcatcctgtaccccaaccagcacttctgccgctgcgtgaagaacggcgagaagtgcagctccagcaactgggacttcgccaacgagatgaaggactactacagcggcaagcagacgaagttcgacaaggacctcaacctggccctgaccgccctccaccacgccttccgggggacctccagcgcgtacatcgccaccatgctgtccaagaagtccaacgacgacctgatcgcctacacgaacaagatcaaggccaagttcccgggcaacgccctcctgaaggcgatcatcgactacatcgcctacatgaagtccctgcccgggatggccaacttcaagtacgacgagttctgggacgagctcctgtacaagcccaaccccgccaaggccagcaacctggcgcgcggcaaggagagcagctacaacttcaagctcgccatctccagcaagtccatcaagacctgcaagaacgtgaaggacgtcgcctgcctgagcccgcggtccggggccatctacgcgagcatcatcgcctgcggcgagcccaacggcccctccgtgtaccgcaagcccagcgggggcgtgttccagtccagcaccgaccggagcatctactgcctgctcgactcccactgcctggaggagttcgaggccatcaaccaggaggagctggacgccgtcaagaagtccaagtgctgggagatcgagtacagcgacgtgaagccgctccaggagggggacggcaccaagagctgccgcatgaaggactccggcaactgcaacgtggccacgaaccggtggcccgtcatccagtgcgagaacgacaagttctactacagcgagctgcagaaggactacgacaagacccaggacatcgggcactactgcctgtcccccggctgcaccaccgtgcgctaccccatcaacccgaagcacatcagcaactgcaactggcaggtctcccggagctccatcgcgaagatcgacgtgcacaacatcgaggacatcgagcagtacaagaaggccatcacgcagaagctccagaccagcctgtccctgttcaagtacgccaagaccaagaacctcccccacatcaagcccatctacaagtacatcaccatcgaggggacggagaccgccgagggcatcgagagcgcctacatcgagtccgaggtgccggcgctggccgggaccagcatcggcttcaagatcaactccaaggagggcaagcacctcctggacgtgatcgcctacgtcaagagcgcctcctacagcagcgtgtacgccaagctgtactccaccgggcccacgagcggcatcaacaccaagcacgacgagctgtgcaccgggccctgccccgcgaacatcaaccaccaggtgggctggctcaccttcgccaaggagcgcacgtccagctgggggtgcgaggagttcggctgcctggccgtctccgacggctgcgtgttcgggagctgccaggacatcatcaaggaggagctgtccgtgtaccggaaggagaccgaggaggtcaccgacgtggagctctgcctgaccttcagcgacaagacgtactgcaccaacctgaacccggtgacccccatcatcaccgacctcttcgaggtccagttcaagacggtggagacctactccctgccccgcatcgtggccgtccagaaccacgagatcaagatcggccagatcaacgacctgggggtgtacagcaagggctgcgggaacgtgcagaagatcaacggcaccgtctacggcaacggggtgccccggttcgactacctctgccacctggcgtcccgcaaggaggtgatcgtccggaagtgcttcgacaacgactaccaggcctgcaagttcctgcagagcccggcctcctaccgcctcgaggaggacagcggcaccgtgacgatcatcgactacaagaagatcctggggaccatcaagatgaaggccatcctgggcgacgtgaagtacaagaccttcgccgactccgtcgacatcaccgcggaggggagctgcaccggctgcatcaactgcttcgagaacatccactgcgagctcacgctgcacaccaccatcgaggcctcctgccccatcaagagctcctgcaccgtgttccacgaccggatcctggtgacgcccaacgagcacaagtacgccctcaagatggtctgcaccgagaagcccggcaacaccctgaccatcaaggtgtgcaacacgaagatcgaggccagcatggccctggtggacgcgaagccgatcatcgagctcgcccccgtcgaccagaccgcctacatccgcgagaaggacgagcggtgcaagacctggatgtgccgcgtgcgcgacgaggggctgcaggtcatcctggagcccttcaagaacctcttcggcagctacatcgggatcttctacaccttcatcatctccatcgtggccctgctggtgatcgtctacgtgctcctgcccatctgcttcaagctgcgggacacgctccgcaagcacgaggacgcctacaagcgggagatgaagatccgctag

SEQ ID NO: 15972 - RNA, 4263 nt, synthetic construct; identical to SEQ ID NO: 12686
  misc_feature 1..4263: note = derived and/or modified CDS sequence (opt11) from OROV(BeAn19992)__NC_005775.1__GP
  source 1..4263: mol_type = other RNA

SEQ ID NO: 15973 - RNA, 4263 nt, synthetic construct; identical to SEQ ID NO: 12687
  misc_feature 1..4263: note = derived and/or modified CDS sequence (opt11) from OROV(BeH759021)__KP691607.1__GP
  source 1..4263: mol_type = other RNA

SEQ ID NO: 15974 - RNA, 4263 nt, synthetic construct; identical to SEQ ID NO: 12688
  misc_feature 1..4263: note = derived and/or modified CDS sequence (opt11) from OROV(BeH759022)__KP691610.1__GP
  source 1..4263: mol_type = other RNA

SEQ ID NO: 15975 - RNA, 4263 nt, synthetic construct; identical to SEQ ID NO: 12689
  misc_feature 1..4263: note = derived and/or modified CDS sequence (opt11) from OROV(BeH759040)__KP691616.1__GP
  source 1..4263: mol_type = other RNA

SEQ ID NO: 15976 - RNA, 4263 nt, synthetic construct; identical to SEQ ID NO: 12690
  misc_feature 1..4263: note = derived and/or modified CDS sequence (opt11) from OROV(BeH759146)__KP691631.1__GP
  source 1..4263: mol_type = other RNA

SEQ ID NO: 15977 - RNA, 4263 nt, synthetic construct; identical to SEQ ID NO: 12691
  misc_feature 1..4263: note = derived and/or modified CDS sequence (opt11) from OROV(BeH759620)__KP691622.1__GP
  source 1..4263: mol_type = other RNA

SEQ ID NO: 15978 - RNA, 4263 nt, synthetic construct; identical to SEQ ID NO: 12692
  misc_feature 1..4263: note = derived and/or modified CDS sequence (opt11) from OROV(BeAn19991)__KP052851.1__GP
  source 1..4263: mol_type = other RNA

SEQ ID NO: 15979 - RNA, 4263 nt, synthetic construct
  misc_feature 1..4263: note = derived and/or modified CDS sequence (opt11) from OROV(Tr9760)__AF312381.2__GP
  source 1..4263: mol_type = other RNA
atggccaacttaatcatcatcagcatggtgctctccatcgcctacggccaccccctgagcacctcccagatcggggaccgctgcttcgctggcgggaacctgttcaaggagatgaacctcagcgtcggcctgggggagatctgcgtgaaggacgacatctccatcgtgaagtccaccacggtcttctccaagaacaagctggccctcgaggccaccaccaagttttaccgcagcttcatcgtgaaggactggtccgagtgcaacccggtgctggacaagttcgggaacttcatggtcctgagcgtggacgataacggccacaccatccccaagatgtacacgtgccgcgctgcctgcgacatccggctcaacaaggacaacgcggagatcatcctgtccagcaccaagctcaaccacttcgagatcgtggggaccacctccacgagcggctggttcaagaacaccatcaccaacaatctcgagcacacgtgcgagcacgtcacggtgaactgcgggcagaagtccgtgaagttccacgcctgcttccgccagcaccggggatgcgtccgcttcttcaaggggacctatatgccccacagcatgatcgaggccatgtgcgtgaacatcgagctgatcatcctgaccctctacatcttcgccgccatcatcttcgccctcatcataaccaagtcctacgtggcttacctcctcttacccctgttctacccggccacgtggttctacggcaaggtctacaagaagatcaatagctgccccaactgcctcctggcctcccaccccttcaccagctgccccaagatctgcatctgcggcagccggttctcctgcaccgaggcgctgaaagtgcaccgcatggggaaggactgcctcggctacaagagcctgtccaaggcccggcagatgtgcaaaagcaagtcctggagcttcaccgccgccatcctgacggggctcatcctgatggagttcatctccccgatcgccggcgagcgcatgtacaagctggaggagctcgcggacgagttcatcaagctgaccgagcaggtcaacattctggagcgggagatggaggtgctcaagcaaagcatcattgtgatgttcgccatcatcctggtgctgcttctgttcgagaacatgatcttcaaccgcctgttccggatcttctaccgctcctgcagcatgtgcggcctcatccactaccggcccgggctgaagatcgacctgaccaagaccaaccgctgcggctcctgcatctgcgggttcgacgagcagcagagctccggcttcgagtacgagatcttcctcacggacatgcacgtccagaaggagagctgcaagtttagcccccgggtgaaccacttccgcaacaccaaagccctgctgttcgccctcgtgatctgcgccaccatctacaccgtctacgcggacgaggactgcctgagtaaggacatcaagatcacgtaccaggagctgcataactgcatcggccccaagatcatgggcgacacgtgcgtttccaagagcgagctctactccgacctgttcagcaagaacctggtcaccgagtatgacaagaagtacttcgagccggacaccgtgaacgaccagttcaacaagatcgagttcgcccaggacgcccaccggatgatcctgctcgagcgcatcctgtacaagaccgagtgcgagatgctgagcctcaagaagaactccggcccctacaacgtggcctggcggacccacttgaagaaccacaacatcgacctgtgcagccgccacaactacaagatgatctgccagtgcatcaacgcacactccatgtgcaagaacaccgacatcgactacaacaaggagatcgagacctactacaagagcaacgcggccgcctaccgcgccgggctcaacacgatcatggacaccctgaagaccgcgttcagaggcctgaccaaggtcctcatcgagaactacatcgagaaggacgactccgacgccctgaaggccctgttcagcaacatcaccgactccgttcaggacaactaccagatgatcgggatcctcaagttcgccagcaagctgctggacatcaacctcgggcgctccacgcggagcgcccaccactccatcatgaccaacgagatccccaagagcaaccccttcaccgactacagctacagcaacgtgaacatcaaagagtgcatgtccccggagagcctgaagtgcttcaagaaacgcgactccacgccccataccaaccacctcctgtgcaagatcgacaacaagtacaaggcgttcgactggcccgagatcgagaccatccagaaggggcagaagctgtgcctgggcgacagccactgcaacctcgagttcaccgccatcaccgccgaccggatcatgagcctgacgaactgctacaaggagtcgttcaccgctcaacccgccgacatgcaggcgggcatcaagaagtgcagcgccgacgagatcggggagtgcaccaccctggaggacaagacgtggcccatcgtcttctgctccggcaagtactactacagcgactccaaggagcacgccaaggacgggagcatcaacaactactgtctcacaaacaagtgctccgagcagcgcttccccatccacgagaactggttcaagaagtgcaactgggacaagacccacaaggagttccggccctacgaaaccaacaactacaacgacatcacgagctaccgcaaggccatcgagtccgagatcggcaccgatctcatgacccaccactacaagcccaccaagaacctgccacacgtggtgccccggtaccacagcatcgacgtccaggggacggagtccaccgagggcatcatcaacggcttcatccagaacaccatccccgccatcagtgggctcgacgtgggctaccacctgaacttcaagggcaaccaactcttcgacatcgtgatcttcgtcaagaaggcggtgtacaaggctcagtaccagaaggcctacaccacgggcccctccatcagcatcaatatcgagcacaacgagcgctgcacaggccactgtccggagaagatccccgctaaggagggatggctcaccttctccaaggagcacaccagctcctggggctgcgaggagtacgggtgcctggcgatcgacacgggctgcctgtacgggagctgccaggacgtcatccggcccgagctcgacgtctacaagaagatcggctccgaggccagcctgatcgagatctgcatcacactgcctcacgagacctactgcaacgacatggacatcctcgagcccatcatcggcgacaagctgagcgcctccttccagaacacccagacgaaccagctgcccaccctcatcgcctacaagaaggggaagatctacaccggccagatcaacgacatcgggaacaccgccctgcagtgcggcagcatccaggtgatcaacgggtccacgatcggcaccggcagccccaagttcgactacatctgccacgctatgcgccggaaggacgtgatcgtccgcaagtgcttcaacgacaactaccagtcctgcacccggctggagaaacgcaacgacctcatcccgtaccggaagggggacgtgatcgaggtgagcaagaccggctccaacatggggcagatgaccttcaagatcgagctgggcgacatcaactacaagatcttcaccaagagcgttgacctccagatgtccgggatctgcgccggctgcatcgactgcgccgagggcattagctgctccatcaacgccgaagttcccgccgagacagtgtgccattgcaagaccaactgcgaggacttcatcaacaacatcgtcttcagcccccagatcaagaactacaacatcaaggtgcactgcaagtccaaggtggagaagataaccgcgcacatctgcgggcgcgacatcgacctccagctgacggtcaagccctacaaccagaagatcgacctgagccagctcgacgagtccaactacatccgggaggaggacctgcagtgcggcacctggctgtgcaaggtgcagaaggaggggattgacatcatgttcaagggtctcttcagcgggctgggccgctactggaccatcctgatctactccatcatcggggtggtcatcatcgtgatcctcgtgtacatcctgctgccgatcgggcgcctcctgaaggccttcctgatccggcacgagatcgagtacgccatggagcagaagatcaagtga

SEQ ID NO: 15980 - RNA, 4263 nt, synthetic construct; identical to SEQ ID NO: 12694
  misc_feature 1..4263: note = derived and/or modified CDS sequence (opt11) from OROV(TRVL-9760)__KC759123.1__GP
  source 1..4263: mol_type = other RNA

SEQ ID NO: 15981 - RNA, 4263 nt, synthetic construct; identical to SEQ ID NO: 12695
  misc_feature 1..4263: note = derived and/or modified CDS sequence (opt11) from OROV(TVP-19244/DEI-216)__KP795073.1__GP
  source 1..4263: mol_type = other RNA

SEQ ID NO: 15982 - RNA, 4263 nt, synthetic construct
  misc_feature 1..4263: note = derived and/or modified CDS sequence (opt11) from OROV(TVP-19249/GML-444672)__KP795076.1__GP
  source 1..4263: mol_type = other RNA
atggccaatctgatcatcttcagcatcatcctcggcatcgcctacgggcaccccctgtccacctcgcagatcggcgaccgctgcttcgccgggggctccctgttcaaggagatgaacctcagcgtgggtctaggagagatctgcgtcaaggacgacatctccatcgtcaagagcaccacggcgttctccaaaaacaccctggccctcgaggccaccaccaagttctaccggagcttcatagtgaaggactggtccgagtgcaacccggtgctggacaagctgggcaacttcatggtgctcaacgtggacgacaacgggcacctggtcccccgcatgtacacgtgccgggccgcgtgtgacatccgcttaaacaaggacaacgccgagatcatcctcagctccaccaagctgaaccacttcgagatcgtgggcaccaccagcacgtccggatggtttaagaacaccatcaccaacaacttggagcacacgtgcgagcacgtgacggtcaactgcggccagaagtccgtgaagttccacgcctgcttccggcagcaccgcgggtgcatccgattcttcaagggcacctacatgccttactccatgatcgaggccatgtgcatcaacatcgagctcatcatcctgaccctgtacatcttcgcggccatcatcttcgccctcatcatcacaaagagctacatcgcctacctgctgctccccctgttctacccggtgacgtggctgtacggcaaggtctacaaacgcatcaactcctgtagcaactgcctcctggcctcccaccctttcaccagctgccccaagatctgcatctgcgggagccgattctcctgcaccgaagcgctgaaggtccaccgaatgggcaaggactgcctcgggtacaagagcctgtccaaggcccggcagatgtgcaagagcaagtcctggagcttcaccgccgccatcctgacgggcctcatcctgatggagttcgtgtcccccatcgccggcgagcgcatgtacaagctggaggagctcgccgacgactacatcgagatggccgagcgggtcgggatgctggagaaggagatcaaggtgcttaaacagttcaccatcgtgatgctcgtcattatcctcatcctgttgctgttcgagaacacgatcttcaactacttgttcaacaccctctaccgcagctgctccatgtgcggcctgatccactaccggccggggctgaaggtggacctcacgaagacaaacaagtgcggcagctgtatctgcgggttcgacgagcagcagtccagcggcttcgagtacgaggtgttcctgaaggacatgcacatccagcgcgagtcctgcaagtttggcccccgggtcaaccacttccgcaacaccaagatcctgctgttcaccatcgcaatctgcacgagcttctacaccgtgtacgcagacgaggactgcctgtccaagaacatcaagatcacctaccaggagctgcacaactgcatcgggccctacatcatgggcgacacgtgcgtgagcaagtccgagctgtacagcgacctcctgtccaagaaccttatcaccgagtacgacaaaaagtacttcgagcccgacaccgtcaacgaccagttcaacaagatcgagttcgcccaggacgcgcaccgcatgatcctcctggagcgcatcctgtacaagacagagtgcgagatgctcagcctgaagaagaacagcgggccgtacaacgtggcctggagaacctacctgaagaaccacaacatcgacctctgcagtcgacacaactacaagatgatctgccagtgcatcaacatgcacagcatgtgcaagaacacggacatcgacttcaacaacgagatcgagacctactacaaggccaacgcagccgcgtaccgctccgacttctacaccatcatcgacaccctgaagaccgccttccggggcctgacgaaggtcctcatcgagaactacatcgagaaggacgacagcgacgccctgaaggccctgttctccaacatcaccaacagcgtgcaggacaactaccagatggttggggtccttaagttcgcgtccaagctgttgaacatcagcctaggccgttccacccggagcgcccagcactcaatcatgaccaacgagatccccaagagcaaccccttcacggactactcctacagctccgtgaacatcaaggagtgcatgagccccgaatccctgaagtgcttcaagaagcgcgacagcgtgccgcacaccaaccacctcctctgcaaaatggacaacaagtacaaggccttcgactggcccgagatcgagaccgtccagaaaggccagaagctgtgtctgggggacagccactgcaacctcgagttcactgccattacggccgataagatcatgtccctgaccaactgctataaggagagcttcactgcgcagcccgccgacatgcagaccggcatcaagaagtgctccgccgacgagatcggggagtgcatcacgctggaggacaaggcctggcccatcgtggtgtgcggcgacaagtactactacagcgacgggaaagagcacgccaaggacgggtccatcaacaactactgcctcgcgaacaagtgcagcgaacagcggttcccgatccacaagaactggttcaagaagtgcaactgggacaagacccacaaggagttcaccaccatgcgccagatcaactacaacgacatcacgtcctaccggaaggccatcgagagcgagataggcaccgacctgatgacacaccactacaagcccaccaagaacctgccccacgtcgtgccccgctaccactccatcgacgtgcaggggacggagagcaccgagggcatcatcaacgggttcatccagaacaccatcccggccatctccggcttaggcgtcggttaccacctgggtttccgggggaaccagctgttcgacatcgtgatcttcgtgaagaaggccgtctacaaggcccagtaccagaaggtgtacaccacgggccccagcatctccataaacatcgagcacaacgagaaatgcaccgggcactgccccgagaagatccccgcgaaggagggctggctcaccttcagcaaggagcacacctccagctggggctgcgaggagtacgggtgcctggccatcgacacgggctgcctgtacggctcctgccaggacgtgatccgcccggagctcgacatctacaagaagatcggcagcgaggcctccctgatcgagatctgcatcaccctgccccacgagacctactgcaacgacatggatatcctcgagcccatcatcggggacaagctgagcgcgagcttccagaacacccagacgaaccagctgccggtcctcatggcgtacaagaagggcaaggtgtacaccggccagatcaacgacgtggggaacaccgccctgcagtgcggctccatccaggtcgtgaacggcagcacaatcggctccgggaaccccaagttcgactacatctgccacgccatgcggcgcaaggacgtgatcgtccggaagtgcttcaacgacaactaccagagctgtacgcgcctggacgctcggaacgacctcatcccctatcgcaagggcgacatcatcgagatctccaagaccggcagcaacatggggcagatgaccttcaagatcgagctaggcgacatcaactacaagatcttcaccaaatccgtggacctgcagatgagcgggatctgcgccggctgcatcgactgcgcggaggggatctcctgcagcatcaacgccgacgtgtccgccgagaccgtctgccactgcaagacaaactgcgaggacttcatctccaacatcgtgatcagcccccagatcaagacctacaacatcaaggtgcactgcaagtcaaaggtcgagaagatcaccgccaacatctgcggccggaacatcgacctccagctgaccgtgaagccgtataaccagaagatcgacctgtcccagctcgacgagagcaactacatcaaggaggaggacctgcagtgcggcacgtggctgtgcaaggtgcagaaggaggggatcgacatcgtcttcaagggcctcttctccggtctgggcaagtactggaccatcctgatctatagcatcatcggcatcatcgtgatcgtgctcctgatctacgtcctgcttcccatcgggcgcctgctgaaggccttcctcatcaagaacgagatcgagtacaccatggagcagaagatcaagtga

SEQ ID NO: 15983 - RNA, 4263 nt, synthetic construct; identical to SEQ ID NO: 12697
  misc_feature 1..4263: note = derived and/or modified CDS sequence (opt11) from OROV(TVP-19254/GML-480914)__KP795082.1__GP
  source 1..4263: mol_type = other RNA

SEQ ID NO: 15984 - RNA, 4263 nt, synthetic construct; identical to SEQ ID NO: 12698
  misc_feature 1..4263: note = derived and/or modified CDS sequence (opt11) from OROV(TVP-19256/IQE-7894)__KP795085.1__GP
  source 1..4263: mol_type = other RNA

SEQ ID NO: 15985 - RNA, 4263 nt, synthetic construct; identical to SEQ ID NO: 12699
  misc_feature 1..4263: note = derived and/or modified CDS sequence (opt11) from OROV(TVP-19257/IQT-1690)__KP795088.1__GP
  source 1..4263: mol_type = other RNA

SEQ ID NO: 15986 - RNA, 4263 nt, synthetic construct; identical to SEQ ID NO: 12700
  misc_feature 1..4263: note = derived and/or modified CDS sequence (opt11) from OROV(TVP-19258/IQT-4083)__KP795091.1__GP
  source 1..4263: mol_type = other RNA

SEQ ID NO: 15987 - RNA, 4263 nt, synthetic construct; identical to SEQ ID NO: 12701
  misc_feature 1..4263: note = derived and/or modified CDS sequence (opt11) from OROV(TVP-19259/IQT-7085)__KP795094.1__GP
  source 1..4263: mol_type = other RNA

SEQ ID NO: 15988 - RNA, 4263 nt, synthetic construct; identical to SEQ ID NO: 12702
  misc_feature 1..4263: note = derived and/or modified CDS sequence (opt11) from OROV(TVP-19262/OBS-9478)__KP795100.1__GP
  source 1..4263: mol_type = other RNA

SEQ ID NO: 15989 - RNA, 4299 nt, synthetic construct; identical to SEQ ID NO: 12703
  misc_feature 1..4299: note = derived and/or modified CDS sequence (opt11) from OROV/FPV(Aus Ch 16129)__KF697137.1__GP
  source 1..4299: mol_type = other RNA

SEQ ID NO: 15990 - RNA, 4257 nt, synthetic construct; identical to SEQ ID NO: 12704
  misc_feature 1..4257: note = derived and/or modified CDS sequence (opt11) from OROV/IQTV(IQT9924)__KF697143.1__GP
  source 1..4257: mol_type = other RNA

SEQ ID NO: 15991 - RNA, 4257 nt, synthetic construct; identical to SEQ ID NO: 12705
  misc_feature 1..4257: note = derived and/or modified CDS sequence (opt11) from OROV/IQTV(MIS-0397)__KJ866387.1__GP
  source 1..4257: mol_type = other RNA

SEQ ID NO: 15992 - RNA, 4257 nt, synthetic construct; identical to SEQ ID NO: 12706
  misc_feature 1..4257: note = derived and/or modified CDS sequence (opt11) from OROV/MDDV(FMD 1303)__KF697145.1__GP
  source 1..4257: mol_type = other RNA

SEQ ID NO: 15993 - RNA, 4257 nt, synthetic construct; identical to SEQ ID NO: 12707
  misc_feature 1..4257: note = derived and/or modified CDS sequence (opt11) from OROV/MDDV(INHRR 17a-10)__KJ866390.1__GP
  source 1..4257: mol_type = other RNA

SEQ ID NO: 15994 - RNA, 4257 nt, synthetic construct; identical to SEQ ID NO: 12708
  misc_feature 1..4257: note = derived and/or modified CDS sequence (opt11) from OROV/Perdoes virus(BeAn789726)__KP691625.1__GP
  source 1..4257: mol_type = other RNA

SEQ ID NO: 15995 - RNA, 4257 nt, synthetic construct; identical to SEQ ID NO: 12709
  misc_feature 1..4257: note = derived and/or modified CDS sequence (opt11) from OROV/Perdoes virus(BeAn790177)__KP691628.1__GP
  source 1..4257: mol_type = other RNA

SEQ ID NO: 15996 - RNA, 4284 nt, synthetic construct; identical to SEQ ID NO: 12710
  misc_feature 1..4284: note = derived and/or modified CDS sequence (opt11) from OROV/UTIV(BeAn84785)__KF697155.1__GP
  source 1..4284: mol_type = other RNA

SEQ ID NO: 15997 - RNA, 3231 nt, synthetic construct
  misc_feature 1..3231: note = derived and/or modified CDS sequence (opt11) from HRTV(TN)__KJ740147.1__GP
  source 1..3231: mol_type = other RNA
atgatcgtcccaattgtactcttcctgaccctgtgtccgtccgaactgagtgcctggggcagccctggcgacccaatagtatgcggagtacggaccgaaaccaacaaatccatccaaatcgaatggaaggaaggccgcagcgaaaaactctgccagatagaccgacttgggcacgtcacttcatggctgagaaaccacagcagtttccagggcctcgtaggacaagtcaaaggaagacctagcgtctcttacttccccgaaggtgcgtcatatcccaggtggtcaggactcctcagcccctgtgatgcggaatggctaggcatgatcgccgtgagcaaagccggggacacagacatgatagtcccggggccaacctacaaggggaaaatcttcgtcgagcgccccacatacaacgggtacaaaggctggggctgcgccgacggaaagagtttgagccacagcggaacctactgcgaaacagattcttcagtatccagcggcctcatacagggcgacagagtcctctgggtgggagaagtagtgtgccaacgcggtacgccagtacctgaagacgtcttcagcgagctagtgtccttaagccaaagtgagttcccggacgtgtgcaaaatcgacggcgtcgcactaaaccagtgcgagcaagagtcgataccccagccgctcgacgtcgcatggatagacgtcgggcgctcacacaaggtcctcatgagagaacacaaaaccaagtgggtccaggaatcctccgcaaaagacttcgtatgcttcaaagtaggccagggcccatgctcaaaacaagaagaagacgactgcatgagcaaaggcaactgccatggagacgaagtgttttgccgcatggccgggtgctcagccaggatgcaagacaaccaagaaggctgccggtgcgagctactacagaagccaggagaaatcatagtaaactacgggggcgtcagcgtgcgcccaacctgctacgggttctcaagaatgatggcaaccctagaagtgcacaaacccgatcgagaattaacggggtgcacaggatgccacctcgaatgcatcgaaggaggagtcaaaatcgtaacactcacgagcgaactccgaagcgcgaccgtgtgcgctagccatttctgcgcgtcagctaaaggcggtagcaaaaccaccgatatcctcttccacacaggagctctagtaggacccaattccataagaataacaggacagctcttagacggatccaaattcagcttcgatggtcactgcatcttcccggacggatgcatggcacttgactgcacattctgcaaggagttcctaagaaacccacaatgttacccggtcaagaaatggctttttctagtagttgtaatcatgtgctgttactgcgccctaatgctgctgacaaacatactacgagcaatcggcgtgtggggaacatgggtctttgcaccaataaaactagctctagcgctaggcctaagactcgcaaaactgtcgaagaaaggactcgtggcggtggtcacccgagggcaaatgatcgtaaacgacgaactgcaccaaatccgagtcgaacgaggtgaacagaacgagggccgacaaggctacggtccgaggggcccaatacgacactggctctacagcccggcactcatcctcatcctgaccaccagcatatgctccgggtgcgacgagctagtacacgcagaatcaaaatccatcacctgtaaatcagccagcggtaacgaaaaagaatgctccgtcacaggccgggccttactcccagccgtaaacccaggccaggaggcatgcctccacttcagtatgcccggatccccggactcaaaatgcctcaaaataaaagttaaaagcataaacctacgatgcaaacaagcgtcgagttactacgtaccagaagcaaaagcgcggtgcaccagcgtacgcagatgccgatgggcaggggattgccagtccggttgcccgacatatttctcaagcaatagcttctcggacgactgggccaaccgcatggacagagctgggctcggaatgtcgggatgcagcgatggctgcggaggagccgcctgcggatgcttcaacgcggccccgagttgcatcttctggcggaaatgggtcgaaaacccgagcaatcgggtctggaaggtttcaccgtgcgcgtcgtgggtcctagccgccacaatagaactcaccttaccaagcggagaagtaaaaacccttgagccagtcaccggacaggcaacacagatgttcaaaggggtcgctataacctacctaggcagcagcatagaaatcgtagggatgacacggctgtgcgagatgaaggaaatgggaacaggcatcatggcactagcaccctgcaatgacccaggacacgccataatgggcaacgtcggagaaatccaatgtagctcgattgaaagcgcaaaacatatacgtagcgacggctgcatctggaatgcggacctagtcgggattgaactccgggtggacgatgcagtatgcttctcgaagctaacgtccgtcgaagcggtcgccaacttctcgaaaatacccgccacaatctccggggtcaggttcgatcaagggaaccacggagaaagccgaatatacggctcgccactagacatcacgcgtgtctcaggagagttcagcgtcagtttccgtggcatgagactgaaactcagtgaaatcagcgcatcttgcacaggcgaaataacgaacgtgagcgggtgctacagctgcatgacgggcgccagcgtcagcataaaactccactcatcaaagaacaccacgggacacctgaaatgcgactcagacgaaaccgcattctcggtcatggaaggcactcacacctaccgcccgcacatgagctttgacaaggccgtcatcgacgaagaatgcgtactcaactgcggtggccactcttcaaaattactactcaagggcagcctagtgttcatggacgtacccagattcgtcgacggctcctacgtacagacataccacagcaaagtacccgctggcggcagagtacccaacccagtagactggctaaacgcgcttttcggagacggaataaccagatggatactcgggataatcggagtgctcctcgcatgcgtaatgctattcgtcgtcgtcgtggcaataacccgccgcctaataaagggactaacgcaacgggcaaaagtagcatga

SEQ ID NO: 15998 - RNA, 3231 nt, synthetic construct
  misc_feature 1..3231: note = derived and/or modified CDS sequence (opt11) from HRTV(Patient2)__JX005844.1__GP
  source 1..3231: mol_type = other RNA
atgatagtcccaatcgtactatttctgaccttatgcccatccgaactatccgcatggggatcccccggcgacccaatcgtatgcggagtccgaaccgaaacaaacaaaagcatacaaatagaatggaaagaaggacgaagcgaaaagctctgccaaatagaccgattaggacacgtaaccagctggctacgaaaccattcctccttccaaggactcatcgggcaagtaaagggccgccccagcgtcagctacttccccgaaggcgcaagctacccccgatggagcggcctactcagtccgtgcgacgcagagtggctaggattaatagcagtaagcaaagccggtgacacagatatgatcgtcccaggccccacatacaaaggaaagatcttcgttgagagaccgacctacaacgggtataaaggatggggatgcgcggacggcaaaagcctatcccatagcggaacatactgcgaaaccgactccagcgtaagctccgggttaatccaaggcgacagagtgctatgggtaggagaagtcgtctgccagcgaggcacacccgtgcccgaggacgtcttctcagaactcgtaagcctatcacaaagcgaatttccagacgtatgcaaaatagacggggtggcgctaaaccaatgcgaacaagaaagtatcccgcagccgctagatgtcgcctggatcgacgtaggaagaagccacaaagtactaatgcgagagcacaaaactaagtgggtgcaggagtcatccgccaaagacttcgtttgtttcaaagtgggtcaaggcccatgttccaagcaagaagaagacgactgcatgagtaaaggcaactgccacggcgacgaagtcttctgcagaatggcagggtgcagtgcacgaatgcaagacaaccaagaaggctgccgatgcgaactcctacagaaaccgggcgaaataatcgtcaactacggtggagtatcagtacgacctacgtgctacggcttttcccgtatgatggcaacactcgaagtccacaaacctgatcgcgaactcacaggatgcacgggatgccacctagagtgtatagagggcggagtgaagatcgtcacactaacatcagaactccgcagcgcaacagtgtgcgcgtcacacttctgtgcatcggccaagggcggaagcaaaacaacggatatactattccacacaggcgccctagttggaccaaacagcatccgcatcacggggcaactcctcgacggctccaaattcagcttcgacgggcactgcatcttcccggacgggtgcatggcactcgattgtaccttctgcaaggagttcctaagaaacccgcaatgttaccccgtcaagaaatggctattcctcgtggtcgtaataatgtgctgctactgcgcactaatgctcctcaccaacatactgcgagcgatcggagtatggggaacctgggtcttcgccccaataaaactggcactagccctaggactgcgactggccaaactcagtaagaaaggactggtggcagtcgtaacaagaggacaaatgatcgtaaacgacgaactacaccaggtccgagtcgaacgcggggagcagaacgaaggacggcagggctacggcccaaggggaccgatccgccactggctgtactcaccggcactaattctgatcttaacaacgagcatctgctcgggatgcgacgaactcgttcacgcggaaagcaaaagcataacatgcaaatccgccagcgggaacgagaaagaatgcagcgtgacaggtagagccctactaccagccgtaaacccagggcaagaagcctgcctacacttctcagtacccgggagccccgactcaaaatgcctcaaaataaaagtcaaaagcataaacctcagatgtaaacaggccagctcttactacgtacccgaagcaaaagccagatgtacgtcagtcagacgatgccgctgggcaggagattgccaatcagggtgcccaacctacttctcgagcaactctttcagcgatgactgggcaaatcgaatggacagggccggcctcggcatgagcggctgttcggatggctgcggcggggccgcatgcggttgcttcaacgcagccccaagctgcatcttctggcggaagtgggtcgagaaccccagcaacagagtatggaaggtctcaccttgcgcatcctgggtccttgcagccacaatagaactgacactaccctcaggtgaagtcaaaaccctcgaacctgtgacaggccaagcgacccaaatgttcaaaggcgtagccataacctacttgggcagctccatagaaatcgtcggcatgacaagactgtgcgaaatgaaagagatgggaacgggaatcatggccctcgctccttgcaacgacccaggacacgcaataatgggtaacgttggagaaatacaatgctccagcatcgaaagcgcgaagcacatacgctcagacggatgcatatggaacgccgacctagtcggcatagaactacgagtcgacgacgcagtctgcttcagcaaattgacatcagtcgaagcggtggccaacttttcaaaaatcccagcgacaatctccggagtccgcttcgaccaaggaaatcacggcgaaagccgtatatacggcagcccattggacatcacaagggtaagcggcgagttctcggtgagcttcagaggaatgcggttgaaactcagcgaaatatccgcctcatgcaccggcgaaatcacaaacgtcagcggttgctactcctgcatgacgggcgcaagcgtatcaatcaaattacacagctctaagaacacaacgggacacctaaaatgcgactcagacgaaaccgctttctccgtaatggaagggacccacacatatcgcccccacatgagctttgacaaggccgtcatcgacgaagaatgcgtactcaactgcggaggacactcgagcaaactcctcctgaagggcagcctcgttttcatggacgtcccacgcttcgtcgacggcagctacgtgcagacataccacagcaaggtgccagcgggcggcagagtaccgaaccctgtcgactggctaaacgccctcttcggggacggaatcacacgatggatcctagggattataggcgtactactggcgtgcgtgatgttattcgtggtcgtagtagccataaccagaagactaatcaaaggcctaactcaacgcgcgaaagtagcctaa

SEQ ID NO: 15999 - RNA, 3231 nt, synthetic construct
  misc_feature 1..3231: note = derived and/or modified CDS sequence (opt11) from HRTV(Patient1)__JX005845.1__GP
  source 1..3231: mol_type = other RNA
atgatagcacccgttgtgctgtttttcaccctgtgcccatctcaactatcagcctggggctcccccggggacccaatcgtgtgtggcgtcagaaccgagaccaataagtccatacaaatagaatggaaagaaggacgctcggaaaaactctgccaaatagacagactcggacatgtcacctcgtggctgcggaaccactcctccttccagggcctcataggacaggtaaaaggccgaccctcagtctcgtatttccccgaaggagcgtcctaccccaggtggagcggcttgctctccccctgcgacgcggaatggctcggcctaatagcagtaagcaaggccggcgacacagacatgatcgtgccaggcccaacatacaaaggaaagatcttcgtcgaacgtcccacatacaacggctacaagggatggggatgcgcggacgggaaaagcctatcacacagcggcacatactgtgaaaccgacagctcggtctcaagcggcctcatccaaggagacagggtactatgggtcggagaagtagtatgccaaagaggaaccccggtcccggaagatgtgttcagcgaactcataagcctgagccaaagcgagttcccagacgtatgcaaggtcgatggagtcgccctaaaccagtgcgaacaagaaagtataccgcaaccattagacgtcgcatggattgacgtaggaagaagtcacaaagtactcatgcgagaacataaaacaaaatgggtacaagagtcaagtgcaaaggacttcgtgtgcttcaaagtaggccaaggaccatgcagcaaacaagaagaagacgactgcatgagcaaaggaaactgccacggagacgaagtgttctgccgcatggcaggatgctcagccagaatgcaagacaaccaagaaggctgccgctgcgaactattacaaaaacccggagaaatcatagtcaactacggaggagtcagtgtacgcccaacctgctacggattctcaagaatgatggccaccctagaagtgcacaaacccgatcgcgagctcactgggtgcaccggctgccacctcgagtgcattgaaggcggtgtaaaaatagtcaccctgaccagcgaactaagaagcgccacagtctgcgctagccacttctgtgcatcagcaaaaggtggcagcaaaacaaccgacatactctttcacacgggcgcactcgtaggtcccaaatcaatacgcataacgggccaactgttagacggctccaaattctcattcgacggccactgcatattcccagacggatgcatggcgctcgactgcaccttttgcaaagagtttcttagaaacccacaatgctacccagtcaaaaagtggctattcctcgtagtagtagtaatgtgctgctactgcgcactcatgctgctaacgaacatcctgagagcaataggcgtatggggcacgtgggtatttgctcccatcaagctagtactggcgctcggccttagattggcaaaactcagcaagaaaggacttgtcgccgtggtcacccgagggcaaatgatcgtgaatgacgagctacaccaaatacgcgtcgaacgaggggaacagaatgaagggagactcgggcacgggccaaggggcccggtaagacactggctgtattcgccagccctcatactaatactgacgacgagcatatgcagcggctgcgacgaactcgtacacgcagaatcgaaaagtataacgtgcaagagcgccagcggaaacgaaaaagaatgcagcgtcactggcagagccctccttccagccgtgaacccgggacaagaggcttgcctacacttcagcatgccaggatccccggacagcaaatgcctcaaaatcaaggtcaaaagcataaacctacgttgcaaacaagcctcaagctactacgtgccagaagcaaaagcaagatgcaccagcgtgcgaagatgtagatgggccggcgactgccaaagcggctgcccaacctacttctcctccaacagcttctccgacgactgggccaatcggatggaccgagcaggcttaggaatgtcgggctgtagtgacgggtgcggcggcgcagcatgcggctgcttcaacgcagccccctcatgtatcttttggagaaaatgggtagaaaaccccagcaaccgcgtatggaaagtaagcccatgcgcaagctgggtactagcagcaatcatagaactcactctacctagcggggaagtaaaaaccctcgaacccgtgaccggccaagcaacccaaatgtttaagggcgtcgccatcacgtacctaggaagcagcatagagatagtcggtatgacgagactctgcgaaatgaaggaaatgggcacaggaataatggcgctcgccccatgcaacgaccccggacacgccatcatgggaaacgtgggcgaaatacaatgcagctcaattgagtccgccaaacacattagatcggacgggtgcatatggaacgcggatttagtgggaatcgaactaagagtggacgacgcggtatgcttctcgaaactaacgtcagtagaagcagtggctaacttctccaagatacccgcaatcataagcggggtaaggttcgaccaaggcaatcacggcgaatcgaggatctacgggagtccgctcgatatcacgaaagtgagtggagagttcagcgtaagtttccgagggatgcgactgaagctgtcagaaataagcgcgtcctgcacgggagaaatcacgaacgtaagcgggtgctacagctgcatgacaggggcaagtgtgagcatcaaactccactcaagtaaaaacacgaccggacatttaaaatgcgacagtgacgaaacagcattctcagtcatggaaggcacacacacctacagaccacacatgagcttcgacaaggcggtagttgacgaagaatgcgtcctgaactgcgggggccacagctcaaaacttctattaaaagggagcctagtattcatggacgtacctcgcttcgtagacggatcatatgtccaaacatatcatagtaaggtcccagccggcggaagggtcccaaacccggtcgactggctaaacgcactcttcggagacggaatcacaaggtggatactcggaatcatcggagtcctattggcctgcgtactcctgttcgtcgtcgtagtagcaataacgcgccgacttatcaaaggcctcacacaacgagcaaaagtagcctag

SEQ ID NO: 16000 - RNA, 3942 nt, synthetic construct
  misc_feature 1..3942: note = derived and/or modified CDS sequence (opt11) from PTV(PAN472868)__NC_027201.1__GP
  source 1..3942: mol_type = other RNA
atgatcttcaccatcctgaacgtgctcacccgcgccatgctggtcatgagcatgtactccctgacgacctgggacagcacctcccggaacgacatgtgcttcagcaacgacagccccctcgagggcctggtgtactactgggagacccacagcaagaagcatgattataagaagcaggagtcccagcgctgccgggtgggggacagcgataagaagatgatcacgaatgtcaccatcatctccctgatcagcgagatccaaaagtccatcagcgagctctccctgagctgcggcaacgacgacaactccaccggccaggtgctgaccttcaacgggctcgaggacacgatccagggggactacatcgtggactgcgtcaccggcctgtaccagagcgacatcggcgtgggggtgggcctggggaagacccaccacgaccaccagcaggtcaagaacaaagccgtggtcatcgacgagaaggagcgcatgatcagtttcctcgaaacccagcagagcgagaacgacatcaagatgcaggtcctgatgtccgagatcgagcagctgaagaaccagctcagcaagaagcggaacgagcgcggccaggagaagcgggacgcggagaaggtgatgagcgacctgatggcccgtaactccgacctgcggaagcacaacgacatcctcacggccgagatcagccagatggagaacaataacaccatccagcgcaacaagaacgtgatgtccaccaccgtcgtgccggccatcctgagcgtggccctgctctcctcttccatcgcgcccatcatggccgccagccccgactcccccatgatcaacccgtggccccacgccaagaaccgggtcgggacgggcatgtacaagtacgacgagaacgacgacagcggctgccgccccatccggtacggagtgtcctgcatcggcttcgacttcatgctgaagatggacaagtaccccttcttcaacgcgttcatcgggcacaaaaccccactggagagcttcgccgacaagatcatcgaaaaggaggaggaaacctgcgagatcggcaccaacaaggagttcaagtgcttcgaggagcgcgcctacatcaagggtacgtgccccaccaacatcaacgccgtgcactacatcgacaacaaggggaagctccggtacgtcaagtgtaaggagaacctggagatgaccgaggactgcgccttttgccgcaagatcaagaagaaggcgggccagtccatccaggtgcagaaaaccagcgtgcccctgcaggacgccatctgccaggagaactccgacacgtacagcgggcccaagatcccgttcaagggcgtctgcaagatagggctcatcaagtacaaggagtgcaagttcaagaccagtagctacgagaccgtgtccttcatcaccctgaaggagaagggcaagatctatattgagcacctgatgctcaagaacatcgaggtcgtgacgaacgtgagcttcgtctgctacgagcacgccggccaggacgagcaggaggtggagcaccgggccctgaagcgcgtgagcgtcaacgactgcaagatcgtggacaactccaagcagaagatctgcaccggggaccacatcttctgcgagaagtacgactgcagcacctcctaccccgacgtgacctgcatccatgcccccggcagcgggcccctgtacatcaacctcatgggctcctggatcaagccgcagtgcgtcgggtacgagcgggtgctggtggaccgcgaggtcaagcagcccctgctcgcgcccgagcagaactgcgacacgtgcgtgagcgagtgcctggacgagggcgtgcacattaagtccaccggcttcgagatcaccagcgccgtcgcctgctcccacgggtcgtgcatctccgcccaccaggaggccagcacatccgtgatcgtcccctacccgggcctgctcgcgagcgtcgggggccggatcgggatacacctgtcccacacgagcgactccgccagcgtgcacatggtggtcgtgtgcccgccccgcgacagctgcgccgcccataattgcctgctctgctaccacggcatactgaactaccagtgccactccacgctgagcgccatcctcacctccttcctgctgatcctcttcatctacaccgtgttcagcgtcaccacgaacatgctgtacgtactgcgcctgatccccaagcagctcaagagtcccgtgggctggctacggctgttcatcaattggctcctgaccgcgctgcgcatcaagacccgcaacgtcatggggcgcatcaaccagcggatcggctgggtggaccaccacgacgtggagcgcccccggcacagagagcccatgcggcgcttcaagaccacgctcctgcttaccctcatcatgatgaccgggggcaacgcctgcagcaacaccgtcgtagccaattccaagcagacgcggtgcgtgcaggagggcagctccaccaagtgtagcatcacggccaccatcacgctgcgcgcgggggtcatcggcgccgagtcctgcttcatcatcaaggggcccatggagaaccagcagaagaccatctcgatcaagaccatcagcagcgagaccgtgtgtcgggagggctccagcttctggacgtccctgtacattccgagctgcctctcgagccgccggtgtcacctggtcggagactgcgtcggcaacaagtgccagagctggcgcgacgaccagctgtcccgggagttcagcggcgtgaaggacaaccacatcatgaacgagaacaagtgcttcgaacagtgcggggccatcggctgcgggtgcttcaacatcaacccatcctgcctctacgtgcacgcctacctgaagtcggcccgcaacgaggcggtccgggtgttctcctgcagcgactgggtgcaccgcgtctccttcgaagtgaagggccccgacggggagaccgagctggtgaccttaggcagcctgggcaccaagttcctgaactgggggacgctctcactgagcctggacgccgagggcatctccgggaccaacagcatctccttcctcgagagctccaagggcgggttcgccctgtacgacgagggctacagcgagatcccgagagagggtttccttggggagatccggtgctccagcgagtccgccgccatcagcgcgcacaagagctgcatccgcgcccccggactcatcaagtacaagcccatgaccgatcagatcgaatgcacagcctccctagtcgaccccttcgccatcttcctgaaggggagcctcccgcagacgcggaacggccagaccttcacgtccaccaaggacaagaagacggtgcaagccttcaccaacggggcgatcaaggccctgctgagcatcaacctcgacgaccacgagatcgtgttcatcaacaaggtccgctcctgtgacgccaccttcctgaacgtgagcggctgctactcctgcgactacggcgcccacgtgtgcgtcaaagtcaagagcagtgagagcgcggacttcttcgccgagtccgaggacaagaccacggtgctgagcttccccatccagagtgggacccacgactattgccaggtgctacacttccagaagcccctggtggacgagcggctgagctactcctgcggtagcgagcccaagctcatcgtcatcaaggggacactggtgtacatgggcgtgtacgacttccgcaataagacaggcgggtccagcacggtcgtgaacccgtccgagggcgcttggagcatcagcaactggttctccgggctgctcgactggctgggcgggcccatgaaggccatcctgaagatcctcggcttcatcgccatcggcatcgtgtgtttcatcctgttcatgatcctgatccggatcgcggtcaatagcataaacatcaagaagaagaactag

SEQ ID NO: 16001 - RNA, 3942 nt, synthetic construct
  misc_feature 1..3942: note = derived and/or modified CDS sequence (opt11) from PTV(Adames)__KR912209.1__GP
  source 1..3942: mol_type = other RNA
atgatcttcaccatcctgaacgtgctcacccgcgcgatgctggtcatgagcatgtactccctgacgacctgggactcatccagccggaacgacatctgcttctccaacgacagtcccctcgagggcctggtgtactactgggagacccactccaagaagcacgactacaagaagcaggggagccagaagtgccgcgtgggcgactccgacaagaagatgataagcaacgtcaccatcatctccctgatcagcgagatccagaagtccatcagcgagctctccctgagctgcgggaacaacgacaactccacaggccaggtgctgaccttcaacgggctcgaggacaccatccggggcgactacatcgtggactgcgtcaccggcctgtaccagagcgacatcggggtgggcgtggggctgggccgcataaaccacgaccaccagcaggttaagaacaaggccgtcgtgattgacgagaaggagaaaatgatctccctcctggagacgcagcagagcgagaacgacatcaagacccaggtcctgatgagcgagatcgagcagctcaaaaaccagctgtccaagcggcgcaacgagcgggggcaggagaaacgcgacgcggagaagctgatgagcgacctcatggcccggaactccgacctgcgcaaccacaacgtgatcctgaccgacgagatctcccagatcaagaacaacatcaccatccaccggaaccgcaacatgatgagcacgaccgtggtcccggccatcctcagcgtggccctgctgtccagctccgtgggccccatcactgccgcgccgcccgacagcaccatgatcaacccctggccccacgccaagaaccgggtcggcacagggatgtacaagtacgacgagaacgacgagtccggctgccgccccatccggtacggggtgagctgcatcggcttcgacttcatgctcaagatggacaagtaccccttcttcaacgctttcatcggccacaagaccccgcttgagtccttcgccgataagatcatcgagaaggaggaggaaacctgcgagatcgggaccaacaaggagttcaagtgcttcgaggagcgcgcgtacatcaagggcacgtgccccaccaacatcaacgccgtgcactacatcgacaacaaggggaagctgagatacgtcaagtgcaaggagaacctcgagatgaccgaggactgcgccttttgccgcaagatcaagaagaaggccggccagagcgtccaggtgcagaagacctccgtgcccctgcaggacgccatctgccaggagaacagcgacatctactccgggcccaagattccgttcaagggcgtgtgcaagatcggcctgatcaagtacaaggaatgcaagttcaagacgagctcctacgagaccatctcgttcatcaccctcaaggggaagggcaagatctacatcgagcacctgatgctaaagaacatcgaggttgttaccaacgtgagcttcgtctgctacgagcacgcggggcaggacgagcaggaggtggagcaccgggccctcaagcgcgtgtccgtcaacgactgcaagatcgtcgacaacagcaagcagaagatctgcacgggcgaccacatcttctgcgagaagtacgactgctccaccagctaccccgacgtgacctgcatccacacccccgggtccggccccctgtacatcaacctgatgggcagctggatcaagccgcagtgcgtcgggtatgagcgggtgctcgtggaccgcgaggtcaagcagcccctgctggtgcccgagcagaactgcgacacgtgcgtgtccgagtgcctcgacgagggcgtccacatcaagagcaccgggttcgaaatcacctccgccgtggcctgcagccacggctcctgcatcagcgcccaccaggaagcgtcaacaagcgtgatcatcccctacccggggctgctggcctccgtcggcggccgaatcgggatccacctcagccacacgtccgacagcgccagcgtgcacatggtggtcgtgtgcccgccccgggactcttgcgcagcccacaactgcctgctgtgctaccacggcatcctcaactaccagtgccacagcaccttgtccgcgatcctgaccagcttcctcctgatcctgttcatctacaccgccttctccgtgaccacgaacgtcctgtacgtgctccgcctgatccccaagcagcttaagagccccgtggggtggctgaagctgtttgtcaactggctgctcaccgccctgcggatcaagaccaggcgggtgatgggccgcatcaaccagcggatcggatgggtcgaccaccacgacgtcgagcgccctcggcaccgcgagcccatgcggcgcttcaagaccacgctgctcctgaccctgatcatggtgaccgggggcaacgcctgctccaacaccgtggtcgccaacagcaagcagacgcggtgcgtgcaggagggttccaacaccaagtgcagcatcaccgcgaccatcacgctccgcgccggcgtcatcggggccgagtcctgcttcatcataaagggccccatggagaaccagcagaagaccatcagcatcaagaccatctccagcgagaccgtctgccgtgagggctccagcttctggacgtccctgtacatcccgagctgcctgtccagccgtcggtgccacctcgtgggggactgcgtgggcaacaagtgccagagctggcgcgacgaccagctgtcccgggagttcagcggggtcaaggacaaccatatcatgaatgagaacaagtgcttcgagcagtgcggcgccatcgggtgcggctgcttcaacatcaacccctcctgcctgtacgtgcacgcgtacctcaagagcgcccgcaacgaggccgtgcgcgtcttctcctgcagcgactgggtgcaccgggtgtccttcgaggtcaagggccccgacggggaaatggagctggtgaccctgggcagcctggggaccaagttcctgaactggggcaccctgtccctcagcctggacgccgaggggatctccggcacgaacagcatctccttcctggagagctccaagggcgggttcgccctctacgacgagggctacagcgagatcccgcgcgaagggttcctaggcgagatccggtgctcctctgagtccgcggccatcagcgcccacaagagctgcatccgcgccccggggctgatcaagtacaagcccatgaccgaccagatcgagtgcaccgcctccctcgtggaccccttcgcgatcttcctgaagggtagcctgccgcagacccggaacggccagacgttcacctccaccaaggacaagaagaccgtccaggccttcacgaacggagccatcaaggcccttctgagcatcaacctggacgaccacgagatcatcttcatcaataaggtgaagtcctgcgacgccaccttcctcaacgtgtctggctgctactcctgcgactacggggcgcacgtctgcgtcaaagtcaaaagctccgagagcgccgacttctttgccgagtccgaggacaagacgaccgtgctgagcttccccatccagtccggcacccgcgactactgccaggtgctgcacttccagaagcccctcgtcgacgagcggctgagctactcctgcggcagcgagcccaagctgatcgtgatcaagggcaccctggtgtacatgggcgtctacgacttccgcgacaagaccgggggctccagcaccgtgatcaacccgtccgaggggacgtggtcaatctctaactggttctccggcctgctggactggctcggcgggcccatgaaggccatccttaagatcctgggcttcatcgcgatcggcatcgtgtgcttcatcctcttcatgatcctgatccggatcgccgtcaacagcatcaacatcaagaagaagaactga

SEQ ID NO: 16002 - RNA, 3942 nt, synthetic construct
  misc_feature 1..3942: note = derived and/or modified CDS sequence (opt11) from PTV(Balliet)__KR912213.1__GP
  source 1..3942: mol_type = other RNA
atgatcttcaccatccttaacgttctcaccagggccatgctcgttatgagcatgtactccctgacgacctgggacagcacctcccggaacgacatgtgcttcagtaacgactcgcccctcgagggcctggtttactactgggagacccacagcaagaagcatgactacaagaagcaggagtcccagcgctgccgggtgggggacagcgacaagaagatgatcacgaacgtcaccatcatctccctgattagcgagatccagaagtccatcagcgagctctccctgagctgcggcaacgacgacaactccaccggccaggtgttgaccttcaacgggctcgaggacactatcaggggcgactatatcgtggactgcgtcacgggcttgtaccagtccgatattggtgtgggggtgggcctgggccgtacccaccacggccatcaacagatgaagaacaaggccgtcgtgatcgacgagaaggagcgaatgatctccctcctggaaacccagcagtctgaaaacgacatcaagatgcaggtactgatgtcagaaatcgaacagctcaagaaccagctgagcaagaagagaaacgaacgcggtcaggagaagcgggacgcggagaaggttatgagcgatctgatggcacgcaacagcgacctccgtaagcacaacgacatactgacggcagagatctctcagatgaagaacaagaacaccatccagcgcaacaagaacaccgtgtccaccaccgtagtcccggccatcctgagcgtggccctgctgtccagctccgtggcgccaatcatagccgccccgcccgacagccccatgatcaacccctggccccacgccaaaaaccgtgtcggcactggcatgtataagtacgacgagaacgacgactccgggtgtcgccccatccggtacggcgtgagctgcatcgggtttgacttcatgctgaaaatggacaagtacccgttcttcaacgcgttcatcggccacaagacgcccttggagtccttcgccgataaaatcatcgagaaggaggaggagacctgcgagatcggcaccaacaaggagttcaagtgcttcgaggagcgcgcctacatcaaggggacctgccccaccaatatcaatgccgtgcactatatcgacaacaagggcaagctgcggtacgtcaagtgcaaggagaacctggagatgaccgaggattgcgccttctgccgcaagatcaagaagaaggcggggcagagcgtccaggtgcagaagacgtccgtgcccctccaggacgccatttgtcaggagaacagcgacacctactcgggcccgaagatccccttcaagggggtgtgcaagatcggcctgatcaaatacaaggagtgcaagttcaagaccagctcctatgagaccgtcagcttcatcacgctaaaggagaagggcaagatctacatcgagcacctcatgctgaagaatatcgaggtggtgaccaacgtctcctttgtgtgctacgagcacgtcgggcaggacgaacaggaggtcgagcaccgggccctgaaacgcgtaagcgtgaacgactgcaagatcgtcgataacagcaaacagaagatctgcaccggggaccatgtgttctgcgagaagtacgactgcagtaccagctaccccgacgtgacgtgcatccacgcgcccgggtccggcccgctctacatcaacctgatggggagctggatcaagccccagtgcgtcggttacgaacgggtgctggtggaccgcgaggtcaagcagccattgctggcccccgaacagaactgcgatacctgcgtatccgagtgcctggacgagggcgtgcacatcaagtcaacagggttcgagatcacctccgcggtcgcctgcagccacggatcatgcatcagcgcccaccaggagccgtcgaccagcgtaatcgtgccctaccccgggcttctggcctccgtaggcgggcgcatcggtatacacctgagccacacctccgacagcgctagcgtgcacatggtggtcgtgtgcccgccccgggacagctgcgcggcccacaattgcctcctgtgctaccacggcatcctgaactaccagtgccacagcaccctcagtgccatcctgaccagcttcttattaatcctgttcatttacaccgtgttcagtgtcacgaccaacatcctgtacgtgctgaggctcattcccaagcagcttaagtcacccgtgggatggctgaagctgttcatcaactggctgctgaccgccctccggataaagacccgcaacgtcatgcggcgcatcaatcagcgtatcgggtgggtcgaccaccacgacgtggaacgcccccggcaccgagagccaatgagacgcttcaagacgaccctgctgctcaccttaatcatgatgacagggggcaacgcctgctccaacacggtcgtggccaacagcaagcagacccggtgcgtgcaggagggcagcaacaccaagtgcagcatcaccgccacgatcaccctgcgcgccggggtcattggcgccgagtcctgcttcatcataaaggggcccatggagaaccaacagaagaccatctcaatcaagaccatctctagcgaaacagtgtgccgcgagggctccagcttctggacctccctctacatccccagctgcctgtcctcccgccggtgccacctggtgggggactgcgtcggcaacaagtgtcagtcctggcgcgacgaccagctctcgcgagagttcagcggtgtgaaggacaatcacattatgaatgagaacaagtgcttcgaacagtgcggggccatcggatgtgggtgcttcaacatcaacccgtcctgcctgtacgtgcatgcctacctcaagtccgcccgcaacgaggccgtccgcgtgttctcctgcagcgactgggtccaccgggtctccttcgaggtgaagggccccgacggggagacagaactcgtgaccctaggttctctgggcacgaagttcctcaactgggggacgctgtccttgagccttgacgccgagggcatctccggcaccaacagcatctccttcctggagagctctaagggtgggttcgcgctgtacgacgagggctacaacgagatacccagagagggcttcctaggagagatccggtgcagctccgagtcagcggccatctccgcccacaagagctgcatccgcgcccccggcctgatcaagtacaagcccatgacagaccagatcgagtgtacggcgtccctggtcgatcccttcgccatcttccttaaggggagcctgccgcagacccgtaacggacagaccttcaccagcacgaaggacaagaagaccgtccaggcgttcaccaacggagccatcaaggcactgctttccatcaacctggacgatcatgagatcgtgttcatcaacaaggtcaagaactgtgacgcgaccttcctgaacgtgagcggttgctactcctgcgactacggcgcccacgtctgcgtgaaggttaagagctccgagtcagccgacttcttcgccgagtccgaggacaagacgacggtcctctccttccccatccaatctggaacccacgactactgccaggtgcttcacttccagaaaccgctggtggacgagcgcctcagctactcctgcggcagcgagcccaaacttatcgtcatcaaggggaccctggtgtatatgggcgtatacgattttcggaacaagacgggcggctcgagcaccgtcgtgaatccctcagagggagcctggagcatcagtaactggttcagcgggctcctggattggctgggcgggcccatgaaggccatcctcaagatcctaggcttcatcgccattggcatcgtgtgcttcgtgcttttcatgatactcatcaggatcgccgtaaactccataaacatcaagaagaagaactga

SEQ ID NO: 16003 - RNA, 3942 nt, synthetic construct; identical to SEQ ID NO: 12717
  misc_feature 1..3942: note = derived and/or modified CDS sequence (opt11) from PTV(PaAR2381)__KP272005.1__GP
  source 1..3942: mol_type = other RNA

SEQ ID NO: 16004 - RNA, 3942 nt, synthetic construct; identical to SEQ ID NO: 12718
  misc_feature 1..3942: note = derived and/or modified CDS sequence (opt11) from PTV(PAN483391)__KP272008.1__GP
  source 1..3942: mol_type = other RNA

SEQ ID NO: 16005 - RNA, 3942 nt, synthetic construct
  misc_feature 1..3942: note = derived and/or modified CDS sequence (opt11) from PTV(GML902876)__KP272011.1__GP
  source 1..3942: mol_type = other RNA
atgatatttaccatcctgaacgtgctcacccgcgccatgctggttatgagcatgtactccctgacgacctgggatagcacctcccggaacgacatgtgcttctctaacgacagccccctcgagggcctggtgtattactgggagacccacagcaagaagcacgactacaaaaagcaggagtcccagaagtgccgcgtcggggacagcgacaagaaaatgatctccaacgtcacgatcatcagcctgatttccgagattcagaagtccatctccgagctcagcctgtcttgcggcaacgacgacaacagcaccggccaggtgctgaccttcaacggcctcgaggataccatccgcggggactacatcgtggactgcgttacaggcttgtaccagtccgacatcggcgtaggggtgggcctggggcggactcaccacgaccaccaccaggtcaagaacaaggccgtggtcatcgatgagaaggaacggatgatcagccttctggagacccaacagtccgaaaatgacattaagatgcaggtcctgatgagcgagatcgaacaactcaagaaccagctgagccgcaagcggaacgagcgcggccaggagaagcgggacgcggagaaagtgatgtccgacctgatggcccgcaacagcgacctccggaaacacaacgacatcctgaccgcggaaatctcccagatggagaacaacaatactatccagcgcaacaagaacgtgatgagcaccaccgtcgtgccggccatcctgtccgtggccctcctgagctccagcatcgcgcccatcatggccgcctcccccgacagtcccatgattaacccctggccccacgccaagaacagggtcggcaccggcatgtacaagtacgacgagaacgacgactccggatgccgccccatccggtacggggttagctgcatcggcttcgacttcatgctgaagatggacaaataccccttcttcaacgcgttcatcgggcacaagacgccgctcgagtccttcgccgacaagatcatcgagaaggaggaggagacctgcgagatcggcaccaacaaggagttcaagtgcttcgaggagcgcgcctacatcaaggggacctgccccacgaacatcaacgccgtgcactacatcgacaacaaggggaagctgcggtacgtcaagtgcaaagagaacctggaaatgacagaggactgcgcattctgccgcaagatcaagaagaaggcgggccagagcatccaggtgcagaagacctccgtgcccctccaggacgccatctgccaggagaactcggacacctacagcgggcccaagatcccgttcaagggcgtctgcaaaatcgggctgatcaagtacaaggagtgcaaattcaagacgagctcctacgaaactgtgagcttcatcaccctgaaggagaagggcaagatctacatcgagcacctcatgttgaagaacatcgaggtcgttaccaacgtgagcttcgtctgctacgagcacgccggccaggatgagcaggaggtggagcaccgggccctgaagcgcgtgtccgtcaacgactgcaagatcgtcgataacagcaagcagaagatctgcacgggcgaccacatcttctgcgagaagtatgactgctccactagctaccccgacgtgacctgcatccacgcccccggctccgggcccctctacatcaacctgatgggcagctggatcaaaccacagtgcgtcgggtacgagcgggtgctggtggaccgtgaagttaagcagcccctcctagcgcccgagcagaactgcgacacgtgcgtatccgaatgcctggacgagggcgtgcacatcaagagcacaggcttcgagatcacctccgccgtcgcctgcagccacgggtcctgtatcagcgcccaccaggaggcctccaccagcgtgatcgtgccctacccgggcctcctggcgtccgtcgggggccgcatcgggatccatctgagccacacgtccgacagcgctagcgtccacatggtcgtcgtctgtccgccccgggactcctgcgccgcccacaactgcctcttgtgttaccatggcattctgaactaccagtgccacagcacgctctccgccatcctgaccagctttctgctcattctgttcatctacaccgtgttctccgtcacgaccaacatgctgtacgtgctgagactcattcccaaacagctcaaaagcccggtgggctggcttcggctgttcatcaactggctgctgacggcgctccgcatcaagacccgtaacgtcatggggcgcatcaaccagcggatcggctgggtggaccaccacgacgtggagcgcccccggcaccgcgaacccatgcggcgcttcaagaccacccttcttctaacgctgatcatgatgaccgggggcaacgcttgcagcaacaccgtcgtggctaacagcaagcagacccggtgcgtgcaggagggctccagcacgaagtgctccatcaccgccaccatcaccctgcgcgcgggggtgatcggcgccgagtcttgtttcatcatcaaggggcccatggagaaccagcagaagacgatttccatcaagaccatcagctctgagacagtgtgccgggaggggagcagtttctggacgtcgctctatatcccgtcctgcctgagcagccgccggtgccacctggtgggcgactgcgtcggcaacaagtgccagagctggcgcgacgaccagctgagccgggagttctccggcgtgaaggacaaccacatcatgaacgagaacaagtgcttcgagcagtgcggggccatcggctgcgggtgcttcaacatcaaccccagctgcctgtatgtacatgcctacctgaagtccgcccgcaacgaggcggtccgcgtgttcagctgctccgactgggtgcaccgggttagcttcgaggtgaagggccccgacggcgaaacggagctcgtggcactgggctccctgggcaccaagttcctcaactgggggaccctgtctctgtcgctcgacgccgagggcatctcggggacgaactccatcagcttcctggagtcctcaaagggcgggttcgccctttacgacgagggctactccgagatccctcgcgagggcttcctcggggagatccggtgcagctccgagagcgccgcgatcagcgcccacaagtcctgtattcgcgcccccggcctgatcaagtacaagcccatgacggaccagatcgagtgcaccgcctccctggtagatcccttcgctatcttcctcaaggggtccttaccgcagaccaggaacggccagaccttcacgagcaccaaggacaaaaagaccgtgcaggcgttcaccaacggggccatcaaggcgctgctctccatcaacctggacgaccacgaaatcgtgttcatcaacaaggtcaagagctgcgacgccacgttcctcaacgtgtccggctgctacagctgcgactacggcgcgcacgtgtgtgtcaaggtgaagtccagcgaatccgccgacttctttgccgagagcgaggacaagaccaccgtcctttccttccccatccagagcggtacccacgactactgccaggtgctgcacttccagaagcccctggtggatgagcgcctctcctatagctgcggctccgagcccaagctgatagtcatcaaggggacgctggtgtacatgggcgtgtacgacttccggaacaagaccggcgggagctccaccgtcgtgaacccgagcgagggcgcctggagcatctccaactggttcagtgggctcctggactggctgggcgggccaatgaaggccatcctcaagatcctgggcttcatcgcgatcggcatcgtgtgcttcatcctgttcatgatcatgatccgcatcgccgtcaactccatcaacatcaagaagaagaactga

SEQ ID NO: 16006 - RNA, 3942 nt, synthetic construct; identical to SEQ ID NO: 12720
  misc_feature 1..3942: note = derived and/or modified CDS sequence (opt11) from PTV(PAN479603)__KP272014.1__GP
  source 1..3942: mol_type = other RNA

SEQ ID NO: 16007 - RNA, 3942 nt, synthetic construct
  misc_feature 1..3942: note = derived and/or modified CDS sequence (opt11) from PTV(PAN478718)__KP272017.1__GP
  source 1..3942: mol_type = other RNA
atgatcttcaccatcctgaacgtgctcacccgcgccatgctggtcatgagcatgtactccctgacgacctgggatagctccagccggaacgacatgtgcttttccaacgacagccccctcgagggcctggtgtattactgggagacccattccaagaagcacgactacaagaagcaggagagccagcgctgccgggtgggggactccgacaagaagatgatcacaaacgttacgatcatcagcctgatcagcgagatccagaagtcaatcagcgagctcagcctgtcctgcggcaacgacgacaacagcaccggccaagtgctgaccttcaacggcctcgaggacaccatccgcggggactacatcgtggactgcgtcacggggctgtaccagtccgacatcggcgtgggggtcggcctggggcggacccaccacgaccaccaacaggtgaagaacaaggccgtggtgatcgacgagaaggagcgcatgatcagcctcctggagacccagcagtccgagaacgacatcaagatgcaggttctgatgagcgaaatcgagcagctcaagaaccagctgagcaagaagcggaacgaacgcggccaggagaagcgggacgcggagaaggtgatgtccgacctgatggcccgcaacagcgatctccggaagcacaacgacatactgaccgccgagatatcccagatgaagtacaacaacacgatccagcgcaacaagaacatcatgagcaccaccgtggtcccggccatcctgtccgtggccctgctgagctccagcgtggcacccatcatggccgccccgcccgactcccccatgatcaacccctggccccacgccaagaaccgggtcgggaccggcatgtacaagtacgacgacaacgacgacagcggctgccgccccattcggtacggggtgtcctgcataggcttcgacttcatgctgaagatggacaagtacccgttctttaacgcgttcatcgggcacaagacgcccctcgagagcttcgccgacaagatcatcgagaaggaggaggagacctgcgagattggcaccaacaaggagttcaagtgcttcgaggagcgcgcctacatcaaggggacctgccccacgaacattaacgccgtccactacatcgacaacaaggggaagctgcggtacgtcaagtgcaaggagaacctggagatgaccgaggactgcgccttctgccgcaagatcaagaagaaggcgggccagtccgtccaggtgcagaagaccagcgtgcccctccaggacgccatctgccaggagaactccgacacctacagcgggccgaagatccccttcaagggcgtgtgcaagatcgggctgatcaagtacaaagagtgcaagttcaagacgtccagctatgagaccgtctccttcatcaccctgaaagagaagggcaagatctacatcgagcacctcatgctgaagaacatcgaggtggtgaccaacgtcagcttcgtgtgctacgagcacgccggccaggacgagcaggaggtggagcaccgggccctgaagcgcgtcagcgtgaacgactgcaagatcgtggattccagcaagcagaagatctgcacgggggaccacgtcttctgcgagaagtacgactgctccaccagctaccccgatgtgacctgcatccacgcacccggctccgggccgctctacatcaacctgatgggcagctggatcaagccccagtgcgttgggtacgagcgggtcctggtggaccgcgaggtgaagcagcccctcttagcgcccgagcagaactgcgacacgtgcgtctccgagtgcctggacgagggcgtgcacatcaagagcaccggcttcgagatcacctccgccgtggcctgcagccacgggtcctgcatcagcgcccaccaggaggcctccaccagcgtcatcgtgccgtaccccggcctcctggcgtccgtcgggggccgcatcgggatacacctgagccacacctccgacagcgccagcgtgcacatggtggtggtgtgcccgccccgggactcctgcgccgcccacaactgcctcctgtgctaccacggcatcctgaactaccagtgccacagcacgctctccgccatcctcaccagcttcctgctcatactgttcatctacaccgtgttctccgtgaccaccaacatgttgtacgtcctgcgcctgatccccaagcagctcaagagcccggtgggctggctgaagctgttcatcaactggctgctgacggcgctccggatcaaaacccgcaacgtgatggggcggatcaatcagcgcatcggctgggtcgaccaccacgacgtggagcggccccgccaccgggagcccatgcgccggttcaagaccaccctgctactcacgctgatcatgatgaccgggggcaacgcctgctccaacaccgtggtcgccaacagcaagcagacccgctgcgtgcaggagggatccaacacgaagtgcagcatcaccgccaccatcaccctgcgggcgggcgtgatcggcgcggagtcctgcttcattgtcaaggggccgatggagaaccagcagaagacgatcagtatcaagaccatctccagcgagaccgtgtgccgcgagggcagcagcttctggacctccctctacatccccagctgcctgtccagccggcgctgccacctggtgggggactgcgttggcaacaagtgccagagctggcgggacgaccagctctcccgcgagttcagcggcgtgaaggacaaccacatcatgaacgagaacaaatgcttcgagcagtgcggggccatcggctgcgggtgcttcaacatcaacccctcctgcctgtatgtgcacgcctacctcaagtcagcccggaacgaggcggtccgagtgttttcctgcagcgactgggtgcatcgcgtctccttcgaggtgaagggcccggacggggagacggagctggtgaccctgggcagcctgggtaccaagttcttaaactgggggaccctgtccctgagcctcgacgccgaaggaatctccgggacgaacagcatctccttcctggagagctccaaaggcgggttcgctctgtacgacgagggctacagcgagatcccccgggagggcttcctcggggagatccgctgctccagcgagtccgccgccatcagcgcgcacaagagctgcatccgggcccccggcctgatcaagtacaagcccatgaccgaccagatcgagtgcaccgcctccctggtcgatccgttcgccatcttcctcaaggggagcttgccccagacccgcaacggccagacgttcacttccaccaaggacaagaagaccgtgcaggccttcacgaacggggcgattaaggccctgctcagcatcaacctggacgaccacgagatcgtgtttatcaacaaggtcatttcctgcgacgccaccttcctgaacgtgagcggctgctactcctgcgactacggcgcccatgtctgcgtgaaggtcaagagctccgagtctgcggacttcttcgccgaatccgaggacaagaccaccgtgctcagcttccccatccagtccgggacgcacgactactgccaggtgctgcacttccagaagcccctggtagacgagcggctcagctactcctgcggcagcgagccgaagctgatcgtcatcaaggggaccctggtgtacatgggcgtgtacgatttccgcaacaagaccggcgggtccagcaccgtcgtaaacccctccgaaggcgcctggagcatcagcaactggttctccgggctcctggactggctgggcgggcctatgaaggccatcctaaagatcctgggcttcatcgccatcggcatcgtgtgcttcatcctgttcatgatcctcatccggatcgcggtcaacagcatcaacatcaagaagaagaactga

SEQ ID NO: 16008 - RNA, 3942 nt, synthetic construct
  misc_feature 1..3942: note = derived and/or modified CDS sequence (opt11) from PTV(Balliet)__KP272023.1__GP
  source 1..3942: mol_type = other RNA
atgatcttcaccatcctgaacgtgctcacccgcgccatgctcgtcatgagcatgtactccctgacgacctgggacagcacctcacggaacgacatgtgcttctcgaacgatagccccctcgagggccttgtgtactactgggaaacccactccaagaaacacgactacaagaaacagaaatcccagcgctgccgggtgggggacagcgacaagaagatgatcacgaacgtgaccattatctcgctcattagcgagatccagaagtcaatcagcgagctctccctgagttgcggcaacgatgacaacagcaccggccaggtgctcaccttcaacgggcttgaagacacgatccgaggggactacatcgtggactgcgtcaccggcctataccagtcggacatcggcgtgggggttggcctggggcgcacccaccacggccaccaacagatgaagaacaaggccgttgtgatcgacgagaaggagcgaatgatcctcctgctcgagacccagcagtctgagaacgacatcaagatgcaggtcctcatgtccgagatcgagcaactgaagaaccagctgtccaagaagcggaacgagcgcgggcaggagaagcgcgacgcggagaaggtgatgagcgacctcatggcccgcaactcagacctgcggaagcataatgacatcctaacggccgagatctcacagatgaagaacaagaataccatccagcgcaacaaaaacacggtgagcaccacggtggtcccggccatcctctccgtggcgttactgagctccagcgtggcgcccatcatcgccgccccgcccgactcccccatgatcaacccctggccccatgccaagaaccgagtcggcaccggcatgtacaagtacgacgagaacgacgacagcgggtgccgcccgatccggtacggcgtgtcctgtatcgggttcgacttcatgctcaagatggacaagtaccccttcttcaacgcgttcatcggccacaagacgcccctggagagcttcgcagacaagatcatcgaaaaggaggaggagacctgcgagatcggcaccaacaaggagttcaaatgtttcgaggagcgcgcctacatcaaggggacctgccccactaacatcaacgccgtgcattacatcgacaataagggcaagctgcggtacgtcaaatgtaaagagaacctcgagatgaccgaggactgcgccttttgccgcaaaatcaagaagaaggccgggcaaagcgtccaggtgcagaagacgagcgtgcccctgcaggacgccatctgtcaagaaaattccgacacctacagcggcccgaagatccccttcaagggagtgtgcaagatcggcttaatcaagtacaaagagtgcaagtttaagacctcctcttacgagaccgtctcctttatcacgctgaaggagaaaggcaaaatatacatcgaacacctgatgttaaagaacatcgaggtggtgaccaacgtcagcttcgtgtgctatgagcacgccgggcaggacgagcaggaggttgagcacaaggccctcaagcgagtctccgtgaacgactgcaagatcgttgataacagcaagcagaagatctgcaccggcgaccacgtcttctgcgagaaatacgactgcagcacctcctaccccgacgtgacgtgcattcacgcgcccgggagcggcccgctatacatcaacctgatggggtcctggatcaagccccagtgcgtgggctacgaacgcgtcctcgtggaccgggaggtgaagcagcccctgctggcgcccgagcagaactgcgacacgtgcgtcagtgagtgcctcgacgagggggtgcacatcaagagtaccgggttcgagatcaccagtgccgtggcatgctcccacggttcatgcatctccgcccaccaggagccgtcaacctccgtcatcgtgccctaccccggactgctggcctcggtgggtgggcgcatcggcatccacctatctcacacctcagactcggcgagcgtgcacatggtggtggtctgccctccccgcgactcctgcgccgcgcacaactgcctgctgtgctaccacggcatcctcaactaccaatgccacagcaccctgagcgctatcctgacctcattcctcctgattctgttcatctacaccgtgttctcggtgacgacaaacatcctgtacgtcctccggctgatccccaaacagctgaagtcccccgtggggtggctcaagttattcataaactggctgctcaccgctctgcgcatcaagacccggaatgtgatgggccgcatcaaccagcggatcgggtgggtggaccaccatgacgtggagcgcccccggcaccgcgagcctatgcggcgcttcaagactaccctgctactgacgctgatcatgatgaccggcggcaatgcgtgcagcaacacggtggtggctaactccaagcagacccggtgcgtgcaagaggggagcaacaccaagtgctcgatcaccgccactatcaccctccgcgcgggcgtgataggggcggagagctgcttcatcataaaggggcccatggagaaccagcagaagactatctccataaagaccatcagctccgagacggtttgccgggaggggagctccttctggaccagcctgtacatcccctcatgcctgagctcccgccggtgccacctcgtaggcgactgtgttggaaacaagtgccaaagttggcgcgacgaccagctgtcccgggagttcagtggggtcaaggacaatcacatcatgaacgaaaacaagtgcttcgagcagtgcggcgccatcgggtgtggctgcttcaacatcaacccgtcctgcctgtacgtacatgcctacctcaagtccgcacgcaacgaggcagtgagagtgttcagctgctccgactgggtgcaccgcgtgagctttgaggtcaaggggcccgacggcgagacagagctggtgactctgggttccctcgggacgaagttcctgaattggggcaccctgagcctctccctggacgcggaggggatcagcggcaccaactccatcagcttcttggagtccagcaagggcgggttcgccttatacgacgaaggctacaacgagatcccccgcgaggggttcctgggcgaaatccggtgctccagcgagtccgccgccatcagcgcccacaagagctgcatccgcgcgccaggtctgatcaaatacaaaccgatgaccgaccagatcgagtgcacggctagcctcgtggacccattcgccatcttcctgaagggctccctgccccagacccgtaacgggcagaccttcaccagcacgaaggacaagaaaactgtccaggccttcaccaacggcgccatcaaggcgctcctgagcataaacctggacgaccacgagatcgtgttcatcaataaggtcaagaactgtgacgccaccttcctcaacgtctccggctgctacagctgcgactacggggcccacgtgtgcgtcaaagtgaaatcctcagagtccgctgacttcttcgcggagagcgaggacaagacgaccgtactgagcttccccatccagagcggcacccacgactattgccaagtcctgcacttccagaagccgctcgtggatgagcggctgtcctacagctgcgggtccgagcccaaactgatcgtgattaagggcaccttggtttacatgggcgtgtatgacttccgcaacaagaccgggggcagctccaccgtcgtgaatcccagcgagggcgcctggtcgatttccaactggttctccggcctgttggactggctcgggggccccatgaaggccatcctgaaaatcctgggcttcatcgccatcgggatcgtgtgcttcgtcctgttcatgatcctgatccgaatcgccgtgaactcgatcaacattaagaaaaagaactga

SEQ ID NO: 16009 - RNA, 3942 nt, synthetic construct
  misc_feature 1..3942: note = derived and/or modified CDS sequence (opt11) from PTV(Adames)__KP272029.1__GP
  source 1..3942: mol_type = other RNA
atgatcttcacaatactgaacgtgctcacccgcgccatgctggtcatgagcatgtactccctgacgacctgggacagctccagccggaacgacatctgcttctccaacgacagccccctcgagggcctggtgtactactgggagacccactccaaaaagcacgactacaagaagcaggggagccagaagtgccgcgtgggcgactccgacaagaagatgatcagcaacgtcaccatcatctccctgatcagcgagatccaaaagtccatcagcgaactctccctgagctgcgggaacaacgacaactccacgggccaggtgctgaccttcaacgggctcgaagacactatacggggcgactacatcgtggactgcgtcaccggcctgtaccagagcgacatcggggttggcgtggggctgggccgcatcaaccacgaccaccaacaggtcaagaacaaggccgtggtgatcgacgagaaggagaagatgatctccctcctggagacccagcagagcgagaacgacatcaagacccaggtcctgatgagcgagatcgagcaactcaagaaccagctgtccaaacggcgcaacgagcgggggcaggagaagagggacgcggagaagctgatgtcagacctcatggcccggaactccgacctgcgcaaccacaacgtgatcctgaccgacgagatcagccagatcaagaacaacatcaccatccaccggaaccgcaacatgatgtccacgaccgtggtcccggccatcctcagcgtggccctgctgtccagctccgtaggccccatcaccgccgcgccgcccgacagcaccatgatcaacccctggccccacgccaagaaccgggtcggcacggggatgtacaagtacgacgagaacgacgagtccggctgccgccccatccggtacggggtgagctgcatcggcttcgacttcatgctcaagatggacaagtaccccttcttcaacgccttcattggccacaagaccccgctggagtccttcgccgacaagatcatcgagaaggaggaggagacctgcgagatcgggaccaacaaggaatttaagtgcttcgaggagcgcgcgtacatcaagggcacgtgccccaccaacatcaacgccgtgcactacatcgacaacaaagggaagctgcggtacgtcaagtgcaaggagaacctcgagatgaccgaggactgcgccttctgcaggaagatcaagaaaaaggccggccagtcggtccaggtgcagaagacctccgtgcccctgcaggacgccatctgccaggagaacagcgacatctactcagggcccaagatcccgttcaagggcgtgtgcaagatcggcctgatcaagtacaaagagtgcaagttcaaaacgtcctcctacgagaccatctccttcatcaccctcaaggggaagggcaagatctacatcgagcacctgatgctgaagaacatcgaggtcgtgaccaacgtgagcttcgtctgctacgagcacgcggggcaggacgagcaggaggtggagcatcgggccctcaagcgcgtgtccgtcaacgactgcaagatcgtggacaacagcaagcagaagatctgcacgggcgaccacatcttctgcgagaagtacgactgctccaccagctatcccgacgtgacctgcatccacacccccgggtccggccccctgtacatcaacctgatgggcagctggatcaagccgcagtgcgtcgggtacgagcgggtgctcgtggaccgcgaggtcaagcagcccctgctggtgcccgagcagaactgcgacacatgcgtgtccgagtgcctcgacgagggcgtccacatcaagagcaccgggttcgagatcacctccgccgtggcctgcagccacggctcctgcatcagcgcccaccaggaagcgtccaccagcgtgatcatcccctacccggggctgctggcctccgtcggcggacgcatcgggatccacctctcgcacacgtccgatagcgccagcgtgcacatggtggtcgtgtgcccgccccgggactcctgcgccgcccacaattgcctgctgtgctaccacggcatcctcaactaccagtgccacagcaccctgagtgcgatcctgaccagcttcctcctgatccttttcatctacacagccttctccgtgaccacgaacgtcctgtacgtgctccgcctgatcccaaagcagttaaagagccccgtgggctggctgaagttgttcgtcaactggctgctcaccgccctgcggataaagacccgcagggtgatgggccgcatcaaccagcggatcggctgggtggaccatcacgacgtcgagcgcccccggcaccgcgagcccatgcggcgcttcaagaccacgctgctcctgaccctgataatggtgaccggcggcaacgcctgctccaacaccgtggtcgccaacagcaagcagacgcggtgcgtgcaggaggggtccaacaccaagtgcagcattaccgcgaccatcacgctccgtgcgggcgtgatcggggccgagtcctgcttcatcatcaagggccccatggagaaccagcagaagaccatcagcatcaagaccatctccagcgagaccgtctgccgggagggctccagcttctggacgtccctctacatccctagctgcctgtccagccgccgttgccacctcgtgggggactgcgtgggcaataagtgccagagctggcgggacgaccagctgtcccgggagttcagcggggtcaaggacaaccacatcatgaacgagaacaagtgcttcgagcagtgcggcgccatcgggtgcggctgcttcaacatcaacccctcctgcctgtacgtgcacgcgtacctcaagagcgcccgcaacgaggccgtgcgcgtcttctcctgcagcgactgggtgcaccgggtgtcctttgaggtgaaggggcccgacggggagatggagctggtgacccttggcagcctcgggaccaagttcctgaactggggcaccttatccctcagcctggacgccgaggggatctccggcacgaacagcatctccttcctggagagctccaagggcgggttcgccctctacgacgagggctacagcgagatcccgcgcgaggggtttctgggcgagattcggtgctccagcgagtccgcggccatcagcgctcacaagagctgcatccgcgcccccgggctgatcaagtacaagcccatgaccgaccagatcgagtgcaccgcctccctcgtggaccccttcgcgatcttcctgaagggcagcctgccgcagacccggaacggccagacgttcacctccaccaaggacaagaagaccgtccaggccttcacgaacggggccatcaaggccctcctgagcatcaacctggacgaccacgagatcatcttcatcaacaaggtgaagtcttgcgacgccaccttcctcaacgtgagcggctgctactcctgcgactacggggcgcacgtctgcgtgaaggtcaagagctcggagagcgccgacttcttcgccgagtccgaggacaagaccaccgtgctgagcttccccatccagtccggcacgcgcgactactgccaggtgctgcatttccagaagcctctcgttgacgagcggctgagctactcttgcggcagcgagcccaagctgatcgtgatcaaggggaccctcgtgtacatgggcgtctacgacttccgcaacaagaccgggggctccagcaccgtgatcaacccgtccgaggggacgtggagcatcagtaactggttctccggcctgctggactggctgggcgggcccatgaaggccatcctgaagatcctgggctttatcgcgatcgggatcgtgtgcttcatcctcttcatgatcctgatccggatcgccgtcaacagcatcaacatcaagaaaaagaactga

SEQ ID NO: 16010 - RNA, 3942 nt, synthetic construct; identical to SEQ ID NO: 12724
  misc_feature 1..3942: note = derived and/or modified CDS sequence (opt11) from PTV(GML488831)__KP272032.1__GP
  source 1..3942: mol_type = other RNA

SEQ ID NO: 16011 - RNA, 3942 nt, synthetic construct
  misc_feature 1..3942: note = derived and/or modified CDS sequence (opt11) from PTV(GML488778)__KP272038.1__GP
  source 1..3942: mol_type = other RNA
atgatcttcaccatcctgaacgtcctcatacgcgccatgctggtcatgagcatgtactcccttaccacgtgggacagtacctcccggaacgacatgtgcttcagtaacgacagccccctcgagggcctggtgtattactgggagacccactccaagaagcacgactacaagaagcaggagtcccagcgctgccgggtgggggacagcgacaagaaaatgattaccaacgtcacgatcatcagtctgatctcggagatccagaagtccatcagcgagctctccctgagctgcggtaacgacgacaattccaccggccaggtgctgacgttcaacgggctcgaggacaccatccgcggtgactacatcgtggactgcgtcacgggcctgtaccagagcgacataggcgtgggggtgggcctggggcggacccatcacgaccaccagcaggtcaagaacaaggccgtggtcattgacgagaaggagaggatgatttccctcctggagacccagcaaagcgagaacgacatcaagatgcaagtgctgatgtcggagatcgagcagctcaagaaccagctgagcaagaagcggaacgagcgcggccaggagaagcgggacgcggagaaggtgatgagcgacctgatggcccgcaactccgacctccggaagcacaacgggatcctcaccgccgagatcagtcagatgaagtacaacaacacggttcagcgctccaagaacgtcatgagcaccaccgtggtgccggccatcctgtccgtcgccctcctgagctccagcgtggcgcccatcatggccgccccgcccgactcccccatgatcaacccctggccccatgccaagaaccgggtgggcaccggcatgtacaagtacgacgacaacgacgactctggatgccgcccgatccggtacggcgtcagctgcataggattcgacttcatgctgaagatggacaagtacccgttcttcaatgcattcatcggacataagactcccctcgagagcttcgccgacaagatcattgagaaggaggaggagacctgcgagatcggcaccaacaaggagttcaagtgcttcgaggagcgcgcctacatcaaggggacctgccccacgaacatcaacgccgtacattacatcgacaacaagggcaagctgcggtacgtgaagtgcaaggagaacctggagatgaccgaggactgcgccttctgcaggaagattaagaagaaggcgggccagtccgtccaggtgcagaagacctctgtctccctccaggatgcgatctgccaggagaacagcgataactactccggccccaagattccgttcaagggggtgtgtaagatcggcctgatcaagtacaaggagtgcaagttcaagaccagctcttatgagaccgtgagcttcatcaccctgaaggaaaaggggaagatctacatcgagcacctcatgctgaagaacatagaggtcgtgaccaacgtgtcattcgtctgctacgagcacgccgggcaggacgagcaggaagtggagcaccgggccctgaagcgcgtatcggtcaacgactgcaagatcgtggacagctccaagcagaagatctgcaccggcgaccacgtgttctgcgagaagttcgactgcagcacgtcctaccccgatgtgacctgcatccacgcccccgggagcggccccctctacattaacctgatggggtcctggatcaagccgcagtgtgtgggctacgagcgggtgctggttgaccgcgaggtgaagcagcccctcctggcgcccgagcagaactgcgacacgtgcgtgagcgagtgcctagacgagggcgtccacatcaagagtaccgggttcgagatcacctcggccgtggcctgctcccacggcagctgcatttccgcccatcaggaggccagcacctcagtgatcgtcccctacccggggctgctggcgtcagtgggcgggcgcatcggcatccacctgtcccacactagcgacagcgcttccgtgcacatggtcgtggtgtgcccgccccgggactcatgcgccgcccacaactgcctcctgtgctaccacggcatccttaactaccagtgccacagtaccctcagcgccatcctcacgtccttcctgctcatcctgtttatctacaccgtattcagcgtgaccaccaacatgctctatgtgctgcgcctcatccccaagcagttaaagagccccgtggggtggctgaagctgttcatcaactggctgctgaccgcgctccggatcaagacgcgcaacgttatgggcagaatcaaccagcggatagggtgggtggaccaccacgacgtcgagcgtcccagacaccgggagcccatgcgccggttcaagaccaccctgctgctcaccttgatcatgatgacgggaggcaacgcctgcagcaacaccgtcgtggccaactccaagcagacccgctgcgtacaagagggcagcaacaccaagtgctccatcacagccaccattaccctgcgggcgggcgtaatcggggccgagagctgtttcatcatcaagtcccccatggagaaccagcagaagaccatcagcataaaaacgatcagtagcgagaccgtgtgccgcgagggatccagcttctggacctccctctacatcccgagctgcctgagctctcggcgctgccacctggtcggggactgcgtgggcaacaagtgccagagctggcgggacgaccaactctcccgcgagttcagcggcgtgaaggacaaccacatcatgaacgagaacaaatgcttcgaacagtgcggggccatcggctgcggctgcttcaatatcaaccccagttgcctgtacgtacacgcctacctcaagagcgcccggaacgaggcggtgcgcgtgttctcctgcagcgactgggtccaccgcgtgtccttcgaggtgaagggccccgacggggagaccgagctcgtcacgttaggcagcctgggcaccaaattcctcaactgggggaccctgtccctgtccctcgacgccgagggcatctccgggaccaacagcatctccttcctggagagctccaagggcgggttcgccctgtacgatgagggctacagcgagatcccgcgggagggcttcctcggggagatccgctgctccagcgagagcgctgccatctccgcgcacaagagctgcatccgggcccccggcctcatcaagtacaagcccatgacggaccagatcgagtgcaccgcctccctggtggaccccttcgccatcttcctcaaggggagcctgccgcagacccgcaacggccagaccttcacgtccaccaaggacaagaagaccgtacaggccttcaccaacggggcaatcaaggccctactcagcatcaatctggacgaccacgagatcatcttcatcaacaaggtccgctcctgcgacgccacgttcctgaacgtgagcggctgttactcctgcgactacggcgctcacgtctgcgtgaaggtcaagagctccgagagcgcagacttcttcgccgagtccgaggataagactaccgtcctcagcttccccatccagtccgggacccacgactactgccaggtgctgcacttccagaaacccctggtggacgagcgcctcagctactcctgcggaagcgaaccaaagctgatcgtcatcaaggggacgctggtgtacatgggcgtgtacgacttccggaacaagactggcgggtccagcaccgtcgtgaacccgagcgagggcgcctggtccatcagcaattggttttccgggttgctggactggctaggcggaccgatgaaggccatcatcaagatcctgggcttcatcgccatcggcgtcgtctgcttcatcctgttcatgatcctgatccgcatcgcggtcaacagcatcaatattaagaagaagaactga

SEQ ID NO: 16012 - RNA, 3945 nt, synthetic construct
  misc_feature 1..3945: note = derived and/or modified CDS sequence (opt11) from PTV(Adames)__DQ363407.1__GP
  source 1..3945: mol_type = other RNA
atgatcttcaccatcttaaacgtgttgacccgcgctatgctggtaatgagcatgtactccctgacgacgtgggacagctccagcagaaacgacatctgcttctccaacgacagtccactcgagggcctggtgtactactgggagacccactccaagaagcacgactacaagaagcaggggagccagaagtgccgcgtgggcgattccgacaagaagatgatcagcaacgtcaccatcatctccctgatcagcgagatccagaagtccatcagcgaactcagcctgagctgcgggaacaacgacaactcaacgggtcaggtgctgaccttcaatgggctcgaggacaccatacggggcgactacatcgtggactgcgtaaccgggctgtaccagtcggacatcggggtgggcgtggggttgggccgcattaaccacgaccaccagcaggtcaagaataaggccgtggtgatcgacgagaaggagaagatgatctccctccttgagacgcagcagagcgagaacgacatcaagacccaggtgctgatgagcgagatcgagcagctcaagaaccagctgtccaaacggcgcaacgagcggggccaggagaagcgcgacgcggagaagctgatgagcgacctcatggccaggaactccgacctgcgcaaccacaacgtgatcctgaccgacgagatcagccagatcaagaacaacattaccatccaccggaaccgcaacatgatgtccacgaccgtagtccccgccatcctcagcgtggccctgttgtccagcagcgtggggcccattacagccgcgccgcccgacagcaccatgatcaacccctggcctcacgccaagaaccgggtcggcacggggatgtacaaatacgacgagaacgacgagtccggctgccgccccatccggtacggtgtgagctgcattggcttcgatttcatgctcaagatggacaagtaccccttcttcaacgccttcatcggccataaaaccccgctggagtccttcgccgacaagatcatcgagaaggaggaggagacctgcgagattgggaccaacaaggagttcaagtgcttcgaggagagggcgtacatcaagggcacgtgccccaccaacatcaacgccgtgcactacatcgacaacaaggggaagctgaggtacgtcaagtgcaaggagaatctcgagatgaccgaggattgcgccttctgccgcaagatcaagaagaaggccggccagagcgtccaggtccagaagacctccgtgcccctgcaggacgccatttgccaggagaacagcgacatctactccgggcccaaaatcccgttcaagggcgtgtgcaagatcgggctgataaagtacaaggagtgcaagttcaagacgagctcctacgagaccatcagctttatcaccctcaagggtaagggcaagatctacatcgagcacctgatgctgaagaacatcgaggtcgtgaccaacgtgagcttcgtctgctacgagcacgccggtcaggacgacgagcaggaggtggagcaccgggccctcaagcgcgtgtccgtcaacgactgcaagatcgtggacaacagcaagcagaagatctgcacgggcgaccacatcttctgcgagaagtacgactgctccacgagctaccccgacgtgacgtgcatccacacccctgggtcgggccccctgtacatcaaccttatgggcagctggatcaagccgcagtgtgtcgggtacgaacgggttctagtggacagagaggtcaagcagcccctgctggtgcccgagcagaactgcgatacctgcgtgtccgagtgcctggacgagggcgtgcacatcaagagcaccgggttcgagatcacctcggccgtggcctgtagccacggctcctgcatcagcgcccaccaggaagcgtccaccagcgtaatcatcccctacccggggctgctggcctcagtcggcggccgtatcggcatccacctaagccacacgtccgacagcgccagcgtccacatggtggtggtgtgcccgccccgggactcctgcgccgcccacaactgcctgctgtgctaccacggcatcctcaactaccagtgccacagcaccctgagcgcgatcctgaccagctttctcctaattctgttcatctacaccgcattctccgtgaccacaaacgtcctgtacgtgctccgccttatccccaagcagctcaagagccccgtggggtggctgaagctgttcgtcaattggctgttaaccgcccttcggattaagacccgccgggtgatgggccgcatcaaccagcggatcggctgggtggaccaccacgacgtcgagcgcccccggcaccgcgagcccatgcggcgtttcaagaccacgctgctcctgaccttgatcatggtgacagggggcaacgcctgctccaacaccgtggtcgccaacagcaagcagacgagatgcgtgcaggaggggtccaacaccaagtgcagcataaccgcgaccatcacgctccgcgccggcgtaatcggggccgagtcctgcttcattatcaagggccccatggagaaccagcagaaaaccatcagcataaagaccatctccagcgaaaccgtctgccgggagggctccagcttctggacgtccctgtacatcccgagctgcctgtctagccgccggtgccacctcgtgggggactgtgtgggcaacaagtgccagtcgtggcgcgacgaccagctgtcccgggagttcagcggggtcaaggacaatcatatcatgaacgagaacaaatgcttcgagcagtgcggcgccatcgggtgcggctgcttcaacattaacccctcctgcctgtacgtgcacgcgtacctcaaaagcgcccgcaacgaggccgtgcgcgtcttctcctgctccgactgggtgcaccgggtgtccttcgaggtcaagggccccgacggggagatggagctggtgaccctgggcagcctcgggactaaatttctgaactggggaaccctgtccctcagtctggacgccgaaggcatttccggcacgaacagcatctccttcctggagtcatccaagggcgggttcgccctctacgacgaaggctactcggagatcccgcgcgaggggttcctgggagagatccggtgctccagtgagtccgcggccatcagcgcccacaagagctgcatccgcgcccccgggctgatcaagtacaagcccatgacagaccagatcgagtgcaccgcctccctcgtggaccccttcgctatcttcctgaagggcagcctcccgcagacccggaacggacagacgttcacctccaccaaggacaagaagaccgtccaggccttcacgaacggggccataaaggccctcctgagcatcaacctggacgaccacgagatcattttcatcaacaaggttaagtcctgcgatgccaccttcctcaacgtaagcggctgctactcctgcgactacggggcgcacgtctgcgtgaaggtcaaaagctccgaaagcgccgacttcttcgccgagtccgaggacaagaccaccgtgctgagcttccccatccaatcaggcacgcgcgactactgccaggtgctccacttccagaagcccctcgtcgacgagcggctgagctactcctgcggcagcgagcccaagctgatcgtgatcaaagggacactcgtgtacatgggggtctacgacttccgcgacaagaccgggggctccagcaccgtgataaacccgtccgaggggacgtggagcatcagcaactggttctccggcctgctggattggctcggcgggcccatgaaggccatcctcaagatcctgggcttcatcgcaatcgggatcgtgtgcttcatcctcttcatgatcctgatccggatagccgtcaacagcatcaacatcaagaagaaaaactga

SEQ ID NO: 16013 - RNA, 3942 nt, synthetic construct
  misc_feature 1..3942: note = derived and/or modified CDS sequence (opt11) from PTV__M11156.1__GP
  source 1..3942: mol_type = other RNA
atgatcttcaccatcctgaacgtgctcacgcgcgccatgctggtcatgagcatgtactccctcacgacctgggacagcacctcccggaacgacatgtgcttctccaacgacagccccctcgagggcctggtgtactactgggagacccacagcaagcgccacgactacaagaagcaggagtcccagcggtgccgcgtgggggacagcgacaagaaaatgatcacgaacgtcaccatcatctccctgatcagcgaaatccagaagtccatcagcgagctctccctgagctgcgtgaacgacgacaactccactggccaggtgctgaccttcaacgggctcgaggacacgatcaggggcgactacatcgttgactgcgtaaccgggctgtaccagagcgacatcggcgtgggtgtcgggctgggccgcacccatcacggtcaccagcagatgaagaacaaggccgtggttatcgacgagaaggagcggatgatctccctcctggagacccagcagagcgagaacgacatcaagatgcaggtcctgatgtccgagatcgagcagctcaagaaccagctgagcaagaagcgcaatgagcggggtcaggagaagcgcgacgcggagaaggtcatgagcgacctgatggcccggaactccgacctccgcaagcacaacgacatcctgacggccgagatcagccagatgaagaacaagaacaccatccagcggaacaagaacaccgtgtccaccacggtcgtgccggccatcctgagcgtggcgctcctgtccagctccgtcgcgcccatcatcgccgccccgcccgacagccccatgatcaacccctggccccacgccaagaaccgcgtggggaccggcatgtacaagtacgacgagaacgacgactccggctgccggccgattcgctacggggtgagctgcatcggcttcgacttcatgctgaagatggacaagtacccgttcttcaacgcgttcatcgggcacaagacgcccctcgagtccttcgccgacaagatcatcgagaaggaggaggagacctgcgaaatcggcaccaacaaggagttcaagtgcttcgaggagcgggcctacataaaggggacctgccccaccaacatcaacgccgtccactacatcgacaacaaggggaagctgcgctacgtgaagtgcaaggagaacctggagatgaccgaggactgcgcgttctgccggaagatcaagaagaaggcgggccagagcgtgcaggtccagaagacgtccgtgcccctccaggacgccatctgccaagagaacagcgacacctactccgggccgaagatcccgttcaagggcgtctgcaagatcgggctgatcaagtacaaggagtgcaagttcaagaccagctcctacgagaccgtgagcttcatcacgctgaaggagaagggcaagatttacatcgagcacctcatgctgaaaaacatcgaggtggtcaccaacgtgtccttcgtgtgctacgagcacgtcggccaggacgagcaggaggtggagcaccgcgccctgaagcgggtgagcgtcaacgactgcaagatcgtggacaacagcaagcagaagatctgcaccggggaccacgtattctgcgagaagtacgactgttccaccagctaccccgacgtgacctgcatccacgcccccggctccgggccgctctacatcaacctgatggggagctggataaagccccagtgcgtagggtacgagcgcgtgctggtcgaccgcgaggtgaagcagcccctcctggcacccgagcagaactgcgacacgtgcgtgtccgagtgcctggatgagggagtccacatcaagagcaccggcttcgaaatcacctccgcggtggcctgcagccacgggtcctgcatcagcgcccatcaggagccgtccaccagcgtgatcgtcccctaccccggcctcctggcctccgtcgggggccggatcgggatccacctgagccacacatccgacagcgcctccgtgcacatggtggtggtatgcccgccccgcgacagctgcgctgcccacaactgcctcctgtgctatcacggcatcctgaactaccagtgccacagcaccctctccgccatcctgaccagcttcctcctcattctgttcatctacaccgtcttctccgtgacgaccaacatcctgtacgtgctgcggctcatccccaagcagctaaagtcccccgtcggctggctgaagctgttcatcaactggctgctgaccgccctccgcatcaagacccggaacgtgatgcgccggatcaaccagcgcatcgggtgggttgaccaccacgacgtcgagcggccccgccaccgggagccgatgcgccggttcaagacgaccctgctgctcaccctcatcatgatgaccggcgggaacgcctgctccaacacggtagtggcgaacagcaagcagacccgctgcgtccaagagggctccaataccaagtgcagcatcaccgccacgatcaccctgcgggccggcgtgatcggggccgagtcctgcttcatcattaagggccccatggagaaccagcagaagaccatcagcatcaagaccatctccagcgagacggtgtgccgcgaggggtccagcttctggacctccctctacatccccagctgcctgtccagccggcgctgccacctggtcggcgactgcgtggggaacaagtgccagtcctggcgggacgaccagctcagccgcgagttcagcggcgtgaaggacaaccacatcatgaacgagaacaagtgcttcgagcagtgcggcgcgatcgggtgtggctgcttcaacatcaacccgtcctgcctgtacgtccacgcctacctcaagagcgcccgcaacgaggccgtgcgggtcttctcctgcagcgactgggtccaccgcgtgtccttcgaagtgaaggggcccgacggcgagaccgagctcgtcaccctggggagccccggcacgaagttccttaactggggcaccctctccctgagcctggacgccgaagggatatccggcactaacagcatctccttcctcgagagctctaagggcggcttcgctctgtacgacgaggggtacaacgagatcccccgggagggcttcctgggcgagatccgctgcagctccgagagcgccgccatttccgcccacaagagctgcatccgggccccggggctcatcaagtacaagccaatgaccgaccagatcgagtgcacggcgtccctggtggaccccttcgccatcttcctgaagggcagcctcccccagacccgcaacgggcagaccttcaccagcactaaggacaagaagaccgtgcaggccttcaccaacggagccatcaaggccctgctgtccatcaacctcgacgaccacgagatcgttttcatcaacaaggtgaagaactgcgacgcgaccttcctgaacgtcagcgggtgctacagctgtgactacggcgcccacgtgtgcgtgaaggtcaagagctccgagagcgccgacttcttcgccgagtccgaggacaagacgaccgtgctgagcttcccgatccagtccggcacgcacgactactgccaggtactccacttccagaagcccctggtcgacgagcggctgagctacagctgcgggagcgagcccaagctcatcgtgatcaagggcaccctggtgtgcatgggggtctacgacttccgcaacaagacgggcggctcaagcaccgtggtgaacccctccgagggggcgtggagcatctccaactggttcagcggcctgctcgactggctcgggggcccgatgaaggcgatcttaaagatcctggggttcatcgccatcggcattgtctgcttcgttctgttcatgattctgatccggatcgccgtgaactccatcaacatcaagaagaagaactga

SEQ ID NO: 16014 - RNA, 3852 nt, synthetic construct
  misc_feature 1..3852: note = derived and/or modified CDS sequence (opt11) from Phlebovirus(CoAr170255)__HM566149.1__GP
  source 1..3852: mol_type = other RNA
atgtacaagctgatcaccaacatcctcaagctgagcgtggtctccgccatgtacagcatcatgttctgggaccccaccggcatctccaagctgtgcctcagcaacaactccccgctggaggggctggtgtactactgggagaacacgatgcgcgagggcgagttcaagcgggagaagcgtaagaagtgccggctcgggatcagcgagcccgcccccgtgtccaaccagaccatcgtcagcctgatcgaggaggtgcagaagtcccccgcggagatgattctgatctgcgaggccaacggcaacagcaccgggtccagcctctccttcgacggactgagcgacaacgagatcaagccgtccatcgtggactgcaccacgggcgaccgaaccagcgacctgcgggtcctcgtggggaagggcatcttcgagaagaagatgtcgatgagcaacgagatcgaccgcgtggtctccctggaggaccacctccagcgggagaaggagctggtgcagaccttccaggacctgcaccacaacgagagcgagaagaacaagctgctcgagcacgagctggagaatgtgcgccaacagctgaagcgggagcgcgagagcaacaagatcaagatgtggaccacgaagcggcccgagatcaccaccatagggctcaccacgacaatcgccaccatcctactggcctcccagagcgtcgcctccagtgtgcccatgcccggccagctcaacacctggccgcacgcgaagaaccgcgtcgggggcggcgtgttcaaggccaacgacgacgacgaggactcctgcaagctgatcgactacgggatcgcctgccacgggttcgactacctgctccggactgacatctaccccttcttcaacgcccacgtgagccaccgctccctgctggaggcgagcaacgaggggatcatcctcaaggacgaggcctcctgcgagatcgagaccaataaggatttcaagtgctacgaggagcgggctttcctgaagtggagctgcccccacctggtgaactccgcccactttatcgacagcaagggcaagttacgcatcattaagtgcaaggccgagtacgaaatcaccgaggactgcacctactgccgcagaatcaagaagaaggcggcccagcagaagcaggtctacaagtccagcatcgccctgcaggatgccgtgtgccaggagaactccgactactacgacggtccccggataacgttcacaggggtgtgcaagatcggcaccatggagtacaagaagtgcaagcacaagagctccagcttcgagaacatcgggttcatcaccatccgcgacaagggcaagtactacatcgagaacatgcggacgaagaacatcgagatggtctctaacgtcagcttcatctgctacaaccacaacgggcaggacaccgagaaggacgtacgcttactaaagcgcgtcaagccgggcgactgcaaggtggtcgacgactcaaagaccaagcactgcaccggcgaccacgtgttctgcgagaagtacgactgcacgaagtcctaccccgaggcgacctgcatgcacgcacccgggtccggccccatcctggtgctggtcatgggggtgtggttcaagccgcagtgcgtgggctacgagcgggtcctcgtggagagagaggtgaaggcccccgtcctgatccaggagaaggactgcgacacgtgcgtgttcgagtgcctggaggacaagatcctaatcaagtccaccgggttcaagatgatcagcgccgtggcttgctcccacggcagctgcgtctccagccaccagtcccccagcaccttcctgtacatcgactaccccggcctgaccgcctccgtcgggggcgagatcgggctccacctgagccataccgacgactccgtgagcgtgcacaagaagatccactgcccggcgcgggacccctgcgaggcccactcctgcatcgtgtgctaccacggcctggtgaactaccagtgccacaccgtgctcagctactccgtggtgagcttcctgctggtctgcatgatgtacttggcctttttcatcacgagccgcctcctgttcttcctgcggatcatgccccgccggctccgcaaccccatctcctggctgaccctgctcatccggtgggtgctgcagaccctgctcgccatcctgcgcctgtcattcaagaagctctccgagaccatcgggtggaacagtccgaacaaccggcagcagatggacgtggaagccaatcgccggcccctgcgccggtatcgcaccacgttcatcctgaccctcctgttcgtcggcctgacctccgcgtgcagcaacaccgccgtgtccaacagcaagcagacgaagtgcctccagtccggcgggtcggtgaagtgctcgatcaccgccacgatcaccctgaaggccggcacgatcggggcggagagctgcttcatcataaagggcccctccgagaaccagcagaaagttatccgggtgaagaccgtgagctccgagaccgtctgccgcgagggcagctccttctggaccgggcagttcacgcccagttgtgtgtcctcccggcgctgccacctagtgggcgactgcgtcgggaaccgctgccaggcctggcgggacgaggtggtgagccgcgaatttggcaacatgaaggacaacaatgtcatgtccgagaacaagtgcttcgagcagtgcggggccgccggctgcggctgcttcaatatcaacccgagctgcctctacgtgcactccaccttcaagagcgtgcggcgcgaggccatccgtgtcttcaagtgcaacgactgggtgcaccgcctgaccttcgaggtgtccggtcccagcggcgagaaggaccggatagtcctgaactccctcagcaccaagttcctgcagtgggggacgatctccctgagcctagacgcggagggcatctccgggaccaatagctacagcttcctggagagcaacaagggcggcttcgccatccacgacgaggagttctccgagatcccccgcgaggggtacctgggcgagattcggtgcagctccgagagcgccgtgatcgccgcccacaagtcctgcatccgggcgccgaacctcatcaagtacaagccaatgaccgaccagatcgactgcacagccagcctggtggaccccttcgccatcttcctgaaggggagcctcccgcagtcccggagcggctacacgttcacctccagcacagacaagaagacggtccaggctttcaactccgggagcatcaaggccctgatctccatcaacatggacgaccacgagatcgagttcctgaacgacgcggccgattgcgacgccacgttcctcaacgtgagcggctgctactcctgcaactacggcgcccaagtatgcatcaaggtccgcagctccaagagctccatcttcagctccaacaacaacgacaacagcatcgtgatcaacttcgacgcggaccaggggacccgggactactgccgcatcatccacttcaacggcccgctggtggacgaaaccctgcactactcctgcgggggcgagagcaagctcctgcagatgaaagggtccctgatcaccgtcggcccctacgacttcagaaacacgaccggcggcaagtccaccatcgtgaacccccacgaggagagctggaacctcttctcctggttcagcgggctgctggactggctcgggggccccctgcgcgccatcttaaagatcgtcctcatcatcatcatcggcatcatcctgttcatcgtggtggccttcctgatccggctcgtcatcttcaacgtactcctgaagtccaagaagaattaa

SEQ ID NO: 16015 - RNA, 3873 nt, synthetic construct
  misc_feature 1..3873: note = derived and/or modified CDS sequence (opt11) from Phlebovirus(CoAr171616)__HM566154.1__GP
  source 1..3873: mol_type = other RNA
atgttccagatcatctacctgctcaccaagctgtacctggtgtcttccatgtacagcatcatgttctgggagaacgagaacatctccaagctctgcctgagcaacaacagccccctggagggcctcgtctactactgggagaacgtgatgaaggagggggattttaaggaggagaagcgcaagaagtgccggatcggcccgagcgacctgaagcgcgtgaccaaccagacgctaaccaccctcatcgaggaggtccagaagtcccccagcgagatccagctgctgtgcgaagaggacgggaacaagaccggcatctccatgttcttcgacgggctcagcgacgacatctccacgcccagcatcgtggactgcaacggcaacatccggatctcggacctgcgcgtgcaggtcggccgagggcacttcgagaaggaaaacgagatccgcaagatcgaggagatcgtgaccctggaagacgacctccggcgcgagcgggacctgaacaagctgctacaggacctcaacaagaaggacgccgaggagcgccggatcatcgagcacgagctgaccaacatgcgcgagcaactccagcgggagcgcgagcgcagcaagcagcagatcaaggagcacgagaaaatcgaggtgaacaaccacaaggagcccgccacccacctgaacgtctccaagctgctcacgatcggcctgctggcgcagcaggtcggccaggtgatcgccaccgagccggggcagctcaacacctggatccacgccaagaacaggatcggcaaaggcctgtacaagaccgaggacacggacgaggacggctgccgggggctggactacggcgtgagctgcctcgggttcgactacctgctgcgaaccgacatctaccccttcttcaactccttcgtgagccacctctccatgctggaggccagcaccgaggacctgatcgagaaggagggcaccagctgcgagatcgagacgaacaaggagttcaagtgctacgaggaacgggcattcatcaagggctcctgtccccacttagtgaacagcgcgcacttcctggacaacaaggggaagctgcgcatcgtcaagtgcaagaccgacttcgagatgaccgaggactgcaccttctgccgcaagatcaagaagaagaacagccagcacaagcaagtcttcaagacgagcatcgccctccaggacgccgtgtgccagaacaactccgacctttacaacggcccccgcatcgtgtacagcaacgtgtgcaagatcgggatggtgtcctacaagcagtgcaagagcaagacctcctcgtacgagtccgtgggcttcgtgatcctgaaggggaagggcaaattctatatcgagaacatgaagatcaaaaacatcgaggtgatcgccaacgtcagcttcatctgccaccagtaccagggccaggacgggaccgagaaggagcagcgctccctcaagcggatcagcgtgggcgagtgcaagtcagtcaacccgcagaagaccaagcactgcacgggggaccacgtattctgcgagaagtacgactgcaccaagtcttaccccgaggtgacctgcctgatggcgcccggctccgggcccatcctggtccagatcatgggcagctggatcaagccgcagtgcgtgggatacgagaaggtgctcgtagagcgcgaggtgaagtcccccaccctgacggaggagagagactgcgacacgtgtgtgtacgagtgcctggaggacaagatcctcatcaagagcaccgggttcaagatgatctctgcggtcgcctgctcccacggcatgtgcgtgagctcccaccaggagcccagcaccttcctgtacatcaactaccccgggatgtccgccagcatcggcggggagatcggcctgcacctgtcccacaccgacgacagcctctccctacataaggtgatcagctgcccgtcccgcaatccctgcgacgtccacagctgcatcatctgctaccacggcatcatcaactaccagtgccacaccgccttatcctacaccatagtggcgttcagcttcatctccttcctctacctgaccttcaaggtgatcagccagctgctctacactttcaaggtcgtgcccaagaagctgaaggggccattctactggatgggctacctgatcaagtggatcgtgaagaccatcctcggggtcgtgagaaacaccttcttcaccatgtccaaccgcatcgggtgggaacggcgcgacgagatccacgaggacatcgaggccaacccgcggcggcacctccagcggttcaagaccacgttcgtgctgaccatgctgatgatcaacggcgggctgtgctgcagcaacactctggtcagcaactccaaacagacccgctgcgtgcagagcggcaacgaggtcaagtgttccgtcagcgccacggtggtgctcaaggcaggggtgattggcgccgagtcctgtttcataatcaaggggcccagcgagaaccagcacaagatgatctcggtgcggaccctgagctccgagaccgtgtgccgcgagggagctagcttctggaccggccacttctcccccagctgcgtctccagccggcgctgccacttagtgggggagtgccacggcaaccggtgccagtcctggcgcgacgaccagatcagccgggagttcgggggcgtgaaggacaacaaccgcatgtccgaaaacaagtgcttcgagcagtgcgggagcatcggctgcggctgcttcaacatgaacccgtcctgcctctacgtgcacacgaccctgaagtccgcccgcaacgaggccgtgcgggtgttcaagtgcaacgactggatccaccgcctgaacttcgaggtcatcgggccgagcggcgagaaggacgtggtgaccttaaactccatgagcaccaagttcctgcagtgggggactatctccttatccctcgacgccgagggcatcaccgggaccaactcctacagcttcctggagtccagcaagggcggctttgccatccacgacgaggagttctccgacatcccccgggaggggtacctgggagagatccgctgcagctccgagagcgcggtcatctccgcgcacagctcctgcatccgggcccccgacctcatcaagtacaagccaatgaccgaccaaatcgagtgcacgagcaccttgatcgacccgttcgccatcttcatgaaggggtccctgccccagacccgcagcggctacaccttcacgtccagcaaggacaagaagaccatccaggccttcaataccaacagcatcaaggcgctcatctctctcaacctggacgaccacgagatcgtgttcgtgagcgaccagaccaactgcgagtgcacgttcctcaacctgaccgggtgctactcctgtgactacggcgcccacgtctgcttccggatcaagagcgacaagaagggtgtgttcgtgtccaacaccgaggccaaggacatcagcttcgggttcgaggtcctgaccggcacgcacgactactgccagatccagcacttcaactcccccagcgtgtacaagaccctctcctacagctgcgggggcgagtccaagctgctggtgatcaagggcagcctcatcaccatcggaccgcacgactaccgcaacaagaccggcggggcctccacggtcgtgaaccccagcgaggagggctggtccgtgaccaactggatcgggggcttcatcagctggctgggcgggcccctgaaggcgctcctgaagatcgccgtcaccatcctggccggcgtggtcatcttcctcatcatctacttcttcctgcggctgatcgccaccaacatcctcatgaagacgaagaagaactga

SEQ ID NO: 16016 - RNA, 3852 nt, synthetic construct; identical to SEQ ID NO: 12730
  misc_feature 1..3852: note = derived and/or modified CDS sequence (opt11) from Buenaventura virus(CoAr3319)__KP272002.1__GP
  source 1..3852: mol_type = other RNA

SEQ ID NO: 16017 - RNA, 3942 nt, synthetic construct
  misc_feature 1..3942: note = derived and/or modified CDS sequence (opt11) from Cocle virus(GML244915)__KP272034.1__GP
  source 1..3942: mol_type = other RNA
atgatgttcacccacctggacgtgctcacccgcgccatgctggtcatgagcatgtactccctgacgacctgggacagcatcaggcgcaacgacatctgcttctccaacgacagccccctcgagggtctggtgtactactgggagacccagtccaaaatgcacgagtacaagaaggaagacagccagaagtgccgggtgggggactccgagaagaagatgatcagcaacgtcaccatcatctccctgatcagcgagatccagaagtccatcagtgagctctccctgagctgcggcaacgacgacaactccacgggccaggtgctgatgttcaacggcctcgaagacaccatccgcggggattacatcgtggactgcctgaccggcctgtaccagagcgacatcggcgtcggggtgggctccgggaagaccaagcacgaccacacgaagctccggaacaaggccgtgatcatcgacgagaaggagaagatgatcagcctgttagaggcgcagcagtccgagaacgacatcaagacccaggtcctcatgagcgagatagagcagctgaaaacccagctgctcaaccgccggtctgagcgcggccacgagaagcggaagaacgaggagatcgtgtccgacctgatggcccgcaacagcgacctgcgtaagcataacgacatcctcaaggacgagatggaccagatcaaggagaacctgaccatcttcaagtcccgcaacgccatcagcacgacctccgtgccggccatcatgagcatcgccctgctctccagctccgtcatgcccatcatcgcggccgtgagcgactcgcccatgatcaacccctggccgcacgccaagaaccgtgtggggagcggcatgtacaagtacgacgacaacgacgagtccggctgccgccccatccggtacggggtcagctgcatcggcttcgaccacatgctgaaaatggacaagtacccctttttcaacgccttcatcgggcataagaccctgctcgagtccttcgtggacaagatcatcgagaaggaggacgagacctgcgaaatcggcacgaacaaggagttcaagtgcttcgaggagcgcgcgtacatcaaggggacctgcccccataacattaacgccgtgcactacctggacaacaaggggaagctccggtacgtcaagtgcaaggagaacctcgagatgaccgaggactgcgcattctgccgcaagatcaagaagaaggccggccaaagcgtccaggtgcagaagacctccgtgccgctgcaggacgccatctgccaggacaacagcgacatttacactggacctcggatcccctacaagggcatgtgcaagattgggctggtgaagtataaggagtgcaagtccaagaccagcagctacgagaccgtgtccttcatcaccctgaagggcaagggcaagatctacatcgagcacctgatgctgaagaacatcgaggttgtgacgaacgtcagcttcgtgtgctacgagcacgcgggccaggtggagcaggaggtcgagcaccgcgccctcaagcgggtgtccgtaaacgactgcaagatcgtcgacagctccaagcagaagatctgcaccggggaccacgtgttctgcgaaaagtacgactgcagcacctcctaccccgacgtgacctgcatccaggccccggggtccgggcccctgtacgtcaacctgatggggtcctggatcaagccccagtgcgtgggctacgagcgcgtgttagtcgagcgcgaggtgaagcagcccctgctgacgccggagcagaactgcgacacgtgcgtgagcgagtgcctagacgagggcgtccacatcaagtccaccgggttcgagatcaccagcgccgtggcttgctcccacggcagctgcatatccgcgcaccaggaggccagcacctccatcattgtgccctaccccggtctgctggccagcgtcggcgggaagatcggcctccacctgagccacacctccgacagcgcctccgtgcacatgatcgtggtctgcccgccccgggatagctgcgccgcgcacaactgcctgctctgctaccacggcatgctgaactaccagtgccactccaccctgagcgctatcctgacctccttcctcctgatcctgttcatctacacgaccttcagcttcatcaccaacatcctctacctgctgcgcctcctgcccaagcagctgaagtcccccatcgggtggctcaagctgttcatcaactggctgttcaccatcctccggatccgcaccaagtacctgatgggccggcttaaccagcgcatcgggtgggtcgagaatcacgacgtggagcggccccggccgcgggagcccatgcgccggttcaagacgaccctcatgctgaccatgctgatgatcaccggcggctacgcctgcagcaacacggtcgtggccaactccaagcagacccgctgcgtgcaggaggggtctaacaccaagtgctccgtcaccgccacggtgaccctcaaggcgggcgtcatcggggccgagagctgcttcgtcatcaagggccccatggagaaccagcagaagaccatatccatcaagaccgtgagctccgaaacggtgtgccgggaggggagttccttctggaccagcctctacatccccagctgcctgtccagccgcagatgccacctcgtcggcgactgcgtgggcaaccgctgccagtcctggcgggaggaccagctgagccgcgagttctccggggtgaaggacaaccagatcatgaacgagaacaagtgcttcgagcagtgcggcgccatcgggtgcggctgcttcaacatcaacccgagctgcctgtacgtccacgcctacctcaaatccgcgcggaacgaagccgtgcgcgtgttcagctgctccgactgggtccaccgcgtgtccttcgaggttaaggggcccgacggcgagaccgagctggtcaccctgggctccctcgggacgaagttcctgaattggggcaccctgagcctctccctggacgccgaggggatcaccggcaccaacagcctgtccttcctcgagagctccaagggcgggttcgccctttacgacgagggcttcagcgagatccctcgggaggggttcctgggcgagatccgatgctccagcgagagcgccgcgatctccgcccataagagctgcatccgggctcctgggctcatcaagtacaagcccatgacggaccagatcgagtgcaccgcctccctggtggaccccttcgccatcttccttaaaggcagcctcccccagacccgcaacgggcagacctttacgtccaccaaggacaagaagaccgtgcaggcgttcaccacgggcgccatacgggccctgctgagcatcaacctcgacgaccacgagatcaccttcatctccaagatcaagaactgcgaggccaccttcctgaacgtcagcggctgctactcctgcgactacggggcccacgtgtgcatcaagatcaagagctccgagagcgcggacttctacgccgagtccgaggacaagacaacggtgttaagcctcccggtctccagcggcacccaggactactgccaggtgctgcacttccagaagcccctggtggacgagcgcctctcctactcgtgcgggtccgagcccaagctgatggtcatcaagggcaccctggtatacatgggcgtctacgacttccggaacaagaccgggggcagcagcacggtggtgaaccccagtgacgccagctggtccatcgccaactggttcagcgggctcctggactggctgggcgggccgctcaaggcgatcctgaagatcctaggcttcatcgccatgggcgtcgtgtgctttatcctcttcatgatcctgatcaagatcgccgtgagatccgtcaacatgaagaagaagaactga

SEQ ID NO: 16018 - RNA, 3873 nt, synthetic construct
  misc_feature 1..3873: note = derived and/or modified CDS sequence (opt11) from Campana virus(VP-334K)__KP272041.1__GP
  source 1..3873: mol_type = other RNA
atgctgcacttcatcaccatcaccacgaagttcctcgctgtggccagcatgtacaacttgctgtactgggaccccaacggcctctcccgcctgtgcctgagcaacaactccccgctcgaggggctggtatactactgggaaaacctgatgaaggaaagtgatttcaagaaggataagaagaagcactgccggatcggcacctccgtggcggcccccgttactaacgagaccctcacgaccctgatcgaagaggtccagaagtcccccagcgagataatactccagtgcgaaagccgcaacaacgataccggtaactccatctatttcgacggcctcgccgatgacatcgagagcccctccatcgtgaactgcgagagcgggaaacgggagtccgacctgcgcgtgctggtcggccagggcctcaagaaggagatcatcctgaacgagatcgccgccatcgaccgccaggcgagcctggaggagcacctccgcggggagaaggccctgacctccctgctccaggaaatcagcaagcaggacgaggccgagcgtaaacgcctggagcatgaggtgtccagcctgcggcagcagctcatgaacgagcgcgaggaaaataagaagcggaagaacatcccggcctttggcgtttccagcacgacaagctccagcctgatgaacatctcccgcgtcgtgaccatcgggctgctcagccagcaggcgatcgccaacccctccctgcccggccaggtgaacacctggccccacgcgaagaaccggattgggcagggcctgtacagaatcgacacgagcgacgaggacggctgccgggggctcaactacggcgtcatctgcctggggttcgaccacctcctgcgcatggacttatacccgttcttcaatgcatacgtgtcccacctgagcctcctggaggcctacaccgagaacatcatccaaaaggacgagaccgagtgcgagatcgagggcggcaaggagttcaagtgctacgaggagcgggcgtacatcaagggggtctgcccccaccgcatcaagtccgcccactacctggaccagaagggcaaactccggatcatcaagtgcaaggagaacctggagctgactgaggactgcacgtactgccgcaagatcaagaaggaccggggtcacaccaagcaggtctacaagaccagcgtgcccctccaggacgctatctgccaggacaactccgacgactacagcggccccaagatctccttcaagggggtgtgcaagattggcatgatcgagtacaaggagtgcaagtacaagagctcgagcttcgagaccgtcggcttcatcacgatcaaggagaaggggaagttctacatcgaggacatgaagctgaagaacctggaggtgaccaacaacgtagccttcatctgccaccagtataccggccaggacgggaccacggacgaggaaaaccgccatctcaagcgcatgagtgtcaaggactgcaagaacgtgaacagctccaagagcaagtactgcaccggcgaccacatcttctgtcaggtgtacgactgcaccaagagctacccggaggcgacctgcttcgtcgcccccgggtccggtcccgtgctggtccaagtgatgggcagctggatcaagccccagtgcgtgggttacgagaaagtcctggtggagcgagaggtgaagatgcccatcctaacggaggagcgcgattgcgacacgtgtgtctacgagtgcaaggaggaccacatcctgatcaagtccaccggcttcaacatgatcagcgccgtcgcctgctcgcacgggagctgcgtgtccgcgcaccaggatcccagcaccttcctgaacatcgagtaccccggcatgtccgcgagcgtcgggggcgagatcggcatccacatctcccacaccgacgacagcctgtcccttcacaagaagatctactgccccgcgcgggacagctgcgaggcccacaactgcatcatgtgctaccatgggctgatcaactaccagtgccacaccgccctgtcctacgccgttgtgagctttatgttcgtctccatcgcctacgtgatcttcaatgtgctccgcctggtcctggtggcgctccacgtagttcccagaaagctcaagagccccatcgactggctgatcctgctgatcaagtgggtgttcctgctcctggccaaggtgatccgcgctttcctcacccacctcaacacaacgatcggatggcgggagcgccagaacaacttcgccgcggacctcgaggcccaacggcgcccactgcagcggttcaagacaaccgtcctcctgatgatgatgctgatcagcgtggtgtccagctgcagcaacagcgtcgtgtccaacagcaagcagacccgctgcatccagtccgggagcaacaccaagtgctccgtgagcgccacgatcaccctcaaagccggcgtcatcggcgccgagtcctgctttgtgataaaggggcccagcgagaaccagcacaagaccatcgtgatccgcaccgtctccagcgagacgatctgccgggagggcagctcattctggactgggcacttcaccccgtcctgcctgtcttcccggcgctgccacctggtgggcgactgcgtggggagccggtgccagggctggcgcgaggatgtcatctcgcgggagttcggcggggtgaaggacaacaaccagatgtctgagaacaaatgcttcgagcagtgcggcgctgccggctgcggatgcttcaacatcaaccccagctgcctctacgtgcacaccattctgcgctccgccaggaacgaggccgtccgggtgttcaagtgcaacgactgggttcacaagctgacgttccacatcaaggggcccaacggcgaggaggaggacgttgtgctcaacagcctgtccaccaagttcctatcgtggggcaccatctccctcagcctggactccgagggaatcaccggcacgaacagctactccttcctggagagctccaagggcgggttcgcaatccacgatgaggagttcagcgagatcccccgcgaggggttcctcggcgagatccggtgctccagcgagtccgcggtggtcagcgcccacaagtcctgcatccgcgccccgggcctgatcaagtacaagcccatgaccgaccaagtggagtgcagcgccagcctggtggaccccttcgccatctttatcaaggggtccctcccgcagacccggagcggctataccttcacgtccagccgcgacaagcggaccatccaggcgtttaacaacggggccatcaaggccctgctgacccttaacctcgacgaccacgaggtaatcttcagtgagagcgtaatcacgtgcgagtgcaccttcctgaacatctccggctgctacagctgtaacttcggggcccaggtgtgcttcaagatcaaatccagcggcatcggcgacttcgtctccagctccgagaccgggaacatcctcttcagctttcccgtgaagtccggcaccgaggactactgccagatccagcatttcaacagccccatggtatccgagagcctgcagtactcctgcgggggcgagtcaaagctgctccttatcaagggcagcttgatctccgtcgggccctacgactaccgcaacaagaccggcgggagctccacggtggtcaacccggcggaggacagctggtccatcttcaactggctcagcggattcctggattggctcgggggccccttgcgagccctggtgaaaatagccctggccataatcggcgccctcgcgctgctattcatcaccatcatgctcgcccgctccgtgatcagcaacaccctttcccggaagaagaaaaactga

SEQ ID NO: 16019 - RNA, 3594 nt, synthetic construct; identical to SEQ ID NO: 14376
  misc_feature 1..3594: note = derived and/or modified CDS sequence (opt11) from RVFV(ZH-548)__DQ380206.1__GP
  source 1..3594: mol_type = other RNA

SEQ ID NO: 16020 - RNA, 3594 nt, synthetic construct; identical to SEQ ID NO: 14377
  misc_feature 1..3594: note = derived and/or modified CDS sequence (opt11) from RVFV(ZS-6365)__DQ380205.1__GP
  source 1..3594: mol_type = other RNA

SEQ ID NO: 16021 - RNA, 3594 nt, synthetic construct; identical to SEQ ID NO: 14378
  misc_feature 1..3594: note = derived and/or modified CDS sequence (opt11) from RVFV(CAR-R1622)__DQ380219.1__GP
  source 1..3594: mol_type = other RNA

SEQ ID NO: 16022 - RNA, 3594 nt, synthetic construct; identical to SEQ ID NO: 14379
  misc_feature 1..3594: note = derived and/or modified CDS sequence (opt11) from RVFV(2250/74)__DQ380209.1__GP
  source 1..3594: mol_type = other RNA

SEQ ID NO: 16023 - RNA, 3594 nt, synthetic construct; identical to SEQ ID NO: 14380
  misc_feature 1..3594: note = derived and/or modified CDS sequence (opt11) from RVFV(T1)__DQ380201.1__GP
  source 1..3594: mol_type = other RNA

SEQ ID NO: 16024 - RNA, 3594 nt, synthetic construct; identical to SEQ ID NO: 14381
  misc_feature 1..3594: note = derived and/or modified CDS sequence (opt11) from RVFV(1853/78)__DQ380220.1__GP
  source 1..3594: mol_type = other RNA

SEQ ID NO: 16025 - RNA, 3594 nt, synthetic construct; identical to SEQ ID NO: 14382
  misc_feature 1..3594: note = derived and/or modified CDS sequence (opt11) from RVFV(MP-12)__DQ380208.1__GP
  source 1..3594: mol_type = other RNA

SEQ ID NO: 16026 - RNA, 3594 nt, synthetic construct; identical to SEQ ID NO: 14383
  misc_feature 1..3594: note = derived and/or modified CDS sequence (opt11) from RVFV(ZM-657)__DQ380204.1__GP
  source 1..3594: mol_type = other RNA

SEQ ID NO: 16027 - RNA, 3594 nt, synthetic construct; identical to SEQ ID NO: 14384
  misc_feature 1..3594: note = derived and/or modified CDS sequence (opt11) from RVFV(ZH-501-777)__DQ380202.1__GP
  source 1..3594: mol_type = other RNA

SEQ ID NO: 16028 - RNA, 3594 nt, synthetic construct; identical to SEQ ID NO: 14385
  misc_feature 1..3594: note = derived and/or modified CDS sequence (opt11) from RVFV(OS-3)__DQ380184.1__GP
  source 1..3594: mol_type = other RNA

SEQ ID NO: 16029 - RNA, 3594 nt, synthetic construct; identical to SEQ ID NO: 14386
  misc_feature 1..3594: note = derived and/or modified CDS sequence (opt11) from RVFV(Sudan 86-2010)__JQ820489.1__GP
  source 1..3594: mol_type = other RNA

SEQ ID NO: 16030 - RNA, 3594 nt, synthetic construct; identical to SEQ ID NO: 14387
  misc_feature 1..3594: note = derived and/or modified CDS sequence (opt11) from RVFV(T-46 (228113))__DQ380199.1__GP
  source 1..3594: mol_type = other RNA

SEQ ID NO: 16031 - RNA, 3594 nt, synthetic construct; identical to SEQ ID NO: 14388
  misc_feature 1..3594: note = derived and/or modified CDS sequence (opt11) from RVFV(2007000094)__EU574055.1__GP
  source 1..3594: mol_type = other RNA

SEQ ID NO: 16032 - RNA, 3594 nt, synthetic construct; identical to SEQ ID NO: 14389
  misc_feature 1..3594: note = derived and/or modified CDS sequence (opt11) from RVFV(ZC-3349)__DQ380207.1__GP
  source 1..3594: mol_type = other RNA

SEQ ID NO: 16033 - RNA, 3594 nt, synthetic construct; identical to SEQ ID NO: 14390
  misc_feature 1..3594: note = derived and/or modified CDS sequence (opt11) from RVFV(2007001602)__EU574043.1__GP
  source 1..3594: mol_type = other RNA

SEQ ID NO: 16034 - RNA, 3594 nt, synthetic construct; identical to SEQ ID NO: 14391
  misc_feature 1..3594: note = derived and/or modified CDS sequence (opt11) from RVFV(1260/78)__DQ380214.1__GP
  source 1..3594: mol_type = other RNA

SEQ ID NO: 16035 - RNA, 3594 nt, synthetic construct; identical to SEQ ID NO: 14392
  misc_feature 1..3594: note = derived and/or modified CDS sequence (opt11) from RVFV(2007000324)__JF326195.1__GP
  source 1..3594: mol_type = other RNA

SEQ ID NO: 16036 - RNA, 3594 nt, synthetic construct; identical to SEQ ID NO: 14393
  misc_feature 1..3594: note = derived and/or modified CDS sequence (opt11) from RVFV(KEN/Gar-Msq/131B-04/06)__HM586972.1__GP
  source 1..3594: mol_type = other RNA

SEQ ID NO: 16037 - RNA, 3594 nt, synthetic construct; identical to SEQ ID NO: 14394
  misc_feature 1..3594: note = derived and/or modified CDS sequence (opt11) from RVFV(2007004194)__EU574031.1__GP
  source 1..3594: mol_type = other RNA

SEQ ID NO: 16038 - RNA, 3594 nt, synthetic construct; identical to SEQ ID NO: 14395
  misc_feature 1..3594: note = derived and/or modified CDS sequence (opt11) from RVFV(73HB1230)__DQ380221.1__GP
  source 1..3594: mol_type = other RNA

SEQ ID NO: 16039 - RNA, 3594 nt, synthetic construct; identical to SEQ ID NO: 14396
  misc_feature 1..3594: note = derived and/or modified CDS sequence (opt11) from RVFV(73HB1449)__DQ380211.1__GP
  source 1..3594: mol_type = other RNA

SEQ ID NO: 16040 - RNA, 3594 nt, synthetic construct; identical to SEQ ID NO: 14397
  misc_feature 1..3594: note = derived and/or modified CDS sequence (opt11) from RVFV(ZH-548M12)__M25276.1__GP
  source 1..3594: mol_type = other RNA

SEQ ID NO: 16041 - RNA, 3594 nt, synthetic construct; identical to SEQ ID NO: 14398
  misc_feature 1..3594: note = derived and/or modified CDS sequence (opt11) from RVFV(ZINGA J83 R1)__KU978776.1__GP
  source 1..3594: mol_type = other RNA

SEQ ID NO: 16042 - RNA, 3594 nt, synthetic construct; identical to SEQ ID NO: 14399
  misc_feature 1..3594: note = derived and/or modified CDS sequence (opt11) from RVFV(Sudan 28-2010)__JQ820491.1__GP
  source 1..3594: mol_type = other RNA

SEQ ID NO: 16043 - RNA, 3594 nt, synthetic construct; identical to SEQ ID NO: 14400
  misc_feature 1..3594: note = derived and/or modified CDS sequence (opt11) from RVFV(2007001292)__EU574046.1__GP
  source 1..3594: mol_type = other RNA

SEQ ID NO: 16044 - RNA, 3594 nt, synthetic construct; identical to SEQ ID NO: 14401
  misc_feature 1..3594: note = derived and/or modified CDS sequence (opt11) from RVFV(Sudan 85-2010)__JQ820488.1__GP
  source 1..3594: mol_type = other RNA

SEQ ID NO: 16045 - RNA, 3594 nt, synthetic construct; identical to SEQ ID NO: 14402
  misc_feature 1..3594: note = derived and/or modified CDS sequence (opt11) from RVFV(2007002060)__EU574039.1__GP
  source 1..3594: mol_type = other RNA

SEQ ID NO: 16046 - RNA, 3594 nt, synthetic construct; identical to SEQ ID NO: 14403
  misc_feature 1..3594: note = derived and/or modified CDS sequence (opt11) from RVFV(2007002476)__EU574036.1__GP
  source 1..3594: mol_type = other RNA

SEQ ID NO: 16047 - RNA, 3594 nt, synthetic construct; identical to SEQ ID NO: 14404
  misc_feature 1..3594: note = derived and/or modified CDS sequence (opt11) from RVFV(2269/74)__DQ380222.1__GP
  source 1..3594: mol_type = other RNA

SEQ ID NO: 16048 - RNA, 3594 nt, synthetic construct; identical to SEQ ID NO: 14405
  misc_feature 1..3594: note = derived and/or modified CDS sequence (opt11) from RVFV(SA-51 (Van Wyck))__DQ380195.1__GP
  source 1..3594: mol_type = other RNA

SEQ ID NO: 16049 - RNA, 3594 nt, synthetic construct; identical to SEQ ID NO: 14406
  misc_feature 1..3594: note = derived and/or modified CDS sequence (opt11) from RVFV(OS-8)__DQ380185.1__GP
  source 1..3594: mol_type = other RNA

SEQ ID NO: 16050 - RNA, 3594 nt, synthetic construct; identical to SEQ ID NO: 14407
  misc_feature 1..3594: note = derived and/or modified CDS sequence (opt11) from RVFV(BIME-01)__KX609032.1__GP
  source 1..3594: mol_type = other RNA

SEQ ID NO: 16051 - RNA, 3594 nt, synthetic construct; identical to SEQ ID NO: 14408
  misc_feature 1..3594: note = derived and/or modified CDS sequence (opt11) from RVFV(Kenya 83 (21445))__DQ380198.1__GP
  source 1..3594: mol_type = other RNA

SEQ ID NO: 16052 - RNA, 3594 nt, synthetic construct; identical to SEQ ID NO: 14409
  misc_feature 1..3594: note = derived and/or modified CDS sequence (opt11) from RVFV(2007000253)__JF326192.1__GP
  source 1..3594: mol_type = other RNA

SEQ ID NO: 16053 - RNA, 3594 nt, synthetic construct; identical to SEQ ID NO: 14410
  misc_feature 1..3594: note = derived and/or modified CDS sequence (opt11) from RVFV(200803166)__JF311381.1__GP
  source 1..3594: mol_type = other RNA

SEQ ID NO: 16054 - RNA, 3594 nt, synthetic construct; identical to SEQ ID NO: 14411
  misc_feature 1..3594: note = derived and/or modified CDS sequence (opt11) from RVFV(2007001107)__EU574047.1__GP
  source 1..3594: mol_type = other RNA

SEQ ID NO: 16055 - RNA, 3594 nt, synthetic construct; identical to SEQ ID NO: 14412
  misc_feature 1..3594: note = derived and/or modified CDS sequence (opt11) from RVFV(ANK-3837)__DQ380215.1__GP
  source 1..3594: mol_type = other RNA

SEQ ID NO: 16056 - RNA, 3594 nt, synthetic construct; identical to SEQ ID NO: 14413
  misc_feature 1..3594: note = derived and/or modified CDS sequence (opt11) from RVFV(OS-1)__DQ380186.1__GP
  source 1..3594: mol_type = other RNA

SEQ ID NO: 16057 - RNA, 3594 nt, synthetic construct; identical to SEQ ID NO: 14414
  misc_feature 1..3594: note = derived and/or modified CDS sequence (opt11) from RVFV(Sudan 2V-2007)__JQ820490.1__GP
  source 1..3594: mol_type = other RNA

SEQ ID NO: 16058 - RNA, 3594 nt, synthetic construct; identical to SEQ ID NO: 14415
  misc_feature 1..3594: note = derived and/or modified CDS sequence (opt11) from RVFV(200803162)__JF311377.1__GP
  source 1..3594: mol_type = other RNA

SEQ ID NO: 16059 - RNA, 3594 nt, synthetic construct; identical to SEQ ID NO: 14416
  misc_feature 1..3594: note = derived and/or modified CDS sequence (opt11) from RVFV(2007001811)__EU574040.1__GP
  source 1..3594: mol_type = other RNA

SEQ ID NO: 16060 - RNA, 3594 nt, synthetic construct; identical to SEQ ID NO: 14417
  misc_feature 1..3594: note = derived and/or modified CDS sequence (opt11) from RVFV(clone 13)__DQ380213.1__GP
  source 1..3594: mol_type = other RNA

SEQ ID NO: 16061 - RNA, 3594 nt, synthetic construct; identical to SEQ ID NO: 14418
  misc_feature 1..3594: note = derived and/or modified CDS sequence (opt11) from RVFV(MP12)__Z30318.1__GP
  source 1..3594: mol_type = other RNA

SEQ ID NO: 16062 - RNA, 3594 nt, synthetic construct; identical to SEQ ID NO: 14419
  misc_feature 1..3594: note = derived and/or modified CDS sequence (opt11) from RVFV__JQ068143.1__GP
  source 1..3594: mol_type = other RNA

SEQ ID NO: 16063 - RNA, 3594 nt, synthetic construct; identical to SEQ ID NO: 14420
  misc_feature 1..3594: note = derived and/or modified CDS sequence (opt11) from RVFV(2007002445)__EU574037.1__GP
  source 1..3594: mol_type = other RNA

SEQ ID NO: 16064 - RNA, 3594 nt, synthetic construct; identical to SEQ ID NO: 14421
  misc_feature 1..3594: note = derived and/or modified CDS sequence (opt11) from RVFV(2008/00101)__HE687306.1__GP
  source 1..3594: mol_type = other RNA

SEQ ID NO: 16065 - RNA, 3594 nt, synthetic construct; identical to SEQ ID NO: 14422
  misc_feature 1..3594: note = derived and/or modified CDS sequence (opt11) from RVFV(Hv-B375)__DQ380218.1__GP
  source 1..3594: mol_type = other RNA

SEQ ID NO: 16066 - RNA, 3594 nt, synthetic construct; identical to SEQ ID NO: 14423
  misc_feature 1..3594: note = derived and/or modified CDS sequence (opt11) from RVFV(763/70)__DQ380188.1__GP
  source 1..3594: mol_type = other RNA

SEQ ID NO: 16067 - RNA, 3594 nt, synthetic construct; identical to SEQ ID NO: 14424
  misc_feature 1..3594: note = derived and/or modified CDS sequence (opt11) from RVFV(RVFBJ01/2016)__KX785331.1__GP
  source 1..3594: mol_type = other RNA

SEQ ID NO: 16068 - RNA, 3594 nt, synthetic construct; identical to SEQ ID NO: 14425
  misc_feature 1..3594: note = derived and/or modified CDS sequence (opt11) from RVFV(Lunyo)__KU167026.1__GP
  source 1..3594: mol_type = other RNA

SEQ ID NO: 16069 - RNA, 3594 nt, synthetic construct; identical to SEQ ID NO: 14426
  misc_feature 1..3594: note = derived and/or modified CDS sequence (opt11) from RVFV(2007000234)__JF326191.1__GP
  source 1..3594: mol_type = other RNA

SEQ ID NO: 16070 - RNA, 3594 nt, synthetic construct; identical to SEQ ID NO: 14427
  misc_feature 1..3594: note = derived and/or modified CDS sequence (opt11) from RVFV(KEN07-KUR340)__EF460404.1__GP
  source 1..3594: mol_type = other RNA

SEQ ID NO: 16071 - RNA, 3594 nt, synthetic construct; identical to SEQ ID NO: 14428
  misc_feature 1..3594: note = derived and/or modified CDS sequence (opt11) from RVFV(2373/74)__DQ380194.1__GP
  source 1..3594: mol_type = other RNA

SEQ ID NO: 16072 - RNA, 3594 nt, synthetic construct; identical to SEQ ID NO: 14429
  misc_feature 1..3594: note = derived and/or modified CDS sequence (opt11) from RVFV(200803169)__JF311384.1__GP
  source 1..3594: mol_type = other RNA

SEQ ID NO: 16073 - RNA, 3594 nt, synthetic construct; identical to SEQ ID NO: 14430
  misc_feature 1..3594: note = derived and/or modified CDS sequence (opt11) from RVFV(200803167)__JF311382.1__GP
  source 1..3594: mol_type = other RNA

SEQ ID NO: 16074 - RNA, 3594 nt, synthetic construct; identical to SEQ ID NO: 14431
  misc_feature 1..3594: note = derived and/or modified CDS sequence (opt11) from RVFV(Entebbe)__DQ380191.1__GP
  source 1..3594: mol_type = other RNA

SEQ ID NO: 16075 - RNA, 3594 nt, synthetic construct; identical to SEQ ID NO: 14432
  misc_feature 1..3594: note = derived and/or modified CDS sequence (opt11) from RVFV(25010-24)__KM210509.1__GP
  source 1..3594: mol_type = other RNA

SEQ ID NO: 16076 - RNA, 3594 nt, synthetic construct; identical to SEQ ID NO: 14433
  misc_feature 1..3594: note = derived and/or modified CDS sequence (opt11) from RVFV(Kenya 9800523)__DQ380196.1__GP
  source 1..3594: mol_type = other RNA

SEQ ID NO: 16077 - RNA, 3594 nt, synthetic construct; identical to SEQ ID NO: 14434
  misc_feature 1..3594: note = derived and/or modified CDS sequence (opt11) from RVFV(ANK-6087)__DQ380216.1__GP
  source 1..3594: mol_type = other RNA

SEQ ID NO: 16078 - RNA, 3594 nt, synthetic construct; identical to SEQ ID NO: 14435
  misc_feature 1..3594: note = derived and/or modified CDS sequence (opt11) from RVFV(SAUDI 200010901)__KU978778.1__GP
  source 1..3594: mol_type = other RNA

SEQ ID NO: 16079 - RNA, 3594 nt, synthetic construct; identical to SEQ ID NO: 14436
  misc_feature 1..3594: note = derived and/or modified CDS sequence (opt11) from RVFV(35/74)__JF784387.1__GP
  source 1..3594: mol_type = other RNA

SEQ ID NO: 16080 - RNA, 3594 nt, synthetic construct; identical to SEQ ID NO: 14437
  misc_feature 1..3594: note = derived and/or modified CDS sequence (opt11) from RVFV(KEN/Kil-006/07)__HM586966.1__GP
  source 1..3594: mol_type = other RNA

SEQ ID NO: 16081 - RNA, 3594 nt, synthetic construct; identical to SEQ ID NO: 14438
  misc_feature 1..3594: note = derived and/or modified CDS sequence (opt11) from RVFV(MgH824)__DQ380210.1__GP
  source 1..3594: mol_type = other RNA

SEQ ID NO: 16082 - RNA, 3594 nt, synthetic construct; identical to SEQ ID NO: 14439
  misc_feature 1..3594: note = derived and/or modified CDS sequence (opt11) from RVFV(Kenya 57 (Rintoul))__DQ380192.1__GP
  source 1..3594: mol_type = other RNA

SEQ ID NO: 16083 - RNA, 3594 nt, synthetic construct; identical to SEQ ID NO: 14440
  misc_feature 1..3594: note = derived and/or modified CDS sequence (opt11) from RVFV(SA-75)__DQ380189.1__GP
  source 1..3594: mol_type = other RNA

SEQ ID NO: 16084 - RNA, 3594 nt, synthetic construct; identical to SEQ ID NO: 14441
  misc_feature 1..3594: note = derived and/or modified CDS sequence (opt11) from RVFV(SA01-1322)__KX096942.1__GP
  source 1..3594: mol_type = other RNA

SEQ ID NO: 16085 - RNA, 3594 nt, synthetic construct; identical to SEQ ID NO: 14442
  misc_feature 1..3594: note = derived and/or modified CDS sequence (opt11) from RVFV(KEN/Mal-032/07)__HM586967.1__GP
  source 1..3594: mol_type = other RNA

SEQ ID NO: 16086 - RNA, 3594 nt, synthetic construct; identical to SEQ ID NO: 14443
  misc_feature 1..3594: note = derived and/or modified CDS sequence (opt11) from RVFV(KEN/Gar-008/06)__HM586965.1__GP
  source 1..3594: mol_type = other RNA

SEQ ID NO: 16087 - RNA, 3594 nt, synthetic construct; identical to SEQ ID NO: 14444
  misc_feature 1..3594: note = derived and/or modified CDS sequence (opt11) from RVFV(Kenya 56 (IB8))__DQ380190.1__GP
  source 1..3594: mol_type = other RNA

SEQ ID NO: 16088 - RNA, 3594 nt, synthetic construct; identical to SEQ ID NO: 14445
  misc_feature 1..3594: note = derived and/or modified CDS sequence (opt11) from RVFV(KEN/Bar-035/07)__HM586969.1__GP
  source 1..3594: mol_type = other RNA

SEQ ID NO: 16089 - RNA, 3594 nt, synthetic construct; identical to SEQ ID NO: 14446
  misc_feature 1..3594: note = derived and/or modified CDS sequence (opt11) from RVFV(TAN/Dod-002/07)__HM586971.1__GP
  source 1..3594: mol_type = other RNA

SEQ ID NO: 16090 - RNA, 3594 nt, synthetic construct; identical to SEQ ID NO: 14447
  misc_feature 1..3594: note = derived and/or modified CDS sequence (opt11) from RVFV(Beijing-01)__KX611606.1__GP
  source 1..3594: mol_type = other RNA

SEQ ID NO: 16091 - RNA, 3594 nt, synthetic construct; identical to SEQ ID NO: 14448
  misc_feature 1..3594: note = derived and/or modified CDS sequence (opt11) from RVFV(Smithburn)__DQ380193.1__GP
  source 1..3594: mol_type = other RNA

SEQ ID NO: 16092 - RNA, 3594 nt, synthetic construct; identical to SEQ ID NO: 14449
  misc_feature 1..3594: note = derived and/or modified CDS sequence (opt11) from RVFV(KEN/Bar-032/07)__HM586968.1__GP
  source 1..3594: mol_type = other RNA

SEQ ID NO: 16093 - RNA, 3594 nt, synthetic construct; identical to SEQ ID NO: 14450
  misc_feature 1..3594: note = derived and/or modified CDS sequence (opt11) from RVFV(KEN/Gar-004/06)__HM586964.1__GP
  source 1..3594: mol_type = other RNA

SEQ ID NO: 16094 - RNA, 3621 nt, synthetic construct; identical to SEQ ID NO: 14451
  misc_feature 1..3621: note = derived and/or modified CDS sequence (opt11) from RVFV(RVFV)__M11157.1__GP
  source 1..3621: mol_type = other RNA

SEQ ID NO: 16095 - RNA, 3480 nt, synthetic construct; identical to SEQ ID NO: 14452
  misc_feature 1..3480: note = derived and/or modified CDS sequence (opt11) from RVFV(ZH-548)__DQ380206.1__NSm-Gn-Gc
  source 1..3480: mol_type = other RNA

SEQ ID NO: 16096 - RNA, 3480 nt, synthetic construct; identical to SEQ ID NO: 14453
  misc_feature 1..3480: note = derived and/or modified CDS sequence (opt11) from RVFV(ZS-6365)__DQ380205.1__NSm-Gn-Gc
  source 1..3480: mol_type = other RNA

SEQ ID NO: 16097 - RNA, 3480 nt, synthetic construct; identical to SEQ ID NO: 14454
  misc_feature 1..3480: note = derived and/or modified CDS sequence (opt11) from RVFV(MP-12)__DQ380208.1__NSm-Gn-Gc
  source 1..3480: mol_type = other RNA

SEQ ID NO: 16098 - RNA, 3480 nt, synthetic construct; identical to SEQ ID NO: 14455
  misc_feature 1..3480: note = derived and/or modified CDS sequence (opt11) from RVFV(T1)__DQ380201.1__NSm-Gn-Gc
  source 1..3480: mol_type = other RNA

SEQ ID NO: 16099 - RNA, 3480 nt, synthetic construct; identical to SEQ ID NO: 14456
  misc_feature 1..3480: note = derived and/or modified CDS sequence (opt11) from RVFV(1853/78)__DQ380220.1__NSm-Gn-Gc
  source 1..3480: mol_type = other RNA

SEQ ID NO: 16100 - RNA, 3480 nt, synthetic construct; identical to SEQ ID NO: 14457
  misc_feature 1..3480: note = derived and/or modified CDS sequence (opt11) from RVFV(CAR-R1622)__DQ380219.1__NSm-Gn-Gc
  source 1..3480: mol_type = other RNA

SEQ ID NO: 16101 - RNA, 3480 nt, synthetic construct; identical to SEQ ID NO: 14458
  misc_feature 1..3480: note = derived and/or modified CDS sequence (opt11) from RVFV(2250/74)__DQ380209.1__NSm-Gn-Gc
  source 1..3480: mol_type = other RNA

SEQ ID NO: 16102 - RNA, 3480 nt, synthetic construct; identical to SEQ ID NO: 14459
  misc_feature 1..3480: note = derived and/or modified CDS sequence (opt11) from RVFV(2007000094)__EU574055.1__NSm-Gn-Gc
  source 1..3480: mol_type = other RNA

SEQ ID NO: 16103 - RNA, 3480 nt, synthetic construct; identical to SEQ ID NO: 14460
  misc_feature 1..3480: note = derived and/or modified CDS sequence (opt11) from RVFV(ZM-657)__DQ380204.1__NSm-Gn-Gc
  source 1..3480: mol_type = other RNA

SEQ ID NO: 16104 - RNA, 3480 nt, synthetic construct; identical to SEQ ID NO: 14461
  misc_feature 1..3480: note = derived and/or modified CDS sequence (opt11) from RVFV(ZH-548M12)__M25276.1__NSm-Gn-Gc
  source 1..3480: mol_type = other RNA

SEQ ID NO: 16105 - RNA, 3480 nt, synthetic construct; identical to SEQ ID NO: 14462
  misc_feature 1..3480: note = derived and/or modified CDS sequence (opt11) from RVFV(ZH-501-777)__DQ380202.1__NSm-Gn-Gc
  source 1..3480: mol_type = other RNA

SEQ ID NO: 16106 - RNA, 3480 nt, synthetic construct; identical to SEQ ID NO: 14463
  misc_feature 1..3480: note = derived and/or modified CDS sequence (opt11) from RVFV(T-46 (228113))__DQ380199.1__NSm-Gn-Gc
  source 1..3480: mol_type = other RNA

SEQ ID NO: 16107 - RNA, 3480 nt, synthetic construct; identical to SEQ ID NO: 14464
  misc_feature 1..3480: note = derived and/or modified CDS sequence (opt11) from RVFV(OS-3)__DQ380184.1__NSm-Gn-Gc
  source 1..3480: mol_type = other RNA

SEQ ID NO: 16108 - RNA, 3480 nt, synthetic construct; identical to SEQ ID NO: 14465
  misc_feature 1..3480: note = derived and/or modified CDS sequence (opt11) from RVFV(Sudan 86-2010)__JQ820489.1__NSm-Gn-Gc
  source 1..3480: mol_type = other RNA

SEQ ID NO: 16109 - RNA, 3480 nt, synthetic construct; identical to SEQ ID NO: 14466
  misc_feature 1..3480: note = derived and/or modified CDS sequence (opt11) from RVFV(Sudan 28-2010)__JQ820491.1__NSm-Gn-Gc
  source 1..3480: mol_type = other RNA

SEQ ID NO: 16110 - RNA, 3480 nt, synthetic construct; identical to SEQ ID NO: 14467
  misc_feature 1..3480: note = derived and/or modified CDS sequence (opt11) from RVFV(2007004194)__EU574031.1__NSm-Gn-Gc
  source 1..3480: mol_type = other RNA

SEQ ID NO: 16111 - RNA, 3480 nt, synthetic construct; identical to SEQ ID NO: 14468
  misc_feature 1..3480: note = derived and/or modified CDS sequence (opt11) from RVFV(73HB1230)__DQ380221.1__NSm-Gn-Gc
  source 1..3480: mol_type = other RNA

SEQ ID NO: 16112 - RNA, 3480 nt, synthetic construct; identical to SEQ ID NO: 14469
  misc_feature 1..3480: note = derived and/or modified CDS sequence (opt11) from RVFV(1260/78)__DQ380214.1__NSm-Gn-Gc
  source 1..3480: mol_type = other RNA

SEQ ID NO: 16113 - RNA, 3480 nt, synthetic construct; identical to SEQ ID NO: 14470
  misc_feature 1..3480: note = derived and/or modified CDS sequence (opt11) from RVFV(ZC-3349)__DQ380207.1__NSm-Gn-Gc
  source 1..3480: mol_type = other RNA

SEQ ID NO: 16114 - RNA, 3480 nt, synthetic construct; identical to SEQ ID NO: 14471
  misc_feature 1..3480: note = derived and/or modified CDS sequence (opt11) from RVFV(Sudan 85-2010)__JQ820488.1__NSm-Gn-Gc
  source 1..3480: mol_type = other RNA

SEQ ID NO: 16115 - RNA, 3480 nt, synthetic construct; identical to SEQ ID NO: 14472
  misc_feature 1..3480: note = derived and/or modified CDS sequence (opt11) from RVFV(2007000324)__JF326195.1__NSm-Gn-Gc
  source 1..3480: mol_type = other RNA

SEQ ID NO: 16116 - RNA, 3480 nt, synthetic construct; identical to SEQ ID NO: 14473
  misc_feature 1..3480: note = derived and/or modified CDS sequence (opt11) from RVFV(OS-8)__DQ380185.1__NSm-Gn-Gc
  source 1..3480: mol_type = other RNA

SEQ ID NO: 16117 - RNA, 3480 nt, synthetic construct; identical to SEQ ID NO: 14474
  misc_feature 1..3480: note = derived and/or modified CDS sequence (opt11) from RVFV(ZINGA J83 R1)__KU978776.1__NSm-Gn-Gc
  source 1..3480: mol_type = other RNA

SEQ ID NO: 16118 - RNA, 3480 nt, synthetic construct; identical to SEQ ID NO: 14475
  misc_feature 1..3480: note = derived and/or modified CDS sequence (opt11) from RVFV(2007000253)__JF326192.1__NSm-Gn-Gc
  source 1..3480: mol_type = other RNA

SEQ ID NO: 16119 - RNA, 3480 nt, synthetic construct; identical to SEQ ID NO: 14476
  misc_feature 1..3480: note = derived and/or modified CDS sequence (opt11) from RVFV(MP12)__Z30318.1__NSm-Gn-Gc
  source 1..3480: mol_type = other RNA

SEQ ID NO: 16120 - RNA, 3480 nt, synthetic construct; identical to SEQ ID NO: 14477
  misc_feature 1..3480: note = derived and/or modified CDS sequence (opt11) from RVFV(BIME-01)__KX609032.1__NSm-Gn-Gc
  source 1..3480: mol_type = other RNA

SEQ ID NO: 16121 - RNA, 3480 nt, synthetic construct; identical to SEQ ID NO: 14478
  misc_feature 1..3480: note = derived and/or modified CDS sequence (opt11) from RVFV(200803166)__JF311381.1__NSm-Gn-Gc
  source 1..3480: mol_type = other RNA

SEQ ID NO: 16122 - RNA, 3480 nt, synthetic construct; identical to SEQ ID NO: 14479
  misc_feature 1..3480: note = derived and/or modified CDS sequence (opt11) from RVFV(Kenya 83 (21445))__DQ380198.1__NSm-Gn-Gc
  source 1..3480: mol_type = other RNA

SEQ ID NO: 16123 - RNA, 3480 nt, synthetic construct; identical to SEQ ID NO: 14480
  misc_feature 1..3480: note = derived and/or modified CDS sequence (opt11) from RVFV(Entebbe)__DQ380191.1__NSm-Gn-Gc
  source 1..3480: mol_type = other RNA

SEQ ID NO: 16124 - RNA, 3480 nt, synthetic construct; identical to SEQ ID NO: 14481
  misc_feature 1..3480: note = derived and/or modified CDS sequence (opt11) from RVFV(763/70)__DQ380188.1__NSm-Gn-Gc
  source 1..3480: mol_type = other RNA

SEQ ID NO: 16125 - RNA, 3480 nt, synthetic construct; identical to SEQ ID NO: 14482
  misc_feature 1..3480: note = derived and/or modified CDS sequence (opt11) from RVFV(OS-1)__DQ380186.1__NSm-Gn-Gc
  source 1..3480: mol_type = other RNA

SEQ ID NO: 16126 - RNA, 3480 nt, synthetic construct; identical to SEQ ID NO: 14483
  misc_feature 1..3480: note = derived and/or modified CDS sequence (opt11) from RVFV(2008/00101)__HE687306.1__NSm-Gn-Gc
  source 1..3480: mol_type = other RNA

SEQ ID NO: 16127 - RNA, 3480 nt, synthetic construct; identical to SEQ ID NO: 14484
  misc_feature 1..3480: note = derived and/or modified CDS sequence (opt11) from RVFV(200803162)__JF311377.1__NSm-Gn-Gc
  source 1..3480: mol_type = other RNA

SEQ ID NO: 16128 - RNA, 3480 nt, synthetic construct; identical to SEQ ID NO: 14485
  misc_feature 1..3480: note = derived and/or modified CDS sequence (opt11) from RVFV(2007002060)__EU574039.1__NSm-Gn-Gc
  source 1..3480: mol_type = other RNA

SEQ ID NO: 16129 - RNA, 3480 nt, synthetic construct; identical to SEQ ID NO: 14486
  misc_feature 1..3480: note = derived and/or modified CDS sequence (opt11) from RVFV(2007002476)__EU574036.1__NSm-Gn-Gc
  source 1..3480: mol_type = other RNA

SEQ ID NO: 16130 - RNA, 3480 nt, synthetic construct; identical to SEQ ID NO: 14487
  misc_feature 1..3480: note = derived and/or modified CDS sequence (opt11) from RVFV(2269/74)__DQ380222.1__NSm-Gn-Gc
  source 1..3480: mol_type = other RNA

SEQ ID NO: 16131 - RNA, 3480 nt, synthetic construct; identical to SEQ ID NO: 14488
  misc_feature 1..3480: note = derived and/or modified CDS sequence (opt11) from RVFV(73HB1449)__DQ380211.1__NSm-Gn-Gc
  source 1..3480: mol_type = other RNA

SEQ ID NO: 16132 - RNA, 3480 nt, synthetic construct; identical to SEQ ID NO: 14489
  misc_feature 1..3480: note = derived and/or modified CDS sequence (opt11) from RVFV(SA-51 (Van Wyck))__DQ380195.1__NSm-Gn-Gc
  source 1..3480: mol_type = other RNA

SEQ ID NO: 16133 - RNA, 3480 nt, synthetic construct; identical to SEQ ID NO: 14490
  misc_feature 1..3480: note = derived and/or modified CDS sequence (opt11) from RVFV(KEN/Gar-Msq/131B-04/06)__HM586972.1__NSm-Gn-Gc
  source 1..3480: mol_type = other RNA

SEQ ID NO: 16134 - RNA, 3480 nt, synthetic construct; identical to SEQ ID NO: 14491
  misc_feature 1..3480: note = derived and/or modified CDS sequence (opt11) from RVFV(2007001107)__EU574047.1__NSm-Gn-Gc
  source 1..3480: mol_type = other RNA

SEQ ID NO: 16135 - RNA, 3480 nt, synthetic construct; identical to SEQ ID NO: 14492
  misc_feature 1..3480: note = derived and/or modified CDS sequence (opt11) from RVFV(ANK-3837)__DQ380215.1__NSm-Gn-Gc
  source 1..3480: mol_type = other RNA

SEQ ID NO: 16136 - RNA, 3480 nt, synthetic construct; identical to SEQ ID NO: 14493
  misc_feature 1..3480: note = derived and/or modified CDS sequence (opt11) from RVFV(Lunyo)__KU167026.1__NSm-Gn-Gc
  source 1..3480: mol_type = other RNA

SEQ ID NO: 16137 - RNA, 3480 nt, synthetic construct; identical to SEQ ID NO: 14494
  misc_feature 1..3480: note = derived and/or modified CDS sequence (opt11) from RVFV(RVFBJ01/2016)__KX785331.1__NSm-Gn-Gc
  source 1..3480: mol_type = other RNA

SEQ ID NO: 16138 - RNA, 3480 nt, synthetic construct; identical to SEQ ID NO: 14495
  misc_feature 1..3480: note = derived and/or modified CDS sequence (opt11) from RVFV(Ken 199800523)__KU978777.1__NSm-Gn-Gc
  source 1..3480: mol_type = other RNA

SEQ ID NO: 16139 - RNA, 3480 nt, synthetic construct; identical to SEQ ID NO: 14496
  misc_feature 1..3480: note = derived and/or modified CDS sequence (opt11) from RVFV__JQ068143.1__NSm-Gn-Gc
  source 1..3480: mol_type = other RNA

SEQ ID NO: 16140 - RNA, 3480 nt, synthetic construct; identical to SEQ ID NO: 14497
  misc_feature 1..3480: note = derived and/or modified CDS sequence (opt11) from RVFV(200803169)__JF311384.1__NSm-Gn-Gc
  source 1..3480: mol_type = other RNA

SEQ ID NO: 16141 - RNA, 3480 nt, synthetic construct; identical to SEQ ID NO: 14498
  misc_feature 1..3480: note = derived and/or modified CDS sequence (opt11) from RVFV(2007002445)__EU574037.1__NSm-Gn-Gc
  source 1..3480: mol_type = other RNA

SEQ ID NO: 16142 - RNA, 3480 nt, synthetic construct; identical to SEQ ID NO: 14499
  misc_feature 1..3480: note = derived and/or modified CDS sequence (opt11) from RVFV(Hv-B375)__DQ380218.1__NSm-Gn-Gc
  source 1..3480: mol_type = other RNA

SEQ ID NO: 16143 - RNA, 3480 nt, synthetic construct; identical to SEQ ID NO: 14500
  misc_feature 1..3480: note = derived and/or modified CDS sequence (opt11) from RVFV(clone 13)__DQ380213.1__NSm-Gn-Gc
  source 1..3480: mol_type = other RNA

SEQ ID NO: 16144 - RNA, 3480 nt, synthetic construct; identical to SEQ ID NO: 14501
  misc_feature 1..3480: note = derived and/or modified CDS sequence (opt11) from RVFV(Kenya 57 (Rintoul))__DQ380192.1__NSm-Gn-Gc
  source 1..3480: mol_type = other RNA

SEQ ID NO: 16145 - RNA, 3480 nt, synthetic construct; identical to SEQ ID NO: 14502
  misc_feature 1..3480: note = derived and/or modified CDS sequence (opt11) from RVFV(2007001292)__EU574046.1__NSm-Gn-Gc
  source 1..3480: mol_type = other RNA

SEQ ID NO: 16146 - RNA, 3480 nt, synthetic construct; identical to SEQ ID NO: 14503
  misc_feature 1..3480: note = derived and/or modified CDS sequence (opt11) from RVFV(2007001811)__EU574040.1__NSm-Gn-Gc
  source 1..3480: mol_type = other RNA

SEQ ID NO: 16147 - RNA, 3480 nt, synthetic construct; identical to SEQ ID NO: 14504
  misc_feature 1..3480: note = derived and/or modified CDS sequence (opt11) from RVFV(ANK-6087)__DQ380216.1__NSm-Gn-Gc
  source 1..3480: mol_type = other RNA

SEQ ID NO: 16148 - RNA, 3480 nt, synthetic construct; identical to SEQ ID NO: 14505
  misc_feature 1..3480: note = derived and/or modified CDS sequence (opt11) from RVFV(2007000234)__JF326191.1__NSm-Gn-Gc
  source 1..3480: mol_type = other RNA

SEQ ID NO: 16149 - RNA, 3480 nt, synthetic construct; identical to SEQ ID NO: 14506
  misc_feature 1..3480: note = derived and/or modified CDS sequence (opt11) from RVFV(SA-75)__DQ380189.1__NSm-Gn-Gc
  source 1..3480: mol_type = other RNA

SEQ ID NO: 16150 - RNA, 3480 nt, synthetic construct; identical to SEQ ID NO: 14507
  misc_feature 1..3480: note = derived and/or modified CDS sequence (opt11) from RVFV(KEN07-KUR340)__EF460404.1__NSm-Gn-Gc
  source 1..3480: mol_type = other RNA

SEQ ID NO: 16151 - RNA, 3480 nt, synthetic construct; identical to SEQ ID NO: 14508
  misc_feature 1..3480: note = derived and/or modified CDS sequence (opt11) from RVFV(35/74)__JF784387.1__NSm-Gn-Gc
  source 1..3480: mol_type = other RNA

SEQ ID NO: 16152 - RNA, 3480 nt, synthetic construct; identical to SEQ ID NO: 14509
  misc_feature 1..3480: note = derived and/or modified CDS sequence (opt11) from RVFV(200803167)__JF311382.1__NSm-Gn-Gc
  source 1..3480: mol_type = other RNA

SEQ ID NO: 16153 - RNA, 3480 nt, synthetic construct; identical to SEQ ID NO: 14510
  misc_feature 1..3480: note = derived and/or modified CDS sequence (opt11) from RVFV(25010-24)__KM210509.1__NSm-Gn-Gc
  source 1..3480: mol_type = other RNA

SEQ ID NO: 16154 - RNA, 3480 nt, synthetic construct; identical to SEQ ID NO: 14511
  misc_feature 1..3480: note = derived and/or modified CDS sequence (opt11) from RVFV(Sudan 2V-2007)__JQ820490.1__NSm-Gn-Gc
  source 1..3480: mol_type = other RNA

SEQ ID NO: 16155 - RNA, 3480 nt, synthetic construct; identical to SEQ ID NO: 14512
  misc_feature 1..3480: note = derived and/or modified CDS sequence (opt11) from RVFV(SAUDI 200010901)__KU978778.1__NSm-Gn-Gc
  source 1..3480: mol_type = other RNA

SEQ ID NO: 16156 - RNA, 3480 nt, synthetic construct; identical to SEQ ID NO: 14513
  misc_feature 1..3480: note = derived and/or modified CDS sequence (opt11) from RVFV(2373/74)__DQ380194.1__NSm-Gn-Gc
  source 1..3480: mol_type = other RNA

SEQ ID NO: 16157 - RNA, 3480 nt, synthetic construct; identical to SEQ ID NO: 14514
  misc_feature 1..3480: note = derived and/or modified CDS sequence (opt11) from RVFV(KEN/Kil-006/07)__HM586966.1__NSm-Gn-Gc
  source 1..3480: mol_type = other RNA

SEQ ID NO: 16158 - RNA, 3480 nt, synthetic construct; identical to SEQ ID NO: 14515
  misc_feature 1..3480: note = derived and/or modified CDS sequence (opt11) from RVFV(MgH824)__DQ380210.1__NSm-Gn-Gc
  source 1..3480: mol_type = other RNA

SEQ ID NO: 16159 - RNA, 3480 nt, synthetic construct; identical to SEQ ID NO: 14516
  misc_feature 1..3480: note = derived and/or modified CDS sequence (opt11) from RVFV(SA01-1322)__KX096942.1__NSm-Gn-Gc
  source 1..3480: mol_type = other RNA

SEQ ID NO: 16160 - RNA, 3480 nt, synthetic construct; identical to SEQ ID NO: 14517
  misc_feature 1..3480: note = derived and/or modified CDS sequence (opt11) from RVFV(Kenya 56 (IB8))__DQ380190.1__NSm-Gn-Gc
  source 1..3480: mol_type = other RNA

SEQ ID NO: 16161 - RNA, 3480 nt, synthetic construct; identical to SEQ ID NO: 14518
  misc_feature 1..3480: note = derived and/or modified CDS sequence (opt11) from RVFV(KEN/Mal-032/07)__HM586967.1__NSm-Gn-Gc
  source 1..3480: mol_type = other RNA

SEQ ID NO: 16162 - RNA, 3480 nt, synthetic construct; identical to SEQ ID NO: 14519
  misc_feature 1..3480: note = derived and/or modified CDS sequence (opt11) from RVFV(KEN/Gar-008/06)__HM586965.1__NSm-Gn-Gc
  source 1..3480: mol_type = other RNA

SEQ ID NO: 16163 - RNA, 3480 nt, synthetic construct; identical to SEQ ID NO: 14520
  misc_feature 1..3480: note = derived and/or modified CDS sequence (opt11) from RVFV(Beijing-01)__KX611606.1__NSm-Gn-Gc
  source 1..3480: mol_type = other RNA

SEQ ID NO: 16164 - RNA, 3480 nt, synthetic construct; identical to SEQ ID NO: 14521
  misc_feature 1..3480: note = derived and/or modified CDS sequence (opt11) from RVFV(KEN/Bar-035/07)__HM586969.1__NSm-Gn-Gc
  source 1..3480: mol_type = other RNA

SEQ ID NO: 16165 - RNA, 3480 nt, synthetic construct; identical to SEQ ID NO: 14522
  misc_feature 1..3480: note = derived and/or modified CDS sequence (opt11) from RVFV(KEN/Bar-032/07)__HM586968.1__NSm-Gn-Gc
  source 1..3480: mol_type = other RNA

SEQ ID NO: 16166 - RNA, 3480 nt, synthetic construct; identical to SEQ ID NO: 14523
  misc_feature 1..3480: note = derived and/or modified CDS sequence (opt11) from RVFV(TAN/Dod-002/07)__HM586971.1__NSm-Gn-Gc
  source 1..3480: mol_type = other RNA

SEQ ID NO: 16167 - RNA, 3480 nt, synthetic construct; identical to SEQ ID NO: 14524
  misc_feature 1..3480: note = derived and/or modified CDS sequence (opt11) from RVFV(Smithburn)__DQ380193.1__NSm-Gn-Gc
  source 1..3480: mol_type = other RNA

SEQ ID NO: 16168 - RNA, 3480 nt, synthetic construct; identical to SEQ ID NO: 14525
  misc_feature 1..3480: note = derived and/or modified CDS sequence (opt11) from RVFV(KEN/Gar-004/06)__HM586964.1__NSm-Gn-Gc
  source 1..3480: mol_type = other RNA

SEQ ID NO: 16169 - RNA, 3204 nt, synthetic construct; identical to SEQ ID NO: 14526
  misc_feature 1..3204: note = derived and/or modified CDS sequence (opt11) from RVFV(ZH-548)__DQ380206.1__Gn-Gc
  source 1..3204: mol_type = other RNA

SEQ ID NO: 16170 - RNA, 3204 nt, synthetic construct; identical to SEQ ID NO: 14527
  misc_feature 1..3204: note = derived and/or modified CDS sequence (opt11) from RVFV(2007000094)__EU574055.1__Gn-Gc
  source 1..3204: mol_type = other RNA

SEQ ID NO: 16171 - RNA, 3204 nt, synthetic construct; identical to SEQ ID NO: 14528
  misc_feature 1..3204: note = derived and/or modified CDS sequence (opt11) from RVFV(ZH-548M12)__M25276.1__Gn-Gc
  source 1..3204: mol_type = other RNA

SEQ ID NO: 16172 - RNA, 3204 nt, synthetic construct; identical to SEQ ID NO: 14529
  misc_feature 1..3204: note = derived and/or modified CDS sequence (opt11) from RVFV(Sudan 86-2010)__JQ820489.1__Gn-Gc
  source 1..3204: mol_type = other RNA

SEQ ID NO: 16173 - RNA, 3204 nt, synthetic construct; identical to SEQ ID NO: 14530
  misc_feature 1..3204: note = derived and/or modified CDS sequence (opt11) from RVFV(ZS-6365)__DQ380205.1__Gn-Gc
  source 1..3204: mol_type = other RNA

SEQ ID NO: 16174 - RNA, 3204 nt, synthetic construct; identical to SEQ ID NO: 14531
  misc_feature 1..3204: note = derived and/or modified CDS sequence (opt11) from RVFV(1853/78)__DQ380220.1__Gn-Gc
  source 1..3204: mol_type = other RNA

SEQ ID NO: 16175 - RNA, 3204 nt, synthetic construct; identical to SEQ ID NO: 14532
  misc_feature 1..3204: note = derived and/or modified CDS sequence (opt11) from RVFV(T1)__DQ380201.1__Gn-Gc
  source 1..3204: mol_type = other RNA

SEQ ID NO: 16176 - RNA, 3204 nt, synthetic construct; identical to SEQ ID NO: 14533
  misc_feature 1..3204: note = derived and/or modified CDS sequence (opt11) from RVFV(Kenya 83 (21445))__DQ380198.1__Gn-Gc
  source 1..3204: mol_type = other RNA

SEQ ID NO: 16177 - RNA, 3204 nt, synthetic construct; identical to SEQ ID NO: 14534
  misc_feature 1..3204: note = derived and/or modified CDS sequence (opt11) from RVFV(Sudan 85-2010)__JQ820488.1__Gn-Gc
  source 1..3204: mol_type = other RNA

SEQ ID NO: 16178 - RNA, 3204 nt, synthetic construct; identical to SEQ ID NO: 14535
  misc_feature 1..3204: note = derived and/or modified CDS sequence (opt11) from RVFV(2007004194)__EU574031.1__Gn-Gc
  source 1..3204: mol_type = other RNA

SEQ ID NO: 16179 - RNA, 3204 nt, synthetic construct; identical to SEQ ID NO: 14536
  misc_feature 1..3204: note = derived and/or modified CDS sequence (opt11) from RVFV(2250/74)__DQ380209.1__Gn-Gc
  source 1..3204: mol_type = other RNA

SEQ ID NO: 16180 - RNA, 3204 nt, synthetic construct; identical to SEQ ID NO: 14537
  misc_feature 1..3204: note = derived and/or modified CDS sequence (opt11) from RVFV(Sudan 28-2010)__JQ820491.1__Gn-Gc
  source 1..3204: mol_type = other RNA

SEQ ID NO: 16181 - RNA, 3204 nt, synthetic construct; identical to SEQ ID NO: 14538
  misc_feature 1..3204: note = derived and/or modified CDS sequence (opt11) from RVFV(2007000324)__JF326195.1__Gn-Gc
  source 1..3204: mol_type = other RNA

SEQ ID NO: 16182 - RNA, 3204 nt, synthetic construct; identical to SEQ ID NO: 14539
  misc_feature 1..3204: note = derived and/or modified CDS sequence (opt11) from RVFV(ZM-657)__DQ380204.1__Gn-Gc
  source 1..3204: mol_type = other RNA

SEQ ID NO: 16183 - RNA, 3204 nt, synthetic construct; identical to SEQ ID NO: 14540
  misc_feature 1..3204: note = derived and/or modified CDS sequence (opt11) from RVFV(T-46 (228113))__DQ380199.1__Gn-Gc
  source 1..3204: mol_type = other RNA

SEQ ID NO: 16184 - RNA, 3204 nt, synthetic construct; identical to SEQ ID NO: 14541
  misc_feature 1..3204: note = derived and/or modified CDS sequence (opt11) from RVFV(MP12)__Z30318.1__Gn-Gc
  source 1..3204: mol_type = other RNA

SEQ ID NO: 16185 - RNA, 3204 nt, synthetic construct; identical to SEQ ID NO: 14542
  misc_feature 1..3204: note = derived and/or modified CDS sequence (opt11) from RVFV(200803166)__JF311381.1__Gn-Gc
  source 1..3204: mol_type = other RNA

SEQ ID NO: 16186 - RNA, 3204 nt, synthetic construct; identical to SEQ ID NO: 14543
  misc_feature 1..3204: note = derived and/or modified CDS sequence (opt11) from RVFV(200803162)__JF311377.1__Gn-Gc
  source 1..3204: mol_type = other RNA

SEQ ID NO: 16187 - RNA, 3204 nt, synthetic construct; identical to SEQ ID NO: 14544
  misc_feature 1..3204: note = derived and/or modified CDS sequence (opt11) from RVFV(Hv-B375)__DQ380218.1__Gn-Gc
  source 1..3204: mol_type = other RNA

SEQ ID NO: 16188 - RNA, 3204 nt, synthetic construct; identical to SEQ ID NO: 14545
  misc_feature 1..3204: note = derived and/or modified CDS sequence (opt11) from RVFV(1260/78)__DQ380214.1__Gn-Gc
  source 1..3204: mol_type = other RNA

SEQ ID NO: 16189 - RNA, 3204 nt, synthetic construct; identical to SEQ ID NO: 14546
  misc_feature 1..3204: note = derived and/or modified CDS sequence (opt11) from RVFV(ZH-501-777)__DQ380202.1__Gn-Gc
  source 1..3204: mol_type = other RNA

SEQ ID NO: 16190 - RNA, 3204 nt, synthetic construct; identical to SEQ ID NO: 14547
  misc_feature 1..3204: note = derived and/or modified CDS sequence (opt11) from RVFV(OS-3)__DQ380184.1__Gn-Gc
  source 1..3204: mol_type = other RNA

SEQ ID NO: 16191 - RNA, 3204 nt, synthetic construct; identical to SEQ ID NO: 14548
  misc_feature 1..3204: note = derived and/or modified CDS sequence (opt11) from RVFV(SAUDI 200010901)__KU978778.1__Gn-Gc
  source 1..3204: mol_type = other RNA

SEQ ID NO: 16192 - RNA, 3204 nt, synthetic construct; identical to SEQ ID NO: 14549
  misc_feature 1..3204: note = derived and/or modified CDS sequence (opt11) from RVFV(2007001811)__EU574040.1__Gn-Gc
  source 1..3204: mol_type = other RNA

SEQ ID NO: 16193 - RNA, 3204 nt, synthetic construct; identical to SEQ ID NO: 14550
  misc_feature 1..3204: note = derived and/or modified CDS sequence (opt11) from RVFV(2007000253)__JF326192.1__Gn-Gc
  source 1..3204: mol_type = other RNA

SEQ ID NO: 16194 - RNA, 3204 nt, synthetic construct; identical to SEQ ID NO: 14551
  misc_feature 1..3204: note = derived and/or modified CDS sequence (opt11) from RVFV(2007001292)__EU574046.1__Gn-Gc
  source 1..3204: mol_type = other RNA

SEQ ID NO: 16195 - RNA, 3204 nt, synthetic construct; identical to SEQ ID NO: 14552
  misc_feature 1..3204: note = derived and/or modified CDS sequence (opt11) from RVFV(2007002476)__EU574036.1__Gn-Gc
  source 1..3204: mol_type = other RNA

SEQ ID NO: 16196 - RNA, 3204 nt, synthetic construct; identical to SEQ ID NO: 14553
  misc_feature 1..3204: note = derived and/or modified CDS sequence (opt11) from RVFV(73HB1230)__DQ380221.1__Gn-Gc
  source 1..3204: mol_type = other RNA

SEQ ID NO: 16197 - RNA, 3204 nt, synthetic construct; identical to SEQ ID NO: 14554
  misc_feature 1..3204: note = derived and/or modified CDS sequence (opt11) from RVFV(ZINGA J83 R1)__KU978776.1__Gn-Gc
  source 1..3204: mol_type = other RNA

SEQ ID NO: 16198 - RNA, 3204 nt, synthetic construct; identical to SEQ ID NO: 14555
  misc_feature 1..3204: note = derived and/or modified CDS sequence (opt11) from RVFV(2008/00101)__HE687306.1__Gn-Gc
  source 1..3204: mol_type = other RNA

SEQ ID NO: 16199 - RNA, 3204 nt, synthetic construct; identical to SEQ ID NO: 14556
  misc_feature 1..3204: note = derived and/or modified CDS sequence (opt11) from RVFV(2007002445)__EU574037.1__Gn-Gc
  source 1..3204: mol_type = other RNA

SEQ ID NO: 16200 - RNA, 3204 nt, synthetic construct; identical to SEQ ID NO: 14557
  misc_feature 1..3204: note = derived and/or modified CDS sequence (opt11) from RVFV(ZC-3349)__DQ380207.1__Gn-Gc
  source 1..3204: mol_type = other RNA

SEQ ID NO: 16201 - RNA, 3204 nt, synthetic construct; identical to SEQ ID NO: 14558
  misc_feature 1..3204: note = derived and/or modified CDS sequence (opt11) from RVFV(Kenya 9800523)__DQ380196.1__Gn-Gc
  source 1..3204: mol_type = other RNA

SEQ ID NO: 16202 - RNA, 3204 nt, synthetic construct; identical to SEQ ID NO: 14559
  misc_feature 1..3204: note = derived and/or modified CDS sequence (opt11) from RVFV(Entebbe)__DQ380191.1__Gn-Gc
  source 1..3204: mol_type = other RNA

SEQ ID NO: 16203 - RNA, 3204 nt, synthetic construct; identical to SEQ ID NO: 14560
  misc_feature 1..3204: note = derived and/or modified CDS sequence (opt11) from RVFV(25010-24)__KM210509.1__Gn-Gc
  source 1..3204: mol_type = other RNA

SEQ ID NO: 16204 - RNA, 3204 nt, synthetic construct; identical to SEQ ID NO: 14561
  misc_feature 1..3204: note = derived and/or modified CDS sequence (opt11) from RVFV(763/70)__DQ380188.1__Gn-Gc
  source 1..3204: mol_type = other RNA

SEQ ID NO: 16205 - RNA, 3204 nt, synthetic construct; identical to SEQ ID NO: 14562
  misc_feature 1..3204: note = derived and/or modified CDS sequence (opt11) from RVFV(OS-1)__DQ380186.1__Gn-Gc
  source 1..3204: mol_type = other RNA

SEQ ID NO: 16206 - RNA, 3204 nt, synthetic construct; identical to SEQ ID NO: 14563
  misc_feature 1..3204: note = derived and/or modified CDS sequence (opt11) from RVFV(BIME-01)__KX609032.1__Gn-Gc
  source 1..3204: mol_type = other RNA

SEQ ID NO: 16207 - RNA, 3204 nt, synthetic construct; identical to SEQ ID NO: 14564
  misc_feature 1..3204: note = derived and/or modified CDS sequence (opt11) from RVFV(73HB1449)__DQ380211.1__Gn-Gc
  source 1..3204: mol_type = other RNA

SEQ ID NO: 16208 - RNA, 3204 nt, synthetic construct; identical to SEQ ID NO: 14565
  misc_feature 1..3204: note = derived and/or modified CDS sequence (opt11) from RVFV(SA01-1322)__KX096942.1__Gn-Gc
  source 1..3204: mol_type = other RNA

SEQ ID NO: 16209 - RNA, 3204 nt, synthetic construct; identical to SEQ ID NO: 14566
  misc_feature 1..3204: note = derived and/or modified CDS sequence (opt11) from RVFV(Sudan 2V-2007)__JQ820490.1__Gn-Gc
  source 1..3204: mol_type = other RNA

SEQ ID NO: 16210 - RNA, 3204 nt, synthetic construct; identical to SEQ ID NO: 14567
  misc_feature 1..3204: note = derived and/or modified CDS sequence (opt11) from RVFV(35/74)__JF784387.1__Gn-Gc
  source 1..3204: mol_type = other RNA

SEQ ID NO: 16211 - RNA, 3204 nt, synthetic construct; identical to SEQ ID NO: 14568
  misc_feature 1..3204: note = derived and/or modified CDS sequence (opt11) from RVFV(200803169)__JF311384.1__Gn-Gc
  source 1..3204: mol_type = other RNA

SEQ ID NO: 16212 - RNA, 3204 nt, synthetic construct; identical to SEQ ID NO: 14569
  misc_feature 1..3204: note = derived and/or modified CDS sequence (opt11) from RVFV(2269/74)__DQ380222.1__Gn-Gc
  source 1..3204: mol_type = other RNA

SEQ ID NO: 16213 - RNA, 3204 nt, synthetic construct; identical to SEQ ID NO: 14570
  misc_feature 1..3204: note = derived and/or modified CDS sequence (opt11) from RVFV(SA-51 (Van Wyck))__DQ380195.1__Gn-Gc
  source 1..3204: mol_type = other RNA

SEQ ID NO: 16214 - RNA, 3204 nt, synthetic construct; identical to SEQ ID NO: 14571
  misc_feature 1..3204: note = derived and/or modified CDS sequence (opt11) from RVFV(OS-8)__DQ380185.1__Gn-Gc
  source 1..3204: mol_type = other RNA

SEQ ID NO: 16215 - RNA, 3204 nt, synthetic construct; identical to SEQ ID NO: 14572
  misc_feature 1..3204: note = derived and/or modified CDS sequence (opt11) from RVFV(KEN07-KUR340)__EF460404.1__Gn-Gc
  source 1..3204: mol_type = other RNA

SEQ ID NO: 16216 - RNA, 3204 nt, synthetic construct; identical to SEQ ID NO: 14573
  misc_feature 1..3204: note = derived and/or modified CDS sequence (opt11) from RVFV(ANK-3837)__DQ380215.1__Gn-Gc
  source 1..3204: mol_type = other RNA

SEQ ID NO: 16217 - RNA, 3204 nt, synthetic construct; identical to SEQ ID NO: 14574
  misc_feature 1..3204: note = derived and/or modified CDS sequence (opt11) from RVFV(Lunyo)__KU167026.1__Gn-Gc
  source 1..3204: mol_type = other RNA

SEQ ID NO: 16218 - RNA, 3204 nt, synthetic construct; identical to SEQ ID NO: 14575
  misc_feature 1..3204: note = derived and/or modified CDS sequence (opt11) from RVFV(200803167)__JF311382.1__Gn-Gc
  source 1..3204: mol_type = other RNA

SEQ ID NO: 16219 - RNA, 3204 nt, synthetic construct; identical to SEQ ID NO: 14576
  misc_feature 1..3204: note = derived and/or modified CDS sequence (opt11) from RVFV(2373/74)__DQ380194.1__Gn-Gc
  source 1..3204: mol_type = other RNA

SEQ ID NO: 16220 - RNA, 3204 nt, synthetic construct; identical to SEQ ID NO: 14577
  misc_feature 1..3204: note = derived and/or modified CDS sequence (opt11) from RVFV(Kenya 57 (Rintoul))__DQ380192.1__Gn-Gc
  source 1..3204: mol_type = other RNA

SEQ ID NO: 16221 - RNA, 3204 nt, synthetic construct; identical to SEQ ID NO: 14578
  misc_feature 1..3204: note = derived and/or modified CDS sequence (opt11) from RVFV(RVFBJ01/2016)__KX785331.1__Gn-Gc
  source 1..3204: mol_type = other RNA

SEQ ID NO: 16222 - RNA, 3204 nt, synthetic construct; identical to SEQ ID NO: 14579
  misc_feature 1..3204: note = derived and/or modified CDS sequence (opt11) from RVFV(clone 13)__DQ380213.1__Gn-Gc
  source 1..3204: mol_type = other RNA

SEQ ID NO: 16223 - RNA, 3204 nt, synthetic construct; identical to SEQ ID NO: 14580
  misc_feature 1..3204: note = derived and/or modified CDS sequence (opt11) from RVFV__JQ068143.1__Gn-Gc
  source 1..3204: mol_type = other RNA

SEQ ID NO: 16224 - RNA, 3204 nt, synthetic construct; identical to SEQ ID NO: 14581
  misc_feature 1..3204: note = derived and/or modified CDS sequence (opt11) from RVFV(SA-75)__DQ380189.1__Gn-Gc
  source 1..3204: mol_type = other RNA

SEQ ID NO: 16225 - RNA, 3204 nt, synthetic construct; identical to SEQ ID NO: 14582
  misc_feature 1..3204: note = derived and/or modified CDS sequence (opt11) from RVFV(ANK-6087)__DQ380216.1__Gn-Gc
  source 1..3204: mol_type = other RNA

SEQ ID NO: 16226 - RNA, 3204 nt, synthetic construct; identical to SEQ ID NO: 14583
  misc_feature 1..3204: note = derived and/or modified CDS sequence (opt11) from RVFV(KEN/Kil-006/07)__HM586966.1__Gn-Gc
  source 1..3204: mol_type = other RNA

SEQ ID NO: 16227 - RNA, 3204 nt, synthetic construct; identical to SEQ ID NO: 14584
  misc_feature 1..3204: note = derived and/or modified CDS sequence (opt11) from RVFV(MgH824)__DQ380210.1__Gn-Gc
  source 1..3204: mol_type = other RNA

SEQ ID NO: 16228 - RNA, 3204 nt, synthetic construct; identical to SEQ ID NO: 14585
  misc_feature 1..3204: note = derived and/or modified CDS sequence (opt11) from RVFV(KEN/Mal-032/07)__HM586967.1__Gn-Gc
  source 1..3204: mol_type = other RNA

SEQ ID NO: 16229 - RNA, 3204 nt, synthetic construct; identical to SEQ ID NO: 14586
  misc_feature 1..3204: note = derived and/or modified CDS sequence (opt11) from RVFV(Kenya 56 (IB8))__DQ380190.1__Gn-Gc
  source 1..3204: mol_type = other RNA

SEQ ID NO: 16230 - RNA, 3204 nt, synthetic construct; identical to SEQ ID NO: 14587
  misc_feature 1..3204: note = derived and/or modified CDS sequence (opt11) from RVFV(KEN/Gar-008/06)__HM586965.1__Gn-Gc
  source 1..3204: mol_type = other RNA

SEQ ID NO: 16231 - RNA, 3204 nt, synthetic construct; identical to SEQ ID NO: 14588
  misc_feature 1..3204: note = derived and/or modified CDS sequence (opt11) from RVFV(KEN/Bar-035/07)__HM586969.1__Gn-Gc
  source 1..3204: mol_type = other RNA

SEQ ID NO: 16232 - RNA, 3204 nt, synthetic construct; identical to SEQ ID NO: 14589
  misc_feature 1..3204: note = derived and/or modified CDS sequence (opt11) from RVFV(Smithburn)__DQ380193.1__Gn-Gc
  source 1..3204: mol_type = other RNA

SEQ ID NO: 16233 - RNA, 3204 nt, synthetic construct; identical to SEQ ID NO: 14590
  misc_feature 1..3204: note = derived and/or modified CDS sequence (opt11) from RVFV(Beijing-01)__KX611606.1__Gn-Gc
  source 1..3204: mol_type = other RNA

SEQ ID NO: 16234 - RNA, 3204 nt, synthetic construct; identical to SEQ ID NO: 14591
  misc_feature 1..3204: note = derived and/or modified CDS sequence (opt11) from RVFV(KEN/Bar-032/07)__HM586968.1__Gn-Gc
  source 1..3204: mol_type = other RNA

SEQ ID NO: 16235 - RNA, 3204 nt, synthetic construct; identical to SEQ ID NO: 14592
  misc_feature 1..3204: note = derived and/or modified CDS sequence (opt11) from RVFV(TAN/Dod-002/07)__HM586971.1__Gn-Gc
  source 1..3204: mol_type = other RNA

SEQ ID NO: 16236 - RNA, 3204 nt, synthetic construct; identical to SEQ ID NO: 14593
  misc_feature 1..3204: note = derived and/or modified CDS sequence (opt11) from RVFV(KEN/Gar-004/06)__HM586964.1__Gn-Gc
  source 1..3204: mol_type = other RNA

SEQ ID NO: 16237 - RNA, 1680 nt, synthetic construct; identical to SEQ ID NO: 14594
  misc_feature 1..1680: note = derived and/or modified CDS sequence (opt11) from RVFV(ZH-548)__DQ380206.1__Gn
  source 1..1680: mol_type = other RNA

SEQ ID NO: 16238 - RNA, 1680 nt, synthetic construct; identical to SEQ ID NO: 14595
  misc_feature 1..1680: note = derived and/or modified CDS sequence (opt11) from RVFV(MP-12)__DQ380208.1__Gn
  source 1..1680: mol_type = other RNA

SEQ ID NO: 16239 - RNA, 1680 nt, synthetic construct; identical to SEQ ID NO: 14596
  misc_feature 1..1680: note = derived and/or modified CDS sequence (opt11) from RVFV(MP12)__Z30318.1__Gn
  source 1..1680: mol_type = other RNA

SEQ ID NO: 16240 - RNA, 1680 nt, synthetic construct; identical to SEQ ID NO: 14597
  misc_feature 1..1680: note = derived and/or modified CDS sequence (opt11) from RVFV(2007001811)__EU574040.1__Gn
  source 1..1680: mol_type = other RNA

SEQ ID NO: 16241 - RNA, 1680 nt, synthetic construct; identical to SEQ ID NO: 14598
  misc_feature 1..1680: note = derived and/or modified CDS sequence (opt11) from RVFV(2250/74)__DQ380209.1__Gn
  source 1..1680: mol_type = other RNA

SEQ ID NO: 16242 - RNA, 1680 nt, synthetic construct; identical to SEQ ID NO: 14599
  misc_feature 1..1680: note = derived and/or modified CDS sequence (opt11) from RVFV(T1)__DQ380201.1__Gn
  source 1..1680: mol_type = other RNA

SEQ ID NO: 16243 - RNA, 1680 nt, synthetic construct; identical to SEQ ID NO: 14600
  misc_feature 1..1680: note = derived and/or modified CDS sequence (opt11) from RVFV(Ken 199800523)__KU978777.1__Gn
  source 1..1680: mol_type = other RNA

SEQ ID NO: 16244 - RNA, 1680 nt, synthetic construct; identical to SEQ ID NO: 14601
  misc_feature 1..1680: note = derived and/or modified CDS sequence (opt11) from RVFV(1853/78)__DQ380220.1__Gn
  source 1..1680: mol_type = other RNA

SEQ ID NO: 16245 - RNA, 1680 nt, synthetic construct; identical to SEQ ID NO: 14602
  misc_feature 1..1680: note = derived and/or modified CDS sequence (opt11) from RVFV(73HB1449)__DQ380211.1__Gn
  source 1..1680: mol_type = other RNA

SEQ ID NO: 16246 - RNA, 1680 nt, synthetic construct; identical to SEQ ID NO: 14603
  misc_feature 1..1680: note = derived and/or modified CDS sequence (opt11) from RVFV(2007000234)__JF326191.1__Gn
  source 1..1680: mol_type = other RNA

SEQ ID NO: 16247 - RNA, 1680 nt, synthetic construct; identical to SEQ ID NO: 14604
  misc_feature 1..1680: note = derived and/or modified CDS sequence (opt11) from RVFV(73HB1230)__DQ380221.1__Gn
  source 1..1680: mol_type = other RNA

SEQ ID NO: 16248 - RNA, 1680 nt, synthetic construct; identical to SEQ ID NO: 14605
  misc_feature 1..1680: note = derived and/or modified CDS sequence (opt11) from RVFV(ZM-657)__DQ380204.1__Gn
  source 1..1680: mol_type = other RNA

SEQ ID NO: 16249 - RNA, 1680 nt, synthetic construct; identical to SEQ ID NO: 14606
  misc_feature 1..1680: note = derived and/or modified CDS sequence (opt11) from RVFV(Kenya 83 (21445))__DQ380198.1__Gn
  source 1..1680: mol_type = other RNA

SEQ ID NO: 16250 - RNA, 1680 nt, synthetic construct; identical to SEQ ID NO: 14607
  misc_feature 1..1680: note = derived and/or modified CDS sequence (opt11) from RVFV(SAUDI 200010901)__KU978778.1__Gn
  source 1..1680: mol_type = other RNA

SEQ ID NO: 16251 - RNA, 1680 nt, synthetic construct; identical to SEQ ID NO: 14608
  misc_feature 1..1680: note = derived and/or modified CDS sequence (opt11) from RVFV(2007004194)__EU574031.1__Gn
  source 1..1680: mol_type = other RNA

SEQ ID NO: 16252 - RNA, 1680 nt, synthetic construct; identical to SEQ ID NO: 14609
  misc_feature 1..1680: note = derived and/or modified CDS sequence (opt11) from RVFV(ZH-501-777)__DQ380202.1__Gn
  source 1..1680: mol_type = other RNA

SEQ ID NO: 16253 - RNA, 1680 nt, synthetic construct; identical to SEQ ID NO: 14610
  misc_feature 1..1680: note = derived and/or modified CDS sequence (opt11) from RVFV(ZC-3349)__DQ380207.1__Gn
  source 1..1680: mol_type = other RNA

SEQ ID NO: 16254 - RNA, 1680 nt, synthetic construct; identical to SEQ ID NO: 14611
  misc_feature 1..1680: note = derived and/or modified CDS sequence (opt11) from RVFV(200803166)__JF311381.1__Gn
  source 1..1680: mol_type = other RNA

SEQ ID NO: 16255 - RNA, 1680 nt, synthetic construct; identical to SEQ ID NO: 14612
  misc_feature 1..1680: note = derived and/or modified CDS sequence (opt11) from RVFV(1260/78)__DQ380214.1__Gn
  source 1..1680: mol_type = other RNA

SEQ ID NO: 16256 - RNA, 1680 nt, synthetic construct; identical to SEQ ID NO: 14613
  misc_feature 1..1680: note = derived and/or modified CDS sequence (opt11) from RVFV(T-46 (228113))__DQ380199.1__Gn
  source 1..1680: mol_type = other RNA

SEQ ID NO: 16257 - RNA, 1680 nt, synthetic construct; identical to SEQ ID NO: 14614
  misc_feature 1..1680: note = derived and/or modified CDS sequence (opt11) from RVFV(ZINGA J83 R1)__KU978776.1__Gn
  source 1..1680: mol_type = other RNA

SEQ ID NO: 16258 - RNA, 1680 nt, synthetic construct; identical to SEQ ID NO: 14615
  misc_feature 1..1680: note = derived and/or modified CDS sequence (opt11) from RVFV(clone 13)__DQ380213.1__Gn
  source 1..1680: mol_type = other RNA

SEQ ID NO: 16259 - RNA, 1680 nt, synthetic construct; identical to SEQ ID NO: 14616
  misc_feature 1..1680: note = derived and/or modified CDS sequence (opt11) from RVFV(SA01-1322)__KX096942.1__Gn
  source 1..1680: mol_type = other RNA

SEQ ID NO: 16260 - RNA, 1680 nt, synthetic construct; identical to SEQ ID NO: 14617
  misc_feature 1..1680: note = derived and/or modified CDS sequence (opt11) from RVFV(25010-24)__KM210509.1__Gn
  source 1..1680: mol_type = other RNA

SEQ ID NO: 16261 - RNA, 1680 nt, synthetic construct; identical to SEQ ID NO: 14618
  misc_feature 1..1680: note = derived and/or modified CDS sequence (opt11) from RVFV(200803162)__JF311377.1__Gn
  source 1..1680: mol_type = other RNA

SEQ ID NO: 16262 - RNA, 1680 nt, synthetic construct; identical to SEQ ID NO: 14619
  misc_feature 1..1680: note = derived and/or modified CDS sequence (opt11) from RVFV(2007002476)__EU574036.1__Gn
  source 1..1680: mol_type = other RNA

SEQ ID NO: 16263 - RNA, 1680 nt, synthetic construct; identical to SEQ ID NO: 14620
  misc_feature 1..1680: note = derived and/or modified CDS sequence (opt11) from RVFV(Hv-B375)__DQ380218.1__Gn
  source 1..1680: mol_type = other RNA

SEQ ID NO: 16264 - RNA, 1680 nt, synthetic construct; identical to SEQ ID NO: 14621
  misc_feature 1..1680: note = derived and/or modified CDS sequence (opt11) from RVFV(OS-1)__DQ380186.1__Gn
  source 1..1680: mol_type = other RNA

SEQ ID NO: 16265 - RNA, 1680 nt, synthetic construct; identical to SEQ ID NO: 14622
  misc_feature 1..1680: note = derived and/or modified CDS sequence (opt11) from RVFV(2373/74)__DQ380194.1__Gn
  source 1..1680: mol_type = other RNA

SEQ ID NO: 16266 - RNA, 1680 nt, synthetic construct; identical to SEQ ID NO: 14623
  misc_feature 1..1680: note = derived and/or modified CDS sequence (opt11) from RVFV(Kenya 57 (Rintoul))__DQ380192.1__Gn
  source 1..1680: mol_type = other RNA

SEQ ID NO: 16267 - RNA, 1680 nt, synthetic construct; identical to SEQ ID NO: 14624
  misc_feature 1..1680: note = derived and/or modified CDS sequence (opt11) from RVFV(Sudan 2V-2007)__JQ820490.1__Gn
  source 1..1680: mol_type = other RNA

SEQ ID NO: 16268 - RNA, 1680 nt, synthetic construct; identical to SEQ ID NO: 14625
  misc_feature 1..1680: note = derived and/or modified CDS sequence (opt11) from RVFV(200803167)__JF311382.1__Gn
  source 1..1680: mol_type = other RNA

SEQ ID NO: 16269 - RNA, 1680 nt, synthetic construct; identical to SEQ ID NO: 14626
  misc_feature 1..1680: note = derived and/or modified CDS sequence (opt11) from RVFV(KEN/Gar-008/06)__HM586965.1__Gn
  source 1..1680: mol_type = other RNA

SEQ ID NO: 16270 - RNA, 1680 nt, synthetic construct; identical to SEQ ID NO: 14627
  misc_feature 1..1680: note = derived and/or modified CDS sequence (opt11) from RVFV(ANK-6087)__DQ380216.1__Gn
  source 1..1680: mol_type = other RNA

SEQ ID NO: 16271 - RNA, 1680 nt, synthetic construct; identical to SEQ ID NO: 14628
  misc_feature 1..1680: note = derived and/or modified CDS sequence (opt11) from RVFV(763/70)__DQ380188.1__Gn
  source 1..1680: mol_type = other RNA

SEQ ID NO: 16272 - RNA, 1680 nt, synthetic construct; identical to SEQ ID NO: 14629
  misc_feature 1..1680: note = derived and/or modified CDS sequence (opt11) from RVFV(BIME-01)__KX609032.1__Gn
  source 1..1680: mol_type = other RNA

SEQ ID NO: 16273 - RNA, 1680 nt, synthetic construct; identical to SEQ ID NO: 14630
  misc_feature 1..1680: note = derived and/or modified CDS sequence (opt11) from RVFV(KEN07-KUR340)__EF460404.1__Gn
  source 1..1680: mol_type = other RNA

SEQ ID NO: 16274 - RNA, 1680 nt, synthetic construct; identical to SEQ ID NO: 14631
  misc_feature 1..1680: note = derived and/or modified CDS sequence (opt11) from RVFV(SA-51 (Van Wyck))__DQ380195.1__Gn
  source 1..1680: mol_type = other RNA

SEQ ID NO: 16275 - RNA, 1680 nt, synthetic construct; identical to SEQ ID NO: 14632
  misc_feature 1..1680: note = derived and/or modified CDS sequence (opt11) from RVFV(Lunyo)__KU167026.1__Gn
  source 1..1680: mol_type = other RNA

SEQ ID NO: 16276 - RNA, 1680 nt, synthetic construct; identical to SEQ ID NO: 14633
  misc_feature 1..1680: note = derived and/or modified CDS sequence (opt11) from RVFV(2269/74)__DQ380222.1__Gn
  source 1..1680: mol_type = other RNA

SEQ ID NO: 16277 - RNA, 1680 nt, synthetic construct; identical to SEQ ID NO: 14634
  misc_feature 1..1680: note = derived and/or modified CDS sequence (opt11) from RVFV(MgH824)__DQ380210.1__Gn
  source 1..1680: mol_type = other RNA

SEQ ID NO: 16278 - RNA, 1680 nt, synthetic construct; identical to SEQ ID NO: 14635
  misc_feature 1..1680: note = derived and/or modified CDS sequence (opt11) from RVFV__JQ068143.1__Gn
  source 1..1680: mol_type = other RNA

SEQ ID NO: 16279 - RNA, 1680 nt, synthetic construct; identical to SEQ ID NO: 14636
  misc_feature 1..1680: note = derived and/or modified CDS sequence (opt11) from RVFV(RVFBJ01/2016)__KX785331.1__Gn
  source 1..1680: mol_type = other RNA

SEQ ID NO: 16280 - RNA, 1680 nt, synthetic construct; identical to SEQ ID NO: 14637
  misc_feature 1..1680: note = derived and/or modified CDS sequence (opt11) from RVFV(KEN/Kil-006/07)__HM586966.1__Gn
  source 1..1680: mol_type = other RNA

SEQ ID NO: 16281 - RNA, 1680 nt, synthetic construct; identical to SEQ ID NO: 14638
  misc_feature 1..1680: note = derived and/or modified CDS sequence (opt11) from RVFV(SA-75)__DQ380189.1__Gn
  source 1..1680: mol_type = other RNA

SEQ ID NO: 16282 - RNA, 1680 nt, synthetic construct; identical to SEQ ID NO: 14639
  misc_feature 1..1680: note = derived and/or modified CDS sequence (opt11) from RVFV(35/74)__JF784387.1__Gn
  source 1..1680: mol_type = other RNA

SEQ ID NO: 16283 - RNA, 1680 nt, synthetic construct; identical to SEQ ID NO: 14640
  misc_feature 1..1680: note = derived and/or modified CDS sequence (opt11) from RVFV__M11157.1__Gn
  source 1..1680: mol_type = other RNA

SEQ ID NO: 16284 - RNA, 1680 nt, synthetic construct; identical to SEQ ID NO: 14641
  misc_feature 1..1680: note = derived and/or modified CDS sequence (opt11) from RVFV(KEN/Bar-035/07)__HM586969.1__Gn
  source 1..1680: mol_type = other RNA

SEQ ID NO: 16285 - RNA, 1680 nt, synthetic construct; identical to SEQ ID NO: 14642
  misc_feature 1..1680: note = derived and/or modified CDS sequence (opt11) from RVFV(Kenya 56 (IB8))__DQ380190.1__Gn
  source 1..1680: mol_type = other RNA

SEQ ID NO: 16286 - RNA, 1680 nt, synthetic construct; identical to SEQ ID NO: 14643
  misc_feature 1..1680: note = derived and/or modified CDS sequence (opt11) from RVFV(KEN/Bar-032/07)__HM586968.1__Gn
  source 1..1680: mol_type = other RNA

SEQ ID NO: 16287 - RNA, 1680 nt, synthetic construct; identical to SEQ ID NO: 14644
  misc_feature 1..1680: note = derived and/or modified CDS sequence (opt11) from RVFV(Beijing-01)__KX611606.1__Gn
  source 1..1680: mol_type = other RNA

SEQ ID NO: 16288 - RNA, 1680 nt, synthetic construct; identical to SEQ ID NO: 14645
  misc_feature 1..1680: note = derived and/or modified CDS sequence (opt11) from RVFV(Smithburn)__DQ380193.1__Gn
  source 1..1680: mol_type = other RNA

SEQ ID NO: 16289 - RNA, 1680 nt, synthetic construct; identical to SEQ ID NO: 14646
  misc_feature 1..1680: note = derived and/or modified CDS sequence (opt11) from RVFV(TAN/Dod-002/07)__HM586971.1__Gn
  source 1..1680: mol_type = other RNA

SEQ ID NO: 16290 - RNA, 1680 nt, synthetic construct; identical to SEQ ID NO: 14647
  misc_feature 1..1680: note = derived and/or modified CDS sequence (opt11) from RVFV(KEN/Gar-004/06)__HM586964.1__Gn
  source 1..1680: mol_type = other RNA

SEQ ID NO: 16291 - RNA, 1521 nt, synthetic construct; identical to SEQ ID NO: 14648
  misc_feature 1..1521: note = derived and/or modified CDS sequence (opt11) from RVFV(ZH-548)__DQ380206.1__Gc
  source 1..1521: mol_type = other RNA

SEQ ID NO: 16292 - RNA, 1521 nt, synthetic construct; identical to SEQ ID NO: 14649
  misc_feature 1..1521: note = derived and/or modified CDS sequence (opt11) from RVFV(35/74)__JF784387.1__Gc
  source 1..1521: mol_type = other RNA

SEQ ID NO: 16293 - RNA, 1521 nt, synthetic construct; identical to SEQ ID NO: 14650
  misc_feature 1..1521: note = derived and/or modified CDS sequence (opt11) from RVFV(200803162)__JF311377.1__Gc
  source 1..1521: mol_type = other RNA

SEQ ID NO: 16294 - RNA, 1521 nt, synthetic construct; identical to SEQ ID NO: 14651
  misc_feature 1..1521: note = derived and/or modified CDS sequence (opt11) from RVFV(200803166)__JF311381.1__Gc
  source 1..1521: mol_type = other RNA

SEQ ID NO: 16295 - RNA, 1521 nt, synthetic construct; identical to SEQ ID NO: 14652
  misc_feature 1..1521: note = derived and/or modified CDS sequence (opt11) from RVFV(SA-51 (Van Wyck))__DQ380195.1__Gc
  source 1..1521: mol_type = other RNA

SEQ ID NO: 16296 - RNA, 1521 nt, synthetic construct; identical to SEQ ID NO: 14653
  misc_feature 1..1521: note = derived and/or modified CDS sequence (opt11) from RVFV(ZINGA J83 R1)__KU978776.1__Gc
  source 1..1521: mol_type = other RNA

SEQ ID NO: 16297 - RNA, 1521 nt, synthetic construct; identical to SEQ ID NO: 14654
  misc_feature 1..1521: note = derived and/or modified CDS sequence (opt11) from RVFV(Entebbe)__DQ380191.1__Gc
  source 1..1521: mol_type = other RNA

SEQ ID NO: 16298 - RNA, 1521 nt, synthetic construct; identical to SEQ ID NO: 14655
  misc_feature 1..1521: note = derived and/or modified CDS sequence (opt11) from RVFV(Sudan 2V-2007)__JQ820490.1__Gc
  source 1..1521: mol_type = other RNA

SEQ ID NO: 16299 - RNA, 1521 nt, synthetic construct; identical to SEQ ID NO: 14656
  misc_feature 1..1521: note = derived and/or modified CDS sequence (opt11) from RVFV(Sudan 86-2010)__JQ820489.1__Gc
  source 1..1521: mol_type = other RNA

SEQ ID NO: 16300 - RNA, 1521 nt, synthetic construct; identical to SEQ ID NO: 14657
  misc_feature 1..1521: note = derived and/or modified CDS sequence (opt11) from RVFV(Kenya 56 (IB8))__DQ380190.1__Gc
  source 1..1521: mol_type = other RNA

SEQ ID NO: 16301 - RNA, 1521 nt, synthetic construct; identical to SEQ ID NO: 14658
  misc_feature 1..1521: note = derived and/or modified CDS sequence (opt11) from RVFV(ARD-38388)__DQ380187.1__Gc
  source 1..1521: mol_type = other RNA

SEQ ID NO: 16302 - RNA, 1521 nt, synthetic construct; identical to SEQ ID NO: 14659
  misc_feature 1..1521: note = derived and/or modified CDS sequence (opt11) from RVFV(Sudan 28-2010)__JQ820491.1__Gc
  source 1..1521: mol_type = other RNA

SEQ ID NO: 16303 - RNA, 1521 nt, synthetic construct; identical to SEQ ID NO: 14660
  misc_feature 1..1521: note = derived and/or modified CDS sequence (opt11) from RVFV(200803167)__JF311382.1__Gc
  source 1..1521: mol_type = other RNA

SEQ ID NO: 16304 - RNA, 1521 nt, synthetic construct; identical to SEQ ID NO: 14661
  misc_feature 1..1521: note = derived and/or modified CDS sequence (opt11) from RVFV(73HB1230)__DQ380221.1__Gc
  source 1..1521: mol_type = other RNA

SEQ ID NO: 16305 - RNA, 1521 nt, synthetic construct; identical to SEQ ID NO: 14662
  misc_feature 1..1521: note = derived and/or modified CDS sequence (opt11) from RVFV(2250/74)__DQ380209.1__Gc
  source 1..1521: mol_type = other RNA

SEQ ID NO: 16306 - RNA, 1521 nt, synthetic construct; identical to SEQ ID NO: 14663
  misc_feature 1..1521: note = derived and/or modified CDS sequence (opt11) from RVFV(SAUDI 200010901)__KU978778.1__Gc
  source 1..1521: mol_type = other RNA

SEQ ID NO: 16307 - RNA, 1521 nt, synthetic construct; identical to SEQ ID NO: 14664
  misc_feature 1..1521: note = derived and/or modified CDS sequence (opt11) from RVFV(Lunyo)__KU167026.1__Gc
  source 1..1521: mol_type = other RNA

SEQ ID NO: 16308 - RNA, 1521 nt, synthetic construct; identical to SEQ ID NO: 14665
  misc_feature 1..1521: note = derived and/or modified CDS sequence (opt11) from RVFV(25010-24)__KM210509.1__Gc
  source 1..1521: mol_type = other RNA

SEQ ID NO: 16309 - RNA, 1521 nt, synthetic construct; identical to SEQ ID NO: 14666
  misc_feature 1..1521: note = derived and/or modified CDS sequence (opt11) from RVFV(2007000253)__JF326192.1__Gc
  source 1..1521: mol_type = other RNA

SEQ ID NO: 16310 - RNA, 1521 nt, synthetic construct; identical to SEQ ID NO: 14667
  misc_feature 1..1521: note = derived and/or modified CDS sequence (opt11) from RVFV(ZC-3349)__DQ380207.1__Gc
  source 1..1521: mol_type = other RNA

SEQ ID NO: 16311 - RNA, 1521 nt, synthetic construct; identical to SEQ ID NO: 14668
  misc_feature 1..1521: note = derived and/or modified CDS sequence (opt11) from RVFV(OS-1)__DQ380186.1__Gc
  source 1..1521: mol_type = other RNA

SEQ ID NO: 16312 - RNA, 1521 nt, synthetic construct; identical to SEQ ID NO: 14669
  misc_feature 1..1521: note = derived and/or modified CDS sequence (opt11) from RVFV(KEN/Gar-004/06)__HM586964.1__Gc
  source 1..1521: mol_type = other RNA

SEQ ID NO: 16313 - RNA, 1521 nt, synthetic construct; identical to SEQ ID NO: 14670
  misc_feature 1..1521: note = derived and/or modified CDS sequence (opt11) from RVFV(Smithburn)__DQ380193.1__Gc
  source 1..1521: mol_type = other RNA

SEQ ID NO: 16314 - RNA, 1521 nt, synthetic construct; identical to SEQ ID NO: 14671
  misc_feature 1..1521: note = derived and/or modified CDS sequence (opt11) from RVFV(2008/00101)__HE687306.1__Gc
  source 1..1521: mol_type = other RNA

SEQ ID NO: 16315 - RNA, 1521 nt, synthetic construct; identical to SEQ ID NO: 14672
  misc_feature 1..1521: note = derived and/or modified CDS sequence (opt11) from RVFV(2007001292)__EU574046.1__Gc
  source 1..1521: mol_type = other RNA

SEQ ID NO: 16316 - RNA, 1521 nt, synthetic construct; identical to SEQ ID NO: 14673
  misc_feature 1..1521: note = derived and/or modified CDS sequence (opt11) from RVFV(2007002445)__EU574037.1__Gc
  source 1..1521: mol_type = other RNA

SEQ ID NO: 16317 - RNA, 1521 nt, synthetic construct; identical to SEQ ID NO: 14674
  misc_feature 1..1521: note = derived and/or modified CDS sequence (opt11) from RVFV(Ken 199800523)__KU978777.1__Gc
  source 1..1521: mol_type = other RNA

SEQ ID NO: 16318 - RNA, 1521 nt, synthetic construct; identical to SEQ ID NO: 14675
  misc_feature 1..1521: note = derived and/or modified CDS sequence (opt11) from RVFV(clone 13)__DQ380213.1__Gc
  source 1..1521: mol_type = other RNA

SEQ ID NO: 16319 - RNA, 1521 nt, synthetic construct; identical to SEQ ID NO: 14676
  misc_feature 1..1521: note = derived and/or modified CDS sequence (opt11) from RVFV(2373/74)__DQ380194.1__Gc
  source 1..1521: mol_type = other RNA

SEQ ID NO: 16320 - RNA, 1521 nt, synthetic construct; identical to SEQ ID NO: 14677
  misc_feature 1..1521: note = derived and/or modified CDS sequence (opt11) from RVFV(OS-8)__DQ380185.1__Gc
  source 1..1521: mol_type = other RNA

SEQ ID NO: 16321 - RNA, 1521 nt, synthetic construct; identical to SEQ ID NO: 14678
  misc_feature 1..1521: note = derived and/or modified CDS sequence (opt11) from RVFV(KEN/Bar-035/07)__HM586969.1__Gc
  source 1..1521: mol_type = other RNA

SEQ ID NO: 16322 - RNA, 1521 nt, synthetic construct; identical to SEQ ID NO: 14679
  misc_feature 1..1521: note = derived and/or modified CDS sequence (opt11) from RVFV(MgH824)__DQ380210.1__Gc
  source 1..1521: mol_type = other RNA

SEQ ID NO: 16323 - RNA, 1521 nt, synthetic construct; identical to SEQ ID NO: 14680
  misc_feature 1..1521: note = derived and/or modified CDS sequence (opt11) from RVFV(200803169)__JF311384.1__Gc
  source 1..1521: mol_type = other RNA

SEQ ID NO: 16324 - RNA, 1521 nt, synthetic construct; identical to SEQ ID NO: 14681
  misc_feature 1..1521: note = derived and/or modified CDS sequence (opt11) from RVFV(2007001811)__EU574040.1__Gc
  source 1..1521: mol_type = other RNA

SEQ ID NO: 16325 - RNA, 1521 nt, synthetic construct; identical to SEQ ID NO: 14682
  misc_feature 1..1521: note = derived and/or modified CDS sequence (opt11) from RVFV(Kenya 57 (Rintoul))__DQ380192.1__Gc
  source 1..1521: mol_type = other RNA

SEQ ID NO: 16326 - RNA, 1521 nt, synthetic construct; identical to SEQ ID NO: 14683
  misc_feature 1..1521: note = derived and/or modified CDS sequence (opt11) from RVFV(Beijing-01)__KX611606.1__Gc
  source 1..1521: mol_type = other RNA

SEQ ID NO: 16327 - RNA, 1521 nt, synthetic construct; identical to SEQ ID NO: 14684
  misc_feature 1..1521: note = derived and/or modified CDS sequence (opt11) from RVFV(ANK-6087)__DQ380216.1__Gc
  source 1..1521: mol_type = other RNA

SEQ ID NO: 16328 - RNA, 1521 nt, synthetic construct; identical to SEQ ID NO: 14685
  misc_feature 1..1521: note = derived and/or modified CDS sequence (opt11) from RVFV(MP12)__Z30318.1__Gc
  source 1..1521: mol_type = other RNA

SEQ ID NO: 16329 - RNA, 1521 nt, synthetic construct; identical to SEQ ID NO: 14686
  misc_feature 1..1521: note = derived and/or modified CDS sequence (opt11) from RVFV(KEN/Bar-032/07)__HM586968.1__Gc
  source 1..1521: mol_type = other RNA

SEQ ID NO: 16330 - RNA, 4020 nt, synthetic construct
  misc_feature 1..4020: note = derived and/or modified CDS sequence (opt11) from SFNV(Toscana)__NC_006320.1__GP
  source 1..4020: mol_type = other RNA
atgttcatcgccaagttgctcctgatcagctgcctggtgcaacaagcctacctcaagtacaccatcatttccgagattggcaatgggacccgcacgagcttctgttactcctcacggacctccctgggcagcctgctcgaggcttgggacaacatcaccgagtcaatcggactgaccagtggcacgtgcaaggtcgggtccctggagaaccgcgactgcaagcgggatatcatgagcaactacgtggccgaggtgcactccaacctccatggacttggcgcaatgatgcacaactacggggacgacaagcgcgtcgaggtgctgaacgacgttattcccgacgagctcaacccgggacggcacaactgcagcgacctagaccggaagcccttctggaccgagtttatcaacgtagccaagcctgccaataagatcgcgcccatctccgtgatcccgccgcccatcgtgaagccaatcccgatcgccgagagcactatcaagaagaccatccccttcgacaagctgctctccgaagccgagaaggagctgaaccagaccaagatccggttggagaccgagcgccggtccaacgccgaggaggcagcccgggagcgggcccggatgagggagatcgaggataagctcagaaagaactgggagctggagcgggagcgcaaggacgccgtcgccgacgacctggccaaggagattgcccggcgccgtgaaatcgagcgcaaggcccacgagctcgataagatgctgaagaagaaggagcgggaggaccaggtggccatcgagcgcgtgtccgaggatatgcggaaccacgtcaggcgccccaacaccaccatcgcccccgcgccgaccatcataaccaccttactcatggccagcgccgtgatggccggccccctcgagaaccgcgagaccaaccacttactgaaccgccccggcaacggggcctatactctgtcagacttcgcggagagcacgtgcaccctggcctacggcagcaagtgcaagtcttgggaacaccagctcgatgaactgagcttcccgttcttccactccaacctggacaagtacagcatgctcgaagccgccactgagaccatcccgattctgaacaaatccagcgccgtatgcaccatctcccccagcacccactcaagcaacgcgtgtgggcgggaggcttccctgatcaagaaaaagtgcgggaacaacatgagcgcctttttctacgtcaacctcgctggccaaatcacagtagtgaagtgcgatacgaaccacgtcctgagtaacgactgcgggaactgcatcagcaagaccctgtccggccagaagatctacaccccagtgcaggacatgttctgccagcgcggctggaccgagagcatcccctccacgagatactctaaggacctctgctccatcgggctgcacaccgtgaaggagtgcaagaccggcaccactaacttcgagcgcgtcgggtttatcgtggtcaagagccggaagatgtacatcgagcagatgaagatgcgctctcgccaggagttctctgaggaccagttcctgtgctacaagagcgagagcagcagtggcagctccgtgaagctcaagaaggtgaaggttgagagctgtaagggtgtgaccaccagttcggcgtccaagtgctcgggcgacgagtacttctgctcccgctacccgtgcgagaccgcaaacgtggaggcgcattgcatcctgcgacgccacagcgccgtcatcgaggtgaacgtcaacggcgtctgggtggtgccccggtgcatcgggtacgaggaggtcctcgtgcgccggacgtccctcaaaatggaggacacctcttcgcgcgagtgcgatacgtgcctgtgggagtgcgggaagaacaagctgatcgtgaagacccacgggcccaagatcgtatacgccacagcgtgcagccatggcagctgcaagagtgtgatgcagaagcccgccaccttcgtgtacctcccgtaccctgggaacagcgagatcgtcggaggcgatatcggagttcacatgaccgaggagtcaagcccctccaacatccacatggtagcccattgccccgccaaagacagctgcgaagtctccagctgcctcttctgcgtgcacggcctgctgaactaccagtgccacaccctcttctccgccctgctgatcagcaccaccgtcatgtctatcctcaccttgctgctcctgctagtaaagggggcgaaagatctcgtaaagaagctgttctactggctgatcaccccgctctgctggctgtcggtgttctgcggctggatgatcaagagctggaagaagaaggtcgggagcgccatctcccggacaaacgacacgatcggctggcgcgacaatcgccggtacggccgcgacgtggaaagagctcagtacaccgggggcgcccccggcgccaagtacagcttctacggcgtgatgatcctgggactcctggggaacgtccactcttgtagcgagtccgtgatcgcggacagcaaggtgatgcagtgcacgacctctggctccagcacgctgtgcaaggcctccggcaccgtcatcatgaaactcggccccatcgggtcagaatcctgcctgatcctgaagggcctcaaggacaacgagaagcagtttatcagcatcaagaccataagtagcgagctgacctgccgggagggcgagtccttctggacgaccctgtacacgccggtgtgcctctcatcccggcgctgccacctgatgggggagtgttgcagcgaccggtgccttaaatggaagaccaacgagacatccgcggagttcaccggcaaggcccacggggaggtgatgcacgaaaaccgctgtttcgagcaaagcggcggaatcggctacggctgtttcaacgtcaacccctcatgtctctacgtgcacagcatcctgaagtccgtatacaagaacggtttcaagatcttccggtgcgtcgcgtggaaccacagaatccggctggaagtgaccacccacagccgcaagttccccatggtgctcatggcaatgtccacgcagcccaccgactggggtagcatcgggttaatcctggacagcgaaggcatcaccgggaccaacgcctacagcttcatgaagcacggcagcggatccctagccatcatcgacgacccgtacagccccgagcccagaaaagggttcctaggagaggtccggtgccccacggaggagaccgccattcgggcgtcccccagctgcaagatggcccccaatctgattgagtaccagcccgagatggacaccgcggagtgcaccacgaacatgatcgaccccatggccatcttcaaccgcgggtctctcccacaggtacgggacggcatgaccttcacccagagcatcgagaagaacacagtgcaggccctgactaccggggaagtccgcgcgtccatccggctgacgttagacgactacgacgtcgtgtaccacaacagccagtccgactgcagcgccaccttcaaaaacttaacgggctgctactcatgcgacgagggcagccgcatgtgctatcaggtcaaggccgagggggagacgatcttccacttcgtgaacgaggacgagtccatcaacgtaatcaacaaggtaagccccgacgtgtccgactactgcaccgtgctgcacttcagccggcccgtcatcagcatcgagggccgctacgactgcgggctcagcaagagccccatggtgataaagggcaccttgatcgccaccgccccgcacgacgaccgcaagcacgagggcgggtccagcctggttgtgaaccccaagggtggtacggtggatttcttcggctgggtctccgggttaaccagctggctgggcggccccctcaagaccttcctcaccatcctggggttcctcgcgctagggctgctgctcgtggtgatcatcatcacgatcgcccggaccggggtcgagcaggctctgaagaagaagaacaagtga

SEQ ID NO: 16331 - RNA, 3972 nt, synthetic construct
  misc_feature 1..3972: note = derived and/or modified CDS sequence (opt11) from SFNV__HM566171.1__GP
  source 1..3972: mol_type = other RNA
atgctgaacaccaagagcatcatcttgatcacgtgcctggtgcagcaggtccacctgaagtacacgatcatctccgaggtgacaaagggcgcccgcgaggtgagctgctactccagcaccacccggctcgatcagctgctggaggcctgggagaacaagtccgcgctcatggggctgcgcaagggcaactgcaagctgggggccatggagcaagtcgactgcaacctcgacctgatgagcaactacgtgtccaacgtgtacgacaacccccacggcctgggggccatgatgtacaacgacaagcggatcgaggtcctcaacgaccagatcccggacagcatgatccccggcggccacaactgctctttgctggagcgcaagcccttctgggccgacctcatccccagtaagaaggagaacccgcggccctccctgatctcattagtgccaacgccacgctccgacttcaagcggaagttcgaggaggccgaggaggagatgaagaagatccgcaaggagctccaggacgagcggcaggcgcagctgagcgtgatcgaggaggggcgcaagcggatgcgcgacctggaggacaagctcatgcggcagtggaacgaggagaagcagaagaagggcctgctggaggagaccctcgagaagaagcgccaactgaagaacaaggccctgctcgacgcccacaacctggacaagcagttgaaggagaaggaccgggagttcaagaccgccatggaggaacaccagaacgagcgccaccggatcaactccaacatgatcaggccgcccatcaccacgcccgcggccgtcatcctaaccagcctgctgtccgccagcgtggtgttagggttcgagctggagaaccggaacaccaatcacgccctgaaccgccccggcaacgggggctactccatcagcgacaataacctcatcgaggccaagtgcatgatcacctacggcaacaagtgcccgagctgggagatgcagctggaccccgtctcctaccccttcttcagctccaacttcgagaagtacagcctgctcgagagcatcagcgagacgtcccccatcatcgggaaattcagcgaggtgtgcgtgctgtccaacctgccgggcgcgcagaagacctgcgccaaggaggccagcctcatcaagaagcagtgctccgacgacatgcgggcctacttctacatcaacagcctggggaagctggctatcgtgacttgccccgagaacaacgtcctgtcccaggactgcaacttttgcctgcgcaaggcgaagggcgagcagtacgtgtacaagcccatccaggacggcttctgccagaacggaggcgtcagctccgtgcccagcatccgctactccaaggacatctgcagcatagggccgacaaaggtgaagaattgccacaagggcacgtcccggtacgagcgcaccgccttcatcagcaccggggacaagaaggtctacctggaggagatcaagatccggagccgccaggagtacgagcccgaccagttcctctgctacaaggtgaaggactccagctccagccccctggcctacgagaaggtgcaggtctccaagtgcaagggaatcgagaccaacagccccaagaagtgcacgggcgacgagtacttctgctccaagtacccctgcgagagcacctcccccgaggccaactgcttcctgcggaagcacagcgccatcctggaggtgaacatcgggggcatgtggatcaagcccaagtgtatcgggtacgagatggcgctcgtcaagcgcgtgggcttgcggtccgaggacgtgagctccaaggagtgcgcaacctgcctgtgggagtgcagttccgggtacatcagcatcaccacgcacggccccaagatctcctatgccaccgcctgcagtcacggcagctgcaagtccatcgtccagaacccgagcacctccatccgcatcagctaccccgggaactccgagatcgtgggcggggacatcggcatccacctcaccgaggacagcagtcccatcaacctgcatctgaagatccactgcagcccgaaggactcctgcgaggtgagcgactgcatcttctgcgtccacgggcttctgaactaccagtgccactccgtggcctctgccctgctcctgtccacgatcaccgccagcctgatcgtgctcatgatctacatgctgagcaagaccaagttcgtcatgaagaagctgatccccatcatgctcacgcccctgtgctggtgcttcgtgttgctcgcctggctgaccaagagctggaagggcaagatgcggaacgccatccagtccgcgaacagcaccatcggctggaccgagcgcgaggagcggatcgtggccgagcgcccccggtcccgcaacactgtccggtacagcttctacggggtggtgatcctggccatgctcgagagcgccttcggctgctccgaaagcctgatcgccgagtccaaggtcatgcagtgcaacatcgcgaacgggaagaccagctgccgcgcctccggcaccatcatcatgaagctgggcccgatcgggagcgaggcctgcctaatcctgaagggcctgcgggactccgacaagcagtacataagcgttaagaccgagtccagcgagctaatctgcagagagggggagtccttctggaccagcctgtacacccccgtgtgcctgtccagccggcgctgccacttaatgggcgaatgcacgggggacctgtgcctgaagtggaagtccaacaagaccagcctcgagttcgccggcaagacccgctccgacgtcatcaacgagaacaagtgctttgagcagagcggcgggctgggctacgggtgcttcaacgtgaacccctcctgcctgtatacccacgcctacctcaagagcgtataccggaacggcttccgcgtcttcaagtgcgctagctggacgcaccgggtgaagctgaccatcaccacccactcccgcacgttccccatgaccctggccgccatgagcacccagccgaccgactgggggtccatcggcctcatcctggacagcgagggcatctccgggaccaacagcttctccttcatgaagcacggcctggggagcttcgctatcatcgacgagccctactccatggagccccggaaaggcttcatcggggaggtgagatgccccaccgaggaggccgcgatcaaggccagcaccctctgcaagaccgccccgcagctgatcgagtaccagcccgagatggactccgccgagtgcacgacgaacatgatcgacccgatgagcgtcttcaatcggggctccctgccccaggtgcgcgagggcatgaccttcacccagagcatggagaaaaatacggtgcaggcgatgaccaccggggaggtccacgcctccatccggatcgtgctcgacgactacgaggtggagtacctgagctcccaggtcgactgcgacgccaccttcaagaacctgacgggctgctacagctgcgacgagggggcccgcgtgtgcatgcagatcatcgcccacggcgacaccatcttccacttccgaaacccggacgtgtccataaacatcctccagaaggtcaatacaaacaccctgatctactgcagcgtggtgcacttcagcaagcccgtgatcaaggaggagggtacgtacgactgcggtgcgggcgagaagcccatgatcctgaaggggaccctcgttgccgtgagcccccacaacgaccgcctggagcagggcgggtcctccatcgtcatcaacccgaagggcggcggggtggacttcctgggttggctcagcgggttctccagctggttcggcgggcccctgaaggccatcctgatggtgatcggcttcctcctgctgggcctcatcctgttcgtcaccatcgccatcgggctgaagttcgccctccgccagatgatcgtgaagcgcatgaagtga

SEQ ID NO: 16332 - RNA, 3873 nt, synthetic construct
  misc_feature 1..3873: note = derived and/or modified CDS sequence (opt11) from SFNV(Namru)__HM566169.1__GP
  source 1..3873: mol_type = other RNA
atgttccagatcatctacctgctcaccaagctgtacctggtgagctccatgtacagcatcatgttctgggagaacgagaacatctccaagctctgcctgagcaacaacagccccctggagggcctcgtctactactgggagaacgtgatgaaggagggggacttcaaggaggagaagcgcaagaagtgccggatcggcccgagcgacctgaagcgcgtaaccaaccagacgctgaccaccctcatcgaggaggtccagaagtcccccagcgagatccagctgctgtgcgaggaggacgggaacaagaccggcatctccatgttcttcgacgggctcagcgacgatatctccacacccagcatcgttgactgcaacggcaacatccggatctcagacctgcgcgtgcaagtcggccgggggcacttcgagaaggagaacgagatccgcaagatcgaggagatcgtgaccctggaggacgacctccggcgcgagcgggacctgaacaaactgctccaggacctgaataagaaggacgccgaggaacgccggatcatcgagcacgagctgaccaacatgcgcgagcagctccagcgggagcgcgagcggagcaagcagcagatcaaggagcacgagaagatcgaggtgaacaaccacaaagagcccgccacccacctgaacgtctccaagctgctcacgatcggcctgctggcgcagcaggtcggccaggtgatagccaccgagccggggcagctcaacacctggatccacgccaagaaccgcatcgggaagggcctgtacaagactgaggacacggacgaggacggctgtcgggggttggactacggcgtgtcttgcctcgggttcgactacctgctgcgcaccgacatctaccccttcttcaactccttcgtgagccacctctccatgctggaggccagtactgaggacctgattgagaaggagggcaccagctgcgagatcgagacgaacaaggagttcaagtgctatgaggagcgggccttcatcaagggctcctgcccccacctcgtgaacagcgcgcacttcctggacaacaaggggaaacttcgcatcgtcaagtgcaagaccgacttcgagatgaccgaggactgcaccttctgccggaagatcaagaagaagaactcccagcacaagcaggtcttcaagacgagcatcgccctccaggacgccgtctgccagaacaactccgacctgtacaacggcccccgcattgtgtacagcaacgtgtgcaagatcgggatggtgtcctacaagcagtgtaagagcaagacgtccagctacgagtccgtcggcttcgtgattctgaaggggaagggcaaattctacatcgagaacatgaagatcaagaacatcgaggtgatcgccaacgtcagcttcatctgccaccagtaccagggccaggacgggaccgagaaggagcagcgctccctcaagcggatctcggtgggcgagtgcaagtccgtcaacccgcagaagaccaagcactgtacgggggaccacgtcttctgcgaaaagtacgactgcaccaagagctaccccgaggtgacctgcctgatggcgcccggctccgggcccatcctggtccagatcatgggcagctggatcaagccgcagtgcgtgggctacgagaaggtgctcgtcgagcgcgaggtgaagtcccccaccctgacggaggagcgggactgcgacacgtgcgtttacgagtgcctggaggacaagatcctcatcaagagcaccgggttcaagatgatcagcgccgtcgcctgctcccacggcatgtgcgtcagctcccaccaggagccctcaaccttcctgtacatcaactacccagggatgtccgccagcattggcggagagatcggcctacacctttcccacaccgacgacagcctctccctgcacaaggtgatctcgtgcccgtcccgcaacccctgcgacgtccacagctgcatcatctgctaccacggcatcatcaactatcagtgccacaccgccctgtcctacaccatcgtggcgttcagcttcatctctttcctctacctgacgttcaaggtgatcagccagctgctctacacgttcaaggtcgtgcccaagaaactgaaggggcccttctactggatgggctacctgatcaagtggatcgtcaagaccatcctcggggtcgtgcggaacaccttcttcaccatgtccaaccgcatcggctgggagcggcgcgacgagatccacgaggacatcgaggccaaccctcggcgccatctccagcggttcaagaccacgttcgtgctgaccatgctgatgatcaacggcgggctgtgctgcagtaacaccctggtcagcaactccaagcagacccgctgcgtgcagtctggcaacgaggtgaagtgctccgtcagcgccacggtggtgctcaaggccggcgtcataggcgccgagtcctgcttcatcatcaaggggcccagcgagaaccagcacaagatgatctccgtgcggaccctgagctccgagaccgtgtgccgcgagggcgcgagcttctggaccggccacttctcccccagctgcgtttccagccggcgctgccacctggtgggcgagtgccacggcaaccggtgccagtcctggcgcgacgaccagatcagccgggagttcgggggcgtgaaggacaacaaccgcatgtccgagaacaagtgcttcgaacagtgcgggagcatcggatgcgggtgcttcaacatgaacccctcctgcctctacgtccacacgaccctgaagtccgcccgcaacgaggccgtgcgggtgttcaagtgcaacgactggatccaccgcctgaacttcgaggtcatcgggccgagcggcgaaaaggacgtggtgaccctcaactccatgagcaccaagttcctgcagtgggggacgatctccctgagcctcgacgccgagggcatcaccgggaccaactcctacagcttcctggagtccagcaagggcggcttcgcaatccacgacgaggagttctccgacatcccccgggaggggtacctgggggagatccgctgcagctccgagagcgcggtcatctccgcccacagctcctgcattcgggcccccgacctcatcaagtacaagcccatgaccgaccagatcgagtgcacgagcaccctgatcgacccgttcgccatcttcatgaaggggtccctgccccaaacccgcagcggctacaccttcacgtccagcaaggacaagaagaccatccaggccttcaacaccaacagtatcaaggcgctcatctccctgaatctggacgaccacgagatcgtgttcgtgagcgaccagaccaattgcgagtgtacgttcctcaacctgaccgggtgttactcctgcgactacggcgcacacgtctgcttccggatcaagagcgacaagaagggcgtgttcgtgtccaacaccgaggccaaagacatcagcttcgggttcgaagtactgaccggcacgcacgactactgccagatccagcacttcaactcccccagcgtgtacaagaccctctcctacagctgcgggggcgagtccaagctgctggtgatcaagggcagcctcatcaccatcgggccccacgactaccgcaacaagacgggcggggcctccacggtcgtgaaccccagcgaagagggctggtccgtgaccaactggatcgggggcttcatcagctggctgggcgggcccctgaaggcgctcctgaagattgccgtcaccatcctggccggggtggtcatcttcctcatcatctacttcttcttgcggctgatcgccaccaacatcctcatgaagacgaagaagaactga

SEQ ID NO: 16333 - RNA, 3990 nt, synthetic construct; identical to SEQ ID NO: 13047
  misc_feature 1..3990: note = derived and/or modified CDS sequence (opt11) from SFNV/SFNV-like(Poona)__HM566177.1__GP
  source 1..3990: mol_type = other RNA

SEQ ID NO: 16334 - RNA, 4002 nt, synthetic construct; identical to SEQ ID NO: 13048
  misc_feature 1..4002: note = derived and/or modified CDS sequence (opt11) from Arrabida virus(PoSFPhlebV/126/2008)__KP863800.1__GP
  source 1..4002: mol_type = other RNA

SEQ ID NO: 16335 - RNA, 4005 nt, synthetic construct
  misc_feature 1..4005: note = derived and/or modified CDS sequence (opt11) from Massilia virus(127)__KT906100.1__GP
  source 1..4005: mol_type = other RNA
atgttctacgccaaattcgtcatttccttatgcctggagcccggattctccctcaaatataccatcataagtaaatccggcagcgggacaatccgacaaatatgtctaagtcacagcaccgacatagacaaagtcttggaactttcctccggagaaatgaacactatagggatcttaggtgggctgtgcacgttcggcgaactaaaaagggaagattgctccccagacgtattctcgaactacgtggcaaatatgtacggaaccgcgcacccctcgagctgtaagtttgtggacataacgggagaccgttcaatagaggtcctcaacgacgccgtacccgactcatttacgccaggcgcacacaactgctcctcattcgaaaagaagccgttctggacggatctcataccagcgaaaaactcatcgggagcaataccctccgtagtctcagtgctccccagcgtcgcagagcacgacttcaacctgaaagtcaaggaagcaaatgacaaactagaggtaatccagcgcgaactcgctgcagaaaaagcgcgctcaggcagactggaggacgaagccagagcgaagatgaaagccctagaagacgaactacgcaacggctggctagcagagagagaggcaaaagaactagccaaaagcgccctggagaaagagcggatcaataaactcgaagtggaacggaaactccacgacctcggcaagaaactgagacaatccgaagacgacgtcgagaaaatgcgcgtccaccacaagaaaggacgcaaagaatcggacgaagaaatgaaaatcgccagaacgacagcccccagcgtctcaacaactctggccacggtagtcttcacatccctcctcgccactggcttagcagctatcgaaccgatcgaagaccgaaacgtcaaccacattttaaaccgaccaggaagcggtgtatatatggccagcccaacattaacgcagaacgaatgcagcctcgactacggcaaagaatgcaaagcgtgggagctgcaggtcagccccctacactacccattcttcacaagcaacgtagataaatacaccttcctagaaagcatcacactactcccacctatcctgctcataaacaacgaattttgcgagcttaccacttcatcaggccccctcaaacagtgccaaaaagaaagttccctcatcaagaaatgctgcacggaagacgccagagcctactttttcatagacctggaagggaaactgtccatagtacactgctcaaacaaccaagtactctctgaagactgcaacttttgtgtcacaaaatctggaggcgtctcgcacaaaatatttatgcccatacaagacgcattctgccagaaaggaggaagcgaatccataccagtagtccgctacagcaaagacatctgcagcatcggactctcaaaggtcaaatcatgccacaaaagcaccagccggtacgagcgaatgggatttatcgtcgcaggcaaaaagaaactatacatagaggacctaaaaatgagatacagacaagagtacgacgaagatcaattcttctgctacaaagtcaacaaaaccagcccactagaatacggcaaggagagtccgagcaaatgcaaaggcgtcggctccaatgagcaaaaatgcaacggtgatgagtacttttgcaaccgatacccctgcgagacgaatagcccagaagcccactgtagcctccgccgccacgccgctgtcgtagaggtatacgtcggaggggcatggattaaacccaaatgcgtgggctacgaaaaagtcctagtgaaaaggggcgggctgaagaccgaagacctgagcgtccgagaatgcacaagttgcctctgggaatgcgagaaaaacaagatcgttatcaagacacacgggccaaaaatcgtaagcgcgacagcctgcggtggcagatcatggaaaagcgtcatgcaaaaaccctccacattcctagacctaccctatccgggcaactccgaaatcatcggcggagaccggggcaaccacctaagcgaaaggggctccccgtacaacatccacagcacgatacactcgcctcctgaggactcacgagacgcctcagactgcatctactgccgacacggactcctcaactaccaatcgcactccgtcgaatcagccatcctactaagcaccgtagtagccaccatactagcactaacgggcgtcgtgctttccagatccaaatccgcggtaagatttctggcctccgccgtagccgtcccattcagatgggtcagcctcctagtggtctgggtcatgaaaaagtggaaagctagagtcgctacagccattcgagcgaccaacaacgcaatcggatgggacaacggactcgaacaagcccgggtcgagaacgcggcacgacgccaacagacggccggccgttggcgctcactcgacgccagtacaatactcagcgtcctgtcaacaggactctgctgcacagaatcccttatagctgagagttccataatgcagtgcacaaccggcgagggctcgacgacttgcaaagccaccggtactgtcgtcctaaaactaggcccaatcggctccgaaagctgcctaatcctcaaaggactacgagacaatgagcgccaattcatatccataaaaacaatcagtagcgagttaacctgtagagaaggcgagtcattctggacacccctttacactccagtgtgtttatcctcccgccgttgccacctcatgggagagtgcaccggcgacatgtgcctaaaatggaaatcaaataagacaagttccgagttcactggaaaaactcactcagaggtgatccacgaaaacaagtgtttcgagcaatcaggcggaatcggctacatgtgtttcaacgtcaacccatcctgcttgatggtacattcctacctcaaaccaatttacaaaaacgcattcaaggtcttccgatgcatcgcctggaaccaccgagtacggttaggcatcacaacgcacaagcggaaattcgaggtaaccctcatggcgatgtctacgcagcaagctgactggggatcgatcggactaatcctcgactcagaaggcataagtggaactaactcctactcattcatgaaacacggtctcggcagttacgccatcatagatgaaccctacagtgtagaacccagaaagggctaccttggagaagtacgatgccccacggaggaaacggcaatcaaggcctccccttcttgcaaagttgcaccagggctcgtcgaataccaacccgaaatggacactctagaatgcaccaccaacatgatggacccaatggcaatatttaaccgaggctcacttccccaagtacggggaggatggacattctcccaaagcatcgagaaaaactcacgccaagccctgaacacgggtgcaatcaacgcctcggtaagacatgttcttgatgaatatgagttcgactacaaagtcaagaccaacgactgcgattccaccttcgtcaacatcaccggatgttactcatgcgacgaaggcgcccggctctgcgtcaaagttcgcacttcatcggaggcaatataccacttcaccgacagcggatacaacatcaacgtgttattcaaagtagaaagcggggtacacgatcactgtacaatattacacttttccaagccagtaatatccatcgagggcaagtatgattgcgggaaaaacaagaaacccatgctaataaaaggaaccctgatcgccatggcaccccacgacgatcgggtggtcagtggtggcagctcgacagtagtaaaccccaaaggccaaggcgtagacttcctcggatggctctcacgtctctcttcatggttcgggggtggaccactcaaaacgttccttatggtaaccgggttcctcatgacaggtgtcataggaggcatagtaaccatcatactcatacgcatagtcctccagcaggcactcgcgaagaaagtcaagtag

SEQ ID NO: 16336 - RNA, 4005 nt, synthetic construct
  misc_feature 1..4005: note = derived and/or modified CDS sequence (opt11) from Massilia virus(130)__KT906101.1__GP
  source 1..4005: mol_type = other RNA
atgttctacgccaagttcgtgatcagcctgtgcctcgagcccggcttctccctgaagtacacaatcatcagcaagtccgggagcggcaccatccgccagatctgcctgtcccacagcacggacatcgacaaggtgctcgagttgtcccgcggggagatggataccataagcatcctgggcggtctctgcaccttcggcgagctgaagcgggaggactgctcccccgacgtgttcagcaactacgtggccaacatgtacggcaccacgcacccctccagctgcaagttcgtcgacatcatcggagaccggtcaatcgaggtgctgaacgacgcggtgcccgactcattcacccccggcgcccacaactgctccagcttcgagaagaagcctttctggacagacctcatccccgccaagaactccagcggggccatcccctccgtcgtgagcgtgctgcccagcgtcgccgagcacgactttaacttaaaggtgaaggaggcgaacgagaagctcgaggtgatccagcgcgagctggccgctgagaaggcccggagcggccgcctggaggacgaggcccgtgcaaagatgaaggccctcgaggacgagctgcgcaacgggtggctggcggagcgggaggccaaagaactcgcaaaaagcgcgctggagaaagagcgtatcaacaagctggaggtcgagcggaagctccacgacctgggcaagaagctgcgccaatccgaggacgacgtagagaagatgcgggtacaccacaagaagcgccgtaaggagagcgacgaggagatgaagatcgccaagaccacggccccgtccgttagcaccaccctcgccaccgtggtgttcacgtccctgctggcgacaggcctcgcggccatcgagccgatcgaggaccgcaacgtcaaccatatcctgaaccggcccgggagcggcgtgtacatggcctcccccaccttaacccagaacgaatgcagcttagactacgggaaggagtgcaaggcctgggagctccaggtgtccccgctgcactacccctttttcacgagcaacgtcgacaagtactccatcctggagagcatcacacagtccagccccattctgctgaagaacaacaactcctgcgagctcactaccagccctggcacgcagaagcaatgccagaaggagagtagcaccatcaagaagtattgcaccgacgatgcgcgcgcatactttttcatcgacctggagggcaaactgagcattgtgcactgcacgaacaactacatcctatccgaagactgtaacttttgcgtgtcaaagctgggtgaggtaggtcataagatcttcatgccgatccaggacgccttctgccagaagggcgggtccgagtcgatccccatcgtgcggtactccaaggacatctgcagcatagggctgttcaaaatcaagaactgccacaagtccacgagccgctacgagcggatgggcttcatcgtcgccggcaaaaagaagctctacatcgaggagctgaagatgcgctaccgccaggagtacgacgaggaccagttcttctgctacaaggtgaagaagaccagccccctggagtacgccaaggtgagcccatcgaagtgcaagggcgtcggcagcaacgagcagaagtgcaatggggacgagtacttctgcaaccggtacccttgcgagacaaactcccccgaggcgcactgcagcctccgccggcacgccgcagtggtggaggtctacgtgggcggtgcctggatcaagcccaagtgcgtgggctacgagaaggtcctggtaaagcgcggcgggttgaaaaccgaggacctctccgtgagggagtgcacgagctgcctgtgggagtgcgagaagaacaagatagtcattaaaacccacggccccaagatcgtgtccgctaccgcctgcgggcacggcagctgcaagagcgtgatgcagaagccgtccaccttcctggacctgccttaccccgggaacagcgagatcatcggcggcgaccgcggtaaccacctcagcgagagggggagcccctacaacatccactccacgatccactgcccgcccgaagacagccgcgacgcctccgactgcatatactgccggcacgggcttcttaattaccagagccactccgtcgccagcgccatcctcctgtccaccgtggttgcgacaatcctggccctcactggggtcgtgctgagccgctccaagagcgccgtgcggttcctggcctccgccgtcgcggtgcccttccgctgggtgtccctcctggtcgtgtgggtgatgaagaagtggaaggcccgggtcacgactgccatccgcgccactaacaacgccatcggttgggacaacgggctggagcaggtccgggtggagaacgccgcccgccggcagcagccggccgtgcgttggcggtccctcgacgccagcaccatcctgtccatcctgggcaccgggttatgctgcacggagagcctgatcgcggagagctccatcatgcagtgcaccaccgaagagggcagcaccacgtgcaaggccaccggtaccgtggtgctgaagctcggccccatcggctccgagagctgcctgatcctgaaggggctccgcgacaacgagaagcagttcatctccatcaaaaccatcagctcagagctgacgtgccgggagggcgagagcttctggacctccctgtacacccccgtttgcctctcgtcccggcgctgccacttgatgggggagtgcaccggcgacatctgcctgaaatggaagtctaacaagacgtcctctgagttcactgggaagacccactccgaggtgatccacgagaacaagtgcttcgagcagagcggcggcatcgggtacatgtgcttcaacgtgaacccctcctgcctcatggtccacagctacctgaagcccatctacaagaacgccttcaaggtgttccggtgcatcgcctggaaccaccgcgtgcgactgggcatcaccacgcacaagcgcaagttcgagatcaccctcatggccatgtccacccagcagaccgactgggggagcatcggcctgatcctggatagcgagggggtcgcgggtacgaacgcatactccttcatgaagcacggcctcgggagctttgccatcatcgacgagccctactccgtggagccccggaagggctacctgggggaagtgaagggccccagagaggagacggcgatcaaggccagcccgtcctgccaggtcgcgcccgggctggtggagtatcagcctgtgatggacaccgtagagtgcaccacgaacatgatggaccccctcgccatcttcaaccggggcagcctgccccaggtgcgcggcgggtggaccttctcccagtcaatcgaaaagaactccctacaggccctcaatacaggcgccatccatgccagcgtgaggcacgtcctggacgagtacgagttcgagtataaggtgaagtccaacgactgcgacagcaccttcgtgaacatcacggggtgttattcttgcgacgagggcgcacgcctctgcgtcaaggtgcggaccagctccgaggccatctaccacttcaccgacagcggctacaacattaacgtcctcttcaaggtggactccggggtgcacgaccactgcaccatcctgcacttcagcaagccggtcatctccatcgagggcaagtacgactgcgggaagaacaagaagcccatgctgatcaagggcacgctcatcgccatggcgccccacgacgaccgcgtcgttagcgggggcagctccaccgtagtgaacccgaagggccagggggtggacttcctgggttggctgagcgggctctccagttggttcggcgggggccccctgaagaccttcctgatggtcaccggcttcctcatgacgggggtgatcagtggcatcgtgaccatcatcctgatccggattgtcctgcagcaggcgctcgccaagaaggtgaagtga

SEQ ID NO: 16337 - RNA, 3999 nt, synthetic construct
  misc_feature 1..3999: note = derived and/or modified CDS sequence (opt11) from Massilia virus(W)__EU725772.1__GP
  source 1..3999: mol_type = other RNA
atgttctacgccaagtttgtgatcatcctgtgcctcgtccagggcttcagcctaaagtacaccatcatttccaagagcgggagcggcaccatccgccagatatgcctaagccactccacggacatcgacaaggtgctcgagctgagctccggggagatggacaccattaacatccagggcggactgtgcaccttcggcgaactcaaacgagaagactgcagccccgacgtgttttccaactacattgcgaacatgtacggcaccacgcacccgtcatcctgccgcttcctggacatcatcggggaccggagcatcgaggtgatgaacgacgcgtcccccgacagcttcacccccggcgcccacaactgttccagcttcgagaaggctcccttctggtccgacctgattccggccaagaacgggagcggcccctcccccagcgtggtttcggtcctcccatccgccaccgaaagcgacttctccctgaaggtgaagaaggcgaacgagaggctggaggtgatccagagggagctcgccgccgagaaggcccgcagcgggcgcctggaggacgaggcgcgcacaaagatgcgggcactggaggacgagctcaggaacggctggctggccgagcgggaggccaaggagctggctaaatccgaccttgagaaggagcgcgtcaacaagctggaggtggagcggaagctgcacgacctcaacaagaagctgcgtcagagcgaggacgaggcggagaggctccgcgagtaccacaacaagcggcgcaaggaatccgacgagaaaatgaaaatgacgaagaccgtggccccgaacgtctcgaccaccctcgccacggtggtgctgacctccctgctcgccaccggcctggccgcaatcgaacccatagaggaccggaacaccaaccacatcctgaaccgccccgggacgggcgtctacatggccagccccaccctcaccgagaacgactgctccctggactacgggaaggagtgcaaggcctgggagctccaggtgagcccgcttcactaccccttcttcacctccaacgtggacaagtacagcctgctggagtccatcacgcaggccagccccatcctcattaagaacaacaactcctgcgagctgaccacctcacccggctcccaaaagcagtgccagaaggagagcagcaccatcaagaagtactgtacggatgacgcccgggcatacttcttcgtcgacctggagggcaacctcagtatcgtgcactgcagcaacaacaacatcctgtccgaggactgcaacttctgcatcagcaagtccggggtgactggccagaaaatcttcatgccgatccaggacgccttctgccagcgtgggggcagtgagtccctgcccgtcatccgctatagcaaagacatctgctccatcgggctgttcaagataaaaagctgccacaagtccacctctcggtacgagcgcatgggattcatcgtggtgggccggaaaaagctgtacctggaggagctcaagatgcgctaccggcaggagtacgacgaagatcagttctactgctacaaggccaagaccacgtcccagctgcagtaccagaaggtcagcccctccaagtgcaagggggtgggcagcaaggaccagaagtgcaacggggacgagtacttctgcaaccgcttcccctgcgagaccaacaacccggacgcccactgttccctgcggcgccacgccgcggtcgtggaagtgaacgtcggcggggcctgggtgaagcccaagtgcgtgggctacgagaaggtactcgtgaaacggggcgggctgaagaccgaggaccttagcgtccgcgagtgcacctcgtgcctgtgggagtgcgagaagaacaagatcgtcatcaaaacgcacggccccaagatcgtgtccgcaactgcgtgcagccacgggtcctgcaagagcgtgatgcagaagccgtccacattcctcgacctgccgtaccccggcaacagcgagatcatagggggcgacatcggcatccacatgtcagagcgggggagcccctccaacatacacatcaccatccactgcccgccgaaggacagctgcgacgtctccgactgcatcttctgccgccacggcatcctgaactaccagtgccacagcgtggcgtctgcgatcctcttgagcacggtggtcgccaccatcctggccctcaccggggtcatcatctcccggagcaaattcgccgtgcgcttcctggcgtccgccgtcgccatccccttccggtgggtgagcctgctcgtggtctgggtgatgaagaagtggaagtcccgcatcgccaccgccatccgagcgaccaacaacgccatcggctgggacaacggcctggagcaggtccgcgttgagaacgccgcccggcgcccccagccggccgtgcgctatgcattttatgccacgacaatcctgtctatcctcggaagcggcctgtgctgcaccgagtccctgatcgccgagagctccatcatgcagtgcaccacggaggactcatccacgacctgcaaggccaccgggaccgtggtgctcaagctggggcccatcgggagcgagtcctgcctgatactcaagggcctgcgggacaacgagaagcagttcatcagcatcaagaccatctcctcagaactgacctgccgcgagggcgagtccttctggaccagcctttacacgcccgtgtgcctgtcctcgcggcgctgccatctgatgggtgagtgcaccggcgacatttgcctcaagtggaagtccaacaagaccagctccgagttcaccggcaaggcgcacagcgaggtgatccacgagaacaagtgtttcgagcagtccggcggaatcggctatggctgctttaacgttaaccccagctgcttgatggtgcatagctacctgaagccgatctacaagaacgctttccgggtgttccgctgcatcgcctggaaccaccgggtccgcctcggggtgacgacccacaagcggaagttcgagatcaccctgatggccatgtccacccagcaaacggactggggctcgatcgggctgattcttgactccgagggcatcgaggggaccaatgcctacagcttcatgaagcacggactgggctccttcgctatcgtggacgagccctactcggtcgagccccgcaaggggtatctgggcgaagtgcggtgccccaccgaggagaccgccatcaaggcctccccgagctgcaaggtggcccccgggctcatcgagtaccagcccgagatggacaccgtcgagtgcaccaccaacatgatggaccccatggcgatcttcaaccgcggctccctgccccaggtacgagaggggaagaccttcacgcagagcatcgaaaagaactccgtgcaggcgctaaccaccggcgagatccatgctagcgtccgcctcgtgctggatgaatacgaaatcgagtacaaggtgacctccaacgattgtgatagcacgttcgtcaacatcaccggctgttactcctgcgacgagggggcccggctgtgcgtgaaggtcaagagctccagcgaggccatataccacttcaccgactcctccttcagcgttaacgtcctcttcaaggtgacaccatccgtgcacgactactgcacgatattgcacttcagccgccccgtgatctccatcgagggcaagtacgactgcgggaagaataagaagcccatgctgatcaagggcaccctcattgccatggcgccgcacgacgaccgggtcatcaacggcggaagctccaccgtggtgaacccgaagggccacggggttgacttcctgggctggctgtccgggctctcctcatggttcgggggccccctgaagactttcctgatggtgatggggttcctcatgatcggcgtgatcatcgtcatcgtgaccatcatcctgatccgaatcgggctgcaacaggccctcgccaaaaagttcaaatga

SEQ ID NO: 16338 - RNA, 3996 nt, synthetic construct
  misc_feature 1..3996: note = derived and/or modified CDS sequence (opt11) from Punique virus(PI-B4-2008)__JF920134.1__GP
  source 1..3996: mol_type = other RNA
atgttctacgccaagttcgtgatcatcctgtgcctcgtccagggcttcagcttgaagtataccatcatctctaagctggggtcaggtaccacgcgccaggtgtgcctctcccacagcacagacctggacaaggtgctggagatctccaacatggaaatggacgccatcaacctcctcgggggcttctgcaccctgggggagctgcggcgcgaggactgtagccccaacgtcttctccaactatgtggtgaacgttcatggcaccatccacagctccaactgcaagttcgtggacatcgtgggcgaccggagcatcgaggtcctaaacgacgcaacgccggactctttcaccccgggggcccacaactgcagctccttcgagaagccgcccttctggaccgacctggtgcccaagaagaacgacaccgacccctccccatccttactgagcgtgttacccgccgcggccgagctcgacttcaacctgaagctgaaagaggcgaacgacaaggtcgaagccatccagcgcgagctcgtagccgagaaggcccggtccggccgcatcgaggacgaggctcggacgaagatgcgcgagctggaggacgagctgcggcgcgggtggatcgccgagcgggaggccaaggagctcgcccacaagaacctggaggaggagcgcgtgagcaagctggagatcgagcggcgcatgcacgacctcgacaagaagctgcggcagtccgagaacgacgccgaccgcctgcgggagcagtacaacaagaagcgcaagagcgaggaggaagtcaagacaccgaaggcgagcaccctcaacgccaccacgacgctggccaccgtggtgctgacctccctcctggccacgggcctggccgcgatcgagcagatcgaggagcggaacaccaaccacatcctcaaccgccccgggaccggcgtctacatggccagccccaccctgactcagaccgagtgcagtctgggctacgggaaggagtgcaagagctgggagctccaggtgagccccctgcattacccgttctttaccagcaacgtggacaagtactcgatcctggagagcatcacccaggaacccacgctcctgatcaagaacaacaactcctgcgagctgaccaccagtcccggctcccagaagcagtgccagaaggagagctccaccatcaagaagtactgcacggacgacgcccgggcctacttcttcatcgacctcgggggcaacctgagcatcgtccactgctccaacaacttcgtgttgagcgaggactgcaacttctgcatttccaagagcggcggggtgggccagaaaatcttcatgcccatccaggacgccttctgccagcgagggggctccgagtcgccgcctgtcgtgcgctacagcaaggacctctgttccatcgggttatttaagatcaagtcttgtcacaagtccaccagccggtacgagcgcatgggcttcatcgtcgcgggccagaagaagctgtacctcgaggagctgaagatgcggtaccgccaggagtacgacgaggaccagttcttctgctacaaggtgaagtccaacagccccctgcagtacgagaaggtgtcccccagcaagtgcaagggggtcggctcccaggaccaaaagtgcaacggggacgagtacttctgcaaccggtacccgtgcgacaccaacaaccccgacgcccactgcagcctgcgccggcacgccgccgtagtggaggtcaacgtgggcggggtgtggatcaagcccaagtgcgtcggctacgagaaggtgctcgtgaagcgcggcgggctgaagaccgaggacctgtccgttcgggagtgcacgagctgcctctgggaatgcgagcgcaacaaggtggtggtcaagacccacggccccaagatcgtgtccgccaccgcgtgcagccacgggtcctgcaagagcgtgatgcagaagccgtccactttcctggagataccctaccccggcaacagcgagatcatcgggggcgacatcggcatccacatgagcgagcgggggtccccctctaacatccacgtcgtggtgcactgcaagccgaaggactcatgcgacatcagcgactgcatcttctgcaagcacggcatcctgaactaccagtgccactccgtcgccagcgccgtgctcctgtccacgatgatcgccgcgtgcctggccctcgtgggggttatcgtgagccgctccaagcacgccgtgaagttcctggctagcgtcgtggccatccccttcaagtgggtgtccttgctcaccgtctgggtggtgaagaactggaagctgcggatcacccgcgtcatccgggccaccaacgacgccatcggctgggagaacaacctggagcaggtccgcgtggagaacgccgcgcggcgcccccagccggccgtgcggtacgcgttctacggcaccacgatcctcagcatcctgtccaccgggctgtgctgcagcgagtccctcatcgccgagagctccatcatgcagtgcaccaccgaggacagctccacggtgtgcaaggccaccggcaccgtggtcctcaagctggggcccatcggtagcgagagctgcctcatcctgaaggggctgcgcgacaacgagaagcagttcatctccatcaagaccatcagctccgagctcacgtgccgcgagggcgagagcttctggacctccctgtacacccccgtgtgcctgagctcccgccggtgccacctcatgggcgagtgcaccggggacatctgcctgaagtggaagacgaacaagaccagcgccgagttcaccggcaagacccactccgaggtgatccacgagaacaagtgcttcgagcagagcgggggcatggggtacggctgcttcaacgtcaacccctcctgcctgatggtgcacagctacctcaagccgatctacaaaaacgccttcaaggtgttccggtgcgtcgcgtggaaccaccgcgtgcggctgggcatcacgacccacaaacgcaacttcgagatcaccctgatggccatgtccacccagcagacggactgggggagcatcggcctcatcctggactccgaggggatcaccggcaccaacagctactccttcatgaagcacgggctgggcagcttcgccatcatcgacgagccctacgtgaccgagccccggaagggttacctcggggaggtccgctgtcctacggaggagaccgccgtgaaggcgtccccgagctgcaaggtggcccccggcctgatcgagtaccagcccgagatggacgtcgtggagtgcaccacaaacatgatggaccccatggccatcttcaaccgggggagcctgccgcaggtccgcgacggcaagacgtttacccagtccatcgagaagtcctcagtgcaagccctcaccaccggggagatccacgccagcgtgcggctggtcctggacgagtacgaggtggagtacaaggtggtcaacaatgactgcgactccacgttcgtgaacatcaccggctgctacagctgcgacgagggcgcgcgcctctgcgtgaaggtaaaggcctccagcgacgtgatctaccacttcaccgactccgacaacagcatgaacgtcctgttcaaggtctccagcaacatccaggactactgcatcgtgctgcacttctccaagcccgtggtcaacgtggaggggaagtacgactgcggtcggagcaagaagcccatgctcataaaggggaccctgatcgcgatggcaccccacgacgaccgcgtgacgaacggcggctccagcatcatcatcaacccgaagggcggcggggtcgacttcctggggtggctctccgggctgagctcctggttcggtggccccctgaaaaccttccttatcatcgctgggtttctgatcgtgggcatcatcatcgtgatcatcatcatcatcctggcccggctcgggatacagcaggccctggccaagaagttgaagtga

SEQ ID NO: 16339 - RNA, 4020 nt, synthetic construct
  misc_feature 1..4020: note = derived and/or modified CDS sequence (opt11) from TOSV(9028)__KU904264.1__GP
  source 1..4020: mol_type = other RNA
atgtttatcgccaagctgcttctgatttcttgcctggtgcagcaggcgtacctcaagtacaccatcatctccgagatcggcaacgggactcgcacgagcttctgctactccagccggacctctctgggtagcctgctcgaggcgtgggataacgtgaccgagtccatcgggctgaccagcgggacgtgcaaggtggggtcccttgagaaccgcgactgccggaaggacatcatgtctaactacgtggccgaggtccactccgacctccacggactaggcgccatgatgcacaactacggagatgacaagcgcgtggagatactgaacgacgtgatccccgacgagctcaacccaggccaccacaactgcagcgacctggaccggaaacccttctggaccgaatttatcaacgtcgccaagcccctgagtgaaatcgtgcccatgagcgtgataccgccgccagttgtgaagctccagccgcccgccgagccctcctcaaagaagcatgtgcccttcgacgtcctactgtccgaggcagagaaggagctcaaccagaccaagatccgcctggaggacgaacgcaagagcaacgccgaggagaccgccaaggagcgggcacggatgaaagaaattgaggacgagctgcgccgagagtgggagctcgagcgcaagcggaaggacgcgatggccgacgacctggctaaggagacggcccgccggcgagaaatcgagcggaaggctcacgagctggacaagatgctcaagaagaaggagcgcgagtccctaatcgcaaaagagaaggccgacgaggacatgcggagccacgtccataaacccaacaccacgcgcgcccccgcccccaccatcatcaccaccctgctcatggcctcagcggcgctggccgggcccctggagaaccgggaaacgaaccatctcttaaaccgccccggcaacggggcctacaccctgtccgacttcgccgagagcacgtgcaccctcgcgtatggctccgagtgcaagagctgggagcatctcctcaacgaagaactgtttccgttcttccactccaacctggacaagtacagcatgctggaggccgccaccgagacagtgcccatcctcaacaagtccagcgccgtctgcacgatctctcccagcacccattccagcaacgcctgcggccgcgaggcgtccgtgatccggaagaaatgctactctaacatgtccgctttcttctacatcaacctggctgggcagatcaccgtgataaaatgtgagacgaaccacgtcctgagctccgactgtggcaattgcatctcgaagtccctcagcggccagaaagtttacacgcccgtgcaggacgttttctgccagaagggctggacccagagcattccgtccacccgctattctaaggatatctgctccatcggcctccacaccgtaaaggagtgcaagatcggcacgaccagcttcgagcgggtgggcttcatcgttgtgaaggggcgcaagatgtacatcgaacagatgaagatgcggtcccgccaggaatacagcgaggaccagttcttatgctacaagtccgagagcggctccggtagctccgtcaagctcaagaagtttaaggtggagagctgtaagggcgtgacaacctcctcagccagtaagtgcagcggtgacgagtacttctgttcccggtacccctgcgagacggcgaacgtcgaggcccactgtatcctgcgccgccacagcgccatcgtggaggtgaatgtcaacggggtctgggtggtccccaggtgcatcggctacgaggaggtgttggtgaagcggactagcctcaaggttgaggacaccaccgggcgcgaatgcgactcctgcctgtgggagtgcggcaagaacaagctgattgtgaagacgcacgggcccaaggtagtctacgccaccgcctgcagccacggatcctgcaagagcgttatgcagaaacccgcaaccttcgtctatctgccataccccggcaactccgagatcgtcgggggagacatcgggatccacatgacagaggaaagctcccccagcaacattcacctcgtggcccactgcccggcccgcgactcctgcgacgtgagcgactgcctgttctgcgtccacggcctgctcaactaccagtgccacacgctgttctccgccctgctcatcagcaccacggtgatgtccatactgaccctgctcctgctgctggtgaagggggccaaggatctggttaaaaagctgttccattggctcatcactcccctgtgctggctgagtgtgttctgctgctgggtggtcaagtcctggaaaagacgggtgggcagcgcgatctccaggaccaatgacaccatcggctggcgggagaaccgccggcacgcccaggacatcgagcgagcccagtacaccgggggcgcaccgggtgccaagtacagcttctacggcgtgatgatcctcggcctgctgtccagcgcgcagagctgctccgagtccgtcatcgccgactccaagatcatgcagtgcacaacgagcgggtccagcaccctctgcaaggcctccggcaccgtgatcatgcgcctggggcccatcggcagcgagtcctgcctgatcctcaagggcctcaaggatagcgagaagcagttcatctctataaagaccatcagttccgagctgacgtgccgggaaggcgagagcttctggaccactttatacacccccatctgcctctccagccgccggtgccatctgatgggcgagtgcgtgtccgaccgctgcctcaagtggaagacgaatcagaccagcgcagagctgaccgggaaggcgcacggcgacgtcatgcacgagaaccggtgcttcgagcagtccgggggcatcggttacggctgcttcaacgtgaaccccagttgcctgtacgtgcacagctacctcaagtccgtctaccgcaacggattcaaggtgttccggtgcgtagcatggaaccaccgcatcaggctggaggttaccacgcacagccgcaagtttcccatggtgctgatggccatgtccacccagccgaccgactgggggagcataggcctgatcttagactccgaagggatcaccggcacgaacagctacagcttcatgaagcacgggagcggctccttcgccatcatcgacgacccctacagcccagagccccggaagggcttcctgggggaggtgcgctgcccgaccgaggagaccgccatgcgcgcttccccaagctgtaagatggcccccaacctcattgagtaccagcccgaaatggataccgccgagtgcacgaccaacatgattgacccgatggccatctttaaccgaggctccctcccacaggtccgggacgggatgaccttcacccagagcatcgagaagaacacggtgcaggcactgaccaccggcgaggtcaaggcatctatccgcttaatcttagacgattacgacgtcgtataccaaaacagccagtccgactgcagcgccaccttcaagaatctgacggggtgctactcctgtgacgagggcagccggctctgttaccaggtgaaggccgagggcgagaccatcttccactttatcaacgaggaagagagcatcaacgtcatcaataaggtgtcccccggagtgagcgactactgcaccgtcctgcacttctcccgccccgtgattagtatcgaaggcacctacgactgcgggctgtccaagcggcccatggtcatcaagggcacgctcatcgcgacggcgccccacgacgaccgcaagcatgaaggcgggtcctcccttgtcgtgaacccgaaaggcgggagcgttgatttcttcggttggctgtcagggctcaccagctggctgggcggccccctgaagaccttcctcactatcctcgggttcctggcggtgggacttctgctggtggtcatcattatcatcatcatccggacggggatgcagcaggcccttaagaagaagatcaagtga

SEQ ID NO: 16340 - RNA, 4020 nt, synthetic construct
  misc_feature 1..4020: note = derived and/or modified CDS sequence (opt11) from TOSV(A189)__KP694241.1__GP
  source 1..4020: mol_type = other RNA
atgttcatcgccaagttactcctgataagctgcctggtgcagcaggcctacctcaagtacaccataatctccgagataggcaacgggacccgcacgagctcctgctacagctcccggaccagcctgggctccctgctcgaggcgtgggacaacatcaccgagagcatcgggctcacctccggcacgtgcaaggtcgggagcctggaaaacagggactgcaagcgggacatcatgtccaactacgtggccgaggtgcacagcaacctccacggcctgggcgctatgatgcacaactacggggacgacaagcgcgtcgaggtgctgaacgacgtgatccccgacgagctgaacccgggccggcacaactgctccgacctggaccgcaagcccttctggaccgagttcatcaacgtcgcccggcccaccaacaagatggcccccatgagcgtgatcccgccgcccatcgtgaagcccatccccgtcgcggagcccaccatcgagaagacgatccctttcgacaagctgctctccgaggccgaaaaagagcttaaccagaccaagatccgcctggaggcggagcggcgcagcaacgccgaggaggcggccaaggagcgggcccgcatgcgcgagatcgaggacaagttacgcaaggactgggagctagagcgggagcgcaaggacgcagtggccgacgacctggcgaaggagatcgcccggcgccgggaaatagagcgcaaggcccacgagctcgacaagatgctgaagaagaaggagcgggaggacctggtggcccgcgaacgcgtctccgaggatatgcggaaccacgtgcgccgacccaacaccaccatcgccccggcgcccacgatcatcaccacactcctgatggcctcggccgtgatggccgggcccctggagaaccgagagaccaaccacctcctgaaccggcccggcaacggggcctacacgctgtccgacttcgctgagagcacgtgcaccctcgcctacggcagcgagtgcaagtcctgggagcaccagctggacgagctgagcttcccgttcttccacagcaacctcgacaagtacagcatgctggaggccgccaccgaaaccgtccccatcctgaacaagtccagcgccgtgtgcaccatctaccaccccaggattcaccggatggcgtgcggccgcgaggcctccctcatcaaaaagaagtgcgggagcaacatgtccgccttcttctacgtgaacctggccggccagatcaccgtcgtgaagtgcgacaccaaccacgtgctgagcaacgactgcggaaactgcatctccaaaacgctcagcggccagaagatctacacccccgtccaggacatgttctgccagaagggctggaccgagtccatcccgaacacccggtacagcaaggatctgtgctccatcgggctgcacacggtaaaggagtgcaagaccggcaccaccaacttcgagcgcgtggggttcatcgtcgtgaagggccggaagatgtacatcgagcagatgaagatgcgcagccggcaggagttctccgaggaccagttcctctgctacaagagcgagtccagtagtgggtccagcgtcaagctgaagaaggtgaaggtggagtcctgcaagggcgtcacgaccagctccgcgagcaagtgctccggcgacgagtacttctgcagccgctacccctgcgagaccgccaacgtggaggcgcactgcatcctgcggcgccacagtgccgtgatcgaggtcaacgtgaacggggtgtgggtcgtgccccggtgcataggctacgaggaggtgctcgtccgccggaccagcctgaaggtggaggacacgtccagccgcgagtgcgacacgtgcctgtgggagtgcgggaagaacaagctcatcgtgaagacccacggccccaagatcgtctacgccaccgcgtgctcccacgggagctgcaagtccgtgatgcaaaagccggccaccttcgtgtacctgccctaccccggcaacagcgagatcgtcggcggggacatcggcgtacacatgacagaggagtccagccccagcaacattcacatggtggcccactgcccggccaaggactcctgcgaggtcagctcctgcctgttctgtgtgcacgggctgctcaactaccagtgccacaccctgttcagcgccctgctcatctccaccaccgtgatgagcattctgacgctgctcttgctgctcatgcgcggcgcgaaggacctggttaagcggctgttctactggctcatcacgccgctgtgctggttgtccgtgttctgcagctggatgatcaagtcctggaagaagcgcgtcgggagcgccatcagccggaccaacgacaccatcggctggcgcgataaccggcgctacggccaggacgtcgagcgggcccagtacaccgggggcgcccccggggcaaagtactcattctacggtgtgatgatcctcggcctgctggggaacgtgcactcatgcagcgagtccgtcctcgccgacagcaaaatcatgcagtgcaccacctccggtagctccaccctgtgcaaggccagcgggaccgtgatcatgaagctgggtccgatcgggagcgagtcctgtctcatcctgaagggcctgaaggacagcgagaagcagttcatctccatcaagaccatcagctcggagctgacctgccgcgagggcgagagcttctggaccacgctctacacccccgtgtgcctgtccagccggcgctgccacctcatgggggagtgcgtctccgaccggtgcctgaagtggaagacaaacgagaccagcgccgagttcacgggcaaggcccacggggaggtgatgcacgagaaccgctgcttcgagcagagtggcggtatcggctacggctgcttcaacgtgaaccccagctgcctgtacgtccactcctacctcaagagcgtgtacaagaacggtttcaagatcttccggtgcgtggcgtggaaccaccgcatccggctggaggtcaccacccactcccgcaagttccccatggtgctgatggccatgagcacccagccgacggactggggcagtatcgggctcatcctggacagcgagggcatcaccgggaccaatgcctactccttcatgaagcacggcagcgggagcttcgccatcatcgacgacccctactcccccgagccccggaagggattcctgggcgaggtgcgctgcccgaccgaggagacggccatccgggcgagcccctcctgcaagatggcccccaacctcatcgagtaccagcccgagatggacaccgccgagtgcaccaccaacatgatcgacccgatggccatcttcaacagagggagcctgccccaggtgcgggacggcatgacgttcacccagtccatcgagaagaacaccgtgcaagccctgaccacgggggaggtgcgcgcgagcatccgcttaaccctggacgactacgatgtcgtgtaccagaactcccagagcgactgctccgccaccttcaagaacctgaccggctgctacagctgtgacgagggctcccggatgtgctaccaggtgaaggccgagggggagaccatcttccacttcgtaaacgaggacgagagcatcaacgtgatcaacaaggtgtcccccgacgtcagcgactactgcacggtgctccacttctcccgccccgtcatcagcatcgagggccggtacgactgcgggctgtccaagcgcccgatggtgatcaagggcaccctgatcgccaccgcgccccacgacgaccggaagcacgagggcgggagctccctcgtggtcaaccccaagggagggaccgtggacttcttcggctgggtgagcgggctaacgagctggctgggcggccccctcaagacctttctgaccatcctggggttcctcgccctgggcctgctcctggtcgtgatcatcatcatcatcgcccgcaccggggtgcagcaagccctgaagaagaagaacaagtga

SEQ ID NO: 16341 - RNA, 4020 nt, synthetic construct
  misc_feature 1..4020: note = derived and/or modified CDS sequence (opt11) from TOSV(AR)__EF656362.1__GP
  source 1..4020: mol_type = other RNA
atgttcatcgccaaactactactaatctcgtgcctagtacaacaagcctacctaaagtatacgatcatatcagaaataggcaacggcacccgtacgagcttctgctatagctcccgaacgtccctaggttcgctcctggaagcgtgggacaacgtaaccgaaagcattggcctaacctctggaacctgcaaagtcggcagcctcgaaaaccgagactgccgaaaggacataatgtccaattacgtcgccgaagtacactccaaccttcacggcctaggcgctatgatgcacaactacggcgacgacaaaagagtagagatcctcaacgatgtaatccccgacgaacttaacccaggacaccacaactgctccgatctcgatcggaaaccattctggactgagttcataaacgtagcaaagccctcgagcgaaatagtgccaatgtccgttatcccaccaccagtagtaaagctccaacctccagcggaaccctcctcgaagaaacacgtaccctttgacgtcctactatctgaagccgaaaaagagctcaatcaaacgaagatacgactcgaggatgagcgcaaatccaatgctgaagaaaccgccaaagagcgcgcccgcatgaaggaaatcgaggatgaactccgtagagaatgggaactggagcgtaagcgcaaagacgccatggccgatgatctcgcaaaagagacggcacgccgccgagaaatcgagcgcaaggcccacgagctcgaccgcatgctcaaaaagaaagaaagggagagcctcatcgccaaagagaaagcggatgaagacatgcggagtcacgtgcataaaccaaacaccaccagagctcccgcccccaccatcatcacgacgctgctgatggcctccgcggccctagcgggacccctcgaaaaccgcgaaactaaccacctactcaaccgaccaggcaacggcgcctacaccctatccgactttgccgaaagcacgtgcaccctagcttacggaagcgagtgcaaatcatgggaacatctactcaacgaagaactattccccttctttcactccaatctagacaaatactccatgctcgaagccgcaacagaaacagtccccatcctcaacaaaagcagtgcagtctgtacgatttccccctcgacacactcatccaacgcatgcggcagagaagctagcgtaattagaaagaaatgctactcaaacatgtccgcctttttctacatcaaccttgcaggacaaatcaccgtcgtcaaatgcgaaacaaatcacgtcctaagttctgactgcggaaactgcatcagcaaaagccttagcgggcaaaaagtgtacacacccgtacaagacgtcttctgccaaaaaggctggacccagtcgatccctagcacccgatacagcaaggacatctgcagcatcggactccatacagtcaaagaatgcaaaatcggaacaacatcatttgagcgagtcgggttcatcgtggtaaaaggcaggaagatgtatatagaacaaatgaaaatgagatcccgacaggaatacagtgaagaccagttcttatgctacaaatccgaatcagggagcggctcgagcgtaaaactcaagaaattcaaagtagaaagctgcaaaggggtcaccacctccagcgcttcaaaatgctctggagatgagtacttctgcaaccgctacccgtgtgaaaccgcgaacgtcgaggcccactgcattctgagacgccattcggcaatagtcgaagtcaacgtaaacggcgtgtgggtagtcccacgctgtataggatacgaggaagtgctcgtaaaacgaacgtcactaaaagtagaagacacgacaggacgcgaatgcgactcatgcctttgggagtgcgggaaagataaactaatcgtcaagacacacggacccaaagtcgtctacgccaccgcctgctcccacggctcctgcaaaagcgtgatgcaaaagcccgccaccttcgtctacctaccctatccagggaactcagaaatcgtcggcggggacatcggcatacacatgacggaagagtcgtcccctagcaacatccacctggtagcacactgccccgccaaagacagctgcgacgtcagtgactgcctcttctgtgtacacggactcctcaattaccaatgccacaccctattctcggccctactcatatccaccacagtgatgtccatcctcaccctgctcctacttcttgtcaagggtgcaaaagacctcgtaaagaaactattctactggttaataaccccactatgctggctgagtgtcttttgctgttgggtcgtcaaatcttggaaacgccgcgtgggctcagctatctcccgaaccaacgacacaataggctggcgcgaaaacaggcgccacgcccaggacatagagagagcacagtacactgggggagcgcctggagcaaaatattctttctatggagttatgatcctaggcctactcagctcggcacaatcttgctccgaatccgtcatcgccgactccaagatcatgcaatgcacgaccagcggcagcagcaccctttgtaaggcatcaggcacagtaataatgagactgggaccgattggtagcgagtcttgcctaatcctcaaaggattaaaagactccgaaaaacaattcatatccatcaagaccatatcctcagaactaacttgccgcgaaggcgaatcgttctggaccaccctctacacaccaatctgtctctcctcacgaagatgccacctcatgggagaatgcgtatcagatcgctgtctcaagtggaaaaccaatcaaacaagtgcagagttcaccggaaaagcgcacggggatgtaatgcacgaaaaccgatgctttgaacaatcgggcgggataggttacggctgcttcaacgtcaatccctcatgtctatacgtacactcatacctcaaatccgtatacaggaacggcttcaaggtctttagatgcgtcgcctggatacaccgcatccgactcgaagtcacaacacacagccggaagttcccaatggtcctcatggccatgtccacccaaccgacagactggggctcgataggactaattctcgactccgagggcataacagggacaaacagctattcttttatgaaacacggctcaggatcctttgccataatagacgacccatactcacccgaacctaggaagggattcctaggcgaagttagatgtcctacagaagaaacagcaatgcgggcgagcccatcctgtaaaatggcccccaacctcatcgaataccagccagagatggacacggcagaatgtacaacaaacatgatcgaccccatggccatattcaaccgaggcagcctcccccaagtcagggacgggatgacattcacccaaagcatagagaaaaacacagtacaggcactaaccactggagaagtcaaagcgtccatacgcctgacactagacgattacgacgtcgtctaccaaaactcgcaatctgactgctcagccaccttcaagaacctaacaggatgctactcttgtgatgaaggttctcgcctctgttaccaggtcaaggccgaaggcgagacagtcttccacttcatcaacgaagaggaatcgatcaacgtcatcaacaaggtttccccgggcgtgtcagactactgcaccgtactccacttcagcaggccagtgatctcaatcgaaggcacttacgactgcggcctctccaaacggccgatggtcatcaaagggacgctaatcgcaacagcaccccacgacgaccggaagcacgaaggaggcagctccctcgtcgtcaaccccaaaggtggctcggtggacttcttcggatgggtctcaggactgacatcttggttaggcgggccccttaaaaccttcctaaccatactcggattcctcgcagtaggactgcttctggtcgttatcataatcattatcatccgcaccggaatgcagcaagcactcaaaaagaagataaaatga

SEQ ID NO: 16342 - RNA, 4020 nt, synthetic construct
  misc_feature 1..4020: note = derived and/or modified CDS sequence (opt11) from TOSV(EsPhGR40)__FJ153283.1__GP
  source 1..4020: mol_type = other RNA
atgttcatcgcgaaactgctactaatcagctgtctcgtccagcaagcctacctaaaatacacgattatcagcgagatcggcaatggtacgcgaacatctttctgttactcaagccgaactagcctaggcagcctcttagaagcgtgggacaacgtcacagagagcatcggcttaaccagcggaacctgcaaagtcggtagtctagagaaccgtgactgtggcaaggacatcatgtccaattacgtagccgaagttcatagcaatctccacggcctaggagccatgatgcacaactacggtgacgacaaaagagtagaaatactcaacgacgtaatacctgacgaactaaacccaggccatcacaattgttcagacctggaccgcaagccattctggaccgagttcatcaatgtagcaaagccactcagcgaaatagcaccaatgtccgtcatacccccacccgtcgttaaattgcaacccccagccgaaccctcatcaaagaaacatgtaccctttgacgtgcttctaagcgaagccgaaaaagaactcaaccaaactaagatccgtctagaggatgaaagaaaaagcaacgcagaagaaaccgcccgagaacgcgcgcgcatgcgcgacatagaagaagaactacgcaaagaatgggaactcgagcgcaaacgaaaggacgcaatggcagacgacctggcaaaagaaacagcaaaaagacgagaaatcgaacgcaaagcccatgaactagatcgtatgttaaagaagaaagaacgagaatccctaatagcaaaagagaaggaggacgaaaacatgaggtcccgcgtccacaaaccctccacaacgagagcgcccgcaccaacgatcatcaccacactcctcatggcatcgacggccttagcggggccactggagaaccgagaaacaaatcacttgctaaacagaccaggcaacggcgcctacacactaagcgacttcgcagaaagcacatgtacgctagcatacggaagcgagtgcaaatcctgggaacatctgctaaacgaagaattattcccattcttccactccaacctcgataaatactcgatgcttgaagccgctacggagacagtccctatactaaacaaatcatccgccgtttgcacaataagtccctcgacacacagctcaaacgcgtgcgggcgagaagcatcagtcattcgcaagaagtgctactctaacatgagcgccctgttctacatcaacctagccggacaaatcaccgtagtgaagtgcgaaaccaaccacgtgctatcctccgactgcggcaactgcatatcgaaatcccttagtggccagaaagtctacacacccgtccaggacgtgttctgtcaaaaggggtggacagaatcgataccttccacgagatattcaaaagacatatgctctataggactacacaccgtcaaagaatgcaaaatcggaaccacgagcttcgagcgcgtcggcttcatagtagtcaaaggccgaaagatgtatatcgagcaaatgaaaatgcgctcccgacaagaatactccgaagaccaattcctgtgctacaaatccgaatccggcagcggcagctccgtaaaactcaaaaagttcaaggtcgaatcctgcaaaggagtaacaacctcgagtgccagcaaatgctcaggcgacgagtacttctgcagtcgttacccatgcgagacagcaaacgtagaggcccactgcatcctgagaaggcacagtgctatagtcgaggtaaacgtaaacggcgtttgggttgtccctcgatgcatcggctacgaagaagtcctcgtcaagcgcacaagcctcaaagtcgaagacacaacagagcgcgaatgcgactcctgtctctgggaatgcggcaaaaataaacttatagtcaaaacccacggaccgaaagtagtctacgccactgcctgcagccatggttcatgtaaatcagtcatgcagaaaccaactacattcgtatacctaccttacccgggcaactcggaaatcgtcggcggcgacatcgggatccatatgaccgaggaatcctcaccttccaacatacacctggtcgcccactgccccgcacgagactcgtgcgacgtgagcgactgcctattctgcgtccatggcctactcaactaccagtgccataccctgttctcagcactactaatctcaaccaccgtaatgtccatactaacgctgctgcttctcctcgtaaaaggcgcgaaagacctagttaagaaactgttctactggctcatcacccctctatgctggctaagtgtcttctgctgttgggtggtcaaatcatggaaacgacgcgtaggcagtgcaatcagccgcacaaacgataccataggatggcgtgagaaccgccgatacgcccaagacatagaacgcgcacagtacacaggcggcgcccccggagcaaaatatagcttctacggagtcatgattctaggcctactatcaagtgcacaatcatgctccgaaagtgttatcgccgactcgaaaataatgcaatgcactacgagcggatcctcgaccctgtgcaaagcaagcggaacggtaatcatgcgcctcggacccatagggtcagagtcctgtttgatactaaaagggttgaaagactcagaaaagcaattcatatcaataaagacaatctccagcgaactaacatgccgagaaggcgaatccttctggactactctgtacacccccatctgcctctcatcgcgcagatgccacctaatgggagaatgtgtttcggaccgttgcctaaaatggaaaacaaacgaaactagcgccgagttcacgggtaaagcccacggagacgtgatgcatgaaaataaatgttttgaacaatctggcgggataggctacgggtgcttcaacgtcaacccgagctgcctctacgtacactcatacctgaagtcagtataccgaaatgggttcaaaatcttccgttgcgtcgcatggaaccacagaatccgactcgaagtaacaactcaatcccgcaaattccccatggtcctcatggcgatgtcaacacagcccaccgactgggggtccatcggattaattctcgatagcgaaggaatcaccggaaccaacagctactcgttcatgaaacacgggtccggtagcttcgccattatagatgacccatactcccccgaaccccggaaaggattcctgggagaagtgaggtgcccaaccgaagaaacagctatgcgcgcatccccgtcatgtaaaatggccccaaatctgatcgagtaccaacccgaaatggatactgcagagtgtacgaccaacatgatcgatcctatggcaatcttcaaccgcggatcccttccccaggtccgagacggaatgacattcacacaatccatcgagaaaaacacagtacaagcccttaccaccggagaagtaaaagcatccatccgactaactctagatgactacgacgtggtctaccaaaactctcagtccgactgcagtgccaccttcaaaaatctaacgggctgttactcctgcgacgaaggctcaaggctctgctaccaagtaaaggccgaaggcgaaacagttttccacttcattaacgaagaagaaagcatcaacgtaataaacaaagtctcgccagacgtatcagactactgcaccgttttacacttctcacgccctataatcagcatagaggggacctacgattgcggccttagcaagcgccccatggttattaagggcaccctaatagcgaccgcaccccatgacgacagaaagcatgaaggcggatcgagtctagtagtcaatcccaagggcggatcagtagacttcttcggctggctatcgggcctaacttcctggctcggcggcccactaaaaacgttcctaaccatactgggcttcctcgcggtcggcctactacttgtcgtaatcataatcatcatcatccgcacaggaatgcaacaggcactgaaaaagaaaataaaatag

SEQ ID NO: 16343 - RNA, 4014 nt, synthetic construct
  misc_feature 1..4014: note = derived and/or modified CDS sequence (opt11) from TOSV(SI-121283)__JF330279.1__GP
  source 1..4014: mol_type = other RNA
atgttcatcgccaagctgctcctaatcagttgcctggtgcagcaggcctatctcaagtacaccatcatctccgagatcggcaacgggacccgcacgagcttctgctactccagccggacctccctgggcagcctgctcgaggcgtgggacaacatcaccgagtccattgggctgactagcgggacctgcaaggtcggctcccttgagaaccgcgagtgcaagcgggacatcatgagcaactacgtcgcagaggtgcactccaacctccacggcctgggcgccatgatgcacaattacggggacgacaagcgcatcgaggtcctgaacgacgtcatccccgacgagctcaacccgggccggcacaattgcagcgatctggaccgcaagcctttctggaccgagttcattaacgtggccaagcccgccaatgagatggcgcccatgtccgtcatcccgccgcccatcgtgaagcccatccccgtggccgagagcaccaccaagaagacgatccccttcgacaaactgctctccgaggccgagaaggaactgaaccaaaccaagatccggctggagaccgagcgccgcagcaacgccgaggaggcggccaaggagagggcccggatgcgcgagatcgaggacaagctccggaaggactgggagctggagcgcgagcggaaggacgcggtcgccgaggacctggcgaaggagatcgcccgccgccgcgagatagagcggaaagcccacgagctcgataagatgctgaagaagaaagagcgcgaagacctggtggcccgggagcgcgtggacgaggacatgcgcaaccacgtccggcgccccaacaccacgatcgcccccaccatcatcaccaccctcctgatggggtccgcggtgatggccggcccgctggagaaccgggagcccacgcacctcctgaaccgccccgggaacggcgcctatcccctgtccgatttcgccgagcctacctgcaccctcgcctacgggagcgagtgcaagagctgggagcaccaactggacgagctgagcttccccttcttccactccaacctcgacaagtacagcatgctggaggcggccaccgagacgatccccatcctgaacaagtcgagcgccgtttgcaccatctccccctccacgcactccagcaacgcctgcgggcgggaggcctctctcatcaaaaagaagtgtggcagcgacatgtccgcgttcttctacgtcaacctggcggggcagatcaccgtggtgaagtgcgacacgaaccacgtcctgagcaacgactgcggcaactgcatctccaagaccttgagcggtcagaagatttacacccccgtgcaagatatgttctgtcagaaggggtggtccgaaagcattccctccacccgatacagcaaggacctgtgctccatcggcctgcacacggtgaaggagtgcaagatcgggacgaccaacttcgagcgggtcggcttcatcgtggtgaaggggcgcaagatgtacatcgagcagatgaagatgcggagccgccaggagttcagcgaggaccagttcctctgctacaagtccgagggcagctccggctcatccgtcaagctgaagaaggtgaaggtcgagagttgcaagggggtgaccacgtccagcgcctccaagtgcagcggcgacgagtacttctgctcccggtacccgtgcgaaaccgccaacgtggaggcgcattgcatactgcgccggcacagcgcagtgatcgaagtgaacgttaacggggtctgggtggtcccgcgctgcataggctacgaggaggtcctcgtgcggcgcacctccctgaaggtggaggacaccagctcccgggagtgcgacacgtgcctgtgggagtgcgggaagaacaagctcatcgtcaagacccacggccctaagatcgtttacgccaccgcttgctcgcacggctcctgcaagagcgtgatgcagaagcccgccaccttcgtctacctgccctatcccgggaacagtgagatcgtgggcggcgacatcggcgtgcacatgaccgaggagtcctcgccgtccaacatccacatggtcgcgcactgtcccgccaaggacagctgcgaagtgtccagctgcctgttttgcgtgcacgggctgctcaactaccagtgccacacgctgttctccgccctgctcatcagcaccaccgtcatgtccatcctgaccctgctcctgctgctcgtgaagggcgccaaagacctggtgaagcgcctgttctactggctcatcacgccactgtgctggctgagcgtcttctgcggctggatgatccggagctggaagaagcgcgtgggtagcgccatctcccgcaccaacgacaccatcggctggcgggacaacagccgccgggggcaggacatcgaacgcgcgcagtacaccggcggcgccccgggggccaagtactccttctacggtgtgatgatcctcgggctgttgggaaacgtccacagctgctccgagagcatcatagccgactccaagatcatgcagtgcactaccagcgggagctccaccctctgcaaggccagcggcacagtgatcatgaagctgggcccgatagggtccgagagttgcctgatcctcaaaggcctgaaggattccgagaagcagttcatcagcatcaagacgatatccagcgagctgacctgcagggagggggagtccttctggactaccctctatacccccgtgtgcctgagctcccgccgctgccacctgatgggcgaatgcgtcagcgatcgctgcctccggtggaagaccaacgagacctcagcggagttcaccgggaaggctcacggcgaggtaatgcacgagaaccgctgcttcgagcagagcggcgggattggctacgggtgcttcaacgtgaacccctcctgcctgtacgttcacagctaccttaagtccgtgtacaagaacggcttcaagatattccgctgcgtggcctggaaccaccgcatccggctcgaggtcacgactcacagccgcaagttcccgatggtgctcatggccatgtccacccaaccgaccgactgggggagcattggcctgatcctcgacagcgagggcatcacggggaccaacgcgtacagcttcatgaaacatggcctggggagcttcgccatcatcgatgacccctactcccccgagccgcggaagggcttcctgggggaggtgcgctgccccacagaggagaccgccatccgggccagcccctcctgcaagatggccccaaacctcatagagtaccagccggagatggacacggcggaatgcaccaccaacatgatcgaccccatggccatcttcaaccgcggcagcctgccccaagtccgggacggcatgacctttacgcagtccatcgagaagaacaccgtgcaggccctgaccaccggggaagtgagagcctcgatccgattgacgctagacgactacgatgtcgtgtaccagaactcccagttcgactgcagcgccaccttcaagaacctgaccggctgctactcctgcgacgagggaagccgcatgtgctaccaggtgaaggcggagggcgagaccattttccacttcgtcaatgaggacgagagtatcaacgtgatcaacaaggtaagccccgacgtctctgactactgcaccgtgctccacttcagccgcccggtgatctccatcgaaggccggtacgactgcgggctgagcaagcgtcccatggtcatcaagggcactctgatcgccaccgcgcctcacgacgaccggaagcacgagggcgggtcctcgctcgtggtcaaccccaagggcgggaccgtggacttcttcggctgggtaagcggtctgacctcctggctgggcgggcccctcaagacgttcctgaccattctgggcttcctcgccctggggctgctcctggtcgtgatcatcataatcattgcccgcaccggcgtggaacaggccctgaagaagaagaacaagtga

SEQ ID NO: 16344 - RNA, 4014 nt, synthetic construct
  misc_feature 1..4014: note = derived and/or modified CDS sequence (opt11) from TOSV(SI-121487)__JF330280.1__GP
  source 1..4014: mol_type = other RNA
atgttcatcgccaagctgctcctaatctcctgcctagtgcagcaggcctacctcaaatacactatcatctccgaaattggcaacgggacccgcacgagcttctgctactccagccggacctccctgggcagcctgctcgaggcgtgggacaacatcaccgagtccatcgggctgaccagcggcacgtgcaaggtcgggtccctggagaatcgcgagtgcaagcgggacatcatgagcaactacgtcgcggaggttcactccaacctccacggtcttggcgccatgatgcacaactacggagatgataagcgaatcgaagtcctgaacgacgtgatccccgacgagcttaacccgggccggcacaactgctccgacctggaccggaagcccttctggaccgagtttatcaacgtggcgaagcccgccaatgagatggcgcccatgtccgtcattcccccgcctatcgtgaagcccatccccgtggccgagagcaccaccaagaagacgatcccattcgacaagctgctctccgaggccgagaaggagctaaatcagaccaagatcatgctggagaccgagcggagaagcaacgccgaggaggcggccaaggaacgcgcccgcatgcgggagatcgaggacaagctccgcaaggactgggaacttgagcgggagcgaaaggatgccgtcgcggaggacctggcgaaagagatcgcccggcgccgggagatagagcgcaaggcgcacgagctcgacaagatgctgaagaagaaggagcgggaggacctcgtcgcccgcgagcgggtggacgaggacatgcgcaaccacgtgcgtcggcctaacaccacgatcgcccccaccattatcaccacccttctgatggcgtccgccgtgatggccgggccgctggagaaccgcgagatcaatcaccttctgaactggcccggcaacggtgcctacacgctaagcgacttcgccgagtccacgtgcacgctcgcgtacggcagcgagtgcaagtcgtgggagcatcagctggacgaactttccttccccttcttccacagcaacctcgacaagtactccatgttagaggccgccactgagaccatccccattctgaacaaaagctccgccgtatgcaccataagcccgtccacccacagctccaacgcctgcggccgggaggcgagcctgatcaagaagaagtgcgggtcagacatgagcgccttcttctacgtcaacctggccggtcagatcaccgtggtgaagtgcgacaccaatcacgtcctgtcgaacgactgtgggaattgcatcagcaaaaccctctctggccagaagatctacacccccgtccaggacatgttctgccagaagggctggtctgagtccatccccagcacccgctattccaaggatctgtgcagcatcgggctgcacacggtcaaggagtgcaagatcggaaccaccaacttcgagcgagtcgggttcatcgtggtgaagggccgcaagatgtacatcgagcagatgaagatgcggagtagacaggagttctccgaggaccagttcctctgctacaagagcgaggggtctagcggctccagcgtcaagctgaagaaggtgaaggtcgaatcctgcaagggcgtaaccacgagctccgccagcaagtgcagcggagatgagtacttctgcagccgttacccatgcgaaaccgcaaacgtggaggcccactgcatcctgcgccgtcactccgccgtcatcgaggtgaacgtgaacggggtgtgggttgtgccgcgatgcatagggtacgaggaagtcctcgtgcggcgcactagcctgaaggtggaggacacctccagccgggagtgcgacacgtgcttgtgggagtgcgggaaaaacaagctgatcgtcaagacccacgggcccaagatcgtgtatgccacggcctgttcccacggcagctgcaagagcgtaatgcaaaagcccgcgaccttcgtctacctgccctacccgggcaactccgagatcgtcgggggcgacataggggtgcacatgaccgaggagagctcccctagcaatatccacatggtggcccactgccccgccaaggattcctgtgaggttagctcctgcctgttctgtgtgcacggcctgctaaactaccaatgtcacacgctgttcagcgccctgctcatctccaccaccgtcatgagtatactgaccctactcctgctcctcgtgaagggggccaaagatctggtgaagcgcctgttctactggttaatcacgccactctgttggctgtccgtcttctgcggatggatgatccgaagctggaagaagagggtgggctccgcgataagccgaacaaacgacaccatcgggtggcgcgacaactccaggaggggacaggacatcgagcgcgcccagtataccggaggggcccctggcgccaaatacagcttctacggggtcatgatcctcggcctgctggggaatgtccactcgtgcagtgagtcgatcatcgcagatagcaagatcatgcagtgcacgaccagcggttccagcaccctctgcaaggcgtcagggaccgtgattatgaagctgggccccatcggcagcgagtcctgcctaatcctcaaggggctgaaggactcagagaagcagttcatctccatcaagacgatcagctccgagctgacctgtcgggagggcgagtcgttctggaccacgctctacacgcccgtgtgcctatccagccgccggtgtcacctgatgggggagtgcgtctccgaccgctgcctcagatggaagaccaatgagactagcgctgagttcaccggcaaagcacacggggaggtgatgcacgaaaatagatgcttcgagcagtccggcggcatcgggtacgggtgtttcaacgtgaacccaagctgcctgtacgtccactcctacctcaaaagcgtgtacaagaacgggttcaagatcttccggtgcgtggcctggaatcaccgcatccggctggaggtaacgactcactcccgcaagttccccatggtgctgatggcgatgagcacccagcctaccgactggggcagcatagggttaatcctcgattccgagggcatcacgggcaccaacgcctatagcttcatgaagcacgggtccggcagcttcgccatcatcgacgacccttactctccggagccccgtaaggggttcctgggcgaggtgcgctgccctaccgaggagaccgccatccgggctagcccctcctgcaaaatggcgccgaacctgatcgagtaccagcccgagatggacacggccgagtgcaccaccaacatgatcgaccccatggccatcttcaaccgcggaagcctcccccaagtccgggacggaatgacctttacgcaatccatcgagaagaacaccgtacaggccctgaccaccggcgaggtgcgtgccagcatccggctgacgctcgacgactacgacgtcgtgtatcaaaactcacagttcgactgtagcgctaccttcaagaacctgaccggctgttactcctgcgacgagggcagcaggatgtgctaccaggtgaaagccgagggtgaaaccattttccactttgtcaacgaggatgagtccatcaacgtgatcaacaaggtgagcccggacgtctccgattactgcaccgttctgcatttcagccggcccgtgatctccatcgagggccgctacgactgcggcctcagcaagcgacccatggtcatcaagtcaacactgatcgccaccgcaccccacgacgatcggaagcacgagggcggctccagcctcgtggttaacccgaagggcgggaccgtggactttttcggatgggtgtccggcctcactagctggctgggcggaccccttaagacgttcctcaccatcctgggcttcctggccctcggcctcctgctggtagtgatcatcatcatcatcgcccgtaccggcgttcagcaggcgctcaagaagaagaacaagtga

SEQ ID NO: 16345 - RNA, 4014 nt, synthetic construct
  misc_feature 1..4014: note = derived and/or modified CDS sequence (opt11) from TOSV(SI-21137)__EU003173.1__GP
  source 1..4014: mol_type = other RNA
atgttcatcgcaaagctgcttctcatcagctgcctggtgcagcaagcctacctcaaatatacaatcatctccgagataggcaatgggacgcggacgtccttctgctactccagccggacctctctgggcagtctgctagaggcgtgggacaacatcaccgagtccatcgggctgaccagcggcacatgcaaggtcgggtccctggagaatcgcgagtgcaagcgggatatcatgagcaattatgtcgccgaggtgcactccaacctccacggcctgggcgccatgatgcacaactacggggacgataagcgcattgaggtactgaacgacgtgatccccgacgagctcaacccgcgtcgccataattgcagcgacctggaccggaaacccttctggaccgagttcatcaacgtggccaagcccgccaacgaaatcgcgcccatgtccgtcatcccgccgcccatagtgaagccaatccccgtggctgagagcacaaccaaaaagacgatcccctttgacaagctgctctccgaggccgagaaggagctgaaccagaccaagatccgcttagagacggagcggcgcagcaacgccgaggaggcggccaaggagcgggcgcgcatgcgggagattgaggacaagctccgcaaggactgggagctggagcgcgagcgcaaggacgcagtcgccgaggacctggcgaaagagatagcccggcgccgggaaatcgagcggaaagcccacgaactcgacaagatgctgaaaaagaaggagcgggaggacctagtggcccgcgaacgcgtggatgaggacatgcggaaccacgtccgccggcccaacaccacgatcgcccccaccatcatcaccacgctcctgatggcgtccgccgtgatggcgggcccgctcgagaaccgtgaaacgaaccacctcctgaatcggcctgggaacggtgcgtacaccctgagcgacttcgccgagtccacgtgcaccttggcgtacgggagcgagtgcaagagctgggagcaccagctggatgagctgtccttccccttcttccacagcaacctcgacaagtactccatgctcgaggccgccaccgagaccatccccatcctgaacaagagctccgccgtgtgcaccatcagcccgagcacccacagctccaacgcctgcggccgcgaggcgagcctcatcaagaagaagtgcggatccaacatgagcgccttcttctacgtcaacctggccgggcagattacggtggtgaagtgcgataccaaccatgtcctgtccaacgactgcggcaactgcatctcgaaaaccctctccgggcagaagatctacactcccgtgcaggacatgttctgccagaagggctggagcgagacgaacccctcaactagatacagcaaagacctttgctccatcggactgcacaccgtaaaggagtgcaagatcgggaccacgaacttcgagcgcgagggcttcatcgtagtgaaggggcggaagatgtacatcgagcagatgaagatgcgcagccggcaggagttcagcgaggatcagttcctttgctacaagtccgagggcagctcgggatcatccgtgaagctgaagaaggtcaaggtggagagctgcaagggcgtgaccaccagtagcgcctctaagtgcagcggcgacgagtacttctgttccaggtacccatgcgagaccgcgaacgtggaggcgcactgcatccttcgtcgccactcagcagtgatcgaggtcaacgtgaacggggtgtgggtagtaccgcggtgcatcggttacgaggaggtgctcgtccgccggacttccctgaaagtggaggacacctcgtcgcgtgagtgcgatacctgcctgtgggaatgtgggaagaacaagttgatcgtgaagacccacggccccaagatcgtctacgccaccgcctgcagccacggctcctgcaagagcgtgatgcagaagcccgcaacctttgtgtatctgccctaccccggcaatagcgagatagtcggcggggacatcggcgtgcacatgaccgaggagtccagcccctccaacatccacatggtcgcccactgccccgccaaggactcatgcgaggtctccagctgcctgttctgcgtacacgggctgctcaactaccaatgccacaccctgttctccgccctgctcatcagcaccacggtgatgtcgatcctgaccttacttctgctcttagtcaagggagctaaggacctggtgaagagactattctactggctcatcacgcccctgtgttggttgagcgtgttctgcgggtggatgatccgctcctggaaaaagcgcgtcggctcggcaatctcccggaccaacgacacgatcggctggcgcgacaacagccggcgcggacaagacatagagcgggcccagtacaccggcggggcccccggtgccaagtactccttctacggcgtgatgatactggggctgctgggcaacgtgcatagctgctcagagagcatcatcgccgactccaaaatcatgcagtgcaccaccagtgggagctccacgctctgcaaggcgagcggcaccgtcatcatgaagctcgggccaatcggctcagaaagctgtctgatcctcaaaggcctgaaggacagcgagaagcagttcatcagcatcaagacaatctccagcgagctgacctgccgcgagggggaatccttctggacgaccctctacacccccgtgtgcctgagctcccggcgctgccacctgatgggcgagtgcgtgagcgaccggtgcctccggtggaagaccaacgagacgagcgccgagttcaccggcaaggcccatggcgaggtcatgcacgagaaccggtgctttgagcagagcgggggcatcggctacgggtgtttcaacgtgaacccgtcctgcctgtacgtgcacagctacctgaagtccgtctacaagaacggcttcaagatcttccgctgcgtggcctggaaccaccgaatccgcctcgaagtgaccacccacagccggaaattcccaatggtcctgatggctatgtccacacagcccaccgactgggggagcattggcttaatcctcgacagcggcgggatcacggggaccaacgcctactccttcatgaaacacgggctcggcagcttcgctatcattgacgacccctactccccggagccgcgcaaggggttcctcggagaggtgcggtgccctacggaggagaccgccatccgcgccagcccctcatgcaagatggcgccgaatttgatcgaataccagcccgagatggacaccgccgaatgtaccacgaacatgatcgaccccatggctatcttcaaccgggggagcttgccccaagtgcgcgacggcatgaccttcacccagagtatcgagaagaacaccgtccaggccctgacgaccggcgaggtaagagcctctatccggctcaccctggacgactacgacgtggtctaccagaactcccagttcgactgcagcgccaccttcaaaaatctaaccgggtgctactcctgcgacgagggcagcagaatgtgctatcaagtgaaggccgagggggagacgatcttccacttcgtgaatgaggacgaatccatcaacgtcatcaacaaggttagcccggacgtgtccgactattgcaccgtactccacttctcccggccggtgatctccatcgagggccgctacgactgcggtctgtctaagcggcccatggtgatcaagggcactctgatagccaccgcgccgcatgacgaccgcaagcacgagggtgggagcagcctcgtggtgaatccgaaaggcgggacggtggacttctttgggtgggtgagcggcttgacctcttggctcgggggccccctaaaaaccttcctgaccatcctggggttcttggcgctgggcctgctcctagtggtcatcatcatcatcatcgcacggacgggggtggagcaggccctgaaaaagaagaacaagtga

SEQ ID NO: 16346 - RNA, 4014 nt, synthetic construct
  misc_feature 1..4014: note = derived and/or modified CDS sequence (opt11) from TOSV(SI-31051)__EU003174.1__GP
  source 1..4014: mol_type = other RNA
atgttcatcgccaagctgcttctgatcagctgcctggtgcagcaagcctacctcaagtacaccatcatctccgagatcggcaacgggacgcgcacgagcttctgctactccagcagaacctccctgggtagcctgctcgaggcgtgggacaacattaccgagtcgattgggcttaccagcggcacgtgcaaagtcgggagcctggagaacagagaatgcaagcgggatataatgagtaactatgtggccgaggtgcactccaacctccacggtctgggcgccatgatgcacaactatggcgacgacaagcgcatcgaggtcctgaacgacgtgatccccgacgaactcaacccgggtcggcacaactgcagcgacctagaccgcaagcccttttgcaccgagttcatcaacgtggccaagcccgccaacgagatggcgcccatgtccgtcatcccgccgcccatcgttaagcccatcccagtggcagagcccaccaccaaaaagacgatccccttcgacaaactgctcagcgaggccgagaaggagctgaatcagaccaagatccggttggaaaccgagcggcggtccaatgccgaggaggcggccaaggagcgcgcccggatgcgcgagatcgaggataaactccggaaggactgggagttggagcgcgagcggaaggacgcggtcgccgaggatctggcgaaggaaatcgcccgcagacgcgagatcgagcggaaggcacacgagctcgacaagatgctgaagaaaaaggagagggaggacctggtggcccgtgaacgggtggacgaggacatgcgcaaccacgtccggcggcccaacaccactatcgccccgacaatcatcaccaccctcctgatggctagcgccgtgatggcggggcccctggagaatcgcgaaacgaaccacctcctgaatagacccggcaacggcgcctacaccctgtccgatttcgccgagtccacgtgcaccctcgcgtacggctccgagtgcaagagctgggaacaccagctggacgaactgagcttcccctttttccactccaaccttgacaagtacagcatgctggaggccgccaccgaaaccatcccgatcctgaacaagtccagcgccgtgtgcaccatctcccccagcacccactccagcaacgcctgcggcagagaggcgtccctcatcaaaaagaagtgcggcagcgacatgtccgccttcttctacgtcaatcttgccggccagataacggtggtgaagtgcgacaccaaccacgttctgtctaacgactgcgggaactgcatatccaagaccctcagcggccaaaagatctacacccccgtgcaggacatgttttgccagaaaggctggtccgagagcatcccttccacgcgctacagcaaggacctgtgctccatcggcctgcacaccgtgaaagagtgcaagataggcaccaccaacttcgaacgggtggggttcatcgtggtgaagggccgcaagatgtacatcgagcagatgaaaatgcggagccgccaggagttcagtgaggaccagttcctgtgctacaagtccgagggctcatcaggcagctcggtcaagttgaagaaggtgaaggtcgagagctgcaagggcgtgacgacctcgagcgcctcgaagtgttctggggacgagtacttctgttcccggtacccgtgcgagaccgcgaacgtggaggcccactgcatcttacgccggcacagcgccgttatcgaggtgaacgtgaacggcgtctgggtggtgccccgctgcatcgggtacgaggaggtcctggtgcggcgcacctccttaaaagtggaggacacgagctcccgggagtgcgacacgtgcctgtgggagtgcggcaagaacaagctcatagttaaaacccacgggcccaaaatcgtgtacgccaccgcatgcagccatgggtcctgcaagagcgtgatgcaaaagcccgcgaccttcgtctacctgccgtaccccggcaactccgagatcgtagggggcgacatcggggtgcacatgaccgaagagtcgagcccctccaacatccacatggtggcccactgtcccgccaaggacagctgcgaagtgtctagctgcctgttctgcgtacacggcctgcttaactaccagtgccacaccctgttctccgctctgctcatcagcaccaccgtcatgtccatcctgacgctgctcctactgctcgttaagggggcaaaagacctggtcaagcgcctgttctactggctcattaccccgctgtgctggctgtctgtcttctgcggctggatgattaggtcctggaagaagcgcgtgggaagcgcgatctcccgcaccaacgacaccatagggtggcgggacaactcccgccggggccaagacatagaacgggcccagtacaccgggggcgcccccggcgccaagtattctttctacggagtgatgatcctcggcctgctggggaacgtacacagctgctccgagtcaataatcgccgactccaagatcatgcagtgcacgaccagcgggtcttccaccctctgcaaggcgagcgggacggttatcatgaagctgggccccatcggctccgagagctgcctaatcctcaaggggctgaaggactccgagaagcaattcatcagcatcaagaccatctccagcgagctaacctgccgggagggcgagtccttctggaccaccctctacaccccggtgtgccttagctcccgccgttgccacctgatgggggagtgcgtcagcgaccgctgcctccgttggaagaccaacgaaacttccgccgagtttacgggcaaggcccacggggaagtgatgcacgaaaaccgctgcttcgagcaaagcggaggcatcgggtacggctgctttaacgtgaacccatcgtgcttgtacgtccacagctacctaaagtccgtgtacaagaacgggttcaaaatcttccggtgcgtggcctggaaccacagaatccggctcgaggttaccacccacagccggaagttccccatggtgctgatggcgatgtccacccagcctacggactggggcagcatcgggctcatcctggacagcggcggcatcaccgggactaacgcctactccttcatgaagcacggcctggggagcttcgctatcattgacgacccttactctcccgagccccggaagggcttcctgggggaagtgagatgccccaccgaggagacggccatccgggccagcccgtcctgcaagatggcgcccaacctcatcgagtaccagcccgagatggacaccgcagagtgcaccaccaacatgatcgaccctatggccatcttcaaccgcgggtctctgccgcaggtccgggacggcatgacgttcacgcagtccatcgagaagaatactgtgcaggccctgactacgggcgaggtgcgcgccagcatccggctaaccttagacgactacgacgttgtgtaccaaaattcccagttcgactgtagtgctactttcaagaatctgaccggctgctattcctgcgacgaggggagccgcatgtgctaccaggtgaaagccgagggcgagaccatcttccacttcgtcaacgaggacgagtccatcaacgtgatcaacaaagtgtcgcccgacgtctccgactactgcacggtgctccactttagccgccccgttatctccatagagggccggtacgattgcggcctgagcaagaggcccatggtcataaagggaaccctgattgccaccgcccctcacgacgaccggaagcacgagggcgggtccagcttagtggtcaacccaaagggcggaacggtggacttcttcggctgggtgtccgggttaacgtcctggctgggcggtcccctcaagaccttcttgaccatcctcggcttcttagccctgggtctcctcctggtcgtgatcataattatcatcgcgcgcaccggggtggagcaggccctgaagaaaaagaacaagtga

SEQ ID NO: 16347 - RNA, 4014 nt, synthetic construct
  misc_feature 1..4014: note = derived and/or modified CDS sequence (opt11) from TOSV(SI-39538)__EU003175.1__GP
  source 1..4014: mol_type = other RNA
atgttcatagccaaactactgctcatatcgtgccttgtacaacaagcctacctaaagtacaccatcatcagcgaaataggcaacggcacaagaacctccttctgctactccagtcggacgtcgctcggctcactactagaagcctgggacaacatcaccgagagcatcgggctcaccagcggcacatgcaaggtaggctccctggaaaaccgggaatgtaaaagagacataatgagcaattacgtggccgaagtgcacagcaatctgcacggacttggcgcgatgatgcacaactacggcgacgacaagcgaatagaagtcttgaacgacgtaatcccggacgaactaaacccgggaagacacaactgctccgacctagacagaaagcccttctggacagagttcattaatgtagccaaacccgcaaacgagatggccccgatgtcagtcataccaccccctatcgtaaagcccatacccgtcgcggaaagcacaacaaagaaaacaatccccttcgacaaactccttagtgaagcagaaaaggaactaaaccaaactaagatccgcctcgagacggaaaggagaagcaacgccgaggaagcagcgaaggaacgcgcaaggatgagggaaatcgaagacaagctccgcaaagactgggaactcgagcgggagcgaaaagacgccgtcgcggaagacttagcaaaagaaatagcccggcgacgcgagatcgaacgaaaggcccatgagttggacaaaatgttaaagaagaaagagcgggaagacctcgtcgcgagagaacgcgtagacgaagacatgcgaaaccacgttcgccgccccaacaccacaatagcccccacgatcataaccacgctgttgatggcgagcgccgtcatggccggacccctcgaaaaccgcgaaacaaatcacctactcaacagacccggcaacggcgcatacacactctccgacttcgccgaaagtacctgcaccctggcttacggaagcgaatgtaaaagctgggaacaccaactagacgagctatccttccccttcttccactcgaacctagacaaatactctatgcttgaagccgccacggagaccataccaatactcaacaaaagctcagccgtctgcactatctcgccctcaacccacagcagcaacgcatgcggccgtgaggcatcgctcattaaaaagaaatgcggtagcgatatgagcgcgttcttctacgtcaacctcgcgggtcagattaccgtagtcaaatgcgacaccaaccacgtactatcaaacgactgcggaaactgtatctccaaaacgctcagcggccagaaaatatatacccccgtccaagacatgttctgccaaaaaggatggtccgaaagcatcccgagcacacgctactccaaagacctttgctccatcggactacacacagtcaaagaatgcaagataggaaccaccaacttcgaacgagtagggttcatcgttgtaaaaggcagaaaaatgtacatcgagcagatgaaaatgcggagccgccaagagttctccgaagaccaattcctctgctacaaatcagaaggcagctcgggctcaagcgtaaaactcaaaaaggtcaaagtcgaaagctgtaaaggtgttacaacatcatcggcttcaaagtgcagcggggacgaatacttctgtagccgctacccatgcgaaaccgcgaacgttgaagcccactgtatccttcgacgtcatagtgctgtaatcgaagtgaacgtaaacggcgtatgggtcgtaccaagatgcatcgggtacgaagaagtgttggtaagacgcacatcactcaaagtagaagacacctcaagccgcgaatgcgacacatgcctctgggaatgtggcaagaacaaattaatcgtcaagacgcatggcccgaagattgtttacgccacagcctgctcacacggatcctgcaagtccgtaatgcagaaacctgcaacattcgtatatctcccataccccggtaacagcgaaatcgtaggaggcgacattggggtccacatgacagaggaaagctcaccctccaatatacatatggtcgcccactgtccagccaaagacagctgcgaagtgtcgagctgcctattttgcgtacacggtctactcaactaccagtgccacacacttttctccgccctacttattagcacaaccgtcatgtccattctaacattgttacttctcctagtaaaaggcgccaaagacctagtcaaacgactcttctactggctcatcaccccgctatgctggctatccgtgttctgcggatggatgatccgatcctggaagaaacgtgtaggaagcgccattagccgcaccaacgacacgataggctggcgggacaacagtagacgaggtcaggacatcgaacgcgcccagtacaccggcggagcgcccggcgcaaaatatagtttctacggtgtcatgatcctcggcctactcggcaatgtacactcatgttccgaatccatcatagctgactcgaagataatgcagtgcacaaccagcgggtcgtccacactctgtaaagcgtccggcacagttatcatgaaactaggaccgataggctcggaatcatgcctgatcctcaaagggctaaaagacagtgagaagcagtttatctctatcaaaaccatatcttcagaactaacgtgccgcgagggcgagagcttctggacgaccctatacacaccggtctgcctaagctcaagacggtgccatctcatgggcgagtgcgttagcgaccgatgtctacgttggaaaacaaacgaaacatccgccgaatttaccggtaaagcccacggagaagtcatgcatgaaaaccgctgcttcgaacaaagcggaggcatcggatatgggtgcttcaacgttaacccaagctgtttatacgtccacagctatctaaaatcagtatacaaaaacggctttaaaatcttcagatgcgtcgcgtggaaccatcgaatccgccacgaagtcaccactcacagtagaaaattcccaatggtcttaatggctatgtcgacccagccaaccgactggggctcaataggcctgatcctcgattccggaggaataacgggcacgaatgcatacagcttcatgaaacacggactgggcagcttcgcgataatcgatgacccctactcacccgaacccagaaaaggattcctaggagaggtccgatgccccacagaagaaacagccatccgcgccagtcccagctgcaagatggcccccaacctaatcgaataccaacctgaaatggacacagccgagtgcaccaccaacatgatcgaccccatggcaatttttaaccgcggatcactcccccaagttcgggacggaatgacgttcacccaatcaatcgagaagaatacagtccaagccctgaccaccggagaagttagggcaagcatcaggctcacactagatgactacgatgtagtgtaccaaaactcccaattcgactgcagcgcgaccttcaaaaatttgacgggatgttactcatgcgacgagggcagcaggatgtgctaccaagtcaaagccgagggggaaacaatcttccactttgtcaacgaggacgaatctatcaatgtcatcaacaaagtctcaccggacgtatccgactactgcaccgtactccacttctctcgaccagtcattagcatagagggcaggtacgactgcggccttagtaagcgacccatggtcatcaaaggcacactcatcgcaaccgcaccccacgacgaccgcaaacacgaaggcggttccagcctggttgtcaatccaaaaggcggaacggtcgacttcttcggatgggtgagcggcctaacttcttggctcgggggaccactaaaaactttcctgacgatcctaggcttcctcgccctcggcctcctgctcgtagttatcatcatcatcatcgcccgcacaggtgtcgagcaagccttgaagaaaaagaataaatga

SEQ ID NO: 16348 - RNA, 4014 nt, synthetic construct
  misc_feature 1..4014: note = derived and/or modified CDS sequence (opt11) from TOSV(SI-40463)__EU003176.1__GP
  source 1..4014: mol_type = other RNA
atgttcatcgccaagctgttactgatcagctgcctggtgcagcaggcctacctcaagtacaccatcatctccgagataggcaacgggacccgcacgtcgttctgctactctagccggacctccctgggcagcttgctcgaggcgtgggacaacatcaccgagtccatcgggctgaccagcggcacgtgcaaggtcgggtccctggagaaccgcgagtgcaagcgggacatcatgagcaactatgtggccgaggtacactccaacctccacggcctgggagccatgatgcataactacggggacgacaagcgcgtcgaggtgctgaacgacgtaatccccgatgagctcaacccgggccggcacaactgcagcgacctggaccgcaagcccttctggacagagttcataaacgtcgccaagcccgtgaacgagatggcccccatgtccgtgatcccgccgcccattgtcaagcccatccccgttgcggagagcacaaccaaaaagaccatccccttcgacaagctgctcagcgaggccgagaaggagcttaaccaaaccaagatccggctggaaaccgagcgcagaagcaacgccgaggaggccgcgaaggagagggcccggatgcgcgagatcgaggataagctccggaaggactgggagcttgagcgcgagcggaaggacgctgttgccgaggaccttgccaaggaaatcgcgcgccggagagagatcgagcggaaggcccacgagctggacaagatgctgaagaagaaggagcgcgaggacctggtcgcccgggagcgcgtggatgaggacatgcgcaatcatgtgcggcgccccaacacgacgatcgcgcccacgatcatcactaccctccttatggcctccgcggtgatggccgggccgctggagaaccgggagacgaaccacctcctgaaccgccccggcaacggggcctacactctgtcagacttcgccgagtccacgtgcaccctcgcctacggcagcgaatgcaagagctgggagcaccagttggacgagctgtccttccccttctttcacagcaacctcgacaagtactccatgctcgaggcggccacggagaccatccccatcctgaacaagagctccgccgtgtgcaccatatcaccgtccacgcatagctccaacgcctgcggccgggaggccagcctcatcaagaagaaatgcgggtccgacatgtccgcattcttctacgtgaacctggccggccagattacggtcgtgaagtgcgacaccaaccatgtgctttccaacgactgcgggaactgcatcagcaagaccctcagtggccagaagatctacacccccgtccaggacatgttctgccagaagggctggagcgagtccatccccagcactcgctactccaaggacctatgcagcatcgggctgcataccgtgaaggagtgcaaaatcggcaccactaacttcgagcgggtggggttcatcgtcgtcaagggtcgcaagatgtacatcgagcagatgaagatgcggagccgccaggagttctccgaggaccagttcctctgctacaagtccgaggggtccagcggaagcagcgtcaagctgaagaaagtgaaggttgagtcctgcaagggcgtcacgaccagctccgccagcaagtgctccggggacgagtacttctgcagccggtacccctgtgagacggccaatgtggaggcgcactgcatccttcgccggcactccgccgtgatagaagtcaacgtgaacggcgtgtgggtggtgccgcgctgcatcgggtacgaggaggtactcgtccggcgcacaagcctgaaggtggaggacacgtccagccgggagtgcgacacgtgcctgtgggagtgcggcaagaacaagctcatcgtgaagacccacggccccaagatcgtctacgcgaccgcctgctcccacggcagctgcaagagtgtgatgcagaagcccgccaccttcgtgtacttgccctacccgggcaattccgagatcgtcgggggcgacatcggcgtgcacatgaccgaggagagctccccctcgaacatccacatggttgcgcactgccccgccaaggactcctgtgaggtcagctcctgcctgttctgcgtgcacggcctgctcaactaccagtgccacaccctgttcagcgccctgctcatctccaccaccgtgatgagcatcctgacgctgctcctgctgctcgtcaagggggcaaaggacctggtgaagcgcctgttctactggctcatcactcccctgtgctggctgtccgtgttctgcggctggatgatccggagctggaagaagcgcgtcggctccgccatcagccgcaccaacgacaccatcgggtggcgggacaactcccgccggggccaggatatcgagcgcgcgcagtacaccggcggcgctccgggcgccaagtacagcttctacggggtgatgatcctcggtctgctggggaacgtacactcctgcagcgagtccatcatcgccgactccaagattatgcagtgcacaacgagcggctccagcaccctctgcaaggcctccggcaccgtaatcatgaagctgggccccatcggcagcgagtcctgtctgatcctcaaggggctgaaggacagcgagaagcagttcatctccatcaagaccatctcatccgagctgacctgccgggagggcgagagcttctggaccacgctctacacccccgtatgcctgtcctcccgccggtgccacctgatgggggagtgcgtgtccgacagatgcctccggtggaaaaccaacgagaccagcgcggagttcacgggcaaggcacacggggaggtcatgcacgagaaccgctgcttcgagcagtccggcggcatcgggtatggctgcttcaacgtgaacccgagctgtctgtacgtgcactcctacctcaaaagcgtctacaagaacgggttcaagatcttccggtgcgtggcctggaatcaccgcatccgtctggaggtgaccacccactcccgcaagttccccatggtcctaatggccatgagcacccagcccacggactggggcagcatcgggctgatcctcgactccggcggcataacggggaccaacgcttacagcttcatgaagcacggcctggggtccttcgccatcatagacgacccgtacagcccggagccccggaagggcttcctgggcgaggtacgctgccccaccgaggagactgccatccgggcctcccccagctgcaagatggccccgaacttgatcgagtaccaaccagagatggacaccgcggaatgcaccaccaacatgatcgaccccatggccattttcaatcgcggctccctgccccaggtgcgggacggcatgacgttcacccagagcatagagaaaaacaccgtccaggcccttacaacgggggaggttcgcgccagtattcggcttacgctggacgactacgacgttgtctaccagaacagccaattcgactgctccgccacattcaagaacctgaccggctgctacagctgcgacgaggggtcccgcatgtgctaccaggtgaaggcggagggcgagaccatcttccattttgtgaatgaggacgagagcatcaacgtcatcaacaaggtgtccccggacgtgtctgattactgcacggtcctccacttctccaggcccgtgatctcgatcgagggccgttacgactgcgggctgtccaagcgccccatggtcataaagggcacgttaatcgccaccgcgccgcacgacgaccggaagcacgagggcgggagcagcctcgttgtgaacccgaaaggcgggaccgtggacttcttcggctgggtgtccggactgacgagctggctgggcgggccccttaaaacctttctgactatcctgggcttcctcgccctggggctgctcctggtggtcatcatcatcatcatcgcccgcaccggcgtggagcaggccctgaagaagaagaacaagtga

SEQ ID NO: 16349 - RNA, 4020 nt, synthetic construct
  misc_feature 1..4020: note = derived and/or modified CDS sequence (opt11) from TOSV(SI-40614)__EU003177.1__GP
  source 1..4020: mol_type = other RNA
atgttcattgccaagttactcctcatcagctgcctggtgcagcaggcctacctcaagtacacaatcatctccgaaatcgggaacgggacccgcacgagcttctgctactccagccgtacctccctgggcagcctgctcgaggcatgggacaacatcaccgagtccatcgggctgaccagcggcacatgcaaggtagggtccctcgaaaaccgcgactgcaagcgggacatcatgagcaactatgtggccgaggtgcactccaacctccacggcctgggcgccatgatgcacaactacggggacgacaagcgcgtcgaggtgctgaacgacgtgatccccgacgagctcaacccgggacggcacaattgcagcgatctcgaccgcaagcccttctggaccgagttcatcaacgtcgccaagcccgccaacaagatcgcgccaatatccgtgatcccgccgcccatcgtcaagcccatccccatcgccgagagcaccatcaagaagaccatccccttcgacaagttgctctccgaggccgaaaaggagttaaatcagacgaagatccggctggagaccgagcgccggagcaacgctggggaggcggcccgtgagcgggcccgcatgcgggaaatcgaagacaagctccgcaagaactgggaactggagcgggagcgcaaggacgctgtagccgatgatctggcgaaggagatcgcacggcgccgggagatcgagcgcaaggcccacgagttggacaagatgctgaagaagaaagagcgggaggaccaggtagccatcgagcgcgtctccgaggacatgcgcaaccacgtccggcgccccaacaccaccatcgcccccgcgccgacgatcatcaccaccctgctcatggccagcgccgtgatggccggcccgttggagaaccgggagaccaatcacctcctgaaccgccccgggaacggcgcctacactctgtcggacttcgcggagagcacatgcactctggcctacggcagtgagtgcaagtcctgggagcatcagttggacgagctgagcttccccttcttccactccaacctagacaagtacagcatgctcgaggccgccaccgagaccataccgatcttaaacaagagcagcgccgtgtgcaccatctcccccagcacacacagtagcaacgcgtgcgggcgggaggcctcactaatcaagaagaagtgcgggaacaacatgagcgcgttcttctatgtcaatcttgccgggcagatcaccgtggtgaagtgcgacacgaaccacgtcctgtccaacgactgcggcaactgcatcagcaagactttatccgggcagaagatctacacccccgtgcaggatatgttctgccaacgcgggtggacagaaagcatcccatccacgcggtacagcaaggacctctgctccatcggcctgcacacagtgaaggagtgcaagaccggggcgaccaacttcgagcgcgtcggtttcatcgtggtcaagagccgcaagatgtacatcgagcagatgaagatgcgcagccggcaggagttctccgaagaccagtttctatgctacaagtctgagagttcctccgggagctccgtgaaacttaagaaagtgaaggtcgagagctgcaaaggcgtaacgacctccagcgcctccaagtgcagtggcgacgagtacttctgctcacggtacccgtgcgagaccgccaacgtggaggcccattgcatccttcggcgccatagcgcggtaatcgaggtgaacgtgaacggggtctgggtggtgcccaggtgcattggctacgaggaggtcctggtgcgccggacctccctcaagatggaagatacgagctcccgcgagtgcgacacgtgcttgtgggagtgcgggaaaaacaaactgatcgtgaagacccacggccccaagatcgtctacgcgacggcttgctctcacggaagctgcaagtccgtaatgcagaagcccgctaccttcgtgtatctaccataccccggcaatagcgagatcgtcggcggggacatcggcgtgcacatgacagaggagtcctcgccatccaacatccacatggtggcccactgccctgccaaggacagctgtgaggtctccagctgcctgttctgcgtgcacgggctgctgaactatcagtgccacaccctcttttccgcgctgctgatcagcacaaccgtgatgtctattctcacccttctgctcctgctggtcaagggcgccaaggatctggtaaagaagctgttctactggttgatcaccccgctctgctggctgtcagtgttctgcggatggatgatcaagtcctggaagaagcgggtcggcagcgccatctcccgcaccaatgacaccataggctggcgcgataaccggcgttatgggcgggacgtggagcgcgcccagtacacgggcggggtgcccggagccatatacagcttctacggcgtcatgatcctgggtctcctgggtaacgtgcactcctgctcagagtccgtgatagctgacagtaaggtcatgcaatgcaccaccagcgggtccagcaccctgtgcaaggcctccggcacggtgatcatgaagttggggcctatcggcagcgagtcctgcttgattctgaagggcctcaaggacaacgagaagcagttcatcagcatcaaaacgatctcctcagaactgacctgccgggaaggggagtccttctggaccacgctgtacaccccggtgtgcttgtcctccaggcgctgccacttgatgggcgagtgcgttagcgaccggtgcctaaagtggaagactaacgagacatcccccgagttcacgggcaaggcccacggggaagtgatgcacgagaaccggtgtttcgagcagtccgggggcatcggctacgggtgcttcaacgtgaatccctcctgcctctacgtccacagcatcctgaagtccgtgtacaagaacggcttcaagatcttccgctgcgtggcatggaaccaccggatccgcctggaggtcaccacccacagccggaagttccccatggtgctcatggcgatgtccacacagccgaccgactgggggtctatcggcctgatactggacagcgaggggataaccggcaccaacgcttactccttcatgaagcacggcagcggttccttcgcgatcattgatgacccctacagccccgaaccccgaaaaggcttcctcggggaggtgcggtgcccgaccgaggagacggcgatccgcgcctcccctagctgcaagatggcgcccaacctgattgagtaccagcctgagatggacaccgccgaatgcaccaccaacatgattgacccgatggccatcttcaaccgggggtctttaccccaggtccgcgatgggatgacattcactcagagcatcgagaagaacaccgtgcaggccctcaccaccggagaggtcagggcgtccatccgcctgacattggacgactacgacgtcgtgtaccagaacagccagtcagactgcagcgcgacctttaagaacctcaccggctgctactcctgcgacgaggggagccggatgtgctaccaggtgaaggccgagggcgagaccatcttccatttcgtcaacgaagacgagagtatcaacgtgatcaacaaggtaagccccgacgtctccgactactgcacggtgctgcacttcagtcgccccgtcatctccatcgaggggcgctacgactgcggactgagcaagcggccgatggtaatcaagggtactcttatcgccacagcgccccacgacgaccgcaagcacgaaggcgggagctccctggtcgtaaaccccaaaggcgggacggtggacttcttcgggtgggtgagcggcctgacgtcctggctcggcgggcccttaaagaccttccttacaattctcggcttcttagccctggggctcctgctggtcgttattatcatcatcatcgcacggaccggcgtggagcaggccctcaagaaaaagaataagtaa

SEQ ID NO: 16350 - RNA, 4014 nt, synthetic construct
  misc_feature 1..4014: note = derived and/or modified CDS sequence (opt11) from TOSV(SI-51903)__EU003178.1__GP
  source 1..4014: mol_type = other RNA
atgttcatagcaaaactactcctaatctcctgcctcgtccaacaagcctacctcaaatacacaataatcagcgaaatagggaacggcacgcgaacctccttctgctacagctcgagaactagcctcgggtcgctgttggaagcgtgggacaacatcaccgaatcaatcgggctgacatcagggacctgcaaagtcggctccttagaaaaccgagaatgcaaacgagacatcatgtccaactacgtagcagaggttcattccaaccttcacggtctgggagccatgatgcacaactacggcgacgacaaacggatcgaagtccttaacgatgttataccagacgaactgaatcccgggagacacaactgctcggatttagaccggaaacccttctggacagagttcataaacgtagcaaaaccggcaaacgaaatagcgccaatgtccgtgattcccccaccaatcgtcaaaccaataccggtcgcagaatcgacgacgaagaaaacaatcccattcgacaaactcctcagcgaagccgaaaaagaactcaatcaaacaaaaatccgactcgaaacagaacgacgatcaaacgctgaggaggccgcgaaagaacgcgctcgaatgcgagaaatcgaagacaaactccgaaaagattgggagctggaacgagaaaagaaagacgcagtcgcagaagacctagctaaagaaatcgcccgacgaagagagattgaacgaaaagcccacgaactcgataaaatgctcaaaaagaaagaacgcgaagacctcgtggcccgcgaacgcgtcgacgaggacatgcgcaatcacgtgcggcgccccaacgcaacgatcgcccccaccatcataaccacacttctaatggcgagcgcagtgatggcgggccccctagaaaaccgagaaaccaatcacctactgaatcgccccggcaatggggcatatacactatcggatttcgccgagagcacatgcacactcgcgtacggatctgaatgtaaatcctgggagcaccaactggacgaactctccttcccattcttccattctaaccttgacaaatactccatgctcgaagcagccacagagacaatccccatcctaaacaagtccagcgccgtgtgcacgatatctccatcaacccacagcagcaacgcatgcggccgcgaagcatcactcataaagaagaaatgtggcagcgacatgtcagccttcttctacgtcaacttggctggacaaatcacagtcgttaaatgcgataccaaccacgtcctatcaaacgactgcggcaactgcataagcaaaaccctatccgggcagaaaatatatacccccgtccaagacatgttctgccaaaagggatggtcagaatcgatcccctccactcgctactcgaaagacctctgctccatcggactgcacactgtaaaagaatgcaaaataggaaccaccaactttgaacgagtaggcttcatcgtagtaaaaggccgcaagatgtatatcgaacaaatgaaaatgcgctccagacaagagttcagtgaagacgaatttctctgttacaaatccgaaggatcctcaggctcaagcgtgaaactcaagaaagtgaaagtagaaagctgcaaaggcgtaacgacgagcagcgcctcaaaatgcagcggcgacgaatacttctgctcccgatacccgtgcgaaacagcgaacgtggaggcacactgcatcttgcgcagacactcggccgttatcgaggtaaacgtcaacggagtttgggtcgtcccacggtgcatcggatacgaagaagtcctggtccgcaggacctcactgaaagtagaagacaccagctcccgcgaatgcgatacctgcctgtgggagtgcggcaaaaacaaactcatcgtcaagacccatgggcccaaaatagtatatgccacagcttgcagccacggaagctgtaaatccgtaatgcaaaaaccggccaccttcgtatacctgccctacccggggaactcggaaatcgtcggcggcgacattggagttcacatgaccgaagaaagctcaccctcaaacatacatatggtagcccactgccccgccaaagactcatgcgaagtatcaagctgcctcttctgtgtacacggactccttaactatcaatgtcatactctattcagcgcgctcctcatcagcaccaccgtcatgtcgatacttaccttgcttctactcctagtaaaaggagccaaagacctggtcaaacgactcttctactggctcatcacacctctctgctggctatccgtcttctgcggatggatgatacgatcttggaagaaacgcgtcggctctgccatctcaaggacgaacgacaccatcggatggcgggacaactctagaaggggccaagacgtggagcgggcgcaatataccggcggggctccaggagccaaatacagcttctacggtgtgatgatcctaggcctcctcggaaatgtacactcatgctcggaatcaatcatcgcagacagcaaaataatgcaatgcactacttccggcagctcaactctttgcaaagcatccggaacggttatcatgaaactaggccccattggatcagaaagctgcctgatcctaaaaggactaaaggactcagaaaagcaattcatatcgatcaaaaccatctcgtccgaactaacctgccgagaaggtgagtccttctggacgaccttatacaccccggtatgtttgagctcgcggcgatgccacctcatgggagaatgcgtaagcgaccgctgcctccgctggaagactaacgagacaagcgcagaatttactggtaaagcccacggagaagtcatgcacgaaaacagatgcttcgaacaatcgggaggaattggctacggctgcttcaacgtaaacccgtcctgcctctatgtacatagctacctcaaatcagtctacaaaaacggcttcaaaatattccgctgcgtcgcttggaaccatcgtatacggctcgaagtcacaacacacagcagaaaattccctatggtcttaatggcaatgtccacccaacccaccgactggggctccatcggcctaatactagacagcggcgggatcaccggtaccaacgcctactccttcatgaagcacggccttggcagtttcgcaataatagacgacccctatagccctgaaccgcgcaaaggcttcctcggcgaagtaaggtgtccgacggaagaaaccgcgatacgggcctccccatcctgcaaaatggccccaaacctaatagagtatcaacccgagatggataccgcggaatgcaccaccaacatgatcgaccccatggcgattttcaacagaggcagcctgccccaggtacgggatgggatgacattcacacaaagcattgagaaaaatactgtacaggccctcaccaccggcgaagttcgcgctagcatccgactaaccctagacgactacgacgtcgtatatcaaaacagccaattcgactgttccgccacattcaagaacctcacaggatgttattcgtgcgacgaagggcccaggatgtgctaccaagtaaaagccgaaggcgaaactatattccatttcgttaacgaagatgagtccatcaacgttatcaacaaggtaagccccgatgtgtctgactactgtaccgtgctgcacttctcccgcccagtcatatccatcgaaggccgatacgactgcggactaagcaaaagaccaatggtgatcaagggcacactcatcgccaccgccccacacgacgacagaaaacacgaaggcggaagctcactcgtcgttaacccaaagggaggcaccgtcgatttcttcggttgggtcagcgggctgacctcctggctaggaggcccactcaaaaccttcctcacaatacttggcttcctcgccctaggcctcctgctcgtcgtcatcattataatcatcgcgcgtaccggtgtagaacaagccctcaaaaagaaaaataaatag

SEQ ID NO: 16351 - RNA, 4014 nt, synthetic construct
  misc_feature 1..4014: note = derived and/or modified CDS sequence (opt11) from TOSV(SI-68809)__EU003179.1__GP
  source 1..4014: mol_type = other RNA
atgttcatcgccaagctgctcctcatcagctgcctggtgcaacaggcctatctcaagtataccattatctccgagattggcaacgggacccgcacgagcttctgttactccagccggacctccctgggcagcctgctcgaggcctgggacaacatcaccgagtccatcggactgaccagcggcacgtgtaaggttgggtccctagagaaccgcgagtgcaagcgggatatcatgagcaactatgtggccgaggtgcactccaacctccacggcctgggcgccatgatgcacaactacggggacgacaagcgcattgaggtcctgaatgacgtgattcccgacgagctaaacccgggccggcacaactgctccgatttggaccgcaagcccttctggacagagttcatcgacgtggccaagccagcaaatgagatcgcgcccatgtccgttatcccgcctcccatcgttaagcccatccctgtggccgagagcacaatcaagaagaccatccccttcgacaagctgctcagcgaagccgaggaggaactgaaccagaccaagatccggctggagaccgagcgccggagcaatgccgaggaggcggccaaggagcgcgcccggatgcgcgaaatagaggacaagctccggaaggattgggagctggagagggagcgcaaagacgccgtcgccgaggacctggcgaaggagatcgcccgccgacgcgagatcgagcggaaagcgcacgagctcgacaagatgctgaaaaagaaggagcgtgaggacctggtagcccgcgaacgcgtgaacgaagacatgcgcaaccacgtccggcgccccaacaccaccatagccccgactatcatcactaccctcctaatggcgtccgcggtgatggccgggccgctggagaaccgagagaccaaccatctcctgaaccgccccggcaacggggcgtacaccctgagtgacttcgctgagtccacgtgcacactcgcgtacggaagcgagtgcaagagctgggagcaccagctggatgaactgtccttcccgttcttccacagcaacctcgacaaatactccatgctggaggccgccaccgagacgatccccatcctgaacaagagctccgccgtgtgcacaattagcccgtccacccattcatccaacgcctgtggccgagaggcgagcctcatcaagaagaagtgcgggtccaacatgagcgccttcttttacgtcaacctggccggccagatcactgtggtgaagtgcgacacgaaccacgtcctgtccaacgactgcgggaattgcatcagcaagaccctcagcggccagaagatctacacccccgtgcaggacatgttctgccagaagggctggagcgagtccatccccagcaccagatactccaaggacctgtgcagcattgggctgcacacggttaaggaatgcaagaccggcaccaccaacttcgagcgggtcggctttatagtggttaaaggccgcaagatgtacatagagcagatgaagatgcggagccgccaggagttctccgaagaccaattcttgtgctacaagtctgaagggtccagcggatctagcgttaagctgaagaaagtgaaagtcgagtcctgcaagggcgtgacgaccagctccgcctccaagtgctcaggggacgagtacttctgcagccggtacccctgcgagaccgcaaacgtggaggcccactgcatcctgcgccggcactccgccgtcatcgaggtgaacgtgaacggcgtctgggtggtgccgcgctgcatagggtatgaggaggtcctcgtgcggaggaccagcctgaaggtggaagacacgtcaagccgggagtgcgacacgtgcctgtgggagtgcggcaagaacaagctcatcgtcaagacacacggtcctaagatcgtgtatgcgactgcctgctcccacggcagctgcaagagcgtgatgcagaagcccgcgaccttcgtttacctgccctacccgggcaactccgagatcgtcgggggtgacatcggggtgcacatgaccgaggagagctcccccagcaacatccacatggtggcccactgtcccgccaaagactcctgcgaggtgagctcctgcctgttctgcgtgcacggactgctcaactaccagtgtcataccctgttcagcgcattgctcatctccaccaccgtcatgagcatcctgacactgctcctgctgctcgtcaagggagccaaggacctggtgaagcgcctgttctactggctcatcacgcccctgtgctggctgtccgtcttctgcggctggatgatccggagctggaagcgccgcgtcggctccgcgatttcccggaccaatgacaccattgggtggcgcgacaactcacggcgcggacaggacgtggagcgggcccagtacaccgggggtgccccgggcgcgaagtacagcttctacggggtcatgatcctcggcctgctgggggaggtgcactcctgcagcgagtccatcatcgcagacagcaagataatgcagtgcaccacctctggctccagcaccctctgcaaggcctccgggaccgtaatcatgaaactgggccccatcggttcggagtcctgcttgatcctcaaggggttaaaagattccgagaaacagttcatctccatcaagaccataagctccgagctgacttgccgcgagggcgagagcttctggaccacgctctacacccccgtctgcctgtccagccggagatgccacctgatgggggagtgcgtgtccgaccgatgcctcaaatggaaaactaacgagacaagcgccgagttcacgggcaaggcccacggagaggtgatgcatgagaacagatgcttcgagcagtctggcggcatcggatacggctgtttcaacgtcaaccccagctgcctgtatgtgcactcctacctcaaaagcgtgtacaagaacgggttcaagattttccggtgtgtcgcttggaaccaccgcatacggctggaggtgaccacccattcccgcaagttccccatggtcctgatggcgatgtcgacccagcctacggactggggcagcatagggctgatcctcgactctggcggcatcaccgggaccaacgcctacagcttcatgaaacacggcctggggagcttcgccattatcgacgacccttacagcccggagcccaggaagggcttcctgggggaggtccgctgccccaccgaagagactgctatccgggcctcccccagctgcaagatggcgccgaacctcatcgagtaccaacccgagatggacaccgccgagtgcaccacaaacatgatcgaccccatggccatcttcaaccgaggctccctgccccaggtgcgggacggcatgacgttcacccagtcgatcgagaaaaataccgtgcaggccctcaccacgggggaggtccgcgcctccatccggctcaccctggacgattacgacgtagtgtaccagaacagccagttcgactgctccgcgacctttaaaaaccttaccggctgttacagctgcgacgaagggtcccgcatgtgttaccaggtaaaagccgagggcgagacgatattccactttgtgaacgaggacgagagcatcaacgtgatcaacaaggtctccccggacgtgagcgactattgcacggtactccacttcagtaggcccgttatcagcatcgagggcagatacgactgcgggctgtccaagcgccccatggtgatcaagggcaccctgatcgccaccgcgccccacgacgacaggaagcacgagggcgggtcctctttagtcgtgaacccgaagggcgggactgtggacttcttcggctgggtctccgggctgacgagctggctgggcgggcccctcaagacattcctcaccatcttaggcttcttggcccttggattactcctggtggtaatcatcatcatcatcgcccgcaccggcgtcgagcaagccctaaagaagaagaacaagtga

SEQ ID NO: 16352 - RNA, 4014 nt, synthetic construct
  misc_feature 1..4014: note = derived and/or modified CDS sequence (opt11) from TOSV(SI-76082)__EU003180.1__GP
  source 1..4014: mol_type = other RNA
atgttcatcgccaagctgctcctgatcagctgcctggtgcagcaggcctacctcaagtacaccatcatctccgagatcggcaacgggacccgcacgagcttttgctactccagccggacctccctgggcagcctgttagaggcgtgggacaacatcaccgagtccatcgggctgaccagcggcacgtgcaaggtcgggtccctcgaaaaccgcgagtgcaagcgggacatcatgagcaattacgttgccgaggtgcacagcaacctccacggcctgggcgccatgatgcacaactacggggatgacaagcgcatcgaggtcctgaacgacgtgatccccgacgaactcaacccgggccggcacaactgcagcgacctggaccgcaagcccttctggaccgagttcataaacgtggccaagcccgccaacgagatggcgcccatgtccgtcatcccgcctcccatcgtgaagcccatccccgtggccgagagcaccaccaagaagactatccccttcgacgagctgctctccgaggccgagaaagagctgaaccagaccaagatccggctggagaccgagcgccggagcaacgccgaggaggcggccaaggagcgcgcccggatgcgcgagatcgaagacaagctccggaaggactgggagctggagcgcgagcggaaggacgccgtcgccgaggacctggcgaaggagatcgcccgccggcgcgagatcgagcggaaggcccacgagctcgacaagatgctgaagaagaaggaacgcgaagacctggtggcccgggagcgcgtggacgaagacatgcgcaaccacgtccggcgccccaacaccacgatcgcccccaccatcatcaccaccctcctgatggcgtccgccgtgatggccggaccgctggagaaccgggagacgaatcacctcctgaaccgccccggcaatggggcctacacgctgagcgacttcgccgagtccacgtgcaccctcgcgtacggaagcgagtgcaagagttgggagcaccaactggacgagctgtccttccccttcttccacagcaacctcgacaagtactccatgctggaggcagccacggagaccatccccatcctgaacaagagctccgccgtgtgcaccatcagcccgtctacccacagctccaacgcatgcggccgggaggcgagcctcatcaagaagaagtgcgggtccgacatgagcgccttcttttacgtcaacctggccggccagatcacggtggtgaagtgcgacaccaaccacgtcctgtccaacgactgcgggaactgcatcagcaagaccctctccggccagaagatctacacccccgtgcaggacatgttctgccagaagggctggagcgagtccatccccagcacacgctacagtaaggacctgtgtagcatcgggctgcacaccgtgaaggagtgcaagatcggcaccaccaacttcgagcgggttgggttcatcgtggtgaagggccgtaagatgtacatcgagcagatgaagatgcggagccgccaggagttctccgaggaccagttcttgtgctacaagagcgaggggtccagcggttccagcgtcaagctgaagaaggtgaaggtcgagtcctgcaagggcgtaacgaccagctccgccagcaagtgctccggggacgagtacttctgcagccggtatccctgcgagaccgcgaacgtggaggcccactgcatcctgcgccggcactccgccgtcatcgaggtgaacgtgaacggcgtctgggtggtaccgcgatgcatcgggtacgaggaggtcctcgtgcggcgcaccagcctgaaggtggaggacacgtcaagccgggagtgcgacacgtgcctgtgggagtgcggcaagaacaagctcatcgttaagacccacgggcccaagatcgtgtatgccaccgcctgctcccacggcagctgcaaatcagtgatgcagaagcccgcgaccttcgtctatctgccctacccgggcaactccgagatcgtcgggggcgacatcggggtgcacatgaccgaggagagctcccccagcaacatccacatggtggcccactgccccgccaaggactcctgcgaggtgagctcctgcctgttctgcgtccacggcctgctcaactaccagtgccacaccctgttcagcgccctgctcatctccaccaccgtcatgagcatactgacgctgctcctgctgctcgtgaagggggccaaggacctggtgaagcgcctgttctactggctcatgacacccctgtgctggttatccgtcttctgcggctggatgatccggagctggaagaagcgcgtgggctccgcgatcagccgcaccaacgacaccattgggtggcgcgacaactcccgcagaggccaggacgtggagcgcgcccagtacaccgggggcgccccgggcgcgaagtacagcttctacggggtcatgatcctcggcctgctgggcaacgtgcactcctgcagcgagtcgatcatcgccgacagcaagatcatgcagtgcaccaccagcggctcaagcaccctctgtaaagcgtccgggaccgtgatcatgaaactgggccccatcggcagcgagagctgcctgatcctcaaggggctgaaggacagcgagaagcagtttatctccatcaagaccatcagctccgagctgacctgccgggagggcgagtcattctggaccacgctctacacccccgtctgcctgtccagccgccggtgccacctgatgggggagtgcgtgagtgaccgctgcctccggtggaagaccaacgagaccagcgccgagttcacgggtaaggcccacggggaagtgatgcacgaaaatcgctgcttcgagcagtccggcggcatcgggtacggctgcttcaacgtcaacccgagctgcctgtacgtccactcctacctcaagagcgtgtacaagaacgggttcaagatcttccggtgcgtcgcctggaaccatcgcatccggctggaggtgaccacccactcccgcaagtttcccatggtgctgatggcgatgagcacccagcctacggactggggcagcatcgggctgatcctcgactccggcggcatcaccgggacgaacgcatacagcttcatgaagcacggcctggggtccttcgccatcatcgacgacccctacagcccggagccccggaagggcttcctgggggaggtccgctgccccactgaggagacggccatccgggcctctcccagctgcaagatggcgccgaacctcatcgagtaccagcccgagatggacaccgccgagtgtaccaccaacatgatcgaccccatggccatcttcaaccgcggctcgttgccccaggtgcgggacggcatgacgttcacccagagtatcgagaagaacaccgtgcaggccctgaccacgggggaggtccgcgcgtccatccggctcaccctggacgactacgacgttgtgtatcagaacagccagttcgattgctccgcgaccttcaagaacctgaccggctgctacagctgcgacgaggggtcccgcatgtgctaccaggtaaaggccgagggcgagaccatcttccacttcgtgaacgaggacgagagcatcaacgtgatcaacaaggtctccccggacgtgagcgactactgcacggtgctccacttctcccgccccgtcatcagcattgagggccggtacgactgcgggctgtccaagcgccccatggtgatcaagggcaccctgatcgccaccgcgccccacgacgaccgaaagcacgagggcgggagcagcctcgtcgtgaacccgaagggcgggacagtggacttcttcggctgggtctccgggctgacgagctggctgggcgggcccctcaagaccttcctgaccatcctgggctttctcgccctggggctgctcctagtggtgatcatcattattatcgcccgcaccggcgtcgagcaggccctgaagaagaagaacaagtga

SEQ ID NO: 16353 - RNA, 4020 nt, synthetic construct
  misc_feature 1..4020: note = derived and/or modified CDS sequence (opt11) from TOSV(TOSV/Mantova.ITA/2013)__KM507329.1__GP
  source 1..4020: mol_type = other RNA
atgtttatcgccaagctgctcctgatcagctgcctggtgcaacaggcctacctcaagtacaccatcatctccgagatcggcaacgggacccgcacgagcttctgctactccagccggacctccctgggcagcctgctcgaggcgtgggacaacatcaccgagtccatagggctgaccagcggcacgtgcaaggtcgggtccttagagaaccgcgactgcaagcgggacatcatgagcaactacgtggccgaggtgcactccaaccttcacggcctgggcgccatgatgcacaactacggggacgacaaacgcgtcgaggtgctcaacgacgtgatacccgacgagctcaacccgggccggcacaactgcagcgacctggaccgcaagcccttctggaccgagttcatcaacgtcgcaaagcccgccaacaagatcgcgcccatctccgtgatcccgccgcccatcgtgaagcccatccccatcgccgagtccaccatcaaggagaccatccccttcgagaagttactctccgaggccgaaaaggagctcaaccagacgaagatccggcttgagaccgagcgccggagcaatgccgaggaggcggcccgcgagcgggcccgcgtccgggagatcgaggacaagctccgcaagaactgggagctggagcgggagcgcaaggacgccgtggccgacgacctggcgaaggagatcgcccggcgccgggagatcgagcgcaaggcccacgaacttgacaagatgctgaagaagaaggagcgggaggaccaggtggccatcgagcgcgtctcagaggacatgcgcaaccacgtgcggaggcccaacaccaccatcgcccccgcgccgacgatcatcaccaccctgctcatggcctcagccgtgatggccgggcccctggaaaaccgggagaccaaccacttgctgaaccgccccggcaacggggcctacacgctgtccgatttcgcggaaagcacgtgcaccctagcctacggcagcgagtgcaagtcctgggaacaccagctagacgagctgagcttccccttcttccactcgaacctggacaagtacagcatgctcgaggccgccaccgagaccatcccgatcctgaacaagtccagcgccgtttgcaccatctcccccagcacccactccagcaacgcgtgcggccgggaggcctccctgatcaagaagaagtgcgggaacaacatgagcgccttcttctacgtgaacctcgcgggccagatcaccgtggtcaagtgcgacacgaaccacgtgctgtccaacgactgcgggaactgcttcagcaagaccttgtccggccagaagatctacacccccgtgcaggatatgttctgccagcgcggctggaccgagagcatcccctctacgcggtacagcaaggacctctgctccatcgggctgcacaccgtcaaggagtgcaagaccggcaccacgaacttcgagcgcgtggggttcatcgtggtcaagagccggaagatgtacatcgagcagatgaagatgcgcagccggcaggagttcagcgaggaccaattcctgtgctacaagagcgagtccagctccggcagctccgtgaaactcaagaaggtcaaggtggagagctgcaagggggtgaccacctccagcgcgtccaagtgcagcggcgacgagtacttctgctcccgctacccatgcgagacggccaacgtcgaggcccactgcatcctgcggcgccacagcgccgtgatcgaggtgaacgtcaacggcgtgtgggtggtcccccggtgcatcgggtacgaggaggtgctggtgcgccggacgtccctcaaaatggaggacacaagctcccgcgagtgcgacacttgcctgtgggagtgcggcaagaacaagctgatcgtcaagacccacgggcccaagatagtgtatgcgaccgcctgcagccatggcagctgcaagtccgtgatgcagaagcccgccaccttcgtctacctcccgtaccccgggaacagcgagatcgtgggcggcgacatcggggtgcacatgaccgaggagtcctcaccctccaacatccacatggtcgcccactgccccgccaaggacagctgcgaggtgtccagctgcctgttctgcgtgcacggcctgctgaactaccagtgccacaccctcttctccgcccttctgatcagcaccacggtcatgtccatcctcacgctgctgctcctgctggtgaagggggcgaaggacctcgtgaagaagctgttctactggctgatcaccccgctctgctggctgagcgtcttctgcggctggatgatcaagtcctggaagaaacgggtggggagcgccatctcccgcaccaacgacacgatcggctggcgcgacaaccggaggtacggccgggacgtggagcgcgcccagtacaccgggggcgcccccggggccaagtacagcttctacggcgtcatgatcctgggcctcctggggaacgtgcactcctgcagcgagtccgtgatcgcggacagcaaggtcatgcagtgcaccaccagcggctccagcacgctgtgcaaggcctccgggaccgtgatcatgaagctcggccccatcgggagcgagtcctgtctgatcctgaagggcctcaaggataacgagaagcagttcatcagcatcaagaccatatccagcgagctgacctgccgggagggcgagtcgttctggaccaccctgtacaccccggtgtgcctcagctcccgccggtgccacctgatgggggagtgcgtcagcgaccgctgcctgaagtggaagaccaacgagacgtccgcggagttcacaggcaaggcccacggggaggtgatgcacgagaaccggtgcttcgagcagagcggcgggatcggctacggctgcttcaacgtgaacccctcctgcctctacgtccacagctacctgaagtctgtgtacaagaacgggttcaagatcttccgctgcgtggcgtggaaccaccggatccgcctggaggtcaccacccacagccggaagttccccatggtgctcatggccatgtccactcagcccaccgactggggcagcatcgggctgatcctggacagcgagggtatcaccgggaccaacgcttactccttcatgaagcacggcagcggctccttcgccatcatcgacgacccgtacagccccgagccccgcaaggggtttctcggcgaggtccgctgccccacggaggagaccgccatccgcgcgtccccgagctgcaagatggcccccaacctgatcgagtaccagcccgagatggacaccgccgagtgcaccacgaacatgatcgaccctatggccatcttcaaccgggggtccctgccgcaggtccgcgacggcatgaccttcacccagagcatcgagaagaacaccgtgcaggccttaacgaccggggaggtgcgggcgtccatccgcctgaccctggacgactacgacgtggtgtaccagaacagccagtctgactgtagcgccacgttcaagaacctcaccggctgctactcttgcgacgagggctcacggatgtgctaccaggtgaaggccgagggggagacgatcttccacttcgtcaacgaagacgagtccatcaacgtgatcaacaaggtgagccccgacgtctccgactattgcaccgtgctgcatttctcaagacccgtcatctccatcgagggccgctacgactgcgggctgagcaagcggcccatggtgatcaagggcacactcatcgccaccgcccctcacgacgaccgcaagcacgagggcgggagctccctggtggtcaaccccaagggcgggacggtggacttcttcggctgggtgagcgggctgacctcctggctcggaggccccctgaagaccttcctgaccatcctcgggttcctggccctgggcctcctgctggtcgtgatcatcatcatcatcgcccggacgggggtgcagcaggccctcaagaagaagaacaagtga

SEQ ID NO: 16354 - RNA, 4020 nt, synthetic construct
  misc_feature 1..4020: note = derived and/or modified CDS sequence (opt11) from TOSV(TOSV/Phl.233/FR/2009)__HQ184337.1__GP
  source 1..4020: mol_type = other RNA
atgttcatcgccaagttactcctgataagctgcctggttcagcaagcctacctcaagtacaccatcatctccgagaccggcaatgggacgcgcaccagcttctgctactccagccggacatccctgggcagcctgctcgaggcctgggacaatgtcaccgagtccatagggctgacaagcgggacctgcaaggtgggctccctggagaaccgcgactgcaggaaagacatcatgagcaactacgtggccgaggtgcactccaacctccacggcctgggagccatgatgcacaactacggggacgacaagcgcgtggagatcttgaacgacgtgatccccgacgagctcaacccgggccaccacaactgcagcgacctggaccggaagcccttctggactgagttcatcaacgtggccaagcccctgtcagagatcgtgcccatgagcgtgatcccgccgcccgtcgtgaagccccagccgcccgccgagccctccagcaagaaacacgtgcccttcgacgttctcctgtccgaggcggagaaggagttgaaccagaccaagatccgcctcgaggacgagcgcaagagcaacgccgaggagacggccaaggagcgggcccggatgaaggagatcgaggacgagctccgccgggagtgggagctggagaggaagcgaaaggacgcgatggccgacgacctcgccaaggagaccgcgcgccggagggagattgagcggaaggcccacgagctggacaagatgctgaagaagaaggagcgcgagtccctcatcgcgaaagagaaggctgacgaagatatgcggagccacgtgcacaagcccaataccacccgcgcgcccgcccccacgatcatcaccaccctgctgatggccagtgcggcattggccgggcccctggagaaccgggaaaccaaccatctcctgaacaggccgggcaacggagcctacacgctgtccgatttcgccgagagcacgtgcaccctggcgtacggctccgaatgcaagagctgggaacacctgttaaacgaggaactgtttcccttcttccattccaacctcgacaagtacagcatgctggaagccgccaccgagacggttcccattttgaacaagagctcggccgtctgcaccatctcccctagcacccactccagcaacgcatgcggccgcgaggcatccgtgatccggaagaagtgctacagcaacatgtccgccttcttctacatcaacctcgccgggcagatcaccgtgatcaagtgcgagacgaaccacgtcctgagctccgactgcggaaactgcatcagcaagtccctgtccgggcagaaagtgtacaccccggtgcaggacgtcttctgccagaagggctggacccagtcaatccccagtacccgctactcgaaggatatctgctccatcggcctccacacggtgaaggagtgcaagatcgggaccaccagcttcgagcgggtggggttcatcgtcgtgaaagggcgcaagatgtacatcgagcagatgaagatgcggtcccgccaggagtacagcgaggaccagttcctgtgctacaagtccgagagcggctccgggagctccgtcaaacttaagaagttcaaggtgcagtcctgcaagggtgtgaccacgtccagcgcctccaagtgcagcggagacgagtacttctgctcccggtacccctgcgagactgcgaacgtcgaggcccactgcatcctccgacgtcactccgccatcgtggaggtcaacgtcaatggggtgtgggtggtcccccgctgcatcggctacgaggaggtgctggttaagcggaccagcctgaaggtcgaagacactacggggcgcgagtgcgactcctgcctctgggagtgcggcaagaacaagctgatcgtcaagacccacgggccgaaggtggtctacgccaccgcctgcagccacggtagctgcaagtctgtgatgcagaagcctgcgactttcgtgtacctgccctaccccggcaactccgagatcgtcggaggcgacattgggatccacatgaccgaggagagctccccgagcaacatacacctggtggcccactgccccgcacgggactcctgcgacgtgagtgactgcctcttctgcgtccacggcctgctgaactaccagtgccataccctcttctccgccctgctgatcagcaccaccgtgatgtcgatcctcaccctgctgctcctgctggtgaagggggccaaggacctcgtcaagaagctgttccactggctgatcacgcccctctgttggctgagcgtgttctgctgctgggtggtcaagtcctggaagcgccgggtgggcagcgcgatctcccgcaccaacgacaccatcggctggagagagaaccgccgacacgcccaggacatcgagcgcgcccagtacaccgggggcgccccgggggccaagtacagcttctacggcgtgatgatcctgggcctgctgtccagcgcgcagagctgctccgagagcgtcatcgccgactccaagatcatgcagtgcaccaccagcgggtccagcaccctgtgcaaggcctccgggaccgtgatcatgcgactcgggccaataggctctgagtcctgcctgatcctgaaggggctcaaggacagcgagaagcaattcatctccatcaagacgatcagctccgaactgacctgccgggagggcgagagcttctggaccaccctgtacacgcccatctgcctctccagccgccggtgccacctgatgggcgaatgcgtgtccgaccgctgcttaaagtggaagaccaaccagactagcgcggagttcaccggcaaagcgcacggcgacgtcatgcacgagaaccggtgcttcgagcagtccgggggcatcgggtacggctgcttcaacgtgaacccctcttgcctctacgtgcacagctaccttaagtccgtctaccgcaacggcttcaaggtgttccggtgcgtggcctggaaccatcgcatccggctggaggtcacgacccacagccgcaagttcccgatggtgctcatggccatgtccacccagcccaccgactggggcagcatcggcctgatcctggactccgagggaattacgggcaccaacagctactccttcatgaagcacgggagcggctccttcgccatcatcgacgacccctacagccccgagcctcggaagggtttcctcggcgaggtgcgctgccccaccgaggagaccgccatgcgggcgtcccccagctgcaagatggcacccaacctgatcgagtaccagccggagatggacaccgccgagtgcaccaccaacatgatcgaccccatggccatcttcaaccgcggaagtctgccccaggtccgggacgggatgaccttcacgcagagcatcgagaagaacactgtgcaggccctcaccaccggagaagtgaaggcgtccatacgcctgacgctggacgactacgacgtcgtgtatcagaactcccagtccgactgcagcgccaccttcaagaacctcaccgggtgctactcctgcgacgagggcagccgactgtgctaccaggtgaaggccgagggcgagaccatattccacttcatcaacgaggaggagagcatcaacgtcattaacaaggtgtcccccggagtgagcgactactgcaccgtcctgcacttctcccgccccgtgatcagcatcgaaggaacgtacgactgtggactctccaaacggcccatggtcatcaagggcaccctgattgccaccgcgccccacgacgatcgcaagcacgaaggtgggagctctctggtggtgaacccaaagggcgggagcgtcgacttcttcggctggctctccgggctgaccagctggctgggcggcccgctcaagacgtttctgaccattctgggcttcctcgccgtgggcctgctgctcgtggtcatcatcataatcatcatccggaccgggatgcagcaggccctgaagaagaagatcaaatga

SEQ ID NO: 16355 - RNA, 4020 nt, synthetic construct
  misc_feature 1..4020: note = derived and/or modified CDS sequence (opt11) from TOSV(TOSV/Phl.51/FR/2009)__HQ184336.1__GP
  source 1..4020: mol_type = other RNA
atgtttatcgccaaactcttgctcatctcatgcctggtccaacaagcatacctcaaatacacaatcatcagcgagataggtaacggaacgcgaaccagcttctgctatagctctcgcacctctctaggttccctcctagaagcctgggacaatgtgactgaaagcataggactaacctcgggtacgtgcaaagtaggctcactagaaaaccgcgactgccggaaagacatcatgagcaactacgttgcagaggtccactctaacctacatggcttgggcgcaatgatgcataattacggggacgacaaacgagtcgaaattttaaatgacgtcattcccgacgaactgaaccccggccaccacaactgctccgacctcgatcgtaaacccttctggaccgagttcatcaatgtcgccaagcccctaagcgaaattgtccctatgagtgtcatacccccacccgtcgtgaaattacaacctcccgccgaaccctcctcgaagaaacatgtacccttcgacgtgcttctctcagaagccgaaaaagaacttaaccaaaccaaaatccgattggaagacgaacgaaaatcaaacgccgaagaaaccgcaaaagaacgcgcgcgcatgaaagaaatcgaggacgaactgcgacgcgagtgggaactggagcgtaagcgcaaggacgcaatggcagacgacctcgcgaaagaaacagcacgccgacgcgaaatagaccgaaaggcacacgagctcgaccgtatgctcaaaaagaaggagagagaaagccttatagccaaagagaaagccgacgaaaacatgcgctcgcacgtccacgagcccaacaccacacgagcaccggcccccaccataataacgaccctactcatggcatcagccgcgctagcgggcccgcttgaaaaccgagaaacaaaccacctacttaaccgcccaggaaacggcgcatacaccctttccgacttcgcagagagcacatgcacgctcgcctatgggtccgaatgcaagagctgggaacacctactgaacgaggaactgttccctttctttcacagcaacctagacaaatattctatgctagaagcagccacagaaaccgtgcccatcctaaacaagagctcggccgtctgcacaatctcaccgtcaacgcacagctccaacgcatgcggaagagaagccagcgtcatccgcaagaaatgctactccaatatgtccgccttcttttacataaacctggccggacaaataaccgtggtaaagtgcgaaactaaccacgtcctatcatccgattgcggcaactgcatctccaagtccctctcaggccaaaaagtttacacgccagtacaggacgtattctgccagaaaggctggacccaaagcattccctccacacgctactccaaagacatatgctccataggcctgcataccgttaaagagtgcaaaattggcactacatctttcgaacgcgttggatttatagtcgtgaaaggacgtaaaatgtacatcgagcaaatgaaaatgcgcagccgacaagagtattccgaagatcaattcctgtgttacaaatcagaatcgggctcaggctccagcgtaaaactaaagaaattcaaagtcgaatcttgcaaaggagtcacaacctcaagcgccagcaaatgctccggcgatgagtacttctgcagcagattcccatgcgaaacggcgaacgtagaagcccactgcatcttacgccgccacagcgccatcgtagaagtaaacgtcaacggcgtgtgggtggtaccgcgctgtatcggatacgaggaagtgctagtcaaaagaacatcactcaaggtcgaagacacaaccgaaagagagtgcgacagctgcctatgggagtgcgggaaaaacaaactcatagtaaaaacccacggcccgaaggtcgtgtatgccacggcctgctcacatggctcgtgcaaatcagtcatgcaaaaacccgccacgttcgtttacctaccctaccccggcaactcggaaatcgtcggcggtgatatcggcatccacatgaccgaagaatcatccccctccaacatccacctagttgcacactgtcccgcccgagacagctgcgacgtatcagactgtctcttctgcgtccacgggctactcaactatcagtgtcacaccctcttctcggccctcctcatcagcaccaccgtcatgtccatcctcaccttactgctactactcgtcaaaggcgcaaaggatctagttaaaaagctattccactggctaataacacccctgtgctggctgtccgtattctgctgctgggtcgtcaaatcctggaaacgccgcgtagggtccgcaatctcccgaacaaacgacacaatcggatggcgagaaaatcgtcgccacgctcaagatatcgaaagagcccaatacaccggcggggcccccggtgcaaagtacagcttcttcggagtcatgatcctcgggctgctaagtagcgcacaaagctgctcggagagcgtaatcgcagactccaagataatgcaatgcaccacgtctggctcgtctaccctatgtaaggccagcggaaccgttatcatgagactcggccctataggcagcgaatcctgcctaatcttaaagggcctcaaagactcagaaaaacaattcataagcatcaaaaccatatcatcagaactgacctgtcgtgaaggagagtctttctggaccactctatacacccccatctgccttagctcccgacgatgccacctcatgggcgaatgcgtctccgatagatgtctcaagtggaaaacaaaccaaacatccgcagaatttacgggcaaagctcacggggacgtcatgcacgaaaaccgctgcttcgaacaaagcggcggtattggctatggctgctttaacgttaacccgtcctgcctttatgtacacagctacctaaagagcgtgtacaggaacgggttcaaagtctttcgatgcgtcgcctggaaccaccggatacgcctcgaggtcaccacccacagtcgaaaattccctatggtccttatggctatgtcaactcagccaacggattggggctcgataggcctcatccttgacagcgaaggcatcaccggaaccaattcatacagcttcatgaaacacgggagcggttcctttgcgataatcgacgacccctactcccccgaaccgcgcaaaggattcctcggggaagtgaggtgcccaaccgaggaaacggccatgagagcaagcccgagctgtaagatggccccaaacctggtagagtatcaaccggaaatggacaccgcagagtgcacaacgaacatgatcgacccgatggccatctttaaccggggcagcctaccccaagttcgagacggaatgacattcacacaatcgatcgaaaagaacaccgtacaagcactcaccacaggagaagtgaaggctagcataagattaacactggacgactacgatgtcgtctaccaaaactcccaaagtgactgcagcgctactttcaagaacctcacgggatgttactcatgcgatgaagggagcagactatgctatcaagttaaagccgaaggcgagaccatcttccacttcataaacgaagaagaatcaatcaatgtcatcaacaaagtctcaccaagagtcagtgactattgcaccgtcttgcactttagtcggccagtcatatcaatagaaggaacctacgactgcggcctttccaagcgccccatggtaattaaaggcaccctaatcgccacggctccacacgatgatcgaaaacacgagggaggctcatccctcgtagtaaacccaaaaggaggatcggtagacttctttggatggctttcaggactaacgtcgtggctgggcggccccctcaaaacgttcctaactatactcggattcctagcagtgggcttactcctggtcgttattatcattataatcatccggactggcatgcaacaagcgctgaaaaagaaaattaagtag

SEQ ID NO: 16356 - RNA, 4020 nt, synthetic construct
  misc_feature 1..4020: note = derived and/or modified CDS sequence (opt11) from TOSV(11368)__KU925897.1__GP
  source 1..4020: mol_type = other RNA
atgttcatcgccaaactgttactgatcagctgcctggtacagcaggcctacctcaagtacaccatcatctccgagaccggcaacggaacgcgcaccagcttctgctactccagccggacatccctcggcagcctgctcgaggcgtgggataacgtcaccgagagcatcgggctaacgagcgggacctgcaaagtgggctccctggagaaccgcgactgccggaaggacatcatgagcaactacgtggccgaggtgcactcgaaccttcatggcttaggcgccatgatgcacaactacggggacgacaagcgcgttgagatccttaacgacgtgatacccgacgagctcaaccctggccaccacaactgcagcgacctggatcggaagcccttctggaccgagttcatcaacgtcgccaagcccctatccgaaatggtacccatgagcgtgatcccaccgcccgtcgtgaagctccagccgcccgccgagccctccagcaagaagcacgtgcccttcgatgtcctgctgagcgaggcggagaaggagctcaaccagaccaagatccgcctggaggacgagcgcaagtccaacacggaggagaccgccaaggagcgggcccggatgaaggagatcgaggacgagctccgcagggagtgggagctcgagcgcaagcgtaaggacgccatggcggacgacctggccaaggagaccgcccgcagacgcgagatcgagcggaaggcacacgagctggacaagatgcttaagaaaaaggagcgcgaatccctgatcgctaaggagaaggcggacgaggacatgagaagccatgttcacaagcccaacaccactcgcgccctggcccccaccatcatcaccaccctcctgatggcctcagccgcgctggccgggcccctcgagaaccgggagacgaaccacctccttaaccgccccggcaatggggcctacaccctctccgacttcgccgagagcacgtgtaccctggcctatggctccgagtgcaagagctgggagcatctgctcaacgaggagctgtttcccttcttccactccaacctggacaagtacagcatgctcgaggccgccacggagaccgtaccgatcctcaacaagagtagcgccgtctgcacaatttcccccagcacccactccagcaacgcctgcggccgcgaggcttccgtgatccggaagaagtgctactccaacatgtccgctttcttctacatcaacctggccgggcagatcacagtgatcaagtgcgagaccaaccacgtcctcagttccgactgcggtaactgcatcagcaagtccctttccggacagaaggtgtacacacccgtgcaggacgtcttctgccagaagggctggacccagtctatcccctccacgcgctacagcaaggacatctgttccattggcctgcacaccgtgaaggagtgcaaaatcgggaccacctcttttgagcgtgtaggcttcatcgtcgtaaaggggcgcaagatgtacatcgagcagatgaaaatgcggtcccgccaggagtacagcgaggaccagtttttatgctataagtctgagagcggcagcgggagctccgtcaagctgaaaaagttcaaggttcagagctgtaagggcgtcacgacctccagcgcgtccaagtgcagcggcgacgagtacttctgctcccggtacccgtgcgagaccgccaacgtcgaggcacactgtatcctgcgccggcactcggctatcgtggaggtgaacgtaaacggcgtgtgggtggtcccacgctgcatcggctacgaggaggtgctcgtgaaacggaccagcctgaaggtggaagatacaaccgggcgggagtgtgactcctgcctgtgggaatgcggcaagaacaagctgatagtgaagacccacgggcccaaggtagtctacgcaaccgcctgtagccacggctcctgcaagagcgtgatgcagaagcccgctaccttcgtgtaccttccgtacccaggcaactccgagatcgtcgggggcgacattgggatccacatgacggaggagagctccccttcaaatatccacctggtggctcactgtcccgcccgggactcctgtgacgtgagcgactgcctgttctgcgtccacggcctcctgaactaccagtgtcacaccctgttctcggccctgctgatcagcaccaccgtaatgagtatcctgacgctcctgctgctcctggtgaagggggccaaggacttagtcaagaagctgttccactggctgatcaccccgctgtgctggctcagcgtgttctgttgctgggtggtcaaatcatggaagcgccgggtgggcagcgcgatctccagaaccaacgatactatcggctggcgggaaaacagacgtcatgcgcaagacatcgagcgcgcccaatacaccggcggcgcacccggggccaagtacagcttctacggcgtgatgatccttggcctgctctccagcgcccagagctgctccgagagcgtaatcgcggactccaagatcatgcagtgcaccaccagcgggtccagtaccctgtgcaaggcctctggcacggtcatcatgcgacttggacccataggcagcgagtcctgcctcatcctgaaggggctgaaggatagcgagaaacagttcatctccatcaagaccatcagctccgagctgacctgccgcgagggcgagagcttctggaccacgctgtacaccccaatatgcctgtccagccgtcggtgccatctgatgggcgagtgcgtgtcagaccgctgcctgaagtggaagaccaaccagaccagcgccgagttcacgggcaaggcccacggcgacgtaatgcacgagaaccggtgcttcgaacagagtgggggcatcgggtacggctgcttcaacgtgaaccctagctgcctttacgtgcacagctacttaaagtccgtatatcgcaacggattcaaagtgtttcggtgcgtggcatggaaccatcgcattcggctggaggttacgacccacagccgcaagttccccatggtgctgatggccatgtccacacaacccacggattgggggagcatcggcctcatcctggactccgaggggatcaccgggacaaatagctactccttcatgaagcacggaagcgggtccttcgccatcatcgatgacccctactcacccgagccgcggaagggcttcctgggggaggtgcgctgccccaccgaggagacggccatgcgggcctccccgagctgcaagatggcgcccaacctcatcgagtaccagcccgagatggacaccgccgagtgtaccaccaatatgatcgaccctatggcgatcttcaaccgcggctccctgccgcaggtccgggacgggatgacgttcacccagagcatcgagaagaacaccgtgcaggccctgaccacgggcgaggtgaaggcctccatccgtctcatcctcgacgactacgacgtggtgtatcagaacagccagtccgactgcagcgcaaccttcaagaaccttaccgggtgctactcctgcgacgagggcagccggctctgctaccaggtaaaagcggaaggcgagaccatcttccactttatcaacgaggaagagagcatcaacgtcatcaacaaggtgtccccaggcgtgtcggattactgcaccgtcctgcatttcagtcgccccgtaatctcaatcgagggcacgtacgactgcggactgtccaagcgacccatggtcataaaggggaccctcatcgccaccgccccacacgacgaccgcaagcatgagggcgggtcctccttggtggtgaaccccaagggtgggagcgtagacttctttggctggttgtcagggttaaccagctggctgggcggccccctcaagacgttcctcacgatcctggggttcctggccgtaggcctcctgctggtggtcatcatcatcataatcatccggaccgggatgcagcaagcgctcaagaagaagatcaagtga

SEQ ID NO: 16357 - RNA, 4020 nt, synthetic construct
  misc_feature 1..4020: note = derived and/or modified CDS sequence (opt11) from TOSV(5904242804)__KU935737.1__GP
  source 1..4020: mol_type = other RNA
atgttcatagcaaagctgctcctgatctcctgcctggtgcagcaggcctacttaaagtacaccatcatctccgagatcggcaacggtacccgcacgagcttctgctactcgagccggacctccctgggcagtctgctcgaggcgtgggataacatcaccgagtccatcgggctgaccagcggcacgtgcaaggttggctccctggagaaccgcgactgcaagcgggacataatgagcaactatgtggccgaggtgcactccaacctccacggcctgggtgccatgatgcacaactacggggacgacaagcgcgttgaagtgctgaacgacgtgatccccgacgagctcaacccgggccgacacaactgcagcgacctcgaccgcaagcccttctggacagagttcatcgacgtcgccaagcccaccaacaaaatcgcaccaatgtccgtcatccctccgcctattgtgaagcccatcccggtcgcggagagcaccatcaagaagtccattcctttcgacaagctgctcagcgaggccgagaaggagctgaaccaaacgaagatccggctggagaccgagcgccggtccaatgccgaggaggccgcgaaggagcgcgcccggatgcgcgagatcgaggacaagctccggaaggattgggagctcgagcgcgagcggaaggacgccgtcgccgacgatctggccaaggagatagcgcgccggcgcgagatcgagcggaaggcccatgagctcgacaagatgctgaagaagaaggagcgcgaagacctggtggcccgggagcgcgtcagcgaggacatgcgcaatcacgtgcggaagcccaacaccaccatcgcccccgcgccgacgatcatcacaaccctcctgatggcgtccgccgtgatggccggacccctggaaaaccgcgagaccaaccacctcctgaaccggcccggcaacggtgcctatacgttaagcgacttcgccgagagcacgtgcaccctcgcgtacggcagcgagtgcaagagctgggaacaccagctggacgagctgtccttccccttcttccacagcaacctcgacaagtactccatgctggaggccgccaccgagaccatcccgatcctgaacaagagctccgccgtctgcaccatcagcccctccacccacagctccaacgcctgcggccgcgaagcgagcctcatcaagaagaagtgcgggtccaacatgagcgccttcttctacgtgaacctggccggccagattaccgtggtcaagtgcgacaccaaccacgtgctatccaacgactgtgggaactgcatcagcaaaaccctctccggccagaagatctacaccccagtccaggacatgttctgccagaagggctggaccgagagcatccccaacacgcggtactccaaggacctatgcagcatcgggctgcacaccgtcaaggagtgcaagaccggaaccaccaacttcgaacgggtgggtttcatcgtcgtcgaggggcggaagatgtatatcgagcagatgaagatgcgctcacggcaggagttctcggaggaccagttcctctgttacaagagcgagtccagctccgggagcagtgtgaagctgaagaaggtcaaggtggagtcatgcaagggcgtgaccacgtccagcgcctccaagtgcagcggcgatgagtacttctgttcccgctacccgtgcgagaccgctaatgttgaggcccactgcatcctgcggcgccacagcgccgtgatcgaggtgaacgtaaacggggtgtggatcgtgccccggtgcatcggctacgaggaggtccttgtgcgccggacgtccctgaaggttgaggacacctcttcccgcgagtgcgacacgtgcctgtgggagtgtgggaagaacaagctcatagtcaagacacacggacccaagatcgtgtacgcaaccgcctgcagccacgggagctgcaagtctgtgatgcagaaaccggcgaccttcgtctatctgccgtaccccggcaactctgagatcgtgggcggggacatcggcgtgcacatgaccgaggagtccagccccagcaacatccacatggtagcccactgccccgccaaggacagctgcgaggtgtctagctgcctgttctgcgtgcacgggctgctcaactaccagtgccacaccctgttctccgccctcctcataagcaccacggtcatgtccatcctgaccctgctcctgctgctcgtgaagggcgcaaaggacctggtgaaacggctgttctactggctcatcaccccgctgtgttggctgagcgtcttctgcggctgggtgatcaaatcctggaagaagcgcgtgggaagtgcgatctcccggaccaacgacacgatcggatggcgcgacaaccgccggtaccgccaagacgtcgagcgggcccagtacaccgggggcgcccccggggccaagtatagcttctacggcgttatggtgctcggcctgctggggaacgtccactcctgcagcgagtccatcatcgccgacagcaagatcatgcagtgcactaccagcggctccagcacgctctgcaaggcgtccgggaccgtgatcatgaagctgggccccatcgggagcgagtcttgcctgatcctcaagggactgaaggacagcgagaagcagttcatctccattaagaccattagcagtgagctgacctgtcgcgaaggcgagtcattctggacgaccctctacaccccggtgtgcctgtccagccggcgctgccacctgatgggggaatgcgtctccgaccggtgcctcaagtggaagaccaacgagacgagcgccgagttcaccggcaaggcccacggagaagtggtgcacgagaaccgctgcttcgagcagtccggcgggatcggctacggctgcttcaacgtcaacccgagctgtctgtacgtgcactcctacctcaagagcgtgtacaagaacgggttcaagatctttcggtgcgtcgcctggaatcacaggatcagactggaggtgaccacccactcccgcaagttcccaatggtactgatggcgatgagcacgcagcccaccgactggggcagcatcgggttgatcctcgattccgagggcatcaccgggaccaacgcctactcattcatgaagcacggctccggcagcttcgccataatcgatgacccgtactcccccgagccccgtaaggggttcttaggcgaagtccgctgccccacggaggagaccgccatccgggccagcccttcttgtaagatggcgcccaacctgatcgagtaccagcccgagatggacaccgccgagtgcactacgaacatgatcgaccccatggcgatcttcaaccgcgggagcctcccccaggtgcgggacggcatgacctttacccagtccatcgagaagaacaccgtgcaagccctgacaaccggggaggtccgcgccagcatccggttgaccctcgatgactacgacgtggtgtaccagaactcgcagagcgactgcagtgcgaccttcaagaacctgacgggctgctacagctgcgacgagggctcccgcatgtgctaccaggtcaaggccgagggggagacgatcttccacttcataaacgaggacgagagcatcaacgtgatcaacaaggtgaacccagatgtctccgactactgcaccgtgctgcacttcagcaggcccgtcatctcgatcgagggccgctacgactgcgggctcagcaagcgccccatggtgatcaagggcaccctgatcgccaccgccccgcacgacgaccggaagcacgagggcgggagctccctaattgtgaaccccaagggcgggacagtcgacttcttcggctgggtgagcgggctcacctcctggctgggaggccctctgaagaccttcctcaccatcctggggttcctggccttgggcctgctgctagtggtcatcatcatcatcatcgcgcgcacgggggtgcagcaggccctgaagaagaagaataagtga

SEQ ID NO: 16358 - RNA, 4020 nt, synthetic construct
  misc_feature 1..4020: note = derived and/or modified CDS sequence (opt11) from TOSV(5963930705)__KU935734.1__GP
  source 1..4020: mol_type = other RNA
atgttcattgccaagctgctccttatatcctgcctcgtccaacaggcgtacttaaaatacaccataatcagcgagatcggcaatggaacccgcacctccttctgctacagctcgcgcacaagtctgggctcgctcctcgaagcctgggataacgtcactgaatcaattggactaaccagcggcacatgcaaggtagggagcttagaaaaccgagattgcaggaaggacatcatgagcaactatgtagcggaagtccactcaaatctgcatggactgggcgcgatgatgcacaactacggggatgacaaacgcgttgagatcctaaacgacgtcattcctgacgaactgaaccccggccaccacaactgttcggaccttgaccggaaaccattttggacagagttcataaatgtggccaaacccctcggcgagatcgtccccatgagcgtgataccgccacccgtagttaagctacaaccacccgctgaaccctcatctaagaaacacgtacccttcgacgtgctcctatcagaggccgaaaaagagctcaaccaaaccaaaatacggttggaagatgaacgaaaatctaatgccgaagagacagcaaaagaacgggccaggatgaaagaaatcgaggaggaactaaggcgcgaatgggaactcgaacgcaagcggaaagacgccatggcagacgaccttgccaaagaaactgcccgtaggcgcgaaatcgaacgcaaggcacacgaactcgaccgaatgctcaaaaagaaagagcgtgaaagcctgatcgcaaaagagaaggccgatgaagacatgcggtcacacgtacacaagcccaacaccacgcgagctccagctcccaccattataaccacactgctcatggcatccgcggcacttgcaggccccctcgaaaaccgcgaaacaaaccatctcctcaaccgccctggcaacggagcctacaccctctcagacttcgccgaatccacttgtactctagcgtacgggtccgaatgcaaaagttgggaacacctccttaacgaggaattgttcccattcttccactcgaacttagacaagtactccatgctggaagctgccaccgaaacagtacccattctgaacaagtcatccgcagtctgcacaatctccccatcaacgcacagctcgaacgcatgcggccgagaggccagcgtgatacgcaaaaagtgctactcgaacatgtcagcattcttctacatcaacctagccggccaaatcaccgtcgtgaaatgcgaaaccaaccacgtcctatccagtgactgcggaaactgtatctcaaaaagcctatcgggacagaaagtctacacaccagtccaagatgtattctgccaaaaaggatggacacagtccatcccatccacacgatactcaaaagacatttgcagtataggactacacaccgtaaaggaatgtaagatcggcaccacgtcctttgaacgggtcggtttcatagtcgtaaagggtcgcaaaatgtacattgagcaaatgaagatgcgctcccgacaagaatacagcgaagatcaattcctctgctacaaaagtgagtcaggctccggctcatccgtcaaactgaagaaattcaaagtagaatcctgtaaaggcgtgactacgtcctccgcctccaaatgcagcggcgacgagtacttctgcagccgctacccatgcgaagccgcaaacgtggaggcgcactgtatccttcgccgccacagcgccatagtagaggtaaatgtgaacggggtatgggtcgttccccgatgcataggatacgaagaagttttggtaaaaagaacatctctaaaagtagaagacaccacagaacgcgaatgcgattcatgcctttgggagtgtggcaaaaacaaactcatcgtcaagacccacgggccaaaggtagtctacgctacagcctgctctcacggatcgtgcaaatcggtcatgcagaaaccagcgaccttcgtctacctgccctaccccggtaattcagagatcgtcggaggagatattggcatacacatgacagaagaatcgtcaccctcgaacatccacctagtagcacactgcccggcccgcgacagctgcgacgtcagcgactgcctcttctgcgtccacggcttactcaattatcagtgccatacactcttctcggccctgctaatttcaaccaccgtcatgagcatcctgacattactactactattagtaaaaggagcaaaagacctcgtgaagaaattattccactggcttattacgccactctgttggctttccgtgttttgctgctggatggtaaaatcatggaaacgacgtgtgggatccgcgatatcgcgcaccaacgacaccatcggatggcgcgagaaccggcgtcacgcccaagacatcgagcgagcccagcacaccgggggcgccccaggagcaaaatacagcttctacggagtaatgatcttgggtctcctctcctccgcccagagctgctcagaatctgtcatcgccgacagcaaaattatgcaatgcaccacatccggctcatccaccctctgcaaagcctcaggtacggttataatgcgcctaggccccatcggttcagaatcatgcctaatattgaaaggcctcaaagactcggagaaacaattcatctcaatcaaaaccatttcatcagaattaacctgccgggaaggcgaatccttctggaccacactctacacgcctatctgcctatcgtcccgccgttgccacctaatgggcgaatgtgtctccgatagatgcttaaaatggaaaaccaaccaaacaagcgccgagttcacaggcaaagcccacggtgacgtgatgcacgaaaaccgctgctttgaacaaagcggcggaataggatacgggtgcttcaacgtcaacccatcctgcctatacgtgcactcctacctaaaaagcgtctaccgaaacggattcaaagtcttccgctgtgtcgcgtggaaccacagaatacgactagaagtaacaacccattcaagaaaattccccatggtactaatggccatgtcgacacaacccactgactggggcagcatcggcctaatcctagacagcgagggcatcaccgggacgaactcctacagcttcatgaaacacggatccggatccttcgcaataatagacgacccatactcccccgagccaagaaaaggcttcctgggcgaggtcagatgccccaccgaagaaacagccatgcgcgcaagccccagctgcaaaatggcccccaacctgatagagtaccaacccgaaatggacaccgcggaatgcaccactaacatgatcgaccccatggccatcttcaaccgcggttccctccctcaagtacgcgacggaatgacattcacccaatcaatcgagaaaaataccgtccaagcactgaccactggggaagtaaaagctagcattcgactaaccttagacgattacgatgtagtctaccaaaattcgcagtccgactgttccgcgaccttcaaaaatctaaccggatgctatagctgcgacgaaggctccagactctgctaccaggtgaaagccgaaggcgaaaccatctttcacttcataaacgaagaagaatcaatcaatgtgatcaataaagtttcccccggtgtatccgattactgcaccgtgctgcacttctcgagcccagtcatttcaatagagggaacatatgactgcggattgagtaaacgaccaatggtcatcaagggaaccctcatagccacagcgccccacgatgacagaaaacacgaagggggatcgtccctagtcgtcaacccgaaaggcggatcagtcgacttctttggctggctatcaggcctcacatcctggctcggaggcccactgaagaccttccttacgatcctcgggttcctcgccgtgggcttactcctagtcgtaatcatcatcataatcatccgcaccggcatgcagcaagccctgaaaaagaaaatcaaatag

SEQ ID NO: 16359 - RNA, 4020 nt, synthetic construct
  misc_feature 1..4020: note = derived and/or modified CDS sequence (opt11) from TOSV(H4906)__KU922125.1__GP
  source 1..4020: mol_type = other RNA
atgttcatcgccaagctgctcctgatcagctgcctggtgcagcaggcctacctcaagtacaccatcatctcggagatcggtaacgggacccgcacgagcttttgctactccagccggacttccctgggcagcctgctcgaggcgtgggacaacgtcaccgaatccatcgggctgaccagcggtacgtgcaaggtggggtcccttgaaaaccgggactgtcggaaggatatcatgagcaactacgtggcagaggtccactctaacctccacggcctgggcgccatgatgcacaactacggggacgacaagcgcgtggagatcctgaacgacgtgatccctgacgagctaaacccgggtcaccacaactgcagcgaccttgaccggaagcccttctggaccgagtttatcaatgtcgccaagcccctgtccgagatcgttcccatgagcgtgataccgcctcccgtcgtgaagccccagccgcccgccgagccctccagcaagaagcacgtgcccttcgacgtcctcctgtccgaagcggagaaagagttaaaccagaccaagatccgcctcgaggacgagcgaaagagcaacgccgaagagaccgccaaggagcgggcccggatgaaggagatcgaggacgagctgcgccgggagtgggagctggagcgcaagaggaaggacgcgatggccgacgacctcgcgaaggagacggcccgccggcgcgagatcgagcggaaagcccacgagctggaccgcatgctgaagaagaaggagcgcgaatccctcatagcgaaggagaaggcagacgaggacatgcgcagccacgtgcacaagcccaacactacaagggcccctgcccccaccattatcacgactctcctgatggcaagcgcggccctcgccgggccattggagaaccgcgagaccaaccacctcctgaaccgcccgggcaacggggcctacaccctatccgatttcgccgagtccacgtgcaccctcgcgtacggctcggagtgcaagagctgggagcacctcctgaacgaggagctgttcccgttcttccactccaacctcgacaagtattctatgctggaggccgccaccgagaccgtgcccatcctgaacaagtccagcgccgtctgcacgatctcccccagcacacactccagcaacgcctgcggccgggaggcgtccgtgattcgcaagaagtgctacagcaacatgtccgcattcttctacatcaacctcgccggtcagatcaccgtggtcaagtgcgaaaccaaccacgttctgagctcggactgcggaaactgcatcagcaagagcctgagcgggcagaaggtgtacacgccggtccaggacgtgttctgccagaagggctggacccagtcaatcccctccaccaggtacagcaaggacatctgctccatcggactccacaccgtcaaggagtgcaagatcgggacgacctcattcgaacgcgtcggcttcatcgttgtcaaggggcggaagatgtacatcgagcagatgaagatgcgctcccggcaggagtacagcgaggaccagttcctgtgctacaagtccgagagcggctccgggagctccgtgaagctgaagaagttcaaggtcgagagctgcaaaggcgtcaccacctccagcgcctccaaatgcagcggtgacgagtacttttgctcccgcttcccctgcgagacagcgaacgtcgaggcccactgcatcctccggcgccacagcgccatcgtggaggtcaacgtgaacggggtgtgggtcgtgccccgatgcatcggctacgaggaggtgctggtcaagcgcaccagcctgaaggtggaggacaccaccgagcgggagtgcgactcctgcctctgggagtgcgggaagaacaagctgatcgtgaagacgcacggcccgaaagtcgtgtacgccaccgcctgcagccacgggagttgcaaaagcgtgatgcagaagcccgcgacctttgtctacctgccctaccccggcaacagcgagatcgtgggcggcgacatcggtatccacatgaccgaagaaagctccccgagcaacatccacctggtggcccactgccccgcccgcgactcctgcgacgtttcagactgcctcttctgcgtgcacgggctgctgaactaccagtgccacaccctcttctccgccctactgatcagcacgaccgtgatgtccatcttgaccctgctgctcctgttagtcaagggcgccaaagacctcgtgaagaagctgttccactggcttattacgcctctctgctggctgagcgtgttctgctgctgggtcgtgaagtcctggaaacggcgcgtggggagcgcgatcagccggaccaacgacacaatcggctggcgcgagaaccggcgccacgcccaggacatcgagcgcgcccagtacaccggcggggcccctggcgccaagtacagcttctacggtgtcatgatcttaggcctcctgtccagcgcgcaaagctgctccgagagcgtgatcgccgatagtaagatcatgcagtgcaccacgagcgggtctagcacgctgtgcaaggcctccgggaccgtcatcatgcggctcggccccatcgggagcgagtcctgcctgatcttaaagggcctcaaggacagcgagaagcagtttatctccatcaagaccatcagctccgagctgacgtgccgtgagggtgagagcttctggaccaccctgtacacccccatctgcctctccagtcgtcgctgccacctgatgggcgaatgcgtctccgaccggtgcctgaagtggaagaccaaccagaccagcgccgagttcaccggcaaggcgcacggggacgtgatgcacgaaaaccgatgcttcgaacagtccggcgggatcgggtacggatgcttcaacgtgaacccgagctgcctctacgtccacagctacctgaagtccgtgtaccggaacggcttcaaggtgttccgctgcgtcgcctggaaccaccgtatcaggctggagatgaccacccacagccggaagttcccgatggtgttgatggccatgtccacccagcccaccgattggggcagcatcgggctgatcctggactccgagggcatcaccggcacgaacagctacagtttcatgaaacatgggagcgggtccttcgccatcatcgatgacccctacagcccggagccacgcaagggcttcctcggcgaggtgcgctgccccaccgaggagaccgctatgcgcgcgtctcccagctgcaagatggccccgaacctgatcgagtaccagccggagatggataccgccgagtgcacgaccaacatgatcgaccccatggccatcttcaaccgggggtccctgccccaggtccgcgacggcatgaccttcacccagagtatagagaagaacacggtgcaggccctcaccaccggggaggtgaaggcatccatccggctgaccctggacgactacgacgtcgtgtaccagaactcacagtccgactgctcagccacgttcaagaacctgaccggctgctactcctgcgatgaggggagccgcctgtgctaccaggtgaaggccgaaggagagaccatcttccacttcatcaacgaagaggaaagcattaatgtcatcaacaaggtgaaccccggcgtgtccgactactgcaccgttctgcacttcagccggccggtgatctccatcgaggggacatacgactgcgggctcagcaagcggcccatggtcataaaggggacactgatcgccactgcgccccacgacgaccggaagcacgagggcggctccagcctggtggtgaaccccaagggcgggtccgtcgacttcttcgggtggctcagcggcctgacctcctggctcgggggcccgttgaagaccttcctgaccatcctgggcttcttggccgtggggctgctgctcgtcgtcatcatcatcatcatcatccgcaccggcatgcagcaggccctgaagaagaagatcaaatga

SEQ ID NO: 16360 - RNA, 4020 nt, synthetic construct
  misc_feature 1..4020: note = derived and/or modified CDS sequence (opt11) from TOSV(MRS2010-4319501)__KC776215.1__GP
  source 1..4020: mol_type = other RNA
atgttcatcgccaagctgctcctgatcagctgcctggtgcagcaggcctacctcaagtacaccatcatctccgagataggcaacgggacccgtacgagcttctgctactccagccggacctccctgggaagcctgctcgaggcgtgggacaacgttaccgagtccatcgggctgatcagcgggacctgcaaggtggggtccctggagaacagagactgccggaaggacatcatgagcaactacgtggccgaagtccactccaacctccacggcctcggcgccatgatgcacaactacgccgacgacaagcgcgtggagatcctgaacgacgtgatccccgatgagctcaacccgggacaccacaactgcagcgacctggaccggaagcccttctggacggagttcatcaacgttgccaagcccctgtccgagatcgtgcccatgagcgtgatcccgccgcccgtcgtgaagttgcagcctcccgcggagccctccagcaagaagcacgtgcccttcgacgtcctgctgtctgaggccgagaaggagctcaaccagacgaagatccgcctggaggacgagcgcaagagtaacgccgaggagaccgccaaggagcgggcgcggatgaaggagatcgaggacgagctgcgccgggagtgggagctcgaacgcaagcggaaggacgccatggccgacgacctggccaaggaaaccgcccgccggcgcgagatcgagcggaaggcgcacgagctggatcgcatgctcaagaagaaggagcgggagtccctgatcgccaaggagaaggccgacgaggacatgcgcagccacgtgtacaagcccaacacgacccgggcccccgcccccaccatcatcaccacgttgctcatggcgtcagccgccctggccggccccctggagaaccgcgagaccaaccacctcctgaaccgacccgggaacggagcctacaccctgtccgacttcgcggagagcacgtgcaccctcgcctacgggtccgagtgcaagagctgggagcacctcctgaacgaggagctgttcccgttcttccactccaacctggacaagtacagcatgctggaggccgccaccgagaccgtgcccatcctcaacaagtccagcgccgtctgcaccatctcccccagcacgcactccagcaacgcgtgcggccgggaggcctccgtgatccgcaagaagtgctacagcaacatgtccgccttcttctacatcaacctggccggccagatcaccgtggtcaagtgcgagaccaaccacgtgctgagctccgactgcgggaactgcatcagcaagtctctcagcggccagaaggtgtacacccccgtccaggacgtgttctgccaaaaggggtggacgcagtcaatcccgtccaccaagtacagcaaggacatctgctccatcggcctgcacaccgtgaaggagtgcaagatcggcatcaccagcttcgagcgggtcgggttcatcgtggtcaagggccgcaagatgtacatcgagcagatgaagatgcggtcccgccaggagtacagtgaggaccagttcctgtgctacaagtccgagagctccagcgggtccagcgtgaagctcaagaagttcaaggtggagtcctgcaagggcgtcacgaccagctccgcgagcaagtgctccggagacgagtacttctgtagccggtacccctgcgagaccgccaacgtggaggcccactgcatcctgcgccggcacagcgccatcgtggaggtcaacgtgaacggcgtgtgggtcgtgccccgctgcatcggctacgaggaggtgctggtcaagcggacctccctcaaggtggaggacacgaccggtcgagagtgcgacagctgcctgtgggagtgtggcaagaacaagctgatcgtgaagacccacgggcccaaggtcgtgtatgccaccgcgtgctcccacggcagctgcaagtccgtgatgcagaagccggccacgttcgtctacctgccctaccccgggaacagcgagatcgtaggcggagacatcgggatccacatgaccgaggagtccagcccctccaacatccacctcgtggcccactgcccggcccgggacagctgcgacgtctccgattgcctgttctgcgtgcacggcctgctcaactaccagtgccacaccctgttcagcgccctgctcatctccacaaccgtgatgagcatcctgacgctgctcctgctgctcgtcaagggggcgaaagacttagtgaagaagctgttccattggctcatcacgcccctgtgctggctgtccgtgttctgctgctgggtcgtcaagtcttggaagcgccgggtgggctccgccatcagccgcaccaacgacaccatcgggtggcgggagaaccgccggcacgcccaggacattgagcgcgcccagtacacaggcggcgcccccggggcgaagtactccttctacggcgtgatgatcctcgggctgctgagcagcgcccagtcctgcagcgagtccgtgatcgccgacagcaagatcatgcagtgcaccacgtccggcagctccaccctctgcaaggcaagcggcacggtgatcatgagggtcgggccgatcggctccgagagctgcctgatcctgaaggggctcaaggactccgagaagcagttcatcagcatcaagaccatctccagcgagctgacctgccgggagggcgagtccttctggaccaccctgtacactcccatctgcctcagctcccgccggtgccacctaatgggggagtgcgtgagcgatcgctgcctgaagtggaagacgaaccagacctcggcggagttcacgggcaaggcccacggcgatgtgatgcacgagaaccggtgcttcgagcagagtgggggcatcgggtacggctgcttcaacgtcaaccccagctgcctctacgtgcactcctatctcaagagcgtgtaccgcaacgggttcaaggtcttccggtgcgtagcctggaaccaccgcatccggctggaggtgaccacccactcccgcaagttccccatggtcctgatggccatgagtacccagccgacggactggggctccatcggcctgatcctggacagcgagggggtgaccggcaccaactcctatagcttcatgaaacacgggtccggcagcttcgccatcatcgacgacccctactccccggagccccggaaggggttcctcggcgaggtgcgctgcccgaccgaggagacggcgatgcgggccagcccctcctgtaagatggcccccaacctgatcgagtaccagcccgagatggacaccgccgaatgcacgaccaacatgatcgacccgatggccatcttcaaccgcggcagcctgccccaggtccgggacgggatgacgttcacccagtccatcgagaagaacaccgtgcaggcgctcaccacgggcgaggtgaaggccagcatccgcctgaccctggacgactacgacgtcgtgtaccagaactcccagagcgactgctccgccaccttcaagaacctcaccgggtgctacagctgcgatgagggctcacggctgtgctaccaggtgaaggccgagggggagacgatcttccacttcatcaacgaggaggagtccatcaacgtcatcaacaaggtgagccccggcgtctccgactactgcaccgtgctgcacttcagccgccccgtgatctccatcgagggcacctacgactgcgggctcagcaagcggccgatggtcatcaagggcaccctgatcgccaccgcgccccacgacgaccgcaagcacgagggcggctccagcctggtggtgaaccccaagggcggctccgtcgacttcttcggctggctcagcgggctgacgtcctggctgggcgggcccctcaagaccttcctgacaatcctgggctttctcgccgtgggcctgctgctagtggtcatcatcatcattatcatccggaccgggatgcagcaggccctgaagaagaagatcaagtga

SEQ ID NO: 16361 - RNA, 4020 nt, synthetic construct
  misc_feature 1..4020: note = derived and/or modified CDS sequence (opt11) from TOSV(Nice/113)__KU204982.1__GP
  source 1..4020: mol_type = other RNA
atgttcatcgccaagctgctcctgatcagctgcctggtgcagcaggcctacctcaagtataccatcatctccgagatcggcaacgggacccgcacgagcttctgctactccagccggacctccctgggcagcctgctcgaggcgtgggacaacgtcaccgagtccatcgggctgaccagcggcacgtgcaaggtggggtccctggagaaccgcgactgtggcaaagacatcatgagcaattacgtggccgaggtccactccaacctccacggcctgggggccatgatgcacaactacggcgacgacaagcgggtggagatcctgaacgacgtgatccccgacgagctaaacccggggcaccacaactgtagcgacctggaccgcaagcccttctggaccgagttcatcaacgtcgcccggcccttgtccgagatcgcccccatgtcggtcatacccccgcccgtggtcaagctccagccgcccgcggagccctctagcaagaagcacgtgccctttgacgtcctgctgtccgaggccgagaaggagctcaaccagaccaagatccgtctggaggacgagcgcaagagcaacgccgaggagaccgccaaggagcgggcgcggatgaaggagatcgaggacgagctgcgccgggaatgggagttggagcgcaagcggaaggacgccatggccgacgacctggccaaggagacagcccgccggcgcgagatcgagcggaaggcgcacgagctggaccgcatgctcaagaagaaggagcgggagtccctgatcgccaaggaaaaggccgacgaggacatgcgcagccatgtccacaagcccaacaccacccgggcccccgcccccacaatcatcacgaccctgctcatggcgagcgccgccctggcaggccccctggagaaccgcgagaccaaccacctcctgaaccgccccgggaacggtgcctacaccctgtccgacttcgcggagagcacgtgcaccctcgcctacggctccgaatgcaagagctgggagcacctcctgaacgaggagctgttcccgttcttccactccaacctggacaagtacagcatgctggaggccgccaccgagaccgtgcccatcctcaacaagtccagcgccgtgtgcacgatctcgccctcgacccactccagcaacgcgtgcgggcgggaggcctccgtcatccgcaagaagtgctacagcaacatgtccgccttcttctacatcaacctggccggccagatcaccgtggtgaagtgcgagaccaaccacgtcctgagctcagactgcgggaactgcatcagcaagtcgctcagcggccagaaggtgtacacgcccgtgcaagacgtcttctgccagaagggctggacccagagcatcccgtccacccggtacagcaaggacatctgctccatcgggctgcacactgtgaaggagtgcaagatcggcacgaccagcttcgagcgcgtggggttcatcgtcgtgggcgggcggaagatgtacatcgagcagatgaagatgcgctcccggcaggagtactctgaggaccagttcctgtgctacaagtccgagagcggctccggcagctccgtcaagctcaagaagttcaaggtggaaagctgcaagggggtgaccacctccagcgcgtccaagtgcagcggcgacgagtacttctgctcccgctacccctgcgagacggccaacgtcgaggcccactgcatcctgcggcgccacagcgccatcgtggaggtgaacgtcaacggggtttgggtggtcccccggtgcatcggctatgaggaggtgctggtgaagcgcacctcactcaaggtcgaggacaccaccgagcgggagtgcgactcctgcctttgggagtgcgggaagaacaaactgatcgtgaagacgcacggccccaaagtggtctacgccaccgcgtgcagccacggctcctgcaagagcgttatgcagaagccggccaccttcgtgtaccttccctaccccgggaactccgagatcgtcggcggggacatcggcattcacatgactgaggagagctcccccagcaacatccacctcgtggcccactgcccggccagggactcctgcgacgtgagcgactgcctgttctgcgtccacgggctgctcaactaccagtgccacaccctgttctccgccctgctcatcagcacgactgtgatgtccatcctgaccctgctcctgctgctcgtgaagggcgcgaaggacctggtcaagaaactgttctactggctcataacgcccctgtgctggctgagcgtgttctgctgctgggtcatcaagtcgtggaagcggcgcgtcggcagcgccatctcccggaccaacgacaccatcgggtggcgcgaaaaccggagacatgcccaggacatcgagcgcgcccagtacaccggcggggccccaggcgcgaagtacagcttctacggcgtgatgatactcgggctgctgtccagcgcccagagctgctccgagagcgtgatcgccgactccaagatcatgcaatgcaccacgagcggctccagcaccctctgcaaggcctccgggaccgtcatcatgcggctgggcccgatcgggagcgagtcctgcctgatcctcaagggcctgaaggacagcgagaagcaattcatctcgatcaagaccatcagctccgaactgacgtgccgcgagggcgagagcttctggaccaccctctacacacccatctgcctgtccagccgacgctgccacttgatgggggagtgcgtgtccgaccggtgcctgaagtggaagacgaaccagaccagcgcggagtttaccggcaaggcccacggggacgtgatgcacgagaaccgctgctttgagcagtccggcgggatcggatacggctgcttcaacgtcaatcccagctgcctgtacgtgcacagctacctgaagtccgtgtaccgcaacgggttcaaggtgttccgctgcgtggcctggaaccaccggatccgcctcgaggtgaccactcactcgcggaagttccccatggtcctgatggccatgtccacccagccgaccgactggggcagcatcgggctgatcctcgactccgagggcatcaccgggacgaacagctactccttcatgaagcacggcagcggctccttcgccatcattgacgacccttacagccccgagccccgcaaggggttcctgggcgaggtgcggtgcccgaccgaggagaccgcgatgcgcgcctcccccagctgcaagatggcccccaacctgatcgagtaccagcccgagatggataccgccgagtgcacgaccaacatgatcgacccaatggccatcttcaaccgggggtccctcccccaggtgcgcgacggcatgaccttcacccagagcatcgagaagaacacggtccaggcgctgacaaccggggaggtgaaggcctccatccggctgaccctcgacgactacgacgtggtctaccagaacagccaatccgactgcagcgccacgttcaagaacctcaccggctgctactcctgcgacgagggcagccgcctgtgctaccaggtaaaggccgagggggagaccatcttccacttcatcaacgaggaggagagcatcaacgtgatcaacaaggtgtcccccgaggtgagcaactactgcacagtgctccacttctcccggcccgtcatcagcatcgagggcacctacgactgcgggctgtccaaacgcccgatggtgatcaagggaacgctgatcgccaccgcgccccacgacgacagaaagcacgagggcgggagctccctcgtcgtgaaccccaagggcgggagcgtggacttcttcggctggctgtccgggctgaccagctggctcggcggccccctgaagaccttcctgacgatcctcgggttcctggccgtcggcctgctcttggtggtgatcatcatcatcatcatccgcaccgggatgcagcaggccctgaagaagaagatcaagtga

SEQ ID NO: 16362 - RNA, 4020 nt, synthetic construct
  misc_feature 1..4020: note = derived and/or modified CDS sequence (opt11) from TOSV(P233)__KU204976.1__GP
  source 1..4020: mol_type = other RNA
atgttcattgcgaaacttcttctcatctcatgcctcgtccaacaagcctacctaaagtataccataataagcgaaatcggcaacggaacccgtacttccttttgctactccagccgcaccagcctcggctcactactcgaggcgtgggacaatgtcaccgagtctataggcctgacttccgggacctgcaaggtcggctcactcgagaaccgcgattgccgaaaagacataatgagtaattacgtagcggaggtccactccaatctccacggactaggcgccatgatgcacaactacggcgacgacaaacgagtcgagatcctcaacgacgtcatccccgacgaactaaaccccggacaccacaactgttcagacctagaccgaaagcctttctggaccgagttcatcaatgtcgctaaaccactttcggagatcgttccaatgagtgtaataccgcctcccgtagtaaaaccgcaaccaccagccgaaccctcctcgaagaaacacgttccctttgacgtactattaagcgaggccgaaaaagaattaaaccaaaccaaaatccgcctagaggatgaaaggaaatccaacgcagaagagacagcaaaagaaagagcacgtatgaaagaaatcgaggacgaactccgtcgcgaatgggaactcgagcgaaaaagaaaagacgctatggccgacgacctagcgaaagaaaccgcgcgacgacgcgaaatcgagcgcaaggcccacgaactggataaaatgctcaaaaagaaagagcgcgagagcctaattgccaaggagaaggcggacgaagacatgcgatcacacgtacacaagcccaacacaacgagagcaccagcaccaaccatcatcaccacgctgctaatggccagcgccgccctggccggtcccctagaaaaccgagagaccaaccacctactaaaccgccccggcaacggcgcgtataccctatcagacttcgccgaatcaacgtgtacgctagcttacggatccgagtgcaaatcatgggaacacctactaaatgaagaactcttcccattcttccactcaaacctcgacaaatattcaatgctcgaagccgccacagaaacagtaccgatcctgaacaagtcctccgccgtttgcacaatatcacccagcacccactccagcaacgcgtgcggacgggaagcatccgttatccgcaagaaatgttactccaacatgtccgcattcttctacataaacctggcggggcaaatcaccgtcatcaaatgcgaaacaaaccacgtcctgtcaagcgactgcggaaactgcatatcaaaatccctttcaggccaaaaagtctacacccccgttcaggacgtcttttgccagaaaggatggacacagtcaattccaagcacacgatacagtaaagacatatgctccatcggactccacaccgtcaaagaatgcaagatcggtaccaccagcttcgaaagggtcggattcatcgtcgtgaaaggcagaaaaatgtacatcgagcaaatgaagatgcgctcccgccaagaatacagcgaagaccaatttctttgctacaaatcagaatcgggttcagggagttccgtcaaactaaagaaattcaaagttaaaagctgcaaaggagtgacaacctccagcgccagcaaatgttcgggcgacgaatacttctgcagcagatacccatgcgagaccgctaacgtggaagcccactgcatcctgcgccgtcactcagccatcgtcgaagtaaacgtgaacggcgtatgggttgtcccccgctgtatcggctacgaagaagtgctcgtgaaacggacgtcgcttaaagttgaagacaccaccggacgcgaatgcgactcctgcctctgggaatgcggcaagaacaaactaatcgtaaaaacgcacgggccgaaggtcgtttacgcgacggcatgttcacacggctcctgcaaaagcgtaatgcaaaagcctgcaacgttcgtctacctcccctaccccggaaactcagaaatagtaggcggggacatagggatacacatgacagaagagagttctccgagcaacattcatctagtcgcacactgcccggcccgtgacagctgtgatgtaagcgactgcctcttctgcgtccacgggttgctaaactatcaatgccatacactcttttcagcactgctgatcagcacaacagtcatgtccatccttaccctcctactgctcctagttaaaggcgctaaggaccttgtcaagaaactcttccactggctcatcacacccctatgttggctcagtgtgttctgctgctgggtagtaaaatcctggaaacggagagtcgggagtgcaataagtcgtaccaacgatactataggctggagagaaaaccgccgccacgctcaagacatagaacgagcacaatatacaggaggggccccaggtgcgaaatacagtttttacggagtgatgatcctaggactattgtcaagcgcccaatcgtgctccgaatccgtaattgccgacagcaagatcatgcaatgtacaacatccggatcttccacgttatgcaaagcaagcggcacagtcataatgagactcggtcctatagggagcgaaagttgcttaattctgaaaggcctgaaagattccgagaaacagtttatctcgataaaaacaatcagctcagaactcacatgccgcgagggcgagtccttctggacgaccttatacacacccatatgtttgtcctcccgccgttgccacctcatgggcgaatgcgtcagcgaccgatgcctcaagtggaaaaccaaccaaacaagcgctgagttcacagggaaagcccacggagacgttatgcacgaaaacagatgcttcgaacagtcgggagggataggttacggctgcttcaatgtgaacccaagctgtctatatgtccacagctacctaaagtctgtataccggaacgggttcaaagtcttcagatgcgtagcgtggaatcatcgcatcagactcgaagtcacgacccacagccgaaagttccccatggtcctcatggcgatgtccacacaaccaacggactggggatcgatagggctaatactagactccgaaggaataacaggaaccaattcatacagcttcatgaaacacgggtcagggagttttgcaatcatcgacgatccatactcccccgagcctaggaaaggattcctgggagaagtcagatgcccaaccgaggaaacggctatgcgagcaagcccatcctgcaagatggccccaaacttaatcgaataccaaccagagatggacacagccgagtgtaccacaaacatgatagaccccatggctatatttaaccgaggctcccttccacaagtccgggacggaatgacgttcacccaatccatcgagaaaaacacagtgcaagcactcaccactggggaagtaaaagcgtccatccgactcaccctcgatgactacgatgtcgtatatcagaacagccagagcgactgttccgccaccttcaagaacctcacgggttgctactcatgtgacgaaggcagccgactctgctaccaggtgaaggccgaaggcgaaaccatattccactttatcaacgaagaagaatcaattaacgtgatcaacaaagtttccccgggtgtgtccgactattgtaccgtactccacttctcccgccctgtcatctccatagagggaacctacgactgcgggctgagcaaacgcccaatggtgatcaaaggcacactaatagcaaccgctccacacgatgaccgcaaacacgagggcggctcctccctggtggtgaaccccaaaggcgggtccgtagacttcttcgggtggctctcaggcctcacctcttggctaggaggcccattaaaaaccttcctgacaatcctaggattccttgccgtgggacttctattagttgtaataatcatcatcataatccggaccggaatgcaacaagccctcaaaaagaaaataaaatag

SEQ ID NO: 16363 - RNA, 4020 nt, synthetic construct
  misc_feature 1..4020: note = derived and/or modified CDS sequence (opt11) from TOSV(T152)__JX867535.1__GP
  source 1..4020: mol_type = other RNA
atgttcatcgccaagctgctcctgataagctgcctggtgcagcaggcctacctcaagtacacaatcatctcggagatcggcaacgggacccgcacgagcagttgctacagctcccggacctcactgggctccctgctcgaggcgtgggacaacatcaccgagagcatcggtctgacctcaggcacgtgcaaggtcgggagcctggagaaccgcgactgcaagcgggacatcatgtccaactacgtggccgaggtgcacagcaacctccacggcctgggcgccatgatgcacaactacggggacgacaagcgcgtcgaggtgctgaacgacgtgatccccgacgagctcaacccgggccggcacaactgctccgaccttgaccgcaagcccttctggaccgagttcatcaacgtcgccaagcccaccaacaagatcgccccaatcagcgtgatcccgccgcccatcgtgaaacccatccccatcgcggagcccaccacgaagaagaacatccccttcgataagctgctctccgaggccgagaaggagctgaaccagaccaagatccgactggagaccgagcgccggagcaacgccgaggaggccgcgaaggagcgcgcccggatgcgcgagatcgaggacaagctccggaaggactgggagctggagcgagagcggaaggacgccgtcgccgacgacctggccaaggagatagcgcgccggcgcgagatcgagagaaaggcccacgagctcgacaagatgctgaagaagaaggagcgcgaagacttagtggccatcgagaaggtgtccgaggacatgcggaaccacgtccgccggcccaacacaacgatagcccccgcccccaccatcatcaccaccctcctgctcgcgagcgccgtgatggccgggcccctcgagaaccgggagacgaaccacctcttaaacagacccggcaacggggcctacaccctctccgacttcgccgagagcacgtgcaccttggcgtacggcagcgagtgcaagtcctgggagcaccagctggacgagctcagcttcccgttcttccactccaacctggacaagtacagcatgctggaggccgccaccgagactatccccatcctcaacaagagcagcgctgtgtgcaccatctcccccagcacccactctagcaacgcatgcggccgggaggcgtccctgatcaaaaagaaatgcgggagcaacatgtccgccttcttctacgtcaacctggccggccagatcacggtggtgaagtgcgacaccaaccacgtcctcagcaacgactgcgggaactgcatatccaagaccctgagcggccagaagatctacacccccgtgcaggatatgttttgccagaagggctggacggagtcaatcccgagcacccgctactccaaggacctgtgcagcatcgggctccacaccgtgaaggagtgcaagaccggcacgaccaacttcgagcgggtcgggttcatcgtggtggagagccgcaagatgtacatcgagcagatgaagatgcggtcccgccaggagttctcggaagaccagttcctgtgctacaagtccgagagctcgagcggctccagcgtcaagctgaagaaggtgaaggtcgagtcctgcaagggggtgaccaccagctccgccagtaagtgctccggcgacgagtacttctgcagccggtacccctgcgagacggcgaacgtggaggcccactgcatcctccgccggcactccgccgtcatcgaggtgaacgtgaacggcgtctgggtggtgccccgctgcatcgggtacgaggaggtcctggtgcggcgcaccagcctgaaggtggaggatacctccagccgggagtgcgacacgtgcctctgggagtgcggcaagaataagctgatcgtcaagacccacgggcccaagatcgtgtacgccaccgcctgcagccacggctcctgcaagagcgtgatgcagaagccggcgaccttcgtcttcctgccctaccccgggaactccgagatcgtgggcggcgacatcggggtgcacatgaccgaggagagctcccccagcaacatccacatggtcgcccactgcccggccaaggactcctgcgaggtgtcgtcctgcttgttctgcgtgcacggcctcttgaactatcagtgtcacaccctgttcagcgccctcctgatctccaccaccgtcatgtcaatcttgaccctcctgctgctactggtgaagggggccaaggacctggtgaagcgcctcttctactggctgatcacgcccctgtgctggctctccgtcttctgcagctggatgatcaagtcctggcggaagcgcgtgggcagcgcgatctccagaaccaacgacaccatcggttggcgcgacaaccgccggtacggccaggacgtggagcgcgcccagtacaccggaggggcccccggcaccaagtacagcttctacggggtcatgatcctgggcctgctcggcaacgtgcactcctgcagcgagagcgtgattgccgactccaaggtcatgcagtgcacgaccagcggatccagcaccctgtgcaaagcctccggcaccgtgatcatgaaactggggccgatcggcagcgagtcctgcctcatcctgaaggggctgaaggacagcgagaagcagttcatctccatcaaaacgatcagctccgagctgacctgccgggagggcgagagcttctggaccaccctgtacacgcccgtttgcctgtccagccgccggtgccacctcatgggcgagtgcgtctccgaccgctgcctgaagtggaagacgaacgagaccagcgcggagttcaccgggaaggcccacggcgaggtgatgcacgagaataagtgcttcgagcagtccgggggcatcgggtatggctgcttcaacgtgaaccccagctgcctgtacgtccactcctacctcaagagcgtgtacaagaacggcttcaagatcttccggtgcgtggcctggaaccaccgcatccggctggaggtcacgacccacagccgcaagttcccaatggtgctgatggccatgtccacccagccgaccgactgggggagcatcggcctcatcctggactccgaggggatcacgggcaccaacgcgtacagcttcatgaagcacgggtccggcagcttcgccatcatcgacgacccatactcccccgagcccaggaagggcttcctgggggaggtgcgctgcccgaccgaggagaccgccatccgggcgagcccctcctgcaagatggcccccaacctcatcgagtaccagcccgagatggatacggcggagtgcaccaccaacatgatcgacccgatggccattttcaaccgcggcagcctgccccaggtccgggacgggatgaccttcacgcagtccatcgagaagaacaccgtgcaggccctgaccaccggcgaagtgcgcgcctccatccggctcaccctggacgactacgacgtcgtgtaccagaactcccagagcgactgctccgccacgttcaagaacctgaccgggtgctacagctgcgacgagggctcccgcatgtgctaccaagtgaaggcggagggcgagaccatcttccacttcgtcaacgaggacgagagcatcaacgtgatcaacaaggtgtcccccgacgtcagcgattactgcaccgtcctccacttcagccggcccgtcatctccatcgaggggcgctacgactgcggcctgagcaagcggccgatggtgatcaaggggacgctaatcgccaccgcgccccacgacgaccgcaagcacgagggcggctccagcctcgtggtcaaccccaagggcgggaccgtggacttcttcgggtgggtgtccggcctgaccagctggctcggcggcccgttaaagacgttcctgaccatcctgggcttcctcgccctggggctgctcctggtcgtggtgatcatcatcatcgcccgcaccggcgtccagcaggccctgaagaagaagaacaagtga

SEQ ID NO: 16364 - RNA, 4020 nt, synthetic construct
  misc_feature 1..4020: note = derived and/or modified CDS sequence (opt11) from TOSV(TOSV/P51)__KU204979.1__GP
  source 1..4020: mol_type = other RNA
atgttcatcgctaaattgcttctcatcagctgcctagtccaacaagcatacctgaaatacacaataatttctgaaatcgggaatggcacacgtaccagcttctgctactcatcacggaccagcttaggatcgctcctagaagcgtgggataacgtgaccgagtccataggcctcacctctggcacatgcaaggtcggctcgctcgagaaccgcgactgccgaaaagacatcatgagtaactacgtagccgaggtgcactccaacctccatggactcggagcgatgatgcacaactacggcgatgataaaagggtagaaatactaaacgacgttatcccggacgaacttaatcccggccaccataattgctcagacctcgaccgcaaaccattctggactgaatttatcaacgtagccaagcccctctcagaaatcgtcccaatgtctgtaatcccaccgccagtagtcaaattacaaccacccgcggaacccagcagcaaaaagcacgtacccttcgacgtcctccttagcgaggccgaaaaggaactcaaccaaacgaaaataagactcgaagacgagcgaaaaagcaacgccgaagagacagcaaaagagcgagcgcgcatgaaagaaatagaggacgagctgcgacgcgaatgggagctcgaacgcaaacgaaaagacgcaatggcagatgacctagccaaagaaacagctcgcagacgagagatcgatagaaaggcgcacgaactcgaccgaatgttaaagaagaaagagcgagagagcctaatagccaaagagaaagcagacgagaacatgcggtcccacgtgcatgagcctaacacaacacgtgcaccagcacccacaattataacaaccctcctgatggcgtcagccgcacttgccggacctctcgagaatagagagaccaatcatctcctcaaccggccagggaacggcgcctacacactatcggactttgccgaatccacatgcacactcgcatatggaagcgaatgcaaaagctgggaacacctcctaaacgaggaactcttcccattctttcattccaacttagacaaatatagcatgctagaagccgcaacagaaacagtccccatcctaaacaagtcctcggcagtatgcacgatctcaccatccacgcacagctcaaacgcgtgcggacgcgaagcgtcggtaatccgcaaaaagtgctacagcaacatgagtgcatttttctacatcaaccttgccggacaaatcaccgtagtgaaatgcgaaacaaaccacgtgctatcaagcgactgcgggaactgcatttcgaagtcgctctcaggtcaaaaagtgtacaccccagtacaggacgtattttgccaaaaaggatggacgcaatcaatccccagcactcgatactcaaaggatatatgctcaatcggactccacaccgtaaaagaatgtaaaataggaaccacctccttcgaacgggtcggttttatcgtcgtcaaaggacgcaagatgtacatcgaacagatgaagatgcgctcacgacaggaatactcggaagaccaatttctctgctataaatccgaatcaggcagcggctcgtccgtcaaactaaagaaattcaaggtcgaaagctgcaagggtgtcaccacgtcttccgcgtccaagtgctccggcgacgaatacttttgcagccgatacccctgcgaaaccgcgaacgtggaagcccactgcattctccgccggcactcagcaatcgtagaagttaacgtaaacggcgtctgggtagttccacgctgtatcggctacgaggaagtcctcgtaaaacgaaccagcctcaaagtagaggacacgaccggccgggaatgcgactcctgcctatgggagtgcggcaagaacaaactcatagtcaagacccatgggccaaaagtagtctacgcaacagcttgctctcacggttcatgcaagagcgtcatgcaaaaacccgcaaccttcgtctaccttccctatccaggaaactccgagatcgtgggcggcgacatcgggatccacatgacagaagagagctcaccatccaacatccacctggtagcgcactgtccggcacgagacagctgcgacgtctcggactgcctattctgcgttcacggactgctgaattaccaatgccacaccctattctccgcgctactcatttccacaaccgtaatgtcaatactcaccctactgctgctcttggtcaaaggtgcaaaagacttagtaaagaaactcttttactggctcatcacacccctctgctggcttagcgttttctgttgctgggtagtcaaatcatggaaacgccgagtcggaagcgcaatatcgcgaaccaacgacacaataggatggcgcgaaaacagacgccacgcacaggacatagaaagggcgcaatacacgggtggggcccctggcgctaaatacagcttttacggggtaatgatccttggcctgctctcaagcgcacaatcgtgctcggaaagtgtaatagcggactcaaaaatcatgcaatgtaccacaagcggaagctcaaccctatgcaaggcgtcaggaaccgttatcatgcgactcggccccattggatcagagtcatgtttaatcctcaagggccttaaggactcagagaagcagtttatctcgatcaagaccatcagctccgaattaacctgccgcgaaggagagagcttctggacgactctatatacgcccatctgcctatcatcacggcgatgccacctaatgggcgaatgcgtctcggatcgttgcctcaagtggaaaaccaaccaaacgagcgccgagttcacaggcaaagcccacggagacgtaatgcacgaaaatcgctgcttcgaacaatcaggcggaataggctacggatgtttcaacgtcaacccctcatgcctttacgtacacagctacctaaaaagcgtgtacagaaacggattcaaagtattcagatgcgtcgcgtggaaccacaggatcaggttagaagtcacgacgcacagccgaaaatttccaatggtactcatggcaatgtccacccaacccaccgattggggctctataggattgatactcgatagcgagggcataacaggcaccaacagctactcctttatgaagcacggctccggctcattcgctatcatcgacgacccttactcccccgaaccgagaaaaggcttcctgggcgaggtacgctgccccaccgaagagacggcaatgcgagcctccccgagttgcaagatggcaccaaacctagtcgagtaccaaccggaaatggacaccgcagaatgcaccacaaacatgatagaccccatggcaatattcaatcgcgggagcttacctcaagtccgcgacggaatgaccttcacgcagtccatcgagaaaaacaccgttcaagcccttacaaccggggaagtcaaagcaagcattcggctaacactcgacgactacgatgtcgtctaccaaaacagccaatccgactgctccgcaacgttcaaaaaccttactggatgctactcctgtgacgaaggctcccgactctgctaccaagtaaaggcagaaggggaaaccatattccactttatcaatgaagaagaatcaataaatgtgatcaacaaagtctccccacgcgtatccgactactgtacagtccttcatttttcacgcccggtcatctcaatcgaagggacctacgactgtggcctcagtaagcgaccgatggtaatcaagggcaccctaatcgccaccgccccacacgacgaccgaaagcacgaaggcggctcatcacttgtagtaaaccccaaaggaggctccgtggatttcttcggatggctatccgggctaacatcatggctaggaggtcctctcaaaacgttcttaaccatactaggcttcctagcagtcggacttctcctagtcgtcatcataatcataatcatacgaacgggcatgcaacaggcactaaagaaaaagataaagtaa

SEQ ID NO: 16365 - RNA, 4020 nt, synthetic construct
  misc_feature 1..4020: note = derived and/or modified CDS sequence (opt11) from TOSV(TOSV_Italy/BB8/2014/human)__KY626661.1__GP
  source 1..4020: mol_type = other RNA
atgttcatcgccaagctgttgctgataagctgtctggtgcagcaggcatacctcaagtacaccatcatatccgagatcggcaacgggacccgcacgtctttctgttactccagccggacctccttgggcagcctgctcgaggcgtgggataatatcaccgagtccatcgggctgaccagcggcacgtgcaaggtcgggtcactggagaaccgcgactgcaagcgggacatcatgagcaactacgtggccgaggtgcactccaacctgcacggcctgggggccatgatgcacaattacggggacgacaagcgcgtggaggtgctgaacgacgtgatccccgacgaactcaacccaggccggcacaactgcagcgacctggaccgcaagcccttctggaccgagttcatcgacgtcgccaagcccaccaacaagatcgcccccatgtccgtgatcccaccgcccatcgtgaagcccatccccgtcgcggagagcaccattaagaagtccatcccctttgacaagctgctcagcgaggctgagaaggagctgaaccaaacgaagatccggctggagaccgagcgccggtccaacgccgaggaggcggcaaaggagcgcgcccggatgagggagatcgaggacaagctccggaaggactgggagttggagcgcgagcggaaagacgccgtggccgacgatctggccaaggagatcgcgaggcgtcgcgagatagagcggaaagcccacgagctcgacaagatgctgaagaagaaagagcgagaggacctggtggcccgggagcgcgtctccgaagacatgcgcaaccacgtgtgcaagcccaacaccaccatcgcccccgccccgacgatcatcaccaccctcctgatggcgtccgccgtaatggccgggcccctggagaaccgtgaaaccaaccacctcctgaaccgtcccggcaacggggcttacacgctgagcgacttcgcggagtcaacgtgcaccctcgcgtacggctccgagtgcaaaagctgggagcaccagctggacgagctgtccttccccttcttccacagcaacctcgacaagtattctatgctggaggccgccactgagacgatccccatcctgaacaagagctccgccgtctgcaccatctccccctccacccacagctccaacgcctgtggccgggaggcaagcctaatcaagaagaaatgcggaagtaacatgagcgcctttttctacgtgaacctggccggccaaataaccgtggtcaagtgcgacacgaaccacgtgcttagtaacgactgcggcaactgcatcagcaaaaccctctccggccagaaaatctacaccccagtgcaggacatgttctgccaaaagggctggaccgagagcatacccaacacgcgctactccaaggacttgtgcagcatcgggctgcacagcgtcaaggaatgcaaaaccggaactaccaacttcgagcgggtgggctttatcgtggtcaagggccgcaagatgtatatcgagcagatgaagatgcggtcgcgccaggagttcagcgaggaccagttcctctgctataagtccgagagctccagcgggtccagcgtgaagctgaagaaggtcaaggtcgaatcctgcaaaggcgtgactacctcctcagccagcaagtgctccggcgatgagtacttctgcagccggtacccgtgcgagaccgcgaacgtcgaggcccactgcattctgcgccggcacagtgccgtgatcgaggtgaacgtcaacggggtgtggatcgtgccgcgctgcatcggctacgaggaggtcctcgtgcggcgcaccagtctgaaggtggaggacacgtcctctcgggagtgcgacacgtgcctgtgggagtgcgggaaggacaagctcatagtcaagacccacggccccaagatcgtctacgccactgcctgtagccacggctcctgcaagagcgtgatgcagaagcccgcgactttcgtctacctgccttaccccggcaattcagagatcgtgggcggggacatcggcgtgcacatgaccgaggaatcatcccccagcaacatccatatggtcgcccactgccccgcgaaggactcctgcgaggtgagctcctgcctgttctgcgttcacgggctgctcaactatcagtgccacaccctgttcagcgcccttctcatctccaccaccgtcatgagcatcctgacgctgctccttctactcatgaaaggcgccaaggatctggtgaaacgcctgttctactggctcataaccccgctgtgctggctgtccgtgttctgcgggtgggtcatcaagagctggaagaagcgggtgggatccgcaatcagccgcaccaacgacaccatcggatggagggataaccgccgctaccggcaggacgtggaaagagcccagtacaccggcggggcccccggggccaaatacagtttctacggggtcatggtgctcggtctgctggggaacgttcacagctgcagcgagagcgtcatcgctgacagcaagatcatgcagtgcacgacctccggctcgtccaccctctgcaaggcgagcgggaccgtgataatgaaactgggccccataggatccgagtcttgcctgatcctaaagggcctgaaggactccgaaaagcagttcatcagcatcaaaaccatctccagcgagctgacctgccgggaaggcgagtccttctggaccacgctctacacccccgtctgcctgagctcccgcagatgccacctgatgggggagtgcgtcagcgaccgctgcctcaagtggaagaccaacgaaacgtccgccgagttcacaggcaaggcgcacggagaggtgatgcacgagaaccggtgcttcgagcagagcggcgggatcggctacggctgcttcaacgtgaacccgtcatgcctgtatgtccacagctacctgaagtccgtgtacaaaaacgggttcaagacctttcgctgtgtcgcctggaaccaccggatccgcctcgaggttaccacccatagccggaaattccccatggttctgatggcgatgagcacgcaacccacggactggggctccataggcctgatcctcgacagcgaggggatcaccggcaccaacgcctacagcttcatgcgccacggtagcggctccttcgccatcatcgacgacccgtacagccccgagccccggaaggggttcctgggcgaggtgcgctgccccacggaggagaccgccatccgggcctcgccgagctgcaaaatggcgcccaacttgatcgagtaccagcccgagatggacaccgccgagtgcactacgaacatgatcgatcccatggccatcttcaaccgcggctccctcccgcaggtcagagacggcatgactttcacccagagcatcgagaagaacaccgtgcaagccctgacgaccggcgaggttcgcgccagcatccggctaactctcgacgactacgacgtggtataccagaacagccagtctgactgttcggcgaccttcaagaacctgacaggctgctactcctgcgacgagggcagccgcatgtgttaccaggtgaaagctgaaggggagactatattccacttcataaacgaggacgagtccatcaacgtcatcagcaaggtgaaccccgacgtgtccgactactgcaccgtcttgcacttttctcggccggtgatcagcatcgagggccggtacgactgtgggttgtccaagcgccccatggtcatcaagggcaccctgattgccacggccccgcacgacgaccggaagcacgagggcggaagctccctgattgtgaaccccaagggcgggacggtggacttctttggctgggtgagcgggttgacctcatggctcggcggccctcttaagaccttcttaaccatactgggattcctggccctcggcctgctgctcgtggtgataatcatcataatcgcgcggactggggtgcagcaggccctgaagaaaaagaacaagtag

SEQ ID NO: 16366 - RNA, 4020 nt, synthetic construct
  misc_feature 1..4020: note = derived and/or modified CDS sequence (opt11) from TOSV(TOSV-54441132704)__KX010933.1__GP
  source 1..4020: mol_type = other RNA
atgtttatcgccaagctgctactcatcagctgcctggtccagcaggcctatctcaagtacaccatcatctcggagatcggcaacggcacccgcacgagcttctgctattccagccggacgtccctgggcagcctgctcgaggcgtgggataacgtcaccgagtccatcgggctgacgagcggcacttgcaaggtggggtctctggagaaccgcgactgcagaaaggacattatgagcaactacgtggccgaggtccattccaacctccacggcctgggggccatgatgcacaactacggggatgataagcgcgtggaaatcttgaacgacgtgatccccgacgagctcaatccgggccaccataactgctcagacctggaccgcaagcccttctggactgagttcataaacgtcgcaaaacccctgtccgaaatcgtgcccatgagcgtgatcccgccgccggtagtcaagttacagccgcccgcagagccctcctctaagaagcacgtgcctttcgacgtcctgctgtccgaggcggagaaagagctaaaccagaccaaaatccgcttagaagacgaacgcaagagcaacgctgaggagaccgccaaggagagagcccggatgaaagaaatcgaggacgagctgcggcgggaatgggagctcgagcgcaagagaaaggacgcgatggccgacgatctcgcaaaggagacggcccgccggcgggagatcgagcggaaggctcatgagctggacaaaatgctgaagaaaaaggaacgcaaatcccttatagcaaaggagaaggcagacgttgacatgcggagccacgtgcacaagcccaacaccaccagggcacccgcaccaacaatcattacgaccctgctcatggcctccgccgccttagccgggcctctggagaaccgggagaccaatcacctcctgaatcgccccggcaacggggcctacacactgtccgactttgccgagagcacgtgcaccctcgcgtacggctccgagtgcaagagctgggagcacctccttaacgaggagctgttcccgttcttccactccaacctggacaagtacagcatgctggaggccgccaccgagaccgtccccattctcaacaagtcctcagcagtttgcacaatctccccaagcacacactccagcaacgcctgcggccgcgaggcgtccgtgatacggaagaagtgctacagcaacatgagtgccttcttctacatcaacctggccggccaaatcaccgttatcaagtgcgagaccaaccacgttctgagctccgattgcggcaactgcatcagcaagtccctcagcggccagaaggtgtacacgcctgtccaggacgtgttttgccagaagggctggacccagagcatcccgtccacccgctacagcaaagacatctgttccataggcctgcacaccgtgaaggaatgtaagatcgggacgacctccttcgaacgggtcggcttcatcgtcgtcaaggggcgcaaaatgtacatagagcagatgaagatgagatcccgccaagagtatagtgaggaccagttcctgtgctacaagtccgagagcggctccgggtcctccgtgaagctcaagaaattcaaagtggaatcgtgcaagggcgtcacaacatccagcgcttccaaatgcagcggcgacgaatacttctgcagccggtacccctgcgagacggcaaacgtcgaggcccactgcatcctgcgccgccacagcgccatcgtggaggtcaacgtgaacggggtatgggtggtaccccgctgcatcggctacgaagaggtcctggtcaaaaggacctccctcaaggtggaggacaccaccgggcgcgagtgcgacagttgcctatgggagtgcggcaagaacaaactgatcgtgaagacgcatgggcccaaggtcgtgtacgcgaccgcctgcagccacggctcctgcaagagcgtgatgcagaagccagcgacgttcgtctacctgccctaccccggcaactccgagattgtcgggggcgatatcgggatccacatgacggaggagagctcccccagcaacatccatctagtggctcactgcccagccagggactcctgcgacgtgagcgactgcctgttctgcgtgcacggcctcctcaattaccagtgccacaccctgttctccgccctgctgatcagcacgaccgtgatgagcatccttaccctgctcctgctgcttgtcaagggggcaaaggatctggtgaagaagctgttctactggctcataacgcctctgtgttggttgagcgtgttctgctgctgggtggtgaaatcctggaagcgccgggtgggcagcgcgatctcgcgcacgaacgacacgattggatggcgcgaaaatcgccggcatgctcaggacatcgagcgcgcccagtacaccgggggtgcccccggggcgaagtatagcttctacggcgtaatgatcctcggcctgctgtcctcggctcagagctgctccgagagcgtgatcgccgactccaagatcatgcagtgtaccacgagcgggtccagcaccttatgcaaggcctccggcacggtgataatgcgcctaggcccgatcggctccgagtcctgcctgattctcaaggggctgaaggacagcgagaagcagttcatctccatcaagaccatcagctccgagctgacgtgccgagagggcgagagcttctggaccacactctacacccccatctgcctatccagccgacggtgtcacctgatgggcgaatgtgtatccgaccgctgcttaaagtggaagaccaaccagaccagcgccgagttcacggggaaagcacacggcgacgtgatgcacgaaaaccgatgcttcgagcagtccggcggcatcgggtacggctgcttcaacgtgaaccccagctgcctgtacgtccacagctacctgaagtccgtgtacagaaacggcttcaaggtgttcagatgcgtcgcctggaaccaccgcattcggctcgaggtgaccactcacagccgcaagtttcccatggtgctgatggccatgagcacacagcctaccgactgggggagcattggacttatcctcgactccgaggggatcaccggcaccaattcgtattcgttcatgaagcacggtagcggctccttcgccatcattgatgatccctacagccctgagccccggaagggtttcttaggagaagtccgctgcccgacggaggagaccgccatgagagcatcccccagctgcaagatggcccccaatctcatagagtaccagcccgagatggatacagccgaatgcaccaccaacatgattgacccgatggccatcttcaaccgcggctccctcccccaggtgcgggacgggatgaccttcacccagagcatcgagaagaacacggtgcaggccctgacgactggcgaggtaaaggcttcgattcgcttaatcctcgacgactacgatgtggtttaccagaacagccagtccgactgctcggcgaccttcaagaatctgacgggttgttactcgtgcgatgagggcagccggctgtgctaccaggtcaaggccgagggcgaaaccatattccacttcatcaacgaggaggagtcgatcaacgtcatcaacaaggtgtcccccggggtcagcgactactgcaccgtgctccatttctcccgccctgtcatctcaatcgaaggcacctacgactgcggactgtccaagcggccgatggtaatcaagggcacgttaatcgccacagcgccccacgacgaccgaaaacacgagggagggagttccctcgtggtgaaccccaagggcgggtccgtcgacttctttggctggctctcagggctcaccagctggctcggcggccctctgaagaccttcctgaccatcctggggttcctggccgtaggcctgctcctggtcgtgatcatcatcatcatcatcaggacggggatgcagcaagctctgaagaaaaagatcaaataa

SEQ ID NO: 16367 - RNA, 3222 nt, synthetic construct
  misc_feature 1..3222: note = derived and/or modified CDS sequence (opt11) from SFTSV(HB29)__NC_018138.1__GP
  source 1..3222: mol_type = other RNA
atgatgaaagtaatatggttctcttccctcatatgcctagtcatccagtgcagcggcgactccgggcccatcatatgcgcaggccccatccacagcaacaaatcagcagggataccccacctcctcggatactcagagaaaatatgccaaatagacagattaatccacgtgagctcctggctgcggaaccactctcaattccaagggtacgtcggtcaacgagggggaagaagccaagtctcatactacccagcagaaaacagctactccagatggagcggattactatcgccttgcgacgcagactggctaggcatgctagtagtaaagaaagccaaagaatccgacatgatcgtgccaggcccctcttacaaaggaaaagtatttttcgaaaggccaacattcgacggatacgtcggctggggctgcggctccggaaaaagcaggactgagagcggggagctatgttcatcagacagcggcacgtcgagcggcctcctcccatcagaccgggtcctgtggatcggagacgtcgcctgccaacccatgaccccgataccagaagagacattcctagagctaaagagcttctcccaaagcgagttccccgacatatgcaaaatagacggcatagtcttcaatcaatgcgagggagaatccctccctcagcctttcgatgtcgcatggatggacgtggggcactcacataaaattatcatgcgagaacacaaaacgaaatgggtccaggaatccagcagcaaagatttcgtatgctataaagaaggaacaggaccctgctcagaatcagaggaaaaagcctgcaaaacctcaggctcgtgcagaggtgacatgcagttctgtaaagtcgccggatgcgaacacggggaagaagcaagcgaggccaaatgccgctgcagccttgtccacaagccaggagaagtagtcgtctcctacggcggcaccagggtccgccccaaatgctacggcttctccagaatgatggccaccctcgaagtcaacccgcccgaacaacgcatcggacaatgcacaggctgccacctcgaatgcataaacggcggagtgagactgatcaccctaacctccgagctccggagcgccaccgtgtgtgcatcccacttctgcagctccgcctcaagcggcaaaaagagtaccgaaatccacttccactcgggaagcctggtaggaaaaacagccatccatgtgaaaggagccctcgtagacggaacagagttcacattcgaaggaagctgcatgttccctgacggctgcgacgccgtagactgcaccttttgccgagagttcctcaaaaacccccaatgctatcccgccaagaaatggctttttatcataattgtaatcttgctcggctacgccggcctaatgctactcaccaacgtgctcaaagccataggagtatgggggtcatgggtcatcgccccagtgaaactaatgttcgcaataatcaaaaagctaatgcgaacggtatcatgcctagtcggaaaactaatggacagaggacgccaagtaatacacgaagaaatcggggagaacggggagggtaaccaggacgacgtccgaatagagatggcgaggccccggagagtgcgccactggatgtacagcccagtaatactaaccattctagccataggactggctgaaggatgtgatgaaatggtacatgccgatagcaaactggtatcctgccggcaaggatccggaaacatgaaggaatgcatcacaacagggagagccctgctaccggcagtaaaccctggacaagaagcatgcctgcactttaccgcgccggggagccccgacagcaaatgcctcaagataaaggtcaagcgaataaacctaaaatgcaagaaatctagcagttacttcgtaccagacgcaagaagcagatgcacctcagttcgacggtgccgctgggccggtgactgccagtccggctgtccgccccatttcacgagcaacagcttcagtgacgactgggcaggcaaaatggacagagctggactcggcttcagcggctgcagcgacggctgtgggggagcggcctgcgggtgctttaacgcagcacctagctgcatcttctggcgaaagtgggtcgaaaacccacacgggataatatggaaggtcagcccctgcgcagcatgggtaccatccgccgtcatagaattaacaatgccgtccggcgaagttcgcacattccatcccatgtcaggcataccaacccaggtctttaaaggcgtctcagtaacctacctaggatcagacatggaggtaagcggacttacagacctctgtgaaatagaggaactcaagagcaagaaactcgcactcgcgccttgcaaccaggcaggcatgggcgtagtcggcaaagttggggaaatccagtgctcaagcgaagaaagcgcccgcaccatcaagaaagacggatgcatctggaacgcggatctagtcggaatcgagctacgcgttgatgacgccgtatgctacagcaaaatcacctcagtagaggccgtcgcaaactactccgccatacccacaactataggcggtctcaggttcgagcgctcccacgactcccagggaaaaatatcaggctcgcccctagacataaccgccatccgaggctcattctcagtcaactaccgcggccttcgcctcagcctctccgaaattacggcaacctgcaccggagaagtaacgaacgtctcaggttgctattcgtgcatgaccggagccaaagtcagcataaaactgcactccagcaaaaactcaacagcgcacgtacgatgcaaaggcgacgaaacagcattctcagtacttgaaggagtccactcctacatcgttaggctatcctttgaccatgccgtcgtcgacgaacaatgtcaactaaactgcgggggacacgaatcgcaagtgactctaaaaggaaacctgatatttctcgacgtcccgaaattcgtagacgggtcttatatgcagacataccacagcacggtaccaactggagccaacataccatcacccacagactggctgaacgctctattcggaaacggcctctcaaggtggatactaggggtcataggcgttctcctaggaggcctcgcactattcttcctaatcatgtttctgctcaaactcggcacaaagcaagtattcagaagccgaactaaactagcgtga

SEQ ID NO: 16368 - RNA, 3222 nt, synthetic construct
  misc_feature 1..3222: note = derived and/or modified CDS sequence (opt11) from SFTSV(Jilin)__KT890281.1__GP
  source 1..3222: mol_type = other RNA
atgatgaaggttatatggttcagttcgctaatttgcctagtcatccaatgcggaggggacacagggccgatcatctgtgccggccccatacacagcaataaatccgccaacatcccgcacctactaggctactccgagaaaatatgccaaatcgaccggctcatacacgtgagctcgtggctcagaaaccactcccagttccaagggtacgtcggacaacggggcggacggtcccaagtatcgtactacccagcagaaaactcctacagcagatggagcggactactaagcccttgcgacgcggactggctcggcatgctcgtagttaaaaaggcaaagggctctgacatgatcgtacccggcccaagctacaaagggaaggtattcttcgaacgcccgaccttcgacggatacgtaggatggggttgtggatcaggaaagagccgcacggagagcggggaattatgctcatccgacagcggcacatcaagcggccttctgccatcagacagagtattatggatcggagacgtagcatgccaaccaatgaccccaatcccagaggaaaccttcctcgaactaaagagcttcagccagagcgagttcccagacatctgcaaaatcgacgggatagtattcaaccaatgcgaaggagaatcccttcctcagcccttcgacgtagcatggatggatgtagggcactcccacaaaataataatgagggaacacaaaacgaagtgggtacaggaatcaagctcaaaagacttcgtctgttacaaagaaggcacaggaccctgttccgaaagtgaagagaaaacctgcaagacctcggggtcctgcaggggagacatgcaattctgcaaggtcgcgggatgcgaacacggagaagaagccagcgaagcaaagtgccgatgcagtctagtgcacaaaccgggcgaagtggtggtcagttacggcggaatgcgcgtaagacctaagtgttacggattctcgagaatgatggcgccactcgaagtaaatccgcccgaacagcggattggacagtgcaccggctgccatcttgagtgcataaacgggggcgtgcgcctcatcacactcacatccgaactaaaaagtgcgaccgtctgcgcctaccatttctgcagctgcgccacaagtggcaaaaagagcaccgagatacaattccacagcggttccctagtgggcaagacagcgatccacgtaaagggcgccctagtagacgggacagagttcacctttgaaggcagatgcatgtttccggacggctgcgacgctgtggactgcactttctgcagagagttcctcaaaaacccacagtgttaccccgcacaaaaatggctattcatcatcatagtcatattactaggctacgctggattaatgctactaaccaacgtcctcaaagctatgggagtgtggggaagctgggtaatagctccggtcaagctagtattcgcaatcatcaaaaagctcatgcgggctgtttcatgcctcatgggaaaattaatggaccgagggcgccaagtcatacacgaagaaataggcgaaaaccgagaaggcaaccaagatgacgtcagaatagagatggcacgaccaaggagggtccgccactggatgtattcaccggtaatacagacaatcgtggctatcggactagcagaaggatgcgacgaaatggtgcacgccgactcaaaactggtgtcatgcaggcaagggtcagggaacatgaaggaatgcgtcacgaccggacgagcactattaccagcagtcaacccaggccaagaagcctgcctgcacttcacagcgccgggcagtcccgacagcaagtgtctaaaaatacgggtgaaacgcataaacttaaaatgcaagaaaagttccagctactttgtccccgatgcacgctcccggtgcacgagcgtaagacgttgccggtgggcaggagactgccaaagcgggtgtcccccacacttcacgagtaactcattcagtgacgactgggcaggcaaaatggatcgcgcggggcttggcttctcaggatgcagcgacggctgcggtggggcggcatgcggatgcttcaacgcggcaccatcatgcatattttggagaaaatgggtcgaaaacccacacggcatcatatggaaagtatccccttgcgccgcctgggtgccctcggcagtaatcgagctgacaatgccgagcggcgaggtacggacattccaccccatgagtggaataccaacccaagtattcaaaggagtaagcgtcacgtacctaggctccgacatggaagtaagtggcctaaccgacctctgcgaaatcgaagaactcaagagcaagaaactagcgctagcaccatgcaaccaagccggcatgggagtcgtaggaaaagtcggcgaaatacaatgctccagcgaagaatcagcgcggacgatcaagaaagacgggtgcatatggaacgcagacctagtcggaatagaactcagagtagacgacgccgtgtgctactccaagataacctccgtcgaagccgtcgccaactactcggccatccccacaaccataggcgggctaagattcgagcgctcccacgattcccaaggcaaaatatcaggaagtcccctagacattactgcaatcaggggctccttctccgtgaactaccgtgggctgcgcctgagtctcagtgagatcaccgctacatgcacgggggaggtaacgaacgtaagcggatgttactcctgcatgactggtgcgaaagtcagtatcaaactgcactccagcaagaacagcaccgcccacgtccgttgcaaaggagacgaaactgccttcagcgtcctagaaggcgtacacagctacagcgtaagcctgagcttcgaccacgcagtagtagatgaacaatgccagttaaactgcgggggccacgagagccaagtgacccttcgcggaaatctcatattcctagacgtaccaaaattcgtcgacggatcatacatgcaaacataccactccacagtgccaaccggcgccaacataccgtccccgaccgattggctaaacgcactcttcggcaacggcctaagtagatggatactaggagtaataggagtgctcctaggcggactcgcactcttcttcctaataatgagcctgttcaaactaggcacgaagcaaatattccgcagccggaccaagctggcgtag

SEQ ID NO: 16369 - RNA, 3222 nt, synthetic construct
  misc_feature 1..3222: note = derived and/or modified CDS sequence (opt11) from SFTSV(05-Lu'an(CHN)-2015)__KX302597.1__GP
  source 1..3222: mol_type = other RNA
atgatgaaggtgatctggttctccagcctcatatgctttgtgatacaatgctcaggcgactcagggcccatcatctgcgcaggaccgatccacagcaacaaaagcgctgacataccacatctgctaggatacagcgagaaaatctgccaaatagacaggctaatccacgtctcctcatggctgcgcaatcacagccaattccaaggctacgtaggccaaaggggcggaagaagccaagtcagttactatccggccgaaaattcatacagccgttggtccggactgctcagcccgtgcgacgcagactggctcgggatgctagtagtgaaaaaggcaaaaggctcagacatgatagtcccaggaccaagctacaaagggaaagtcttcttcgaacgccctacctttgacggatacgtgggatgggggtgcgggtcaggaaagtcacgcacagaatcaggagaattatgcagttccgacagcgggacctccagtggactacttccatcagatcgggtactatggatcggagacgtcgcctgccaaccaatgacccccataccggaagaaacgttccttgaactcaagagcttctcacaaagcgagttcccggacatatgtaaaatcgacggtatagtattcaaccaatgcgaaggagaaagtctcccacaacccttcgacgtcgcgtggatggacgtggggcactcgcacaaaatcataatgagagaacacaaaaccaaatgggtccaggaatccagctcaaaagacttcgtatgctacaaagaagggaccggcccctgctcggaatcagaagagaaaacatgcaaaacctccggatcatgcagaggagacatgcaattctgcaaagtagcaggctgcgaacacggcgaagaagccagcggagccaaatgtaggtgcagcctcgtccacaagccgggggaagtcgtcgtcagctacggcggcatgagagtccgccccaaatgctacggctttagccgaatgatggcaactctcgaggtcaaccagccagaacagagaatcggccaatgcacaggatgccacctggaatgcatcaacggcggcgtaagactcataacactgacgtccgaactcaaatcagccaccgtatgcgcatcacatttctgctcctcggcaacatctgggaaaaagtccaccgaaatccaattccactcaggatccctcgtaggcaaaacagcgatccacgttaaaggggcattagtcgacggcacggagttcaccttcgaaggcagctgcatgttccccgacgggtgcgacgcagtagactgcacgttctgcagagagttcctgaaaaacccccaatgctacccagccaaaaagtggctattcataataatcgtgatactactaggatacgcagggctaatgctactcacgaatgtcctcaaagccattggcatatggggttcatgggtcatagccccagtcaagctcatgttcgcaatcataaagaaactgatgagaacagtgagctatctaatgggcaaactcatggaccgtggcaggcaagtcatccacgaagaaataggcgaaaaccgcgaaggcaatcaggatgacgtccgcatagaaatggccagaccccgccgagtccgccactggatgtacagccctgtaatcctaacaatcctcgccataggactcgccgaatcatgcgacgaaatggtacacgcagactccaagctagtttcctgccgacaaggctcaggcaacatgaaagaatgcgtaacgaccggaagggccctactacctgcggtcaaccccggacaagaagcctgcctacacttcaccgcacccggaagccccgacagtaaatgcctcaaaataaaagtaaaacggataaatttaaaatgcaagaaaagttcctcatatttcgtacccgacgcacgttcgcgatgcacaagcgtccgacgatgccggtgggccggcgactgccaatcaggatgtcccccacacttcaccagtaatagcttcagcgacgactgggccggaaaaatggaccgagccgggctcggattcagcggctgcagtgacggatgcggaggcgcagcgtgcggatgcttcaacgccgccccctcctgcatattctggaggaaatgggtcgaaaacccacacggaataatctggaaagtctccccatgcgccgcatgggtcccaagcgccgtaatcgaactaacaatgccctccggcgaagtacgaacattccacccgatgtccggaatcccaactcaagtcttcaaaggagtatccgtcacttatctgggctccgatatggaggtaagcgggttaaccgacctctgcgaaatagaggaactaaaatcaaagaaactagcactagcaccctgcaaccaagcggggatgggagtcgtcggcaaagtaggagaaatacagtgcagcagcgaagagtcagcacgcacgataaagaaagacggatgcatatggaacgctgacctagtaggcattgaactacgagttgacgacgccgtctgctacagcaaaatcacctcagtggaggctgttgccaactacagcgccatacccacgaccatcggcggtctgagattcgagcgcagtcacgactcacaaggcaaaatcagtgggtcgccactagatatcacagccataagaggatcattctccgtcaactataggggcctccgcctctcactatccgagatcacggcaacctgcacaggcgaggtcaccaacgtatccggatgctacagctgcatgaccggcgcaaaagtatccataaaactccatagcagcaaaaactcaacagcccacgtacgatgcaaaggagacgaaacagcgttctccgtactagaaggtgttcacagctacacggtcagcctctccttcgatcacgccgtcgtagacgagcaatgccaactaaactgcgggggccacgaaagccaagtaaccctcaaagggaacctaatcttcctagacgtaccgaagttcgtcgatggaagctacatgcaaacatatcatagcacagtccccaccggcgctaacataccttccccaactgactggctcaacgcattgttcggaaacggtctaagccgttggatactaggagttatcggcgtccttctgggaggactcgcactattcttcatgatcatgagcctattcaagctaggcacaaaacaggtgttccgatcgagaaccaagttggcgtaa

SEQ ID NO: 16370 - RNA, 3222 nt, synthetic construct
  misc_feature 1..3222: note = derived and/or modified CDS sequence (opt11) from SFTSV(07-Lu'an(CHN)-2015)__KX302598.1__GP
  source 1..3222: mol_type = other RNA
atgatgaaagttatatggttctcatccctaatatgcctcgtaatacaatgcagcggcgacagcggcccaataatatgtgccggaccgatacacagcaacaaatcagcagggataccccacctactcgggtactcagagaaaatatgccaaatagacagactgatacatgttagcagctggcttcgtaaccactcacaattccaagggtacgtgggacaacgcggtgggaggtcccaagtctcgtattaccccgcagaaaactcatacagcagatggagcggcttactgtcaccctgcgacgccgactggctaggaatgctagtcgtaaagaaagctaaagaatcagacatgatagtaccagggccctcctacaaaggaaaagtattcttcgaaaggcccacattcgatggatatgtcggctggggctgcggcagcggaaagagccgcaccgaaagtggcgaactctgctcaagcgacagcggcacaagcagcgggctactaccttcggacagagtgctatggatcggcgacgtcgcctgccagccaatgacacccatccccgaagaaacattcctcgagcttaagtcgttcagccaaagcgagttccctgacatatgcaagatagacggcatcgtgttcaaccaatgcgaaggcgaatcattgccacagcccttcgacgtggcctggatggacgtaggacacagccacaaaataatcatgagggaacacaagaccaaatgggtacaggagtcgagctccaaagactttgtctgctacaaagaaggaacaggcccatgctcggagtcagaagaaaaagcatgcaagacaagcggcagctgcagaggcgacatgcaattttgtaaagtcgccggatgcgaacacggcgaagaagcctcagaggccaaatgccgctgtagcctcgtacacaagcccggagaggtggtggtcagttacggcggcatgcgcgtgagacccaaatgctacgggttcagccgtatgatggccacattagaagtcaatcccccggagcaaaggattggtcaatgcacaggatgccacctcgagtgtatcaacggcggcgtgcgattaataacactcaccagtgaactacggtccgcaactgtctgcgccagccacttctgttcaagcgcaacctcaggcaagaaatcaacagaaatacacttccattcaggtagcctagttggcaaaactgctatccacgtcaaaggtgcacttgttgacggtacagagttcaccttcgaaggaagctgcatgttcccggacggctgcgatgcagtggactgcacattctgcagagagttccttaaaaacccccaatgctaccccgcgaagaaatggctgttcatcatcatcgtaatccttctcggatacgcgggtctaatgcttctcacaaacgtcctgaaagcaatcggagtctggggatcctgggtcatcgccccagtcaagctcatgttcgcgataatcaaaaagctcatgcgcacagtaagctgcctggtaggaaaactaatggacagaggcagacaagtaatccatgaagaaatcggcgaaaacggggaaggaaaccaggacgacgtccgcatagaaatggcacgaccgcgacgcgttagacactggatgtactcgccagtaatcctcacaatcctagcaataggtctcgccgaaggatgtgacgaaatggtccatgccgactcgaaactggtgagttgccgacagggaagtggcaacatgaaagagtgcataacaacaggccgcgcactattgccagcagtgaacccaggccaagaggcctgcctacacttcactgcacctggaagcccagactcaaaatgcctcaagatcaaagtaaaacgcattaacctgaagtgcaagaaaagtagcagctatttcgtacctgacgcaagaagtcggtgcacaagcgtacgccggtgccggtgggcaggagactgccaaagcggctgcccaccccacttcactagcaatagcttctccgacgactgggcaggaaaaatggaccgggccggactcggcttttcgggttgcagtgacggctgcggaggagcagcatgcggttgcttcaacgcggccccgagctgcatattctggagaaaatgggtcgaaaacccccacggaataatatggaaagtctcgccctgcgcggcgtgggtcccatcggccgtgatagagctcacaatgccaagcggagaagtaagaacattccatccgatgtcagggataccaacacaagtcttcaaaggagtctcagtgacctacctaggcagcgacatggaagtcagcggactcaccgacctatgcgaaatagaagaactcaaaagcaagaaactggcactcgcgccctgcaaccaagccggcatgggcgtcgttggcaaagtcggggaaatccaatgctcctccgaggaaagcgcccgcaccatcaagaaagacggctgcatctggaacgcagacctggtcggaatcgaactcagagtcgacgacgccgtgtgctacagcaaaatcacctcagtagaggccgtagccaactatagcgcaatacctacaacgatcggcgggctccgcttcgagcgctcccacgatagccaaggaaaaataagcggatcaccgttagacataaccgcaatacgagggagcttctccgtaaactacagggggctccggctatcgctatccgaaatcaccgcaacctgcacaggagaggtcacgaacgtatccggctgctacagctgcatgacaggagccaaagtaagcataaaattacactccagcaaaaactccacggcccacgtacggtgcaaaggcgacgaaacagccttctcagtcctagaaggtgtgcacagctacatcgtctcgctgagcttcgaccacgcagtagtcgacgaacaatgccagctgaactgcggaggacacgagtcgcaagtaaccctcaaaggaaacctcatcttccttgacgtccccaaatttgttgacgggtcctacatgcaaacataccacagcacagtacccaccggcgctaacatcccaagccccactgactggctgaatgcccttttcggcaacggcttatcacgttggatactaggcgtaatcggagtactcctaggagggctagccctattcttcctcatcatgttcctccttaaactgggcaccaaacaagtgttccggagcagaacaaaactcgcctaa

SEQ ID NO: 16371 - RNA, 3222 nt, synthetic construct
  misc_feature 1..3222: note = derived and/or modified CDS sequence (opt11) from SFTSV(12-Lu'an(CHN)-2014)__KX302595.1__GP
  source 1..3222: mol_type = other RNA
atgatgaaagttatctggttcagtagcttaatctgcctcgtcattcaatgctccggcgacactggcccgattatctgcgccggcccaatccacagcaataaatccgccaatataccgcacttactggggtacagcgaaaagatatgccaaatcgacaggttaatccacgtctcatcatggctaagaaaccactcccaattccaggggtacgtcggacaaagaggaggacgctcccaagtctcatattatccggcagaaaactcctactcaaggtggagcggcctactctcaccttgcgacgcagactggctaggaatgctagtcgtcaaaaaggccaagggatcggacatgatcgtacccgggccctcgtacaaaggcaaagtattcttcgaaagaccgacctttgacggatacgtaggatggggctgcggctcaggcaagtcacgaaccgaaagcggcgaactatgcagcagcgactccggaactagctccgggctccttccctcagaccgagtcctatggatcggcgacgtcgcctgccaaccaatgacccctatccccgaagagacattcctagaactgaaaagtttcagccagagcgagttccccgacatatgcaaagtggacgggatcgtcttcaaccagtgcgattccgaatcgctaccgcagcccatagatgtcgcctggatggacgtagggcacagccacaaaataataatgcgggaacataaaacgaaatgggtccaggaaagcagctccaaagacttcgtctgttacaaggaaggaacaggcccctgcagcgagagtgaagagaaaacctgcaaaacctcagggtcctgcagaggtgacatgcaattctgcaaagtggcaggctgcgaacacggggaggaagccagtgaagcaaagtgccgctgctccctcgtccacaaaccaggcgaagtagtcgtctcatacggcggcatgcgcgtacgcccaaaatgctatggcttcagccgcatgatggcgacccttgaagtaaatccacccgaacaaagaatcgggcaatgcacaggctgccacctcgaatgcatcaacggaggcgttagactcataaccctcacatccgagttgaaaagcgccaccgtctgcgcgtcccacttctgcagctcagccacaagcggcaagaaaagcaccgaaatccaattccactccggctccctagtgggcaaggccgcaatacacgtaaaaggcgccctcgtggacggaactgagttcacattcgaaggctcctgcatgttccccgacggatgcgacgccgtagactgcacattctgtagggagttcctaaagaacccacagtgttacccagctaagaaatggctctttataatcatagtaatcctccttgggtacgccggcctcatgctactcacgaacgtcctcaaggccataggagtatgggggtcttgggtaatggcacctgtcaagctcatgttcgcaatcatgaagaaactgatgcgatccgtctcgtgcctgatgggaaaactaatggaccgcggacgccaagtcatccacgaagaaatcggagaaaaccgagaaggtaaccaagacgacgtcagaatcgaaatggcccgcccgcgacgagtccgacactggatgtacagcccggtcatactaaccatcctagcaataggcctggccgaaggctgcgacgaaatggtacacgcagattcaaagctagtctcatgccgccaaggatcgggaaacatgaaagaatgcgtaactacaggacgcgccctactccccgcggtcaacccaggccaggaagcctgcctccacttcacagcccccggctcccccgactcaaaatgcctaaaaataaaagtcaagcgaatcaacctgaaatgtaagaaaagcagctcctacttcgtacccgacgcaagatcacgatgcaccagcgtcaggcgctgccgatgggcgggggactgccaaagcgggtgcccaagttacttcacgtcaaacagcttcagcgacgactgggcagggaaaatggatcgagccggcctcggcttctctggatgctccgatggctgcggaggggccgcatgcgggtgcttcaatgcggcccccagttgcatattctggcgaaaatgggtcgaaaacccacacggcataatatggaaagtgtcaccttgcgccgcatgggtccccagcgcggtcatcgaactaacaatgccttcaggggaagtacgaaccttccaccccatgagcggcatcccaactcaggtctttaaaggtgtatcagtaacataccttggctccgacatggaagtatccggactaacagatctctgcgaaatagaggaactaaaaagcaagaaactcgccctcgcaccctgcaaccaagcgggaatgggcgtcgtaggcaaagtcggagaaatacaatgcagctcggaggaatcagctcgcacaatcaagaaagacggctgcatatggaacgcagaccttgtcggaatagaactgagagtggacgatgcggtctgctactccaaaataacatccgtcgaggcagtcgccaactactcagccatccccactacaataggcggactacgattcgaacgatcacacgactcccaaggcaaaatatccggttcaccattggacatcacagcaattcgaggctctttcagcgtcaattacagaggcctacgccttagcctctccgaaataacagcgacatgcacgggcgaagtcacgaacgtctcagggtgctactcatgcatgaccggagcgaaagtatctataaaattgcactcaagcaaaaattcaaccgcacatgtacgttgccgaggcgacgaaaccgcattctcggtcctagagggagtacacagctacacagtgtccctatcatttgaccatgcagtggtagatgagcaatgccaactcaactgcggcggccacgagtctcaagtcacactcaaagggaacctcatcttcctcgacgtcccaaaatttgtcgacgggtcgtacatgcaaacctaccatagcagcgtaccaaccggagcaaacatacctagtccaacggactggctcaacgccctgttcggcaatggcctgagcagatggatcctaggggtaatcggagtgctactgggagtcctcgcccttttcttcctgataatgagcctcttcaaactcgggaccaaacaagtcataagatcaaggaccaaactcgcataa

SEQ ID NO: 16372 - RNA, 3222 nt, synthetic construct
  misc_feature 1..3222: note = derived and/or modified CDS sequence (opt11) from SFTSV(14-Lu'an(CHN)-2014)__KX302596.1__GP
  source 1..3222: mol_type = other RNA
atgatgaaggttatctggttctcctcgctaatctgcctcgtaatccaatgcagcggcgacacaggaccgatcatatgcgccggacccatccactcaaataaatcagccaacataccacacctactcggctacagcgaaaagatctgccagatcgataggctaatacatgttagttcgtggttacgcaaccactcccaattccaaggttacgtaggccaacgcgggggacggtcacaggtctcatactatccagcggagaactcctacagtaggtggtccggcttactgtccccctgcgacgcagactggctagggatgctcgtagtgaaaaaggccaaaggctccgacatgatcgtaccaggccccagctacaaaggaaaggtattcttcgagcgaccaaccttcgacggctacgtgggatggggctgtggcagcggcaaaagtcgcacggagagcggcgaactatgcagcagcgacagcgggaccagctctggactactaccatcggacagggtattatggataggagacgtcgcgtgccaacccatgacaccaatcccagaagaaacattcctagaactcaagagcttctcacaaagcgagttcccagacatctgcaaagttgacggcatagtcttcaaccagtgcgacagcgaaagcctcccgcagccgatagacgtggcatggatggacgtcgggcatagccacaaaataataatgagagaacacaaaaccaaatgggtccaggaatccagttcaaaagacttcgtatgctacaaagagggcaccggaccgtgctcggaatcggaggagaaaacatgcaaaacatccggaagctgccgaggggacatgcaattctgcaaagtggccggctgcgaacacggggaagaagccagcgaagccaagtgtcgctgctccctcgtacacaaaccaggcgaggtcgttgtaagctacggtggcatgcgtgtacgcccgaaatgctatggattcagccggatgatggcaaccttagaagtgaatccaccggagcagaggatcggacaatgcaccggttgccacctcgagtgcatcaacggaggcgtcagactaatcacactcacctcagagctgaaatccgcgacagtctgcgccagccacttctgcagctccgccacaagcggaaagaaatccacagagatacaattccacagcggcagcctagtgggaaaagcagcaatacacgtaaaaggggcgctagtagacggaaccgagttcacgttcgaaggaagctgcatgtttccagacgggtgcgatgccgtcgactgcaccttctgccgcgagttcctcaaaaacccccaatgctacccagcgaaaaagtggctatttatcataatcgtcatcctcctcggctacgcagggctcatgttactaacgaacgtactcaaagctataggcgtgtggggaagctgggtcatggcgccagtaaaactcatgttcgcaatcatgaaaaagctaatgcgatcagttagttgcctaatgggaaaactgatggaccgcggccgacaggtgatccacgaagaaattggcgaaaatagagaaggaaaccaagacgatgtcaggatagaaatggcccgcccacgccgcgtacgccactggatgtacagcccggtaattctaacaatcttagcaatcggccttgccgaaggctgcgatgaaatggtgcacgctgacagtaagctagtatcatgcagacagggaagtggtaacatgaaagaatgcgtcacaacagggcgcgccttgctcccagctgtaaacccaggccaagaggcatgcctccacttcacagcacctgggtccccggactccaaatgccttaagatcaaggtgaaacggatcaacctaaaatgcaaaaagagcagctcatacttcgtcccagacgcccgctcccgctgcacaagcgtccgccgatgcagatgggccggtgactgccagtctggctgtccgtctcatttcacaagcaattccttcagcgatgattgggccggcaaaatggacagagccgggctcgggttttcaggctgcagcgacggctgcgggggtgcagcgtgcggctgcttcaacgcggcaccaagctgcatcttttggcgcaaatgggtcgaaaacccacacggaataatctggaaggtcagcccttgcgccgcatgggtaccaagcgcagtgatagaactaactatgccgagcggggaagtacgcacattccacccaatgtcaggcattccgacccaagtattcaagggagtgagcgtaacgtacctgggatccgacatggaagtaagcgggctcaccgacctatgcgaaatcgaggaactaaagtcaaagaaacttgccctcgcaccgtgcaatcaagctggcatgggcgtggtgggcaaagtcggtgagatccaatgcagctcagaggaatccgcgagaacgataaagaaagacggatgcatctggaacgctgacctcgtgggcatcgaactccgcgtagacgacgcggtctgctactcaaaaatcacatcagtagaagccgtggcgaactacagcgcaatacctacaacaataggtggtctcagattcgaaagatcacacgactctcagggaaaaatttcgggctcgcccctagacatcaccgcaatcagaggctcattctcggtcaactaccggggcctaagactatcactgagcgaaataacggccacatgcactggagaagtaacaaatgtaagcggttgctacagctgcatgacgggcgcgaaggtcagtataaaattacacagcagcaaaaactcgaccgcgcacgtccgctgccggggcgacgagacggccttctcagtactggaaggcgttcacagctacacagtgagtctcagcttcgaccacgccgtggtagacgaacagtgccaactcaactgcggtggccacgaatcacaagtcaccctgaaaggtaacctgatattcctcgacgtaccgaaatttgtcgacggaagttacatgcaaacgtaccactctagcgtaccaacaggggccaacatcccgagcccaactgactggctaaacgcgctattcggcaatggcctcagccgatggatcctcggggtcataggggtactgctaggcgtactggcacttttcttcctaatcatgagcctatttaaactcggcactaagcaagtcttcagaagccgaacaaaactcgcgtga

SEQ ID NO: 16373 - RNA, 3222 nt, synthetic construct
  misc_feature 1..3222: note = derived and/or modified CDS sequence (opt11) from SFTSV(18-Lu'an(CHN)-2015)__KX302599.1__GP
  source 1..3222: mol_type = other RNA
atgatgaaggttatatggtttttctcactaatatgcttcgtaatacaatgctcaggtgactcagggccaatcatatgtgcaggccccatccactccaataaatcagccgacatcccgcacctcctaggatactcagagaaaatctgccagatcgacagacttatccacgtcagttcatggctgcgcaaccacagtcaattccaagggtacgtgggccaaagagggggccggtcccaagtatcgtactaccccgcagaaaacagctactcccggtggagcggcctgctctcaccatgtgacgcggactggctcggaatgctcgtcgtcaagaaagcgaaaggcagtgatatgatcgtgcccggccccagctataaaggcaaagtcttcttcgaacgaccaaccttcgacggctacgtgggatggggctgcggatcgggcaaatcacgcacagagtctggggaactatgcagttccgacagcgggacctcaagcggtctcctaccctctgacagggtactctggataggtgacgttgcgtgtcaaccaatgaccccgatcccggaagaaaccttcctagagctcaagagcttcagccaaagtgagttcccggacatatgcaaaatcgacggaattgtatttaaccaatgcgagggcgaaagcctcccccaacccttcgacgtagcatggatggacgttggacactcccacaaaataataatgagggagcacaaaacaaaatgggtgcaagaaagcagcagcaaagactttgtgtgctacaaagaaggaaccggaccatgcagcgaatccgaagagaaaacatgcaagacaagcggctcgtgccggggcgacatgcaattctgcaaagtagcagggtgcgaacacggcgaagaagcctccgaagcgaagtgccggtgctcccttgtccacaaacccggcgaagtcgtagtatcgtacagaggcatgcgaatccgcccaaaatgttacggtttctcacgaatgatggcgaccctcgaagtcaaccagccagaacaacgaatcgggcaatgcaccgggtgtcacctcgaatgcataaacggcggagtaagattaatcacactcacatcagaactaaagtcggccaccgtatgcgcaagccatttttgcagcagcgcaaccagcgggaagaaatcaacagaaatacaattccactcaggctcgcttgtagggaaaacggcaatccacgtcaaaggagccctggtcgacggcaccgagttcaccttcgaaggctcctgtatgttccccgacgggtgcgatgcagtcgactgcaccttctgtagagagttcctcaagaatccacaatgctatccagccaaaaagtggctgttcataatcatcgtcatcctactaggctacgcaggcctgatgctactaacgaacgtactaaaagccataggaatatggggcagttgggtcatagccccagtcaagctgatattcgcaataatcaagaaactcatgcgcacagtaagttgcctgatgggaaaacttatggacagaggacgccaagtcatacacgaagaaataggcgagaacagagaagggaaccaagacgacgtcagaatcgagatggcgcgaccacgaagagttaggcactggatgtacagcccagtcatactcacgatattggcaatagggcttgccgagggatgcgacgagatggtacatgcggacagcaaactcgtcagctgccggcaaggcagcggaaacgtaaaagaatgcgtgacaaccggcagagccctgctaccagccgtgaacccaggccaggaagcctgcttacacttcacagcacccggctcacccgacagcaaatgcctaaagatacgcgtcaaacgcatcaacctgaaatgcaagaaatccagttcctacttcgtgccagacgcccgcagccgctgcacgagcgtacgaagatgcagatgggcaggggactgccaaagcggatgccctccccatttcacaagtaactccttcagcgacgactgggcaggcaaaatggaccgcgccggcctcggattttcgggctgcagtgacggatgcggcggcgcggcttgtgggtgcttcaacgcggcacccagctgcatcttctggagaaaatgggtagaaaacccacacggcatcatatggaaagtatcaccatgcgccgcttgggtaccctcagccgtcatcgagctaaccatgccctccggtgaagtcaggacattccatcctatgagtggaatcccgacccaagtcttcaagggggtatcgatcacctacctaggttcggacatggaagtcagcggactgacagacctatgtgaaatcgaagagttgaaatcaaagaaactcgcactagcgccatgcaaccaggccggaatgggagtggtgggcaaagtcggagaaatccaatgttcatcagaagagagcgcacgtacaatcaagaaagacggctgcatctggaacgccgacctagtgggcatcgaactcagggtcgacgacgcagtctgctactcgaaaataacctcggtcgaagcggtagccaactactcagcaatacccactacaatagggggcctaagattcgaacgctcacacgactcccaaggcaaaatctcgggatcacccctagacataactgccataagagggtccttctccgtcaattaccgcggactccgcctgtccctgtccgagatcacggcaacctgcacaggcgaagttacgaacgtgagcggatgctacagctgcatgacgggcgcgaaagtaagcatcaaactccactccaacaagaacagcaccgcccacgtgcgctgcaaaggagacgaaacagcgttttccgtactggaaggggtacacagctacacagtatccctatcattcgaccacgccgtagtagacgagcaatgccaactcaactgcggaggccacgaatcacaagtaactctaaagggcaacctgatcttcctcgacgtacccaagttcgtagatggctcctacatgcaaacgtaccattccacagtaccaaccggagcaaatatcccaagccccaccgactggctgaacgcactcttcggcaacggactcagcagatggatactaggggtaataggagtgctcctaggagggctagccctattcttcatgatcatgagcctcttcaagctaggcacaaagcaagtcttcagatcgcgaaccaaactagcctaa

SEQ ID NO: 16374 - RNA, 3222 nt, synthetic construct
  misc_feature 1..3222: note = derived and/or modified CDS sequence (opt11) from SFTSV(27-Lu'an(CHN)-2015)__KX302600.1__GP
  source 1..3222: mol_type = other RNA
atgatgaaagtcatctggttctccagcctcatctgctttgtaatccagtgttccggcgactcaggccccatcatatgcgcaggcccaatccactcaaacaaatcagctgacataccacacctactcggctactccgagaaaatctgtcaaatagaccgactaatccacgtatcatcatggctacgaaaccactcacaattccagggatacgtcggccaacgaggtggcaggagtcaagtatcgtactacccagccgaaaacagctacagtagatggtcaggactactttcaccctgcgacgcagattggctcggaatgctggtagtaaagaaagcgaaaggcagcgacatgatagtaccgggaccatcctataaaggcaaagtcttcttcgagaggccgacattcgacggctacgtcggctggggctgtggtagcggtaaaagccggacagaaagcggggaattgtgctcctccgactcgggcacaagctcaggacttctaccatccgacagagtcctatggataggcgacgtcgcctgccaaccaatgacaccaatcccagaagaaaccttcctagagctaaaatcattcagccaaagcgagttccctgacatatgcaagatagatgggatagtcttcaaccaatgcgaaggtgaatcactcccacagcccttcgacgtagcctggatggacgtcggccacagccacaaaatcattatgcgggaacacaagaccaaatgggtccaagaaagctcctccaaagacttcgtatgctacaaagaagggacaggcccatgctccgaatccgaagagaaaacctgcaaaacaagcggcagctgcaggggcgacatgcagttttgtaaagttgcaggatgcgaacacggcgaagaggccagcgaggccaagtgtaggtgcagcctagtgcataagccaggcgaagtagtagtctcctacggcggcatgcgcatacgccccaaatgctacggattttcgcgaatgatggccaccctagaagtcaaccagccggaacaaagaataggtcaatgcaccggctgccacctcgaatgcataaacggaggagtcagactaatcacactcacgagtgaactcaaatccgccaccgtctgtgcctcacacttctgctcatccgccacctccggaaagaaatccaccgaaatccaattccactcgggatcccttgtaggcaaaacagccatacatgtcaaaggagcactcgtggacgggaccgagttcaccttcgaaggctcctgcatgttccctgacggctgcgacgccgtcgactgcacgttctgccgcgagttcctgaaaaacccccagtgctacccagccaagaaatggctctttatcatcatcgtaatacttcttggatatgcgggcttaatgttgctcacaaacgtgctcaaagccatcggaatatggggatcatgggtaatcgccccagtaaaactcattttcgcgataatcaaaaagctaatgagaaccgtatcctgcctgatgggaaaactcatggaccgaggccgacaagtcatacacgaagaaatcggcgaaaaccgggaaggcaaccaagacgatgtccgtatcgagatggcacgcccacgcagagtcaggcactggatgtactcccccgtaatacttacaatactagcaatcggcctggctgaatcatgtgacgaaatggtccacgctgacagtaaactcgttagctgccgccaaggatcaggtaacatgaaagaatgcgtcaccacgggacgagcactccttccggccgtcaaccccggccaagaagcatgtctacacttcacggcccccgggagcccggacagcaagtgcctaaaaatcaaggtgaagcgtatcaacctaaagtgcaagaaaagctcaagctacttcgtcccagacgcccggtcccgatgcacctcagtacgtcgctgcagatgggcgggcgactgccaatccggatgcccaccccatttcacctcaaacagcttcagcgacgactgggcgggaaaaatggacagagcagggctaggcttttcaggatgctccgatggatgcggaggagccgcctgtggctgtttcaacgctgcaccctcttgcatcttctggcgaaagtgggtagaaaacccccacggcataatctggaaggtatccccctgcgcggcctgggtcccgtccgcagttatcgaactcacaatgcccagcggcgaggtgcggacattccaccccatgtcaggaatccccacccaggtcttcaaaggcgtatccgtaacgtacctcggctcagacatggaagtcagtggactcacagacttatgcgagatcgaagaactaaagagcaagaaactcgccctcgcgccctgcaaccaggcgggaatgggagtagtcggaaaagtcggcgaaatccagtgcagctcggaagaaagcgcccgcacaataaagaaagacggctgcatatggaatgcggacctagtaggcatagagctgagagtagacgacgcagtctgctactccaaaataacaagcgttgaagccgtcgccaactactcggcaatcccgaccactataggcggcctgcgatttgagagatcccacgactcacaaggcaaaatatccggctcccctctagacatcaccgccattcgcggctccttctccgtaaactacagaggcctacgcctatccctatccgagatcacagccacatgcaccggcgaagtcaccaacgtatcaggatgctactcctgtatgacgggcgccaaggtgtcgattaaactacattcatccaaaaactcaaccgcccacgtccgatgcaaaggcgacgaaacagcatttagcgtactggaaggcgtccactcatacaccgtaagtctatccttcgatcatgccgtagtggacgaacaatgccaattgaactgcggaggacacgagtcccaagtcacacttaaaggaaacctcatcttcctagacgtccctaaattcgtcgacggctcatacatgcagacatatcatagcaccgttccaaccggcgccaacatcccctcgcccacggactggctcaacgcactcttcggcaacgggctgtcccggtggatactaggcgtaatcggtgtactattgggaggcctagctctcttcttcatgatcatgtcactattcaaattaggaacaaagcaagtcttccgcagcagaaccaaactagcataa

SEQ ID NO: 16375 - RNA, 3222 nt, synthetic construct
  misc_feature 1..3222: note = derived and/or modified CDS sequence (opt11) from SFTSV(36-Lu'an(CHN)-2015)__KX302601.1__GP
  source 1..3222: mol_type = other RNA
atgatgaaagtaatctggttttcctcgctcatatgcttcgtcatacaatgcagcggagactcgggacccatcatctgcgccggacctatccacagcaacaagtccgccgatatcccacacctactgggatactcggagaaaatatgccaaatcgacagactaatacatgtcagctcctggctcagaaaccattcacaattccaggggtatgtaggacagcggggaggcaggagccaagtatcatactacccagccgaaaacagctacagccggtggtcaggcctcctatccccctgcgacgccgactggctcggaatgctagtggtgaaaaaggcaaagggttccgacatgatagtacctgggccctcatataaaggcaaggtcttcttcgaacgcccaacgttcgacggatacgtcgggtggggatgcggatccggaaaaagccgaacagaatcaggcgaactgtgttcgtcggactcagggacctcatcaggactcctaccctcagacagagtactgtggatcggcgacgtcgcatgccagccgatgacgccaatccctgaagaaacgttcctcgaactaaaatcattctcccaaagtgaatttccagacatatgcaagatcgatggtatagtctttaaccagtgcgaaggagaaagcctgccacaaccattcgatgtggcatggatggacgtagggcacagccacaaaattataatgagggaacacaaaacgaaatgggtccaagaatcgagcagcaaagacttcgtctgctataaagaagggacaggaccgtgctcagagagcgaagagaaaacctgcaagacgtcaggctcatgcaggggagacatgcaattctgtaaagtagcaggctgcgaacacggggaagaagcgtcggaagcgaaatgccgctgttccctcgtacataaaccaggagaagtcgtggtaagctatgggggaatgcgcgtacgaccaaagtgctacggattcagccgcatgatggcgaccttggaagtgaaccagccagagcagaggataggtcagtgcaccggatgccatctggagtgcataaacggcggcgtacgcctcataacactcaccagcgagctcaaaagtgcaaccgtatgcgcgagccacttctgctcctctgccacatccggaaagaaaagcacagaaatccagttccactccgggagtctcgtaggcaaaaccgccatccacgtaaagggagcactggtggacggaactgagttcacatttgaaggctcgtgcatgttcccagacgggtgcgacgccgttgactgcacattctgcagggagttcctaaagaacccacaatgctacccagccaagaaatggctgttcatcattatagtaatactcctcgggtacgcaggactcatgctcctgacgaatgtcctgaaagccatcggcatttgggggagctgggtaatagccccagtaaagctcatgttcgcaatcattaagaaactcatgcgcacagtatcctgcctaatgggcaaactcatggaccgcggacgccaagtcatacacgaagagataggcgaaaacagagagggcaaccaggacgacgtaaggatcgaaatggcgcgtccacgcagagtaagacattggatgtactccccggtcgtcctcacaatcctagcgataggcttagcggaatcctgtgatgagatggttcacgcggacagcaaactcgtatcctgcaggcaaggcagcggtaacatgaaagaatgcgtgaccacaggcagagccctgctccctgcggtcaaccccggccaggaagcgtgcctacactttaccgcacccgggtcacccgacagcaaatgtctcaaaataaaagtaaagcggataaacttaaaatgcaagaaatcatcaagctactttgtgcccgacgcaaggagcagatgcacgagcgtccgcagatgtagatgggcgggcgactgccagagtgggtgccctccccacttcacatccaatagcttcagtgacgattgggcagggaaaatggaccgggccggactcgggttctcggggtgctcagatggatgcggcggtgcggcatgcggttgcttcaacgcggcacctagctgcatattctggcgaaaatgggtcgagaacccgcacggcattatatggaaagtgagtccatgtgccgcatgggtaccctctgctgtcatcgaacttaccatgccaagcggagaagtacgcacgtttcaccccatgtccggaatccccacccaggtcttcaaaggggtcagcgtcacttacctagggtcggacatggaagtgagcggtttaacagacctgtgcgaaatcgaggaactgaaatcgaagaaactggcactagcgccatgcaaccaggcaggcatgggcgttgtggggaaagtaggtgaaatccaatgctcctcggaagaatccgcgcgcacgataaagaaagacggctgcatatggaacgccgacctcgtcgggatcgaactccgggtagacgacgccgtttgctactccaaaataacaagcgtcgaagctgtcgcaaattattcggcaattcccacgacaatcggagggctacggttcgagcgttcgcacgatagtcagggaaaaataagtggatcaccactggacatcacagcaatcagagggagcttctcagtcaactatcgcggactccgactgtccttgagtgaaataacagcaacctgcacaggcgaagtaacaaacgtaagcgggtgctacagctgcatgaccggagccaaagtgagcataaaactgcacagctccaaaaactctaccgcccacgtccgctgcaaaggagacgaaaccgcattctcagtcctcgaaggagtacactcttacacagtcagcctctcattcgatcacgcagtggtcgacgagcagtgccaactcaactgcggcggacatgagagccaggtaactctcaaaggcaacctaatattcctagacgtgccgaaattcgtcgacgggtcttatatgcaaacgtaccacagcacagttccgaccggagccaacataccgagcccgaccgattggctgaacgcgctattcggcaacggactcagccgctggatcctaggagtaataggcgtcctactaggcggactcgcgctattctttatgatcatgagcttgttcaaactagggacgaagcaagtattccggagccgaacaaaactagcataa

SEQ ID NO: 16376 - RNA, 3222 nt, synthetic construct
  misc_feature 1..3222: note = derived and/or modified CDS sequence (opt11) from SFTSV(42-Lu'an(CHN)-2015)__KX302602.1__GP
  source 1..3222: mol_type = other RNA
atgatgaaagtaatatggttcagcagcctcatctgctttgtaatccaatgctcaggcgactccggcccgataatatgcgccggccccatacacagcaataaatcagccgatataccacatctgctggggttctcagagaagatatgccaaatagaccgactaatccacgtgagctcctggctacgaaaccactcgcagtttcaggggtacgtgggacagcgcggaggcaggagccaggtcagctactaccccgcggagaacagctattcacgctggtcgggcctacttagcccttgcgacgccgattggctcggcatgctagtcgtaaagaaagccaaaggaagcgatatgatagtgccagggccatcgtacaaaggaaaagttttcttcgagcgtcccaccttcgatgggtacgtaggctggggctgcgggtcagggaaatcaagaacagaatcaggggagctctgcagcagcgacagcggcacatcaagcggtctactccccagcgacagggtactatggataggagacgtagcctgccaaccgatgactcccatcccagaagaaacgttcctcgaactcaagagcttcagccaaagtgaatttcctgacatatgcaaaatagacggcatagtcttcaaccagtgcgaaggggagagcctaccccagcccttcgacgtagcatggatggatgtaggacacagccacaagataataatgcgggaacacaaaacaaaatgggtacaagaaagctccagcaaagatttcgtctgctacaaagagggcacagggccatgctcagagtcggaagagaaaacgtgcaagaccagcggcagttgcagaggcgacatgcaattctgtaaagtagccggatgcgaacacggggaggaagcctcagaagccaagtgtcgatgtagcttagtccacaagccgggagaggtcgttgtctcctacggacgaatgagagtccgacccaaatgctacgggttctcgcgcatgatggcaacactagaagtgaaccaaccagagcaaagaataggacaatgtaccggctgtcacctcgaatgcataaacggtggagtaagactaataacgctaacctcagagctcaagagcgcaaccgtctgcgcaagccacttctgcagttccgccacatccggaaagaaaagcacagaaatccaattccactcaggatcgctagtcggaaaaaccgccatacacgtcaaaggtgccctcgtagacgggactgagttcacgttcgaaggaagttgcatgttccctgacggatgcgacgcggtggattgcaccttctgccgtgaatttctgaaaaacccccaatgctacccagccaagaagtggctattcataattatcgtaatactactcggatacgcaggactaatgctactaacaaacgtactcaaagccataggaatctgggggagctgggtcatcgcaccagtcaaactaatctttgcaatcataaagaaactaatgagaaccgtaagctgtctcatgggaaaacttatggacaggggaagacaagtcattcacgaagaaataggagaaaaccgagaagggaaccaagacgacgtccgaatcgagatggcacgtccacgaagagtcagacactggatgtacagccccgtaatactaacgatcctagccatcggcctagcagaaagttgtgacgaaatggtacacgccgactcgaaactggtatcttgccgccaagggagcggtaacatgaaagagtgcgtcaccacagggcgagccctactcccggcagtgaacccgggacaagaagcatgcctgcacttcacagccccggggagtcccgacagcaaatgcctaaagataaaggtaaaacgaatcaacctcaaatgcaaaaagagttcaagttacttcgtacccgacgcccggtcccgctgtacaagcgtgcgacgctgccgatgggcgggcgactgccaaagcggatgcccaccacatttcacaagcaacagcttcagtgacgactgggcgggcaaaatggaccgggcaggcctcggattctcgggctgcagcgacggatgcggcggggccgcatgcggctgcttcaacgccgcaccctcctgtatcttctggcgcaaatgggtagaaaacccccatgggatcatatggaaggtttccccatgcgcggcatgggtaccaagcgcagtcatagaactaacgatgcccagcggcgaagtacgcacattccaccccatgtccggaatccccacacaagtattcaaaggagtatccgtcacctacctaggaagtgacatggaagttagcggcctaacagacctctgcgagatcgaggaactcaagagtaaaaagctcgccttggcgccatgcaaccaagccgggatgggtgtggtaggaaaagtaggggaaatacagtgcagcagcgaggagagcgccagaacaatcaaaaaggacggctgcatatggaatgcagacctagtcggaatagaactacgagtcgatgacgctgtctgctatagcaaaatcacatccgtcgaggccgttagcaactactccgcaattccaacgaccataggaggactccgattcgaacgaagccacgacagccaagggaaaatatcagggtcacccctggacatcaccgcaatcagaggcagcttctccgtcaactacagaggccttagactaagcctgtccgaaataaccgcaacgtgtaccggcgaagtcacaaacgtaagcggatgctactcatgcatgaccggagccaaggtttctataaagctacactcaagcaagaactcgacagcgcacgtaagatgcaaaggtgacgagaccgccttttcggtcttggaaggagtccacagttacaccgtcagtctcagctttgaccatgcagtggtagacgaacaatgccagctgaactgcggaggccacgaatcgcaagtaacactaaaagggaatctcatattcctcgatgtcccaaaattcgttgacggatcgtacatgcaaacatatcactcaacagtaccgacaggagccaacataccgagtcctaccgactggctcaacgccctattcggcaacggcctcagccgctggatactcggcgtcattggagtactattgggcggactagccttattcttcatgatcatgtcactattcaaacttgggaccaaacaggtattcagaagcaggacaaaactagcatga

SEQ ID NO: 16377 - RNA, 3222 nt, synthetic construct
  misc_feature 1..3222: note = derived and/or modified CDS sequence (opt11) from SFTSV(44-Lu'an(CHN)-2015)__KX302603.1__GP
  source 1..3222: mol_type = other RNA
atgatgaaggtaatctggttcagcagcctgatatgcttcgtcatacaatgcagcggggattcgggccccatcatctgcgccggcccaatccacagcaacaaatcagcagatatcccacacctccttggattctcggagaaaatatgccaaatagaccggctaatacacgtcagctcttggctacgcaaccacagccaatttcaaggatacgtaggacaaagaggaggaaggagccaggtaagctattatccagccgaaaactcgtacagccggtggtcgggattactctcaccatgcgacgcggactggctcggcatgctcgtagtcaaaaaggccaagggaagcgacatgatagtgcccggaccctcctacaaaggcaaggttttctttgaacgcccaactttcgacggctacgtaggatggggatgcgggtcaggcaaaagccgaacagaatcgggcgaactctgcagcagcgacagcggaacctcgagcgggctactaccatcagaccgtgtgctatggataggggacgtagcatgtcagcccatgaccccaattcccgaggagaccttcctggaactaaagtcctttagccagtccgaatttccggacatatgtaagatagacggcattgtattcaaccaatgcgagggagaaagcctcccacaacccttcgacgtggcctggatggacgtaggacactcgcacaaaataataatgagagaacataagacaaagtgggtccaggaatccagctcgaaagacttcgtgtgctacaaagagggcacaggaccgtgcagcgaatcggaagagaaaacatgcaaaacctcaggcagctgccggggcgacatgcagttctgcaaagtcgccggctgcgaacacggagaagaagcatcggaggcaaaatgtaggtgcagtctggtgcacaaaccaggtgaagtagtagtgtcatacgggggcatgagggtccgaccaaaatgctacggattctcgcgcatgatggctaccctcgaagtaaaccagccggagcagaggatcgggcaatgcaccggatgccacctcgaatgcataaacggaggggtcagattaatcacacttacaagcgaactgaaatccgcgaccgtatgcgcaagtcacttttgcagcagtgccacgtccgggaaaaagtcgacggaaattcaattccactcggggtcgctcgtgggaaaaacagcgatccatgtcaagggcgccctagtggacggaaccgagttcacgttcgagggcagctgcatgttcccggacggatgcgatgccgtggactgcaccttctgccgggagttcctcaaaaacccacaatgctacccggccaagaagtggctattcattataatcgttatcctcctcggatacgcaggcctaatgttgctcaccaacgtgctcaaagccataggcatatgggggagttgggtcatcgcacccgtcaaattaatcttcgccatcatcaagaaactcatgcgcacagtaagctgcctaatgggcaaattaatggatcgcggaaggcaagtcatacacgaagaaatcggagaaaaccgagaaggcaatcaggacgacgtccgaatcgaaatggcgcgccctcgacgagtacggcactggatgtatagcccagtaatactgacaatactcgcaataggactggcagagagctgtgacgaaatggtgcatgcggactccaagctagtcagttgtcgacaagggtccgggaacatgaaagaatgcgtaaccacaggacgggcgctgctcccagcagtaaatcccgggcaagaagcatgcctccacttcaccgcgccaggcagcccggacagtaaatgtctcaaaatcaaagtcaaacgtataaacctaaaatgcaaaaagagctccagctactttgtgcccgacgcacggtcacgatgcacaagcgtgcgacgctgtaggtgggcaggagactgccagagcggatgcccaccacacttcacctccaacagcttttcggatgactgggccgggaaaatggacagggcaggactaggattcagtgggtgcagcgatggctgcggcggcgcagcatgcgggtgcttcaacgctgccccgagctgcatcttctggcgaaaatgggtagaaaacccacacggcatcatttggaaggtctcgccatgcgccgcatgggtaccctccgcagtaatcgagctaacaatgccaagcggagaggtgcgcacgttccaccccatgtccggaataccaacacaagtcttcaaaggcgtctcggttacatacttgggatcggacatggaagtcagcggcctaacagatctatgcgagatcgaggaacttaagagcaagaaactagcactagcgccctgtaatcaggcaggcatgggagtcgtaggcaaagtcggggaaattcagtgcagctccgaagagagcgcacgcacgataaagaaagatggctgcatatggaacgcagacctagtcgggatagaactgagggtcgatgacgccgtttgctactccaaaataacaagcgtcgaggcggtgagcaactactcggcgatcccaaccaccataggaggactgaggttcgagagaagccacgacagccaggggaaaatctcggggtcgccactagacataaccgcgatcagaggtagcttctcggtgaactaccgcggcctaagactgagtctaagtgagatcacggcgacatgcacgggcgaggtcacaaacgtaagtggatgctacagctgtatgacgggcgccaaagtgagcattaaacttcactccagcaagaactcgacagcacacgtccgatgtaaaggagacgaaacagccttctccgtcctagaaggggtacatagttacacggtcagcttgagcttcgatcacgcagtcgtagacgaacagtgccagctcaattgcgggggccacgaaagccaagttacactcaaaggtaacctaatctttctagacgtcccaaaattcgtcgacgggagctacatgcaaacataccacagtacggtaccgaccggcgcaaacataccgagcccgaccgattggctaaacgcactcttcggcaacggtctaagccgttggatactaggggtgataggagtgttactaggaggactagcgcttttcttcatgataatgagcctgttcaagctgggcacgaagcaagtgttccgcagcagaaccaagctagcataa

SEQ ID NO: 16378 - RNA, 3222 nt, synthetic construct
  misc_feature 1..3222: note = derived and/or modified CDS sequence (opt11) from SFTSV(52-Lu'an(CHN)-2015)__KX302604.1__GP
  source 1..3222: mol_type = other RNA
atgatgaaagttatctggttcagctcactaatatgcttcgtcatccagtgctctggggactcaggtccaataatctgcgcaggaccaatccacagcaataaaagcgccgatatacctcatttactcggctactcagaaaagatctgccaaatagaccgcctaatccacgtatcctcctggctacgcaaccactcacaattccaaggatacgtaggccaaagaggcggcagatctcaagtaagctactacccagcagaaaactcctatagccggtggtcaggccttctaagcccctgtgatgcggactggctaggcatgctagtcgtgaagaaagctaaaggaagcgacatgatagtaccaggaccatcatacaaaggcaaagtattcttcgaacgccccacattcgatggctacgtgggctgggggtgtggatccggcaaaagccgcacagagtcaggcgaactatgctcaagtgactcaggaacttcaagcggcctcctgccatcagaccgggtcctgtggatcggcgacgtagcatgccaacccatgacaccaataccagaagaaaccttcctggaactcaagagctttagtcaaagcgagttcccagacatctgtaaaatcgatggcatcgtcttcaaccaatgcgaaggagagtcactcccacaaccatttgacgtagcctggatggatgtcgggcactcccataaaataataatgcgcgaacacaaaaccaaatgggtccaagaatccagctcaaaagacttcgtatgctacaaagaaggaaccggcccctgctccgagtccgaagagaaaacgtgcaagacatcgggctcatgccgaggcgacatgcagttctgcaaagtggcaggctgcgaacacggagaagaagcctcagaagctaaatgtcgctgcagcctcgtgcacaagccaggtgaagtcgtagtttcctacgggggcatgcgcgtccgccccaaatgctacggattctcgcgaatgatggccaccctcgaagttaaccagccagaacaacgaatcgggcaatgcacaggctgccacctagagtgcataaacgggggagtacgactgatcacactaacatctgagctcaaaagcgcgacagtatgcgcatcccacttctgtagctccgcaacctccggcaaaaagtctaccgaaatccaattccactccggatcactggtaggcaagacagcaatccacgtaaaaggggcgctagtcgacggcaccgagttcacattcgagggctcctgcatgttcccggatggatgcgatgccgttgactgtaccttctgccgagagttccttaaaaacccccaatgctaccccgccaagaaatggcttttcataatcatagtcatcctcctcggatacgctggcctaatgttactaaccaacgtcctaaaagccatcggcatctgggggagctgggtgattgccccagtcaaactcatattcgctatcatcaagaaactgatgcgaacagtcagctgcctcatgggcaaactcatggaccgcggacgccaggtcatccacgaagaaataggagaaaacagagagggaaaccaagacgacgtcagaatagagatggcgagaccaagacgagtgcgacactggatgtacagcccggtaatcctgaccatcctagcaattggcctggccgaaagttgcgacgaaatggtccacgcggactcaaaactggtctcttgccggcagggatccggaaacatgaaagagtgcgtgacaacgggccgagccctgctcccagccgtaaacccgggacaagaagcctgcttgcacttcaccgcacctggcagcccagattcgaaatgcctcaaaatcaaagtgaaacgcatcaacctaaaatgcaaacgaagctccagctacttcgtacccgacgcacgttcacgctgcacaagcgtcaggcgttgcagatgggcaggcgactgccaaagcggatgcccaccccacttcacctcaaattccttctcagatgactgggccgggaaaatggacagagccggtctaggcttctccggatgttcagacggctgcggcggggccgcctgcgggtgcttcaacgccgccccctcgtgcatcttctggcgaaaatgggtagaaaatccccacgggatcatctggaaggtctcaccgtgcgcagcgtgggtaccctcagccgtaatagagctaacaatgcccagtggcgaggtcagaacatttcaccccatgtccgggataccaacgcaagtgtttaaaggagtcagcgtcacatacctgggctccgacatggaagtatcaggactcacggacctctgcgaaatagaagaactgaagtcaaagaaactcgcgctcgcaccatgcaaccaagccgggatgggagtcgtaggtaaagtaggcgagatacaatgtagcagcgaggagagcgcacgcaccatcaagaaagacggctgcatttggaacgccgatctcgtaggaatcgaactccgcgtcgacgacgcagtctgctacagcaaaatcacatcggtcgaagccgtcgccaattacagcgcaatacccacaacaataggaggactgagattcgagcgcagccacgactcacaaggtaaaattagcggctcacccctagacatcactgcaatccggggatccttctccgtcaactaccgtggactgagactaagtctctccgagatcaccgcaacttgtacgggtgaggtcactaatgtaagtggatgctacagctgcatgacgggagcaaaagttagcataaaactacacagcagcaaaaatagcaccgcccacgtacgttgcaagggagacgaaaccgctttctcagtactggaaggcgtccacagctacaccgtaagcctgtccttcgatcacgccgttgtagacgagcaatgccaactcaattgcggaggacatgaatcccaagtaaccctcaaagggaacctgatattcttagacgtacccaaatttgtcgacggctcatacatgcaaacataccacagcaccgtaccgaccggggccaacatccccagcccaaccgactggctaaacgcactattcggcaacggcctcagcagatggatacttggggtgatcggcgtcctcctgggcggtctcgccctctttttcatgatcatgagtcttttcaagctaggcacaaaacaggtattccgatcccgaaccaaactggcgtaa

SEQ ID NO: 16379 - RNA, 3222 nt, synthetic construct
  misc_feature 1..3222: note = derived and/or modified CDS sequence (opt11) from SFTSV(HL/Injected)__KF791953.1__GP
  source 1..3222: mol_type = other RNA
atgatgaaagtcatatggttcagtagcttaatatgcctggtcatacaatgtggcggcgacacaggacccatcatctgcgcgggacccatacactccaacaaaagtgcagacatcccccatctgctgggatactcagagaagatctgccaaatcgatcgactcatacacgtctccagctggcttaggaaccactcccaattccagggatacgtaggccaacgcggcggaagaagtcaagtatcgtactaccccgcggaaaacagttacagccgatggagcgggctactgtcgccctgcgacgccgactggctgggcatgcttgttgtcaagaaggcaaaaggaagcgacatgatcgtcccggggccatcgtataaagggaaggttttcttcgagcgccccactttcgacggctacgtaggatggggttgcggctccggaaaaagcaggacagaatccggggaactctgcagcagcgactcgggcacgagttccgggctgctcccaagcgaccgagtcctatggatcggggacgtggcatgccaaccaatgacacccatccccgaagaaacgttcctggagctaaagagcttcagccagagtgagttcccagacatatgcaaaatcgacggcatcgtcttcaaccagtgcgagggagagagcctcccccaaccatttgacgtggcatggatggacgtaggccactcccacaaaatcatcatgcgagaacacaaaacgaagtgggtacaagaaagcagcagcaaagacttcgtatgctacaaggaaggcacaggaccatgcagcgagtccgaagagaaaacctgcaaaacgtcgggaagctgcagaggcgatatgcaattctgcaaagtagccggatgcgaacacggagaagaagccagcgaggccaaatgtagatgcagcctagtgcacaagccaggcgaagtagttgtatcatatggcggaatgcgagtcaggccgaaatgctacggattcagccgcatgatggcgacactggaagtctcccaacctgagcaacgcatcggccaatgcacaggctgccacctcgaatgcataaacggcggagtacgactaatcaccctcacctcagaactaaaaagcgccacggtctgcgcgtcacacttttgcagcagcgcaacgtcggggaaaaagtccacagaaatccagttccactccggaagcctggtgggaaaaacagcaatccacgtaaagggagcactcgttgacggaacggagttcacatttgaaggctcctgcatgttcccagacggatgcgacgcagtcgactgcacattttgcagggagttcctaaagaacccccagtgctacccagccaaaaagtggctattcataataatagtaatactactgggatacgccggcctcatgctgctcactaacgtactcaaagccatcggggtctggggctcatgggtaatcgcaccagtaaagctagtctttgcgataataaagaaactcatgcgagcagtttcatgcctaatgggaaaactcatggaccggggacgccaagtaatacacgaagaaataggcgaaaaccgcgaagggaatcaagacgacgtacgcatcgaaatggcaagacctagacgggtcaggcactggatgtacagtccggtcatactgacaatactcgcaataggcctcgcggaaggctgcgacgaaatggtccacgcggactcgaaactcgtatcttgccgccagggctcaggcaacatgaaagaatgcgtaaccacaggccgcgcactcctcccagcggttaacccaggccaagaagcatgtcttcacttcacggcaccgggtagccccgattccaaatgccttaaaatcaaagtgaaacgaataaacctcaaatgtaagaaaagttctagttactttgtgccagacgcccgatctagatgcacatcagtaaggcgctgccgatgggcaggagactgccaatcaggatgcccaccccacttcacaagcaatagctttagtgacgactgggcgggaaaaatggaccgagcgggactaggattcagcgggtgctccgatggatgcggaggcgccgcgtgcgggtgcttcaacgcagctccaagctgcatattctggcggaaatgggtagaaaacccccacgggataatctggaaagtcagcccatgcgccgcatgggtccccagcgctgtgatcgaactaacgatgccatccggcgaagtccgaacgttccatccaatgtccggaatcccaacacaagtcttcaagggagtaagcgtcacatacctcgggagcgacatggaagtttcaggactaacagacctctgtgaaatcgaagaactcaagagcaagaaattagccttagcaccatgcaaccaggccggaatgggcgtagtcggaaaagtgggcgagatccaatgcagtagcgaagaatccgccaggacgattaagaaagatggctgtatctggaacgcagacttagtaggcatcgaactccgcgtggatgacgcggtctgttacagcaaaatcacctcagtcgaagcagtagccaactactcggccattcccaccacaatcgggggactacgcttcgaacgctcccacgactcacaaggaaaaattagcggctcaccactagacatcacagcgatccgaggatccttctccgtaaactatcgcggactccgactctccctctcagaaatcaccgcaacgtgcacaggagaggtaaccaacgtcagcgggtgctactcctgcatgacaggagcgaaagtcagcatcaaattacactccagcaaaaactcaacagcccacgtacgatgcaagggggacgagaccgcattcagcgtactcgaaggagtacactcctactcagtcagtctcagcttcgaccacgcagtggtcgacgagcaatgccaacttaattgcggaggtcacgagagtcaagtaacattaagaggcaacctaatatttctggacgtacctaaattcgtagacggatcgtatatgcagacatatcactccacggtgcccaccggagcgaatataccatctcctaccgattggctaaacgccctcttcgggaacggactaagccgctggatcctgggcgtgatcggcgtcctacttggaggactggcactcttcttcctgattatgtcattattcaaactcgggacaaaacaaatattccgctcacgcaccaaactcgcatag

SEQ ID NO: 16380 - RNA, 3222 nt, synthetic construct
  misc_feature 1..3222: note = derived and/or modified CDS sequence (opt11) from SFTSV(HL/Larvae/G2)__KF791955.1__GP
  source 1..3222: mol_type = other RNA
atgatgaaagtaatatggttttcctcactcatctgtctggtcatccaatgcggcggagacacaggacccataatatgcgcaggcccaatccacagcaacaagagcgctgacataccacacctactcgggtactcggagaaaatctgccaaatagacaggttaatacacgtgagctcctggctcagaaatcactcgcaattccaggggtacgtagggcaacgagggggccggagccaagtctcatactaccccgccgaaaacagctacagccgctggtcgggcttgctaagtccatgcgacgccgattggttaggtatgctggtagtaaagaaggccaagggaagtgacatgattgtgcccgggccaagttacaaaggcaaagtcttctttgaaagacccacctttgacggatacgtcggctgggggtgtggctctggcaagagccgtaccgaatcaggcgaactatgctcatcagacagcagaacatcaagcgggctcctccccagcgacagggtcctctggataggcgacgtagcatgccaaccaatgacccccatcccggaagaaaccttccttgaacttaagagcttcagccaaagtgagttcccagatatctgcaaaatcgacggaatagtcttcaaccagtgcgaaggcgaaagcctgccccaaccattcgacgtagcctggatggacgtaggccactcacacaaaataatcatgcgtgaacacaaaacaaaatgggttcaggaatccagctccaaagacttcgtctgctacaaagagggcaccggcccatgctctgagagcgaagagaaaacctgcaaaacctccggcagctgccggggcgacatgcaattctgcaaagtagccgggtgcgaacatggcgaagaagcatccgaagccaaatgtaggtgcagtctggtacacaaacccggagaagtcgtggtaagctacggaggaatgagggtgcgccccaaatgctacggcttctcacgcatgatggccacactagaagtgagccagccagaacaacggatcgggcaatgtacaggatgccatctcgaatgcataaacggcggagtgcgcctcataaccctaacatccgaactaaaaagcgcaacagtatgcgcaagccacttctgctccagcgccacatccgggaagaaaagcacggaaatacaattccactccggctccctcgtaggcaaaaccgcaatccacgtcaaaggcgccctcgtagatggtacagagttcacgttcgaagggtcctgcatgttccctgacggctgcgacgcggtagactgcaccttttgtcgagagttcctgaaaaacccccaatgctacccagccaagaaatggctattcataataatcgtcatactcctaggatacgcggggctcatgctcctcacgaacgtcctaaaggctataggagtttggggctcctgggtgatagcgcccgtaaaattagtattcgcaatcataaagaaactcatgcgggcagtatcatgcctaatgggtaaactaatggacagaggacgacaggtgatacacgaagaaataggagaaaaccgggaaggcaaccaagatgacgtacgaatcgaaatggctcgcccgagacgagtacgacactggatgtacagcccggtgatactaacaatactcgcaatagggctagcggaaggctgcgacgaaatggtgcacgcggactccaaacttgtatcgtgccgacaaggaagtggaaacatgaaagaatgcgtaaccacaggaagggcattactaccggctgttaacccaggccaagaagcctgtctacacttcacagcccccggaagtcccgactcaaaatgcctaaaaataaaagtcaagcgaatcaacctaaaatgcaaaaagagctcatcctacttcgtccccgacgcccggagccggtgcacatcagtccgtagatgtaggtgggcaggcgactgccaaagcggatgccctccacacttcacctccaattccttctcagatgactgggccggaaaaatggacagagcaggactagggtttagcggatgcagtgatggatgcgggggagccgcatgcggatgcttcaatgcggcgccttcgtgcatattctggcggaaatgggtcgaaaatccacatggcatcatatggaaagtatccccatgcgcagcctgggtcccatcagccgtcatagaactcaccatgccgtccggggaagtacgaacattccaccccatgagcgggatacccacccaagtattcaaaggagtaagcgtcacttacctgggctccgacatggaagtaagcggcctaacagacctgtgcgaaatagaagaactaaaaagcaagaaacttgcactcgctccatgcaaccaggctggcatgggggtcgtgggaaaagtaggcgagatccaatgcagctcagaagaaagcgctcgaaccatcaagaaagacgggtgcatctggaatgcagatctagtggggatcgaactaagagtcgacgacgcagtctgctactccaaaatcacctccgtagaggcagtcgccaactactcagcaatccccacaacaattggagggctccggttcgaacgctcacacgattcccaaggtaaaatctccggatcacccttggacataacagcaatcaggggtagcttcagcgtcaattatcggggcctgcgtctctcactatcagaaatcacagcaacatgcacaggcgaagtgacaaacgtaagcggctgttacagctgcatgaccggcgcaaaagtaagcatcaaactccacagtagcaaaaactcaaccgctcacgtacgctgcaaaggagacgaaaccgcatttagtgtactagaaggagtccatagctacagcgtcagcctaagtttcgaccacgcagtagtagacgaacagtgccagctcaactgcggcgggcatgaaagccaagtcactttacgaggcaaccttatcttcctcgacgtcccaaaattcgtagacggatcctacatgcaaacctatcacagcaccgtcccaaccggagccaatatcccaagcccgacagactggctgaacgccttattcgggaacggcctaagccgatggatactaggggtcatcggcgttctcctaggcggactagcgcttttcttcctcatcatgagcctcttcaagctgggcacaaaacaaatatttagaagccgtaccaaactggcatag

SEQ ID NO: 16381 - RNA, 3222 nt, synthetic construct
  misc_feature 1..3222: note = derived and/or modified CDS sequence (opt11) from SFTSV(JS2011-004)__KC505124.1__GP
  source 1..3222: mol_type = other RNA
atgatgaaagtcatatggtttagcagcctaatatgcctagtcatacaatgcggcggcgacacgggaccgatcatctgcgcgggaccgatccacagcaacaaatccgccgacataccacacctactcggatactcagaaaagatttgccaaatagatagattgatccacgtgtccagttggctacgtaatcactcgcaattccaagggtacgtaggccaacgcggcggacggagccaagtcagctactaccccgcggaaaacagttacagtcggtggagcggcctgctatccccctgcgacgcagactggctaggaatgctagtcgtaaagaaagccaagggctcagacatgatcgtgcccggcccctcctacaaaggaaaagtattcttcgaacggccaaccttcgatggatacgtcggatggggttgcggaagcggaaaaagtagaaccgaatccggcgagctgtgctccagcgattccggcacgagcagcggactactaccaagcgacagggtcctgtggattggagacgtcgcctgccagcccatgacccccatcccagaagaaaccttcctagagctcaagtccttctcccaatcagagttcccggacatctgcaaaatcgacggcatagtatttaaccaatgcggaggagaatcattgccacagccatttgacgtagcctggatggacgtcgggcactcgcacaagatcatcatgcgtgaacacaaaaccaagtgggtacaagaaagctcaagtaaagacttcgtatgctataaggaagggacaggcccatgctcagaaagcgaagagaaaacatgcaaaacgagtggatcctgccgcggtgacatgcaattctgcaaagtagcggggtgcgaacacggggaagaggcatccgaagccaagtgccgctgttcactcgtacacaaaccgggggaagtggtcgtatcctacggcggcatgcgggtaagacccaaatgctacgggttctcacggatgatggcaactctcgaagtaaaccaacccgaacaacgcatcggccaatgtacgggctgccacctagaatgcatcaacggaggtgtaagactgataacgctgacctccgagttaaaaagcgcgaccgtctgcgcaagtcacttctgcagctccgccaccagcggcaagaaaagcaccgaaatacaattccactcaggctctctggtcggaaaaactgcaatccatgtcaaaggcgcactcgttgacggcaccgagttcacatttgagggctcctgcatgttcccggacgggtgcgacgcagtggactgcaccttctgtagagagttcctcaaaaacccacaatgctaccccgccaagaaatggctctttatcataatcgtgatcctactaggatacgccggcctaatgctcctaacaaacgtactcaaagcaatcggcgtatggggatcgtgggtgatagcaccagtcaaacttgtgttcgcgatcatgaagaaactcatgagagcggtttcctgcctgatgggcaaactcatggatagaggacggcaagtcatacacgaagaaataggagagaacagggaaggcaaccaggacgacgtgaggatcgagatggcacgccccagacgcgtaagacactggatgtacagcccagtaatcctaaccatattggcaataggcctcgccgaaggatgcgacgaaatggtacacgccgattcgaagctagtaagctgcagacaaggcagcggcaacatgaaagaatgcgtgactaccggcagagctctcctaccagcagtcaaccccggacaggaggcatgcctgcacttcaccgcccccggaagcccagacagtaaatgtctcaaaatcaaagtcaaacgaataaatctaaagtgtaagaaatcctcaagctacttcgtgcccgacgccaggagccgatgcaccagcgtacgacggtgtcgctgggccggagactgccagtccggctgtcccccacacttcacttcaaattcgtttagcgacgactgggccggcaaaatggacagagcaggtcttggattttcggggtgctccgatggctgcggcggggcggcatgcgggtgcttcaacgcagcaccatcttgtatcttctggcgcaaatgggtagaaaacccccacggaatcatttggaaagtatctccatgcgccgcctgggtaccatccgccgtaatagaactcactatgccatccggagaagtccgcacattccacccaatgagtggcataccgacccaagtctttaaaggcgtatcagtcacgtacctcggaagtgacatggaagttagtggcctcaccgacctatgcgaaatcgaagaattaaaatccaagaaattagccctagcaccatgcaatcaagcgggcatgggagtcgtaggaaaagtaggagaaattcagtgctccagcgaagagagcgcccgcacaataaagaaagatggctgcatctggaacgcggacctagtcggaatcgaactcagggtggacgacgcggtgtgctactcgaaaataacctcagtagaagcagtggcaaattactcagccatccccaccacaataggcggcctaaggttcgaacgttcacacgattcccaaggcaaaatctcaggctcaccgctagacatcaccgcgatcaggggttcattcagcgtcaattacagaggcttacgccttagcctgagcgaaatcaccgcgacatgcacgggcgaagtcacaaacgtctccgggtgctactcatgcatgacgggagcaaaagtatcaatcaaactacattcaagtaaaaacagcaccgcgcacgtaagatgcaagggcgacgagactgccttcagcgtgctagagggcgtccacagctactcagtcagcctgtcattcgaccacgccgtagtcgacgagcagtgccaactaaactgcggaggacacgaatcacacgtaacacttaaaggaaacctgatcttcctcgacgtacccaaattcgtcgatggctcctacatgcaaacataccacagcaccgtaccaacaggagcaaatataccttcaccgaccgactggctgaatgcgctgttcggaaacggactatctaggtggattctaggggtaatcggcgtcctcctcggcgggctcgcactattcttcttaataatgagcttgttcaagctgggaacaaagcaagtgttccggtcccgaacaaaactcgcctaa

SEQ ID NO: 16382 - RNA, 3222 nt, synthetic construct
  misc_feature 1..3222: note = derived and/or modified CDS sequence (opt11) from SFTSV(JS2011-013-1)__KC505127.1__GP
  source 1..3222: mol_type = other RNA
atgatgaaagttatatggttcagcagcctcatatgcttcgtcatacagtgctcaggagactcaggacccatcatatgcgccggcccaatccacagcaacaaatcagccgacataccacatctcctcggttactcggagaagatatgccaaatagaccgactcattcatgtcagcagctggctaagaaaccacagccaatttcaaggatacgtaggtcaacgcggaggaaggagccaagtcagctattacccagccgaaaactcatatagcagatggtcgggcctactcagcccctgcgacgcagactggctaggaatgctggtagtaaaaaaagctaaaggaagcgacatgattgtacccgggccctcctacaaaggcaaagtttttttcgaacgaccaacattcgacggatacgtcggctggggatgcgggtcagggaaaagccgcaccgagagcggcgaactatgcagcagcgacagcggaacaagcagtggcctcctgccctccgaccgagtactatggatcggagatgtcgcctgccagccaatgaccccaattcccgaagaaacgtttctcgaactgaaaagcttctcacagagcgaattccccgacatatgcaagatagacggcattgtcttcaaccagtgcgaaggagagagccttccacaacccttcgacgtggcctggatggacgtaggccactcccataagatcataatgagagagcacaagactaagtgggtacaagagtcaagttcaaaagatttcgtatgttacaaagaaggaacgggaccctgctcagaatccgaagaaaaaacatgcaaaacttcggggagctgccggggtgacatgcaattctgcaaggtagcaggctgcgaacacggggaagaagcctcagaagcaaaatgcagatgctcgctagtccacaaaccaggcgaggtcgtcgtctcgtacgggggcatgagagtccgccccaaatgctacggcttcagtcgcatgatggccaccctcgaagtcaaccagccagaacagcgcctaggacaatgcacaggatgccatctcgagtgtataaacggaggagtgcgactaatcaccctcacctcagagcttaaaagcgcgacagtgtgcgcatcacacttctgtagcagcgccacatcggggaagaagagcaccgaaatccaattccacagtggcagcctcgtaggaaaaaccgccatacatgtcaagggcgcgctcgtagacgggaccgaattcactttcgaggggtcatgcatgttcccagacggttgcgacgccgtagattgcaccttctgcagggagttcttaaaaaacccccaatgctaccccgccaagaaatggctattcatcatcatcgtcatcctcctagggtacgcaggcctcatgctacttacaaacgtccttaaagccatcggaatatggggctcatgggtaatcgccccagtcaaactcatgttcgccatcattaaaaagctaatgcgcacagtcagctgcctcatgcggaaactaatggaccgcgggcgccaagtcatacacgaagaaatcggcgaaaacagagaaggaaaccaagacgacgtccgtatcgagatggctcgaccacgccgcgtacgacactggatgtactcacccgtcatactaacaatactagccatagggcttgcagaaagctgtgacgaaatggtccacgccgacagcaaactcgtctcgtgccgacaaggaagcggaaacatgaaggaatgcgtgacaacaggaagggccctcctccccgcagtaaaccccggccaggaagcatgcctacacttcaccgccccaggcagcccagactcaaaatgcctcaagatcaaagtcaaacgaatcaacctcaagtgcaaaaaaagctcatcctacttcgtccccgacgcaagaagccgctgcacgagcgtccgcagatgcagatgggcgggagattgccagtctggctgccccccgcattttacgagtaacagcttctccgacgactgggccggcaagatggacagagcaggactcgggttcagcggctgtagcgatgggtgcggcggtgccgcatgcggatgcttcaacgcagcgccaagttgcatattctggcgaaagtgggtcgaaaacccacacggcattatctggaaagtaagtccctgcgccgcatgggtaccctccgcggtaattgagctaacaatgccgtcaggagaggtacgcacctttcacccaatgagcggcatccccacacaggtcttcaagggggtaagcgtaacttacctcggaagcgacatggaggtaagtggactgaccgacctctgcgaaatcgaagaattaaaatccaagaaactagcccttgcaccctgcaaccaggccggaatgggtgtcgtcggaaaagtcggcgagatacagtgcagttcagaggagtccgcacgaacaatcaagaaagacggctgcatctggaacgcagacctagtaggaatagaactcagggtggatgacgcggtctgctactcgaaaatcaccagtgtcgaggcggtagccaactactcagcaatacccacaaccataggaggattaaggttcgagcgctcacacgattcacaaggcaaaatttctggtagccccctagacatcacagccatacgcggaagcttcagcgtcaagtaccgaggattgcgcctaagcctatcagaaattacggccacctgcacaggagaagtaacaaatgtgagcggatgctactcatgtatgaccggcgccaaagttagtataaaactacacagcagcaagaactcgactgcacacgtccgatgcaaaggagacgaaacagcattttcagtccttgaggggggccacagctacacagtgtcattaagcttcgaccacgccgtagtggacgaacagtgccagctgaattgcggcggccacgaaagccaagtgaccctaaaaggaaacctcatatttctcgacgttcccaaattcgtagacggatcatatatgcagacataccattcaactgtcccaacaggagctaacatcccgtccccaacagattggctcaatgcactattcggaaacggcctaagcagatggattctaggagtcatcggcgtactactaggaggactcgcactcttcttcatgatcatgagcctgttcaagctaggaacaaagcaagttttcaggtccaggaccaagctagcatga

SEQ ID NO: 16383 - RNA, 3222 nt, synthetic construct
  misc_feature 1..3222: note = derived and/or modified CDS sequence (opt11) from SFTSV(JS2011-027)__KC505130.1__GP
  source 1..3222: mol_type = other RNA
atgatgaaagtaatctggttctcctcactcatctgcctcgtaatacagtgcgggggagacacaggaccgatcatctgcgcgggcccaatacacagcaacaaatcggcagacatcccacacctcctaggttactcggaaaagatatgtcaaatcgaccgcctcatacacgtatcgtcttggctgaggaaccactcgcaattccaaggatacgtaggacaacgaggagggcgatcgcaagtctcctactatcccgcggaaaatagttacagccgatggtccggactactctccccatgtgatgccgattggctcggcatgctcgtcgtgaaaaaggcaaaaggctcggacatgatcgtacccgggccctcgtataaaggaaaagtcttcttcgagcgaccaacatttgacggatacgtggggtggggctgtggttccggaaaatcccgaacagagagcggggaattgtgctcgtccgacagcggcaccagtagcggactcctgccgtccgaccgagtcctctggataggcgacgtagcctgccagccgatgactccgatacccgaggaaactttcctagaactcaagagcttttcacaaagcgagttcccggacatctgcaagatagacggaatagttttcaaccaatgcgaaggtgaaagcctgccgcaaccattcgacgtggcatggatggacgttggccactcacacaagatcataatgcgcgaacacaaaacgaaatgggtccaagaatcatcaagcaaagattttgtatgctacaaggaaggcacaggtccatgctcagaaagcgaagagaagacgtgcaaaacaagcggatcttgccggggagacatgcaattctgtaaagtggccggctgcgaacacggagaagaagccagcgaagcgaagtgtaggtgcagcctagtacacaagccaggagaagtagtagtatcatacggcggaatgagagtccggccgaagtgctacggattctcgcgtatgatggcgacactcgaagtcaacgaaccagaacaacggataggacagtgcaccggatgccacctagagtgcatcagcggaggagtacgcctcatcacactaacgagcgagctcaagagcgcgacagtatgcgcctcacacttctgttcctcagccacgtccggaaagaaaagcacagaaatccaattccactcaggatcactcgtcggcaaaaccgctatacacgtcaaaggagcgctcgtagacggaacagaatttaccttcgaaggatcctgcatgttccctgacggatgcgacgccgtggactgtaccttctgcagagagttcctaaagaacccacaatgttacccagccaagaaatggctattcatcataatcgtaatcctcctcgggtatgcaggcctcatgctgctcacgaacgttctcaaagccataggtgtttggggaagctgggtgatagccccagtaaaactcgtattcgcgatcataaagaaactaatgcgcgccgtctcctgcttaatgggaaaattaatggaccgcggaagacaagtgatccacgaagaaatcggagaaaacagagaagggaaccaagacgacgtaagaattgaaatggctaggccccgcagggtccgccactggatgtactccccagtaatcctcaccatattagccatgggcctggccgaaggatgcgatgagatggtgcatgccgactccaaactggtctcctgtcgacaaggaagcggcaacatgaaagagtgcgtcaccactggacgggctctactcccggcagtaaacccagggcaggaagcctgcctccactttacagcacccggcagccccgacagcaaatgcctgaaaatcaaagtcaaacgaataaacctcaaatgcaaaaagtcgtcctcatacttcgtcccagacgccagaagccgatgcacgagcgtaagaagatgcagatgggcgggcgactgccaaagcggctgtccaccccatttcacatcaaactcattctcagacgactgggcgggcaaaatggaccgcgccgggctcggattcagcggatgcagcgatggatgcggcggagcagcttgcggatgcttcaacgcagcgcccagctgtatattctggagaaagtgggtagaaaaccctcacggaataatatggaaggtatcaccatgtgcagcatgggtcccctccgcagtcattgagctcacgatgccgtcaggcgaggtacgaactttccatccgatgagcggtataccaacccaggtattcaagggagtcagcgtcacgtatctgggaagcgacatggaagtaagcggactcacggacctatgcgagatagaggagctaaaatcgaagaagctggcactcgccccatgcaaccaagcaggcatgggagtagtaggcaaagtaggagaaatccaatgctccagcgaagaaagcgcacgcacaatcaagaaagacggatgcatctggaacgcagaccttgtcgggatcgagctccgagtcgatgatgcagtctgctactctaaaataacatcggtagaagctgtggcgaactactccgcaatccccacgacaatcggcgggctacgattcgagcgaagtcacgacagccaaggaaaaataagcggctcaccactagacatcacagccatccgcgggagcttctcaattaactaccgcggcctaaggcttagcctaagcgaaatcaccgcaacctgcacgggagaagtcaccaacgtatcagggtgctatagctgcatgacaggcgccaaagtatccatcaaactccactccagcaaaaactccacagcacatgtacgctgcaagggagacgagacggcattttcagtcctcgaaggcgtccacagctacagcgtaagcctatcattcgaccacgccgtagtggacgagcaatgccagctcaactgcggagggcatgaatcacaagtaaccctacgaggaaacctaatctttctagacgtgccaaaattcgtcgacggctcctacatgcaaacatatcacagcacagtaccgaccggggcaaatatccccagcccaaccgactggctaaacgccttattcggaaacggactgagccgatggatactcggcgtaatcggggtactgctaggcggcctcgcactcttcttcctcatcatgtcgctgttcaagctcggtaccaaacaagtattcagatctcgaacgaagctggcatga

SEQ ID NO: 16384 - RNA, 3222 nt, synthetic construct
  misc_feature 1..3222: note = derived and/or modified CDS sequence (opt11) from SFTSV(JS2011-034)__KC505133.1__GP
  source 1..3222: mol_type = other RNA
atgatgaaagtaatatggttcagttctctcatatgcttcgtcatccagtgcagcggcgactcaggcccgataatctgcgcaggacctatacactccaacaaaagcgctgacatcccccacctcctagggtactcagagaaaatttgccaaatcgatagacttatccacgtatccagctggctccgcaaccactcccaattccaagggtacgttgggcaacgaggaggccgttcacaagtctcatactaccccgctgaaaacagctatagcagatggtcgggactactttccccatgcgacgcggactggctcggcatgctcgtcgtgaagaaggccaaaggctcagatatgatagtaccggggccaagttacaaaggcaaagtcttcttcgagcgtccaacctttgacggttacgtcggatgggggtgcggcagcggcaagagccgcaccgagagcggcgagctgtgctcatccgactccggaacatcaagcggtctcctgcccagtgaccgcgtcctatggattggggatgtagcgtgtcagcccatgacaccgataccggaagaaaccttcctcgagctcaagagtttcagccaaagcgagttccccgacatatgcaaaatcgatggcattgtattcaatcaatgcgaaggcgaatccctcccgcagcccttcgacgtggcctggatggacgtagggcacagccacaagataatcatgcgcgagcacaagaccaagtgggtacaagaatcgtcctcaaaagatttcgtatgctataaagaaggcaccggcccatgctcggaatcagaagagaaaacgtgtaaaacgagcgggagttgcagaggagacatgcagttctgcaaggtagctgggtgtgaacatggggaagaagcctcggaagcaaaatgcagatgcagcctagtccataaaccaggcgaagtcgtagtctcgtacgggggcatgcggattcgcccaaaatgctacggtttctcacgaatgatggccaccctggaagtcaaccagccggaacaacgcatcgggcaatgcacaggatgccacctagagtgcataaacggaggcgtaagactaatcactctgacgtcagaactcaaatcagcaacggtttgcgcaagccatttctgcagcagcgcaacgtccgggaaaaagtcaacagaaatccaatttcactccggaagcctagtaggcaagaccgcaatccacgtaaaaggcgccctggtggacggaacggagttcacattcgaagggtcatgcatgttccctgacggctgcgacgccgtggactgcacgttctgcagagagttcctcaagaacccccaatgctaccccgccaagaaatggctgttcataatcatagtcatactcctcggctacgcaggattaatgctgttgactaacgtcctcaaagcaataggaatctggggatcatgggtcattgccccagtaaaactgatgttcgcaataatcaagaaactcatgcgaacagtatcgtgcctaatgggaaaactcatggaccgagggagacaggtaatacacgaagaaataggcgaaaacagagaaggaaaccaagacgacgtaaggattgagatggcccggccacgcagagtgagacactggatgtactccccagtgatactgacattcctcgccataggattggctgagagctgcgacgaaatggtccacgcagactcaaaacttgtcagttgcagacagggcagcggaaacatgaaagaatgcgtaacgacaggaagggccctactgccggccgtaaacccaggacaggaggcatgcctacattttacagcacccggctccccagatagcaaatgcttgaagatcaaggtcaagcggataaacctgaaatgcaagaaatcaagtagctacttcgtacctgacgcccgcagccgatgcacctccgtacgccgctgccggtgggcgggcgattgccaatccggatgcccaccccatttcacaagtaacagcttcagcgacgactgggccggcaaaatggaccgcgccgggcttggcttctcctgctgcagcgatggatgcggaggggcagcctgtggatgcttcaacgcagcccccagctgcatcttttggcgtaaatgggtcgaaaacccacacggcatcatatggaaagtcagtccgtgcgccgcctgggtaccctccgccgtcatcgaactaactatgccgtcaggagaagtccgaacgttccacccgatgagcggaataccgacccaggtattcaaaggggtgagcgtcacctacctcggctcggacatggaagtcagtgggctcacagacctatgcgagatcgaggaactgaaaagcaagaaactcgccctcgccccatgtaaccaggctggaatgggcgtagttggcaaagtcggggaaatccaatgcagctccgaagaaagcgcacgcacaataaagaaagacggatgcatctggaacgcagaccttgtcggaatcgaactaagagtcgacgacgcagtctgttactcaaaaataacctccgtcgaggccgtagccaactactcagccatcccaacaaccatcggaggactccgttttgagcgctcgcacgacagccagggcaaaatttccggaagccccttagacatcacagcaatcagaggctccttctcagtaaactaccggggactccgcctcagcctcagcgagatcacagccacgtgcacaggagaggtcaccaacgtgtccgggtgctacagctgcatgaccggcgcaaaagtgtccatcaaactacactcttctaagaactccacagcccacgtccgatgcaaaggggacgaaacggctttcagcgtactagaaggggtccacagttataccgtatcattgtcgttcgaccacgcggtcgtagacgaacaatgccaactcaactgcgggggacacgagtcacaagtaacccttaaaggaaatctaatcttccttgatgtcccaaagttcgtggacggcagctacatgcaaacataccacagcaccgtccccaccggagcaaacatcccaagtcccaccgactggctcaacgcactattcggcaacggcctaagtcgatggatactcggagtcataggtgtgctcctaggcggactagccctcttctttatgatcatgagcttgctaaagctaggaaccaaacaagtctacaggtcccgcacaaagctagcttga

SEQ ID NO: 16385 - RNA, 3222 nt, synthetic construct
  misc_feature 1..3222: note = derived and/or modified CDS sequence (opt11) from SFTSV(JS2011-062)__KC505136.1__GP
  source 1..3222: mol_type = other RNA
atgatgaaggtgatctggttcagcagcctaatctgcttagtcatacagtgtagcggtgactcaggcccgatcatatgcgctggaccaatacatagcaacaaatcagcagacatcccccacctactcgggtactcggaaaagatctgtcaaatagaccgactcattcacgtctcctcatggctacggaaccactcgcaattccaaggatacgtcggacaacgcggaggaagatcacaagtgtcgtactaccccgccgtaaattcctattccaggtggtcaggcttgctctcaccctgcgacgccgactggcttggaatgctagtagtcaaaaaggccaaaggaagcgacatgatagtcccggggccctcatacaagggtaaagtcttcttcgaacgcccaaccttcgatggatacgtgggatgggggtgtggctcgggaaaaagccgaacagaaagcggagaactgtgcagtagcgacagtgggacgtcgtccggactgctacccagcaatcgcgtcctctggatcggagacgttgcgtgccaacccatgacacccatcccagaagaaacattcctagaactcaaaagcttcagccaaagcgaattcccagacatatgcaaaatagacgggatagtgttcaaccaatgcgaaggagagagcctaccccaaccattcgacgtcgcctggatggacgtcggacacagccataaaataataatgcgagaacataaaactaaatgggtacaagaatcctcatcgaaagactttgtatgttacaaagaaggaacaggaccatgctcagagtcggaagagaaagcctgtaagacatccggatcctgccgaggcgatatgcaattctgcaaagtcgcaggatgcgaacacggagaagaagcctcagaagctaaatgtcgatgcagtctagtccataaacccggggaagtagtagtatcctatggcggcatgagagtacgcccaaaatgctacggcttctcccgaatgatggcaacactcgaggttaacccgccagagcagcgcataggacaatgcacaggatgccacctagaatgtataaacggaggcgtacgccttataacgctaacctcagagcttaaaagcgcgaccgtctgcgcctcccacttctgctcgtcagccaccagtggcaagaagtccacagagatacagttccactcaggatcactcgtgggaaaaacggccatccacgtaaaaggcgccctggtagacggaaccgagttcacattcgaaggatcatgtatgttcccagacgggtgcgacgctgtagactgcacgttctgcagagaattcttaaaaaacccacaatgctaccctgcgaaaaaatggctattcattatcattgtcatactccttggatacgcaggactaatgctgctcacaaacgtactgaaagccataggcgtgtggggcagctgggtaatagcacctgtcaagctcatgttcgcgataatgaaaaagctcatgagaacagtctcctgcctcatgggaaaactcatagaccgcggccgacaagtcattcacgaagagataggtgaaaacggcgaaggcaaccgggacgacgtcaggatcgaaatggcccgaccgcggcgggtgcgccactggatgtactcccccgtcatactcacaatactcgccatcggcttggctgaaggctgtgacgaaatggtccatgcagactcaaaactcgtatcctgtcgccagggatccggcaacatgaaggaatgcgtcaccacgggccgagcactcctacccgcagtaaaccccggccaggaggcatgcttacacttcacagcacccggaagccccgactcaaaatgcctaaaaatcaaggtgaagcgcattaacctaaagtgtaaaaaaagcagcagctacttcgtccccgacgctaggagcagatgtaccagcgtccgacgctgcagatgggccggcgactgccagagtggttgcccaccccacttcaccagcaacagcttctccgacgactgggccggcaaaatggacagagccggcctcgggttcagcggctgctccgacggctgcggcggagcagcctgcggatgcttcaacgcagccccaagctgcatcttttggcgcaagtgggtggaaaacccccatggcataatatggaaggtctcaccctgcgccgcctgggtgccctcagcagtgattgagctcacaatgccatctggggaggtccgcaccttccatcccatgagtggcataccaacgcaagtcttcaaaggagtctcagtcacatacctgggatcagacatggaggtgagtggactaacggacctatgcgagatcgaggaacttaaaagcaaaaaactagcacttgcaccatgcaaccaggcaggaatgggagtcgtaggtaaagttggagaaatacaatgctcgtccgaagaaagcgcacgaacaataaagaaagatggctgcatatggaacgccgacctagtcgggatcgaactcagagtagacgacgccgtgtgctacagtaagataacatccgtagaagccgtcgccaattactcagcaataccaaccacaattggcggcctacgctttgaacgctcacacgacagccagggcaaaataagcggctcacccctagacatcaccgcaataaggggaagcttcagcgtcaattacaggggactcaggctctcactaagcgaaataacagccacatgcacaggagaagtaacgaacgtgagcggctgctatagctgcatgacaggagccaaagtgtccatcaagctacactcgagcaaaaactcgaccgcacacgtccggtgcaaaggagacgaaacagcattcagcgtcctcgaaggcgtacacagctacacagtcagtctatccttcgaccacgcagtagttgacgaacaatgtcagctcaactgcggaggacacgaaagccaagtcaccctgaaaggcaacttgatctttctcgacgtaccaaaatttgtcgatggctcatacatgcaaacgtatcatagcacggtcccaacaggggcaaacataccatcccccacggactggctcaacgcactgtttggaaacggactcagccgatggatactcggactcataggcgtcctactagggggactagcgcttttcttcctaataatgagcctgtttaaactcggcacaaaacaagtattccggagccgcacgaagctcgcgtga

SEQ ID NO: 16386 - RNA, 3222 nt, synthetic construct
  misc_feature 1..3222: note = derived and/or modified CDS sequence (opt11) from SFTSV(JS2011-109)__KC505139.1__GP
  source 1..3222: mol_type = other RNA
atgatgaaagttatatggtttagctcgctgatatgccttgtcatccagtgcggcggagatactggcccaattatatgcgcgggaccaatacacagtaacaagtcagcagacatcccccacctcctcggatactcggagaaaatatgccaaatagacagactcatccatgtaagcagctggctccggaaccactcacaattccaaggctacgtgggccaaagaggtggccgcagccaagtctcgtattatccagccgaaaattcatatagcagatggtccggactcttaagcccctgcgacgccgactggctcgggatgctagtagtcaagaaagccaaaggcagtgacatgattgtcccggggccctcatacaaaggcaaagtcttcttcgaaagaccaacattcgacggatacgtcgggtggggctgtggttccggcaaatcccgcaccgaaagcggggaactatgctcgtcagactccggaacctcgagcggactcctacccagcgacagagtcttgtggataggagacgtagcctgccaaccgatgacccccataccggaagaaacattcctagaattaaagagcttcagccagtccgagttcccagatatatgcaaaatcgatggaatcgtattcaaccagtgtgaaggcgaatcactcccgcagccattcgacgttgcctggatggacgtaggacacagccacaagataatcatgcgagagcacaaaacgaagtgggtccaagaaagtagcagcaaagacttcgtctgttacaaagaaggcaccggtccatgcagcgaaagcgaggagaaaacgtgcaagacaagtgggtcgtgcagaggcgacatgcaattctgcaaagtagccggatgcgaacacggagaagaagcaagcgaagcaaagtgccgatgcagtctcgtccacaaaccgggcgaagtagtcgtatcctacgggggcatgcgagtccgccccaaatgctacggattctcccgcatgatggccaccctagaagtgaatcaacccgaacaacgcatcgggcaatgcacgggatgccacctagagtgcatcaacggcggcgtgcgtctcatcaccctgaccagcgaactgaagtcagcaacagtttgcgcatctcacttctgcagctcggcaaccagcggaaagaaaagcaccgagatccaattccactccggctcactggtcggaaaaacagcaatacacgtcaaaggcgcgctagtggacggaactgagttcactttcgaaggctcatgcatgttcccggacggctgcgatgcagtcgactgcaccttttgccgcgagttcctcaaaaacccgcaatgctacccggccaaaaagtggcttttcatcataatcgtcatactcctaggctacgcaggcctcatgctgctcacaaacgtcctaaaggcaatcggtgtatggggaagctgggtaatagcgcccgtcaaactggtcttcgcaataatcaagaaactcatgcgagcagtcagctgcctaatgggaaaactcatggaccgcggacgacaggtaatccacgaagaaatcggtgaaaatagagaaggaaaccaggacgacgtacgaatagaaatggcgcgaccccgccgagtacgacattggatgtacagcccagttatactaacaatactcgcaatagggctcgccgaaggctgcgacgaaatggtgcacgcggacagcaagttagtctcatgccgccaaggatccggaaacatgaaggaatgtgtaaccaccggccgagccctactgccagctgtgaacccgggccaagaagcatgcctacacttcacagcgcccggcagcccagactcaaagtgcctaaaaatcaaagtcaaacgcatcaacctaaaatgcaaaaagagctccagctacttcgtacccgacgccaggtcccgatgcacctccgtccgccgctgccgatgggcaggagattgccagagcggctgcccgccccacttcacaagcaacagcttcagcgatgactgggccggaaagatggacagggccgggctcgggttctccggctgctcagacggctgcggcggggcggcatgcggctgcttcaatgcggcaccctcctgtatattttggcgaaaatgggtcgaaaacccacatggcataatctggaaagtctccccgtgcgcagcctgggttccaagcgcagtcatagaactaacaatgcctagcggcgaagtaaggacattccaccctatgagcgggatccccacccaggtatttaaaggagtatctgtcacctatctgggcagcgacatggaagtaagcggactaacggacctttgtgagatagaagaactcaagtcgaaaaagctagcgctcgcgccctgcaaccaagccggaatgggggtagtaggcaaggtcggcgaaatacaatgtagcagcgaagagtctgcgcgaacgatcaagaaagacggctgcatctggaacgcagacctagtcggaatcgaactaagggtagacgacgcggtatgttactcgaaaatcacatcggtggaggccgtggccaactactccgcaatacctaccaccatcggaggcctcagattcgaacgaagccacgactcacaaggcaaaatatccggaagcccacttgacattactgcaatcagaggctcattcagcgtaaactacaggggactgcgactcagcctttcagaaatcacagctacatgcacaggagaagtaacaaacgtctccggctgctacagttgtatgactggggcgaaagtttccataaaactacactcgagcaaaaacagcacagctcacgttagatgtaagggagacgaaaccgccttctcagtactcgaaggggtccatagctacagcgtaagcctatcattcgaccacgccgtagtagacgaacaatgtcagctcaactgcggaggccatgaaagccacgtgaccttaagaggcaacctaatcttcttggacgtccccaaattcgtagacggctcctacatgcaaacctaccacagtaccgtacccaccggggcaaatatcccaagcccaaccgactggctaaacgccctctttggcaacggcctgtcccgatggatactaggggtcattggcgtgctgctcggcggcctcgccctgttcttcctaataatgagtctcttcaaactaggaacgaagcaagtcttccgcagccggaccaaactcgcgtaa

SEQ ID NO: 16387 - RNA, 3222 nt, synthetic construct
  misc_feature 1..3222: note = derived and/or modified CDS sequence (opt11) from SFTSV(JS2011-13-2)__KR230770.1__GP
  source 1..3222: mol_type = other RNA
atgatgaaggtaatatggttcagctcgcttatatgcttagtaatacaatgtggcggcgacacaggcccgatcatctgcgcaggcccgatccactcaaacaaaagcgcagatatcccccatctgctcggatactccgagaaaatatgccaaatcgaccgactgatccacgtcagcagctggctacgcaaccactcgcagttccaaggctacgtagggcagagaggcggcagaagccaggtctcatactatcccgcagaaaactcctacagccgatggagcggcttgttatccccatgcgacgccgattggcttggaatgctggttgtaaagaaagcaaaaggatcagatatgatagtaccggggccgagctacaagggcaaagtatttttcgagcgcccaacattcgacggatacgttggatggggatgcggctccggaaaaagtaggacagaaagcggggaactatgctcctcggactccggaacgtcgagcggactcctgccttcagaccgcgtgctctggataggagacgtggcatgccaaccgatgaccccaatacccgaagagacattcctcgaacttaaatccttctcgcaatcagagttccctgacatttgtaaaatcgacggaatcgttttcaaccaatgcgagggcgagagcctcccccagccgttcgacgtcgcgtggatggacgtcggacactcacacaaaataatcatgagagaacacaaaacaaaatgggtacaagaaagcagcagcaaagacttcgtctgctacaaggaaggaaccggcccgtgctcagaatccgaagagaaaacctgcaaaacctcaggaagctgtcggggagacatgcaattctgcaaagtagcaggatgtgaacacggggaagaagcatcagaagccaagtgccgatgctccctagtacacaagccaggtgaagtagtggtctcatacggaggaatgagagtgcgcccaaagtgttacgggttctcgcgcatgatggcaacactcgaagtgaatcaaccagaacaacggataggacaatgcacaggctgccatctagagtgcataaatggcggtgtccggcttatcaccctaacctcagagctcaaaagcgccaccgtctgtgcgagccacttctgttcttccgccacaagcggtaaaaagtccacggagatacagttccactcaggatccctcgtaggcaaaactgccatccacgtaaaaggcgcattagtagacgggaccgagttcaccttcgaaggctcgtgcatgttccccgacggctgcgacgccgtagactgcacattttgcagggagttcctaaagaacccccaatgctacccagcaaagaaatggctattcatcatcattgtcatcctactcggatatgcaggcctaatgctgctaacgaacgtcctgaaagccattggcgtatggggcagctgggtaatcgcaccggtaaaactggtatttgcaataatcaaaaagctcatgcgagcagtcagctgcctgatgggaaaactgatggatcgcgggcggcaggtaatccacgaagaaataggggaaaatcgcgagggaaaccaagacgacgtacgtatagagatggcgcgaccccgcagggtgcgccactggatgtacagccccgtcatcctcacgatactcgcaatcggcctagcagaaggatgcgacgaaatggtgcacgcggatagtaagttagtctcgtgcagacaggggtcaggaaacatgaaagagtgcgtcaccacgggcagggcccttctgccagcggtcaacccgggccaagaggcatgcttgcattttaccgcaccaggtagcccggactccaaatgcctaaagataaaggtcaaacgcataaacctcaaatgcaaaaagagctcgagctatttcgtaccagacgcaaggagtcgctgcacctcagtacggagatgccgatgggcaggagactgccaaagcggctgcccaccccacttcaccagcaacagtttcagcgacgactgggccgggaagatggacagagccggcctcggcttctcaggctgcagtgacgggtgcggaggggccgcttgcgggtgcttcaacgcagcacccagttgcatcttctggagaaagtgggtcgaaaatccacacgggatcatctggaaagtctcaccctgcgcggcatgggtaccatcagctgtgatcgaactcacgatgccctcaggggaagtgagaacgttccacccgatgagcggaatcccgacacaagtcttcaaaggagtctcggtaacctacttaggctccgacatggaagtgtccggactcaccgacctctgcgaaatcgaagaactcaaatccaaaaagctcgcactagcgccatgcaaccaagcgggaatgggagtagtaggcaaagtcggagagatacagtgcagctcggaagaaagcgcccggacaataaagaaagacggctgcatctggaacgcggatctagtcggcatcgaacttcgagtagacgatgcagtctgctattccaaaataacatcggtcgaagcggttgcaaactactcagccatccctaccaccatcggcggcctcaggttcgaacgtagccacgacagtcaggggaaaatcagcggctctccactggacatcacggccataagaggtagctttagcgtcaactacagaggtctacgcctaagcctaagcgaaataacagccacatgcacaggcgaagtcaccaacgtaagtggctgctacagctgcatgaccggagcaaaagtaagcatcaaactgcactcatccaaaaattccaccgcacacgtccgatgcaaaggggacgaaaccgcgttctcagtcctagaaggagtccacagctactccgttagcctcagctttgaccatgcagtcgtcgacgaacaatgccagctcaactgcggaggacacgagtcgcacgtaaccctaaaaggaaacctgatcttcttagacgttcctaaattcgtcgacgggagctacatgcaaacataccatagcaccgtccccaccggcgcaaacatcccaagccccacagactggttaaacgcactcttcggcaacggcctaagcagatggatactcggcgtcatcggcgtgctactcggaggactagctctcttcttcctaataatgtcccttttcaaactcggaaccaaacaagtgttcagaagccgcacaaaactagcatag

SEQ ID NO: 16388 - RNA, 3222 nt, synthetic construct
  misc_feature 1..3222: note = derived and/or modified CDS sequence (opt11) from SFTSV(JS2011-69)__KR230771.1__GP
  source 1..3222: mol_type = other RNA
atgatgaaagtcatctggtttagctcactcgtgtgcctagtaatccaatgcagcggcgacaccggcccaatcatctgcgccggtccaatccacagcaacaaaagcgcaaatatcccccacctcctcgggtactctgagaaaatctgccaaatagacaggctcatacatgtaagctcgtggctacgaaaccacagccagttccaaggctatgtgggccagcgcggaggccggtcccaagtttcatactaccccgcagaaaatagctacagtcgatggtcaggcctactcagcccctgcgacgcggactggctcggtatgctagtcgtcaagaaagccaaaggatcagacatgatcgtacctggaccgtcatacaaaggcaaagtcttctttgaaaggcccacatttgacggatacgtgggatggggctgcggttcaggcaaaagccgcaccgaaagcggggagctatgcagctccgacagcgggacgtcatcgggactgctcccgtcggacagggtcctatggatcggcgacgttgcctgccaaccaatgaccccgatacccgaagagacattcctagaactaaagagcttcagccaaagtgagttccccgacatctgcaaaatcgacgggatagtctttaatcaatgcgactcagaatcactaccacaaccattcgacgtagcctggatggacgtcggccactcccacaaaatcatcatgcgggaacacaaaaccaaatgggtacaagaatcgagctcgaaggacttcgtatgctataaagagggtacaggcccctgtagtgaatcggaggagaaaacatgcaagaccagcggcagctgtcgaggcgacatgcaattttgtaaagtcgccggctgcgaacacggagaagaggcctctgaagcaaaatgccgatgcagcctcgtgcacaaacctggagaggtcgtcgtcagttacggaggaatgcgcgtgcgcccgaaatgctacgggtttagtcgcatgatggcgaccctagaagtgaacccacccgaacagagaatcggtcaatgcacaggttgccacctagaatgcatcaacggaggagtacgcttaatcacactcacaagcgaactcaaatccgcgaccgtgtgcgcaagccacttctgcagctcagccacaagcggtaagaaaagcaccgaaatccaatttcactcaggaagcctcgtcggcaaagccgcaatccacgtaaaaggcgccctagtagacgggaccgagtttaccttcgaagggagctgcatgtttcccgacggatgcgacgcagtcgattgcaccttctgcagagaatttctcaaaaaccctcaatgctacccagcaaagaaatggctattcatcatcatcgtcatcctactaggatacgccggcctaatgctgctaacaaacgtactcaaagccatcggggtatgggggtcatgggtcatggccccggtcaaacttatgttcgccatcataaagaaactaatgaggagcgtctcctgcttaatggggaagctaatggaccgaggaagacaggtaatacacgaggaaatcggagaaaacagagaaggcaatcaagacgacgtcagaatcgagatggcacgccccagaagagtccggcattggatgtacagcccggttatactaacaatcctagctataggactggcggaaggatgcgatgaaatggtacacgcggactccaagctggtgagctgcagacaaggaagcggcaatatgaaagagtgcgtgacaacgggccgggcgctcctcccagccgtgaacccggggcaagaagcatgtttgcacttcaccgcaccaggatccccagactccaaatgcctaaaaattaaagtcaagcgaataaatctaaaatgcaagaaatcgagcagctatttcgttcccgatgcaagatccagatgcaccagcgtgcgccgatgccgctgggccggcgattgccaaagcggctgcccgagccatttcacatcaaactcgttcagcgacgactgggcaggcaaaatggaccgagctgggctcggtttttcaggctgcagcgacggctgcgggggagccgcctgcgggtgcttcaacgccgccccatcctgcatattctggaggaaatgggtcgaaaacccacacgggatcatatggaaagtctcgccctgcgcagcctgggttccctccgccgtaatcgaactaacaatgccgtccggcgaagtccgtacattccacccaatgagcgggatcccaacccaagtcttcaaaggagtatcagtgacgtacctgggctccgacatggaagtgtcgggcctgacggatctatgcgaaatagaggaactaaaaagcaaaaagctcgctctagcaccatgcaaccaggccggaatgggcgtagtgggtaaggtaggagagatccaatgctcctctgaggaaagcgcacgcacgataaagaaagacggatgcatatggaacgcggacctcgtaggaatagaactcagggtggacgacgcagtctgctattccaaaatcacatcagtagaagcagtagcgaactactcagccataccgacgacgatcggcgggctacggttcgaacgatcgcacgacagtcaaggcaagataagcggctcaccactagacatcaccgccgtaagaggatcattctcagtaaactacagaggactaagactcagcttaagcgagatcactgcaacctgcacgggagaagtaacgaatgtaagcgggtgctacagttgcatgaccggcgcgaaagtgtctattaaactgcactccagtaaaaactcaactgcacacgtcagatgcaaaggagacgagaccgcattctccgtactagagggggtccactcctacaccgtatccctgagctttgaccacgcggtagtagatgaacaatgccagctcaactgcggaggacatgaatcgcaagtgacactcaaagggaacctaatcttcctagacgtgccgaaatttgtggacggatcatacatgcagacataccactcaagtgtaccaaccggggccaacataccgagtccgaccgactggctgaacgcattgttcggcaacggactatctaggtggatactcggagtcatcggggtacttctcggtgtcctcgcgctgttcttcctcatcatgagcctattcaaactcggaaccaaacaggttttccgaagccggacgaaactcgcctaa

SEQ ID NO: 16389 - RNA, 3222 nt, synthetic construct
  misc_feature 1..3222: note = derived and/or modified CDS sequence (opt11) from SFTSV(JS2012-020)__KC505142.1__GP
  source 1..3222: mol_type = other RNA
atgatgaaagtcatatggtttagctccttaatatgcctcgtcattcaatgcggcggggatacgggacccatcatatgtgcaggccccatccatagcaataaatccgccgacataccgcacttacttgggtactcggagaaaatctgccaaatcgaccggctcatccacgtgagttcttggctaaggaaccatagccaatttcagggctacgtaggccagcgaggaggaaggagccaagtatcatactaccccgcagaaaacagctacagccggtggagcggtttactgtcgccatgcgacgccgactggctcggcatgctggtagtgaagaaagcgaaaggctcagacatgatcgtacccggaccatcgtacaaaggcaaagtctttttcgaacgaccaacattcgatggatacgtcggatggggctgcggcagcggaaaatccaggactgaaagcggagaattatgctccagcgacagcggcacctcaagcgggcttctaccctcagatagagtattatggataggcgacgtcgcctgccagccgatgactccaatccccgaggaaacgttcctagaacttaaatcattctcgcaatccgagttcccggacatatgcaagattgacggaatagtctttaaccaatgcggaggggaaagcctaccccagccattcgacgtagcctggatggacgtagggcacagccacaaaataataatgagagaacacaaaacaaaatgggtccaggaaagcagcagcaaagacttcgtctgctacaaggaaggcaccggaccatgctcagaatccgaagaaaagacctgcaagacgtccggctcctgccgaggtgatatgcagttctgcaaagtggccggatgcgagcacggcgaagaagcctcagaagcaaaatgccgttgtagcctcgtccacaaaccgggagaggtcgtcgtatcatatggaggaatgcgcgtaggcccgaaatgctacgggttctcgcgcatgatggcaaccctggaagtcaaccaaccggagcaacgcataggacagtgcaccggctgccatctcgaatgcatcaatggaggcgtgcggctaataaccctaacatccgaactaaagagcgccaccgtctgcgcgagccacttctgctcaagcgcaacatccgggaagaagagtacggaaattcagttccactcgggaagtctagtgggcaaaaccgcaatacacgtcaaaggcgcgcttgtcgacggcacggagttcaccttcgaaggcagctgcatgttcccagacggatgcgacgcagtagactgtacattttgccgggagttcctcaaaaatccacaatgctacccagcgaagaaatggctatttatcatcataataatcctattaggatacgcaggactcatgctcctcacaaacgtactcaaagcaatcggagtctgggggagttgggtcatagcacccgtcaaactcgtgttcgccatcatcaaaaagctcatgcgagcagtcagttgcctgatgggaaaactaatggatagaggaagacaggtaatacacgaggaaataggcgaaaacagagaaggaaaccaggacgatgtcagaatagaaatggcaagaccaagaagagtaaggcactggatgtactccccagtcatcctaacaatactagccatcggactcgccgagggatgcgacgagatggtacacgcggattccaagctggtaagctgcaggcagggctccggaaacatgaaagaatgcgtaacgaccgggcgagccctcctaccggcagtaaatccagggcaggaggcatgcctacacttcaccgctcccgggagtccagacagcaaatgtctcaagataaaggtaaagcgtataaacttaaaatgtaaaaagtcctcaagctacttcgtacccgacgctagaagcagatgcacctcagtaagaagatgccgatgggcgggcgactgccaatcaggctgcccgccccacttcaccagcaacagtttcagcgacgactgggcaggaaagatggaccgagcgggcctcgggttctctggctgctccgacgggtgcgggggagcagcgtgcggatgcttcaacgccgcaccaagctgcatcttctggcgaaagtgggttgagaacccacacgggatcatctggaaggtcagcccatgcgcagcctgggtccccagcgccgtgatagaactaactatgccgtctggcgaagtgcgcacattccaccccatgagcgggattccgactcaagtcttcaaaggagtcagcgtaagttacctcggcagcgacatggaagtatcaggcctaacagatctgtgcgaaatcgaggaactgaaaagcaagaaactagcgctcgccccgtgcaaccaggcagggatgggggtcgttggaaaagtcggggagattcaatgtagctcagaagagagtgcgcgaaccataaagaaagacggatgtatatggaacgcggacctcgtaggaatagaactccgagttgatgacgcggtctgctactcgaaaataaccagcgtagaagcagtcgccaactactcggcaatcccaacaacgataggaggcctaagattcgagcgctcacacgacagccaaggaaaaatatcgggctcaccactcgatataactgccatcaggggctcgttttcagtcaactacaggggcctccgtctgagcctaagcgaaataacagcgacctgcacgggagaagtcacaaacgtaagcggttgctacagttgcatgactggagcaaaagtaagcataaaattgcacagcagcaaaaactcaacagcacatgtacgctgcaaaggggacgaaaccgccttttcagtcctagaaggggttcacagctacagcgtgtcgctcagttttgaccacgcagtcgtagacgaacaatgtcaactcaactgcggaggacacgagtcacacgtaaccctgaaagggaacctaatcttcctcgatgtcccgaaattcgtagacgggtcctacatgcaaacataccacagcacagtccccactggggcaaacattccaagcccgaccgactggctgaacgcactcttcggaaacgggctgagtcggtggatccttggtgtgataggggtgctgcttggaggcctcgccctcttcttcctaatcatgtccctgttcaaactcggcaccaaacaagtgttccgaagccggacaaaactcgcataa

SEQ ID NO: 16390 - RNA, 3222 nt, synthetic construct
  misc_feature 1..3222: note = derived and/or modified CDS sequence (opt11) from SFTSV(JS2012-035)__KC505145.1__GP
  source 1..3222: mol_type = other RNA
atgatgaaagtcatctggttctcctcccttatctgcctagtaatccaatgcggcggagacaccggaccgatcatatgcgccggccccattcactccaacaagtccgcagacatcccccacctactaggatactctgaaaagatatgtcaaatagataggctcatacacgtctcctcctggctacgcaaccactctcagttccaagggtacgtaggccagcgcggcgggcgaagccaggtaagctactatcccgcagagaacagctattcaagatggagcggcctactctcaccgtgtgacgccgactggctaggaatgctagtagtgaagaaagccaaaggctcggacatgatagtgccggggccaagctacaaaggcaaagtattcttcgaaagaccaacctttgacggatacgtcggctggggatgtggcagcggcaaaagccggaccgaaagcggagaactatgcagcagtgactcgggcaccagctcaggactactgccctcagaccgcgtgctgtggatcggggacgtcgcctgccagcccatgacccccatcccagaggaaaccttcctcgagctaaaaagtttctcacaatccgaatttccagatatctgcaaaatcgacggcatagtattcaaccaatgcgagggcgagagcctcccccaaccctttgacgtcgcctggatggacgtcggccactcacacaaaatcataatgcgcgaacacaaaacaaaatgggtccaagaatcgagctcaaaagacttcgtctgttataaagaaggcaccgggccatgctcagaaagcgaggagaaaacgtgtaaaacctcagggagctgccgaggcgacatgcaattttgcaaagtagccggctgcgaacacggggaagaagcgtcagaagcaaaatgccgctgcagcctggtacacaaacccggagaagtggttgtctcgtacggcggtatgcgcgtacgccccaaatgctacggattctcacgcatgatggcaaccttgggagtcaaccagccagagcaaaggataggccagtgcaccgggtgccacctggaatgcataaacgggggcgtacgtctaatcacactaacgagtgaactaaaaagcgcgacagtgtgcgcgtcgcacttctgctcatccgctactagcggaaagaagtccacagaaatccaatttcactccggaagcctggtaggaaaaaccgcgatacacgtaaaaggagccctagtggacgggacagagttcacattcgaagggagctgcatgttcccagacggctgcgacgccgtagactgcacattctgtcgagagttcctgaaaaacccccagtgctaccccgcaaagaaatggttattcattatcatagtaattctcctcggctacgccggattaatgctgctgaccaacgtcctcaaggccataggggtatggggaagctgggtcatcgcaccagtaaagctcgtcttcgccataattaaaaagctaatgagggcagtatcgtgcctgatgggaaagctcatggaccgcggccgccaagtaatccatgaagaaataggcgaaaaccgagaaggcaaccaagacgacgtacgcatcgagatggcccgaccccgaagggtcagacactggatgtactccccggtcatcctcaccatcttagcaatcggcctagccgaaggctgcgacgaaatggtacacgcagactccaagctagtcagctgcagacaaggaagcggcaacatgaaagaatgtgtaactaccggacgggccctcttaccggccgttaacccaggccaagaagcatgcctccacttcaccgcccctggatcaccagactcaaaatgcctcaaaataaaggtgaaaagaataaacctcaaatgcaaaaagagctcaagctacttcgtcccagacgcccgctcccgatgcaccagcgtaagaagatgcagatgggcaggagactgccagagcgggtgcccgccgcacttcacaagcaacagcttctccgacgactgggctggcaagatggatcgcgccgggctaggattctccggctgcagcgacggctgcgggggagccgcttgcggctgcttcaatgcggcccccagctgcatattttggagaaaatgggtggaaaacccccacggaataatctggaaggtatccccatgcgcagcctgggtaccgtccgccgtcatcgagctcacaatgccaagcggagaagttcgaacattccaccccatgtcagggataccgacacaagtctttaaaggagtcagcgtcacctacctgggatccgacatggaagtatccggactaaccgacctatgcgagatagaggaattaaaatcgaaaaagctagccctagcaccctgcaaccaagcaggcatgggagtagtaggcaaggtaggcgaaatccaatgcagctctgaggaatcagcacgcaccatcaaaaaggacgggtgtatctggaacgcagacctggtaggaatcgaactccgggtagacgacgcagtatgctacagcaaaatcaccagcgtagaagcagtcgcaaactacagcgcgatcccaaccaccataggaggactccgattcgagagaagtcatgactcacagggcaaaataagcggatcaccgctggacataactgccatccggggaagtttcagcgtcaattacagaggcttacgcctcagcttatccgagataaccgcaacgtgtactggagaagtcacaaacgtgtcaggctgctactcctgtatgacaggcgcaaaagtcagtataaaattgcactcctcgaagaactcgaccgcccacgtaagatgcaagggtgacgaaacagccttcagcgtactcgagggagtacactcatacagcgtctcactcagcttcgatcacgccgtggtagacgaacagtgccagctgaactgcggcggacacgaatcacacgtaacactgcgaggaaacttaatcttcctcgatgttccaaaattcgtggacgggtcctatatgcaaacctaccacagcacagtcccaacaggcgctaacatccccagtcccaccgattggcttaacgcacttttcggcaacggcctatctcgatggattctcggtgttataggagtacttctgggcgggctcgccctcttcttcctcatcatgagcctgttcaaactcggcacgaaacaagttttccgctcacgaacaaaactcgcatga

SEQ ID NO: 16391 - RNA, 3222 nt, synthetic construct
  misc_feature 1..3222: note = derived and/or modified CDS sequence (opt11) from SFTSV(JS2012-79)__KR230772.1__GP
  source 1..3222: mol_type = other RNA
atgatgaaagtaatatggttcagcagcctaacatgcttcgtcattcaatgcagcggggactccggaccaataatatgcgcgggtccaatccacagcaacaaaagcgcagatataccacatctgctcggatacagcgagaaaatctgtcaaatcgaccgactgatacacgtctcctcatggctccgaaaccacagccaattccaaggatacgtcggccagcgcggcgggagaagtcaagtctcatactacccagcagaaaattcctacagtcgctggtcgggcctactttcaccctgtgacgcagactggctagggatgctagtcgtgaagaaagccaagggatccgatatgatagtccccggtccaagctacaaaggcaaggtgtttttcgaaagacccacctttgacggctacgttgggtggggctgcgggagcggcaaaagccggacagaaagcggtgagctgtgctcaagcgacagtggtacctccagcggactcctccccagcgacagagtcctctggataggcgacgtcgcatgccaaccaatgaccccgattcccgaagaaaccttccttgaactcaagagtttctctcaaagcgagttcccagacatatgcaaaatcgacggcatcgtctttaaccagtgcgaaggcgagagcctcccacaaccattcgacgtcgcatggatggacgtgggccactcacacaaaataataatgcgagagcacaaaacaaagtgggtccaggaatcgtcaagcaaagacttcgtgtgttacaaagagggcaccggcccgtgctcagaatcggaagagaaaacatgcaagacctccggatcgtgcagaggcgacatgcagttctgcaaagtagcaggatgcgaacacggagaagaagcatcagaagcaaaatgccgttgtagtctggtccacaaaccaggcgaagtcgtggtttcgtacgggggcatgcgaatacgacccaaatgctacgggttctcccgtatgatggccactctcgaagtaaaccagccagaacaaagactcggccaatgcacaggatgccaccttgaatgcataaatggcggagtccgtctaattaccctgacgagtgagctaaagagcgcaaccgtctgcgcgagtcacttctgcagcagcgcaacgagcggcaaaaagagcacagagatacaattccactcaggaagcctcgtcggaaagaccgccatccatgtaaagggagcacttgtggacggcaccgaatttaccttcgaaggatcatgcatgttccctgacggatgcgacgcggtggactgcacattttgcagggaatttctcaagaacccgcagtgctaccccgccaagaaatggctattcataattatcgtgatactgctcgggtacgcaggacttatgctattgacaaatgtacttaaagccattggaatctggggaagctgggtcatagcacctgtcaagctaatgttcgcgataatcaagaaactgatgagaacggtctcgtgcctaatgaggaaactcatggatcgtggtcgtcaggttattcacgaggagataggcgaaaacagggaagggaaccaggacgatgtcaggatcgaaatggctcgcccgcgcagagtccgacactggatgtacagcccggtgatcctgaccatcctggcaataggattagcagaaagctgtgatgaaatggtacacgcagactcgaaactcgtatcctgccggcagggcagtggcaacatgaaagagtgcgtgacaaccggacgggccctactgtcagcagtaaacccgggccaggaggcatgcctacacttcactgcacccggatcacctgactcaaaatgtctaaaaataaaagtgaaacgcatcaacctgaaatgcaaaaagagctcgagctatttcgttcccgacgcgagaagccgctgcacaagcgtaaggaggtgtaggtgggcgggcgactgccaaagcggatgtcccccgcactttacgtccaactcattcagcgacgactgggccggcaaaatggaccgagccggcctcgggttctcaggatgcagcgacggctgcggcggcgcagcctgcggttgcttcaacgccgccccctcgtgcatcttttggaggaaatgggtagaaaacccccacggtataatctggaaagtaagcccctgcgccgcatgggtgcccagcgcagtcatagaactaacaatgccaagcggggaggtacgaacgttccacccaatgagtggtataccaacacaagtattcaaaggtgtctcagtaacctacttaggcagtgacatggaagtaagcgggctcacagacctgtgcgaaatcgaggaattgaaatcaaagaaactagccctagccccttgcaaccaggccggcatgggggtagtggggaaagtaggagaaatccaatgcagcagcgaagagagcgctcgcacaatcaagaaggacggatgcatctggaacgcggacctcgtagggatagaactacgggtagacgacgcagtgtgctactcaaaaataacctcggtagaagccgtagctaactacagcgcaataccaacaacgattggcggactcagattcgagagatcccacgacagccaaggaaaaatcagcggatcacctttagacataacggcaataagaggcagcttctcagtcaattacaggggcctgagactgagcctttcggagataacggctacctgcacaggcgaggtgacgaacgtaagcggttgctacagctgcatgaccggagcgaaagtctccatcaaactacactccagcaagaactcaacagcacacgtccgctgcaaaggcgatgagacagccttctccgtcctagaagggggccacagctacaccgtgagcctatccttcgaccacgccgtagtcgacgagcaatgccaactcaattgcgggggacacgaaagccaagtcacactaaaaggaaacctaatcttcctcgacgtcccgaaattcgtagatggcagctacatgcagacgtatcacagcaccgtaccgacaggagcgaacatacctagcccaaccgactggctaaatgcactgttcggaaacggactaagccggtggatattaggagtcataggagtgttactcggaggcctcgcactcttctttatgatcatgagcctgttcaagctcgggacaaagcaagtattccggagccgcaccaaactcgcgtaa

SEQ ID NO: 16392 - RNA, 3222 nt, synthetic construct
  misc_feature 1..3222: note = derived and/or modified CDS sequence (opt11) from SFTSV(JS2013-44)__KR230773.1__GP
  source 1..3222: mol_type = other RNA
atgatgaaggtaatatggttcagttcactaatatgcttcgtaatacaatgcagcggggacagcggtccaatcatctgcgcaggaccaattcacagcaacaaatcagccgatataccccacctcctaggctactctgaaaagatctgccaaatcgacaggctaatccacgtctccagttggctacgaaaccactcacaattccaagggtacgtcgggcaaagagggggccggagccaagtcagttactaccccgccgaaaacagttacagccgctggtcgggtctgctaagcccctgtgacgcggactggctaggaatgctcgtcgtgaagaaagcaaaaggctcagatatgatcgtacccggaccctcatacaaaggtaaagtcttctttgaaagaccaacgttcgacggatacgtaggctggggatgcggctccggcaaaagtaggacagaaagcggggaactctgcagctccgacagtggcacctcaagcggcctcctaccctcagaccgagtattatggatcggggacgtggcatgccaacctatgacaccgatccccgaagaaacgttcctagaactcaagagcttctcgcaaagtgagttccccgacatctgtaaaatcgacgggatcgttttcaaccaatgcgaaggcgagagcctgccacaaccattcgacgtcgcctggatggacgtcgggcactcccacaaaatcattatgcgagagcacaaaacaaaatgggtccaggaatcatccagtaaagactttgtatgctataaagagggcaccgggccgtgcagcgagtcagaagagaaaacgtgcaaaacaagtggcagctgtcgcggggacatgcaattctgcaaagtggcagggtgcgaacacggggaagaaacctccgaagcaaaatgccgatgcagtctggtacacaaacccggagaggtagtagtgagttacggcggaatgaggatacgcccaaaatgctacggattttcgcgaatgatggcaacactggaagtgaatcaacccgaacaacgactaggccaatgcacagggtgccacctagaatgcatcaacggaggggtacgtctgatcactctgaccagcgaactaaaaagtgcgaccgtgtgcgcgagccacttctgctcctcagctaccagcggaaagaaaagtaccgaaatccaatttcacagcgggagcctagtcggcaaaaccgccatacacgtaaaaggagccctagtagatggcacagaatttaccttcgaaggctcatgcatgtttccggatggctgtgacgccgtagactgcactttctgccgggagttcctcaaaaacccgcagtgttacccagcgaagaaatggctattcatcataatagtgatcctactaggctacgccggactaatgctgctcacaaacgtactaaaagcaataggcatctggggaagctgggtaatagcccccgtcaaactgatgttcgcaatcatcaagaaactcatgaggacagtctcttgccttatgagaaaactcatggaccgcggaaggcaagtgatccacgaagaaatcggcgaaaaccgagaaggcaaccaagacgacgtgcgcatcgaaatggctcggcccagacgcgtccgacactggatgtacagcccagtaatcctcaccatcctggcaatcggacttgcggagagttgcgacgagatggtgcacgcagacagcaaactcgtatcctgcagacaaggaagcggaaacatgaaagaatgcgtaaccacagggagagccctactgcctgctgtcaatccaggacaagaggcgtgcctacatttcaccgcccccggaagccccgactcgaaatgcctgaaaatcaaagtcaaacgaataaacctaaaatgcaagaaaagtagctcctacttcgtccccgacgcgcgcagccgatgcaccagtgtaagacggtgccgatgggccggcgactgccaaagtggatgcccaccccactttacctcaaacagcttctccgacgactgggcaggaaaaatggaccgggcgggcctcggattcagcggctgctcggacggctgcggcggcgcagcatgcggctgcttcaacgcagccccctcatgcatattctggcgaaaatgggtagaaaacccccacggaattatctggaaagtcagcccctgcgcagcatgggtacccagcgcggtgatcgaactaacaatgccaagcggagaagtacggacattccatccaatgtcggggattcccactcaagtattcaaaggggtctcggtaacgtacctaggaagcgacatggaagtctccggtcttaccgacctctgcgagatcgaggaacttaaatccaagaaactcgcgctagccccctgcaaccaagccggaatgggagtcgtaggcaaagtcggggaaatacaatgcagctcagaagagagcgcccgcacgataaagaaagatgggtgcatctggaacgccgacctcgtcggtatagaactcagggtggatgacgccgtctgctactcaaagattacatctgtggaagcagtggcaaactattccgcgatccccacgaccataggcggcctccgcttcgaaaggagccacgacagccaaggcaaaatctcaggcagccccctagacatcagcgccatcagaggctcattcagcgtcaactatcgcggcctacgtctcagcctcagcgagatcactgccacatgtacaggcgaggtaacaaacgtctctggttgctactcctgcatgacaggtgccaaagtctcaataaaacttcacagcagcaaaaacagcaccgcgcacgtacgctgcaaaggagacgaaactgcattctcagtactagagggagtccactcgtacattgtatcactcagcttcgaccacgcggttgtcgacgaacaatgtcagctgaattgcggcggtcatgaaagtcaagtaaccctcaagggaaacttaatcttcctagatgtcccaaaattcgtcgacggctcgtacatgcaaacataccacagcaccgtcccaaccggagcaaacatcccgtccccgacagactggctgaatgcactcttcggtaacggcctatcacgctggattctaggcgtaatcggagtactcctaggcggattggcactattcagcatgattatgagcctcttcaaactcggaaccaaacaagtattccggtcccgcacgaaactcgcctaa

SEQ ID NO: 16393 - RNA, 3222 nt, synthetic construct
  misc_feature 1..3222: note = derived and/or modified CDS sequence (opt11) from SFTSV(JS2013-46)__KR230774.1__GP
  source 1..3222: mol_type = other RNA
atgatgaaagttatatggtttagctcactaatatgcttagtcatccagtgcggcggagacacaggtccgataatatgcgcaggcccaatccatagcaataagtccgctgacataccccacttgctcgggtactcagagaaaatatgccaaatagacaggcttatccacgtgtcgagctggctacgcaaccattctcaatttcaagggtacgtgggccagcgtggaggaaggtcccaggtctcctactacccggcggaaaatagctacagccggtggtcagggcttctctccccctgtgacgccgactggctagggatgctggtcgtgaaaaaggcaaaagggagcgacatgatagtaccaggtccttcgtacaaaggaaaggtatttttcgaacgcccaacattcgacgggtacgtaggctggggctgcggtagcggcaagagtcgtaccgagagcggtgaactatgctctagcgacagtggcacctcaagtggactcctaccaagcgacagagtactctggataggtgacgtcgcatgccagccgatgaccccgatcccagaggaaacattcctagagctcaagagtttcagccaatccgagttcccagacatttgcaaaatcgacggcatcgtcttcaaccagtgcgaaggcgagagcttaccccaacccttcgacgtagcctggatggacgtcgggcactcacacaagatcataatgagggagcataaaacaaaatgggtccaagagtcaagttcgaaagacttcgtctgctacaaagagggaacgggcccatgttcggaatcagaggagaaaacatgcaagacttcaggctcctgtagaggcgacatgcaattctgcaaggtagcagggtgcgaacacggagaagaagcatcagaagctaaatgccgctgtagcctagtccataagccgggcgaagtcgtggtaagctacggtggtatgcgcgtacgcccgaagtgctacggattctctagaatgatggcgaccctggaggtcaacgagcccgagcaaagaatcggacaatgcaccggctgccacctagaatgcataagtggaggagtacgtctgataacactaacgagtgaactcaaaagcgccacagtgtgcgcatcccacttctgctcctcagccacatccggaaagaaatccacagaaatccaattccactcgggttcgctagtgggaaagacagcaattcacgtcaaaggagcgctagtggacggcaccgagttcacattcgaaggatcgtgtatgttccccgacggttgcgacgccgtggactgcactttttgccgcgagttcctcaagaatccccaatgttacccagccaagaaatggcttttcatcataatcgtgatcctgctaggatacgcaggcctgatgctgctaacaaacgtcctaaaagccatcggagtctgggggagctgggtaattgccccggtaaagctagtattcgcgatcataaagaaacttatgcgcgcagtctcatgcctgatgggaaaactaatggacagaggacgacaagtcatacacgaagaaataggcgaaaaccgagaagggaaccaggacgacgtacgcattgaaatggcgagaccacgccgagtccgacactggatgtacagccccgtaatactaacgattctggcgatgggcctcgccgaagggtgcgacgaaatggtacacgcggatagcaagctagtatcatgcaggcaaggaagcggcaacatgaaagaatgcgtaaccacgggcagagcactgctcccggcagtcaacccgggccaggaagcgtgccttcactttatggcgcctgggagccccgactcaaaatgcctcaaaatcaaagtgaaacgcataaacctcaaatgtaagaaaagctccagctatttcgtgcccgacgccaggtccagatgcacaagtgtacgacgctgcagatgggctggagattgccaaagcggatgcccgccacatttcactagcaatagcttcagcgacgactgggccgggaaaatggacagggccgggctaggtttctccggatgctccgacggatgcggcggggcagcctgcgggtgcttcaacgcggccccgagttgtatattctggaggaagtgggtagagaacccccacgggatcatatggaaagtatcgccctgcgcggcttgggtaccctcagctgtaatagagctcactatgcccagcggcgaagtacgcaccttccaccccatgagtggaatcccgacccaggtcttcaaaggtgtcagcgttacgtacctcggcagcgatatggaagtcagcggactgacggacttgtgcgagatagaggaactcaagtccaaaaagctcgcacttgccccatgtaatcaagccggtatgggggtagtgggcaaggtaggagagatccaatgctcatccgaagaaagcgcccgcacaataaagaaagacggatgcatatggaatgcagacctcgtaggcatcgaactaagagtagacgacgcggtatgctactccaaaattacctcagtcgaggccgtcgctaactactcggccatacccacgaccataggcggcctacgtttcgaaagaagccacgacagccagggaaaaatcagcggctcgcctctcgacataaccgcaattaggggaagtttctcaataaactaccggggcctgcgtttgagcttaagcgaaatcagcgcgacatgcacgggggaagtaacgaacgtaagcgggtgctactcctgcatgaccggggcgaaagtaagcattaaactacacagcagcaaaaactcgacagcacacgttcgctgcaaaggagacgaaacagcgttcagcgtcctcgaaggagtccacagctactccgtgagcctgagctttgaccacgctgtagtagacgaacagtgccaactaaactgcgggggtcacgaatcgcaagtcaccctaagaggaaacctgatctttctagatgtcccaaaattcgtagacggatcgtacatgcaaacctaccacagcacggtcccgacgggggccaacatcccgagccccaccgactggttgaacgcactcttcggcaacggactctccagatggatactaggtgtcatcggcgtgctactaggcgggctcgcactcttcttcctaattatgtccctattcaaattaggaaccaaacaggtgttccgaagccgaaccaaactagcgtaa

SEQ ID NO: 16394 - RNA, 3222 nt, synthetic construct
  misc_feature 1..3222: note = derived and/or modified CDS sequence (opt11) from SFTSV(JS2013-52)__KR230775.1__GP
  source 1..3222: mol_type = other RNA
atgatgaaagtcatctggttctcctccttaatatgcttcgtcatccaatgctccggcgactcaggccccatcatctgcgcaggccccatccactccaacaagtccgcagatatccctcacctccttggctactcagagaaaatctgccagatagacaggctcatccacgtaagcagctggctacgtaaccactcacaattccaaggatacgtaggtcagcgcggaggcagaagccaggtcagctactacccagcagaaaacagttatagccgatggtctgggttactaagcccctgcgacgcagactggttggggatgctagtcgttaagaaagcaaaaggatcagacatgatagtacccggccccagctacaaaggaaaagtcttcttcgagcggccaacattcgacggatacgtaggatggggctgtggatccggcaaaagccgaaccgagtccggcgagctatgctcaagcgacagcggaacctcatccggcctactaccatcagaccgcgtcctgtggatcggcgacgtagcctgccagccaatgacccccatccccgaagaaaccttcctagaacttaagagcttcagtcaaagcgagttccccgacatctgcaaaatcgacggcatcgtcttcaaccaatgtgaaggagaaagcctcccgcagcccttcgacgtcgcttggatggacgtcggacattcacacaaaattataatgagggaacataaaacgaaatgggtccaagaaagtagctcaaaggacttcgtatgctacaaagagggcacaggaccgtgctcagagtcggaggagaaaacatgcaaaaccagcggctcctgcagaggagacatgcaattctgcaaagtggcaggatgcgagcacggggaggaagcatccgaagctaaatgccgctgctccctcgtccacaagccaggggaagtcgtagtatcctacgggggaatgagagtgcgacccaaatgctacggcttcagccgcatgatggcaaccctcgaagtaaaccagcccgaacaacggatagggcagtgtaccggctgccacctcgaatgcatcaacggaggtgtgcgcctaatcacactaacctccgaactcaaaagcgccaccgtctgcgccagccacttctgctcctcagcaacgagcggcaagaaaagcaccgaaatccaattccacagcggaagcctagtcggcaaaaccgccatacacgtaaagggcgccctcgtagacgggacagagttcaccttcgagggctcctgcatgttccccgatggatgcgacgcagtagactgcacgttctgcagagagttcctaaagaacccacaatgctacccggcaaagaaatggctattcatcataatcgtaatactacttggctacgccggcctaatgctactcacaaacgtactcaaagccatcggaatatggggaagctgggtcatagcacccgtcaaactcatgtttgcgatcatcaagaaacttatgcgcaccgtaagctgcttaatgggaaaattgatggaccgcgggagacaagtaatccacgaagaaatcggagaaaatcgcgaaggaaatcaagacgacgttagaatagaaatggcaaggccccgtagagtccgacactggatgtatagccccgtgatcctcacatttctagccataggactagccgaatcatgcgacgaaatggtacacgccgactccaagctagtcagctgcagacagggatccggaaacatgaaagaatgcgtcaccaccggccgagccctgctcccagcggtcaacccgggacaagaagcctgcctgcacttcacagcgcccggcagtccagacagtaaatgtctgaaaatcaaagtgaaaagaattaatctaaaatgcaagaaatcatcaagctacttcgtaccggacgccagaagcagatgcacctccgtacgacgctgtcgatgggccggcgactgccaaagcgggtgcccgccccacttcacatccaactcattcagcgacgactgggcaggaaaaatggacagggcaggactaggcttttctggctgtagcgacggatgcggcggggccgcatgcgggtgcttcaatgcagctccatcatgtatcttctggcggaaatgggttgagaacccgcacgggataatctggaaggtctcaccctgcgcagcatgggttcccagcgcggtgatagaattgacaatgccaagtggcgaagtccgaaccttccaccctatgtctggcatcccgacacaagtgttcaaaggagtcagcgtcacttaccttggcagcgacatggaggtaagcgggctcaccgacctctgcgaaattgaggagcttaaaagcaaaaagctagcgcttgctccctgcaaccaagccgggatgggagtcgttggcaaagtcggagaaattcaatgctcaagcgaagaaagcgctcgcacaataaagaaagacggatgcatctggaacgcggacctggtcggaatagagctacgggtcgacgacgccgtttgttacagcaaaatcacctccgtcgaagccgtggccaactactctgccatcccaacaaccatcggcgggctcagattcgaacgctcccatgactcacagggaaaaatctccggctctccactcgacataacagccatccgcggatccttcagcgtaaattacagaggactgcgcctgagtctcagcgaaataaccgccacgtgcacaggagaagtaacaaacgtctctggttgctactcctgcatgaccggagccaaagtcagcataaaactccactccagcaaaaactcaacagcacacgtacgatgcaaaggagacgaaaccgccttctcagtcttagaaggcgtacactcatacacagtctccctaagtttcgaccacgcggtagtcgacgagcagtgccaactaaactgcgggggccacgaatcacaagtaacactgaaggggaatctcatattcctcgacgtgccaaaattcgtcgatgggtcttacatgcaaacttaccacagcaccgttccaaccggagccaatataccaagcccgacagactggctaaacgcactattcgggaatggcctttcacgatggattctaggagtaatcggtgtcctattaggcgtcctagccctatttttcttgataatgagcctgttcaaactagggacaaaacaagtattccgaagccgcaccaagctcgcataa

SEQ ID NO: 16395 - RNA, 3222 nt, synthetic construct
  misc_feature 1..3222: note = derived and/or modified CDS sequence (opt11) from SFTSV(JS2013-69)__KR230776.1__GP
  source 1..3222: mol_type = other RNA
atgatgaaagtgatatggttctcctcactaatatgctttgtcatccaatgcagcggagactccggcccaataatctgcgccggacccatccacagcaacaaaagtgccgacatcccccacctactaggctacagcgagaagatctgccaaatcgaccgtctaatccacgtcagcagctggcttaggaaccactcacaattccaaggatacgtaggccaacgcggaggccgctcgcaagtatcctactaccctgccgaaaactcatactcacgctggagcggactactcagcccatgcgacgcggactggctagggatgctggtcgtcaaaaaggccaaaggatccgacattatcgtaccaggcccttcctacaaggggaaggtattctttgaaagacccacatttgacggatacgtcggatggggatgtggaagcggaaagtcccgaaccgaatcaggcgaactctgcagctcagacagcggaacgagctccggactgctcccaagcgatcgagtcctgtggattggcgacgtggcgtgccagccaatgacacctatacccgaagaaaccttcctagaactcaagtctttctctcagtcagagttcccggacatctgcaaaattgatggaatcgtgttcaaccaatgcgaaggagagagcctcccccaaccattcgacgtcgcatggatggacgtcggacactcacacaaaatcatcatgcgcgagcacaagacaaaatgggtacaggaatcctctagcaaggacttcgtctgctacaaagaaggcaccggaccgtgctcagaatctgaggagaaaacttgcaaaacatcagggtcatgccgcggagacatgcagttttgtaaagtagcaggatgcgaacatggcgaagaagcgtccgaagcgaaatgccgctgctccctcgtgcacaagccgggggaagtggtggtctcttatgggggaatgcgggtccgcccaaaatgctacggcttctcacgaatgatggcaacgctagaagtcaaccagcccgaacagagacttggccaatgcactggatgccacctggagtgcatcaacggcggcgtgcgcctcattaccctcacctcagaactaaagagcgccaccgtctgcgcatcacacttctgcagctccgcaacgtcgggcaaaaagagtaccgaaatacagttccacagcggatccctagttggcaagaccgccatccacgtaaagggggcactcgtagacggaaccgagttcacactggaatctagctgcatgttcccagacggctgcgacgccgtagactgcacgttctgccgagagttcctgaagaacccacaatgctatccggcgaagaaatggctattcatcataatagtcatcctcctcgggtacgcagggctcatgctactaacaaacgtgctgaaagccattggtatatggggctcgtgggtaatcgcccccgtcaaattaatgttcgctatcatcaagaagctaatgaggacagtcagctgcctcatgcgcaaactcatggacagaggccgccaagtcatccacgaagaaataggagaaaaccgagaaggtaaccaagatgacgtccgcatcgaaatggcgagacccagacgagtccgccactggatgtactcacccgtaatcctgaccatccttgcgataggcctcgccgaaagctgcgacgaaatggtccacgcggacagcaaactggtcagctgcagacaaggctcaggtaatatgaaagagtgcgttaccacaggaagggcattgctaccagctgtcaatcccggacaagaggcctgcctacactttacggccccggggagccccgacagtaaatgcctaaagataaaggttaaacgcataaacctaaaatgcaaaaagtcatcctcctatttcgtgccggacgctcgatcacgctgcacatcagtgaggagatgccgatgggctggtgactgccaatcaggatgtccaccgcacttcacttcaaacagcttctcagacgactgggcgggaaaaatggatagagccggtcttggattctcaggctgcagcgacgggtgcggaggcgcagcatgcggatgcttcaacgcggccccatcctgcatattctggaggaagtgggtagaaaatccccacggcatcatctggaaagtatccccatgcgcggcgtgggtgccatccgccgtgatagaactcaccatgccctcaggcgaagtcaggacattccacccgatgtcaggaatcccaacccaagtcttcaaaggggtaagcgtaacatacctaggatccgatatggaggtaagcggactcacagacctgtgcgagatcgaagaactcaaaagcaagaaactcgccctcgcaccgtgcaaccaagccggaatgggcgtcgtcggcaaagtaggcgaaatacagtgctcctcagaagagtccgcacgcactataaagaaagacggctgcatatggaacgccgacctcgtaggaatagaactcagagtcgacgacgccgtatgctatagcaaaataaccagcgtagaagcagtcgccaactacagcgcgatcccaacaacaattggtggactgagattcgagcgatctcacgactcacaaggaaaaatcagtgggtcaccattagacatcactgcaatacgtggcagcttcagcgtaaactacagaggactcaggctatccctcagcgaaataacagcgacatgcacaggcgaggtgaccaacgtgtccgggtgctacagctgcatgaccggcgcgaaagtatccatcaaacttcacagcagcaaaaactccacggcacacgtcaggtgcaaaggtgacgaaaccgcattctcggtgctcgaaggcgtgcactcttacacagtgtccctgagctttgaccacgccgtagtcgacgaacagtgtcaactaaactgcggaggacacgaaagccaagtcacattaaaaggcaacctcatattcctagacgtaccaaaattcgtagacggctcctacatgcaaacgtaccactcctccgtccccacaggggcaaacatcccatcacctaccgactggctgaatgcactcttcggaaacggactgtcgcgctggatactaggcgtcatcggggtactcctcggagtcctggccctcttcttcttaataatgtccctcttcaaattaggaaccaaacaagttttccgctcacgaaccaaactagcctga

SEQ ID NO: 16396 - RNA, 3222 nt, synthetic construct
  misc_feature 1..3222: note = derived and/or modified CDS sequence (opt11) from SFTSV(JS2013-71)__KR230777.1__GP
  source 1..3222: mol_type = other RNA
atgatgaaagtcatatggttcagctcgctgatctgctttgtaatacaatgcggcggagacacagggccaataatatgcgcgggacccatacattctaacaaatcagcagacataccacacttactgggatatagcgagaaaatctgccaaatcgaccgcctgatccacgtcagctcgtggctaagaaatcactcgcaattccaaggttacgtcggccaacgagggggtcgaagtcaagtctcgtactacccagccgaaaactcctacagtcgatggagcggcctattaagtccatgcgacgctgactggctagggatgctagtagtaaagaaagccaaaggctcagacatgatagtaccgggcccctcatacaagggtaaggtcttcttcgaacggccgacgtttgacggatacgtaggatggggatgcggctcgggaaaatcacgtacagaatcgggggaactctgcagctcggacagcggcacctcaagcgggctactaccgagcgaccgagtcctctggataggcgacgtagcatgccaacccatgacacccataccggaagaaacatttctagaactcaaatcattctcacaaagcgagttcccggacatatgtaaaattgacggaatagtatttaatcagtgtgaaggggaatcactcccacaaccattcgatgtcgcatggatggacgtggggcacagccacaaaatcataatgagggagcacaagacaaaatgggtccaagaatctagcagtaaggacttcgtatgttacaaagaaggcacgggcccatgttccgaatccgaagagaaaacctgcaaaaccagcggcagctgcagaggcgatatgcaattctgcaaagtagccgggtgcgaacacggcgaagaagcctcagaagcaaagtgcagatgcagcctcgtacacaagccgggtgaggtagtggtcagctacggaggcatgcgagtacgaccgaagtgctacggattcagtcggatgatggcgaccctggaagtgaaccagcctgagcagaggataggacaatgcacagggtgccacctcgaatgcataaacgggggcgtacgactaatcaccctaacgagcgaactcaaatccgcgaccgtatgcgcatcgcacttttgcagcagcgcaacaagcggcaagaaaagcaccgaaatccaatttcactcaggctccctcgtaggtaaaacagcaattcatgtcaaaggagccctagtcgacggcacagaatttacatttgagggatcctgcatgttcccagacggatgcgacgcagtggactgtactttctgcagggagttcctcaaaaacccccagtgttacccagccaagaaatggctattcataataatagtcatactattgggttatgccggcctcatgctcctaacaaacgtactcaaagcaataggcgtgtggggaagctgggtcatagcgccagtcaagctagtctttgcgataatcaagaaactcatgagagcagtaagctgtctaatgggaaaactaatggatcgtggacgacaagtcatacacgaagaaataggagaaaacagagaaggtaaccaagacgacgttcgaatcgagatggcccgcccgcggagggtaagacactggatgtacagccccgtcatcctcaccatactcgccatcggccttgctgagggatgcgacgaaatggtacatgctgactccaaactcgttagctgcaggcaagggagcggcaacatgaaagagtgcgtgacaactggacgcgccctgctcccggcagtaaacccaggacaagaggcctgcctccacttcaccgcaccgggaagcccagacagtaaatgcctgaaaataaaagtcaaacgaataaacctaaaatgcaaaaagagctcctcctacttcgtccccgacgcccgatccagatgcacaagcgtgcgcagatgcagatgggccggcgactgccaaagcggatgcccgccccacttcacgtcaaacagcttttcagatgactgggccggaaaaatggacagagccggcctaggattcagcggatgcagcgacggctgcgggggagcggcatgcggatgcttcaacgccgcaccaagctgcatcttctggcgcaaatgggtggaaaacccccacggaatcatctggaaagtctcaccgtgcgcagcatgggtgcccagtgccgtgatcgaactcacaatgccgtccggggaagtcagaaccttccacccaatgagcgggattccaacccaagtcttcaaaggcgttagcgtaacttacctcgggtcggacatggaagtgagcggcctcaccgacttgtgcgaaatcgaagaactaaaaagcaagaaactcgccctcgcaccctgcaaccaagcagggatgggggtggtaggcaaagtcggagagatccaatgcagttcagaagaaagcgcgagaacaatcaagaaagatggatgcatctggaacgcggacctcgtaggaatagaacttcgagtcgacgacgcggtatgctacagtaaaatcacctcagtcgaggccgtcgcaaattactcagctataccaaccaccatcggagggctacgatttgaacggagccacgacagccaagggaaaatctcgggctccccactagacataacagccatccgcggctcattctcggtaaactatagagggctacgactgtcactatcagagataaccgccacatgcaccggggaagtcacaaatgtcagcggatgctacagttgcatgacaggcgctaaagtgagcataaagctacactctagcaagaacagcacggcgcacgttcgatgcaaaggcgacgaaacagcattttcggtcctcgaaggggtacacagctactcagtgtccctgtccttcgaccacgccgtggtcgacgaacaatgccagttaaactgcggaggccacgaaagccacgtcaccctacgaggaaacctcatcttcctagacgtcccaaaattcgtggacggctcatacatgcaaacataccactccacagtacccactggcgcaaacatcccgagtccaactgattggctcaacgcgctattcggaaacggactgagcagatggatactcggggtgataggagtactactaggcggactagccctattcttcctaataatgagcctattcaagctagggaccaaacaggtcttccggtcacgaacaaaactcgcgtag

SEQ ID NO: 16397 - RNA, 3222 nt, synthetic construct
  misc_feature 1..3222: note = derived and/or modified CDS sequence (opt11) from SFTSV(JS2014-03)__KR230778.1__GP
  source 1..3222: mol_type = other RNA
atgatgaaggtaatctggttcagtagcctcatatacttcgtgatccagtgctcgggcgactccggacctatcatatgcgcaggtcccatacactcaaacaaatccgccgacatcccgcacctcctaggatactccgaaaagatatgccagatcgaccgacttatacacgtgtcctcctggctgcgaaaccacagccagttccagggctatgtcggccaacgcggcggccgctctcaggtgtcgtactacccagcagaaaactcgtactcacgctggtccggcctactctcaccgtgcgacgcagactggctcggcatgctggtcgtcaagaaagccaaaggaagcgacatgatcgtcccaggcccaagctacaagggcaaagttttcttcgaaagaccaacattcgacggatacgtgggctgggggtgcggcagcggcaaatcgaggaccgaaagcggagaactatgcagtagcgattcaggaacaagcagcggcctcctgccctcggaccgagtcctctggatcggcgacgtcgcgtgccaaccaatgacaccgatacccgaagaaaccttccttgaactcaagagtttttcccagtcggagttcccagacatatgcaagatagacggaatagtcttcaaccagtgcgagggcgaatcactaccgcagccattcgacgtggcctggatggacgtagggcactcccacaagataatcatgagagaacacaagacgaaatgggtccaggaatcctcaagcaaagacttcgtctgctacaaagagggaacgggaccctgctccgaatcagaagagaagacatgcaaaacaagcgggagctgcagaggcgatatgcaattctgcaaggtagccggatgcgagcacggcgaagaggcatcagaagctaagtgccgatgctcactggtgcacaaacccggggaggtcgtagtctcatacggcgggatgcgaatacgaccaaaatgctacggattctcccgaatgatggctacactggaagtcaaccagccagaacaaagaattggacagtgtacaggctgccacctcgaatgcatcaacgggggcgtccgcctaatcacactcaccagcgagctaaaaagcgcaaccgtatgcgcctcgcacttctgcagcagcgcgacgagcggcaaaaagagtacagagatccaattccacagcggcagcctcgtaggcaagaccgcgatccacgtcaagggcgcgttggtcgacggtaccgaatttacattcgaaggaagttgcatgttcccagacggctgcgacgcggtagactgtaccttctgccgcgagttcctcaaaaacccccaatgctaccccgcaaagaaatggcttttcataatcatagtaattttgctcggatacgccggcctgatgctactgacaaacgtcctcaaagccataggaatctggggctcatgggtcatcgcaccagtaaaactcatgttcgccatcatcaaaaagctaatgcgcacagtttcctgcctcatgggcaaactaatggaccgcggtagacaagtaatccacgaagagataggagaaaaccgagagggcaaccaagacgacgtcagaatcgaaatggccagacccaggagagtgagacactggatgtacagccccgtcattcttacattcctcgccataggcctagcagaatcctgcgatgagatggtacacgctgacagcaagctagtctcatgccgccaagggagcggcaacatgaaagagtgcgtaacgaccggaagggcgctccttccagctgtgaacccaggacaggaagcctgcttgcacttcaccgcaccaggcagcccagattcgaaatgcctcaagatcaaagttaagcgtatcaacctcaagtgcaaaaagagctcatcatacttcgtaccagacgctagatcgagatgcacaagcgtaagaagatgccgatgggcgggtgattgtcaaagtgggtgcccaccccacttcacatccaactccttcagcgacgactgggccgggaaaatggaccgtgccggtctcggattcagcggctgctcagacgggtgtggcggcgcagcgtgcggatgcttcaacgcagccccctcctgcatcttctggagaaaatgggtcgaaaatccccatggaatcatatggaaagtatcaccctgcgccgcctgggtaccctccgcagtcatagagctcacaatgccaagtggcgaggtgagaaccttccaccctatgtcaggcattccaacgcaagtcttcaaaggagtatcagttacgtacctcggaagcgatatggaagtaagtggcctcacagacctctgcgagatcgaggaactcaaaagcaaaaagctagccctagccccatgtaaccaggcaggaatgggcgtagtcggccgagtcggagagatacagtgctcaagcgaggaatccgcccggactataaagaaagacggatgcatctggaacgcggacctagtaggaatagaactccgcgtggacgacgcagtatgctactcgaaaataaccagcgtagaggccgtggccaactactccgccatcccgactactatcggaggactccggttcgaacgatcacacgacagccaaggaaaaatctcaggaagccccctcgacataacagcgataagaggctccttctcagtcaactaccgcggcttgagactatcactaagcgaaataacggccacgtgcaccggggaagtaaccaacgtaagcggctgctatagttgcatgacaggagccaaagtctccataaaactacatagttccaaaaactcaaccgcacacgtaagatgcaaaggagacgagacagcgttttcggtactggaaggcgtccactcctataccgtctcattatccttcgaccacgctgtcgtcgacgaacaatgccaactaaactgcggcggccacgagtcacaagtcacacttaagggcaatctcattttcctagacgtcccaaaattcgtcgacggctcctacatgcaaacataccacagcaccgtacctaccggagccaacataccatccccaacggactggctcaacgcactcttcggaaacggactctcacgctggatactcggagtcataggcgtactgctagggggactcgctctcttctttatgatcatgtccctattcaaactggggaccaagcaagttttccggtctcggaccaaactcgcgtag

SEQ ID NO: 16398 - RNA, 3222 nt, synthetic construct
  misc_feature 1..3222: note = derived and/or modified CDS sequence (opt11) from SFTSV(JS2014-16)__KR230780.1__GP
  source 1..3222: mol_type = other RNA
atgatgaaagttatctggttcagctcgctaatctgcctcgtgatacaatgctccggagacaccggaccaatcatatgcgcgggcccaatccactccaacaaatcagcaaacataccacacttgctcggttactctgagaagatctgccagatagacagacttatccacgtatcctcatggctccgaaaccactcccaattccaaggctatgtaggccagcgcggcggccggtcccaggtctcatactacccagcggaaaacagctattcccgatggtcaggactgctctcgccatgcgacgcagactggcttggaatgctagtagtgaaaaaggccaaaggatcggacatgatagtacccgggccctcatacaaaggcaaagtctttttcgaacgcccgacttttgacggctacgtaggctggggctgcgggtccggtaagagcaggaccgaaagcggagaactgtgcagcagtgacagcgggacttctagcggactattacccagcgaccgagtcctgtggataggcgacgtcgcatgtcaacccatgacaccaatacccgaagagaccttcctcgagctgaaatcttttagccaaagcgagttcccagacatatgcaaagtcgatggaatcgtgtttaaccagtgcgacagtgaatcccttccacagccaatagacgtagcgtggatggacgtcgggcactcccacaagattataatgcgagaacacaaaacgaaatgggttcaggaaagctcatcaaaggacttcgtatgctacaaggaaggaacaggaccttgcagcgaatcggaagagaaaacgtgcaaaacctccggctcgtgtcgtggcgacatgcaattctgcaaagttgcaggatgcgagcacggagaagaggcgtcggaagcgaaatgccgctgctccctggtccacaaaccaggcgaagtagtcgtctcgtacggcggcatgcgagtacgcccgaaatgctacggtttctcacgcatgatggcgaccttagaagttaacccacccgagcaaagaataggccaatgcacaggctgccatctcgaatgcataaacggcggagtgcgcctaatcacgctcacatcagaacttaaaagcgccacagtgtgcgcgagtcacttctgctcaagtgccacgagcgggaagaaaagcaccgaaatacaattccactcaggaagtctagtaggtaaagccgcaatccatgtcaaaggagcattagtggacgggaccgagttcactttcgaaggctcatgcatgttcccagacggctgcgatgccgtggactgtaccttctgcagagagttcttaaagaacccgcagtgttacccagctaagaaatggctatttataataatagtaatactgctgggttacgcaggcctcatgctactaaccaacgtcctcaaagccatcggcgtgtggggaagttgggtaatggccccagtaaaacttatgtttgccatcatcaagaaactgatgcgatcagtctcgtgcatgatggggaaactaatggaccgcggcaggcaagtgatccacgaggagataggcgaaaaccgtgagggcaaccaagatgacgtcagaatagagatggcgcgcccccgaagggtccggcactggatgtacagcccggtcatactcaccattctagccataggcctagccgaaggctgcgatgaaatggttcacgcagactcaaaactcgtgctgtgcagacaagggagcggaaacatgaaagagtgcgtaaccacaggacgagcacttctcccagccgtaaacccaggacaagaagcatgcttacacttcaccgccccaggttcaccagactcgaaatgcctcaaaatcaaagtcaaacgaataaacctcaaatgcaagaaaagctcaagctacttcgtacccgacgcccgatctagatgcacatcagtccgaagatgtaggtgggccggcgattgccagagtggatgccccagtcacttcacatccaacagcttcagcgacgactgggcaggaaaaatggaccgcgctgggctcggattctcaggctgcagcgacggctgcggaggggccgcctgcggatgctttaacgctgccccgagctgcatcttctggcgaaaatgggtcgagaacccacacggaatcatatggaaagtatcaccctgcgccgcctgggttcccagcgcggtaatcgaactcacgatgccaagcggggaagttcggaccttccaccccatgagtggaatcccaacacaggtcttcaaaggagtctcagtaacgtatctgggctccgacatggaagtgagcggacttacagacctatgcgagatagaagaactaaaaagcaagaaattagctctcgcaccgtgcaaccaagcgggaatgggagtcgtaggaaaagtaggagaaatacaatgcagctcggaagagagcgctcgaacgatcaagaaagacggatgcatatggaacgccgatctcgtcggcatcgaactaagggtagacgacgcagtctgttactccaaaattacatcagtggaggcagtagcaaactactcggccatcccaacaactatcggaggactacgattcgaacgatcgcacgactcccaaggaaaaatatccggatcacctctagacataacagctatcagggggtcgttcagcgttaactacaggggcctgcggctgtccttgagcgaaataaccgccacatgcaccggggaggtaaccaacgtatcggggtgctacagctgcatgaccggcgccaaagtcagcatcaaactgcattcgtccaaaaacagcacagcacacgtgcgctgccgaggggacgagaccgccttctctgtcctcgaaggagtacacagctataccgtatccctgagcttcgaccacgccgtagtagacgaacaatgccaattaaactgcggaggacacgaaagccaagtgacactcaaaggcaacctgatcttcctagacgtcccaaaattcgtcgatggctcttacatgcaaacgtaccacagctcggtaccgaccggggcaaacatcccgagtccaaccgactggttgaacgcactctttggcaatggcctgagccggtggatactaggcgttatcggcgttctactcggagtcctcgcgctgtttttcttaataatgagcctatttaaactggggaccaaacaagtattccgttctagaaccaaactcgcctaa

SEQ ID NO: 16399 - RNA, 3222 nt, synthetic construct
  misc_feature 1..3222: note = derived and/or modified CDS sequence (opt11) from SFTSV(JS2014-18)__KR230781.1__GP
  source 1..3222: mol_type = other RNA
atgatgaaggtcatatggttcagctcactcatatgcttagtaatccaatgcggaggggatacgggaccgatcatctgcgcggggccaatacatagcaacaaatccgcggacatcccacacctcctaggctactcagagaaaatctgtcaaatcgaccgactcatacacgtaagctcgtggctgcgaaatcactcgcaattccaagggtacgtaggccagagagggggccggagtcaggtatcgtactaccccgccgaaaacagctacagtaggtggtcgggcctactatcgccatgcgacgcggactggctcggcatgctagtcgttaagaaagccaaaggctcagacatgatagttcccggcccgtcatacaaaggcaaagtatttttcgaacgtccaaccttcgacggctacgtaggctggggctgcggctccggcaaaagccgcacagaaagcggggaactctgctctagcgatagcggaacatcgagcgggctactgccgagtgacagggtcctgtggataggcgacgtcgcttgtcagcccaccacgcccatcccagaagagacattcctagaactaaagagctttagccagagcgagttcccggacgtctgcaaaatagacggaatcgtctttaaccagtgcgaaggcgaatccctaccccagccatttgacgtggcctggatggatgtggggcactcccacaagataatcatgcgggagcacaaaacgaaatgggttcaagaatcgagcagcaaagatttcgtatgctacaaagaagggacaggtccctgcagcgaatctgaagagaaaacatgcaagacgagcggaagctgcagaggcgacatgcaattctgcaaagtcgcaggctgcgagcacggagaggaggcgtcggaagcaaaatgccgctgctccctagtacataagccaggcgaggttgtagtcagctacggaggcatgcgtgtcagaccaaaatgctacggcttctcacgcatgatggccacgttggaagtgaacccaccggagcaaagaatagggcagtgcaccgggtgccacctcgagtgcataaacggcggggtgcgcctaatcacgctcactagcgaactaaaaagcgcgacagtgtgcgcaagtcacttctgcagctcggccacgtcagggaaaaagagtacggaaatacaatttcactcagggtcgcttgttggcaaaaccgcgatacatgtcaaaggcgccctagtagacggaacagagttcaccttcgaaggatcatgcatgtttccagacggctgcgatgcagtcgactgcaccttctgccgcgagttcctcaagaacccacaatgttaccccgccaagaagtggctattcatcataatagtaatcttactaggctacgccggcctaatgctgctcacaaacgtactaaaagcaataggcgtctggggaagctgggtcatagcccccgttaaattagtattcgctatcataaagaaactgatgcgggcagtctcgtgtctaatgggaaaactgatggaccgcgggcggcaagtcatccacgaagaaataggcgaaaaccgcgaaggcaaccaagacgacgtaaggatagagatggcacgcccaagacgcgttcggcactggatgtatagcccggtcatacttacaatcctggcaataggcttggccgagggctgcgacgagatggtgcacgccgactcaaaactcgtctcgtgtaggcagggcagcggaaacatgaaagagtgcgtaaccacgggaagggccctgctccctgccgtcaaccccggccaagaagcgtgcctacactttaccgcgccagggagcccagactcaaaatgcctcaaaatcaaagtaaaaagaatcaacttaaaatgcaaaaagtctagctcctacttcgtacccgacgcaaggagccgatgcacgagcgtacgccgctgccgatgggcgggagactgccaaagcggctgcccaccccactttacgtcaaatagtttcagcgacgactgggccgggaaaatggacagggcaggcctaggcttcagcggctgcagtgacggctgcggcggggccgcatgcggatgttttaacgcggcaccgagctgcatcttctggaggaaatgggtcgagaacccacacgggatcatctggaaagtgtcaccctgtgccgcatgggtcccatcagccgtgatcgagctcacaatgccaagcggggaagttagaacatttcaccccatgagcggtatccctacccaggtattcaagggggtctccgtaacataccttggcagtgacatggaagtgagcgggctcacagacctctgcgaaatcgaagaactgaaaagcaaaaagctagcactcgcgccatgcaatcaagccgggatgggggtggtcggtaaagtcggagaaatccaatgcagctcggaagagagcgcccgcacaatcaagaaagacggctgcatctggaacgcggacctagtaggaatagagttgcgcgtcgacgacgccgtatgttactccaaaataacctccgtcgaagccgtggcaaattactcagccatccctacgaccatcggagggctcaggttcgaacgctcgcacgatagccaggggaagatctccgggtctcccctggacataaccgcaatcaggggctctttctcggtcaattatagaggactcagactgagcttgagcgaaataacagcgacctgcacgggcgaggtaacgaacgtgagcgggtgctactcatgcatgacgggtgccaaagtctccataaaactacattcaagtaaaaactcgaccgcacatgtcagatgcaaaggcgacgaaaccgcattctcggtcctggaaggcgttcactcatactccgtgagcctcagcttcgaccacgccgttgtagacgaacagtgccaactaaactgcggcggacacgaatcacaagtaaccctgcgtggcaacctaatcttccttgacgtccccaaatttgtcgatggatcgtacatgcaaacataccacagcaccgtaccaaccggagccaacatcccaagtccgaccgactggctaaacgcactattcggcaacggactgagtcggtggatcctaggggtcataggcgtattactgggaggcttagcactattcttcttgatcatgtccctattcaagctcggcaccaaacaagtattccgctctagaacgaaactagcgtga

SEQ ID NO: 16400 - RNA, 3222 nt, synthetic construct
  misc_feature 1..3222: note = derived and/or modified CDS sequence (opt11) from SFTSV(JS2014-31)__KR230782.1__GP
  source 1..3222: mol_type = other RNA
atgatgaaggtaatctggttcagctccctgatatgcttcgtcatacaatgctcgggcgactcaggacccatcatttgcgcgggacccatacactcgaacaaatccgcagacatcccacacctcctaggctactcagagaaaatatgccaaatagacagactaatccacgtgagttcgtggctacgaaaccacagtcaattccaaggatatgtcggtcaacgaggaggacgctcacaagtatcctactatccggccgaaaactcatactcacgatggtccggactgttatcgccctgcgacgcagactggctaggcatgctagtcgtcaagaaggcaaagggttcagacatgatagtacctggacccagttacaaaggtaaggtcttcttcgagcgccccacctttgacgggtacgtaggctggggctgcggatcaggaaagagtagaacagaaagcggagagctctgtagctccgattcaggaaccagtagcggactcctgccatccgaccgcgtactgtggatcggagacgtcgcatgccaacccatgaccccgatccccgaggagacatttttagaactcaaatcattctcccaaagcgagttcccagacatctgcaaaatcgacggcatagtcttcaaccagtgtgaaggcgaatctctaccccagccattcgacgtcgcatggatggacgtgggccactcccacaaaataatcatgagggaacacaaaacaaagtgggtccaggaatccagctcaaaggacttcgtatgctacaaagaaggcacaggaccctgctccgaatcagaagagaaaacgtgcaagaccagcggctcatgcagaggagacatgcagttctgcaaagtagccgggtgtgaacacggcgaagaggcatccgaagcaaagtgcagatgctcactggtccacaaacctggcgaggtagtagtatcctacggagggatgagaatccgcccaaaatgctacgggttctcccgaatgatggcaacactagaggtaaaccaaccggagcaaagactagggcagtgcacagggtgccacctcgaatgcataaacggtggagtgcgcctgataaccctaacctctgaactcaagagcgcgacagtatgcgccagccacttttgcagttcagccacaagcggaaagaaaagcactgaaatacaatttcactccggatcgctagtcggaaaaaccgccatacacgtcaaaggagcgctagtagacggtaccgagttcacgtttgaaggatcatgcatgttcccagacggatgtgatgcggtcgactgtaccttttgtcgcgagttcctcaaaaacccccaatgttacccagccaagaaatggctgttcatcatcatagtcatcctcttaggatacgccggcctcatgctcctcacgaacgttctaaaagcaatcggaatctggggcagctgggtcatagccccagtcaaactaatgttcgcgataataaagaaactgatgagaacagtcagctgcttaatgcggaaattgatggacagaggccgccaggtcatccacgaggaaattggcgaaaaccgagagggcaaccaagacgacgtacgaatcgagatggctcggccacgacgagtacgacactggatgtacagcccggtcatactcaccatcctggccatcggtctggcagaaagctgcgacgaaatggtacacgcagactcaaaactcgtctcgtgccgacaagggtccggaaacatgaaagaatgcgtaacaacaggcagggccctactacccgcggtaaatccaggccaagaagcatgcttacacttcacagcacccggatcccctgactcaaaatgcctaaaaataaaggtcaaacgaataaacctcaaatgcaaaaagtcctcaagctacttcgtgcccgacgcccgctcaagatgcaccagcgtgcgaagatgccgctgggcgggcgactgccaaagcggatgcccaccccatttcacatccaactcattctcggacgactgggcaggcaagatggacagagccggccttgggttcagtgggtgcagtgacggctgtggaggcgcagcttgcggatgcttcaatgccgccccaagctgcatattctggcgcaaatgggtcgagaacccacacggcatcatctggaaggtatccccctgtgcagcatgggtcccatcagcagtaattgaactaacaatgcccagtggcgaggtacgcacattccaccccatgagcggaatcccaacccaagtattcaaaggggtatcagtgacctacttaggatcggacatggaagtgagcggactcacagacttatgcgaaatagaagaattgaaatcgaagaagctagccttagcgccgtgtaaccaagcaggaatgggggtcgtaggcaaggtcggagaaatccaatgttcatcagaggagagcgcacgaacaatcaaaaaggacggctgcatatggaacgcagacctagtcgggatagagcttcgcgtagacgacgccgtatgctacagtaaaatcacatcagtcgaagccgtagcaaactactcagcgatacctacaactataggcgggctacgctttgaacgcagccacgactcccaaggtaagatctccgggagcccactagacataaccgcgattcggggatcattctcggtcaactaccgaggactccgactctccctttcagaaatcaccgccacatgcaccggagaagtcaccaacgtatccggatgctatagctgtatgacaggagccaaagtatccatcaaactccactcatccaaaaactccacagcgcatgtaaggtgcaagggggatgagacagcattctcggtacttgagggggtacacagctacaccgtctccctgtcattcgaccatgccgtggtcgacgaacagtgccaactaaattgcggagggcacgagtctcaagtaaccctcaaagggaacctgatcttcctagacgtccccaaattcgtcgacggttcatacatgcaaacctaccacagcacggtaccgacaggagcaaacatcccaagccccacggattggcttaacgcgctattcggcaacggcttgagccgctggatcctcggagtaattggcgtcctactaggggtactcgccctcttcttcctcattatgtcactgttcaaactcgggactaaacaagtattccgtagccgcacaaagctagcatga

SEQ ID NO: 16401 - RNA, 3222 nt, synthetic construct
  misc_feature 1..3222: note = derived and/or modified CDS sequence (opt11) from SFTSV(JS2014-33)__KR230783.1__GP
  source 1..3222: mol_type = other RNA
atgatgaaagtgatctggttctccagcctcatctgcttcgtaatccagtgcagcggcgattccggcccgatcatatgcgccggcccgatacacagtaacaaatcggcagacatcccgcacctcctcggatactccgaaaagatctgtcaaatagaccgactgatccacgtgtcctcctggttacggaaccactcacaattccagggctacgtcggacaaagagggggcaggagccaagtaagctactatcctgcggaaaacagctacagcagatggtcgggtctactctcaccatgtgacgcagactggctaggaatgctcgtcgtaaagaaagcaaaagggtcggacatgatcgtaccgggaccctcatacaaaggcaaagtattctttgaaaggccgacctttgacgggtatgtgggatggggctgcggatctggaaagagccgcacagaaagcggagaactgtgtagctctgactcgggaacatcttcaggactactcccaagcgacagggtactctggattggagacgtagcctgccaacccatgaccccaataccagaggagacctttttggagctcaagagcttctcacagagcgagttcccagacatatgcaaaatcgatggcatagtgtttaaccaatgtgaaggcgagagccttcctcaaccgtttgatgtagcctggatggacgtcggccactcacataaaataataatgcgggaacacaaaaccaaatgggtccaagaatcatccagcaaagactttgtgtgctataaagagggaacaggaccatgctcagaatcagaggagaaaacctgcaagacctcaggctcatgtaggggcgatatgcaattctgcaaagtcgccggatgcgaacacggggaagaggcttccgaagcaaaatgcagatgctcactcgtacacaaacccggcgaagtcgtagtaagctacggaggcatgcgggtacgtccaaaatgctatggcttctcacgcatgatggccacccttgaagtcaaccaacctgaacaacgtattgggcagtgcaccggctgtcatctggaatgcattaacggaggagtccgccttatcacgctaacatccgaattaaaaagtgccaccgtatgcgcgagccacttttgctcctcagcgacaagcgggaagaaaagtacagaaatacaattccactcgggttcgctcgttggaaaaacagcgatacacgtaaaaggagcactcgtcgacggaaccgagttcaccttcgagggcaactgcatgtttccagacggctgtgatgccgtagactgtacattctgcagggaatttctgaaaaacccgcagtgttaccccgccaagaaatggctattcatcataatcgtaatcctactaggatacgcagggttgatgctgctaacaaacgtactaaaagccataggcatatggggaagctgggtcatcgccccagtaaaactcatattcgcaattatcaagaaactcatgcgggcagtcggctgcctaatgggaaaactaatggacagaggtagacaagtaattcacgaggaaataggcgagaaccgcgaagggaaccaagatgacgtcagaatcgaaatggcaagaccgcggcgagtccgacactggatgtactccccagtcatactaacaatcctggccatcgggctcgccgagagctgtgacgaaatggtacacgcggacagcaagctagtatcttgccgacaaggcggagggaacatgaaagaatgtgtaacgacagggcgtgccctgctcccagcagtaaatccgggccaagaagcatgcctccacttcaccgcccccggaagtccggacagcaaatgcctaaaaatcaaagtaaaacggatcaacctgaaatgcaaaaagagctcctcctacttcgtgcccgatgccaggagccgttgcacgagcgtccgcagatgcagatgggcaggagactgccagagcggatgcccgccccatttcacgagcaacagcttcagcgatgattgggcagggaaaatggaccgggccggcttggggttctcgggctgcagcgacggttgcggcggagccgcatgcgggtgcttcaacgcagccccatcatgcatattctggcggaaatgggtcgaaaacccacacggcatcatctggaaggtatccccatgcgcagcatgggtgcccagcgcagtaatcgaactgacgatgccatcaggcgaagtgcgcacattccaccccatgtccggaatccccactcaagtcttcaaaggagtctcagtaacctacctaggctcagacatggaagtgtccggtctcactgacctatgcgaaatcgaggaactcaagagcaagaaactcgccctcgcaccctgcaatcaagcaggcatgggcgtcgtaggcaaagtcggggaaatacaatgcagcagtgaggagagcgccaggacaataaagaaggacggatgcatctggaacgccgacttggtgggaatcgaactaagagtcgacgacgcagtctgctactcgaaaataaccagcgtagaagcagtggccaactactcagcgatacccacaacaatcggcggtctgcgattcgaacgaagccacgacagccaaggaaaaataagcggctcgcccctcgacataacggcgatacgcgggagcttcagtgtcaactacagaggcctgcgtttaagcctgtcagaaataacagcaacctgtaccggggaagtaacgaatgtaagcggatgctactcctgcatgacaggagcaaaggtgtcgatcaaactccactcaagcaagaacagtacagcgcacgtacgatgcaaaggcgacgagaccgccttcagcgtcctagaaggggtacacagctacacagtaagcctaagttttgaccacgccgtcgtagacgagcaatgccaactaaactgcgggggccacgaaagccaggtgacgttgaaaggaaacctgatattcctggacgtgccgaagttcgtcgatggcagctatatgcaaacataccacagcgccgtcccgaccggcgcaaacatccccagccccacggactggctcaacgcactgtttggcaacggcctgagccgatggattctcggcgtcataggtgtgttactcgggggcctagcacttttcttcatgatcatgagcctgttcaaactcggcacaaaacaagccttcagatccagaaccaaactagcttaa

SEQ ID NO: 16402 - RNA, 3222 nt, synthetic construct
  misc_feature 1..3222: note = derived and/or modified CDS sequence (opt11) from SFTSV(JS2014-39)__KR230784.1__GP
  source 1..3222: mol_type = other RNA
atgatgaaagtcatatggtttagctccttaacctgcttcgtaatacaatgcagcggcgactcaggccccatcatttgcgcaggcccaatccacagtaataaatcagccgacatcccacacctcctcggctactcagagaagatatgccaaatcgacagactcatacacgtaagctcctggctccgcaatcacagccaattccaaggatacgtaggccagaggggaggacgatcacaagtcagttactacccggcagaaaactcctatagccgatggtcaggcctgctatcgccatgcgacgcagactggttgggaatgctcgtggttaagaaagcaaaaggatcagacatgatcgtgcctgggccatcatacaaaggcaaagtcttcttcgaacgcccgaccttcgacgggtacgtgggatggggctgcggatcgggaaagagtcgaacagagtcaggcgaactttgcagttccgacagcgggacgtcaagcgggctccttccctcggacagagtcctctggataggagacgtagcatgccagcccatgacgccgatcccggaagaaaccttcctcgaactgaaatccttcagccaaagcgagttcccggacatctgcaagatcgacggcatcgtcttcaaccaatgcgaaggagagtcactgccgcagcccttcgacgtagcatggatggacgtcgggcattcccataagatcattatgcgagaacacaaaacaaaatgggtacaagaatcaagctcaaaggacttcgtttgctacaaagaaggcacaggcccgtgttccgagtcggaggagaaaacctgtaaaacgagcggctcttgccgaggcgacatgcaattctgcaaagtggccggatgtgaacacggcgaggaaaccagtgaagcaaaatgccgctgcagcctggtacataaaccaggcgaagtcgtcgtatcctatggcggaatgcgaatacgcccaaaatgctacggcttctcacgaatgatggccaccctagaagtaaaccaaccagagcaacgactcggacaatgcacggggtgccacctggagtgcataaatgggggcgtgcgcttgataactctgaccagtgaactcaaaagcgcgaccgtatgcgcaagtcacttctgctcatcagccaccagtggaaagaaatccacggaaatacaattccactccggcagcctagtcggcaagaccgcaatccacgtaaagggagcgctagtggacggaactgagttcaccttcgaaggctcctgcatgttcccagacggctgcgacgcagtcgattgcaccttctgccgggagttcctcaaaaacccgcaatgctaccccgcaaagaaatggctttttatcatcatagtaatcctattagggtatgcaggcctcatgctcctaacgaacgtcttaaaagcaatcggaatatggggatcctgggtaatcgcaccagtcaaacttatgttcgctatcatcaagaaactaatgcgaaccgtatcatgcctgatgaggaaactcatggaccgcggcagacaagtgattcacgaagaaataggagaaaaccgagaaggaaaccaagacgacgtaagaatcgaaatggcgcgcccacgacgagtacgacactggatgtacagcccggtaatactgacaatactagcaatagggctcgcagaaagctgtgacgagatggtacacgcggatagcaaactcgtctcatgtcgccaaggaagcggaaacatgaaagaatgcgtaaccacaggcagagctctactcccagccgtgaatccgggacaagaagcatgcctccacttcacggccccaggcagccccgacagcaaatgcctcaaaatcaaagtaaaacgcataaacctgaaatgcaagaagtcgagctcatacttcgtgccagacgccagaagccgctgcacatccgtacgacggtgccgctgggcgggcgattgccaatcgggatgcccaccccacttcacaagtaacagcttcagcgacgactgggccggcaaaatggacagagctggccttggcttcagcggctgctccgatggctgcggaggggccgcttgcggctgcttcaacgcagcacccagctgtatattctggaggaaatgggtcgaaaacccccacggaataatctggaaagtctcaccttgcgccgcctgggttccgtcagccgtaatcgagctgaccatgccgtcaggagaggtgcgcacctttcaccccatgtccgggataccgacacaagtcttcaaaggggtcagcgtaacatacctcggcagcgacatggaagtttcaggactcacagacctttgcgagatagaggaactcaaatcaaagaaactcgcactcgccccatgtaaccaggctggaatgggggtcgtcggcaaagtaggcgagatacaatgctcatcagaagaaagcgcccgcacaatcaagaaagacggctgcatctggaacgcagacctagtggggatagagctacgcgtggacgatgcggtctgctacagcaaaataacatcggtcgaagccgtagccaactatagcgccatccccaccacaataggagggctccgcttcgagcgaagccacgactcccagggaaaaatcagcggaagcccactcgacatcagtgcaataaggggatccttcagcgtaaattaccggggcctccgcctctccctgagcgaaatcacagccacatgcaccggggaggtcaccaacgtcagtgggtgctacagctgcatgacaggagcaaaagtaagcataaaattacactccagtaaaaactcgacagcacacgtacgatgcaaaggagatgagaccgccttcagcgtcctagagggtgtccactcttacatcgtgagcctgagcttcgaccacgcggtagtcgacgagcaatgccagctcaactgcggcggacatgaatcccaagtgacactaaaaggcaatctaatatttctcgacgtgccgaagttcgtcgacggatcttacatgcaaacataccactccacggtcccaacgggagcaaacataccaagccccactgactggctaaacgcactgttcggtaacggcctgagtcggtggatactcggcgtaataggcgtgctactgggcggtctggcactcttcagcatgatcatgagtctcttcaaactgggtaccaaacaagtgttccggagcagaacaaaactcgcatga

SEQ ID NO: 16403 - RNA, 3222 nt, synthetic construct
  misc_feature 1..3222: note = derived and/or modified CDS sequence (opt11) from SFTSV(JS2014-H.longicornis-02)__KR230786.1__GP
  source 1..3222: mol_type = other RNA
atgatgaaagttatatggttctcttccttgatatgcttcgtcatccaatgctcaggagactcgggacccataatatgtgcaggaccaatccactcaaacaaaagcgccgacatacctcacctcctaggttacagcgaaaagatctgccaaatagacagacttatacacgtgagtagctggctccgcaaccacagtcagttccaaggatatgtagggcaaagaggaggacgcagccaagtatcgtactaccccgctgagaatagttacagtaggtggagcggcctactaagcccctgcgacgcggactggctcggtatgctagttgtcaagaaagcaaaaggttccgacatgatagtccccggacccagctacaagggaaaagtcttcttcgaaagaccgacattcgatgggtatgtaggatggggctgcgggagcggtaagtcaaggacagagagcggggaactctgctcgagcgactccggaacctcatcagggctactaccgtcagaccgcgtactatggataggcgatgtagcctgccagccaatgacacccatcccagtggaagcatttctcgaattgaaatcattcagccaaagcgagttcccagacatatgcaaaatcgacgggatcgtctttaaccaatgcgaaggcgagtcccttccgcagcccttcgacgtcgcttggatggacgtgggacactcacacaagattataatgagagaacacaaaacaaaatgggtccaagaatcgagctctaaggacttcgtctgctacaaagaaggcacagggccctgcccggaatcagaagagaaaacgtgcaagacgtccggttcctgccggggcgatatgcaattctgcaaagtggccggctgcgaacacggcgaagaggcatctgaagcgaaatgcagatgtagcctggtccacaaacccggagaagtcgtcgtctcatatggtggaatgcgcatacgcccgaaatgctacggatttagccgaatgatggccaccctcgaagtgaaccagccagaacagcgtctaggccaatgcacaggctgccacctcgaatgcatcaacggaggggtccgcctaataacgctcacgtccgaactaaaatcggccaccgtctgcgcaagccacttctgcagctccgccacgagtggtaagaagtccacagaaatccagttccacagcggaagcctcgtaggcaagacagcgatacacgtaaaaggcgcccttgtagatggcacagagttcacattcgaaggctcatgcatgtttccagacggatgcgatgcagtcgactgcacattctgccgcgaatttctcaaaaacccccaatgctaccctgccaagaaatggctattcataatcatcgtaatcctactaggatacgcaggcctaatgctcctaaccaacgtactcaaagccatagggatatggggaagctgggtcatagcaccagtaaaactcatgttcgccataatcaagaaactgatgcgcacagtctcatgcctaatgagaaaactaatggaccgcggacgccaagtcatccacgaagaaatcggcgaaaaccgagagggcaaccaggacgacgtaagaatcgagatggcaagaccacgaagggtaaggcactggatgtactcccccgtgatcctcacgatcctggcaatcgggctcgctgagagctgcgacgaaatggtacacgcagactccaaactggtctcgtgccgacagggaagcgggaacatgaaggaatgcgtgacaacgggtagagcactcctgccggcggtaaaccccggccaagaagcgtgcctacactttacggccccaggcagcccggacagcaaatgcctaaaaatcaaagttaagcggataaacctgaagtgcaagaaaagctcaagctacttcgtccccgacgcacggagcagatgcactagcgtaagacgctgcagatgggcaggggactgccaatccggctgtcccccacacttcacgtccaacagcttcagtgacgactgggcaggaaagatggaccgggccggactaggattctccggctgcagcgacggatgcggcggcgcagcctgcggctgctttaacgcagcaccgagttgtatattctggcgaaaatgggtcgaaaacccgcacggaatcatctggaaagtatcaccttgcgccgcatgggtcccgtcggccgtaatcgaactcaccatgcccagcggagaagtacgcaccttccacccaatgtcaggaataccaacacaagtcttcaaaggtgtcagcgtaacctatctcggcagcgacatggaagtcagcggactgaccgacctgtgcgaaatcgaagaattaaaaagcaaaaagctcgcactggccccctgcaaccaagcaggaatgggcgtcgtaggcaaggtcggagaaatccaatgctccagcgaggagagcgcacggacaataaagaaagacggatgcatctggaacgccgacttggtaggcatagagctaagagtcgacgatgccgtctgctactcaaaaattacctcggtagaagccgtagccaactactccgccataccaacgaccatcgggggcctaagattcgaacgaagccacgactcacaggggaaaatcagcggctccccgctagacatcactgccattcgcgggagtttcagcgtcaactacaggggcttgagactgtcccttagcgaaataacagctacctgcacaggagaagtcacaaacgtaagtggatgctattcctgcatgacaggggcaaaagtcagcatcaaactacacagctcgaagaacagcaccgcccacgtaaggtgtaagggagatgaaacagcattcagcgtcttggaaggcgttcacagctatacagtcagcctcagcttcgaccatgcagtcgttgatgagcaatgccagctaaactgcggaggccacgaaagccaagtgaccttaaaagggaacttgatcttcctcgacgttcccaaattcgtagacggatcctacatgcaaacctaccacagtacagttccaaccggagccaacatacccagcccaacagactggctcaacgcgctattcggtaacggactaagccgctggatattaggcgtcataggagtattactaggcggactcgcactcttcttcatgataatgtccctattcaaacttggaactaagcaagtatttcggagccgaacaaagctggcctga

SEQ ID NO: 16404 - RNA, 3222 nt, synthetic construct
  misc_feature 1..3222: note = derived and/or modified CDS sequence (opt11) from SFTSV(JS2014-H.longicornis-03)__KR230787.1__GP
  source 1..3222: mol_type = other RNA
atgatgaaagtcatatggttcagctctctgacatgtttcgtcatacaatgctccggagactctggacccataatatgcgcaggaccgattcacagcaacaaatcagcggatatcccccacctcctaggctactccgagaaaatctgccagatagatcgactgattcatgtgagctcctggctacgcaaccacagccaattccaaggatacgtaggccaacgcggaggacgaagccaggtcagttactacccagcagaaaacagctactcaagatggtcaggactactatcaccctgtgacgcagactggctaggcatgcttgtagtaaagaaagccaaagggtcagacatgatcgtacccggcccaagctacaaaggaaaagtatttttcgaacgaccaaccttcgacggatacgtcggctggggctgcggctcaggtaagtcaagaaccgaatccggcgaactctgctcatccgactccggcacatcttctggactactacccagcgaccgagtcttatggataggagacgtagcctgccaaccgatgactcccataccagaagagaccttcctcgaactaaaatccttcagccaatcagagttcccagacatctgcaagatagacggtatcgtgtttaaccaatgcgagggcgaatcactaccccagccattcgacgtggcctggatggacgtgggccactcacacaaaataatcatgagagaacacaagactaaatgggtccaagagtcatccagcaaagacttcgtatgctacaaagaaggaacaggcccatgctcggaatccgaggagaaaacctgcaaaactagcggcagctgccgcggtgacatgcaattctgcaaagtcgccggctgtgaacacggagaagaggcgtccgaagcgaaatgccgctgctccctcgttcacaaacccggggaagtagtagtctcatacggagggatgaggatcagaccgaaatgctacggattctcccgcatgatggcgaccctggaagtaaaccaacccgaacaaagaatcgggcaatgcacaggatgccatctcgaatgcataaacggaggcgtccgactaatcaccctcacctcagaactcaagagcgcaaccgtttgcgcgtcccacttttgcagttcggcgacatcaggaaagaagtccacagaaatacaatttcacagcggatcactcgtagggaaaaccgcaatccacgtcaaaggagccctcgtagacggaacagagttcacattcgaaggctcctgcatgttcccagacgggtgcgatgcagtcgactgcacattttgccgagagttcctgaaaaacccccagtgttatccagccaagaaatggttattcataataatagttatattactcggatatgcaggcctcatgctgctcacaaacgtactcaaagcaataggcatatggggaagctgggtcattgcaccagtaaaactcatgttcgccatcataaagaaactgatgcggacagtctcttgcctaatgggaaaactgatggaccgaggacgccaagtaatccacgaagaaatcggagaaaaccgcgaagggaaccaagacgacgtacgcatcgaaatggcccgaccccgcagggtccggcactggatgtacagcccagtaatactgacattcctcgcgatcggactagcagaaagctgcgacgaaatggttcacgcagacagtaaactcgtgtcatgcagacaaggatccggcaacatgaaagaatgcgttaccacaggtagagccctcctaccagcagtcaacccaggacaggaagcatgcctccacttcaccgctcctggatccccagactcgaaatgcctgaaaatcaaagtcaaacgcatcaaccttaaatgcaagaaatcatcgtcttacttcgtccccgacgctcggagccgctgcacatccgtgcgccggtgccgttgggcaggcgactgccagtccggatgcccgccccactttacatccaactccttttcagacgactgggcaggaaaaatggatcgcgcgggcctagggttcagcggctgtagtgacggctgtggaggggcagcatgcgggtgcttcaacgccgcaccgagctgcatattctggagaaaatgggtcgaaaatccgcacggcatcatatggaaagtcagcccatgcgcagcctgggtacccagcgcagtgatcgaactaaccatgccatcaggagaggtaagaacgttccacccaatgtcaggcattcccacccaagtatttaaaggagttagcgtaacatacctcggctctgacatggaggtctcaggactcacggacctatgcgaaatcgaagaacttaaatcaaagaaacttgcgctcgcgccctgtaaccaagcaggaatgggagttgtcggcaaagttggagagatccagtgctcaagcgaagaaagcgcgagaacgattaagaaagacggttgcatttggaacgccgacctagtcggcatagaactccgcgtagacgacgcagtatgctacagcaaaatcacatcggtcgaagcggtcgcgaactacagcgccatccctacgaccatcgggggactcagatttgaacgatcccacgattcccagggaaaaatctccggctcacctctcgatataaccgccatcaggggctcattctcggtcaactaccgtggcctacgattgagcctcagcgagattacagctacatgcaccggcgaggtaacgaacgtcagcggctgctacagctgcatgacgggtgccaaggtctcaatcaaactccactcctccaaaaacagcaccgcacacgttcgctgcaaaggagacgaaacagcattcagcgtcctagaaggagtacactcctacacagtctccctctccttcgaccacgccgtggtagacgaacagtgtcaactcaactgcggcggacacgagtctcaagtcacactaaaaggcaacttgatctttctagacgtccccaagtttgtcgacggaagctacatgcaaacgtaccactccacggtaccaaccggggccaacataccgtcaccaacagactggctaaacgcactattcggaaacggcctttcccgctggatcctaggggtcattggagtactacttggaggcctcgcactctttttcatgataatgtcactcttcaagctcggaacaaaacaagtgttcagatcacgcacaaaactcgcataa

SEQ ID NO: 16405 - RNA, 3222 nt, synthetic construct
  misc_feature 1..3222: note = derived and/or modified CDS sequence (opt11) from SFTSV(JS2014-Hedgehog-02)__KR230789.1__GP
  source 1..3222: mol_type = other RNA
atgatgaaggtgatatggtttagcagcctaatatgcttcgtaattcaatgtagcggcgactcaggaccgatcatatgcgcgggaccaatacacagcaataagtcggcagacatcccccacctcctagggtatagcgagaaaatatgccaaatagatagactgatccacgtaagcagctggttacggaaccacagccaattccaaggatatgtaggacaaaggggcgggagatcacaagtcagctactatcccgcagaaaatagctatagccggtggtcagggctcctctcgccatgcgatgcggattggctaggtatgctggtcgtcaagaaggcaaaaggttcagacatgatagtccctggtcccagctacaaaggaaaggtattcttcgaaagaccgaccttcgacggatacgtaggctggggatgcggctccggcaagagccgaaccgagagcggagagctgtgctcaagcgacagcggcacctcaagcgggctgctaccctcagacagagttctttggataggcgatgtagcatgccagcctatgacccccataccggaagaaaccttcctcgagcttaagagcttcagccaaagtgagttcccggacatctgcaaaatcgatggcatcgtcttcaatcagtgcgaaggagagagcttgccacaaccctttgatgtagcctggatggacgtgggccactcacacaaaataatcatgagagaacacaaaacaaaatgggtacaagaatcatcgagcaaagatttcgtgtgctacaaggaaggaacggggccttgcagcgaatcggaagaaaagacatgcaaaaccagcgggtcttgtcgcggcgacatgcaattttgcaaagtagcagggtgcgaacatggagaagaagcaagcgaagcaaaatgccgatgcagcctagtccacaagccaggagaagtagtagtttcttacggaggaatgaggatacgcccgaagtgttacggcttcagccgtatgatggcaacactcgaagtaaaccagccagaacagagaatcgggcagtgcacgggttgccacctggaatgcatcaacggtggcgttcgccttattacgctcacaagcgagctaaaaagcgcaacggtgtgcgcatcacacttctgcagctcagcaacaagcggcaaaaagtcaacagaaatacagttccactcgggatcgctagtgggtaaaaccgccattcacgtcaaaggtgcgctggtggacggcaccgagttcaccttcgagggcagctgcatgttccccgacggctgtgacgccgtagactgcacattctgcagagagttcctcaaaaacccgcaatgctacccagccaagaagtggctatttatcatcatagtaatattgttaggctacgcaggcctgatgctactcacgaatgtactgaaagccatcggtatttggggaagctgggtcatcgctccagtcaagctcatgtttgcgatcatcaaaaagctgatgcgaacagtgtcatgcctaatgggaaaattaatggaccgaggacgacaggtcatacacgaagaaataggcgagaatcgcgaaggcaaccaagacgacgtacggatagagatggcccgcccgcgacgagtccgacactggatgtacagcccggtcatcctgaccatactagcaatagggttagccgagagctgcgacgaaatggtacacgccgactcgaagctagtctcgtgcagacaaggaagcggcaacatgaaagaatgcgtgacgacgggcagggcactactgccggccgtgaaccccggccaggaagcctgcctccacttcacagcgccggggagcccggactcgaaatgcctcaaaatcaaagtaaagcgaattaatctgaaatgcaagaaaagcagtagctacttcgtacccgacgcacgaagcagatgcacgagtgtgcgaaggtgcagatgggccggcgactgccagtcaggatgcccgccccacttcacaagtaacagcttcagcgacgactgggcagggaaaatggaccgggccggactgggattctcgggctgtagtgacgggtgcggtggggccgcatgcgggtgcttcaacgcggccccgagctgcatattctggagaaaatgggtagagaatccacacggaataatatggaaagtctccccgtgcgcagcatgggtgccgtcagccgtgatcgaactcacgatgcccagcggggaggtgaggacgttccacccaatgtcagggatacccacgcaagtgttcaagggggtctcagtcacatacctgggatcggacatggaagtgagcggtcttacagacttatgcgaaatcgaagaactaaagagcaagaaactagcactagccccgtgcaaccaggcagggatgggggtagtaggcaaagttggggagattcaatgctcatcagaagagtcagcacgcacgatcaaaaaggacggatgcatatggaacgcagacctggtcgggatagagctacgggtcgacgacgcagtctgttactcgaaaataaccagcgtcgaagcggtcgcaaactatagcgcaatacctaccaccatcggaggcctgagattcgaaagatcgcacgacagtcagggcaaaatctctgggagccccttggacataacagcaatacggggctcgttctcagtcaactacagaggattgcgcctaagcctgtccgagatcacagccacgtgcacgggcgaagttaccaacgtgtccggttgctatagttgcatgacgggcgcaaaggtaagtataaagttacacagcagtaaaaattcgaccgcgcatgtacgttgcaaaggagacgagaccgcattcagtgtcctcgagggagtgcacagttataccgtaagcctgagcttcgaccacgcagtcgtggacgaacagtgccagctaaactgcggaggacacgaaagccaagtcacactaaagggaaacctaatattcctggacgtccccaaattcgtcgatggctcgtacatgcaaacgtaccacagcacggtcccgacaggggcaaacataccaagcccgacagattggctaaacgccctcttcggaaacggactgtcgaggtggatcctcggagtaatcggagtacttcttggtgggctagcactattcttcatgataatgagcttattcaagctcgggacaaagcaagtgttcagaagcagaaccaagctggcataa

SEQ ID NO: 16406 - RNA, 3222 nt, synthetic construct
  misc_feature 1..3222: note = derived and/or modified CDS sequence (opt11) from SFTSV(KACNH)__KU507558.1__GP
  source 1..3222: mol_type = other RNA
atgatgaaagtcatctggttctcatccctcatatgcttagtcatacagtgcagcggagattccggcccaatcatatgcgcgggtccgatacacagcaacaaaagcgcttccataccgcacctactaggctactcagagaaaatatgccagatagacagactaatacacgtatcatcatggctgcgaaatcactcccagttccaaggctacgtaggacaaagaggagggcggagtcaggtctcgtactacccagccgaaaacagctacagtaggtggtcagggctactcagcccctgcgacgcagactggctcggaatgctcgtagtcaagaaagctaaaggatctgacatgatcgtaccgggaccctcctacaaaggcaaagtattcttcgaacggccaacattcgacggctacgtcggctggggatgcggcagtggcaagtcacgcaccgaatccggcgaactatgcagctcagacagtggcacctccagcggactcctcccgtcggaccgcgtcctctggataggcgacgtcgcatgccaacccatgaccccaatcccagaagaaacattcctcgaacttaaaagtttctcccaatcagagttcccagacatctgcaaaatagacgggatagttttcaatcagtgcgaaggagagagcctaccacaacctttcgatgtcgcatggatggacgtcggacatagccacaagatcataatgagagagcacaaaacaaaatgggtccaggagtcaagctcaaaagacttcgtctgctacaaggagggcacaggaccctgtagtgaaagcgaagaaaaagcctgcaaaacaagcggcagctgcagaggcgacatgcaattctgtaaagtcgccggctgcgaacacggcgaagaggcatcagacgccaaatgccgctgttccctggtccacaaacccggagaggtcgtcgtctcatacggcggcatgagagtgagaccaaaatgctacgggttcagcagaatgatggcaacgctagaagtcaacccacccgagcaacgaataggccaatgcaccgggtgccaccttgaatgcataaacggcggagtgcgcctgatcactctaacaagcgaactcaaaagcgcgacagtatgtgcatcgcacttctgcagcagcgcaacaagcggcaagaaaagcacagagatacaattccacagcggaagcctcgtggggaagaccgcaatacacgtaaaaggagcccttgtggacggcaccgaatttacattcgaaggaagctgcatgttccccgacggctgcgacgcggtagactgcacattctgccgagagttcctcaaaaacccgcagtgctacccggccaagaaatggctattcatactaatcgtaatcctcctcgggtacgccggacttatgctcataaccaacgtcctcaaagcaatcggcgtatgggggtcctgggtcatcgcgccggtaaaactgatgttcgcaataataaagaaactaatgagaacggtcagctgtctcatgggaaaactaatggaccggggtcgtcaagtcatccatgaagaaatcggcgagaacggggaggggaatcaagacgacgtccgcatcgaaatggcccgacccagaagagtccgacactggatgtatagcccagtaatcctcaccatactcgcaatcggcctggccgaaggttgcgacgaaatggtacacgccgacagtaaactcgtatcatgccggcaaggatccggaaacatgaaagaatgcgtgacaacaggccgagcactactaccagccgtaaatcccggacaagaagcgtgcctccacttcaccgccccaggcagccccgactcaaaatgtctgaaaataaaagtgaaacgcatcaacttaaaatgcaaaaagtcgtcgagctacttcgtaccagacgccagatcccgatgcacgagtgtccgaagatgtaggtgggccggagactgccaaagtggctgcccaccccactttacgtccaacagcttcagcgacgactgggcaggcaaaatggatagagccggactcggcttcagcggatgctcagatggatgcggcggagcggcgtgcggttgcttcaacgccgccccctcctgcatcttttggcgcaaatgggtcgagaacccgcacggcatcatatggaaggtctccccgtgcgcagcatgggtaccctcagccgtaatcgaactcacaatgccaagcggggaggtacgaacattccacccaatgagcggaatcccaacccaagtattcaaaggagtgtcggtaacctacctcggctccgacatggaagtcagcggactcacagacctctgcgaaatagaagaactcaaaagcaagaaactagcattagccccttgcaaccaggcaggtatgggagtcgtagggaaagtcggagaaatccagtgcagcagcgaagagagcgccaggaccataaagaaagacggttgcatctggaacgccgacctagtaggcatagaactccgagtcgacgatgccgtctgctatagcaaaatcacatctgtagaagcagtagccaactactcagccatacccactaccatcggcgggcttcggtttgaacgctcccacgactcccaaggaaaaatctcggggagcccactcgacataaccgcgatcagaggatcgttctctgtcaactaccgcggcctaagactatcgctcagcgaaatcaccgctacatgcacaggagaagtcaccaacgtcagcgggtgttacagctgtatgacaggcgccaaagtaagcatcaaactccactcatccaaaaattcaaccgcccatgtaagatgtaaaggagacgaaaccgccttctcagtactagaaggcgtacatagctacaccgtatcactcagcttcgatcacgcggtcgtcgacgaacagtgccaactaaactgcggcggccacgaatcacaggtaacgctaaaaggcaacctaatatttctagacgtaccaaaattcgtagatggatcgtacatgcagacataccattcaaccgtccccacaggtgccaacataccaagccccaccgactggctgaacgccctcttcgggaacggactcagcagatggatattaggcgtaataggcgtactcctaggcggactggccctcttcttccttatcatgtccttgttcaaactaggaacaaaacaagtattccgctcccgcaccaaactagcgtga

SEQ ID NO: 16407 - RNA, 3222 nt, synthetic construct
  misc_feature 1..3222: note = derived and/or modified CDS sequence (opt11) from SFTSV(KACNH2)__KU507559.1__GP
  source 1..3222: mol_type = other RNA
atgatgaaagtgatatggttctcctcactaatctgcctagttatacaatgtagtggcgacacgggcccaatcatctgcgcaggccccattcacagcaacaaaagcgcaaacatcccgcatctgctagggtactcggagaaaatttgtcagatagacagacttatacacgtgagcagctggctaagaaaccactcgcagttccaaggatacgtaggccaacgaggaggccgaagccaagtatcatactatccagcagaaaattcttacagtaggtggtcaggtctgctaagcccgtgcgacgcggactggctaggtatgctagtggtaaagaaagccaaaggatcagacatgatcgtccccgggcccagttacaaaggtaaagtattcttcgaaaggcctaccttcgacggatacgtaggctggggctgtggatcgggcaaaagcaggaccgagtcaggagaactctgctctagcgacagcgggacctcaagcggcctactcccttctaatagagtactttggatcggagacgtagcctgtcaacccatgactccgataccggaagaaaccttcctcgagctaaaatccttcagtcagtcagagttcccagacatttgcaaaattgacggcatcgtgttcaaccaatgcgaatcggaaagcctgcctcagccattcgacgtcgcttggatggacgtcggccacagccacaagataataatgagagaacacaaaacaaagtgggtccaggaatcgtctagtaaagacttcgtatgctacaaagaaggcacaggaccgtgtagcgagtcagaagaacgaacatgtaaaacatccggaagctgcagaggcgacatgcaattctgcaaagtcgctggctgcgagcacggcgaagaagcctccgaagcgaaatgccgatgctccttagtccacaaacccggggaggtagtggtgagctacggaggaatgcgagtgagacctaaatgctacggcttctcgcgcatgatggcaacactagaagtaaatccacccgagcaacgaatcgggcaatgcaccgggtgccacatcgaatgcataaacgggggagtaagactaatcacactcaccagcgagctaaaaagcgcgaccgtgtgtgcgagccacttctgtagcagcgccactagcggaaagaaaagcactgaaatacaattccacagcggctcgcttgtgggaaaagcggcaatacacgtcaaaggagccctcgtagacgggaccgagttcactttcgaaggctcgtgcatgttccccgacggatgcgatgcagtcgactgcaccttctgcagggaatttctcaaaaacccgcaatgctacccggccaagaagtggctatttatcataatcgttatactgctaggatacgcagggctaatgctactcacaaacgtactgaaggccataggagtatggggatcctgggtaatagccccagtgaagctcatgttcgccatcatcaaaaagctcatgcgttcagtgagctgcctaatgggaaaactaatggaccggggccgtcaagtcatacacgaagaaataggcgagaacagggaaggaaaccaagacgatgtacggatagagatggcacgaccacgtagagtgcgtcactggatgtacagccccgtaatactaacaatcctcgccatcgggctagcagaaggctgcgacgaaatggtgcacgcagactcaaaactggtcagctgccggcagggaggcggcaacatgaaggagtgcgtaacaaccggccgggccctactcccggccgtgaaccccggccaagaagcctgcctacacttcaccgcgccaggcagcccggactcgaaatgcctaaaaatcaaggtaaaacggataaacctgaaatgcaaaaagtcctccagctacttcgtccccgacgcacgaagccggtgcacaagcgtgcgccgctgtaggtgggcaggagactgccaaagcggctgcccctctcattttacatccaattcctttagcgacgactgggccggaaagatggaccgagcaggcctcgggttcagcggctgtagcgacggctgcggcggcgctgcatgcgggtgcttcaacgcagccccgtcatgcatcttctggcgcaagtgggtcgagaatccacacgggataatatggaaagtctcgccatgtgcagcgtgggtgccatcagccgtaatcgaactcacgatgccatcgggagaggtgagaacattccaccccatgagcggaatcccgacccaagtattcaaaggggtctcagtcacatacctaggcagcgatatggaagtgtccgggctcacagatctctgcgagatcgaagaattaaaaagcaagaagctcgcgctagcgccctgcaatcaggccggaatgggcgttgtaggcaaagtcggggaaatacagtgcagcagcgaagaaagtgcgcgaacgatcaagaaagacggatgtatctggaacgcagacctggtagggatcgaactacgggttgacgacgccgtctgctactcgaaaataacaagcgtcgaggccgtagccaattattcagcaataccgacaaccataggagggctacggttcgaacggtctcacgacagccaaggcaaaatctcaggctcgccactcgacataaccgcaatccgaggctcgttctcagtcaactacagaggactacgcctgtccctgagcgaaatcacagctacctgcaccggagaggttacgaacgtgtccggatgctacagctgcatgacaggcgccaaagtcagcataaaactacacagctccaaaaactcgaccgcgcacgtgcgatgcaaaggcgacgaaacggcattctccgtactagagggaatccactcctataccgtgagcttaagtttcgaccatgccgtcgtcgacgaacagtgccagctcaactgcgggggacatgaatcccaggtcacactgaaaggaaacctcatcttcctagacgttccaaagttcgtagatggctcctacatgcaaacataccacagtagcgtcccaaccggcgcgaacatcccatcgccgaccgactggttaaacgcactattcggaaacggcctcagccgatggatcctaggggtaatcggagtcctactaggtggactcgccttgttcttcctaataatgagcctcttcaagctagggacaaagcaagtatttagaagcagaacgaagctagcgtga

SEQ ID NO: 16408 - RNA, 3222 nt, synthetic construct
  misc_feature 1..3222: note = derived and/or modified CDS sequence (opt11) from SFTSV(KACNH3)__KP663744.1__GP
  source 1..3222: mol_type = other RNA
atgatgaaggtaatctggttttcatcgctgatctgcttagtcatacagtgctcaggggacacgggaccgataatctgcgcgggtcccatacacagtaataaatcagctaacatcccccacctactaggatactcagagaaaatctgtcaaatcgaccgattaatacacgtaagttcctggctacgaaaccactcgcagtttcaaggatacgtgggccagcgcggcggaaggagccaggtatcgtactaccccgccgaaaactcgtatagcagatggtcgggactcctcagcccctgcgacgcggactggctcggcatgctagtcgtcaaaaaggcgaagggctcagacatgatcgtacccgggccaagctacaagggcaaggttttcttcgagaggccaacattcgacgggtacgtcggatggggatgcggctcaggaaaaagccggaccgagagtggggagctatgcagcagcgattccggaacatccagcggcctcctcccgtcagacagggtcctgtggattggcgacgtagcgtgccaaccaatgacccccatccccgaggagacttttctagagctcaagagcttctcccaaagcgaatttccagacatatgcaagatagacggcatcgtgttcaaccagtgcgaaagcgagtccctgccccagccattcgacgtggcatggatggacgtcgggcactcacacaagatcataatgcgggaacataagaccaaatgggtacaagagtcatcgtcgaaagacttcgtgtgttacaaagagggcaccggtccgtgctccgaatcagaagagaaaacatgcaagacatccggctcgtgcaggggcgatatgcagttctgcaaggtagcgggatgcgaacacggggaggaggcctccggcgccaaatgccgctgcagcctagtgcacaaaccaggcgaggtagtggtgtcctacggcggaatgcgtgtgcgcccgaaatgctacgggttctcaagaatgatggcaacactcgaagtaaatccgcccgaacaaagaatcgggcaatgcaccggttgccacctggaatgtatcaatgggggcgtacgactaattacattaaccagcgaactaaagagcgcgaccgtatgcgcgagccatttctgcagctcagccacgagcggcaaaaagagcaccgaaatacaattccactcgggatcattagtaggaaaaaccgcgatccacgtaaaaggagcgctagtagacggtaccgagttcacgttcgaaggaagctgcatgttcccagacggatgcgatgcagtggattgcacattctgtagggagttcctcaaaaacccgcaatgctaccccgccaagaaatggttattcataatcatcgtaatcttactcggatacgcgggcctgatgctactaacaaacgtactaaaagccatcggcgtgtgggggtcatgggtcatagcacccgtaaagctgatgttcgcaatcataaagaaactcatgagatcagtgtcatgcttaatgggcaaactaatggaccgcggaaggcaagtaatacacgaagaaatcggcgagaacagagaaggaaaccaggacgacgtacgcattgagatggcgcgaccacgacgagtcagacactggatgtatagcccggtaattctcaccatcctagccattggactcgccgaaggctgcgacgagatggtccacgctgactcaaaattggtatcttgcaaacaaggatcagggaacatgaaagagtgcgtcacaaccggcagagccctcctaccagccgtgaaccccggccaagaagcgtgcctacactttacagccccaggcagtccggactccaaatgcctcaaaattaaggtaaaaagaataaacctaaagtgcaagaaatcaagcagttacttcgtgccggacgcccgcagtagatgcacaagcgtacgaaggtgccggtgggctggtgactgccaaagtggatgcccgagccatttcactagcaactcatttagcgacgattgggcaggcaaaatggacagggctgggctagggttctcaggctgtagcgacggctgcgggggagccgcatgcggctgcttcaacgcggcaccgagctgcatcttctggcggaaatgggtggagaacccgcacgggataatatggaaagtgtcaccatgcgccgcttgggtgccctccgccgtcattgagctaaccatgccgagcggagaggtacgcacatttcatccgatgagcggaatacccacccaggtattcaaaggggtatcggtaacgtacctgggctctgacatggaggtgagcggcctaacggacctatgcgaaatcgaggaactgaaatcgaagaaactcgcattggcaccatgcaaccaagccggaatgggcgttgtgggcaaagtaggagaaatccaatgcagctcagaggaaagtgcacgcacgatcaagaaagatggttgcatctggaacgcggacctagtcggaatcgaactaagagtcgacgacgccgtatgctactcaaaaataacctcggtcgaggccgtggcaaattattccgcaatccccaccacaataggcggtctacgcttcgaaagatcccacgacagtcagggaaaaatctcaggttcgcctcttgacataaccgcaatccgaggatcattctcggtaaactaccgaggattgcgcctatccttaagcgaggtaaccgcgacatgcacgggcgaagtaacaaacgtgtcgggctgctattcatgcatgacgggtgcgaaagtgtcgataaaactacactcctccaaaaatagcacagcacacgtgcgatgcaaaggcgatgaaaccgcatttagcgtcctggaaggagtccacagctacaccgtgagcctcagcttcgatcacgcagtggtcgatgaacaatgccagctaaactgcggcggacacgaatcgcaagtgaccctgaaaggaaacctcatcttcctcgacgtaccgaagttcgtcgacggctcatacatgcaaacgtaccacagctcggtcccaaccggagccaacataccatctcccacagactggctaaacgcgctattcggaaacggactcagccgctggatcctaggggtcataggcgtccttctaggcgggctcgcacttttcttcctaataatgagcctgtttaaactcggcaccaaacaagtgtttaggagcagaaccaagctcgcctga

SEQ ID NO: 16409 - RNA, 3222 nt, synthetic construct
  misc_feature 1..3222: note = derived and/or modified CDS sequence (opt11) from SFTSV(KADGH)__KU507548.1__GP
  source 1..3222: mol_type = other RNA
atgatgaaggtgatatggttctcctcattaatctgcctcgtaatacaatgcagcggggacacaggaccaataatctgcgcagggccaatccattctaacaaatctgccaacatcccccacctactaggctactcggaaaagatatgccaaatcgatcgcctgatacacgtaagctcgtggctccgaaaccactcgcaattccaaggatacgtcggacaacgcggaggccgcagccaggtatcatactatccggccgagaacagctatagtagatggtccggactgctctccccatgcgatgcagactggctaggaatgctagtcgtgaaaaaggccaaagggtcagacatgatagtcccagggcccagctacaaaggcaaagtattctttgaacggccaaccttcgacggatacgtaggatggggatgcgggagcggcaaaagccgtactgagtccggggagctctgcagctccgacagcgggaccagcagcgggctactaccatctgacagggtcctatggattggcgacgtagcctgccagccaatgacccccatacccgaagagacattccttgagctcaaatcattcagccagagcgagttccccgacatctgcaaaatcgacggtatagtgttcaaccaatgcgaaagcgaaagcctagcccaacccttcgatgtcgcatggatggacgtcggacatagccataaaatcataatgcgagaacataaaacaaaatgggtccaggaatcatcctccaaggacttcgtctgctataaggaggggacaggaccatgctcagaatcagaagagaaaacgtgcaagacctcaggatcgtgccgcggcgacatgcaattctgcaaggtcgccggctgcgaacacggcgaagaaacatcagtggccaaatgccgctgctctctagtccataaaccaggggaagtagtcgtcagctacggaggaatgcgcgtccgacccaaatgctatggcttctctcgtatgatggcaactctggaagtcaacccacctgaacaacggatcggacaatgcaccgggtgccacctggagtgcataagcggcggagtgcgcctcatcaccctcaccagcgaactcaaaagcgcaacagtctgcgcctcacacttctgcagcagcgccaccagcgggaagaaatccactgaaatacaattccactccgggagcctagtaggcaaagcagcaatccacgtcaaaggcgttctggtagacgggaccgagttcacgtttgaaggatcctgcatgttcccagacgggtgcgacgcagtcgattgtaccttctgtagagaatttctaaagaacccccaatgctacccagccaagaaatggctattcatcattatcgtcatcctactcgggtacgccggactaatgctactcacaaacgtcctcaaagcaatcggggtgtgggggagctgggtcatcgcccccgtcaaactcatgttcgcgataattaagaaactcatgcgatcggtctcatgtctcatgggcaaacttatggaccgaggacgacaggtcatccacgaagaaataggggaaaacagagaaggtaaccaggacgacgtgcgcatagaaatggctagaccacgtagggtacgacactggatgtactcccccgtaatactaactatactagcgataggcctcgcggaaggctgcgacgaaatggtacatgcggactcaaaactcgtaagctgccgacaaggcagcggaaacatgaaagaatgcgtcaccacgggacgtgcgttactaccggcagttaaccccggccaagaagcatgcctgcacttcaccgcaccaggctccccggactcgaaatgcctaaaaatcaaagttaaacgcatcaacctcaagtgcaagaaatcctccagctacttcgtacccgacgcccgtagccggtgcaccagcgtccgaagatgtagatgggcgggcgattgccaatcgggatgtccgagccatttcacatccaattcattcagcgacgactgggccggcaaaatggaccgcgccgggctaggcttctccggttgcagcgacggctgcggaggtgctgcatgcgggtgcttcaacgccgcgccaagctgcatattctggcgcaaatgggtcgaaaacccccacggcatcatttggaaagtctcgccctgcgcagcatgggtaccaagcgccgtaatagaattaaccatgcccagcggagaagtgcgtactttccaccctatgagcggaatccccacacaggtattcaaaggagtctcagtcacatacctcgggagcgatatggaagttagcggcctcaccgacctatgcgaaatcgaagaactaaaatctaaaaagctcgcactagcaccttgcaaccaagccggtatgggggtcgtaggcaaagtaggagaaatccaatgctcatcggaagaatccgcccgcaccataaagaaagacggatgcatatggaacgcggacctagtagggatagaattaagagtggacgacgcagtctgctactcaaaaatcacatccgtagaagctgtcgcaaactactccgccattccaaccaccatcggcggactccgattcgaacgaagccacgactcacagggaaaaataagtgggtcacccctcgacataaccgcaatcagagggagcttttcagtcaactacagaggactgcgcctgtccctaagcgaaatcacagcgacctgcaccggcgaggtcacaaacgtcagcgggtgctattcctgcatgacgggcgccaaggtcagcatacggctccactcaagcaaaaacagcaccgcacacgtgcgttgcaaagaagacgaaacagccttctcagtcctcgaaggagtacactcatacacagtgtcactcagtttcgaccacgcagtagtagacgaacaatgccagcttaactgcggaggtcacgaatcgcaagtgacgctcaaaggaaaccttatcttcctcgacgtaccaaaattcgtcgatggctcatacatgcaaacttaccacagtagcgtacccaccggcgctaacataccaagccccacagactggctaaacgccctattcggtaacggtctctccagatggatcctcggggtaatcggcgtcctactaggcggcctagccctcttctttctgatcatgtcacttttcaaattaggcacaaagcaagtattcaggtcccggaccaagctcgcataa

SEQ ID NO: 16410 - RNA, 3222 nt, synthetic construct
  misc_feature 1..3222: note = derived and/or modified CDS sequence (opt11) from SFTSV(KAGBH)__KU507560.1__GP
  source 1..3222: mol_type = other RNA
atgatgaaagtaatatggttctcatccctcatatgtctcgtaatacaatgctcaggagatacaggcccgatcatatgcgccgggccaatccactcaaacaaaagtgccaacataccacatctactcggatactcggaaaagatctgccaaatagacagactcatacacgtatcttcttggctccgaaatcactcgcagttccaaggatatgtcggacaacgcggaggccgatcacaagtatcatactttcccgcagaaaacagctacagtagatggtcaggactcctgtcaccatgcgacgccgactggctaggaatgttagtcgtcaaaaaggctaaagggtccgacatgatagtacccgggccctcatacaaaggaaaggtattcttcgaacgccccaccttcgacggatacgtgggatggggctgcggatcgggcaaaagccggaccgaaagcggcgaactatgctcgagcgacagcggcacatcgagcggcttactcccctcagatcgggtcctatggataggcgacgtagcatgccaacccatgacacccatccccgaagaaacatttctagaattaaagagcttcagccaaagcgagttcccagacatatgtaaaatagacggaatagtctttaaccaatgcgaatccgaaagcctcccccagcccttcgacgtggcatggatggacgtaggccacagccacaagatcataatgcgtgaacataaaaccaaatgggttcaggaatcaagctcaaaggacttcgtgtgctacaaagaaggcacaggaccttgctcagaatccgaagagaaaacgtgcaagacttcaggaagttgcagaggagacatgcaattctgcaaagtggccggctgcgaacacggggaagaggcatcagaagccaaatgcagatgcagcctggtacataagcccggagaggtcgtcgtgtcgtacgggggcatgagggtacgcccaaaatgctacggcttcagccgcatgatggctacactagaggtaaacccacccgaacagcgaatcgggcaatgcacaggctgtcacctcgaatgcataaacgggggcgtacgcctcataacactcaccagcgaactcaagtccgcgaccgtatgcgcctcccacttctgcagctcagccacctcaggaaagaaatctactgaaatacaattccactcgggctcgctagtaggcaaaacagcgatccacgtcaaaggagcactcgttgacggaaccgagttcacattcgaaggctcatgtatgttccccgatggatgcgacgcagtcgactgcaccttctgcagggaatttctgaaaaatccccaatgctacccggccaaaaagtggctattcattatcatcgtaatcctactaggatacgcaggcctaatgttactgacaaacgtactaaaagcaatcggtgtatggggtagctgggtaatcgccccagtcaaactcatgtttgccataatcaagaagctcatccgcagcgtatcctgcctgatggggaagctgatggaccgcgggaggcaagtcatccacgaagaaatcggcgaaaaccgagaaggtaaccaggatgatgtacgcatagaaatggccaggccacgcagggtccggcactggatgtacagcccagtcatcctaacaatccttgctattggattggccgagggatgcgacgagatggtacacgcggacagcaaacttgtgtcctgcaaacaagggtccggaaacatgaaagaatgtgtgaccaccggcagagcactactcccggccgtgaacccaggccaagaagcctgcctccacttcacagcacccgggtccccagactccaaatgccttaaaataaaagtaaaacggataaacctgaaatgcaagaaaagctcgtcctacttcgtaccagacgccagaagccgatgcacctcagtccgccgctgtaggtgggcaggagactgccaatccggctgcccctcacacttcacaagcaacagcttcagcgatgattgggcagggaagatggaccgagccggattaggatttagcggatgcagtgacggatgcggcggcgccgcatgtgggtgcttcaacgcagccccaagctgcatattctggagaaaatgggtagagaacccccacggaataatctggaaagtctccccctgcgccgcatgggtaccctccgccgtaatcgaactgaccatgccctcaggagaagtgcggacattccacccaatgagcggaatcccaacccaagtctttaaaggagtatcggtaacgtacttaggctcggacatggaggtaagcggcctgacggacctgtgcgagatcgaggaattgaagagtaaaaagctagcactagcaccctgtaaccaggccggaatgggagtggtgggcaaagtaggagaaatccagtgttcatcagaggaaagcgcccgcacgatcaagaaggacggctgcatctggaacgcagacctggtcgggatagaactccgggtcgacgatgcagtatgctactctaaaatcacatccgtagaagcagtcgcgaactacagcgcaataccgacaaccatcggaggcctacggttcgagcgaagccacgacagccaggggaagatatccggtagcccgctcgacatcacagcgataagggggagcttctcggtcaactaccgcggactacgcctaagcctaagcgagatcaccgccacgtgcaccggcgaagtcactaacgtatccggatgctactcttgtatgaccggagccaaagtatccataaaactccattcatccaaaaattcaaccgctcacgtacgctgcaaaggggacgaaacagccttctcagtcctagaaggagtccactcatacacagtaagcctctcattcgatcacgccgtcgtggacgaacagtgccagcttaactgcggcgggcacgaaagccaagtcaccctgaaaggcaacctaatcttcctcgacgtaccaaagttcgtcgacgggtcatacatgcaaacataccactcatcagtcccaacaggagccaatatcccaagccctacagactggttaaacgcccttttcggcaacggactcagccgatggatcctaggcgtcatcggagtcctgctcggcggactcgctctcttcttcctcataatgagcttgttcaaactgggaaccaagcaagtattccgaagcagaacgaaactcgcgtga

SEQ ID NO: 16411 - RNA, 3222 nt, synthetic construct
  misc_feature 1..3222: note = derived and/or modified CDS sequence (opt11) from SFTSV(KAGBH3)__KU507561.1__GP
  source 1..3222: mol_type = other RNA
atgatgaaggtaatatggttcagtagcctcatatgcctggtcatacaatgctcaggcgacacaggacccatcatatgcgcgggcccaatacacagcaacaaatccgccaatataccacatctccttggatactcagaaaagatctgccaaatcgacagactcatccacgtctcctcttggttgaggaaccactcgcaattccagggctatgtgggccaaagaggaggaaggtcgcaagtgtcgtacttccctgcagaaaactcatactcccggtggtccggactcctaagcccctgcgacgcagactggctagggatgctagtcgtaaagaaggccaaaggctcggacatgattgtacccggcccatcctacaaaggaaaggtctttttcgagcgcccgaccttcgacgggtacgtcggatggggctgcggctccggcaagagccgcaccgaaagcggggaactctgttcaagtgactccggaacatccagcggcctcctcccgagcaaccgcgttctatggattggcgacgtagcatgccaacccatgacaccaataccagaagagacattcctagaactcaagagcttttctcaaagcgagttcccggacatctgcaagatcgatggcatcgtcttcaaccaatgcgaaagcgaaagtttacctcaacccttcgacgtggcctggatggacgtaggacactcacataagatcattatgcgcgaacacaaaacaaaatgggtccaagaatcaagctccaaagacttcgtgtgctacaaagaaggaacaggtccatgctcggaaagcgaagagaaaacctgcaaaaccagcggaagttgtagaggagacatgcaattctgcaaggtcgccggatgtgaacacggggaagagacatcagaggcgaaatgccgatgcagcctagtacataaacccggcgaggtcgtcgtgtcatacggaggcatgcgcgtgcgaccaaaatgctacggcttcagccgcatgatggcgacactagaagtaaatcccccagaacagcgaatcggccagtgcacgggatgccacctagaatgtatcaacggaggcgtccgcatcatcacactcacgagcgaactcaaatccgcaacagtctgcgccagccatttctgctcctctgccacgtcaggaaagaaaagcacagaaatccaattccacagcggttcactcgtcggcaaaaccgctatccacgtgaaaggcgcgctcgtggacggcacagaatttacgttcgagggatcatgcatgttccccgacggttgtgacgcagtcgactgtactttttgcagggagttcctcaaaaacccccagtgttaccccgccaagaaatggctgttcatcataatagtaatcctccttggatacgcaggcctgatgctcttaactaacgtcctcaaagcaatcggcgtctggggctcctgggtaatagcccccgtaaaactcatgtttgccatcattaagaagctcatgcgatcagtatcatgcttgatgggaaaattaatggatcgcgggcgacaagtcatacacgaagaaataggagaaaatagggagggcaatcaggacgacgtacgcatcgaaatggcccgcccccgaagagtgcgccactggatgtactccccagtcatactcacgatcctcgcgataggcctagcagaaggatgtgacgagatggtccacgccgattctaagctcgtactctgcaaacaaggctccggtaatatgaaagaatgtgtaactacgggccgggccctactaccagccgtaaaccctggacaagaagcctgcctacactttacagcccctgggagccccgactcaaaatgccttaagatcaaggtcaaacgcataaacctcaaatgcaaaaagagcagctcatactttgtgcccgacgcgcgctcacgatgcacaagcgtacgtagatgccgatgggcgggcgactgccaaagcgggtgtccatcgcacttcaccagcaacagtttcagcgacgactgggccggcaaaatggaccgcgcaggactagggttctcaggctgcagcgacggctgcggaggcgcagcttgtggatgcttcaacgcggcgccatcgtgcatcttctggaggaaatgggtcgagaacccacacgggatcatatggaaagtgtccccatgcgccgcatgggtgccctcggctgtgatcgaactcaccatgcccagcggcgaagtacgcacgtttcacccgatgagtgggatcccaacacaagtcttcaaaggagtgagcgtaacgtacctcgggtccgacatggaagtttcaggcctgaccgacctatgcgaaatcgaagaactgaaaagcaagaaactagcactcgcaccgtgcaaccaagcgggaatgggggtagtcggcaaagtcggagaaatacaatgcagcagcgaagaaagcgccagaaccatcaagaaagacggctgcatatggaacgcagacctcgtcggcatcgaacttagggtggatgacgcagtgtgctactccaaaataacctccgtagaggccgtcgcgaactacagcgcaatccccactaccatcggaggactaagattcgaacgatcccacgacagccaaggcaaaatatcagggagcccactcgacataaccgcaatccgcggcagcttcagcgtaaactaccgaggcctgcggctgagcctatctgaaataaccgctacatgcaccggggaagtgacaaacgtatcaggatgctatagctgcatgacgggcgcgaaagtatccataaaactccactcctccaaaaactcaacagcgcacgtacgatgcaaaggagacgaaacagccttctcagtactagaaggcgtccactcatatgcggtaagcctgagtttcgaccacgccgtagtagatgaacaatgccaacttaactgcggaggccacgaaagccaagtcactctaaaaggaaacctcatcttcctagacgtaccaaaattcgtggacggatcgtatatgcagacttaccatagctcagtaccgacgggagctaacattccaagcccaacagattggctcaacgcactctttggtaatggcctgagccgctggattctaggcgtaataggcgtgctcctcggcggactcgcgctattcttcctgatcatgagccttttcaaacttggcaccaaacaagtattccgctcaaggactaaactggcatga

SEQ ID NO: 16412 - RNA, 3222 nt, synthetic construct
  misc_feature 1..3222: note = derived and/or modified CDS sequence (opt11) from SFTSV(KAGBH4)__KU507562.1__GP
  source 1..3222: mol_type = other RNA
atgatgaaagtcatctggttcagctcactaatctgcctggtaattcaatgctcgggagacacaggacccataatctgcgcggggcccatccacagcaataaatcggccaacattccacaccttctcggatacagcgagaaaatctgccaaatagacagactgatacacgtgagcagctggctgaggaaccactcacaattccaaggatacgtaggccaacgtgggggccgcagccaagtctcatatttcccagcggaaaactcatattccagatggagtggattactaagcccctgtgacgcagactggctaggaatgctcgtggtaaagaaagccaaaggctcagacatgatcgtgccaggtccgagctacaagggcaaggtctttttcgaacgtccgacattcgacggatacgttggatggggatgcggatccgggaaaagccggaccgaaagcggcgaactatgctcctcagatagcggaacatcgtccgggctactgccaagcgacagagtcctgtggataggcgacgtagcatgccaaccgatgacccccattcccgaagaaaccttcctcgaactcaagtcattcagccagagcgagttcccggacatctgcaaaatagacgggatcgtcttcaatcagtgcgaaagcgagagcctcccccaacccttcgacgtcgcatggatggacgtaggccactcccacaaaatcataatgcgggaacacaaaacgaagtgggtacaggaaagcagttccaaagatttcgtctgctacaaagaagggactggaccctgctccgaatccgaagagaaaacgtgcaaaacgagtgggtcatgccggggagacatgcagttctgcaaggtcgccggctgcgaacacggagaagaagcctcagaagcaaaatgccgatgtagcctcgtccacaagccgggcgaagtcgtcgtctcttacggagggatgcgagtgaggccgaaatgctacggcttcagtcgaatgatggccacgttggaagtgaatccgcccgaacaacgaatcggccaatgcaccggctgccacctagaatgcataaacggaggtgtcagactcatcaccctaacaagtgaactgaaatcagccacagtgtgcgcaagccacttctgcagttccgcgacaagcggcaagaaaagcaccgaaatacaattccactcgggcagcctagtaggaaaaaccgcaatacacgtcaagggcgccctagtagacgggacagagttcacgttcgaaggatcatgcatgttcccggacggatgcgacgccgtagactgcacattctgcagagagttcctcaaaaacccacagtgctacccggcaaagaaatggctgttcataataatagtgatcctactaggatacgccggtctgatgctactaacgaacgtcctcaaagcgatcggagtctggggctcgtgggttatagctccagtaaaactcatgttcgccatcataaagaagctcatgagatccgtcagctgcctcatgggcaaattaatggaccgcggacgacaagtaatacacgaagaaattggcgaaaatagagaagggaaccaagacgacgtgcgcatcgaaatggcaagaccccgcagagtccgacactggatgtactccccagtcatcctaacaatactagcaattggactagcagaaggctgcgacgagatggtacacgcagattcaaagctagtatcatgtaaacaaggatcgggcaacatgaaggagtgcgtcaccacaggacgagccctactacccgcagtcaacccaggccaagaagcctgtctacatttcacagcccccggaagcccagattccaaatgcctcaaaatcaaagtcaaacgaatcaacctaaaatgcaaaaagagctcaagctacttcgtgcccgacgccagatcccggtgcacgtccgtccgacgctgtaggtgggcgggcgactgccaatcaggatgcccaagccacttcacatccaacagtttctcagatgactgggccgggaagatggaccgcgccggactgggcttctcgggctgttcagatggctgcggcggagctgcatgcggctgcttcaacgccgcgcccagctgcatcttctggcggaaatgggtagagaacccccacggcatcatatggaaagtgagcccctgtgcagcatgggtcccaagcgcggtcatcgagttaactatgcctagcggagaagtgagaaccttccacccaatgtccgggatccccacccaagtcttcaaaggagttagtgtaacgtacctgggctcggacatggaagtctccggactgacagatctctgcgagattgaggaactaaaaagcaagaaactagccctagcaccatgcaaccaggccggcatgggcgtagtcggaaaagtcggcgagatacaatgtagctccgaagaatcagcacgcactatcaagaaagacggctgcatctggaacgcagatctcgtcggcatcgaactacgagtggatgacgcagtatgctactcgaaaataaccagcgtagaagccgtcgccaattactcagccatccccaccaccatcggcggcctccgtttcgaacgatctcacgactcccagggaaaaatttcaggatcgccactagacatcaccgccatacgaggatcattcagcgtcaattacagaggcctaagactctcactgtcagagattaccgcaacatgcacaggggaagtcacaaacgtcagcggctgctacagttgcatgaccggagccaaagtatcaatcaaactacactcgtcgaaaaactcaaccgcccacgtacgctgcaaaggagatgagaccgcgttcagcgtactagaaggtgtacacagctacacagtaagcctatcattcgatcatgcagtcgtcgatgaacaatgtcaactcaactgcgggggacatgaaagccaagtcaccctcaaaggaaacctaatattcctcgacgtacccaagttcgtcgacggctcgtatatgcaaacataccacagcagcgtaccaaccggcgccaacatacccagcccaaccgactggctcaacgcgctatttggaaacggcctaagtcgctggatactaggcgttataggtgttctcctaggagggctcgccctattctttctgatcatgagcctattcaaacttggaaccaaacaagttttccggagccgcacaaaattagcctaa

SEQ ID NO: 16413 - RNA, 3222 nt, synthetic construct
  misc_feature 1..3222: note = derived and/or modified CDS sequence (opt11) from SFTSV(KAGBH5)__KP663738.1__GP
  source 1..3222: mol_type = other RNA
atgatgaaagtcatctggttcagctcgctcatatgcctggttatacagtgtagcggagacaccggaccgattatctgcgcgggaccgatacacagtaacaaatccgcaaatataccacatctgctagggtacagcgagaaaatctgccagatagacaggttaatacacgtatcgtcgtggctacgaaaccactcacaattccagggatacgtgggccaacggggaggcaggtcccaggtttcgtactttccagccgaaaattcttacagtagatggtcgggcctcttgtcgccgtgtgacgcggactggctaggcatgttggtcgtaaagaaagccaaaggctcggatatgatagtccccggccccctatacaaaggcaaagtcttcttcgaacgccccacattcgacggatacgtaggctgggggtgcggcagcggaaagagcaggaccgaatccggggagctctgcagcagcgatagcgggacctccagcgggctactgccctccgacagagtactctggataggcgacgtcgcgtgtcaacccatgaccccaatcccagaggaaacattcctcgaactgaaaagtttcagccaaagcgagttcccagacatctgcaaaattgacggcatagtattcaaccagtgcgaaagcgagagcctgccacagccctttgacgtggcttggatggatgtgggccacagccacaaaataataatgagggaacacaaaactaagtgggtccaagagtcgagctcgaaagactttgtatgctacaaagagggcacagggccatgctccgaatcagaagaaaagacgtgcaaaacttcaggctcctgcaggggagacatgcagttctgcaaagtcgccggctgcgaacacggggaggaaacctccgaagcgaaatgccgatgtagcctcgtacacaaaccaggtgaggtcgtcgtaagctacgggggaatgcgagtccgacccaaatgctacggattctcacggatgatggccaccctagaagtgaacccaccagagcagagaatcggacaatgtaccggatgccaccttgagtgcataaatggcggcgtacgtttgataacgctgaccagcgaactaaaatcggcgaccgtgtgcgcgagtcatttctgtagctcggcaacctcagggaaaaagagcacggaaatccaatttcattcaggctcactggtaggcaagaccgcgatccacgtcaaaggcgccctagtagacgggacggagttcacattcgagggtagatgcatgttcccggacggatgcgacgcggtagactgcacattctgcagagagttcctgaagaacccgcaatgctacccagcgaagaaatggcttttcataatcatcgtgatcctgcttgggtacgccggactgatgctattgacaaacgtgctaaaggcagtgggagtatgggggagctgggtcattgccccggtaaaactaatgttcgccataatcaaaaagctaatgaggtcagtcagctgcctaatgggcaaactgatggatcggggacggcaagtcatacacgaagaaataggcgaaaacagggagggaaaccaggacgacgtacggatcgagatggcgcgccccagacgggtcagacactggatgtatagcccagtgattctggccatccttgccatcggcctagccgaaggctgcgatgagatggtgcacgcagactcgaagctagtctcttgcaaacaggggagcggaaacatgaaagaatgcgtaacgacaggaagggcactcctcccagcagtaaatccggggcaagaggcatgtttacacttcacggctcccgggtcaccagactcgaaatgtctcaaaatcaaagtcaaacgaataaacctcaaatgcaagaaaagctcaagctacttcgtaccagacgcccggagtaggtgcactagcgtaaggcgctgccgatgggcaggagactgccagagtggatgcccaagccactttacgagcaacagcttcagcgacgactgggcggggaaaatggacagagccggactaggcttctccggctgtagtgacggctgcggcggggcagcctgcgggtgcttcaacgctgccccctcctgcatattctggagaaaatgggtggaaaacccgcacgggatcatctggaaagtctcaccatgcgcagcatgggtaccaagtgccgtgatcgaactcacgatgccgagtggagaagtacgcacgttccacccaatgagcggaatccccacccaagtcttcaaaggagtatcagtcacctacctgggatccgacatggaagtgagcggactcacggacctgtgcgaaatcgaggaattgaaatccaaaaagctggcgctcgccccatgcaaccaggcggggatgggagtagtaggtaaggtcggggaaatacaatgcagcagtgaggaaagcgcacgcacaataaagaaagatggctgcatatggaacgcagacctagtcgggatagaactccgcgttgacgacgcggtatgctacagcaaaataacgagcgtcgaagccgtagccaactactcggcgatacctacgaccatcggcgggctccggttcgagcgcagtcacgacagccaggggaaaataagcggctcgcccctagacatcaccgcgatcagaggcagcttctcggtcaactaccggggcctaagactaagtttaagcgaaatcactgcaacctgcacaggagaagtaactaacgtgagcggatgctacagctgcatgacaggagctaaagtaagtataaaattgcactcaagcaagaacagcaccgcacacgttagatgcaaaggagacgaaaccgccttttcagtactagaaggagtacacagctacacagtatcgctatcctttgaccacgcagtagtagacgagcagtgccaactaaactgcggcggccatgagagccaagtcacactaaaaggcaacctaatcttcctagacgtaccaaaattcgtagacggatcctacatgcaaacataccacagctccgtcccgaccggggccaacatcccgtcaccgacagactggttaaacgcactattcggaaatggcctaagccgatggatcctcggcgtcatcggtgtactgctgggaggactcgcactcttcttcctgatcatgagtctcttcaagctggggacaaagcaagttttccgaagccggacaaaactggcgtga

SEQ ID NO: 16414 - RNA, 3222 nt, synthetic construct
  misc_feature 1..3222: note = derived and/or modified CDS sequence (opt11) from SFTSV(KAGBH6)__KP663741.1__GP
  source 1..3222: mol_type = other RNA
atgatcaaggtgatctggttctccagcctaatatgcctagtaatccaatgctccggcgacacgggcccaataatctgcgccggccctatacacagcaacaaaagcgcgaacattccacatctactcggatactcggagaaaatatgccaaatagacagactcatccacgtcagctcttggctgcgcaaccactcacaatttcaaggctatgttgggcaacgaggtggaagaagccaggtcagctacttccccgcagaaaacagttacagccgatggtcaggactactgtcgccatgtgacgccgactggctcggcatgctcgtagtgaagaaagcaaagggttcagacatgatcgtgcccggcccctcctacaaagggaaggtcttcttcgaaagacccaccttcgacggatacgtaggatggggttgcggcagcggtaaaagcaggaccgaaagcggcgaactatgctccagcgacagcggcacctcaagcggactactacccagcgaccgagtactatggataggagacgtcgcatgccagcccatgacacccataccagaagaaacattcctagaactaaaatccttctcccaaagcgagttccccgacatctgcaaaatagacggtattgtcttcaaccaatgcgagagcgaaagcctaccccagccattcgatgtagcgtggatggacgtaggacatagccacaaaatcatcatgcgggaacacaagacgaaatgggtccaagaatcaagttcgaaagacttcgtttgttacaaagagggaacgggaccatgttcagaatccgaagagaaaacgtgcaagacatccggatcgtgtcgcggcgacatgcagttctgcaaagtggcaggatgcgaacacggcgaagaagcatcagaagcgaaatgccgctgctcactcgtacacaaacccggagaagtcgtggtatcgtacggaggaatgcgagtacgcccgaaatgctacggtttcagccgcatgatggcgacactagaagtgaacccaccagaacaacgcataggccaatgtacagggtgccatctcgagtgcatcaatggtggagtgcgactgataactctcaccagtgaactaaagtccgcaaccgtctgcgccagccatttctgcagctcggcaacgagtggcaaaaagtccactgagatccagtttcactcgggatccctcgtcggcaaaaccgcaatccatgtcaaaggagctcttgtagacgggaccgagttcacgttcgaaggctcctgcatgttcccagacgggtgtgatgcggtcgactgcaccttctgtcgcgagttcttgaaaaacccccaatgctacccagcaaagaaatggctgtttatcatcatcgtaatcctcctagggtacgccggactgatgctactaacaaacgtcctcaaagcaataggcgtatgggggtcctgggtcatagcacccgtaaagctaatgttcgcgataatcaaaaagctcataagaagcgtatcttgcctaatgggcaaactaatggaccgcggccgccaagtaatacacgaagaaatcggagaaaacagggagggaaaccaagacgacgtacgaatcgagatggcccgcccacgaagagtaagacactggatgtactctccagttatactcacaatcttggccatcggtctcgctgaaggttgtgacgagatggtccacgctgactcaaagctagtttcgtgcaaacaagggtccggaaacatgaaagaatgcgtaactacaggccgagcactgctgccagccgtgaacccgggacaagaagcatgcctccactttacagcccccgggtcaccagacagcaaatgtctaaaaatcaaagtcaaacgaataaatctcaaatgcaagaaatcctcaagttacttcgtacctgacgcgcgcagccgctgcaccagcgtacgcagatgtaggtgggcaggagactgccaaagcggatgccccagccacttcacatccaactcgttctcagatgactgggcggggaaaatggacagggccggactaggcttcagtggctgcagcgatggctgcggaggagcagcatgcggttgcttcaacgcggcccccagctgcatattttggaggaaatgggtggagaacccccatggtataatctggaaagtctcaccttgcgccgcatgggtaccctcagcagtaatcgagctaactatgccaagcggagaagtgcggacattccaccccatgagcggaatacccacccaagtctttaaaggggtatctgtaacgtatttaggctcagacatggaggtaagcgggctaacggacctgtgcgagatagaggaactaaaaagtaagaaactagcgctcgcaccctgcaaccaagccggcatgggcgtagtaggcaaagtcggagaaatccaatgctcatcggaagaatccgcacgaacaataaagaaagacggctgcatctggaacgctgacctcgtaggcatcgaacttagggtagatgacgccgtgtgttactccaaaataacgagcgtagaagccgtagcgaattactccgcaatacccacgaccataggcggactccgcttcgagagatcccacgatagccaaggaaaaatatccggaagtcccctcgacatcaccgcgataagagggtccttcagcgtaaactatagaggccttcgattaagcctcagcgaaatcagcgccacatgcactggcgaagttacaaacgtgagtggctgctacagctgcatgacaggcgcgaaagtctcaataaaactacactcgagcaaaaactcaaccgctcacgtccgatgcaaaggggacgaaacagcgttttcggtcctggaaggcgtacacagctacaccgtatcactcagcttcgaccacgcagtagtcgacgagcagtgccaactaaattgcgggggacacgagtctcaagtgacactaaaaggcaacttaatattcctagacgtcccaaaattcgtagacggctcatacatgcaaacataccactcctctgtacctacgggagccaatatccccagcccgacagactggctaaacgcactcttcggaaacggactatccagatggatcctcggagtgataggagtactactaggcgggctcgccctcttcttcctgataatgagcctgttcaagctcgggacaaagcaggccttccggtcaaggacaaaattagcatag

SEQ ID NO: 16415 - RNA, 3222 nt, synthetic construct
  misc_feature 1..3222: note = derived and/or modified CDS sequence (opt11) from SFTSV(KAGNH)__KU507550.1__GP
  source 1..3222: mol_type = other RNA
atgatgaaagtcatctggttctccagccttatatgcttagtcatacaatgcagtggagacacgggaccgattatatgtgcaggcccaatacacagcaataaaagcgcgaacataccgcacctcctgggatattctgagaaaatctgccaaatagacagactaatacacgtcagttcttggctaaggaaccacagccagttccaagggtacgtcggcagacgcgggggtaggtcccaggtctcatacttcccggccgaaaacagttactcgagatggagcggactactgagcccttgcgacgccgactggcttggcatgctagtggtaaagaaagcaaagggaagcgacatgatcgtgccagggccgagctataaaggcaaagtcttcttcgaacgcccaaccttcgacggatacgttggctggggctgcggatcgggaaagtcacgaactgagtccggggagctgtgctcgtcagatagcgggaccagtagcggcctcctgccatcggaccgcgtcctgtggataggagacgtcgcttgtcagcctatgaccccgatcccagaagaaaccttcctcgaactcaagtcattcagtcaatccgagttccctgacatatgcaagatcgacggaatagtcttcaaccaatgcgaaagtgagagtctcccgcagccattcgacgtggcatggatggacgttggacacagccataaaatcataatgcgcgaacacaaaacgaaatgggtacaggaatccagctcaaaagacttcgtatgctacaaggaggggacgggtccgtgctcggaatcggaagagaaaacttgcaaaactagcggctcgtgccgaggggacatgcagttctgcaaagtcgccggttgcgaacacggtgaagaggcaagcgaggccaaatgccgctgcagtctagtccacaaacccggggaagtagtcgtgtcgtacggaggcatgcgcgtacgaccaaaatgctacgggttctcccgcatgatggcgacactagaagtaaatccgcccgaacagcggataggacaatgcacagggtgccacctcgagtgcataaacgggggcgtcaggctgatcacactaaccagcgaactcaaaagcgcaaccgtttgcgcctcccacttctgtagcagcgcaacaagcggtaaaaagagcactgagatccaattccactccggcagcctagtgggaaaaacagcaatccatgtgaaaggcgcactcgtcgacggtacagagttcacctttgagggcagctgcatgtttcccgacggatgcgacgccgtagactgcaccttctgccgagagtttcttaaaaacccccaatgctacccagcgaaaaagtggctattcatcatcatcgtgatcctgctcgggtacgcaggactgatgctcctcaccaacgtcttgaaagccataggcgtttgggggagctgggtgatagctccggtcaaactcatgttcgcgatcatcaagaaactaatccgcagcgtatcatgcctgatgggaaagctaatggaccgcggacgccaggtcatacacgaggagataggtgagaaccgcgaaggaaaccaggacgacgtaagaatagaaatggcgagaccaagaagagtacgacactggatgtactcaccagtcatactcacaatcctcgcaataggactggcagaaggttgtgatgagatggtgcacgcggactcaaaactggtcagctgcaaacaaggctccgggaacatgaaagagtgcgtaacaacaggccgggctctactaccggcagtgaatcccggccaggaagcgtgtctacacttcacggcgcccgggagcccagactcaaagtgcctaaaaataaaggtaaaacgtataaatctaaaatgtaagaagtcatcgtcctacttcgtcccggatgcaagaagccgctgcacatcagtccggcggtgccgctgggcgggagactgccagagcggctgcccaagccacttcacgagcaacagcttcagcgacgactgggccgggaagatggaccgggcaggactggggttctcgggctgcagcgacggttgtggcggggccgcctgcggatgcttcaacgcggccccaagctgcatcttctggagaaaatgggtcgagaacccgcacgggatcatctggaaagtcagcccctgcgccgcctgggtccccagcgccgtaatagagctaaccatgccaagcggagaggtcagaaccttccatccaatgagcggaatcccgacccaggttttcaaaggagtgtcagtgacctacctcggcagtgacatggaagtgagcgggctaacagacctatgcgaaatcgaggaactcaaaagcaagaaactcgcactggccccctgcaaccaagcaggaatgggcgtagtgggaaaagtgggagagatacaatgctcctcggaagaatcagcccggaccatcaagaaagacggctgcatctggaacgccgacctggtaggtatcgagcttagggtcgatgatgcggtatgctactcaaaaatcacttcagtagaggcagtggcaaactactcagcaataccaacgaccataggcggtctgcgcttcgagcgaagccacgacagccaggggaaaatctcaggaagcccactagacataacggcgatccgaggctcattctcggtcaattacaggggacttcgcctaagcctgagcgaaatcaccgcgacgtgcaccggagaagtcacgaacgtgagtggatgctacagctgcatgacaggggcgaaaataagtatcaaactccattcgagtaaaaactcgacggcacacgtacgatgcaaaggtgacgagaccgcattcagcgtcctagaaggcgtacacagctacacagtatccttaagtttcgaccatgccgtggtcgacgaacaatgccaactcaactgcggagggcacgaatcgcaggtaactctcaaaggaaacctcatatttctagacgtaccgaaattcgtcgacggcagctacatgcaaacgtaccacagctcagtcccaaccggagcaaacatcccgagcccaacagactggctaaacgcattattcggcaacggactatcaaggtggatactcggagtaataggagtcctattagggggtctagcactcttcttcctgatcatgagcctatttaaactaggcaccaatcaagttttccgctcaagaacgaagctcgcataa

SEQ ID NO: 16416 - RNA, 3222 nt, synthetic construct
  misc_feature 1..3222: note = derived and/or modified CDS sequence (opt11) from SFTSV(KAGNH4)__KU507551.1__GP
  source 1..3222: mol_type = other RNA
atgatgaaggtgatctggttcagcagcctcatatgcctcgtcatccaatgcagcggcgacacaggacctatcatttgcgccggaccaatacactcaaacaaaagcgcgaacataccccatctactcggctactcggagaaaatctgccaaatagacaggctcatacatgtgagctcatggctccgcaatcactcgcaattccaggggtacgtggggcaaagaggcggccggagccaggtatcctacttcccggccgaaaactcctatagtcgctggtccggcctcctgtccccctgcgacgcggactggctcggaatgctggtggtgaagaaagccaaaggcagcgacatgattgtgccaggaccatcctataaaggcaaggtcttcttcgaacgcccgacattcgacggatacgtcggatggggctgtggatcaggaaaaagccggacagaatcaggggagctgtgctccagtgattccgggacctccagcggactgttacccagcgacagggtcttatggataggcgacgtcgcatgccaacccatgacacccatcccagaagaaacgttcctagagctcaagagcttcagccaaagcgagttcccagacatatgtaaaatcgacggcatagtatttaaccaatgcgaaagcgaaagtctaccccagccattcgacgtcgcctggatggacgtcggacactcccacaaaatcatcatgagagaacataaaacaaaatgggtacaagaatcaagttctaaggacttcgtctgctacaaagaaggaacaggaccctgctccgaaagtgaagaaaagacatgcaaaaccagcggctcctgcagaggagacatgcaattctgcaaagtagctggatgtgaacacggcgaagaagccagcgaagcgaaatgccgatgctcgctcgtccacaaaccaggagaggtggtagtctcgtacggcggaatgcgaatacgaccaaaatgctacggattctcacgtatgatggccaccctcgaagttaatcccccagaacaaaggatcgggcagtgcaccggttgccacctagagtgcataaacgggggcgtacgcttgatcacactaacaagcgaacttaaatcagcaaccgtatgcgcctcccacttctgctcaagcgccacatcaggcaaaaagagcaccgaaattcaatttcacagcggatccctggtcggcaagactgcgattcacgttaagggagcgctagtagacggaaccgagttcacgttcgaaggaagctgcatgttcccggacggatgcgacgcagtggattgcacattctgcagagagttcctaaagaacccccaatgctatccggccaagaaatggcttttcataataatcgtaatactgctaggttacgccggcctaatgctactcacaaacgtactaaaagccataggcgtatgggggtcctgggtaatcgccccagtgaaactaatgtttgcgataatcaagaaactcatgcgctcagtctcatgcctcatgggcaaactcatggaccgaggtagacaagttatccacgaagaaatcggcgaaaaccgggaagggaaccaagacgacgtccgaatagagatggcgcggccccgccgagtgagacactggatgtacagcccagtaatactcactatactcgcaataggcctagccggcggttgtgacgaaatggtacacgctgactcaaaacttgtatcatgccgacaaggaagcggtaacatgaaagaatgcgtgaccacgggacgagccctcctaccagccgtcaacccgggccaggaagcatgccttcacttcacagcaccaggatcaccagattcaaaatgcctcaaaattcgagtcaaacgcatcaacttgaaatgcaagaaaagcagttcctacttcgtaccagacgcgcgcagccgatgcacgagtgtccgaagatgcagatgggcaggcgactgccaatccgggtgcccatcccacttcacatctaacagtttttcagacgactgggccgggaaaatggacagagcgggccttggtttcagcggctgtagcgacgggtgtggcggggcagcctgcggatgcttcaacgcagcacctagctgcatcttctggcggaaatgggtagaaaacccccatggcatcatatggaaagtgtcaccatgcgcagcctgggtcccaagcgccgtaatcgaactcacgatgccaagcggggaagtaagaacattccaccccatgtccgggataccgacccaggtatttaaaggcgtatcggtaacctacctcggctcggacatggaagtaagcgggctgacagacctgtgcgaaatagaagaactaaaatcccgcaaactagcactagccccatgcaaccaagcagggatgggggtcgtgggtaaagtgggagaaatacaatgctcaagtgaagaatcagcacgcactatcaagaaagacgggtgtatctggaacgccgacttggttgggatagaactcagagtcgacgacgcagtctgctactccaaaataaccagcgtggaagccgtcgccaactacagcgccatccccacgaccataggaggcttacggttcgaaagatcacatgacagccagggcaaaatcagcggaagccccctagacataacagcaataaggggctccttctcagttaactaccgcggactacgactcagcctctcagaaataaccgcgacgtgtacaggtgaagtcacgaacgtatccggctgctacagctgtatgactggcgccaaagtatccatcaaactacattcgagtaaaaattcgaccgcccacgtaagatgcaaaggggacgaaacagccttcagcgtactagaaggggtgcacagctacacagtcagcctgagcttcgatcacgccgtggtggacgaacaatgccaactcaactgcggcggacacgaatcccaagtcaccctaaaggggaatctaatatttctcgatgtacctaaattcgtcgacggctcatacatgcagacgtatcactcctcggtcccgaccggcgcgaacataccaagccctaccgactggttaaacgccctcttcggaaacggactttctaggtggatacttggtgtgatcggagtattactcggaggcctcgcactcttcctcctcatcatgagcctattcaaactgggcacgaagcaagtcttccgcagcagaacaaaactcgcgtga

SEQ ID NO: 16417 - RNA, 3222 nt, synthetic construct
  misc_feature 1..3222: note = derived and/or modified CDS sequence (opt11) from SFTSV(KAGWH2)__KU507564.1__GP
  source 1..3222: mol_type = other RNA
atgatgaaagtaatatggttcagctccctcatatgcctggtaatacaatgcggcggggacacaggtccaataatatgtgcaggcccaatccacagcaacaaatcggcgggaataccccacctactaggatactcagagaaaatctgccaaatagaccggctcatacacgtgagctcctggttacgaaaccactcacaatttcaaggctacgtgggccaacgcgggggacgatcacaagtatcatactaccccgcggagaacagctattccagatggtcaggattactctcgccctgcgacgcagactggctagggatgcttgtagtgaaaaaggcaaagggcagcgacatgattgtccctggaccctcttacaaaggaaaagtcttcttcgaacgacctacattcgacgggtacgtaggctggggctgtggatcaggcaagtctcgaaccgaaagtggggagctgtgctcgagtgacagcggaacctcaagtggcctactgcctagcgaccgggtcctatggatcggagacgtcgcgtgccaaccaatgaccccgataccagaagaaaccttcttagagctaaaaagtttctcccagagtgagttcccagacgtgtgcaaaatcgacggcatagtattcaaccaatgcgaaggagaatcactaccacagccattcgacgtggcctggatggacgtaggacactcacacaaaatcataatgagggaacacaaaaccaagtgggtgcaggaatcgagctccaaagacttcgtatgctacaaagaaggaacgggcccatgctcggaatcagaagaaaagacatgcaagacatcgggcagctgcaggggcgacatgcagttctgcaaagtagcaggatgcgagcacggggaagaggcctctgaggcgaaatgccgctgcagccttgtccacaaacctggcgaagtggtggtcagttacggaggaatgagagtcagacccaaatgctacggcttcagcagaatgatggcaaccttagaagtgaatccgccggagcaaagaatcgggcaatgcaccggatgccatttagaatgcataaatgggggagtacgcctcattacgctcacgtcagagctaaagagcgccaccgtgtgtgcaagccacttctgtagttcagcaacgagcgggaaaaagagcacagaaattcaattccactcaggctcactggtgggaaaaacggcgatccatgtaaaaggagccctggtggacggaacagagttcacgttcgaaggctcatgcatgttcccagacgggtgcgacgccgtagactgtaccttctgccgagagttcctaaagaacccgcaatgctacccagcaaagaagtggctattcataataattgtaattttgctcgggtacgcgggcctaatgctgctcacaaacgtactcaaagcaatcggcgtatgggggagctgggtcattgcaccggttaaacttgtgttcgcgatcatcaagaaactgatgagggcggtcagctgcctgatgggaaaactgatggatcgagggcgccaggtaatacacgaagaaataggcgagaatagggaaggaaaccaggacgacgtgcggatcgaaatggcacgtccgcgacgggtaagacactggatgtacagtccagtcatcctgacgatcctggcgataggcctagcagaggggtgcgacgaaatggttcatgcggactcaaagctcgtctcctgccgccagggatccggaaacatgaaggaatgcgtaactacaggccgtgccttactcccggctgtgaaccccggccaggaagcatgcctccacttcaccgccccaggaagcccggatagcaaatgcctgaaaatcaaggtcaagcgcatcaacttgaaatgcaagaagagttcgtcctacttcgtgcccgatgcacggagccgatgcacgagcgtaaggcgctgcagatgggcgggcgattgccagagcgggtgcccaccgcactttacgtccaacagcttttcggatgactgggccgggaaaatggaccgagccggcctcggcttcagcggttgcagtgacggctgcggaggggcggcgtgtgggtgcttcaacgccgccccgagctgtatattctggagaaaatgggtcgagaacccgcacggaatcatatggaaggtttcaccttgcgccgcatgggtgccgagcgcagtcatcgagctaacaatgccgagcggggaggtaagaacattccacccaatgagcggaatcccaacacaagtcttcaagggggtctcggtaacctacttgggctccgacatggaagtgagcggcctcacggacctctgcgagatagaggaactcaaatcgaaaaagctcgcactcgcaccatgcaatcaagcaggcatgggggtcgtaggcaaagtcggggaaatacaatgctcaagcgaagagagcgcccgcacgataaagaaagacggctgtatctggaacgcagacctagtcgggatcgagctcagagtcgacgacgcagtttgctactcgaaaatcacctcagtagaggcggttgcaaactactcagccataccaacgacaataggtggactcaggtttgagcgcagccacgacagccaggggaaaatctcgggttcacctctggatatcacggcgatcagaggatcattctcagtaaattacagaggcctaagactctccctcagcgagattacagccacatgcaccggcgaagtaacgaacgtgagcgggtgctactcatgtatgacaggtgcaaaagtcagcataaaactacactcgagcaagaacagcaccgcacacgtaaggtgcaaaggggacgaaaccgccttctcggtactggaaggggtccacagctactcagtatcgctatccttcgaccatgccgtggtggacgaacaatgccagctcaactgcggaggccacgaatcacaagtaactctccgcggaaacctgattttccttgacgtaccgaagtttgtagacggctcttacatgcaaacgtaccacagcacggtcccgaccggggcaaacataccaagtccaacagattggctgaacgcgctattcggaaacggattaagccgatggatactcggagtcatcggcgtgctactaggagggctcgcactattcttcttgataatgagcctattcaaactcgggacaaagcaagtattcagaagcaggacaaagctagcgtga

SEQ ID NO: 16418 - RNA, 3222 nt, synthetic construct
  misc_feature 1..3222: note = derived and/or modified CDS sequence (opt11) from SFTSV(KAGWH3)__KP663735.1__GP
  source 1..3222: mol_type = other RNA
atgatgaaagtaatatggttcagctcactgatatgtttagtgatccaatgcagtggcgacacgggcccaatcatatgtgcagggccgatccacagcaacaagagcgccaacatcccgcacctcctaggatactcagagaagatatgtcaaatcgacagattaatacacgttagcagctggctacgcaaccactcacagttccaaggttatgtaggccaaaggggaggacggtcccaagtctcgtattttcctgcggaaaacagttactccaggtggtccggactactatcaccatgcgacgcagactggctcggaatgcttatagtcaagaaagcgaaagggagcgacatgatcgtgcccggcccctcctacaaaggcaaggtattctttgagcgaccaaccttcgatggctacgtcggatggggatgcggatccggcaaaagcaggacagaaagcggggaattatgttcttccgactcaggcacaagtagtgggctactcccatcagacagagtcctgtggataggagacgtcgcatgccagccgatgaccccgatacccgaagagaccttcctagaactcaaatctttcagccaaagcgagttccccgacatctgcaaaatagacggcatcgtcttcaatcaatgcgaaagcgaatcactaccacaacctttcgacgtagcctggatggatgtcggtcacagccacaaaatcatcatgcgagaacacaaaaccaagtgggtccaagaaagcagctccaaagacttcgtctgctacaaagagggaaccggcccatgctccgaaagcgaagaaaagacgtgcaaaacaagcggttcatgcagaggggacatgcagttctgcaaggtagccggctgcgagcacggagaagaagctagcgaagcaaaatgcagatgcagtctagtccacaaaccgggggaagttgtagtatcctacggaggtatgagggttaggcccaaatgctatggattcagtcgcatgatggccacactggaagttaatcccccagaacaacgaataggacaatgcacaggctgccacctcgaatgcataaacggcggcgtacgccttatcacactgacatcggaactaaaatccgccaccgtgtgcgcaagccacttctgctcctcagcgacatccggtaagaaaagcaccgaaatacagttccactcaggtagcctcgtcggcaaaaccgccattcacgtaaaaggcgcgctagtagacggtacagagttcacatttgaagggtcctgcatgttcccggacggctgcgacgccgtagactgcacattctgccgcgagttccttaaaaacccacaatgctaccccgctaagaaatggttatttataatcatcgttatcctactaggatacgcgggcttaatgctactaaccaatgtcctcaaagccatcggggtctggggaagttgggtaatagccccagtaaaactaatgttcgccataatcaagaaacttatgcgcagcgtctcatgcctaatgggaaaactcatggatcgaggacggcaagtaatacacgaagagattggcgaggtcagggagggcaaccaggacgacgtccggatcgaaatggcacgacctagacgagtccgacactggatgtacagcccagtcatactcactatcctcgcgatcggactcgcagaggggtgcgacgagatggtgcacgcggactccaaactcgtctcctgcaaacaaggctcgggaaacatgaaagaatgcgtaacaaccggacgagccctactacccgccgtaaaccccggacaagaagcatgcctacacttcacggcaccgggatcacccgactcaaaatgcctcaaaataaaagtaaagaggataaacctgaaatgcaagaaatccagcagctacttcgtccctgatgcccgtagccgctgcaccagtgtacgtagatgccgctgggcaggagactgccaatccgggtgcccgagccactttaccagcaacagcttcagcgacgactgggcaggcaaaatggacagagcaggcctgggcttcagcggatgcagcgacggctgcggcggcgcagcgtgcggatgcttcaacgcagccccatcctgtatattctggcgaaaatgggtcgaaaatccacacggcataatctggaaagttagcccatgcgcagcctgggtgccgtcggcagtcatcgaactgaccatgccctcaggagaagtaagaaccttccacccaatgtccggcatcccgacacaagtcttcaaaggggtcagcgtcacatacttaggtagcgacatggaagtaagcggactaacggatctctgcgagatcgaagaactgaaaagcaagaaactcgcgctcgcaccatgcaaccaggcaggaatgggggtagtagggaaagtaggcgagattcaatgcagctcagaagagtcagcacgaaccataaagaaagacggatgcatctggaacgccgacctggtcggaatagaactcagagtggacgatgcagtatgctacagcaaaatcacctccgtagaagcggttgccaactactctgccataccgaccaccataggcgggctgcgatttgagagaagtcacgactcccaaggcaaaatctcaggtagcccgctagacataacagctatcagaggatccttctccgtcaactaccgcggactcagactcagcctcagcgaaataacagcgacgtgtacaggagaggtaacaaatgtaagcggctgctattcatgcatgaccggcgcaaaggtcagtataaaactccacagctccaaaaacagcacagcacacgtgcgatgcaaaggtgacgaaaccgcattcagcgtcctcgagggcgtacacagctatacagtgtccctcagcttcgaccacgccgtcgtcgacgaacaatgccagctaaactgcggcggccacgaatcacaagtcacgctaaaaggtaacctaatcttcctcgacgtacccaaattcgtagacggctcatacatgcaaacataccacagcagcgtaccaacgggagccaacattccatccccaaccgactggctcaacgccctattcgggaacggtctaagccgctggatactaggggtaataggcgtgctactcgggggactagccctcttcttcctcatcatgagcctcttccgactcggaacaaaacaagtcttccgctctcgaaccaagctagcctag

SEQ ID NO: 16419 - RNA, 3222 nt, synthetic construct
  misc_feature 1..3222: note = derived and/or modified CDS sequence (opt11) from SFTSV(KAICH)__KU507565.1__GP
  source 1..3222: mol_type = other RNA
atgatgaaagtaatctggttcagcagcttaatctgcctcgtgatccagtgcggaggggacacaagtcctatcatatgcgcaggcccaatccactcgaataaatccgcagacattccgcaccttctaggctactccgagaaaatctgtcagatagacagacttatacatgtctcgtcatggctccgcaaccacagccaatttcaaggttacgtcgggcagcgaggcggccggtctcaagtctcatactatcccgccgaaaacagctactccaggtggtcaggcctactcagcccgtgtgatgcggactggctaggaatgctggtcgtaaagaaagcgaaaggctcagacatgatcgtacccggaccctcctacaagggaaaagtattcttcgaacgacccacctttgacggctacgtcggatggggatgcggctcagggaaatcccggacggaaagcggcgaactctgctctagcgactctgggacgtcatccggactcttaccgtccgacagggtgctgtggataggcgacgtagcgtgccaaccaatgaccccaatcccagaagagacattcctagaactaaaatcattcagccaaagcgagttccccgatatctgcaagatcgatggaattgtcttcaaccaatgcgaaggagaaagcctacctcaaccattcgatgtagcgtggatggatgtcggccactcacacaaaataataatgagggaacacaaaacaaaatgggtccaggaatcaagcagcaaagacttcgtgtgctacaaggaaggaaccggaccttgctccgaatcagaggagaaaacatgcaagacatcgggaagctgcagaggagatatgcaattttgcaaggtggctgggtgtgagcacggggaggaagcctcagaagcaaaatgtcgctgctcactcgtacacaaacccggcgaggtcgtggtctcatacggaggcatgcgagtacgaccgaaatgttacggattctcacgaatgatggccaccctcgaggtaaaccaaccagaacaacgcatcggtcagtgcaccggctgtcacttagaatgcataagtggaggcgtgcggctcatcacgctcacttccgagcttaaaagcgccacagtatgcgcaagccacttctgcagcagcgccacgtccggcaagaaatccacagagatacaattccacagcggaagcctggtaggaaaaaccgcgatccacgtcaaaggagccctcgtcgacggaaccgagttcacattcgaaggctcatgcatgttcccggacggatgtgacgccgtagactgcacgttctgcagagaatttcttaaaaacccacaatgctaccccgcaaagaaatggctctttatcatcatagtgatactactaggatacgcaggtctcatgctgctcaccaatgtactcaaagccataggcgtctgggggagctgggtgatcgcgcccgtcaaattagtcttcgcaatcatcaaaaagctgatgcgcgcggtctcctgcttgatggggaaactcatggacagaggacgccaggtcatacacgaggaaatcggggaaaaccgcgagggaaaccaagacgacgtacggatcgaaatggcacgcccacgccgtgtaagacactggatgtacagccccgtgatactaaccatactcgcaataggcttagccgaaggctgcgacgaaatggtacacgcggactccaagctagtctcatgccgacaaggatcaggcaacatgaaagaatgcgtaaccaccggcagagccctgctaccagccgtcaaccccggccaagaagcgtgcttacacttcaccgcgcccgggtccccggactcaaaatgtctgaaaatcaaagttaaacgaattaacctcaagtgcaagaaatcctcaagctacttcgtccccgatgccagaagccgctgcacctccgtacggcgatgcagatgggcgggggactgccagtctggatgcccgccccacttcactagcaattcattctctgacgactgggcaggtaaaatggacagagcaggactcggattctcaggctgtagcgacggatgcggcggcgcagcttgtggatgcttcaacgcagctcccagctgtatcttttggcgaaaatgggtagaaaacccccacggcataatatggaaggtatccccctgcgccgcctgggtcccctcagcagtcatcgaactaacaatgccttccggcgaagtaagaaccttccatcccatgtctgggatacccacacaagtcttcaaaggagtatcagtaacatacctaggatccgacatggaagtaagcggactcacggacctctgtgagatggaagaactgaaatcgaaaaagctcgctttagcaccatgtaaccaagccggcatgggagtcgtggggaaagttggtgaaattcaatgcagctcagaagaaagcgcacgcaccatcaagaaagacggctgtatctggaacgcagacctcgtcggcatagaactccgtgtggacgacgcagtctgctacagtaaaataacctcagttgaggcagtaaccaactactcagcaatcccaaccaccatcggagggctcaggttcgaacgatcccacgatagccaaggcaaaatatcaggatcaccgctcgacataacggccataagaggcagcttctcagttaactaccgcggactcagactctccctgtccgagatcacagcgacctgcaccggagaagtaacgaacgtaagcgggtgctacagttgtatgacaggtgcgaaagtcagcattaaactgcactcatccaaaaactcgacagcacacgtgcgatgcaaaggcgacgaaaccgccttctctgtcctagagggagtccacagctacagcgtcagcctatcattcgaccacgcagtagtagacgaacaatgccaactaaactgcggcggccacgaaagcaaggtaaccctcagagggaacctcatcttccttgacgtaccaaaattcgtcgacggcagctacatgcaaacctaccacagcacagtcccaactggggccaacatcccgtccccgacggactggctaaacgccctcttcggcaacggactgtcgaggtggttccttggagtcattggagtactactcgggggactcgcactcttcttcctgatcatgagcttatttaaactagggacaaaacaagtgtttaggtcaaggtcgaaactcgcctag

SEQ ID NO: 16420 - RNA, 3222 nt, synthetic construct
  misc_feature 1..3222: note = derived and/or modified CDS sequence (opt11) from SFTSV(KAJJH)__KU507566.1__GP
  source 1..3222: mol_type = other RNA
atgatgaaggtcatctggtttagctcactaatctgcctggtgatacaatgctccggagacactggccccatcatctgtgccgggcccatacacagcaacaagagtgcaaacatcccacacctactcggctacagtgaaaagatctgtcaaatcgaccgcctcatccacgtaagctcatggctgcgtaaccactcccaattccagggttatgtcggacaacgcgggggcagatcccaagtctcatactaccccgcagaaaattcatactcacgatggtctggcctactatcaccctgcgacgccgactggctgggaatgctcgtcgtgaaaaaggcgaagggctcggacatgatagtaccagggccaagttacaagggcaaagttttcttcgaaagaccaacattcgatggatacgtgggctggggatgcggatcaggcaagagccgcaccgagtccggagagctctgctcaagcgacagcggaacgagcagcggactcctaccctcgaaccgggtactatggatcggagacgtggcttgccaacctatgactccaatccccgaagaaaccttcctagagctaaaatctttcagccaaagcgagttcccggacatatgcaagatagatggaatcgtattcaaccaatgcgagagcgaaagcctcccacagcccttcgacgtagcatggatggatgtcgggcacagtcacaaaataatcatgagagagcacaaaacaaaatgggtgcaagaatcaagctcaaaagacttcgtgtgctataaagaaggcacaggaccgtgctcggagagcgaagaaagaacctgtaaaacctcagggagctgcagaggagacatgcaattctgcaaggtcgcaggatgcgaacacggagaagaagccagcgaagcaaaatgtaggtgcagcctagtccacaaaccaggagaagtcgtagtgtcatacggaggaatgagagtgaggcccaaatgctacggcttcagccgaatgatggccaccctagaagtaaacccaccagaacagaggatcggccaatgcaccggatgccacatagaatgcataaacggaggcgtacgcctcatcacactcacaagcgagctaaagagcgccaccgtatgcgcctcacacttctgcagttcagctacgagcgggaagaaatccaccgaaatccagtttcacagcgggtcgctggtcgggaaagctgcaatccacgtaaaaggggcgctagtcgacggaaccgagttcacattcgaaggatcctgcatgttcccagacggctgtgatgccgtcgactgcaccttctgccgcgaatttctcaaaaacccacaatgctatccagccaagaaatggctctttataattatagtaatactactaggctacgcaggcctaatgttactcacgaacgtgctcaaagcaataggagtgtggggatcctgggtaatcgcgccagtaaaacttatgttcgccatcataaagaaactaatgcggagcgtaagttgcctgatggggaaactgatggacagaggcagacaggtgatacacgaagagataggagagaacagggaaggaaaccaggacgacgtcaggattgaaatggcacgaccaagacgagtaaggcactggatgtattccccagtcatcctcacaatcctcgcaatcggactagccgagggatgcgatgaaatggtccacgcggatagcaagctggtcagctgtagacaagggggaggcaacatgaaggagtgtgtcaccacagggagagcactcttacccgcagtaaacccaggacaggaagcctgtcttcacttcacggcaccaggaagccccgacagtaagtgcctaaagataaaagtcaagcgaataaacctaaaatgcaaaaagagctcaagctacttcgtccctgacgcaaggtcaaggtgtacgagcgtcaggcgctgccggtgggcaggggactgccagagcggatgcccgagccacttcactagcaacagcttcagcgacgactgggcaggaaagatggacagagccggcctgggcttcagcggctgcagcgacggctgcggaggagcagcctgcggatgcttcaatgccgcacccagttgcatcttctggagaaaatgggtcgagaacccccacgggataatatggaaagtatcgccctgcgccgcgtgggtccccagcgcagtaatagaactcaccatgccatccggagaagtgagaacattccacccaatgtccggcatcccaacacaagtcttcaagggagtgtctgtaacatacttaggatcggacatggaagtaagcgggctgacagacttgtgcgaaatcgaggaactaaaatcaaagaaactcgcgctcgccccgtgcaaccaggcagggatgggcgtggtaggcaaagtcggggaaatccaatgcagcagtgaagaatcagctcgtacaatcaaaaaggacggctgcatatggaacgcggacctggtcgggatagaactcagagtagacgacgcagtgtgctactcaaagatcacctcagtcgaagcggtagccaattactcagcaatacccacgacgataggaggactacgattcgagcgaagccacgattcccaaggaaagatatcagggagtccactcgacataacagccatacggggaagtttcagcgtaaactaccggggcctaagactgagcctgtccgaaataacggcgacctgcacaggagaagtgacaaacgtatccggatgctacagctgcatgaccggcgccaaagtgagcatcaaactacacagtagtaagaacagcaccgcacatgtaagatgcaaaggtgacgagaccgccttcagcgtactcgaaggcgtgcactcgtataccgtgtcactctccttcgaccatgccgtagtcgacgagcagtgccaactcaactgcgggggccacgaaagccaagtcaccctaaagggaaacctgatctttctggacgtcccaaaattcgtcgacggctcctacatgcaaacgtaccacagctcagtaccgaccggagccaacatcccgtcccctacggactggctcaacgcactattcgggaacggactaagcagatggatactcggagttataggtgtgctactcggcggactcgccctcttcttcctcataatgagcctcttcaagctaggaaccaagcaggtcttccgaagcagaacaaaactagcgtga

SEQ ID NO: 16421 - RNA, 3222 nt, synthetic construct
  misc_feature 1..3222: note = derived and/or modified CDS sequence (opt11) from SFTSV(KAJNH2)__KU507552.1__GP
  source 1..3222: mol_type = other RNA
atgatgaaggtcatctggttcagctccctcatatgcctggtcattcaatgtagtggggacacaggcccaatcatctgcgcgggacccatccactctaacaaatcagcaaacataccacatctcctaggctactcagagaaaatctgccagatagatagactgatccacgtgagctcttggctgcgcaaccattcacaatttcaaggctacgtaggacagcgaggcgggcgatcgcaagtatcatactacccagcggagaacagttacagcagatggtcgggcctactatccccctgcgacgcggactggctggggatgctggtcttaaagaaagccaaagaaagcgacatgatcgtgcccggacccagctacaaaggcaaagtctttttcgaacgacccacctttgacggatacgtgggctgggggtgtggatccggaaaaagtagaaccgagagcggggagttgtgctccagcgatagcggcacctcaagcgggctcctgccgtccgaccgagtactgtggatcggcgacgtagcctgccaacccatgaccccaattccggaggagacattcctggaactcaaatctttcagccagtcagagttccccgacatctgtaaaatagacggcatagttttcaatcagtgcgaaagcgaaagtctaccgcaaccatttgacgtcgcttggatggacgtaggccactcccacaagatcatcatgcgagaacacaaaacaaaatgggtgcaagagtcaagctctaaagatttcgtatgctacaaagaaggcaccggcccctgctccgaatcggaagagaaaacatgcaaaacctcagggtcgtgccgaggagacatgcaattctgcaaagtagcaggatgcgaacacggagaagaagcatcagaagcaaaatgcagatgctccctcgtccacaaaccaggagaggtagtcgtatcctacggaggaatgcgagtaagaccgaagtgctacggcttctcgcgcatgatggcgacactagaagtaaacccgcctgagcagagaataggacaatgtacgggatgccacttggaatgcataaacggaggggtgagactcatcacactaacaagcgaactgaaatccgcgacagtgtgcgcgagccacttctgcagctcggccacgagcggcaagaaaagcacggaaatacaattccactcaggctcacttgtcggcaaagccgcaatccacgtcaaaggggccctagtggacggcaccgagttcacattcgagggttcttgtatgttccccgacgggtgcgacgccgtggactgcaccttctgcagggagttcctcaaaaacccacaatgctatccagcaaagaaatggctgtttataatcatagtcatactgctcggatacgccggattaatgctgctgacaaacgtcctaaaagccataggagtctggggctcgtgggttatagcaccggtcaaactaatgttcgccataatcaagaaactcatgagatcagtgtcgtgcctgatgggaaaacttatggatcgggggcggcaagttattcacgaagaaataggcgaaaacagggaaggcaacagagatgacgtcagaatcgaaatggcccggccaagaagggtaagacactggatgtatagtccggtaatactaaccatactcgccattggcctggcggaaggatgtgatgaaatggtacacgccgacagcaagctagtatcgtgcaggcaaggaagcggaaatatgaaagaatgcgtaacaaccggtagagcactcctccccgctgtaaacccaggacaggaggcgtgtctccatttcacagcccccggaagccccgattctaaatgcctcaaaatcaaagtaaaacgaatcaacctcaaatgcaagaaatcctcgagttacttcgtacctgacgccagaagcagatgcaccagtgttagaaggtgcagatgggcgggagactgccaaagcggatgccccagccacttcaccagcaactcgttcagcgatgactgggccggaaaaatggacagggcaggactagggttcagcggatgcagcgacggctgcgggggtgccgcatgcggctgctttaacgcagccccctcctgcatattctggaggaagtgggtagaaaacccccacggaatcatatggaaagtgagcccctgtgctgcatgggtgccatcagcggtgatagagctaacaatgccatcaggagaagttcgcaccttccacccaatgagcggaatccccacccaagtcttcaagggggtctccgtaacatacctaggaagcgacatggaagtatcagggctaacagacctctgcgaaatcgaggaactaaaaagcaagaaactagcgcttgcaccctgcaaccaagccggaatgggggtcgtcggaaaagtcggcgaaatccaatgttcttcagaagaaagcgccagaacgataaagaaagacgggtgcatttggaacgccgacctagtcggcatagagctcagagtcgacgacgcggtatgctacagcaaaatcacatccgtagaagcagtagcaaactacagcgccatccccaccaccatcggcggactacgcttcgaacggtcacacgacagccaagggaaaatcagtggatcgcccctcgacataaccgcaatacgagggagcttctcggtaaactatcgaggactcaggctatcgctcagcgaaatcacagcaacctgcaccggcgaagtcacaaacgtaagcggatgctacagctgcatgaccggggccaaagtaagcataaaactccactcaagtaaaaacagcacggcacacgtccgatgcaagggagacgagacagccttcagcgtactagagggggtccacagctacaccgtctccctctcattcgaccacgcggtagtcgacgaacaatgccaattgaactgtggcggacatgaatctcaagtcacactcaaaggcaacctgatatttctagacgtcccaaaattcgtggatgggagctacatgcaaacataccacagctccgtgcccaccggggccaacatacccagcccaacggactggctaaatgccctcttcggcaacggcctaagtagatggatcctcggagtaataggcgtgctactcggtgggctagctctcttctttctaataatgtcactattcaagttagggacaaaacaagtcttcaggagccgagcgaagctagcatga

SEQ ID NO: 16422 - RNA, 3222 nt, synthetic construct
  misc_feature 1..3222: note = derived and/or modified CDS sequence (opt11) from SFTSV(ZL13-32)__KU361342.1__GP
  source 1..3222: mol_type = other RNA
atgatgaaagtcatatggttcagctctctaatatgcttcgtaatacaatgcagcggagacagcggcccgatcatctgcgcgggccccatccatagcaacaaatcggccgacatcccacacttactcggatacagcgaaaagatttgccaaatagaccgacttatacacgtcagcagctggttacgcaaccatagccaattccaaggatacgtgggccaacgcggcggccgctcccaagtctcatactaccccgccgaaaatagctactccaggtggagcggactgctctcaccctgcgacgctgactggctgggtatgctcgtcgtcaagaaagcaaaaggctcagatatgatcgtgccaggcccaagttacaaaggtaaagtctttttcgaaagaccgacatttgatggatacgtcggctggggctgcggctcaggcaaaagcagaaccgagtcaggcgaactctgcagcagcgactccggaacatcgagcggactgctgccctcagaccgcgtactatggataggcgacgtcgcgtgccaacccatgaccccaatcccggaagaaacattccttgagctaaagagcttctcccaatcagagttccccgacatctgcaaaatagacggcattgtcttcaaccagtgcgaaggagagtccctcccgcagccctttgacgtggcatggatggacgtaggccactcgcacaaaataatcatgagagagcacaaaacaaagtgggtccaagagtcctcaagtaaagacttcgtctgctacaaagaaggcaccggcccctgctccgagagcgaggagaaaacctgcaagacatcagggagctgcaggggagacatgcagttctgcaaagtagcaggatgcgaacacggagaagaagcaagcgaggccaaatgccgctgctccctcgttcataaaccaggagaagttgtggtatcgtacggaggaatgagagtacgaccgaagtgctacggattctcacgcatgatggcaaccctagaggtaaaccagcccgagcagagaatcggccaatgcaccggatgccacctagagtgcatcaacgggggcgttcgcctcatcacactgacgagcgaactcaaaagcgccacggtgtgtgccagccacttctgttcctccgccacttccggtaaaaagagcacagaaatacaattccactcgggaagcctagtaggcaaaacagcaattcacgtaaaaggagcgctcgtagacggcacagagttcacattcgaaggatcatgcatgttccccgacgggtgcgatgcagtcgattgcacattctgcagggagttcctcaaaaaccctcagtgctacccagctaaaaagtggttatttatcatcatagtaatattgctaggctacgcaggactgatgcttctaaccaacgtgctcaaagccatcggaatatggggatcctgggtcatagccccagtcaaactaatattcgccataataaagaaactgatgcgtacggtatcgtgcctcatgggaaaactgatggaccgaggccgccaagtaatacacgaagaaatcggagaaaaccgagaaggaaaccaagacgacgtccgaatcgaaatggcgcgcccccgacgcgtcaggcattggatgtactcccccgtcatcctaacgatcctagcaatcggcctagccgagagctgcgacgaaatggtgcacgcagactcaaaactcgtcagctgcaggcaagggagcggcaacatgaaagagtgcgtaacaaccggtcgcgcccttctacccgccgtgaacccaggccaagaagcgtgcctccactttacggcaccaggaagtccagactccaaatgcctaaaaatcaaagtaaaacgaataaacctcaaatgcaagaaaagctcaagctacttcgtgcccgacgcccgctcacgctgcacgagcgtccgccgctgcagatgggcgggcgactgccaaagtggatgcccaccacacttcactagcaacagcttctcagacgattgggccggtaaaatggacagggccgggctaggtttctccggatgttcagacggatgcggaggggccgcatgcggctgtttcaatgcagccccaagctgcatcttctggagaaaatgggtcgaaaacccacacggaatcatatggaaagtctcaccctgcgcagcatgggtccctagcgccgtgatcgaactaaccatgccgtccggggaagtacggacctttcatcccatgagcggcattccaacacaagtcttcaaaggcgtaagcgtaacatatttaggcagcgacatggaggtcagcggcctcacagacctctgcgaaatcgaggaactcaaatcgaagaaactagccctggcaccatgcaaccaagccgggatgggcgtcgtaggaaaagtcggggaaatacagtgttcttcagaagaaagcgcacgaacgatcaagaaagacgggtgcatctggaacgccgacttggttggtatcgagctgcgagtcgacgacgcggtctgctattcgaaaataacatccgtagaagcagtcgcaaattactccgccattcccacaacgataggcggtctgagattcgaacgctcacatgacagtcaaggtaaaatctcaggcagtcccctagacataacagcaatccgggggtcgtttagcgtcaactacaggggactacgactaagtctaagcgaaataaccgcaacatgcacaggcgaggtcaccaacgtcagcgggtgctatagctgcatgacaggcgccaaagtcagcataaaactgcactctagtaaaaacagcacggcacacgtaaggtgcaaaggagacgagacagctttctcagtcctcgaaggcgtccacagctacaccgtctcactcagcttcgaccatgcagtagtggatgaacagtgccaactgaactgcggcggccacgaatcacaagtcaccctaaaaggcaacctcatctttctagacgtgccaaaattcgtcgatggcagctacatgcaaacataccacagcacagtcccaactggggctaacatacccagccccacggattggctcaacgcgctgttcggcaacgggctgtcacgttggatacttggagtcataggagtcctcctcggcggactagcactcttcttcatgatcatgagtctatttaaactaggaacaaaacaagtcttcagaagtcgcactaaactagcgtga

SEQ ID NO: 16423 - RNA, 3222 nt, synthetic construct
  misc_feature 1..3222: note = derived and/or modified CDS sequence (opt11) from SFTSV(AHL/China/2011)__JQ670930.1__GP
  source 1..3222: mol_type = other RNA
atgatgaaagtcatatggttttccagtctaatatgtctcgtcatccaatgcagcggtgatacaggaccgatcatatgcgcaggacctatccacagcaacaaatccgccgacatcccacatctcctcggatacagcgagaaaatctgccagatagaccggctaatacacgttagttcctggctacgaaaccactcacagttccaaggctacgtaggacaaagaggtggaagaagccaggtctcctactacccggccgaaaactcttatagtcgatggtccggcctcctatccccctgtgacgctgactggctcggaatgcttgtcgtgaagaaagccaaaggttccgacatgatcgtccccggcccctcatataagggcaaggtattcttcgaacgaccaacattcgacgggtacgtaggctggggctgcggaagcggtaagtcccgaacggaatccggggaattgtgctcgagcgacagtgggacatcctcgggactcctcccttccgaccgggtactatggataggagacgtagcttgccaacccatgacccccatacccgaagaaacattcctagaactcaagagcttctcccagagcgagttcccagacatatgcaaaatcgacggcatcgtattcaaccaatgcgaaggcgagagcctccctcagccgttcgatgtagcctggatggacgtaggtcactcacacaaaataatcatgagggaacacaaaaccaagtgggtgcaagagagtagctccaaagacttcgtatgctacaaagagggcacaggtccctgtagtgagtccgaagagaaaacgtgcaagactagcggcagctgccggggcgacatgcaattctgcaaggtcgcaggatgcgaacacggggaagaggcatccgaagccaaatgtcgatgctcgcttgttcataaaccgggcgaagtcgtagtgtcctacggaggcatgaggatacggcccaaatgctacggattctccagaatgatggcaacactagaagttaacccgcccgaacaacgaatcggacagtgcaccggatgtcacctagaatgcatcaacggcggcgtgagactaatcactctcacctcggaactaaaaagcgcgacagtatgcgcgagtcatttctgttcttccgcaacgtcaggcaaaaagaacacagaaatccagttccacagcggatccctagttggaaaaaccgcaatacacgtaaaaggagctctcgtcgacggaacagacttcacattcgaaggctcatgcatgttccccgatggatgcgacgcagtagactgcaccttctgccgagagttcctcaaaaacccacaatgctacccagcaaagaaatggctattcataatcatcgtaatcctcttaggctacgcaggcttgatgctactcacgaacgtcctcaaggcaataggcgtatggggaagctgggtcatagcgccggtaaaactcatgttcgccatcatgaaaaagctgatgaggagcgtatcatgcctcatgggaaagctcatggaccgcggcagacaagtaatccacgaagaaatcggcgaaaacagggaaggaaaccaagacgacgtccgcatcgaaatggcaagaccacgaagggtccgacactggatgtatagccccgtcatccttacaatcctagccacaggactggcggaaggatgcgatgagatggtccacgcagactcaaaacttgtctcatgcagacaagggagcggaaacatgaaggaatgcgtaaccacaggccgcgcccttctacccgcagtgaacccaggccaggaagcctgcctccatttcaccgcgccggggagccccgactcaaaatgcctcaaaataaaggtcaaaaggataaacctcaagtgtaagaaaagctcatcctatttcgtacccgacgcccgctcaaggtgtacgtctgtgagacgatgccgatgggccggtgactgccaaagcggatgcccaccccacttcacaagcaacagcttcagcgacgactgggctggaaaaatggatcgagcaggactcggattctcaggctgcagcgacggctgcggcggagctgcgtgcggatgcttcaatgcggccccgagttgcatattctggagaaaatgggtcgagaatccccacggcatcatatggaaagtaagcccctgcgcagcgtgggtaccatcggcagtcatagagctcacgatgccaagcggggaagttcgcaccttccacccaatgagcggaatcccaacacaagtattcaaaggcgtatccgtcacatacctgggatcggacatggaagtatccggactcacggatctgtgcgagatagaggaattgaagtccaagaaactcgcccttgcaccctgcaaccaagcgggcatgggcgtcgtcggaaaagtcggagaaatacaatgcagctccgaagagtccgcacgcaccataaagaaagatggctgcatctggaacgccgatcttgtcgggattgaactcagagtcgatgacgcagtctgctactccaaaataacctcggtagaagccgtggccaactactccgcaatcccaacaacaataggcggcctgaggttcgaacgcagccacgattctcaaggcaaaatttcagggtcgccactggacataaccgccatacgggggtccttctcagtcaactaccgaggcctacgcctttccctaagcgaaataaccgcgacatgcacgggagaagttaccaacgtcagcgggtgctacagctgcatgacaggagcaaaagtatccgtgaaactacactcatccaagaactcaaccgcacacgtcagatgcaaaggcgatgaaaccgctttctccgtcctagaaggggtacacagctacacggtctcactcagcttcgaccacgctgtagttgacgagcaatgccaactgaactgcggaggacacgaaagccaagtaacactcaaaggaaatctcatcttcctcgacgtcccaaaattcgtcgacggcagctacatgcaaacctaccacagcaccgtccccaccggggcaaacataccgtcaccaacggattggctgaacgcactcttcggaaatggcctaagcagatggatcctaggcgtaatcggagtactcctaggtggcctggcactcttcttcctcataatgagtctattcaagctcggaaccaaacaagtgttccgctcaaggacaaaactcgcttag

SEQ ID NO: 16424 - RNA, 3222 nt, synthetic construct
  misc_feature 1..3222: note = derived and/or modified CDS sequence (opt11) from SFTSV(AH-YTY/China/05/2012)__KR017849.1__GP
  source 1..3222: mol_type = other RNA
atgatgaaagtcatatggttcagctcgctaatatgcttcgtaatacaatgcagcggcgacagtggcccgattatctgcgccggaccgatccacagcaacaaatcagcagacatcccacacctactcggctactcagagaaaatctgccagatcgaccgactgatacacgtaagcagctggttaagaaaccactcccaatttcaggggtacgtaggccaacggggaggacgatcccaagtatcctactatccagcagaaaacagttactcccgatggtcaggcctactctcaccatgcgacgcagactggctaggcatgctcgtagtaaagaaagccaagggtagcgatatgatagtcccgggcccatcatataagggcaaggtattctttgaacgaccgacctttgacggatacgtaggctggggatgcgggtcaggtaagtcgcgaaccgaatccggagagttgtgcagctccgacagcggcacctcgtccggcctcctcccaagcgacagagtactatggataggcgacgtcgcgtgtcaacccatgacccccatccccgaggagacctttcttgaattaaaatcctttagtcaaagcgagttcccagatatctgcaaaatagacggcatcgtattcaatcaatgcgaaggagaaagtctacctcagcctttcgacgtggcatggatggatgttggccacagccacaaaataataatgcgcgagcataaaaccaaatgggtacaagaatctagctccaaggacttcgtatgctacaaagagggcacaggcccgtgctccgaatccgaagagaaaacctgcaaaacgagcggatcctgccgcggcgacatgcagttctgcaaagtagccggatgcgaacacggagaagaagcctccgaagcaaaatgccgttgctccctagtccacaaaccaggggaagtcgtggtgagctacggcggaatgcgggtacgacccaagtgctacggattcagcagaatgatggcgacgttagaagtaaaccagccagaacaacgaatcggacaatgcacagggtgccatctcgaatgcatcaacggcggcgtgcgactgattaccctaacaagcgagctaaaaagcgccaccgtctgcgcctcccacttctgcagctctgccaccagcggcaaaaagagcacagaaatccagttccactccggatcactcgtcgggaagacggcgatacacgtcaaaggagcactcgtcgacgggaccgagttcacctttgaaggctcgtgtatgttccccgacggctgcgacgccgtggactgtaccttctgtcgggagttcctcaaaaacccacaatgttacccggccaagaaatggttgttcatcataatagtaatactgctaggctacgcgggcctaatgctactcacaaacgtcctaaaggccataggcatatggggaagctgggtaatagcaccagtcaaacttatcttcgcaatcattaagaaactaatgcgcgccgtcagctgcctaatgggcaaattgatggacagaggacggcaagtcatacacgaagaaataggcgaaaacagggaaggcaaccaggacgacgtcagaatcgaaatggcacgcccacgtcgagtgaggcattggatgtacagcccagtaatactcacaatactcgccatcggcctggccgaaagttgcgatgaaatggtacacgcagacagcaagctagtgtcctgtagacaaggcagcggaaatatgaaagagtgcgttacaaccggccgagccctcctaccggcggtcaaccccggacaagaagcctgcctacacttcaccgcacccgggagcccagactctaaatgcctaaaaatcaaagtaaagcgaataaacctaaagtgcaagaaatcctcgagctacttcgtcccagacgcccgctcaagatgcaccagcgtacgccggtgcagatgggccggcgactgtcaatcaggatgtccgccccacttcacatccaattcgtttagcgacgactgggccggaaaaatggacagagccggactaggattctccgggtgtagcgacggatgcggcggcgccgcgtgcggctgcttcaatgcggccccctcatgcatattctggagaaaatgggtcgagaacccccacggaatcatatggaaagtgagcccctgcgcggcctgggtaccctcagcagtgatagagctaacaatgccctccggggaggtccgtaccttccacccaatgtccgggatcccaacccaggtctttaaaggggtatctgtcacctacctcggaagcgacatggaagtaagcggcctcacagacctatgcgaaatagaagaactcaaaagcaaaaagctagcactcgccccctgcaaccaagccggaatgggagtcgtggggaaagtcggagaaatccagtgcagctccgaagagtccgccagaaccataaagaaagacggatgcatatggaacgcagatctcgtagggatcgagctccgcgtagacgatgccgtatgctatagcaaaataaccagcgtagaagcagtcgcaaactactcagcgatacccacaaccatcggtggactccgattcgaacgatctcacgatagccagggaaaaatatcaggatcacccctagacatcacagctatccgtggcagcttcagcgtgaactaccgaggactacgcctcagcctcagcgaaatcaccgccacgtgtaccggagaggtaacaaacgtctcgggatgctacagctgcatgacgggcgcgaaagtgagcataaaattacactcaagcaaaaattcgacagcccacgtacgatgcaagggagatgaaaccgcattctccgtactcgaaggagtccactcatacactgtcagcctcagcttcgaccacgcagtggtagatgaacaatgccagctaaactgcggaggccacgaaagccaagtaactctcaaaggaaatctaatcttccttgacgtaccaaagttcgtagacgggtcgtacatgcaaacataccacagcacggtccccaccggcgccaacatccccagtccaacagattggctcaacgcactattcggaaatggactgagcagatggatcctgggagtcattggcgtgctattgggcggcctcgccttgttcttcatgatcatgagcctattcaaactaggcaccaaacaagtgttccgaagccgcaccaaactcgcctaa

SEQ ID NO: 16425 - RNA, 3222 nt, synthetic construct
  misc_feature 1..3222: note = derived and/or modified CDS sequence (opt11) from SFTSV(AHZ/China/2011)__JQ670931.1__GP
  source 1..3222: mol_type = other RNA
atgatgaaagtaatatggttcagctcgctaatatgcttcgtgatacaatgctccggcgactcagggcccatcatctgcgccggaccaatccacagcaacaaaagcgcggacatcccccacctactgggttactccgaaaagatatgccaaatagaccgactgatacacgtaagcagctggctacgcaaccactcccagttccaaggatacgtcggacaacggggaggcagaagtcaagtcagctactatccagcggaaaattcctacagccgatggtccggcctcctatcaccatgcgacgccgactggctcggcatcctagtagtaaagaaagcaaagggaagcgacatgatagtgcccgggccatcatacaaaggtaaagtattcttcgagaggccgaccttcgacggatacgtgggctggggatgcggcagcggcaaaagccgaaccgagagcggagaactatgctcctccgactcaggaacgtcaagcggcctactcccctcagaccgcgtgctctggataggagacgtagcatgccaacccatgaccccaatacccgaggaaaccttcctagaactcaagtcatttagccaaagcgagttcccagacatctgcaagatcgacggaatagtctttaaccagtgcgaaggggagtccctaccacagcccttcgatgtagcctggatggacgtcggacactcgcataaaataatcatgagagaacacaaaacaaaatgggtacaggaaagcagctcaaaagacttcgtctgttacaaggagggaacgggcccctgcagcgaaagcgaggagaaaacgtgcaaaacctctgggtcctgccgaggagacatgcagttctgtaaaatagcagggtgtgaacacggcgaggaagcgtcggaagccaaatgcagatgttcgcttgtccacaaaccgggagaggtcgtcgtaagctacggcgggatgagagtacggcccaagtgctacgggttctcgcgcatgatggcaacattagaagtgaaccagcccgaacaacggatcggacagtgcaccggatgtcaccttgaatgcatcaacggcggggtacgactaatcaccctgacgagcgaactcaaatcggcaaccgtatgcgcctcgcacttctgcagttcagccacatcgggtaagaaatccacagagatccaattccactcaggctccctcgttggaaaaactgcaatacatgtgaaaggggccctagtggacggcacagagttcaccttcgaaggtagctgcatgttcccagacggatgtgacgcagtagactgcactttctgcagagagttcctcaaaaacccccaatgttatcccgctaagaaatggctattcataattatcgtcattctactaggatacgccggcctaatgctcctgacaaacgtactcaaggcgatcggcatttggggaagctgggtcatcgcacccgtcaagctgatattcgcaataatcaagaaactcatgcgaacagtgtcgtgcctcatgggcaaactcatggatcgaggcagacaagtaatacacgaagagataggcgaaaaccgcgaaggcaatcaagacgacgtaagaatcgagatggcacgtcccagacgagtacgccactggatgtactcacccgtcatcctgaccatactagcaatcggactagcggagagctgcgacgaaatggtacacgcagacagcaagctagtctcatgccggcaaggatcaggaaacatgaaagaatgcgtgacaaccggaagggcattactccccgcagtaaaccccggccaagaagcatgcctccacttcaccgcccccgggagcccagacagtaaatgtctcaaaataaaagtaaaatggatcaacctaaaatgcaagaagtcctcatcatactttgtgcccgatgcccgatcaagatgcacctccgtacgaagatgccggtgggctggcgactgccaaagtgggtgcccgccacacttcacctcgaactcgttcagcgacgactgggccggaaaaatggaccgagccggactgggcttctcaggatgctcagacggttgcggaggagccgcatgcgggtgcttcaacgcagcaccatcatgcatcttctggcgcaaatgggtcgaaaacccacacggaataatctggaaagtcagcccttgcgcagcatgggtcccgtcagccgtgatagaactaagcatgccaagcggagaagttcgaaccttccaccccatgagcggcatcccaacccaggtctttaagggcgtcagcgtaacctacctaggatcagacatggaagtctcaggtctcaccggcctatgcgagatagaagaactcaaaagcaagaaactcgccctggcaccctgcaaccaagcagggatgggagtagtaggcaaagtgggggagatccaatgctccagcgaagaaagcgcaagaacaataaagaaagacggctgcatctggaacgccgacctcgttggcatagaactacgcgtagacgacgctgtctgctactccaaaataacgagcgtagagagcgtggccaactactccgccattccaacaaccataggcggactacgatttgaaaggagccacgatagtcaaggaaaaataagtggatccccgctggacataaccgctataagggggagcttctcggtaaactaccgcggtctaagactgagcttatcagaaatcacagcaacctgcaccggcgaagtaacaaacgtcagcggctgttatagctgcatgaccggagcgaaagtatccatcaagctacactcaagcaaaaatagcaccgcacatgtcagatgcaaaggcgacgaaacagccttctccgtcttagaaggagtacactcatacaccgtgtccctcagtttcgaccacgccgtcgtcgacgaacaatgccagctaaactgcgggggacatgaatcgcaagtaacactaaagggtaacctcatcttcctcgatgtaccaaaattcgtcgacggctcatacatgcaaacgtatcacagcacggtaccaacgggcgccaacatcccatcaccaaccgactggttgaacgcgctatttggcaacggcctatcacgctggatactcggtctcatcggcgtccttctaggaggcttagcccttttcttcatgatcatgtcacttttcaagctcgggacaaaacaagtattccggagccggactaaactagcctaa

SEQ ID NO: 16426 - RNA, 3222 nt, synthetic construct
  misc_feature 1..3222: note = derived and/or modified CDS sequence (opt11) from SFTSV(DS02/CHN/2013)__KR698332.1__GP
  source 1..3222: mol_type = other RNA
atgatgaaagtcatatggttcagcagcctcatttgcctagtaatccaatgcagcggggacacgggcccaatcatatgtgccggcccaatccactcgaacaaatcggccaacattccccatctactaggctactccgagaaaatatgccaaatagacagacttatacacgtaagctcatggctaaggaaccactcccaattccaagggtacgtaggacaaaggggcggacggagccaagtaagctactacccagcagaaaacagctacagcagatggtcggggttgctctccccttgcgacgcggactggctcggaatgttggtcgtcaagaaagccaaagggtcggacatgatagtgcctggccccagctacaaaggcaaagtcttcttcgaacgtccaacattcgacggctacgtaggctggggctgcggctcggggaaaagccgaactgaatccggcgaactctgctccagcgacagcggaacaagcagcggcctcctgccatctgacagggtcctctggataggcgacgtcgcgtgccaacccatgacaccgatacccgaagaaacctttctggaactcaagagcttctcccagtccgagttcccagacatttgcaaaatcgacggcatagtctttaatcaatgcgaatcagaaagcctcccacaaccgttcgatgtggcctggatggatgtgggtcactcacacaaaatcataatgcgagaacacaaaacaaaatgggtccaagaatcatcaagcaaggacttcgtgtgctataaagaaggcacaggcccgtgttccgaaagcgaagagaaaacctgcaaaacaagtggatcgtgccggggcgacatgcaattctgcaaggtcgcagggtgcgagcacggagaggaagcctcagaagcgaaatgccgctgcagcctcgtgcacaaaccgggagaggtcgtggtaagctacggaggtatgcgagtaagacctaaatgttacggattctcgcggatgatggcaactctagaagtcaacccaccagaacaacgaatagggcaatgcacgggatgccatctggaatgcatcaacggaggcgtccgactcgtcacactcacgtcagaactgaaatcagcgacagtttgcgcctcacacttctgctcatcagcaactagcggaaagaaaagcacagagatacaattccacagcggctcactcgtaggcaaagccgcaatacacgtaaaaggagcattagtagacggaaccgagtttaccttcgagggcagctgcatgttccccgacggatgcgacgcggtagactgcacgttctgtcgagagttcctcaagaacctacaatgctacccggcaaagaaatggttatttatcataatcgtcatcctactaggctacgcaggactaatgctcctaacaaacgtactaaaagcaatcggcgtctgggggagttgggtgatagcacccgtaaaactcatgttcgcgatcatcaagaagctgatgcgatcggttagttgcctgatgggaaagctaatggaccgcgggcgccaagtaatccatgaagaaataggagaaaacagagagggaaaccaggacgacgtcagaatcgaaatggtccgtccacgacgcgtacggcactggatgtacagcccagtaatactcacaatcctagcaataggcctaacagaaggatgtgacgaaatggtgcatgccgacagtaaactggtaagttgccgccaagggagcggcaacatgaaagaatgcgtaacaacaggcagagccctacttccagcagtgaaccccggacaagaggcctgcctacacttcaccgcaccaggcagcccagactccaaatgcctgaaaatcaaagtcaaacggataaacctaaaatgcaaaaagtcctcaagttacttcgtccccgacgcacgcagtaggtgcacgagcgtacggagatgcagatgggccggagactgccagagcgggtgcccgtcccatttcacgtccaactcattcagtgacgactgggcaggaaaaatggaccgtgctggactaggcttttcgggctgcagcgacggctgcggaggagccgcctgcggatgcttcaacgcagcacctagctgcatcttctggcgaaaatgggtggagaatccccacggcataatttggaaagtctccccatgcgcagcatgggtaccatcagccgtgatcgagctcaccatgccaagcggcgaagtgagaacatttcacccaatgtccgggatcccaactcaagtcttcaaaggcgtaagcgtcacatacctcggcagcgacatggaagtgagcgggttaacagacctatgcgaaattgaggaactaaaatccaaaaagctcgcactagcaccctgcaaccaggcaggaatgggagtcgtcggaaaggttggcgaaatccaatgcagctcggaagaaagcgcacgaacaattaagaaagacggctgcatatggaacgcggacctggtcggaatcgaactaagagtggacgacgcagtatgttactcaaaaatcacatctgttgaggcagtggcgaattacagcgccatcccgactacgataggcggccttagatttgaaagaagtcacgactcccaaggaaagatctcaggatcacccctcgacatcaccgcaatcagaggctccttcagcgtcaactaccgaggccttaggttatcactgagcgaaatcacggcaacatgcacaggagaagtaactaatgtaagcggatgctattcctgcatgacgggcgcaaaagtgagcataaaactccacagcagcaagaactccacagctcacgtacgatgcaaaggagacgaaacggcgttcagtgtcttggaaggggtccacagctacaccgtcagtttatcgttcgaccacgccgtcgttgacgaacagtgccagctcaactgcggcggacacgaaagtcaagtcaccctcaagggcaacctcatattcttagacgtacccaaatttgtcgacgggagctacatgcagacatatcattcatccgttccgaccggggctaacataccgtccccaacagactggctcaacgccctattcggaaatggactcagccgctggatactcggagtcattggcgtactactgggaggcctagccctgttcttcctgatcatgagtctattcaagctgggaaccaagcaagtgttcagaagccgcactaaacttgcatga

SEQ ID NO: 16427 - RNA, 3222 nt, synthetic construct
  misc_feature 1..3222: note = derived and/or modified CDS sequence (opt11) from SFTSV(DS03/CHN/2013)__KR698333.1__GP
  source 1..3222: mol_type = other RNA
atgatgaaggtcatatggttcagctcactcatatacttagtcatacaatgcagcggggacagcggcccaataatctgcgctggtccaatacacagcaacaaatcggcaaatatcccgcatttgttaggatactcagaaaagatatgccaaatcgacaggctcatccacgtcagcagctggttacgcaaccactcgcaattccaaggctacgtaggccagcgaggagggaggtcacaagtgtcatactatcccgcggaaaacagctactcaaggtggtcgggcctgctgtcaccctgcgacgcggattggctggggatgctcgtagtgaagaaagcgaagggctcagacatgatcgttcccggtcccagctacaaaggcaaagttttctttgaacgccccaccttcgacggctacgtgggctgggggtgcggctccggaaaaagtagaacagaaagcggagaattatgctcctcagacagtggaacctcaagcggacttctcccaagtgacagagtcctatggatcggagacgtggcatgtcagccaatgacgccgatccccgaagagacattcctcgaactaaaatccttctcccagagcgagttcccggacatttgcaaaatagacgggattgtattcaaccaatgcgagcgtgaaagcctaccgcaaccgtttgacgtggcatggatggatgtcggacactcgcacaagatcatcatgcgagaacacaaaacaaagtgggtccaagaatcaagctccaaggacttcgtctgctacaaggaggggacaggaccatgctcggaatccgaagagaaaacgtgcaagaccagcggctcatgcaggggcgatatgcaattctgcaaggtagcaggatgcgagcacggcgaggaggctagcgaagccaagtgccgctgctccctagtccacaaaccaggggaggttgtggtatcatacgggggcatgcgagtgcgacccaagtgctacggtttctcccgcatgatggcgaccctcgaagtcaacccgccagaacaacgcatcggtcagtgcacaggatgccacctcgaatgcataaacgggggtgtacgactcataacacttacaagcgaactcaaaagtgccactgtttgcgcctcccacttctgtagcagtgcgacaagtgggaaaaagtcaactgaaatccaatttcactcagggagcctagtaggcaggacagccatacatgtcaagggagccctagttgacgggacagagttcacgttcgaaggttcatgcatgttcccggacggatgcgatgcagtggactgtaccttttgcagagagttccttaagaacccccaatgctatcccgcaaagaaatggctgttcataataatcgtaatattgctaggctacgcgggactaatgttgctaacgaacgtcctaaaagccataggcgtgtggggatcctgggtgatcgccccagtaaaattaatgttcgccataatcaagaaactcatgcggtcggtatcgtgcctaatgggaaaactcatggaccgcggacgccaggtaattcacgaagaaatcggtgaaaaccgtgaaggcaaccaagacgacatccgcatcgaaatggcgcgcccacgaagagtccggcactggatgtactcgcccgtcatactcacgatcttggcagtaggtttggccgaaggatgcgacgaaatggtacacgcggactcgaaacttgtctcatgcaaacaaggaagcggaaacatgaaagaatgtgtaacaaccgggcgggcactactcccggcagtaaacccggggcaagaagcgtgcttgcacttcacagctccgggaagccccgacagcaaatgcctaaagatcaaagtgaaaagaataaacttgaaatgcaagaaatcctcgtcctacttcgtacccgacgctagaagccggtgcacgagcgtgcgacgatgcagatgggccggcgattgtcaaagcggatgtccgagccacttcaccagtaacagcttcagcgacgactgggccgggaaaatggacagggccggactgggcttttccggatgctccgacggctgtgggggagccgcgtgcgggtgcttcaacgcggcccccagctgcatcttctggaggaagtgggtagaaaacccacatggcataatctggaaggttagcccttgcgcagcgtgggtgccctccgccgtaatcgagctcacaatgccgagcggagaggtgagaacatttcatcccatgagtggcatcccgacacaagtatttaaaggggtgtcagtcacgtacctgggatcggacatggaagtgagcggcctgaccgacctatgcgaaatcgaagaactcaaaagcaaaaagttggcactcgcgccatgcaaccaagcaggcatgggcgtagtaggaaaggtaggggaaatacaatgtagcagcgaggaatccgcacggaccataaagaaagacggctgcatatggaacgcagacctagtagggatcgagttacgggtggacgacgcagtatgttacagcaaaattaccagcgtagaagctgtagcaaactactccgccatacccacaaccataggcggtctccgatttgaaagatcgcacgacagccaaggcaaaatatcaggctcaccactagacattacagcaatccgtggcagcttctcggtaaactaccggggcctccgcctatccctaagcgagatcaccgcaacatgcaccggagaagtcactaatgtaagcggatgctactcgtgcatgacgggagcaaaagtatcaataaaactacactcgtccaaaaactcaaccgcccacgtgcgatgcaaaggggacgaaaccgcattctcagtactagaaggagtacacagctatacagtaagtctgtctttcgaccacgccgtagtagacgaacagtgccagctaaactgcggaggccacgaatcccaagtgacactaaaagggaacttaatatttctcgatgtacccaaattcgtagacggctcatacatgcaaacgtaccacagctcggtcccgaccggggcaaacatcccctcaccaacagactggctaaacgctctattcggaaatggattaagcagatggatactcggcgtaataggggtactattaggcggactcgctctcttcttcctgattatgagtcttttcaaactcgggaccaaacaagtattccggagccgcacaaaactcgcataa

SEQ ID NO: 16428 - RNA, 3222 nt, synthetic construct
  misc_feature 1..3222: note = derived and/or modified CDS sequence (opt11) from SFTSV(DS04/CHN/2013)__KR698334.1__GP
  source 1..3222: mol_type = other RNA
atgatgaaagtaatatggttcagtagcctcatctgtctagttatacaatgtagcggagacaccggccccataatatgcgccggaccgatccattccaacaaatccgccaacataccacatctactcggttattccgagaaaatctgccaaatcgacaggctgatacacgtcagctcgtggctccgcaaccattcccaattccaagggtacgtgggccaacgcggtggccgaagccaggtctcatactacccagcggaaaacagctattcacgatggtcaggacttctcagcccatgcgacgccgactggctaggaatgctcgtagtaaagaaagctaaaggttcagacatgatcgtacccggcccctcctacaaaggaaaagtgttcttcgagcgacccacattcgacggatacgtaggatggggctgcggctcaggcaaaagtcggactgaatccggagagctatgctcaagtgactcgggcacaagcagtgggctcctcccctccgacagagtgctatggataggcgacgtagcctgccaaccaatgacaccgataccagaagaaaccttcctcgagctcaagtcattctcccagtccgagttcccggacatatgcaagatcgacggcatcgtattcaaccagtgcgagtcagaaagtctgccccaacccttcgacgtcgcctggatggacgtaggccactcccataagataataatgcgagaacacaaaaccaaatgggtccaagaatcgagctcgaaagatttcgtatgctacaaagaagggacaggaccgtgctccgaatccgaagagaaaacatgcaagaccagcggcagttgccgaggcgacatgcaattctgcaaggtggcaggctgcgaacacggagaagaagcgtcagaagcaaaatgtaggtgctccctggtacacaagcctggcgaagtcgtcgtaagctacggcggcatgcgagtccgcccaaaatgctatggatttagccgcatgatggcaacactcgaagtaaatccaccagaacaaagaattggacaatgtaccggttgccacctagaatgtatcaacggcggggtacgcctgataacgctgaccagcgaactaaagtcagcaacagtttgcgcctcccacttctgcagctccgccacaagcggaaagaaaagcacagagatccagttccactcaggaagcctggtgggaaaagccgccatccacgtgaaaggagcgctagtcgacgggacagagttcacgttcgaaggctcttgcatgttccccgacgggtgcgacgccgtagactgcaccttctgccgtgagttcctcaaaaacccccagtgctacccagccaaaaagtggctattcattatcatagtcatcctactaggatacgcaggcttaatgctgctcacaaacgtacttaaggccataggagtatggggaagctgggtaatagcacccgtgaagctcatgttcgcaatcataaagaaactaatgaggtcagtctcttgcctaatgggcaaactgatggaccgcggcagacaagtaatccacgaagaaatcggagaaaaccgggaaggcaaccaggatgacgtcaggattgaaatggtgcgcccacgccgcgtcagacactggatgtacagcccggtaatactaacaatcctcgccattggattgaccgaaggatgcgacgaaatggtacacgccgacagtaaactcgtatcatgcaggcaaggaagcggaaacatgaaggaatgcgtaactacaggtagagcactcctccccgcggtcaatccgggacaagaagcatgcctccacttcacggccccaggctcccccgacagcaaatgcctaaaaataaaggtcaaacgcataaacctaaaatgtaagaaaagcagctcgtacttcgtacccgatgcacggtcgcgatgcacgagcgttcgccgctgtaggtgggcaggagactgccaaagtggttgccccagccactttacaagtaacagcttttccgacgactgggccggaaaaatggacagggctggcctaggcttcagcggatgcagcgacggctgcggcggagcggcctgcggatgctttaacgcagcaccctcatgcatattctggcgcaaatgggtcgaaaatccacacggcatcatatggaaagtctcaccatgtgccgcatgggtccccagcgccgtcatagaactgacaatgccaagcggagaagtacgaacattccgtccaatgagcgggataccgacccaagtattcaaaggagtatccgtcacttacctcggctcagacatggaagtcagcggactaaccgacctatgcgaaatagaggaactaaaatcaaagaaactcgccctagcaccatgcaaccaggcaggaatgggagtcgtaggcaaagttggtgagatacaatgtagcagcgaagaaagcgcccgaaccataaagaaagatggttgcatctggaatgcagacctggtaggaatcgaactccgcgtcgatgacgccgtatgctactctaaaataacatccgtcgaagccgtcgtcaactactcggccatacctaccaccataggagggctgaggttcgagcgctcgcacgatagccaaggtaaaatcagcggaagcccactggacataacagcaatccgtgggtccttcagcgtcaattacagaggactgcgcctgagcctcagcgagatcactgcaacctgcacaggcgaggtcactaacgtgtctggatgctacagctgtatgaccggcgccaaagtcagcataaaactacacagctcgaaaaactcaaccgcacacgtccgctgcaaaggagacgaaacagcattcagcgtgcttgaaggagtccacagctataccgtatcgctatcattcgatcacgcagtggtagacgaacagtgccagctcaactgcggaggccacgaaagccaagtcactctaaaaggaaacctcatattcctcgacgtcccgaaatttgtcgacggctcgtacatgcaaacataccactccagcgtgcccacaggggccaacatcccatccccaacagactggctcaacgccctcttcggcaatggcctatccaggtggatactcggagtaatcggcgtactgctcgggggactagccctgttcttcctaataatgagcctatttaaactcggcaccaaacaagtcttcaggagcagaaccaaactggcctaa

SEQ ID NO: 16429 - RNA, 3222 nt, synthetic construct
  misc_feature 1..3222: note = derived and/or modified CDS sequence (opt11) from SFTSV(DS05/CHN/2013)__KR698335.1__GP
  source 1..3222: mol_type = other RNA
atgatgaaagtgatctggttcagctcgcttatctgcctagtcatccagtgctcaggagacactggcccaataatatgcgctggaccaatccacagcaacaaatccgcgaacatcccccacctcttaggctactcagagaaaatctgtcaaattgacagactaatacacgtaagctcgtggctacgaaaccacagccaattccaaggatacgtgggccaaagaggcggtaggtcccaagtctcatactacccggcggaaaactcatattcccgctggtcaggactgctaagcccctgtgacgcggattggctcggcatgctcgtggtgaagaaagcaaaaggatcagacatgatcgtcccaggaccgtcatacaagggcaaagtcttcttcgaacggccgaccttcgacggatatgtcggctggggctgtggctcaggcaagtcaaggacagaatcgggagaactatgctcatctgactcagggacatcgagcggactactcccatccgaccgcgtcctatggataggtgatgtagcctgccaaccaatgacacccatccccgaagaaacgttcctagaactcaagagcttcagtcaatccgagttccccgacatctgcaaaatcgacgggatcgtcttcaatcaatgtgaatcagaaagtctaccacaaccattcgacgtagcctggatggatgtcggacacagccacaaaataataatgcgcgaacacaaaacaaagtgggtccaagaatcatcaagcaaagacttcgtgtgctacaaagaaggaaccgggccatgctccgaaagcgaagagaaaacatgtaaaacatccggctcatgccggggagatatgcaattctgtaaggtggccggctgcgaacacggagaagaagcgtcagaagcgaaatgccgctgcagcctcgtgcacaaacccggggaagtcgtcgtgagctacggtggaatgagagtacgcccgaaatgccatggattcagcagaatgatggcaaccctcgaagtaaatcccccagaacaacgcatcggacaatgcacggggtgccacctcgaatgcataaacgggggagtacgcctaataacgctcacatcggaactaaagagcgccacagtatgcgcctcacacttctgctcatcagccacatccgggaagaaaagcaccgagatacagttccactccggaagtctagtgggcaaagcggccatccacgtaaaaggcgcgctcgtagacggaaccgagttcaccttcgaaggcagctgcatgttcccagacggatgcgacgccgtggattgtactttctgccgggagttcttgaaaaacccacaatgctacccagcaaagaaatggctattcatcatcatagtcatcctactcgggtatgccggcctaatgctactgacaaacgttctcaaggccataggcgtatggggatcatgggtaatagcccctgtcaaacttatgttcgccataatcaaaaagctcatgcgttcagtttcatgcctaatgggcaaactgatggaccgtggacgccaagtgatacacgaagaaataggcgaaaaccgagaaggaaaccaagacgacgtacggatcgaaatggtccgaccacgacgagtaagacactggatgtactcccccgtaatcctcacgatcctagccattgggctgaccgagggatgcgacgagatggtccatgccgactcaaaactggtgagctgtcgacaaggaagcggaaacatgaaagaatgcgtcacaacaggccgcgctctcctcccggcggtcaacccgggacaggaagcctgcctgcacttcacagcaccaggcagccccgactcaaagtgcctcaaaattaaagtcaagcgaatcaacctcaagtgcaagaaatccagcagctacttcgtacccgacgctcgaagtcgctgcacatctgtgcgcagatgcagatgggcgggagactgccaatcaggatgcccgagccacttcacctcaaatagtttctcagacgattgggccggaaagatggaccgagccggcttaggcttcagcggatgtagcgacggatgcggcggtgccgcctgcggctgtttcaacgcagcccctagctgtatattctggcgaaaatgggtcgagaacccacacggaataatatggaaggtcagcccctgcgcagcatgggtgccgagcgccgtcatagaactaacgatgccgagcggcgaagtacgaacgttccaccccatgtccggaatcccgacacaagtctttaagggagtgagcgtaacctacttaggttcggacatggaagtaagcgggctcacagacctctgcgaaatagaggaactaaaaagcaaaaagctcgccctcgcaccgtgcaatcaagctggcatgggggtagtagggaaagtcggggaaatccaatgctcctcagaagagagcgcaagaactatcaagaaagacgggtgcatatggaacgcggacctagtcggaatcgaactaagagtagacgacgccgtatgctatagcaaaataacctcggttgaagccgtagctaactactctgcgatcccaacgaccataggcggactccgcttcgaaagatcacacgactcacaagggaaaatatcaggctcgccattggacataaccgcaatccgagggagcttctcagtgaattacagaggcctaagactaagcctaagcgaaataaccgcgacgtgcaccggagaggtcaccaacgtcagtggatgctacagctgcatgacaggagccaaagtcagcataaaacttcactcgtccaaaaatagcaccgcacacgtcaggtgcaaaggcgacgaaactgcgttctctgtcctagaaggggtacacagctacaccgtcagcctatcatttgaccatgcagtcgttgacgaacagtgccagcttaactgcggagggcacgagagccaagtaaccctaaagggaaacctcatcttcctagacgtaccaaaattcgtcgacggctcctacatgcagacgtaccacagctccgtgccgacgggcgccaacatcccaagcccaacagactggctgaacgcccttttcggcaacggactctcccgatggatactcggggtaatcggggtgctactgggcgggctagcactattcttcctcataatgtccctattcaaactaggaaccaaacaggtgtttcgctccagaaccaaacttgcgtag

SEQ ID NO: 16430 - RNA, 3222 nt, synthetic construct
  misc_feature 1..3222: note = derived and/or modified CDS sequence (opt11) from SFTSV(HB154/China/2011)__JQ733560.1__GP
  source 1..3222: mol_type = other RNA
atgatgaaagtaatatggttcagcagtctaatatgcctggtcatccagtgcagcggagacagtggcccaattatatgcgcaggccccatccactcgaacaaatccgccgggataccgcacctactcggatactctgaaaagatttgccaaatcgacaggctaatacacgtatcatcctggctgcggaaccactcgcagttccagggatacgttggccaacgaggaggaaggagtcaggtatcatattatccagcagaaaacagttactcaaggtggagcgggctgctctccccctgcgacgcggactggctgggcatgttggttgtgaagaaagcaaaagaaagtgacatgatcgtaccaggaccctcgtacaaaggaaaagtcttcttcgagcgcccgacgttcgacggatacgtgggctggggatgcggatcaggcaaaagccggacagagtcaggggagctctgcagctccgactcagggacatcaagtggactacttccctccgaccgcgtcttgtggataggagatgtagcgtgccagccgatgacgccaatcccagaagagaccttcctcgaactgaaatcattcagccaaagcgagttcccagacatatgtaaaatagacggcatagtctttaaccaatgcgaaggcgaaagcctaccacagcccttcgacgtcgcctggatggacgtgggacactcacataagataatcatgagggaacacaaaaccaaatgggtacaggagagtagctccaaagactttgtatgttacaaagaagggaccggtccgtgctcagaatcggaagaaaaagcgtgcaagacatccggatcctgtagaggcgacatgcaattttgcaaagtggcaggctgcgaacacggggaagaagcctcagaagcaaaatgccgctgcagcttagtccacaaaccaggcgaggtcgtggtgagctatggaggcatgagagtgcgcccaaaatgttacggcttctcccgaatgatggcgaccttagaagtgaacccaccggaacaaagaatagggcaatgcaccggctgccacctagaatgcatcaacgggggagtacgcctcatcaccctcacgtccgaactccggagcgcaaccgtgtgcgccagccatttctgcagctccgcgactagcggcaagaaaagcaccgagatccacttccattcaggcagcctagtaggaaaaaccgccattcatgttaaaggagccctcgtagacggaaccgaatttacattcgaaggttcctgtatgttcccggatggatgtgacgccgtggactgcacattctgcagagagttcctcaaaaacccacaatgttacccggcgaaaaagtggctattcataataatagtcatcctactagggtacgcaggcctgatgctccttacaaacgtactaaaagccatcggcgtgtggggaagctgggtcatagccccagtcaaactcatgttcgccatcataaagaaactgatgcgaacagtctcgtgcctcgtcggaaaattgatggaccgaggcagacaggttataaatgaagaaataggagaaaacggtgaaggaaaccaggacgacgtaagaatcgaaatggcccgcccacgcagagtcagacactggatgtatagccctgtaatacttaccatcctcgccatagggctggccgaagggtgcgacgaaatggtccacgccgactccaagctagtaagctgccggcagggaagcggcaacatgaaagagtgcataacaaccggcagagccctgcttcccgccgtgaacccgggacaagaagcatgcctacatttcacagcacccggatccccagactccaaatgcctaaaaatcaaagtaaaacgcatcaacctcaaatgcaagaaaagcagcagctacttcgtccccgacgcacgatcccggtgcacgagcgtacgaagatgcagatgggccggggactgccaatctggctgcccaccccacttcacatccaacagcttctcggacgactgggctggcaaaatggacagagcaggcctcgggttctctggatgctccgacggctgcggaggcgcagcctgtggttgcttcaacgcggcaccctcctgcatcttctggaggaaatgggttgagaacccccacgggatcatctggaaagtgtcaccatgcgcagcatgggtgccttccgctgtgatagaactcaccatgccaagcggagaagtgcgaacattccatcccatgagcgggatcccaacacaagttttcaaaggcgtgtcagtcacttacctcggatcggacatggaggtgagcgggctgacagacttgtgtgaaatagaggagctaaaaagcaagaaactagcactagcgccatgcaaccaggccggcatgggagtagtgggcaaagtgggagagatacaatgcagcagcgaagaatcagcacgaaccatcaagaaagacggctgcatctggaacgcagacctcgtcggcatcgaactccgggtggacgatgcagtctgctattcaaaaatcacgtcggtagaagccgtagccaactacagcgccatccccacaacaataggcggactaaggttcgaacgatcacacgactcgcagggcaaaatatcaggctcgccactagacataaccgcgatccggggctcattctctgtaaactatcgcggacttagactcagcctatcagaaatcacagccacgtgcactggagaagttacaaacgtaagcggctgctacagctgcatgacgggcgccaaagtgagcataaaactacattcaagcaaaaactccaccgcacatgtacggtgcaaaggggacgaaaccgcgttctccgtactggaaggggtccatagctacatagtgagcctgagcttcgaccacgccgttgtcgacgagcagtgtcaactaaactgcggaggccatgaaagccaagtaacactgaagggaaacctcatattcctagacgtgccgaaatttgtagacggatcgtacatgcaaacgtaccactccaccgtaccaaccggcgcaaacataccaagcccaaccgactggctcaatgcactgttcggcaacggcctcagcagatggatactcggggtgataggagtactcctgggaggactcgcgctgttctccttaataatgttcctacttaaactcggcaccaagcaagtatttagatcaaggacaaagctcgcatga

SEQ ID NO: 16431 - RNA, 3222 nt, synthetic construct
  misc_feature 1..3222: note = derived and/or modified CDS sequence (opt11) from SFTSV(HB155/China/2011)__JQ733563.1__GP
  source 1..3222: mol_type = other RNA
atgatgaaggtaatatggttcagctctctcatttgcctcgtcatacaatgttccggagacagcggtccaattatatgcgcagggccaatacacagcaacaaatccgcgggcatcccccatcttctcggctactccgagaaaatatgccaaatagaccgactcatacacgtaagctcttggctccgtaaccactcccaattccaaggctacgtcggccaacgaggcggcagaagccaagtctcatactaccccgcggaaaactcctacagccgctggagcggcctactctcaccatgcgacgccgactggctcggaatgctcgtagtcaagaaagccaaagagtcagatatgatagtacccggaccatcgtataaagggaaagtatttttcgaacggccgacattcgacgggtacgtaggctggggatgtggaagcggcaagagcaggacggaaagcggagaactgtgctcaagtgacagcggcacaagtagcgggcttcttcccagcgacagggtcctctggataggagacgtcgcatgccaaccaatgacgcccatcccagaggagaccttcctagaactaaaatcattcagtcaatctgaatttccggatatatgcaaaatcgacgggatagtattcaaccaatgtgaaggagagagcttgccccagccgttcgacgtcgcctggatggacgtcggtcactcacacaaaataataatgagggagcataaaacaaaatgggtccaagagagtagtagcaaggacttcgtctgctacaaagagggaacgggcccatgctcagagagcgaagaaaaagcgtgcaaaaccagcggctcatgcaggggagacatgcaattctgcaaagttgcaggatgcgaacacggcgaggaggcctcggaggccaagtgccgctgcagcctggtacataagcctggcgaagtagtagtgagttacgggggcatgagggtacgcccgaagtgctacggattctcccgcatgatggcaacactcgaagtgaacccacccgaacaacgaatagggcaatgcaccggatgccacctggaatgcattaacggaggagtccgcctaataacactcacaagcgagctccgaagcgccacagtctgcgcaagtcacttctgctcctccgccacgagcggcaaaaagagcactgaaatccacttccattcaggatcccttgtcgggaaaaccgcaatacacgtaaagggagcgctagtagacggcacagagttcaccttcgaaggctcatgcatgttcccagacggatgcgacgccgtcgactgcaccttctgccgtgagttcctcaagaaccctcaatgctatcccgccaagaaatggctattcataataatcgtcatacttctaggatacgcagggctaatgctactcaccaacgtactgaaagccatcggcgtctggggaagctgggtcatagcaccagtcaagctcatgttcgccataataaagaaactgatgagaaccgtctcatgcctggtaggcaagctgatggaccgcgggcgacaagtcatacacgaagaaataggtgaaaacggagaagggaaccaggacgacgtgagaatagaaatggcacgtccccgccgcgtaaggcactggatgtactcacccgtcatactaactatattagccataggactggccgaaggctgtgacgaaatggtacatgctgacagcaagctagttagctgtcggcaagggagcggtaacatgaaagaatgcatcacaaccggccgtgccctcttaccagcagtcaatccgggacaagaggcatgcctacacttcaccgcgccaggctcacccgactcaaaatgcctcaaaatcaaagtcaaacgcataaacctgaaatgtaagaaatcctcctcttacttcgttcccgacgccagaagccgctgcacatcagtgaggaggtgccggtgggcaggcgactgtcaatcggggtgcccaccacacttcaccagcaacagtttcagtgatgactgggccggaaaaatggaccgagccggcctaggcttcagcggctgcagcgacggatgcggcggcgccgcatgcggatgcttcaatgccgcaccctcatgcatcttctggcgcaaatgggtggaaaacccccatggaatcatctggaaggtcagtccatgtgcagcctgggtaccatccgcagtaatcgaattaacaatgccaagcggagaagtacgcaccttccatcccatgtctggcatccctacccaggtctttaaaggcgtcagcgtaacttacctcggatcagacatggaagtaagcggtctcacggacctctgcgagattgaagaactcaaatcgaaaaagctcgccttagccccatgcaaccaagcagggatgggcgtcgtcggaaaggtaggggaaatccaatgctcctcagaggagagtgcacgcacaatcaagaaagacggatgcatctggaacgcggaccttgtaggaatcgagttacgcgtggacgacgcagtatgctactcaaaaataacatcagtcgaagccgtagccaactactccgcaatcccaacaacaatcggcgggctcaggttcgaacgctcccacgactcccaaggcaaaatcagcgggtcaccacttgacataaccgcgatccgcggctccttctcggttaactaccgaggactacgactatccttaagcgaaatcacagcaacgtgcacgggagaagtcaccaacgtatccggatgctacagttgcatgacaggagctaaagtaagtatcaaactacactccagcaaaaacagcactgcccacgtacgctgcaaaggggacgagacagccttcagcgtcctagaaggtgtacacagctacatagtcagcttgtccttcgaccatgcggtggtagatgaacaatgccaactcaactgcgggggacacgagtcacaagtaaccctgaaaggcaaccttatattcctcgacgtcccacgatttgtggacggctcctacatgcaaacataccatagcaccgtaccaaccggagcaaatatcccgtccccaacagattggctaaacgcactcttcggcaatggactgagccgatggatcctcggagtgatcggcgtactactaggcggcctcgccttattcttcctgataatgttcctgctgaaactaggcaccaaacaagtattcagatcacgcacaaagctagcgtaa

SEQ ID NO: 16432 - RNA, 3222 nt, synthetic construct
  misc_feature 1..3222: note = derived and/or modified CDS sequence (opt11) from SFTSV(HB156/China/2011)__JQ733566.1__GP
  source 1..3222: mol_type = other RNA
atgatgaaggtgatatggtttagctcactcatatgcctagtcatccaatgcagtggggactcaggacccataatatgcgcggggcccatacactcaaacaaatcggcaggaatcccccatcttctcggttactctgagaagatttgccagatcgacagacttatacacgtatccagctggctaagaaaccactcccaattccagggttacgtaggacaacgcggaggcagaagccaggtctcctactaccccgcagaaaactcctacagccggtggtcaggactcctctcgccatgcgacgcagattggttgggcatgttggtagtaaagaaagccaaagaaagcgacatgattgtaccaggaccatcgtacaaaggcaaagttttcttcgagcgcccaacattcgacggttacgtcggctgggggtgtggctccggaaaaagcaggactgaatctggggaactatgctcaagcgacagcggcacttcgagtggcctcctcccgagcgacagggtactctggattggcgacgtcgcctgccaacccatgacacccatcccagaagaaacctttctcgaactaaagagcttctcccagagtgagttcccagacatctgcaaaatcgacggtatagtcttcaaccaatgcgagggggagtctctgccgcagcccttcgacgtcgcctggatggacgtcgggcacagccataaaattataatgcgagaacacaaaacaaaatgggttcaggaaagcagctctaaagatttcgtgtgctacaaagaaggaacgggcccgtgctcagaatcggaagaaaaagcatgcaaaacatcgggatcgtgccgcggcgacatgcagttctgcaaagtcgcgggatgcgagcacggcgaagaagcgtcggaagccaaatgccgatgctcacttgtacacaaacccggcgaagtcgtggtctcctacggaggcatgcgcgtcagaccaaaatgctacggattcagcagaatgatggctacactcgaggttaacccacccgaacaaagaatcggacaatgcaccggatgccatctggagtgcatcaacggcggagtacgactaataacgctcacctcagaactcagatcagctacagtatgcgcctcccacttctgcagctccgccaccagcggcaaaaagtccacggagatccacttccactcaggctccctggtgggcaaaacagccatacacgtcaagggcgcactcgtagatggaacagagttcacatttgaaggctcgtgcatgttcccggacggctgtgacgcagtagactgcaccttctgcagagagttccttaaaaacccacaatgctacccggctaagaaatggctctttattataatagtaattctactgggatacgcagggctaatgctgctcacaaacgtccttaaagccataggagtatggggcagttgggtcatcgcaccagtcaaactaatgttcgccataatcaagaaactaatgcgaacggtttcctgcctggtcggaaaactgatggaccgagggcgacaagtcatacacgaagagatcggcgagaacggtgaaggcaaccaagacgatgtcaggatcgaaatggcccgacccaggagagtcaggcactggatgtattcacccgtcatactcacaatcctggcaatcgggttagccgaaggctgcgacgagatggtacacgccgacagcaaactcgtctcatgtaggcaaggaagcggcaacatgaaagaatgcataaccacgggccgggcccttctcccagcggtaaaccccggacaagaagcctgcctgcacttcacagcaccaggaagccccgacagcaaatgcctcaaaatcaaagtcaaacggataaacctcaaatgcaagaaaagtagcagctacttcgtgcccgatgcccgatccaggtgcacatccgtgcggaggtgtaggtgggccggagactgccagagcggatgccctccccatttcaccagtaactccttcagcgatgactgggcaggaaaaatggacagggccggcctaggcttctcaggctgtagcgacggctgcggcggcgcagcatgcggatgcttcaacgccgccccaagctgtatattctggcgaaaatgggtagagaacccgcacggcattatatggaaagtctcaccctgcgcagcctgggtaccaagtgccgtaatagaactaaccatgccgagtggggaagtccgaacattccatcctatgagcggaataccaacacaagtcttcaaaggggtctcggtcacatacctaggctcagacatggaggtcagcggcctcactgacctttgcgaaatagaagagttgaaaagcaagaaactagcgctcgccccctgcaaccaggccggaatgggcgtcgtaggcaaagtcggagagatacaatgctcctccgaggagtccgctagaaccattaagaaagacggatgcatatggaacgccgacctggtcggcatagaactccgggtggacgacgcagtctgctactcgaaaataacatcagtcgaagctgtcgccaactacagcgccataccaacaaccataggaggactgagattcgagcgcatccatgacagtcaaggcaaaatctccggctccccactggacatcacagcgatccgcggctccttctcggtcaactacagaggccttcgcctgagtctcagcgagatcaccgcaacgtgtaccggcgaggtaacaaacgtatcaggatgctactcatgtatgactggggcgaaagtatctataaaactacactcatccaaaaactcaacagcccacgtcaggtgcaaaggagacgaaacagcgttctcagttctggaaggagtgcactcatatatcgtatcgctatcatttgaccacgccgtcgttgatgaacaatgccagctcaactgcggaggccacgaatcacaagtgaccctcaaagggaacctcatattcctcgacgtaccgaaattcgtcgatggctcatatatgcaaacataccactcaacagtccctaccggggccaacatcccgtcaccaaccgactggttaaacgcactgtttggcaacggcttatccagatggatactaggagtcatcggagtactcttaggaggcctagcactattcttcctaataatgttcctactaaagctcggcaccaaacaagtattccggtccagaaccaagctcgcatga

SEQ ID NO: 16433 - RNA, 3222 nt, synthetic construct
  misc_feature 1..3222: note = derived and/or modified CDS sequence (opt11) from SFTSV(HB2014-04)__KR080475.1__GP
  source 1..3222: mol_type = other RNA
atgatgaaggtaatatggttcccatcactcatatgcttcgtaattcagtgctccggcgactcaggacccataatatgcgccggcccgatccacagcaacaaatcggccgacatcccccacctactcggctactcggagaaaatatgccagatcgacaggctcatacacgtaagctcgtggttacgcaatcactcacagttccaaggctacgtaggccaacgcgggggcagaagtcacgtaagttactacccagcagaaaacagttacagcagatggtcaggcctcctcagcccatgcgatgcagactggcttgggatgctggtagtgaagaaagcgaaaggaagcgacatgattgtgccgggcccgagctacaaaggaaaagtcttctttgaacgcccaacattcgacggctatgtgggctggggctgcggaagcggaaagagccgaacagaaagcggagaactctgcagcagtgactccgggacctccagcggcctcttaccatcggatcgagtgctctggataggcgacgtcgcatgccaacccatgacacccataccggaggagacatttctagaactaaagtcttttagccagtcggagttccccgacatatgcaaaatcgacggcatcgtattcaaccagtgcgaaggagaatccctcccacaaccatttgacgtcgcatggatggatgtcggacactcacacaaaataataatgagggaacataaaacaaagtgggtacaggaaagtagctccaaagacttcgtatgctacaaagagggcacaggcccatgcagcgaatcagaggagaaaacatgcaaaacctcaggcagttgtaggggagacatgcaattctgcaaagttgccggatgcgaacacggagaagaagccagcgaggcaaagtgccgctgctcactcgtccacaaaccaggagaggtcgtagtctcatacggcggaatgcgtgtgcgaccaaaatgctacggattctcacgcatgatggcgacgctcgaggtcaaccaaccagaacaacggatcggacagtgcacaggatgccacctagaatgcatcaatggcggcgtgcgcctaatcaccttgacgagcgagctaaagagcgccaccgtatgcgcgtcccacttttgcagtagcgctacgagtgggaaaaagagcaccgagatacaattccactccggctcactggtcggcaaaacagcaatacatgtaaaaggcgcgctcgtcgacgggactgagttcacctttgaaggcagttgcatgttcccggatggatgcgacgcggtagactgcacattctgcagagaatttctcaagaaccctcaatgctacccggcaaagaaatggcttttcataataatcgtcatcctgctcggatacgcaggtctaatgttactaacgaacgtgctcaaggccataggcatctggggttcatgggtaatcgcaccggtcaaactgatattcgccatcatcaaaaagctcatgcgaaccgtctcgtgcttaatgggaaaattgatggaccgaggacgacaagtcatacacgaagaaataggcgaaaacagggaggggaaccaagatgacgtcagaatcgagatggcccgaccaagacgagtcagacactggatgtacagtccagtcatactgacaatactcgcaatcggattggctgaaagttgtgacgaaatggtacacgcagactcaaagctagtatcatgcaggcaaggctccggaaacatgaaggagtgcgtgaccaccgggagagccctcctgcccgccgtaaacccaggccaggaagcctgcctccacttcaccgcccccggctcacccgactcgaaatgcctcaaaataaaagtaaagcgaataaacctcaagtgcaaaaagagctccagctatttcgtcccagacgcacggtcaaggtgcacaagcgtgcgtcgctgtagatgggcaggcgactgccagagcggctgcccgccacacttcacaagcaacagtttcagcgacgactgggcaggcaaaatggacagagcggggctagggttttccggctgcagcgacggctgtggaggcgccgcctgcggatgcttcaatgcggcccccagctgcatattctggaggaaatgggtagaaaatccacacggaataatatggaaagtctcaccatgcgccgcatgggtcccctcggcagtaatcgaactgacaatgccgtcaggggaagtaaggaccttccatcccatgtcaggtataccgacgcaagtattcaaaggagtaagcgtcacctatctgggatcagacatggaggtatccggcctcacggacctttgcgaaattgaggaactgaaatccaagaaattagccctggcaccgtgcaaccaagcaggaatgggcgtagttggaaaagttggggagatccagtgcagttccgaggaatcagcccgtaccataaagaaagacggctgcatctggaacgcagacctagtaggtatagagctccgagtggacgacgcggtatgctacagcaaaatcacatcagtagaggccgtcgccaactacagcgccataccaacaaccataggaggcctcagattcgagcgaagccacgactcccaaggcaaaatctcaggatcacctcttgacatcacggccatcagaggctcattctcagttaactacagggggcttcgcctaagcctgagtgaaataaccgcaacctgcacgggcgaagtgacaaacgtaagcggatgctactcatgcatgacgggtgcgaaagtctccatcaaactacactccagcaagaactcaaccgctcacgtccgatgtaaaggggacgaaaccgccttcagcgtccttgagggagtgcacagctacacagtgagcctcagcttcgaccacgccgtagttgatgaacaatgccaattaaactgcggaggacacgaaagccaagtgactttgaaagggaatctcatatttctagacgtaccaaagttcgtcgacggctcgtacatgcagacgtatcacagcacggttccaacgggagctaacatcccgtctccaaccgactggctaaacgccctcttcgggaacggcctatccaggtggatcctcggagtaattggagttctactcggtggactcgcgctattcttcatgataatgagcctcttcaagctcggaaccaaacaagtctttagaagcagatcaaagctagcataa

SEQ ID NO: 16434 - RNA, 3222 nt, synthetic construct
  misc_feature 1..3222: note = derived and/or modified CDS sequence (opt11) from SFTSV(HNXH)__KT254590.1__GP
  source 1..3222: mol_type = other RNA
atgatgaaggtaatatggttcagctcactcatatgtttggttatccagtgtggaggagacaccggaccgataatctgcgccggaccaatccacagcaacaagagtgccgacatacctcacttactcggatactcggagaaaatctgtcaaatagacaggctcatccacgtgagctcctggctacgcaaccactcgcagttccaaggatatgtaggtcaacgcgggggccgctcccaagtctcgtactatccagcagaaaacagctacagtagatggtcaggcctcctatccccctgcgacgcagactggctagggatgctggtcgtgaaaaaggccaagggatcagacatgatcgtacccggcccatcgtacaaaggaaaggtcttcttcgagaggcccaccttcgacggctacgtaggctggggctgcggatcgggaaagtccagaaccgaaagtggagaactgtgctcaagcgattcggggacatcgagcggcctactaccttccgatagggtattatggataggagacgtcgcatgccaacctatgaccccgattcccgaagagacttttctcgagctgaagtcattctcccaaagtgaatttccggacatatgcaaaatcgacggcatagtcttcaaccaatgcgagggcgagtccttaccccagccatttgacgtagcatggatggatgtcggacactcccacaaaataataatgagagagcacaaaacaaagtgggttcaggaatcctcctcaaaagacttcgtctgctacaaagaaggcacggggccatgctcagaatcagaagagaaaacgtgcaaaacatcaggaagctgccggggtgacatgcaattctgtaaagtcgcagggtgcgagcacggtgaggaggcctcagaggcgaaatgcagatgcagcctagtccacaaaccaggagaagtcgtggtcagctacggaggcatgcgagtgaggccaaaatgctacggattctcccggatgatggccaccctagaagtaagccagccggagcaaaggatcggccagtgcaccggatgccacctagagtgcataaacggaggtgtccgacttataaccctgacaagcgaactaaagtccgcaaccgtgtgcgccagccacttctgcagctccgccacgagcggaaagaaaagtacagaaatacaattccatagcggatcgctggttggcaaaactgctatacacgtaaagggagcgctcgtagatggaacagagttcacgttcgaaggatcgtgcatgttcccagacgggtgcgacgcagtggactgtaccttctgcagggagttcttgaagaacccacaatgctacccagccaaaaagtggctattcatcattatcgtgattctactaggatatgcaggattaatgctcctcacgaacgtgcttaaggcaataggcgtctggggcagctgggtgatagccccggtaaagctcgtgttcgcactcataaagaaactaatgcgcgcagtaagttgtttaatgggaaaactgatggaccgcggacgccaggtgatacacgaggagattggggagaatcgcgaaggcaaccaagatgacgtaaggatagagatggcgcgcccgagacgggtaagacactggatgtacagcccagttattctaacgatactggccataggcttagcagaaggatgcgacgaaatggttcacgcagattcgaaattagtctcgtgcaggcaaggcagcggaaacatgaaagagtgcgtgaccactgggagagcactgttaccagcagtgaacccaggccaagaagcctgcctgcactttaccgcacccggaagccccgactcaaaatgcctcaagataaaagtcaaacgcataaacctaaaatgcaaaaagagctcaagttactttgtaccagacgctagaagccgatgcaccagcgtgcgcagatgccggtgggcaggagactgccagagcggctgcccaccacacttcacatcaaatagcttctcagacgattgggctggcaaaatggacagagctggcctaggtttctcgggctgcagcgacggatgcggcggagccgcgtgcggatgcttcaacgcagccccatcctgcatattttggcggaaatgggtagagaacccacacggaatcatatggaaggtatcgccctgcgccgcatgggtgcccagcgccgtgatagaactcacgatgccgtccggagaggtgcgcacattccacccaatgtccggaatcccgacacaggtattcaaaggagtatcagtcacatacctgggcagcgacatggaagtgagcggcctaacggacctatgcgagatcgaggaactcaaatcaaagaaactcgccctcgcgccctgcaaccaagcgggtatgggagttgtaggcaaagtcggggaaatacaatgcagctcggaagagagcgccagaacaataaagaaagacggatgcatctggaacgcggatctagtaggaatcgaactaagggtcgatgatgccgtctgctattccaaaatcacctcggtagaagcagtagccaactactccgcaatcccgacaaccataggcggcctgagatttgagagatcacacgacagccaagggaagatcagcggatcgcccctggacataacagcgataagaggttccttttccgtaaactaccggggactaagactcagcttaagcgaaattacggcaacctgcacaggagaagtcacgaacgtcagcggctgctacagctgtatgacgggcgcaaaagtgagcataaaactgcactcgagcaaaaacagtactgcacacgtacgatgtaaaggagatgagacagcattctccgttctagagggggtccacagttactccgtcagcctaagtttcgaccacgcggtcgtcgatgagcagtgtcaactcaactgcggaggccatgaaagccaagtaacattgcgcggaaacctgatattccttgacgtcccaaagtttgttgacggatcgtacatgcaaacataccacagcaccgtgccgaccggcgccaatataccaagcccgaccgattggttaaatgcactattcggaaacggactgtcacggtggatccttggagtgacgggtgtcctcctaggcggcctagccctgttctttctaatcatgagcctatttaagctgggaacaaaacaaattttccgaagcaggactaagctcgcgtga

SEQ ID NO: 16435 - RNA, 3222 nt, synthetic construct
  misc_feature 1..3222: note = derived and/or modified CDS sequence (opt11) from SFTSV(JS2012-goat01)__KC473538.1__GP
  source 1..3222: mol_type = other RNA
atgatgaaagtaatctggttcagctccctaatctgcttcgtgattcaatgctcaggagacagcggcccaatcatatgcgcggggccaatacactccaacaaatcggcagacatcccacaccttctagggtactcggagaaaatctgccagatagaccggttaatccacgtatcatcatggttacgaaatcactcccaattccaagggtacgtcgggcaacgcggcggaaggtcacaagtcagctactacccagcagagaacagctactcacgatggtctggcctactctcaccctgcgacgcggactggctcggcatgctggtggtcaaaaaggcaaaaggttccgacatgatagtaccaggtccctcgtacaaaggcaaggtctttttcgaaagaccaaccttcgatggctatgtaggatggggctgcggaagcggaaaaagccggaccgagagcggcgagctctgctcaagcgacagcggcaccagcagcggacttctcccatccgacagagtcctatggataggcgatgtggcatgccagcccatgacccccatcccagaagaaaccttcctcgagttaaagagcttcagccaatccgagttcccagacatatgcaaaatagatggcatagtattcaaccagtgcgaaggagagagcctaccccaacccttcgacgtggcctggatggatgtcgggcacagtcataaaatcataatgagagagcataaaaccaaatgggtccaggagtcctcatccaaagacttcgtgtgctataaagaggggacgggaccatgctcagagtcagaagagaaaacatgcaaaacgtccgggtcgtgccgcggagacatgcaattctgcaaagtcgccgggtgcgaacacggagaagaggcaagcgaagcgaagtgccgctgcagtctagtacacaaaccaggcgaagtggtcgtgagctacggaggcatgagaataagacccaagtgctacgggttcagccggatgatggcgaccctcgaagtaaaccaaccagaacagcgactcggccaatgcaccggctgccacctggaatgcataaacggcggcgtcagactcatcaccctgacaagcgaactcaagtccgctaccgtctgcgcaagccacttctgctcgagtgcaacgagcggcaagaaaagtacagagatccaattccactccgggtcactcgtaggcaaaacggcaatacatgtgaaaggagccctagtcgacgggaccgagttcactttcgaaggctcctgcatgtttccagacggatgtgacgcagtggattgcaccttctgcagagagttcctaaagaacccccaatgctacccggcaaagaaatggctattcatcatcatcgtgatcctcctcggttacgcaggattaatgctattaacaaacgtgctaaaagcaatcggaatatggggaagctgggtaatagcccccgtaaaactgatgtttgcaataataaagaaactcatgcgcacggtatcctgcctaatgcggaaactaatggaccggggacgccaggtcatacacgaagaaataggagaaaaccgagaaggcaaccaggacgacgtccgcatagaaatggctcgacccagaagggttagacactggatgtatagccccgtaatactaacgatcctggccatcggattggccgaatcatgcgacgaaatggtacacgcagactcgaaattagtctcctgcagacaaggaagcggcaacatgaaagaatgcgtcacgaccggccgtgcactactcccggccgtaaaccccggccaggaggcttgcctccacttcaccgcacccggatccccagactcaaaatgtctaaaaataaaggtaaagcgcatcaacctcaagtgcaagaaatcatccagctactttgtcccagacgcgagaagcagatgcactagcgtacggcgttgtaggtgggcaggcgattgccaatcaggctgcccgccccactttacatccaacagttttagcgacgactgggccgggaaaatggatagagctggactcggattctcgggctgcagcgacggctgcggcggcgcggcttgcggatgcttcaacgctgccccctcatgcatcttctggcgaaaatgggtagaaaacccgcacggaataatatggaaagtctccccatgcgccgcctgggtgccaagcgcagtgattgaactcacgatgccaagcggcgaagtaagaacattccaccccatgagcgggatcccaacccaagtattcaaaggagtgagcgtaacctacctcggcagcgacatggaagtaagcggactaacggacctatgcgaaatagaggaactcaaaagcaaaaagctcgcactcgccccttgtaaccaggcaggcatgggcgtagtaggcaaggtcggcgaaatccaatgcagttcagaagagagcgcaagaactataaagaaagacggctgtatatggaacgcagacctcgtaggaatcgaactgcgcgtagacgacgcagtatgctactcaaaaatcacgagcgtagaagccgtagccaactacagtgcaatacccaccaccatcggcggactccggtttgaaagatcgctagatagccaaggcaaaattagcggctcacccctcgatatcacagccataagaggttcattcagtgtgaattaccggggcctacgcttatcgctgagcgagatcacagcaacctgcacgggcgaggtcacgaacgtcagcggctgctactcatgtatgacgggcgccaaggtgtcaatcaaactccacagcagcaaaaactcaacagcacacgtccgctgcaaaggggatgagaccgcgttctcggtactggagggggtccacagctacaccgtaagtctgagcttcgaccatgcagtggtcgacgaacaatgccaactcaactgcggcggacacgaatcacaagttacactcaaagggaacttgatattcctcgacgtccccaaattcgtcgacggatcatatatgcaaacgtaccacagcaccgtaccaacaggggcaaacatcccctcaccgaccgactggctgaacgcgctgttcgggaacggactgtctaggtggattctgggcgtcatcggtgtcttactgggcgggctagcgctattcttcatgataatgagcctgttcaaactcggcaccaaacaagttttccgcagcaggactaaactagcttaa

SEQ ID NO: 16436 - RNA, 3222 nt, synthetic construct
  misc_feature 1..3222: note = derived and/or modified CDS sequence (opt11) from SFTSV(JS2012-tick01)__KC473541.1__GP
  source 1..3222: mol_type = other RNA
atgatgaaagtaatatggttctcctcactcatatgcttcgtcatccaatgcagcggagactccggccccataatatgcgcaggtcccatacatagcaacaagtcagccgacataccacacctactaggatactctgagaaaatatgccaaatcgaccgactaatacacgtaagctcatggctgcggaaccattcccaattccaaggatacgtaggacaacgaggcggacgatcccaagtctcttactaccccgccgaaaactcttacagtagatggtcgggcctcttgtcaccatgcgacgccgattggctcggtatgctcgtggtaaagaaagccaaaggatccgacatgatcgtaccagggccctcatataagggaaaggtcttcttcgaaagaccaaccttcgacggctacgtcggctgggggtgcggctcaggaaagagtagaacggaaagtggcgaactatgttcgtctgactccggaacaagttccggcttacttcccagcgaccgagtactgtggatcggcgatgttgcttgccagccgatgactcccatcccggaggaaacattcctagaactgaaatcattcagccaaagcgagttccccgacatctgcaaaatcgacggaatagtcttcaaccagtgcgaaggcgaaagcctccctcagcccttcgacgtcgcatggatggacgtgggccactctcacaaaataataatgagagaacacaaaaccaagtgggtacaggaatcgtcgagcaaggacttcgtatgctacaaagaaggtaccggcccatgctccgaaagcgaagagaaaacgtgcaaaactagcgggtcatgccgaggagacatgcaattctgcaaagtcgctggatgtgaacacggagaagaagcctccgaagcaaaatgtcgctgctcactcgtacacaaacccggagaagtcgtagtatcttacggcggtatgagagtgcgccccaaatgctacggattctcgcgcatgatggctaccctcgaggtcaaccaaccggaacaacgactgggccaatgcacaggatgccacctcgagtgcataaacggcggggtccggttaataacgcttacgtcagaactcaaatcagcgacagtctgtgcaagccacttctgctcatcggccacaagcgggaagaaatccaccgaaatccaattccactccgggagtctagtcggcaaaacagcaatacacgtcaaaggcgccctagtagacggcaccgagttcacattcgaaggctcctgcatgttcccagacggctgcgacgcggtagactgcacattctgccgagagttccttaaaaacccgcaatgctacccagccaagaaatggctatttatcataatcgtaatattactcgggtacgctggcctcatgctcctaaccaacgtcctgaaagccataggcatatgggggagttgggtaatcgccccagtcaaacttatgttcgcaatcatcaagaaactaatgcgcaccgtctcctgtttaatgagaaaactaatggatcgcgggcggcaagttatccacgaagaaatcggagaaaacagagaaggcaaccaagacgacgttcgcatagaaatggcacgaccccgccgagtccgccactggatgtacagcccagtcatactaacgatcctggcaatcggcttggccgaatcgtgtgacgaaatggtacacgcggactccaaactcgtaagctgccgccagggctccgggaatatgaaagaatgcgtaacaacaggtcgcgccttactcccagcggtaaacccgggacaagaagcgtgtctacatttcaccgcaccaggctccccagactcaaaatgcctcaaaatcaaggtcaagcgcataaacctaaagtgcaagaaaagcagcagctacttcgtgcccgacgccagaagcagatgcacctccgttcgccgctgtagatgggccggcgactgccaatccggctgcccgccccattttacatctaattctttctctgacgactgggcaggcaaaatggaccgcgccgggctcgggttctcgggttgcagtgatggctgcggcggagccgcatgcggctgcttcaatgccgccccctcctgcatcttctggagaaaatgggtggaaaacccccacggcataatatggaaagtttcaccctgtgcagcctgggttccatccgccgtgattgagctaacaatgccgagcggggaggtacgcacattccaccccatgtccggcatccctacccaagtattcaaaggcgtatccgtgacctacctcggctcggatatggaagtgagcggcctaacagacctatgcgaaatcgaggaactaaaatcgaagaagctcgccctagccccatgcaaccaagccggaatgggagtcgtcggcaaagtaggagaaatacaatgcagctcagaggaatcagcacgaacaatcaaaaaggacggctgcatatggaacgccgacctcgtaggcatagaactcagagtcgacgatgccgtatgttactccaagattaccagcgtcgaagcggtcgccaactattccgcaatacccacaaccatcggcggactaagattcgagcgctcacacgacagccaaggcaaaatctcaggctcacctctcgacataaccgcgatcagaggcagcttctccgtaaactaccggggcttgcgtctaagcctgagcgaaataaccgccacatgcaccggcgaagttaccaacgtaagcggctgttacagctgcatgaccggagccaaagtgtcaatcaaacttcactcatccaagaactcaacagcccacgtccgctgcaaaggcgacgagacagccttctctgtactggaaggagttcacagctacaccgtaagcctctcgttcgaccatgcagtagtggacgagcaatgccaattaaattgcgggggacacgaatcccaagttacccttaaaggaaacctaatctttctcgacgtacccaaattcgtcgacggctcgtacatgcagacctaccacagcacagtaccaacaggcgcaaacatcccatcccctacagactggctaaacgccctcttcggcaacggactaagccggtggatcctcggcgttataggagtgctcctaggcggattagcgctattcttcatgatcatgtctctattcaaattaggaaccaagcaagtcttcagatcgagaaccaagctcgcgtga

SEQ ID NO: 16437 - RNA, 3222 nt, synthetic construct
  misc_feature 1..3222: note = derived and/or modified CDS sequence (opt11) from SFTSV(LN2012-14)__KF887436.1__GP
  source 1..3222: mol_type = other RNA
atgatgaaggtgatctggttctcctccctcatctgcttcgtgatacaatgctctggagactccggcccaataatctgcgcggggccaattcattccaacaaatcagctgatataccccatctccttggttactcagaaaagatatgccaaattgaccgactaatacacgtctcctcctggctaagaaaccacagccaattccagggatacgtaggacaacgcggcggtcgatcccaggtgtcatactaccccgcagaaaactcctacagcagatggtcagggctactctcaccctgtgacgccgattggctcggaatgttagtagtaaagaaagctaaaggatctgatatgatagtccccggccccagttataaggggaaagtcttcttcgagcgaccaacattcgacggctacgtaggatggggctgcggctcagggaaatcgaggacggagtccggagaattatgctccagcgacagcggcacaagcagtgggctactgccaagcgaccgagtactatggatcggcgacgtcgcgtgccaacccatgaccccaatccccgaagaaacctttctagaacttaagagcttctcccagtcggagttcccagacatctgcaaaattgacggcatagtcttcaaccaatgcgaaggcgaaagcctcccacaacccttcgatgtcgcgtggatggatgtcggccacagccacaaaatcatcatgcgcgaacacaagacaaaatgggtacaagaatccagcagcaaagacttcgtatgctacaaagaagggaccggcccatgctccgaatcagaggagaaaacgtgcaagacatccggatcatgcaggggagacatgcagttctgcaaagtggcaggatgcgaacacggcgaagaagcatcggaagccaaatgccgatgcagcctcgtccacaaaccaggagaagtagtggtctcatacgggggcatgcgggtccgcccaaagtgctacggattttcacgcatgatggccacgctagaagtgaatcaaccagaacagcgcatcggccaatgcacaggatgccacctggaatgtatcaatgggggcgtccgactcatcacactcacatccgaactaaaatcagcaaccgtatgcgcgagccacttctgctcctccgcaacatccggaaagaaatccaccgaaatccagtttcactcgggcagtctcgttggaaaaacagcaatccacgtaaaaggcgcactcgtcgacggcacggagttcacgttcgaaggaagttgcatgttcccggacggatgcgatgccgttgactgcaccttctgcagagaatttctcaaaaacccccagtgctacccagccaagaaatggctctttattatcatcgtgatactgctaggctacgccggcctaatgcttctcacgaacgtcctcaaagcgatcggtatatggggctcctgggtaatcgcccccgtcaaactaatattcgcaatcatcaaaaagctaatgagaacagtcagctgcctgatgggcaaactaatggaccgaggacgtcaagtaatacacgaagaaattggcgaaaatagagaaggaaaccaagacgacgtatggatcgaaatggcgcgaccccgaagggtcaggtattggatgtacagtccagtaatcctaacaatcctcgccgtaggcctagccgagagctgtgacgaaatggtacacgcagactcaaaactcgtctcatgtcgacaaggaagcgggaacatgaaagaatgtgtcaccaccggccgcgccctactacccgccgtcaacccaggccaggaagcgtgcctccacttcacagccccagggtccccggactcaaaatgccttaagataagagtcaaaaggattaacctaaagtgcaagaaatccagctcctacttcgtcccagacgcacgatcccggtgcacaagcgttcgacgatgccgctgggcaggagactgccaatcaggctgtcccccacacttcacatccaacagcttcagcgacgactgggtcggtaaaatggaccgcgccgggctcggattctcaggatgcagcgacggctgcggaggagccgcatgcgggtgcttcaacgctgcgccgagctgcatcttctggagaaaatgggtcgaaaacccacacggcatcatctggaaggtatcaccatgcgccgcatgggtgccctcggcagtgatagaacttacaatgccaagtggcgaagtacgcacgttccacccaatgtcggggatacctacccaggtatttaaaggcgtatcagtaacgtatctcggatccgatatggaagtaagcggactaaccgacctatgcgagatcgaggaactgaagtcaaagaaactcgcactcgcgccatgcaaccaggccggtatgggggtagtaggcaaagtcggcgagatccaatgttcctccgaagagtcggccagaacaattaagaaggacggatgcatatggaacgccgacctagtaggtattgaactcagagtagacgatgccgtttgctacagcaaaataaccagcgtcgaggcggtagcaaattattcagccatccccacaacaatcggcggactaagattcgagcgatcccacgacagccaaggcaaaatctccggatccccactagacataaccgccatccgagggagcttttcagtaaactaccgagggctccgcctgtccctctccgagataacggcgacctgcacaggtgaggtaacaaacgtgagtggatgctacagttgtatgacaggagccaaagtaagcataaaactacactccaacaaaaattccaccgcccacgtccgctgcaaaggagatgaaaccgcatttagcgtgctagaaggcgtccacagctacaccgtatccttgagtttcgaccacgctgtcgtcgacgagcaatgccaactcaactgcggcggacacgaaagccaagtcacactaaaaggcaatctcatattccttgatgtcccaaaattcgtcgacggcagctacatgcaaacataccactctacagttccaaccggggcaaacatcccctcccccactgactggctcaacgctctcttcggtaatggactatcgagatggatactcggagtaatcggcgtactgctgggcggactcgccctatttttcatgatcatgagcctattcaaactaggcaccaagcaagtgttcagaagccgcaccaaactcgcataa

SEQ ID NO: 16438 - RNA, 3222 nt, synthetic construct
  misc_feature 1..3222: note = derived and/or modified CDS sequence (opt11) from SFTSV(LN2012-34)__KF887437.1__GP
  source 1..3222: mol_type = other RNA
atgatgaaagtcatatggtttttcagcctgatatgcttcgtaatacaatgctccggtgactcgggcccaataatatgcgcgggccccatacactccaacaaatcagccgatatcccacacctactaggctactcagaaaagatatgccaaatcgaccgacttatccatgtatcttcatggcttcgcaaccactcacaatttcaaggatatgtaggacagagagggggcagaagccaggtcagctattacccagccgaaaacagctactcccgctggtccggcttgctctcaccctgcgacgcagactggctcgggatgctagtagtgaagaaagcaaaggggtctgacatgatagtgccaggaccctcctataagggtaaggtcttcttcgaacgacccaccttcgacgggtacgtcggctggggctgcggatcaggcaagtccaggaccgaaagcggggaactgtgcagcagcgactccggcacctcgagcgggctactccccagcgacagggtcctgtggataggcgacgtggcgtgccaaccaatgacccccataccggaagagaccttcctcgagctgaagtcattctcacaatccgagttcccggacatctgcaagattgacggtatagtatttaaccaatgcgaaggcgaaagcctgccccagcccttcgacgtagcctggatggacgtcgggcactcccacaagataattatgcgagaacacaaaacaaaatgggtacaggaatccagcagtaaagacttcgtatgttacaaagagggcaccggcccatgctcagagtcagaagaaaagacttgcaaaacgtcgggctcttgccgaggggacatgcaattctgcaaagtcgccggctgcgaacacggagaagaagccagcgaagccaaatgtcgatgcagcttagtacacaaacccggcgaagtcgtggtgtcatacggcggcatgcgcataagacctaaatgttacgggttctcgagaatgatggcgaccctagaagtcaaccagcccgaacaacgaatcggccaatgcacaggctgtcacctcgaatgcattaacggcggagtcagactcatcacactcacaagcgaactcaaaagtgccaccgtatgcgccagtcacttctgcagctcagccaccagcgggaagaaatccacagaaatacagttccactcgggctcactcgtaggcaaaacggcgatacacgttaaaggagcgctcgtagacgggactgagttcaccttcgaagggtcatgcatgttcccggacggatgcgacgccgtcgactgtacattttgccgagagttcctaaagaacccgcagtgctacccagctaagaaatggctattcatcatcatcgtaatcctactaggctacgcaggactaatgctcctcacaaacgtgctcaaagcaatagggatatgggggtcctgggtcattgctccggtcaaactgatattcgccatcataaagaagctcatgcgcacggtatcctgcctaatgggtaaactgatggaccgcggcagacaggtgatccacgaagaaataggcgaaaaccgagaagggaaccaggacgacgtcagaatcgaaatggcacggccccgaagggtacgccactggatgtacagcccagttatccttaccatcctagccataggcctggccgagagttgcgacgagatggtccacgcagactccaaactggtctcatgccgacaaggcagcggaaacgtgaaagaatgcgtgaccaccggcagagcactcctcccagccgtgaaccctggtcaggaagcgtgcctccacttcaccgccccaggatcccccgactctaaatgcctgaagattcgagtgaagaggatcaatctgaaatgcaaaaagagtagctcctacttcgtacccgacgcaaggtccagatgcacatcagtgcgcagatgccgctgggcaggcgactgtcagagcggctgcccaccccatttcacctccaactccttctcagacgactgggcagggaaaatggaccgcgcaggacttgggttctccggctgcagcgacggctgcggaggcgccgcctgcgggtgcttcaatgcagcaccaagttgtatattctggcgaaaatgggtcgagaacccgcatgggataatttggaaggtatcgccctgtgccgcgtgggtaccgtcagccgtaatagagcttaccatgccgagcggagaggtcagaaccttccacccaatgtcaggcataccgacccaagtattcaaaggagtatcaataacctacctaggtagcgacatggaagtaagcggacttaccgacctctgcgagattgaggaactaaaaagcaagaaactagccctcgctccatgcaaccaagcggggatgggagtcgtggggaaggtcggcgaaatccaatgctccagcgaagagagtgcacgaaccatcaaaaaggacggctgcatatggaacgccgacctagtcggaatcgaactccgggtcgacgacgccgtctgctactctaaaatcacctccgtcgaagccgtggccaactacagcgccatacccacaaccatcggcggcctcaggttcgaacgctcccacgacagccagggcaaaatcagcggctcgcctctcgacatcacggcaatacggggcagcttctcagtaaactaccgcggcctacgcctgagcctcagcgagataacagcaacctgcaccggagaagtcaccaacgtaagtggctgctacagttgcatgacaggcgccaaagtatccatcaaactccactcaaataaaaattccaccgcacacgtgcgatgcaaaggggatgaaacagctttctcagtcctggaaggagtacactcctatactgtatccctcagctttgaccacgccgtagtagacgagcagtgccagctaaattgcgggggacacgaaagccaggtcaccctaaaaggaaacttaatattccttgacgtcccaaaattcgtcgacggatcatacatgcaaacctaccactcaaccgtccccacaggcgccaacatcccaagcccaaccgactggctaaacgcgctgttcggcaacggactaagcagatggatactcggcgtaataggagtcctcctaggcggcctcgcgctgtttttcatgatcatgagtttgttcaaactagggacaaaacaggtctttcgaagccgcaccaaactagcctga

SEQ ID NO: 16439 - RNA, 3222 nt, synthetic construct
  misc_feature 1..3222: note = derived and/or modified CDS sequence (opt11) from SFTSV(LN2012-41)__KF887438.1__GP
  source 1..3222: mol_type = other RNA
atgatgaaggtaatatggttcagctcactgatatgcttcgtcatccaatgctcgggcgattcaggaccgatcatatgcgcgggacccatccacagtaataaaagtgcggacatcccgcaccttcttggatactcagagaaaatctgtcaaatcgacagactcatacatgtctcatcatggcttcgcaaccactcccaattccaagggtacgtcggtcagagagggggccggtcccaagtgtcgtactacccagcagaaaactcttacagcagatggagcggcctactatccccctgcgacgcagactggctagggatgctcgttgtaaagaaagcgaagggcagcgacatgatcgtgcccgggccatcctacaaaggcaaagtcttcttcgaacgccccacattcgacggttacgtaggatgggggtgcggatccggaaaaagcagaacagaaagcggggaactatgcagctccgacagtgggacaagctcaggcctgctgcccagtgacagagtactatggatcggagacgtagcatgccaacccatgacaccaatacccgaggaaacattcctagaactaaaatcattcagccaatcggagttcccggacatatgcaagatagacgggatcgtattcaaccaatgcgaaggcgagagcctgccgcaaccatttgacgtagcatggatggacgtagggcacagccacaagataataatgagagaacacaaaacgaaatgggtgcaggaatctagctcaaaagacttcgtatgctacaaagaaggaaccggaccgtgttcggaaagcgaagagaaaacctgcaaaaccagtggcagctgccgcggagatatgcagttctgcaaagtggccggatgcgaacacggcgaagaagcaagtgaagcaaaatgccgctgcagcctcgtccacaaaccaggcgaagtggtggtaagctacgggggaatgagagtgcgcccgaaatgctacggattctcgcgaatgatggctacactagaagtaaaccaaccggaacagaggatcggacagtgcaccgggtgccaccttgaatgcatcaacggaggcgtaagattaatcacgctcacatcggaactcaaatccgcgacagtgtgcgcgagccacttttgcagctcagcaacttccggaaagaaaagcacagagatacaattccactcgggcagcctagtaggaaaaacagccattcacgtcaaaggcgcacttgtagacggaaccgagttcacattcgagggatcatgtatgttcccggacggctgcgacgcagtggattgcacattctgcagagagttcctaaagaacccacaatgctaccccgccaagaaatggctctttataataatagtaatcctattagggtacgcaggcctcatgctactcacaaacgtacttaaggctataggcatatggggcagttgggtcatcgccccagtaaagctcatcttcgcgatcatcaagaaactgatgaggacggtatcatgcctcatgggaaaactgatggacagagggcgacaggttattcacgaagaaataggcgaaaaccgagaaggaaatcaagacgacgtgcgcatcgaaatggcacgcccccgccgtgtccgacactggatgtactcccccgtcatactcaccatcttggccatcggcttggccgagagctgcgacgagatggtgcatgcagactcaaagctagtctcgtgcaggcaaggatcaggaaacgtgaaagaatgcgtgaccacaggcagagcattactgccggccgtaaatccgggccaagaggcttgcctccacttcaccgcacccggatcccccgactcaaaatgtttaaaaatcagggtcaaacgtataaacctaaaatgcaagaaatcaagtagctacttcgtaccggacgccagaagcagatgcacctccgtcagacgatgtaggtgggccggtgactgccaaagcggctgcccaccgcacttcacaagtaacagttttagcgacgactgggcagggaaaatggaccgcgcaggacttggcttctcgggttgtagcgacggatgcggcggcgccgcgtgcggatgctttaatgccgccccaagctgcatcttctggagaaaatgggtggaaaatccccacggcataatatggaaagtatcaccctgcgcagcctgggtcccaagcgctgtaatagaactaactatgccaagcggcgaagtgcggacattccaccccatgagcggaatcccaacgcaggtattcaagggagtctccgtaacgtacctgggctccgacatggaagtcagcggactaacagacctgtgcgaaatcgaagaactcaaatcgaagaaactcgcgctcgccccctgcaaccaagccggcatgggcgtggtaggcaaagtaggagagatccaatgcagttccgaagaatcggcaagaacaatcaaaaaggatggctgcatctggaacgcggaccttgtcggaatagaactcagagtggacgacgcagtatgctactcgaagatcacctctgtcgaggctgttgttaactactcagccataccaacgacaataggagggctaagattcgagcgatcccacgactcccaaggaaaaatctcgggctcgcccctagacatcaccgcaatccgaggatcattctcagtcaactaccgaggactacgtttatccctgtcagagataaccgcaacctgcacgggagaagtaaccaacgtatccgggtgctacagctgcatgaccggcgcaaaagtaagcatcaaactacactcgaacaaaaattcaaccgcacacgtccgctgcaaaggagacgaaaccgcattcagcgtcctagagggagtccattcatacaccgtaagcctcagcttcgatcacgccgtcgtcgacgaacaatgccaactaaactgcggcggacacgagagccaagtcaccctcaagggcaacctaatcttcctggacgtacccaaattcgtcgacggctcatacatgcaaacataccacagtacagtaccaaccggagccaacattccgagcccaaccgactggctcaacgcactcttcggcaacggcctctcccgctggatcctaggagtcataggagtactcttaggcggactagcactattctttatgataatgagcctattcaaacttggaaccaagcaggtattccgaagccgcacgaaactagcatga

SEQ ID NO: 16440 - RNA, 3222 nt, synthetic construct
  misc_feature 1..3222: note = derived and/or modified CDS sequence (opt11) from SFTSV(LN2012-58)__KF887440.1__GP
  source 1..3222: mol_type = other RNA
atgatgaaagtcatctggttcagctcattaatctgcttcgtgatacaatgcagcggagacagcggcccgatcatctgcgcagggcctatccattccaacaaatcggccgatatcccccatctgctcggatactcggagaaaatatgccaaatagacaggctcatacacgtgtcgtcctggctaagaaaccactctcagttccaaggatacgtgggccagagaggtggacgaagccaggtctcatactacccagccgaaaacagctacagccgatggtccggcttactatccccctgcgatgcggactggctgggtatgctggtcgtaaagaaagcgaagggatctgatatgatcgtacccggcccttcctacaaaggcaaagtcttcttcgaacgacccacgtttgacggatatgtaggatggggctgtggctcaggcaagagccgcaccgaatccggagaactctgcagctcagacagcgggacatcatccggattactcccaagcgacagagtcctatggatcggagacgtagcatgccaacccatgacccccataccagaagaaacattcctagaactaaagtcgttcagtcagtccgagttccccgacatctgtaaaatcgacggcatcgtctttaatcaatgtgagggcgaatcccttccacaaccattcgacgtcgcctggatggatgttggccactcccacaagatcataatgcgagagcacaaaactaaatgggtccaagaatcaagtagcaaagacttcgtttgctacaaagaaggcacaggtccgtgcagcgaaagcgaagagaaaacatgcaaaacatcaggatcatgccgcggagacatgcaattctgcaaagtagccggttgcgaacacggcgaagaggcatcagaagcaaagtgccgctgcagcctcgtccacaaaccaggagaagtagtagtcagctacgggggcatgcgcgtacgacccaaatgctacggtttctcacgcatgatggccactcttgaggtcaaccagccagtgcaacgaataggccaatgtacaggctgccacctcgaatgcatcaacggaggggtacgcttaatcacactcacttcagaactaaaaagcgccaccgtttgcgccagccacttctgtagcagcgcaaccagcggaaagaaaagcaccgagatacaattccactccggcagtctagttggaaaaaccgcgatacacgtaaagggggcactcgtagacggcacagagtttacattcgaaggatcatgcatgttcccagatggatgcgacgcagtagactgcaccttctgccgggagttcctgaaaaatccccaatgctatccggcaaagaaatggctattcatcataatcgtgatcttgctaggatacgcaggcctaatgctcctaaccaacgtacttaaagctattggcatatggggaagctgggtaatagcacccgtcaaacttatattcgcgataataaagaaactcatgaggacagtctcgtgcctgatggggaaactaatggaccgaggccgccaagtaatccacgaagaaataggggaaaaccgagaaggcaatcaagacgatgtgcggatagaaatggcacgcccgagacgagttcgccactggatgtacagcccagtcatactcacaattctagtaatgggtctggcagaatcatgcgacgaaatggtgcacgcggactcaaaactcgtaagctgcagacaaggaagcggcaacatgaaagaatgtgtcaccacgggccgagccctactgcccgccgtaaaccccggccaagaagcatgcttgcacttcaccgcaccagggagccctgacagcaaatgccttaaaatcaaagtcaaacgaatcaacttaaaatgcaaaaagtcctcaagctattttgtacctgacgcaagatcacgatgcacctccgttcgaagatgccgatgggctggagactgccagagcggctgtcccccacacttcacgagcaacagcttcagcgacgactgggccggcaagatggacagagccgggctaggcttctcaggctgcagcgacggatgcggaggagccgcatgcggctgcttcaacgccgcgcctagctgcatcttctggcgtaagtgggtagaaaaccctcacggcatcatctggaaagtctccccctgcgcagcctgggtcccatcagcagtgatcgagctgacaatgccatcaggggaggtgcgcaccttccaccctatgtcaggtatcccaacacaagtcttcaaaggggtatccgtaacatacctcggcagcgatatggaggtgagcggcctgacggacctgtgcgaaatagaagaactgaaaagcaaaaagctcgcccttgccccctgcaaccaagcaggcatgggagtcgtcggaaaggtaggcgaaatacaatgcagctccgaagaatccgcacgaacgatcaagaaagatggctgcatctggaacgccgaccttgtaggtatagaactacgggtcgacgacgcggtgtgctacagtaaaatcacctcggtcgaggcagtagcaaactactctgcaatccccactaccataggaggcctacgattcgaacggagccacgacagccagggcaaaatctcgggatccccgctggacattacagccatacggggctcattttccgtcaactaccgggggttacgcttgagcctcagcgaaatcaccgcaacatgcaccggcgaagtaaccaacgtatccggatgctactcctgcatgacaggcgccaaagtgtcaatcaaactacactccagcaagaactcgaccgctcacgttcgatgtaaaggagacgaaaccgccttctccgtcttggagggggtccattcctacacagtaagcctaagttttgaccatgcagtagtcgacgagcagtgccagctcaactgcggtggccacgaaagccaggtcaccctaaaaggaaacctaatcttcctcgacgtcccgaaattcgtcgatggctcctacatgcaaacataccacagcacggtcccaactggagcaaacatccccagccccacagactggctcaacgcacttttcggcaatggactatcacgatggatactaggggtcataggcgtgctcctgggaggcctcgccctgttcttcatgatcatgtcactgttcaaactaggaactaagcaggtattcagatcccgaaccaaactagcttga

SEQ ID NO: 16441 - RNA, 3222 nt, synthetic construct
  misc_feature 1..3222: note = derived and/or modified CDS sequence (opt11) from SFTSV(NB24/CHN/2013)__KR698337.1__GP
  source 1..3222: mol_type = other RNA
atgatgaaagtcatatggttcagctctctcatatgcctcgtaatacaatgcagcggagacaccgggccaatcatttgcgccgggcccatacactcaaacaagtccgcagacatccctcacctactcggctatagcgaaaagatctgccaaatcgaccggctcatacacgtctcctcctggctccggaaccatagccagttccaaggctacgtcgggcagcgaggaggcaggtcgcaagtaagctactacccagcggagaacagctacagcagatggagcgggttgctcagcccatgcgatgcagactggctaggaatgttagtcgtcaaaaaggctaaaggctccgacatgatcgtaccaggcccctcctataaaggaaaagtattcttcgaacgcccgaccttcgacgggtacgtaggctggggttgcggatcaggaaagagcagaaccgaatcgggggaactctgcagcagcgacagcggcacatcgagcggactgctcccatcggaccgagtcctctggatcggcgacgtagcatgccaaccgatgacccctataccggaggagacgttcctagaactaaagagcttctcacaatccgagttcccagacatctgcaaaatcgacggaatcgtattcaaccaatgcgaatccgaaagcctaccccagccattcgatgtcgcgtggatggatgtaggacacagccacaaaatcattatgcgagaacacaagacaaaatgggtacaagaaagctcatcgaaagatttcgtgtgctataaggaaggcaccggcccttgcagtgagtcggaagaaaagacatgcaaaacgtccgggagctgcagaggggacatgcagttctgcaaagtcgccggatgcgaacacggagaagaggcaagcgaagcgaagtgtaggtgcagcctcgtacacaaaccgggagaggtcgtagtctcgtacggcggcatgcgcgtacgaccgaaatgctacggattttcacgaatgatggcaaccctggaagtaaaccctccagaacaacgcataggacaatgcacaggatgccacctggaatgcgtcaacggtggagtgagacttatcaccctcacaagcgaactcaaaagcgccaccgtctgcgcctctcacttttgcagctcagcaacatccgggaagaaaagcacggaaatacagttccacagcggatccctcgtagggaaaacggccatccacgtaaaaggcgccctagtagacggaacagagttcactttcgaaggctcctgcatgttcccagacggctgcgacgcagtagactgtacattctgcagagagttcctgaaaaacccacaatgctatcccgcaaagaaatggctatttataaacatcgtgatcctcctgggctacgccggattgatgctcctcacaaacgtgttaaaagccatcggcgtgtggggatcatgggtaatagccccagtcaaactcatgttcgccatcataaagaaactaatgcggagcgtgagctgcctaatgggtaaactgatggatcgaggaagacaggtcatccacgaagaaatcggcgaaaaccgagaaggaaaccaagacgacgtgagaatcgaaatggcacgaccaagaagagtaaggcactggatgtactccccggtcatcctaacaatactggccgtcggccttgcagaaggatgcgacgaaatggtccatgccgactcgaaactggttagctgtaaacaaggatcaggaaacatgaaagaatgcgtgacgacaggacgggctctcctcccggccgtcaacccaggacaggaagcatgcttacacttcactgcccccggcagtccagactcaaaatgcctgaaaatcaaagtcaagaaaataaacctaaaatgcaagaaaagctcgagctactttgtcccagatgccagaagccgatgcacaagcgtacgacgatgtcgatgggccggtgactgccagtcaggctgcccctctcacttcacatccaacagcttcagcgatgactgggcaggaaaaatggaccgagcagggctcggcttcagcggatgttcagacggatgcggcggagcagcatgcgggtgcttcaacgcggccccaagctgcatattctggcgcaaatgggttgagaacccacatggaatcatatggaaagtaagcccatgcgcagcatgggtcccctcagcagtaatcgaactaacaatgccaagcggagaagtaagaacattccaccccatgtcgggtataccgacacaggtttttaaaggcgtctcagtcacgtacctgggaagcgacatggaggtcagcggcctaacggacctgtgcgaaatcgaggaactaaaatcgaagaaactagcacttgcaccctgcaaccaggcgggaatgggcgttgtgggcaaagtaggagagatccaatgctccagcgaagaatcggctcggacaatcaagaaagacgggtgcatatggaacgcagacctagtaggaatagaactccgagtagacgacgcagtatgctacagcaaaatcacgagtgtggaagccgtcgcgaactattccgcaatcccaaccaccatcggcggcctaagattcgaaagaagccacgacagccaaggcaaaatctctggcagccccttagacatcacagccattcgaggctcattcagcgtaaactaccgcggactacggcttagcctgagcgagatcaccgcaacatgcaccggcgaagtgaccaacgtaagcggatgttactcgtgcatgaccggcgcaaaagtcagtatcaaactccactcaaacaaaaatagcaccgcacacgtcagatgcaaaggagacgaaacagccttcagcgtactggaaggcgtacacagctacaccgtgagcctcagcttcgaccacgccgtcgtagacgaacaatgccagctaaactgcggaggacacgagagccaagtaacactaaaaggaaatctcatcttcctagacgtacccaaattcgtcgacggctcctacatgcaaacctaccactcaagcgttcccaccggggcaaatattccctcgccaacagactggctaaatgcactgttcggaaacggtctatcacggtggatcttaggcgtcatcggtgtactactaggaggactcgcactattcttcctaatcatgtccctcttcaaactggggaccaaacaggtcttcaggagtcgctctaagctggcataa

SEQ ID NO: 16442 - RNA, 3222 nt, synthetic construct
  misc_feature 1..3222: note = derived and/or modified CDS sequence (opt11) from SFTSV(NB31/CHN/2013)__KR698338.1__GP
  source 1..3222: mol_type = other RNA
atgatgaaggtgatctggttcagctccctgatttgcttcgtgatccagtgcagcggggacaccgggcccatcatctgcgccggtccgatacactccaacaagagcgccaatatcccccacctcctggggtattccgaaaagatctgccagatcgatcgcctgatccacgtgtcctcttggctccggaaccacagccagttccagggttatgtggggcaacgcggcgggcggtcccaggtcagctactacccgtccgagaatagcaactcccgctggtcagggctcctgtccccatgtgacgccgactggctcggcatgctggtggtgaagaaggccaagggtagcgacatgatcgtcccgggcccctcctacaaggggaaggtgttcttcgaacggcccaccttcgacggatacgtgggctgggggtgcggttccgggaagtcccggacggagagcggcgagttatgcagctcagatagcggaacaagcagcgggctcctgcccagcgacagggtcctgtggatcggcgacgtggcctgtcagccgatgacccccatccctgaggagaccttccttgagctcaagagcttcagtcagagcgagttcccagacatatgcaagatcgacgggatcgtattcaaccagtgcgagtccgagagcctgccgcagcccttcgacgtcgcgtggatggacgtggggcacagtcacaagataatcatgcgcgagcataagaccaaatgggtgcaggaatcctccagcaaggacttcgtctgctacaaagaaggcaccggcccctgctccgagagcgaggagaagacttgcaaaacgtccggcagctgccgcggggacatgcagttctgcaaggtggccggctgcgagcacggggaggaggcgtcggaggccaaatgtcggtgcagccttgtccacaagcccggcgaggtcgtggtgagctacgggggcatgagggtcagaccgaaatgctacggcttctcccggatgatggccacgttagaggtaaatccgcccgagcaacgcattgggcagtgcaccggctgccacctggagtgcatcaacgggggcgtccggctcattacactgacctcagagctgaaatccgccactgtctgcgctagccacttctgctccagcgccacctcggggaagaagaacaccgagatccagttccacagcggatcactcgtgggcaaaaccgtcatccacgtcaagggggccctggtggacggaacggagttcactttcgaaggttcttgcatgtttccggatggctgcgaagccgtcgattgcaccttttgccgcgagttcctgaaaaacccccagtgctaccccgccaagaagtggctgttcataataatagtgatcctgctggggtatgccggactcatgctgctgaccaacgtcctcaaggccatcggcgtctgggggtcctgggtaatcgctcccgtgaaactgatgtttgccatcatcaagaaactgatgagaagcgtttcctgcttgatgggcaagctgatggaccgcgggcgccaggtgatccacgaggagatcggcgagaatagggagggcaaccgagacgacgtgcgaatagagatggcccggccacgccgcgtccggcactggatgtacagcccggtgatactgacgatcctcgcgatcgggctggcagaaggctgtgacgaaatggtgcacgccgactccaagctagtcagctgtaaacaggggtccggaaatatgaaggagtgcgtgacgaccggacgagtgctcttgcccgccgtcaaccccggccaggaggcctgccttcacttcaccgcgcctggcagccccgacagcaagtgcctaaaaataaaagtgaagcggatcaatctgaagtgcaagaagtccagctcgtacttcgttcccgacgccagaagtaggtgcacgagcgtcaggcggtgccggtgggccggggactgccagagcggctgcccctcccacttcactagcaactccttcagtgacgactgggccggaaaaatggatcgcgcgggcctggggttctcaggctgcagcgacggctgcggaggcgctgcttgcgggtgtttcaacgccgccccctcctgcatcttctggcgcaagtgggtggagaacccccatggcataatctggaaggtgtctccctgcgcggcatgggtcccttccgctgtaatcgaactaaccatgccgagcggggaggtgcggaccttccaccccatgtctggtatccccacgcaggtcttcaaaggcgtgtccgtgacctacctggggtccgacatggaagtcagcggcctgaccgacctctgcgagatcgaggagctcaagagcaagaagctcgccctggccccctgcaaccaggcggggatgggcgtagtgggcaaagtcggagaaatccagtgctccagcgaggagtccgcacgaactatcaaaaaggacggctgcatctggaacgccgacctggtgggtatcgagcttcgcgtggacgacgcggtatgctacagcaagatcacgtccgtggaagccgtggcgaactacagcgccatcccgaccaccatcggcgggctgcgatttgagcggtcccacgacagccagggcaagatatccggcagccccctcgatatcactgccatccgcggaagtttcagcgtcaattaccggggcttacgcctgtccctcagcgaaatcacggcgacctgcacaggggaagtgaccaacgtgtccggatgctactcttgcatgaccggggccaaggtctccatcaagctgcacagctcaaagaactctacggcgcatgtccgctgcaagggtgacgagaccgccttctcggtcctggagggcgtccactcctacaccgttagcctctccttcgaccacgccgtggtagacgaacagtgccagctgaactgtggaggccacgaaagccaggtgacacttaaggggaacctcatcttcctggacgtgcccaaattcgtcgacggctcctacatgcagacataccactctagtgtcccaaccggggccaacatcccgagccccaccgactggctgaacgctctcttcggcaacggcctatcgcggtggatcttgggggttgtgggcgtgctcctcgggggactggtcctattcttcctgatcatgagcttgttcaaacttggcaccaagcaggtcttccgctcccgcacgaagctggcctga

SEQ ID NO: 16443 - RNA, 3222 nt, synthetic construct
  misc_feature 1..3222: note = derived and/or modified CDS sequence (opt11) from SFTSV(NB38/CHN/2013)__KR698341.1__GP
  source 1..3222: mol_type = other RNA
atgatgaaagtcatctggttttcatcacttatctgcctcgtaatacaatgcggcggcgacacgtccccaatcatctgcgcaggaccaatacacagcaacaaaagcgctgatatcccccaccttctagggtacagcgagaagatatgccaaatagaccgacttatccacgtgagctcgtggctcagaaaccactcacaattccaaggatacgtgggacagcgaggaggcagaagccaagtatcatattacccagctgagaactcatacagtcgatggagcggcctactaagcccctgcgacgccgattggctcggaatgctagtagtgaagaaagccaaaggaagcgacatgatcgtgccaggaccaagctacaaaggtaaagtctttttcgagcgccccaccttcgacggatacgtaggctggggctgtggcagcggaaaaagccgaaccgagtccggcgagctctgctccagcgactccggaacaagttccggactactaccctccgacagagtcctatggatcggagacgttgcatgccagcccatgaccccaataccagaagagaccttcctagagcttaagagcttctcccagagtgaatttccggacatatgcaaaattgacggcatcgtattcaaccaatgcgaaggagagtctctaccccaacccttcgatgtcgcctggatggacgtcgggcattcgcacaaaataataatgagagaacataaaactaaatgggttcaggaaagcagtagcaaagacttcgtatgctataaagaaggtacgggcccctgctccgaatcggaagagaaaacctgcaagacctcagggagctgccgaggcgacatgcaattctgcaaagtggccggctgcgaacacgaagaagaggcttcggaagcaaagtgccgttgtagcctcgtccacaaacccggagaagtagtcgtatcgtacggtggcatgagagtacggccaaaatgctacggcttcagtagaatgatggcaaccctcgaagtcaaccaacccgaacaaagaatcggccaatgtacagggtgccacctcgaatgtatatcaggcggagtgcgactgataaccctaaccagtgagctaaaaagcgccactgtatgcgccagccacttttgtagcagcgcaaccagcggtaagaaaagcaccgagatacaattccactccggcagccttgtcggcaaaaccgcaatacacgtcaaaggcgcactcgtcgacggaaccgagttcacatttgaaggctcatgcatgtttcccgacggatgcgacgccgtagattgcaccttctgccgcgagttcctgaaaaacccccagtgctacccagccaagaaatggctattcatcataatcgtaatactactaggatacgcagggctaatgctactcacgaacgtactcaaagcaataggcgtctggggaagctgggtaatcgcccccgttaaactggtgttcgcaatcattaagaaacttatgagagcggtgtcctgtttaatgggaaaactgatggacaggggaagacaagtgatccacgaagaaatcggagaaaatcgcgaaggcaaccaggacgacgtcaggatagaaatggcacgacccagacgtgtccgccactggatgtactccccggtcatacttaccatattggcaatcggactagcagaaggctgcgacgaaatggtccatgccgacagcaagctagtatcatgcaggcaaggcagcggaaacatgaaagagtgcgtcaccacaggtagagcactactcccggccgtgaaccccggccaagaagcctgcctacacttcacagcgccaggcagccccgatagcaaatgcctcaaaataaaagtcaaacggatcaacctgaaatgcaagaaatcctctagctactttgtgcccgacgcacgaagtaggtgcaccagcgtgaggagatgtaggtgggctggcgactgccaaagcggatgcccaccccactttacgagcaattcattctccgacgactgggccggaaaaatggaccgcgcaggactaggcttcagcgggtgctcggacggatgcggcggggccgcctgcggctgctttaacgcggctcccagctgcatcttttggcgcaaatgggtcgaaaacccccatggaattatctggaaagtctccccctgcgccgcatgggtaccctcagctgtaatagagctcacgatgccctccggcgaagtcagaacatttcaccccatgagcgggattccaacacaagtctttaaaggggtatccgtcacgtaccttgggtcggacatggaagtcagtggactcacagatctttgcgaaatggaagaactcaaatccaagaaactcgccctggcgccatgcaatcaagcaggaatgggagtcgtcggcaaagtgggcgaaatacaatgcagcagcgaagaatcagcgagaacaatcaagaaagacggctgcatatggaatgcagacctggtcggcatagaactcagggtagacgacgcggtgtgctacagcaaaatcaccagcgtcgaggcggtggcaaaccactcagcaatacccaccaccataggcgggctccgattcgaacgctcccacgacagccaaggcaaaatatccggctcgccactggacataaccgcaataagagggtcgttcagcgtcaactaccgaggattgcgtctctccctatccgaaattaccgcaacgtgcacgggagaagtgacgaacgtttcaggctgctacagctgcatgaccggcgcaaaagtatccatcaaactacactcgagcaaaaactccacagcgcacgtgagatgtaaaggtgatgagaccgcgttctctgtattagaaggtgtccactcctacagcgtatccctcagctttgaccacgcagtagtcgacgagcaatgccagctaaactgcgggggccacgaatcaaaagtcacattacggggaaacctgatcttcctcgacgtaccgaaatttgttgacggaagttacatgcaaacctaccacagcacagttccaacaggagccaacatcccgtcacccactgactggctgaacgcactcttcggaaacggactaagcagatggttcctaggcgtaataggggtactgctgggcgggctcgcgctattctttctaatcatgtccctcttcaaactgggtaccaaacaagtcttccgatcccggtcaaaactcgcctag

SEQ ID NO: 16444 - RNA, 3222 nt, synthetic construct
  misc_feature 1..3222: note = derived and/or modified CDS sequence (opt11) from SFTSV(NB39/CHN/2014)__KR698342.1__GP
  source 1..3222: mol_type = other RNA
atgatgaaagttatctggttcagcagcttaatctgcctcgtcatacagtgcagtggggacacgggcccaattatttgcgccggtccaatccacagcaacaaatcagccgatattccacacctactaggctactcggagaaaatttgtcaaatcgacagactgatacacgtgagctcctggctgcgcaaccactcacagttccaaggatacgtgggccgacgcggcggcagaagccaagtaagctactacccagcagaaaacagctactcacgttggtcgggcctactctcgccatgcgacgctgactggttagggatgctggtagtcaaaaaggcaaagggctcagatatgatcgtacccggaccatcctataaaggaaaagtattctttgaacgacccacctttgacggctacgtaggctggggctgcggctcaggaaaaagccgaaccgagagcggagaactttgctcgagcgacagcggaacaagcagcggccttctgccatcggacagagtactctggataggcgacgtagcatgccagccaatgacccccataccagaagagacattcctagagctaaagagcttcagccaaagcgagttccccgacatatgcaaaatcgacggcatagtattcaaccagtgcgaaagcgaatccctaccccaacccttcgacgtagcatggatggacgtcggacactcccacaaaataattatgcgagaacacaaaactaaatgggtgcaagaatcatcctccaaagacttcgtgtgctacaaagaagggacaggcccatgctcagaatccgaggagaaaacatgcaagactagcggaagctgccgcggagacatgcagttctgcaaggtcgccgggtgcgagcacggcgaggaagccagcgaggcaaaatgccgctgcagcctcgtgcataagccaggcgaagtagtagtctcgtacggcggcatgcgtgtgcgcccaaagtgctacggattctcccgaatgatggccaccctagaagtgaacccacccgagcaacggatcggccaatgcaccggatgccacctcgaatgcgtcaacggcggtgtccgcttgataacactcacgagcgaactcaaatcggcgactgtatgcgctagccacttctgctcaagcgccacctcaggaaagaaatccaccgaaatccaattccacagcggttcccttgtcggaaaaactgcaatacacgtcaaaggggctctagtagacggaaccgagttcacattcgaaggctcatgcatgttccccgacggctgcgacgcagtcgactgcacattttgcagggaatttctcaaaaacccccaatgctacccagcaaagaaatggctatttataatcatagtaatcctactcggatacgctggcctaatgctgcttacaaatgtactcaaagcaataggcgtttggggaagctgggtcatagcacccgtcaagctaatgtttgccatcatcaagaaactgatgcgatccgtatcgtgcctcatgggcaaactgatggaccgaggacgccaagtcatacacgaagaaatcggcgagaaccgcgagggcaaccaggacgacgtcaggatcgagatggctcgaccaagacgcgtaaggcactggatgtacagcccggtcatacttacaattctcgccgtaggcctcgcggaaggatgcgacgaaatggtacacgccgactcaaagctagtcagctgtaaacaaggtagcgggaacatgaaagaatgcgtgaccaccggccgagccctgcttccagccgtcaatcccggccaagaagcgtgcttacactttacagctccaggatccccagaccttaaatgcctcaaaatcaaggtcaagaaaataaacctaaaatgtaagaaaagctcctcctacttcgtccccgacgcacgctccagatgcacaagcgtaaggcgctgccgatgggccggcgactgccagtccggatgcccgtcccacttcacctccaacagcttcagcgacgactgggcaggaaaaatggacagggcaggcctcggtttcagcggctgttccgacggctgtggaggcgccgcctgcggatgctttaacgccgccccatcctgcatattctggcgcaaatgggtagagaacccgcacggcatcatctggaaagttagcccctgcgccgcgtgggttcccagtgcagtaatcgaattaacaatgccaagcggcgaagtacgaaccttccatcccatgtccgggataccgacccaagtgttcaaaggagtctccgtcacgtatctagggtccgacatggaggtgtcagggctcaccgacctatgcgaaattgaggaactaaaatccaagaaactcgccttagcaccatgtaaccaggccggcatgggagtcgtgggcaaagtgggggaaattcaatgcagtagcgaggagagcgcgcgaacaatcaagaaagacggctgcatctggaatgccgatcttgtaggtatcgaactcagggtcgacgacgcggtctgctattccaagatcacaagcgtcgaagcagtggccaactactcggcaatcccgactaccataggcgggctaagattcgaaagatcacacgacagtcagggcaagatctccggctcaccccttgatatcaccgcaatcaggggatcattctcagtcaactacagggggctccgcctttccctcagcgaaataacggccacatgcacaggggaagtcacaaacgtaagcggctgttacagctgcatgaccggagcaaaagtgtccatcaagctacactccaacaaaaactccaccgcccacgtacgatgcaagggcgacgaaaccgctttctccgtcctggaaggagtccacagttacaccgtctcactcagtttcgaccacgcagtagttgacgaacagtgccagctaaactgcgggggacacgagtcacaggtcaccctcaaggggaatctcatctttctcgacgtaccaaaattcgtcgatggatcatacatgcaaacataccactccagcgtccctaccggcgcaaatattccaagccccaccgactggctaaacgcactcttcggtaacggcctatccagatggatactcggagtaataggagtgctacttggcggactcgcgctattcttccttatcatgtccctgttcaagctaggaaccaaacaagtatttcggtccaggacaaaactcgcatag

SEQ ID NO: 16445 - RNA, 3222 nt, synthetic construct
  misc_feature 1..3222: note = derived and/or modified CDS sequence (opt11) from SFTSV(QD7)__KR706566.1__GP
  source 1..3222: mol_type = other RNA
atgatgaaagtcatttggttctcatcactaatatgcttcgtaatacaatgcagcggcgactcaggcccaataatctgcgccggaccaatccacagcaacaaaagcgcagacataccacacctcctcggctactcggagaaaatctgccagatagacagattaatacacgtatcctcatggctccgtaaccactcccagttccagggatacgtgggccaacgtgggggccggagccaagtatcatactacccagccgaaaactcatactccagatggagcggcctcctatcaccgtgcgacgcggactggttagggatgctagtcgtcaagaaagccaaaggatcagacatgatagtacccggcccctcgtataagggaaaagtattcttcgaacggccgaccttcgacggctacgtcggatgggggtgcgggtcaggcaagagcaggacagaaagcggcgaactatgctccagcgactccggcacatcaagcgggctcctcccgtcggacagggtcctctggataggcgacgttgcgtgccaaccaatgacaccaatacctgaagaaacatttctggaactcaagagctttagtcaatccgagttcccagacatatgcaaaatagacggcatcgtgttcaatcagtgcgaaggtgaatcacttccgcaaccattcgacgtagcctggatggacgtcggccactcccacaaaataatcatgcgcgaacacaaaacaaaatgggtacaggaatcaagcagtaaggacttcgtctgctataaggaaggcacaggcccctgcagcgaatccgaagagaaaacgtgcaagacctccggatcgtgcaggggagacatgcaattctgcaaagtcgccgggtgcgaacacggagaagaagcgtcagaagcgaaatgcagatgcagcctcgtacacaagccaggagaagtcgtagtcagctacggaggaatgcgtatacgaccaaagtgttacgggttctcccgaatgatggccacactagaagtaaaccaaccagaacagcggataggtcaatgcacgggttgccacctcgaatgcatcaacggaggcgtaaggttgataacgcttacgtcagaactcaagagcgcaacagtatgcgcctcacacttctgcagttcagcaacaagcgggaaaaagagcaccgaaattcaattccactcaggttcgctagtcggtaaaacagccatacacgtcaaaggggccctcgtcgacggtacagagttcacgttcgaggggtcctgcatgttcccggacgggtgcgacgcagtagactgcaccttctgcagggagttccttaagaacccccaatgctacccagccaagaaatggctctttatcataatcgtcattcttctaggatatgcaggactaatgctgctcactaacgtactaaaagccatcggaatatggggcagctgggtcatagcccccgtaaaactcatgttcgccatcattaagaagctcatgcggaccatgtcttgtctaatggggaaactcatggacagaggcagacaggtcatccacgaagaaatcggcgaaaacagggaaggaaaccaagacgacgtacgaatcgagatggcaagaccacgccgcgtccgccactggatgtactcgccggtcatattaaccttcctcgcaatcggcctcgccgagagctgcgacgaaatggtccacgccgactccaaactggcatcgtgccgacaaggctccggaaacatgaaagaatgcgtgacaaccgggcgcgcactgcaccccgccgtaaaccctggacaagaagcatgcctgcacttcacagcacccggaagcccagactcaaaatgtctaaaaataaaagtaaagcgaataaacctaaaatgcaaaaagagttcgtcatacttcgttcccgacgcccgctcaaggtgcacaagcgtacgacgctgcagatgggccggagactgccagtcaggatgtcccccacattttacgagtaattcattctccgacgattgggcgggaaagatggacagagccggcctcggtttctcaggatgctccgacggctgcggaggagcagcatgcggctgcttcaacgcggccccgagctgtatcttttggcgcaaatgggtagaaaacccacacggcataatatggaaagtgtcaccgtgcgcggcgtgggtcccaagcgccgtcatagaactcaccatgcccagcggagaggtacgcaccttccacccaatgtctggaataccaacacaggttttcaagggcgtatcggtcacatacttgggctccgacatggaagtatccggactcaccgacctttgcgaaatcgaggagctaaaaagcaaaaagctagcactggccccctgcaaccaagcaggaatgggcgtggtgggaaaagtcggagaaatacaatgcagcagcgaagaatccgcaagaacaatcaagaaagacggatgcatctggaacgcagaccttgtgggcatcgagctcagagtagacgacgcggtatgctacagcaaaataacatccgtagaagcggtcgcaaactacagcgcgataccaaccaccatcggaggcctcagattcgaacgcagccacgacagccaaggcaaaatctcaggctccccactagacatcacggccatccgcgggtccttctccgtaaattacagaggactacgcctaagcctgagtgaaatcaccgccacgtgcactggcgaagttaccaacgtcagcggctgctattcatgcatgacgggtgcaaaagtatctatcaaattacactcgagcaaaaacagcactgcccacgtccgatgcaagggagacgagaccgccttcagtgtcttagaaggggtacacagctacacagtgtcattgagcttcgatcacgcagtcgtagacgaacaatgccagcttaactgcggcggtcacgaatcacaagtaaccctgaagggcaacctcatatttcttgatgtaccaaaattcgtcgacggctcatacatgcaaacataccacagcaccgtgcccacaggcgcaaacatccctagccccaccgactggctgaacgccctattcggcaatggcttaagccgctggatactaggcgtcatcggcgtgctcctaggtggtttagccctcttcttcatgatcatgagtctattcaaactgggaaccaaacaagtcttcagaagccggacaaagctggcgtaa

SEQ ID NO: 16446 - RNA, 3222 nt, synthetic construct
  misc_feature 1..3222: note = derived and/or modified CDS sequence (opt11) from SFTSV(Rodent01/NB/CHN/2014)__KR698343.1__GP
  source 1..3222: mol_type = other RNA
atgatgaaagtcatatggttctcctccctaatctgcctcgtcatccagtgctcaggagacaccgggccaatcatatgtgccggaccaatacattcaaacaaaagcgccgacatcccacatctcctcggttactcagagaaaatctgtcaaatagacagactcatacacgtatcttcctggctccgcaatcatagtcaatttcaaggctacgtcgggagacgcggcggcagatcccaggtcagttactaccccgccgaaaactcctattcacgctggtcaggacttctctccccctgcgatgcagactggctaggaatgctggtcgtcaaaaaggccaaaggctccgacatgatcgttcccgggcccagctacaaaggtaaagtctttttcgaacggcccaccttcgacgggtacgtaggctggggatgcggcagcggcaaatccagaaccgaaagcggagaactctgttcttctgacagcggaacctccagcggcctactcccatcagaccgagtcctctggatcggcgacgtcgcctgccaacctatgactccaatacccgaggagaccttcttagaactaaaatcgttctcccaatctgagttcccagatatatgcaagatagacggaatcgtcttcaaccagtgcgaaagcgaaagcctcccacagccattcgacgtcgcctggatggacgtcggccactcccataagatcatcatgagagaacacaaaaccaaatgggtccaggaatctagtagcaaggacttcgtctgctacaaggaaggaacaggcccctgctcagaaagcgaagagaaaacctgcaaaacatcagggtcatgcaggggcgacatgcaattctgcaaagtagccgggtgcgaacacggcgaagaggcctcggaagccaaatgccgatgcagcctggtccacaaaccaggcgaagtcgtagtcagctacggaggcatgcgcgtccggcccaaatgttacgggttttcacgaatgatggccaccctggaagtcaacccgcccgaacaacgcataggacaatgcaccggatgccacctcgagtgcgtcaacgggggcgtgcgtcttattacactcacctccgaactaaaatcagccacagtctgcgcctcacacttttgctcaagcgccacaagcggcaagaaatcaaccgaaatccagttccacagcggatctttggtcggcaagacggcaatccacgtaaaaggcgcactcgttgatggaacagagttcacattcgaaggatcctgcatgttcccagatgggtgcgacgcagtggactgcactttttgcagagagttcctcaaaaaccctcagtgctaccccgccaaaaagtggttgttcataatcatcgttatactcctaggctacgcagggctgatgttgctcaccaacgtcctcaaagcaattggagtgtggggctcctgggtcatcgcaccagttaaattaatgttcgccatcataaagaaactcatgcggtcagtctcgtgcctgatgggcaaactaatggaccgaggccgccaggtcatccacgaagaaataggcgaaaacagggaaggaaaccaagacgatgtaaggatcgaaatggcccgcccgcgcagagtccgccattggatgtactccccagttatactcaccattctcgcagtcggcctcgccgaaggttgcgacgaaatggtgcacgcggacagtaaactcgtctcctgcaaacaaggatcaggaaatatgaaagaatgcgtaacgacgggaagggccctcctcccggccgtgaaccccggtcaagaagcatgtctacacttcacagcaccaggctcacccgacctgaaatgccttaaaataaaggttaagaaaatcaacttaaaatgcaagaaatcttcctcatacttcgtcccagatgcacgctccagatgcaccagcgtcagacggtgcagatgggccggcgactgtcaaagcggttgcccaagccacttcacatccaatagcttctccgacgactgggcgggcaaaatggatcgcgccgggctcggattcagcggatgcagtgacggctgcggcggggctgcatgcggctgcttcaacgctgcacccagctgcatattctggagaaaatgggtagagaacccccacggcataatatggaaagtaagtccctgcgcagcctgggtcccatcagccgtcatagaacttacaatgccaagcggagaagtccgcacattccacccgatgagcggaatcccgacccaggtcttcaaaggcgtcagcgtcacctatctagggtccgatatggaagtttccggccttacagatctctgcgaaattgaggaacttaaaagcaagaaactcgccctcgcaccttgcaaccaagcgggcatgggagtcgtcgggaaagtaggagaaatccaatgcagcagcgaggaaagtgcgcgtaccattaagaaagacggatgcatctggaacgcggacctcgtcggaatagaacttcgagtagatgacgccgtctgctacagcaaaattaccagcgttgaagcagtcgccaactacagcgcaataccaacaaccatcggcggcctacgattcgagcgctcccacgacagccaaggcaaaatctcaggttcacccctagacataactgcgatccgcgggagcttctcagtcaactacagaggactgcgcctaagcctcagcgaaatcaccgccacgtgcacaggcgaagtcaccaacgtcagcggatgttactcatgcatgataggcgccaaagtaagtatcaaactccactcaaacaaaaactcgaccgcccacgtacgctgcaaaggcgacgagaccgccttctccgtcctagagggggtccacagctatacagtctccctatccttcgatcacgcagtagttgacgagcagtgtcaacttaactgcggaggacacgagtcgcaagttacccttaaaggcaacctcatattcctggacgttccgaaattcgtcgacggctcgtatatgcaaacctaccattcctccgtcccaacgggcgcaaacatacccagccccaccgactggctgaacgctctcttcggcaacggcctctcacggtggatcctcggggtcataggcgtactcctaggagggctcgcactatttttcctgataatgagcctcttcaaactggggaccaaacaagtgttccgaagcagaaccaaactagcgtag

SEQ ID NO: 16447 - RNA, 3222 nt, synthetic construct
  misc_feature 1..3222: note = derived and/or modified CDS sequence (opt11) from SFTSV(SDLZtick12/2010)__JQ684872.1__GP
  source 1..3222: mol_type = other RNA
atgatgaaagtcatatggttcagctccctaatatgcttcgtcatacaatgctcaggagattccggtcccatcatatgcgccgggccaatacactcgaacaagagcgccgatatcccccacctactcggatactcagaaaagatctgccaaatagaccgcctcatacacgtaagctcgtggctccgaaaccacagccaattccaaggctacgtagggcaaaggggtggaaggtcccaggtctcatactacccagcggaaaactcatactcaagatggagcggcctcttgtcgccctgcgatgccgactggctgggcatgctagttgtcaagaaagccaaagggtctgacatgatagtaccagggcccagctataaaggcaaagtcttcttcgaaagacccacattcgacggctacgtcggctggggatgcggcagcggcaaatcacgaaccgaaagcggcgaattatgctcctccgactccggaacttcatcgggactattaccgtcggaccgagtactctggatcggcgatgtagcctgccaacccatgactccaataccagaagagacgttcctggaactcaagagcttcagccagagcgaatttccggacatatgcaaaatagacgggatagtgttcaaccagtgcgaaggcgaatcactgccacaacccttcgacgtagcatggatggacgttgggcactcacacaaaatcatcatgcgagagcacaaaacaaaatgggtgcaagaatccagctcaaaagacttcgtatgttacaaagagggcacaggaccgtgctcagaatcggaagagaaaacgtgcaaaacctctggaagctgcagaggcgacatgcagttctgcaaagtcgccggctgcgaacacggagaagaagcctcagaagcgaaatgccgctgctccctcgtccacaaaccaggagaagtagttgtaagctacggaggcatgagaatacgacccaaatgctacggattctcacgcatgatggcaaccctggaagtaaaccaaccggaacaacggataggacaatgtaccgggtgccacctcgaatgtatcaacggcggcgtcaggctgatcacactcacaagtgagctcaaatccgcaaccgtgtgcgcaagccacttttgcagttccgccaccagcggaaagaaaagtacagagatccagttccactcgggcagcttagtcggtaaaaccgccatccatgtaaaaggagcgttagtagacggaaccgagttcaccttcgaagggtcctgcatgttcccagacggatgcgacgccgtggattgcacattctgcagggagttccttaaaaatccccaatgctacccagccaaaaagtggctgttcataataatagtaatactcctcggatacgcaggcctaatgctactcaccaacgtcctcaaagccatcggcatatggggatcttgggtcatagctccagtaaaactaatgttcgccatcattaagaaacttatgcgcacagtatcctgcctaatgggcaaattaatggaccgcggccgccaagtaatacacgaagaaatcggagaaaatagagaagggaaccaagacgacgttcggatcgaaatggcccgtccccgacgcgtaagacactggatgtacagcccagttatactcacattcctagccattggactcgccgaatcctgcgacgaaatggtgcacgccgacagcaagctagtctcgtgcagacaaggcagcgggaacatgaaagagtgtgtgacaacgggccgcgcgctgctacccgcggtaaacccaggccaagaggcatgcctacactttacagcgcctggctccccagacagcaaatgcctcaagataaaagtcaagagaatcaaccttaagtgtaaaaagtcaagctcatacttcgtgccggacgcccgatcccgatgcaccagcgtgcgacgatgcagatgggcaggcgactgccaatccggctgcccgccccacttcaccagtaactcgttcagtgacgactgggctggaaaaatggacagagccggactaggcttcagcggatgcagcgacggctgtggcggagcagcatgcggctgcttcaacgcagccccgtcatgcatcttttggcgaaaatgggtagagaacccacacggcataatatggaaggtctcaccctgcgcagcttgggtgccatcagccgtcatagaactaaccatgcccagcggcgaagtccggacctttcaccccatgtcagggatcccgacgcaggtcttcaagggagtctcggtcacctacctaggaagcgacatggaagtgtccgggctgacggacctatgcgagatagaggaactgaaatcgaagaaactggcgcttgctccatgtaaccaagccggaatgggggtcgtaggcaaagtaggggagatccaatgcagctcagaagagagtgcaagaacaatcaagaaagacggatgtatatggaatgccgatctagttgggatcgaactgcgggtggacgacgcagtgtgctactcaaaaataacctcagtcgaggcagtcgcgaactactccgcaatcccgaccacgattggaggactaagatttgagcgctcacacgactcccaagggaaaatcagtggcagtcccctggacataaccgccattcggggcagcttctccgtcaactaccggggcctcagactctcactaagcgagatcacagccacgtgcacgggcgaagtcacaaacgtaagcgggtgttacagctgcatgacaggagccaaggtctcaataaaacttcacagcagcaaaaactcaaccgcacatgtacgctgcaaaggagacgaaacagcattcagtgtcctcgagggtgtccactcctacactgtcagcctgtcttttgaccacgccgtagtggatgaacagtgccaactcaactgcggcggccatgaaagccaagtgacactaaaaggcaacctcatattccttgacgtaccaaaattcgtagacggatcatacatgcaaacatatcacagcaccgtgcccaccggggccaatatcccctcaccaaccgactggctcaacgcactatttgggaatggactctccaggtggatactgggcgtcatcggtgttctgctaggcggactcgcgctgttcttcatgatcatgtcactattcaaacttggcactaaacaagtattccgctcacgcacaaaactcgcataa

SEQ ID NO: 16448 - RNA, 3222 nt, synthetic construct
  misc_feature 1..3222: note = derived and/or modified CDS sequence (opt11) from SFTSV(Zhao)__KF374684.1__GP
  source 1..3222: mol_type = other RNA
atgatgaaggtaatctggttcagctcgctaatatgcctcgttatccagtgcagcggcgacacaggacccatcatatgcgccggccccatccacagcaacaaatcggccaacatcccacacctcctaggctactcagaaaagatatgtcaaattgaccgattaatacacgtctcctcctggctacgaaaccatagccaattccaaggatacgtcggacaacgcggaggaagatcccaggtgtcgtactacccagcagaaaacagctactcacgatggagcgggctactcagcccatgcgacgcggactggctcggaatgctcgtcgtaaagaaagcgaaagggtcagacatgatcgtaccaggccccagctacaaagggaaggtattcttcgaacgcccaaccttcgacggctatgtcggatggggctgtggcagcggaaagagtcggacagaaagcggagaactctgctcgagcgactccggaacttcatcaggattactaccgtccgatagagtactctggattggcgacgtcgcctgccagcccatgacacccatacccgaagaaaccttcctcgaactcaaatcgttcagtcaatcagagttcccagacatctgcaaaatcgacggaatcgtattcaaccaatgcgaaagcgaatcactaccccaacccttcgacgtcgcgtggatggatgtaggacactcgcacaaaataataatgcgagaacacaaaacgaaatgggtgcaagaatcatcaagcaaagatttcgtatgctataaggaaggaacaggcccgtgcagcgaaagtgaagagaaaacatgcaaaacgagcggttcctgccgcggcgatatgcagttctgtaaagtagcaggttgcgaacacggggaagaagcgagcgaagcaaaatgccgctgcagtctggtacacaaaccaggggaagtcgtcgtaagctacggagggatgcgagtccgaccaaagtgctacggattcagccggatgatggccacgctcgaagtaaatccgccagaacagcggataggacagtgcacgggatgccatctcgaatgcataaacggaggggttcgcctagtaacgctaacatcagagctgaaaagcgctacggtatgtgcatcccatttctgcagctcagcgacgagcgggaagaaatcaacagagatacaattccacagcggctccctcgtgggcaaagcagcgatacacgtcaaaggtgcgctagtcgacgggacggagttcaccttcgaagggtcatgcatgttcccggacgggtgcgacgcagtagactgcacattctgcagagagttcctcaaaaacccccagtgctaccccgcaaagaagtggcttttcataattatcgtaatcctactaggctacgcgggcctcatgctcctcacgaatgtcctcaaagccataggagtatggggaagctgggtcatagccccagtaaaactaatgttcgcgatcataaagaaactcatgcgcagcgtatcctgcctcatgggtaaactcatggaccgcggaaggcaagtcatacacgaagaaataggagagaacagagagggaaatcaggacgacgtgcgaatcgaaatggtacgaccgcgacgggtccgccactggatgtactcaccagtcatactgacaatcttagcaatcggtttaacagagggctgcgacgaaatggtccacgccgacagcaaactggtgtcatgccggcaaggctcaggaaacatgaaagagtgcgtaaccacagggagagccctcctacctgctgtgaacccgggacaggaggcttgcctccacttcaccgcacccggctccccggacagcaaatgcctgaaaatcaaagtcaagagaatcaacctcaaatgtaagaaaagctccagctacttcgtaccagacgcacgcagtcgctgcacgagcgtaaggcgctgtaggtgggcgggcgactgccaaagcggatgtccgagccacttcacatcaaacagctttagtgacgactgggcagggaaaatggacagagcaggactcggattctccggatgcagtgacggatgtggaggagcggcctgcggctgtttcaacgccgcacccagctgcatcttctggcggaaatgggtcgaaaacccacacggaattatatggaaagtaagcccatgcgcggcttgggtaccaagcgcggtcatagaactaaccatgccgagcggggaggtgagaaccttccatcccatgagcgggataccgacccaagtcttcaaaggcgtctccgtaacctacctgggcagcgacatggaggtgtctggcctaaccgacctatgcgaaatagaagaactaaagagcaagaaactagcgctcgcaccatgcaaccaagccggaatgggggtcgtcggaaaagtaggagaaatccaatgcagctcggaagaatcagcaaggacaatcaagaaagacgggtgcatctggaacgcagacctcgtgggaatagaactcagggtcgacgacgcagtctgctacagcaaaataacgagcgtcgaagctgtggcaaattactcggccatccccacgacgatcggcgggctcagattcgaacgctcccacgacagccagggcaaagtctcgggcagcccactcgacattaccgccatacgcggcagcttctccgtcaactacagggggctcaggttaagcctaagcgaaatcacggcaacttgcaccggcgaggtgacaaacgtgagcggatgctatagctgcatgaccggtgcaaaggtctccattaagctccactcaagcaaaaatagcacagcgcacgtacgctgcaaaggcgacgagactgccttcagcgtacttgaaggcgtccacagctatacagtctcattatcgttcgatcacgccgtagtcgacgagcaatgtcagctcaactgcggaggccacgaatcacaagtgacactaaaaggaaacctcatcttcctcgacgtaccaaagttcgtcgacggcagctacatgcaaacctaccatagcagtgtaccgaccggtgccaacatcccaagtccaactgactggctcaacgcactattcggcaacggactctcccgatggatacttggggtcataggggtgctcctaggcggcctagcactattcttcctaataatgagcctcttcaaactaggaacaaaacaagtattccggagcagaaccaagttagcgtga

SEQ ID NO: 16449 - RNA, 3222 nt, synthetic construct
  misc_feature 1..3222: note = derived and/or modified CDS sequence (opt11) from SFTSV(Zhejiang/01/2011)__KJ597824.1__GP
  source 1..3222: mol_type = other RNA
atgatgaaagtcatatggttctcatcgctcatatgcctggtaatccaatgcagtggagataccggacccatcatatgcgcgggcccgatccatagcaacaaaagcgcgaatatcccccacttactgggatactcagagaaaatatgccaaatagaccgactcattcatgtgtcctcatggctaagaaaccactcacaatttcaggggtacgtgggacaacgaggcggacgcagccaggtaagctactacccagcggaaaacagctactcacgatggtcgggcctgctcagcccatgcgacgcggactggctaggaatgctcgttgtcaaaaaggccaagggctcggacatgatagtaccaggaccatcctacaaaggcaaagtattcttcgaacgccctaccttcgacggttacgtaggctggggatgcggctcgggaaagagcaggaccgaaagcggcgaactatgctccagcgacagcggaacatcgagtgggctcctccccagtgacagggtactatggattggggacgtcgcgtgccaaccgatgacaccaattccagaagaaacgttcctcgagctcaagagcttcagccagagcgagttcccggacatatgcaaaatcgatggtatagtattcaaccaatgtgaaagcgaaagcctgccccagccattcgacgtcgcttggatggacgtggggcactcacacaaaataatcatgagggaacacaagaccaaatgggtccaggagagcagcagcaaagacttcgtatgctataaagaaggaacaggaccgtgttcagaatccgaagagaaaacatgcaaaacatcagggtcctgccgcggcgacatgcagttctgcaaagttgcgggatgcgaacacggagaagaggccagcgaggcaaagtgccgatgtagcctagtccataaaccgggcgaggtcgtggtaagttatgggggcatgcgagttagaccaaaatgctacggtttttcgaggatgatggcgacattagaggtgaacccgcccgaacaaagaatcggacaatgcaccggctgtcacctagagtgcataaacggaggggtacgcctagtaacactgaccagtgaactcaagagtgcaacagtgtgcgcgagccatttctgctctagtgccactagcgggaagaagtccacggagatacaattccactcgggcagtctagtggggaaagccgcaatccacgtaaaaggagccctagtagacggtaccgagtttacattcgaggggagctgcatgttcccagacggctgcgacgccgtggactgtaccttctgcagggaatttctcaagaacccgcaatgttacccagcgaagaaatggctatttattataatagtgatcctcctcggatacgccggactcatgttactgacgaacgtgctcaaggccataggcgtatggggaagttgggtcatcgccccggtaaagctaatgtttgcgatcatcaaaaagctaatgcgctcggtctcgtgcctgatgggaaaactgatggatcgaggcaggcaagtcatacacgaagagataggcgagaatagagaaggcaatcaggacgacgttaggatagaaatggtacgaccgagaagggtgaggcactggatgtacagtccggtgatactgacaatcctcgcaatcgggctaacagaaggctgcgacgaaatggtacacgcagactcgaagctagtttcatgtcgacagggatccgggaacatgaaagagtgcgtcaccacaggcagagcactactcccggcggtgaaccccggccaagaagcatgcttacattttacggcgccaggaagcccagacagcaaatgcctaaaaatcaaagtcaaaagaatcaacctgaaatgcaaaaagagttcaagctattttgtccccgacgcccggtccaggtgcacaagcgtacgaaggtgtaggtgggcaggcgactgccaaagcggctgtcccagccacttcaccagtaacagcttcagtgatgactgggccggaaaaatggatcgggcaggcctaggcttcagcgggtgcagcgacgggtgcggtggggcagcctgcggatgcttcaacgcggcgccaagctgtatcttttggcggaaatgggtggagaacccgcacgggatcatctggaaggtcagcccctgcgccgcgtgggtgccatctgcagtaatagagctaacaatgcccagtggagaagtaaggacattccacccaatgagcggaataccgacccaagtcttcaaaggggtctctgttacgtacctgggcagcgatatggaagtgtcaggactcacggacctgtgcgagatagaagaacttaaatcaaagaaactcgctctagcgccatgcaaccaggcggggatgggagtagtcggcaaagtgggggaaatccaatgcagctcagaagaatccgcgcgaacaataaagaaagacggatgcatctggaacgcagacctggtcggaatagaactccgagttgacgacgcagtatgctactcaaaaataacatcagtcgaggccgtggccaactactcggcaatacccacaaccatcggagggctcagattcgagcgctcgcacgacagccaagggaaaatatcaggctcaccactggacatcaccgccatcaggggctcgttctcggtaaactacagggggttgagactgagcctctctgagataacggctacctgcacgggcgaggtgacaaacgtgtccggatgctacagctgcatgaccggcgcgaaagttagcataaaactacacagcagcaaaaactccacggcacacgtaagatgcaaaggggacgaaacggcgttcagcgtactggaaggggtccatagctacacagtaagcctcagcttcgaccacgcagtagtagacgaacagtgccagctaaattgcggaggacacgaaagtcaggtaacgctaaaaggaaacttgatctttctagacgtcccgaaattcgtggacggatcgtacatgcaaacctatcactcctcagtgccgaccggcgcaaacatcccctccccaaccgactggttgaacgcactcttcggcaacggattgagcagatggatactaggggtgatcggggttctactcggagggctagctctcttcttcctgataatgagcctattcaaacttggcacgaaacaagtattcaggagtaggacaaaacttgcgtga

SEQ ID NO: 16450 - RNA, 3222 nt, synthetic construct
  misc_feature 1..3222: note = derived and/or modified CDS sequence (opt11) from SFTSV(ZJ2013-06)__KP280204.1__GP
  source 1..3222: mol_type = other RNA
atgatgaaggtgatatggttctccagcctcatatgcctcgtaattcagtgcagcggagatacaggaccgatcatctgcgcagggccaattcacagcaacaaatcagcagacataccgcacttacttggatacagtgagaaaatctgccaaatagacagactaatacacgtgtcctcgtggctacgcaaccattcccaattccaaggctacgtcggtcagcgcggagggcgaagccaagtatcgtactaccccgcggagaactcctacagcagatggtcagggctactaagcccatgtgacgcggactggctaggtatgctggtagtgaaaaaggcaaaaggcagcgatatgatagtacccggaccatcctacaagggcaaggtcttcttcgaacgacccaccttcgatggatacgtgggttggggctgcggctccggcaaaagccggacagagagcggagaactgtgcagcagcgatagtggcacatcgtcagggctgctccccagcgaccgagtattatggataggcgacgtcgcctgccaaccaatgacccccatcccagaagaaacgtttctagaattaaagagcttttcgcagagcgagttccccgacatatgtaagatagacggcatagtcttcaaccaatgcgagagtgagagcctaccccagccattcgacgtggcatggatggacgtcgggcacagccacaaaataataatgagagaacacaaaactaagtgggtacaggaaagctcatccaaagatttcgtgtgctacaaagaaggcactggaccatgcagcgaatctgaagagaaaacctgcaagaccagcggctcgtgcagaggcgatatgcagttctgcaaagtggcaggatgcgaacacggagaagaagcctcagaagcgaaatgccgctgttccctggtccacaaacccggagaagtcgtagtctcatatgggggaatgcgggtgcgaccaaaatgctacggattctcacgaatgatggcaaccttagaagtaaacccaccagagcaaagaattggacaatgcaccggctgccacctcgagtgcgtaaacggaggcgtgcggctaatcacactcacaagcgagctcaaaagcgcgacagtgtgcgcgagccacttctgctccagcgccacaagcggcaagaaaagcacggaaatccaatttcatagcggctcccttgtaggcaaaaccgccatacacgtgaaaggcgcgctagtggacggcacagagttcacgttcgaaggctcatgcatgttcccggacgggtgcgatgccgtcgactgcacgttctgccgcgagttcctgaaaaacccccagtgctaccccgccaagaaatggctattcataaacatagtgatcctcctcggctacgccggccttatgctgctcacaaacgtgctcaaagcaataggcgtatgggggagttgggttatcgcccccgtaaaactcatgttcgcaatcataaagaaactcatgaggtcagtatcgtgccttatggggaaattaatggaccgcggccgacaggtaatccacgaagaaattggcgaaaacagggaaggcaaccaggacgacgtgaggatagagatggcaaggccgaggcgcgtaaggcactggatgtacagcccagttatactaacgatcctcgccgttggactggccgaggggtgcgacgaaatggtgcacgccgactccaaactcgttagttgcaaacagggatcgggaaacatgaaagagtgcgtcaccaccggcagggccctactcccagcagtcaacccgggccaagaggcatgtttgcacttcacagcgccaggcagtccggactcgaaatgcctcaaaatcaaagtcaagaagatcaatttaaagtgcaagaaaagctccagctacttcgtgccagacgcaagaagcagatgcacgagcgttagaagatgccggtgggcaggcgactgtcaaagcggatgcccaagccactttacaagtaacagcttcagcgacgactgggctggaaaaatggaccgagccggactcggatttagtggctgcagcgatggatgcggcggggccgcctgcggctgctttaacgctgcgccgagctgtatcttctggaggaaatgggtagagaatccgcacggaataatatggaaagtctcaccatgtgccgcatgggtaccgtcggccgtcattgagcttacaatgccgagcggagaagtacgcaccttccacccgatgagcggaataccaacccaggtatttaaaggagtcagcgtaacgtacctaggctcggacatggaagtctccggactgacagacctatgcgagattgaggaactaaaaagcaagaaactcgcactcgcgccatgcaaccaagcgggaatgggagtcgtaggcaaagtcggcgaaattcaatgctcaagcgaagaaagcgcgcgtacaatcaagaaagacgggtgcatctggaacgccgacctagtaggcatagagctcagggtcgacgacgcagtgtgctactccaaaataacatcagtcgaagccgtagcaaactactccgcgatcccaacgaccatcggcggtctacggttcgaacgatcacacgattcccagggcaaaatcagtgggtcacccctggacataaccgcgatccgaggatccttctcagtcaattacagaggactgagactcagcctaagcgagataacagcgacgtgtaccggagaggttactaacgtgagcggatgctactcctgtatgacaggggcgaaagtttctataaaattgcacagcaacaaaaacagcaccgcgcacgtgcggtgtaaaggcgacgagaccgcgttttcggtcttagaaggggtccacagctacacagtaagcctcagcttcgaccacgccgtagtggacgaacaatgccaactaaattgcggaggacacgaatcacaagtaaccttaaaaggaaacctaatcttcctcgatgttccgaaattcgtagatggctcatacatgcaaacataccatagctcagtcccaacaggggcgaacatcccaagtccaaccgactggctgaacgcactcttcggcaacggcctgagtagatggatactcggagtcataggcgtactcctagggggcctagcactcttcttccttatcatgagcttgttcaagctcgggaccaagcaggtcttccggtccagaacaaaactcgcctag

SEQ ID NO: 16451 - RNA, 3222 nt, synthetic construct
  misc_feature 1..3222: note = derived and/or modified CDS sequence (opt11) from SFTSV(ZJZHSH-AM/China/05/2012)__KR017846.1__GP
  source 1..3222: mol_type = other RNA
atgatgaaggtaatctggttcagctcgctgatctgccttgttatacagtgtagcggagacacaggacctataatatgtgccggcccgatacatagcaataagtcagcaaacataccccatctactcgggtattccgagaaaatatgccaaattgaccgtctaatacacgtaagcagctggctacgtaatcactcccaatttcaagggtacgtagggcaacgaggaggacgaagccaggtatcgtactatcccgctgaaaatagctactcgaggtggagcggtctcctctcgccctgcgacgcggactggttaggtatgctggtagtcaagaaggccaaaggcagcgacatgatcgtcccagggccttcgtacaagggaaaagtattcttcgaacgcccaaccttcgacggatacgtgggatggggctgcggaagcggcaagagccgaaccgaaagcggcgaattatgctcgtccgacagcggaaccagcagcgggctactgccctcggaccgagtcctctggatcggcgacgttgcatgccagccaatgacaccgatcccggaagaaacatttctcgagctaaagagtttcagccagagcgagttccccgacatctgcaaaatagacgggatagtatttaaccaatgcgagagcgagagcttaccccagcccttcgacgtggcctggatggacgtaggccactcgcacaaaatcataatgcgggagcataagacaaaatgggtacaggaaagcagttctaaagacttcgtgtgctacaaagaggggacgggcccgtgcagcgaatcagaagagaagacgtgcaaaacctcgggttcatgcaggggcgacatccaattctgtaaggtggccgggtgcgaacacggggaggaagcgtccgaagccaaatgtcgatgtagtctggtccataagccgggagaagtcgtcgtctcgtacggaggtatgcgcgtacgaccgaagtgctacggattcagccgaatgatggctacactggaagtaaaccctcccgagcaaagaataggccaatgtaccggatgtcacttagaatgcataaacgggggtgtgcgactaatcacactcacgtccgaactaaagagcgctacagtctgcgcaagccacttttgttcatcagcaactagcgggaagaaaagcacggaaatacaattccactcgggttcacttgtaggtaaggcagcaatccacgtcaagggagcgctcgtggacgggaccgagttcacgtttgaaggaagctgcatgttccccgacgggtgcgatgcggtcgactgcactttctgccgcgagttcctcaagaacccgcaatgttacccagcaaagaaatggctattcatcataatcgtaattctcctcggatatgcgggcctgatgctgctgacgaacgtactgaaagccataggagtctgggggagctgggtcatagcccctgtcaaactcatgttcgcaataataaagaaactcatgcgcagcgtatcatgcctgatgggaaaactaatggatagaggcagacaggtaatccacgaagaaataggcgaaaacagagaaggaaaccaggacgacgtaagaatagagatggtccgaccgcgcagggtcagacactggatgtatagcccggtcatactcacgatcctggcaataggtctaacagaaggatgcgacgagatggtccacgcggactcgaaactggtctcctgcagacaaggaagtggaaacatgaaagaatgcgtgaccacgggcagagccctactcccggccgtcaaccccggccaggaagcgtgcctgcacttcaccgcacccggaagcccagattcgaaatgcctaaaaatcaaagtcaaacggatcaacctcaaatgcaaaaagtcaagtagctacttcgtgccagacgccaggagcagatgcacatccgtgcggcgatgtaggtgggcgggagattgccagagcgggtgcccaagtcatttcacgagcaactccttcagcgacgactgggcaggcaaaatggaccgggccggtctaggattctcgggctgcagcgacggctgcggaggagccgcatgcggttgcttcaatgcggcaccatcatgcatattctggaggaaatgggtagaaaacccccacggaatcatatggaaagtatcgccctgcgccgcttgggtgccatcggccgtcatagagctcaccatgccaagcggagaggtgagaacattccatccaatgagcgggatcccaacccaggtattcaaaggggtctccgtaacatacctcgggtcggacatggaggttagcggactgacggatctgtgcgagatcgaggaacttaaatcaaagaagctcgcgctagcgccatgcaatcaagccggcatgggggtcgtaggaaaggtcggagagatccaatgtagcagcgaagaatcagcgcgaaccatcaagaaagacggatgtatatggaacgcggacctggttggcatagaacttagagtagacgacgcagtctgttacagtaaaataacatcagtcgaagccgtggcaaactacagcgcaatcccaacgaccataggcgggctccgattcgagcggtcacacgacagccaagggaaaatatctggcagccccctagacatcacagcaatccgaggatccttctccgtaaactacagaggactaagactaagcctgagtgaaataacagccacgtgcaccggagaggtaacgaacgtaagtggttgctactcatgcatgacaggggcgaaagtaagcataaaattacactcatccaaaaactcgactgcgcacgtccgatgtaaaggggacgaaacagctttctcagtactagaaggagtccacagctacaccgtatcactcagcttcgaccacgccgtagtcgacgagcagtgccaactgaactgcgggggccacgaatcgcaagtcacgttgaagggaaacctaatattcctcgacgtacctaaattcgtagatggcagctacatgcaaacctaccacagttcggtcccgaccggagcaaacatcccaagccccacggactggctcaacgcgctatttggcaacggcctatccaggtggatactcggggtcataggcgtgctcctgggcgggctcgctctcttcttcctaatcatgagcttgttcaaactcgggacaaagcaggtcttcagaagcagaaccaaattagcgtga

SEQ ID NO: 16452 - RNA, 3222 nt, synthetic construct
  misc_feature 1..3222: note = derived and/or modified CDS sequence (opt11) from SFTSV(ZJZHSH-CXD/China/05/2012)__KR017858.1__GP
  source 1..3222: mol_type = other RNA
atgatgaaagtaatatggttcagttccctgatatgcctagtcatccaatgcggcggagatacaggaccaataatctgcgcaggaccgatacacagcaataaatcggccggaatcccccatctactcggatattcagaaaagatatgtcagattgacaggctaatccacgtgagcagctggctgcgcaaccacagccaattccaaggatacgtcggccaaagaggcggcagaagccaggtgtcatactatccagcggaaaacagctatagccgctggagtggcctcctcagtccatgcgacgcagactggctgggcatgctggttgtcaagaaagcaaaaggatccgacatgatcgtacccggaccctcatacaaagggaaagtattcttcgagcgccccaccttcgacggctacgtaggatggggctgcgggagcggcaaaagcagaaccgaaagtggcgaactatgctccagcgacagtgggaccagcagcgggctcctaccctccgaccgggtcctgtggattggtgatgttgcatgccaaccaatgacgccgataccagaagagaccttcctcgagctcaagagcttctcacaaagcgagttccctgacgtgtgcaagatagacggcatcgtcttcaaccagtgcgagggcgaaagtctaccccaaccctttgacgtggcatggatggacgtaggacactcgcacaaaattattatgcgggaacacaaaaccaaatgggttcaagaaagcagttcaaaagacttcgtgtgctacaaagaaggaacgggaccgtgcagcgaatcagaagagaagacgtgcaaaacgtccgggtcatgcagaggcgacatgcaattctgcaaggtggccgggtgcgagcacggcgaagaggcctccgaggcaaaatgccgctgcagcctcgtccataaacccggagaagtcgtagtctcttacgggggcatgagggtacgccccaaatgctacggattttccagaatgatggccaccctagaagtaaacccacccgaacaaagaatcggccaatgtactgggtgccacctagaatgcatcaatggcggcgtacgactaatcacactgacgtccgaactcaaaagcgcgaccgtatgcgccagccacttctgcagctccgcaacctcaggaaagaaatcaacggaaatccagttccactcgggctcccttgtgggaaaaacagcgatacacgtcaaaggcgcgctcgtggatggcaccgagttcacgttcgaaggctcctgcatgttcccagacggatgcgacgcagtagactgcaccttctgtagggagttcctcaaaaacccacagtgctacccagccaaaaagtggctatttataatcatagtaatcttactaggctacgcaggtctaatgctcctcacaaatgtcctcaaagcaataggcgtatggggctcatgggtaatagcgcccgtgaagctcgtgttcgcaatcataaagaaactaatgcgagcggtctcctgcctaatgggcaaactaatggaccgtggacgccaggtcatccacgaggaaatcggcgaaaaccgcgaaggaaaccaaaacgatgtcagaattgaaatggcaagaccgagacgagtaagacactggatgtactcgcctgtcatactaacgatattagcaataggcttcgccgaagggtgtgacgagatggtacatgcagactccaagctagtctcgtgcagacagggcagcgaaaacatgaaggagtgcgtcactacgggcagagctctgctccccgcagtaaaccccggacaagaggcctgcctgcacttcacagcccccggctcacccgactcgaaatgcctaaaaataaaagttaaacgcataaatctaaagtgcaaaaagagctcctcatacttcgtgcccgacgccaggtcacgctgtacaagcgtcagaagatgtagatgggcgggcgattgccagtcgggttgccctccacatttcacgagtaactcattctccgacgactgggcagggaaaatggaccgggccggcctcgggttctccggttgcagtgacggatgcggaggagcagcatgtggatgcttcaacgcagcccccagctgcatattctggcgcaaatgggtcgaaaacccacacggaatcatttggaaagtctcgccatgcgctgcatgggtaccctcggccgtcatcgaattaacaatgccaagcggcgaagtacgcacgttccacccgatgagcggaatccccacacaggtcttcaaaggcgtatcagtaacctacctcggatccgacatggaggtcagtggactcaccgacctatgtgaaatagaggaactgaaaagcaagaaactcgcgctagccccctgtaaccaggcgggcatgggcgtcgtcgggaaagtcggagaaattcaatgtagcagcgaagaatcggcacgaacaatcaaaaaggacggatgcatatggaacgcagacttagtaggtatagaactaagagttgatgacgccgtctgttactcaaaaataacctcagtcgaggcagtcgcaaactacagcgccatcccaacgacgattggcgggctcaggttcgaacgcagccacgactcccaaggcaaaatatcaggctcgccactcgacataaccgccatacgcggatccttctcggtcaactaccgaggactgagattgagcctgtcagaaatcacagccacatgcacgggagaagtaaccaacgtcagcggatgctacagctgcatgaccggagccaaagtaagcatcaaactacacagctccaagaactcaaccgcacacgtacgctgtaaaggagacgagacggccttcagcgtactagagggtgtccactcctacagcgtgagtttatccttcgatcacgcagtagtagacgaacagtgccaactcaactgcggcggacacgaaagccaagtaacgttacgaggaaacctgattttcctagacgtcccaaaattcgtagacggatcttacatgcaaacgtaccacagcacagtaccaaccggggcaaatatcccaagccccaccgactggctaaacgcactcttcggcaacggactttcccgatggatcctaggggtcataggcgtgctattaggcgggcttgccctcttcttcttaattatgagcctgttcaaactcggcacgaagcaagtcttccggtcacgcacgaaactagcatga

SEQ ID NO: 16453 - RNA, 3222 nt, synthetic construct
  misc_feature 1..3222: note = derived and/or modified CDS sequence (opt11) from SFTSV(ZJZHSH-FDE/China/06/2012)__KR017859.1__GP
  source 1..3222: mol_type = other RNA
atgatgaaagtgatatggttctcctcgttaatctgcttagtgatccaatgcagtggagacaccggaccgataatctgcgcagggcccatacactcgaacaaatctgctaatataccacacctcctggggtacagtgagaaaatatgccaaatcgaccgtctcatacacgtctcctcctggctccgcaaccacagccaatttcaaggatacgtcggccagcggggcggccgcagccaagtctcatattacccagcagaaaacagctactcaagatggtccggactccttagtccatgcgacgccgactggctcgggatgctagttgtcaagaaagcgaaaggtagtgacatgatcgtcccgggacccagctacaaaggcaaagtcttcttcgaacgcccaacattcgatggatacgtcggatggggttgtgggtccggcaaaagcagaaccgaaagcggcgaactgtgcagtagcgactcgggcacgtcctcgggcctgctaccaagcgacagagtcctatggatcggcgacgtcgcgtgtcaaccgatgacccccatccccgaagaaacattcctggaactcaaatcgttctcacagagcgaatttccggacatatgcaagatagacggcatcgtattcaatcagtgcgagagcgagagcctaccccaaccattcgatgtagcatggatggacgtagggcacagccacaaaatcatcatgcgagagcacaaaacaaaatgggtccaagagagcagctccaaagactttgtatgctacaaggaaggcaccggcccatgcagcgaatccgaagagaaaacgtgcaaaactagcggctcctgccgaggtgacatgcaattctgcaaagtggcaggatgcgaacacggcgaagaggcttcagaagccaaatgcagatgcagcctcgtacacaaaccgggcgaagtggtcgtgagttatggagggatgcgcgtacgacccaaatgctacgggttcagtcgaatgatggctaccctcgaggtaaacccgcccgagcagcgaatcgggcagtgtacaggctgccacctcgaatgcatcaacggcggagtccgcctcatcaccctaacttcggaactcaaaagcgccaccgtctgcgcctcacacttctgctcctccgccacctccggtaagaaatccacagaaatccaattccactcagggagcctggtaggaaaagcagcaatccacgtcaaaggtgccctagtagacggcactgaatttaccttcgaaggatcctgcatgttcccagacggctgcgacgcagtggactgcactttctgccgcgagttcctcaaaaacccacaatgctacccggcgaagaaatggctattcataatcatcgtaatcctcctagggtacgccggcctgatgctcctcacaaacgtcctaaaagccatcggtgtctggggaagctgggtaatcgcacccgtgaaactcatgttcgccataatcaagaaattgatgcgcagcgtcagctgcctcatgggaaaactgatggatcgaggacgacaagtcatacatgaagaaataggtgaaaaccgcgaaggcaaccaagacgacgtgcgaatcgaaatggtccgcccacgccgcgtacgacactggatgtacagccccgtcatcctaaccatcttagcgatcggcttaacagaagggtgcgacgaaatggtccacgccgactcaaaactcgtatcttgccggcaaggcagcggcaacatgaaagaatgcgtcacgacaggcagagcactactccccgccgtaaacccaggacaagaggcttgcctgcacttcacggcaccaggcagcccagactcgaaatgcttaaaaattaaagtaaaacgcataaacttaaaatgcaagaaaagcagctcatacttcgtccccgacgcccgcagtcggtgcacgtcggtgcgacgatgccgatgggccggagactgccagtcgggatgcccctcccacttcacaagcaactcatttagcgacgattgggccggcaaaatggaccgagccggcctcggattctccggatgcagcgacggatgtgggggtgccgcatgcgggtgtttcaacgcagcaccatcatgtatcttctggcggaaatgggtggaaaacccacacggcattatctggaaagtaagcccgtgcgcagcatgggtaccctcagcagtcatagaactcacaatgcccagcggagaagtgcgcacctttcacccaatgtcaggtatacctacacaggtcttcaaaggagtctccgtaacctaccttggaagcgacatggaggtctctggcctaaccgacctctgcgaaatcgaagaactcaaatccaagaaactggccctcgccccgtgcaaccaagccggcatgggagtagtcggcaaagtaggagaaatccagtgcagctcagaagagtccgcacgaaccatcaagaaagacggatgcatctggaacgccgacctagtcggcatcgaacttcgcgtggacgacgcagtctgctactccaaaataacctcagtagaagcagtcgcgaactattccgcaatccccactaccataggcggcctacgattcgaacgttcccacgactcacagggaaaaataagcggctcacccctcgacatcaccgccatccgaggatccttctctgtcaactaccgcggcctacgcttatcactatcagagatcacggcaacctgcacaggtgaagtgacaaacgtgtccggatgttactcatgcatgaccggagccaaagtgtcaatcaaactacactcaagcaaaaactcaaccgcccacgtccgctgcaaaggtgacgagaccgccttctcagtgctagaaggcgtgcactcgtacaccgtgtctctcagcttcgaccacgccgtcgttgacgagcaatgtcaactaaactgcggcggacacgaatctcaagtcaccctaaaaggcaacctcatattcctggacgtccccaaattcgtcgacggcagctatatgcagacataccactcatcagttccaaccggcgccaacataccttcaccaaccgactggctcaacgccctctttggtaacggcctatcacggtggatactcggcgtcataggagtcctattaggaggcctcgcactcttcttcctaatcatgagtctgtttaaacttggcaccaaacaggtctttagaagcagaacgaagctcgcatga

SEQ ID NO: 16454 - RNA, 3222 nt, synthetic construct
  misc_feature 1..3222: note = derived and/or modified CDS sequence (opt11) from SFTSV(ZJZHSH-FZHR/China/07/2013)__KR017862.1__GP
  source 1..3222: mol_type = other RNA
atgatgaaagtcatctggttcagctcactcatctgccttgtgatacaatgcgggggcgacacgggtcccatcatatgcgcgggtccgatccatagcaacaaaagggcaggaatcccccacctcctcgggtacagcgaaaagatctgccaaatagacagattgatacatgtatccagctggcttcgaaatcacagccaattccaagggtacgtaggacaacgcggaggaaggtcacaagtgagctactaccccgcggaaaattcgtactccaggtggtcgggcctattatcaccttgcgacgccgactggctaggcatgttagtagtcaaaaaggccaagggaagcgacatgatagtaccagggcccagctacaaaggcaaagtattcttcgaacgaccaacctttgacgggtacgtcggatggggatgcggatctggaaagtctaggacggaatcaggagaactgtgctcaagcgactccggaacaagcagcggcctcctcccaagtgacagagtcctatggataggagacgtggcgtgccaaccaatgacacccatcccggaagagaccttcctagaactcaaatcattttcacagagcgagttcccggatgtatgtaaaattgacggcatcgtctttaaccaatgcgaaggcgaatctttacctcaacccttcgatgttgcctggatggacgtcggccactcgcacaagataattatgagagagcacaaaacaaaatgggtccaagaatcaagctcaaaagacttcgtgtgctacaaggaaggaacaggcccctgcagcgaaagcgaggagaaaacctgcaaaacgtccggctcatgcaggggcgacatgcaattctgtaaggtcgcgggctgcgagcacggggaagaggcatccgaggcaaagtgccgctgcagcctagtgcacaaacccggagaagttgtcgtcagctacgggggcatgcgagtccgaccaaaatgctacggattctcccgaatgatggccaccttagaagtgaacccgccagaacagcgaatcggccaatgtacaggatgtcaccttgagtgcataaacggaggagtcaggctaataacgctaacaagcgaactcaaaagcgccaccgtgtgcgccagccatttctgcagcagcgcgacctcaggaaagaaaagcacagaaattcaattccactccggaagcctagtaggcaaaaccgcaattcacgtaaaaggtgccctcgtagacgggaccgaatttacattcgaagggagctgcatgttcccagacgggtgcgatgccgtggattgcaccttctgcagagagttcctgaaaaaccctcagtgctaccccgcaaagaaatggctattcataatcatagtcatcttgctcggatatgcaggcctaatgttgttaacaaatgtgttaaaagccatcggagtctggggcagctgggtcatagccccggtaaaactcgtgttcgcgatcataaagaaactcatgagagcagtgtcatgcctcatgggaaaactaatggaccgaggccgacaggtaatacacgaagaaatcggggaaaatagggaaggcaatcaggacgatgtaagaatcgaaatggcacgacccaggagagtgcgccactggatgtacagcccagtgatattgaccatattagccatcggattagcagaaggctgcgacgagatggtgcacgcggattcaaaactggtcagctgccgccaggggtctggaaacatgaaagaatgcgtcacaaccgggagagcgcttctccccgcagtaaacccaggacaggaggcttgcctacactttaccgcaccaggaagtcccgactcaaaatgcctcaaaataaaagtaaaaaggatcaacctaaaatgcaagaaaagcagcagttacttcgtgccggacgccagatcaaggtgcacaagcgtacgcagatgccggtgggcaggagactgccaaagcggatgcccgccccacttcacgagcaacagcttcagcgacgactgggctggcaaaatggaccgagcgggcctagggttctcaggctgcagcgacggttgcggaggagccgcttgtggatgctttaacgcagcaccgagctgcatattctggcgcaaatgggtagaaaacccacacgggatcatctggaaagtatcgccatgcgcagcctgggtcccatcggctgtaatagaactaacaatgccatcaggcgaagtgcgaacattccacccgatgagcgggatccccacacaagtcttcaaaggggtatcagtaacatatctgggcagcgacatggaggtatccggactcacagacctatgcgagatcgaggaactaaaaagcaagaaactagccctagccccctgcaaccaggcaggaatgggggtcgtaggcaaagtaggtgaaatccaatgctccagtgaagaaagcgcacgcaccatcaagaaagatggctgcatatggaacgcagacctagtaggtattgagctcagggtagacgacgccgtatgctacagcaaaataacctcggtagaagccgtcgccaactactcagcaatcccaacaacaatcggagggctcagattcgaacgcagccacgacagccaaggaaaaatctcagggtcgccgctggacatcacggcaatccgcggatccttttcagtaaattacaggggcctacgcctgtccctctccgagattaccgcaacatgcacgggagaggtgactaacgtcagcggctgctacagctgcatgacgggggcaaaagtgtcaataaaactacactccagcaaaaacagtaccgcccacgtacggtgcaaaggtgacgaaaccgcattttccgtcctagaaggagtacacagttatagcgtatccctcagcttcgaccacgctgtagtggacgagcaatgccagctcaattgcgggggacacgaaagccaggtcaccctaagaggaaacctcatattcctagacgtccccaaattcgtggacggatcctacatgcaaacataccacagcacagtacccacaggcgcgaacataccatcaccgaccgattggctcaacgccctctttggtaacggcctctctaggtggatcctcggcgtcatcggtgtactcctaggtggactagcactgttctttctgataatgagcctatttaaactaggaaccaaacaggtcttccgcagtaggaccaagctcgcgtaa

SEQ ID NO: 16455 - RNA, 3222 nt, synthetic construct
  misc_feature 1..3222: note = derived and/or modified CDS sequence (opt11) from SFTSV(ZJZHSH-HCY/China/06/2012)__KR017855.1__GP
  source 1..3222: mol_type = other RNA
atgatgaaagtcatatggttcccctcgcttatctgcctagtgatacagtgcagtggtgacaccggcccaatcatctgcgcaggcccaatccactcgaacaagagcgccaacatcccacatctgctaggatactcagagaagatatgccaaatcgaccgactcatccacgtatctagctggctaagaaaccacagccagtttcagggctacgtcggccagagaggcggccggagccaagtctcctactaccccgcagagaactcatacagccgatggagtggtctgctatcaccctgcgatgcagactggctaggaatgctagtagtaaagaaagcgaaaggatcagacatgatcgtacccgggccgagctacaaaggaaaagtattcttcgaacgccccacgttcgacgggtatgtcggctggggctgcggatcgggcaaaagtaggaccgagagcggggagctatgttcttcagactccggcaccagcagcggactgctacccagcgacagagtcctgtggataggagacgtcgcatgccagcccatgacaccgataccagaagaaacattcctcgagctcaaaagtttctcgcagtccgaatttcccgacatatgcaaaatagatggcatagttttcaaccagtgcgagagcgaaagcctaccccaaccattcgacgtcgcctggatggacgtaggccacagccacaagataataatgagagaacacaaaacaaaatgggtgcaagaaagtagcagcaaagacttcgtgtgctacaaagaaggcacaggaccgtgctccgagtccgaagagaaaacgtgcaagacctcaggaagctgccgcggcgacatgcaattctgcaaagtcgcagggtgcgaacacggcgaagaggcctccgaagcgaaatgcagatgcagcctagtgcacaaaccaggcgaagtagtggtatcgtacgggggtatgcgagtccggccgaaatgctacggattcagccgcatgatggccactctagaagtgaacccgccagaacaacgcatcgggcagtgcactggatgccaccttgaatgcatcaacggaggagtacgcctagtcaccctaacctccgagctaaagagcgcaaccgtctgcgcctcacacttctgctcctccgccacctccggtaagaaaagcacagagatacaattccacagcggcagcctagtcggtaaagcagccatacacgtaaaaggcgcattagtggacggaaccgagttcacgttcgaagggtcctgcatgttccctgacggatgcgacgcagtggattgcaccttctgccgcgagttcctcaaaaacccccagtgctaccccgcaaagaaatggctattcatcataattgtcatcctactcggatacgcaggcttaatgctgctgaccaacgtactgaaagccataggagtctggggctcctgggttatagcaccggtcaaactaatgttcgcgatcatcaaaaagctgatgagaagcgtatcatgcctgatgggcaagctcatggacagaggaagacaggtaatacacgaagaaataggcgaaaacagagaaggaaaccaagatgacgtacgcatagaaatggtgcgaccccgacgcgtacggcactggatgtacagcccagtaatcctaaccatcctggcaataggactcacagaaggctgcgacgaaatggtccacgcagacagtaagctcgtatcatgccggcaaggaagtggcaacatgaaagagtgtgtaaccacaggccgggccctcctccctgccgtgaaccccgggcaggaagcgtgcctacacttcacagcaccaggatcgcccgactccaagtgcctcaagatcaaagtaaaacgcatcaacctaaaatgcaagaaaagcagctcctacttcgtcccggacgcacgatccagatgcaccagcgtccgaagatgccgatgggcaggagactgccaaagcggttgtccatcccacttcacttctaattcattcagcgacgactgggcgggcaaaatggacagagcgggccttggattcagtggatgcagcgacgggtgtggcggcgccgcgtgtggatgtttcaacgcagcaccaagctgcatcttctggagaaaatgggtcgagaacccacacggaataatatggaaggtctcaccatgcgccgcctgggtaccctcagctgtaatcgaactaaccatgcctagcggagaggtgcgcacattccacccaatgagcgggattccgacccaggtattcaaaggagtatcagtcacctacctgggatcagacatggaagtttcgggactaacagacctatgcgaaatcgaggaactaaaatccaaaaagctggcgctagcaccgtgcaaccaagctgggatgggagtagtaggaaaagtcggagagatacaatgcagcagcgaagaaagcgcacgaaccatcaagaaagatggctgcatctggaacgcggacctagttggaatagaactcagagtcgacgacgcggtctgctatagcaaaataacctccgtcgaggccgtcgccaattatagcgccatacccaccaccataggcggacttcgattcgagcgctcacacgacagccaaggaaaaataagcggctcacccctagacataacagcaatcagaggatcattctcagtcaactacagaggactgagactatctctgagtgagatcacagccacttgcacaggcgaagtgacaaacgtctcgggctgctactcctgcatgaccggcgcgaaagtcagcataaagctccactccagcaagaactccacagcacacgtccggtgcaagggggacgaaacggcgttcagtgtactagagggggtccactcgtacaccgtgagcctcagcttcgaccacgccgtagtggacgaacaatgccaactcaactgcggcggacacgaatcgcaagtgacactgaaaggcaatctgatcttcctcgacgttccgaaattcgttgatggttcatacatgcaaacataccattcctccgtcccaacaggcgccaacatcccctccccgactgattggctcaacgccctcttcggaaacggactcagcagatggatcctcggagtaatcggagtactactaggaggactagccctattcttcctattcatgagcctattcaagctcgggactaaacaggtcttcagaagtagaacgaaacttgcgtaa

SEQ ID NO: 16456 - RNA, 3222 nt, synthetic construct
  misc_feature 1..3222: note = derived and/or modified CDS sequence (opt11) from SFTSV(ZJZHSH-HYC/China/05/2012)__KR017847.1__GP
  source 1..3222: mol_type = other RNA
atgatgaaagtaatatggttcagctccctaatatgcttagtgatacaatgctccggtgacacgggaccgatcatatgtgcgggcccaatccactccaataaatcggctaatatcccccacttactcgggtactccgaaaagatatgccagatagacagactcattcatgtctcctcatggcttcgcaaccattcgcagtttcaagggtacgtaggccaacgtggcggacgcagccaagtatcatactaccccgcggaaaatagctacagcagatggtctggcctactttcgccatgcgacgccgactggcttgggatgctcgtagtcaagaaagctaaaggctcggacatgatagtacccggaccatcctacaaaggaaaagtcttcttcgaacgcccaacgttcgacggctacgtaggttggggatgcggatcggggaaatcacgaacagaaagcggggaactctgcagcagcgatagcggcacctccagcgggctcttgccctcggacagagtcctatggataggcgacgttgcttgccaaccgatgacacccattccggaagaaacattcctggaactaaaatccttctcccaaagcgagttcccggacatatgcaaaattgacggcatcgtctttaaccagtgcgagagcgaaagtctacctcagccgtttgatgtagcctggatggacgtaggccactcccacaaaatcataatgagagagcacaaaacaaaatgggtacaggaatcaagcagtaaagacttcgtgtgctacaaagaaggcaccggaccgtgctccgaatcggaagaaaagacttgcaagaccagtggatcgtgccggggagatatgcaattttgtaaagtagccggatgcgaacatggcgaagaagcatcggaggccaaatgccgctgcagcctagtccacaaaccaggcgaggtagtagtcagttacggaggcatgcgagtccgacccaaatgttacggcttctcacgcatgatggccaccttggaagtaaatcccccagagcagagaatcggacagtgcactgggtgccacctggaatgcataaacggaggcgtacgactaatcacactaacaagcgaactaaaaagcgcaacggtctgcgcgagccacttctgcagctctgccacatctggaaagaaaagtacggaaatccaatttcactctggatcgctagtaggcaaagccgcaatacacgtcaaaggcgcactggtggacggaactgagttcacattcgaaggatcgtgcatgttcccagacggctgcgacgccgtagactgtaccttctgcagggagttcctcaaaaacccacaatgctatccagccaagaaatggctgttcataataatagtgatactgctcggatacgcaggtctcatgctgctaacgaacgtcctgaaagcaataggcgtctggggctcatgggtcatagccccagtgaagctgatgttcgccatcataaagaaattaatgagatcagtgtcatgcctaatggggaaactgatggaccgggggcgacaagtcatacacgaggaaataggtgagaacagaaaaggaaaccaagacgatgtacggatagaaatggtgcggccacgaagagtgcgacactggatgtacagcccggtaatactcacaatactagcgatagggttaacagaagggtgcgacgagatggtccacgcggactcgaaactcgtatcctgcagacaaggaagtgggaacatgaaagagtgcgtgactacgggacgggccctacttccggcggtcaacccaggacaggaagcatgcctgcacttcaccgcgccaggcagcccggattccaaatgccttaaaataaaagtcaaaagaatcaacctaaaatgcaagaaaagctcgagctactttgtccccgacgccaggagcagatgcacaagtgtgcgaaggtgccgatgggccggcgactgccaaagtggctgccccagccacttcacaagcaactctttcagtgacgactgggcaggcaaaatggacagggctgggttagggttctccggctgcagcgatggatgcggaggcgctgcctgcggttgtttcaacgcggcaccaagctgcatcttctggaggaaatgggtcgagaacccacacgggatcatctggaaagtctcgccctgcgcagcatgggtaccatcagcagttatcgaactaacaatgcccagcggagaagtccgcacgtttcaccccatgtcagggataccaactcaggtgttcaaaggggtgagcgtaacgtacttaggttccgacatggaagtatcaggactcacggacctgtgcgagatcgaggaactaaaatcgaagaaactcgcgctagcaccctgcaaccaggccggaatgggcgtcgtgggcaaagtcggagaaatccaatgctcctcggaagaatccgcacgcacgataaagaaagacggatgcatctggaacgcagatctagtcggaatagaactccgtgtcgacgacgcagtatgctacagcaaaataacttcggtcgaggccgtggccaactactcagcgatccccacgaccataggagggctacgattcgaacgatctcacgacagccaaggcaagatcagcggatcacccctagacataacagcaatcagaggttcattctcagtcaactacaggggcctccgactgagcctgtccgaaatcacagccacctgtacaggcgaggtaacgaacgtcagtggatgctacagctgcatgacgggcgccaaagtgagcataaaactccactcatccaaaaactcaaccgcacacgtacgatgcaaaggggacgaaaccgcgttctcagtgctagaaggagtacactcctataccgtgagcttgagcttcgaccacgcagtggtcgacgaacagtgtcagctcaactgcggcggacacgagagccaggtgaccctaaaagggaacttaatcttcctagacgtccctaagttcgtcgacgggagctacatgcaaacttaccacagctcagtaccgaccggggcaaacatccccagcccgacagactggctaaacgcactattcggcaacgggctaagccgctggatactaggagtgattggggtactgctcggcggccttgccctcttcttcctcatcatgtccctgttcaaactcggaacaaaacaagtattccgaagtagaacaaagctagcctag

SEQ ID NO: 16457 - RNA, 3222 nt, synthetic construct
  misc_feature 1..3222: note = derived and/or modified CDS sequence (opt11) from SFTSV(ZJZHSH-HYJ/China/07/2012)__KR017852.1__GP
  source 1..3222: mol_type = other RNA
atgatgaaagtcatctggttttcctccctgatctgcctcgtcatacagtgtagcggagataccggcccaatcatttgcgcaggcccaatacactccaacaaatccgccaacatccctcacctactaggatactcagagaaaatctgccagatagaccggctcatacatgtaagttcatggctccgaaaccacagccaatttcaaggatacgtcggacaacgcgggggcaggagccaagtatcttactatcccgcggaaaacagctactcacggtggtccggtctgctatcaccctgcgacgcagactggctaggaatgctagtcgtcaagaaagcgaaaggatccgacatgatcgttcccggccccagctacaaaggaaaagtcttcttcgaacgccccacctttgacggatacgtaggatggggctgcggatccggcaaatccagaaccgaatctggcgaactctgctcctccgacagtggaacctccagcggccttctcccaagcgacagagtcctctggatcggcgacgtagcttgccaaccaatgacgccgatcccggaagaaacatttctcgagttgaaaagtttcagccaaagtgagttcccggacatatgcaaaatagatggcatagtcttcaaccaatgcgagagcgaaagtctaccacaacccttcgacgtagcctggatggacgtaggccactcacacaaaataattatgagagagcacaaaaccaaatgggtacaagaatcgtcttccaaagactttgtctgctacaaagagggcacaggaccctgctcagaatcagaggagaaaacctgcaaaacatcaggctcatgcaggggcgacatgcaattctgcaaagtcgcgggatgtgaacacggagaagaagcctccgaagccaaatgcagatgctccctggtgcacaagcccggggaggtcgtggtctcatacggtggcatgcgcgtccgaccaaagtgctacggtttctcccgtatgatggccacgctggaagtaaacccgcccgaacaaaggatcggacaatgcacgggatgccacctagaatgcataaatggaggtgtacgactgataaccctcacaagcgagctaaagagcgcaaccgtctgcgcaagccacttctgcagctctgcaacgtcaggcaagaaaagtaccgaaattcagttccactcaggctccctagtcggaaaagccgcgatccacgtcaaaggcgccctcgtggatggaaccgagtttaccttcgaaggctcatgcatgttccccgacggatgcgatgctgtagactgcaccttctgcagagagttcctaaagaacccacaatgttacccagccaagaaatggctattcattatcattgtaatattactagggtacgcggggttaatgctactgacaaacgtactaaaagcaataggagtatggggatcatgggtaatcgcccccgtcaaactcatgtttgccattataaagaaactcatgagatccgtctcatgccttatgggtaaactcatggaccgcgggcgacaagtgatccacgaagaaataggagaaaaccgcgagggaaaccaggacgacgtcaggatcgaaatggtgcgacccagacgagtcagacactggatgtacagccctgtcatactaaccatcctggctatcggactgactgaagggtgcgatgagatggtccacgcagacagtaaactggtctcctgtaggcaaggaagtgggaacatgaaagaatgcgtcaccacaggcagggcgttgctcccagcggtgaaccctggccaggaagcgtgccttcacttcacagcccccggaagccccgactccaaatgcctcaaagtaaaagtaaaacgaatcaacctgaaatgcaagaaaagcagttcatacttcgtcccagacgcccgctcaagatgcaccagcgtacgccggtgcagatgggcaggagactgccagagcggctgcccatcccactttacgtccaattcattctcagacgactgggcggggaaaatggaccgagccggcctcgggttctcaggctgcagcgacggctgtggaggggccgcctgcggctgttttaacgctgcacccagctgcattttctggagaaaatgggtagagaacccgcacggcattatatggaaagtctctccatgcgccgcctgggtgccctcggccgtaattgaactcacaatgccaagcggcgaggtacgcacgttccaccccatgtcaggcatcccgacccaagtttttaaaggagtctccgtaacctacctcggttccgacatggaagtatccggcctcacagatctctgtgaaatcgaagaactaaaaagcaaaaagctagccctcgcgccctgcaaccaggcaggcatgggggtagtaggcaaagtcggggaaatacagtgcagttccgaagaatccgcaagaactattaagaaagacggctgtatctggaacgccgacttagtcgggattgaactccgcgtagatgacgccgtctgttattctaaaatcacatccgttgaggcagtggcaaactactcagcaatacctaccaccatcggcggactccgattcgaacgctcacacgacagccaggggaaaatatcgggctcgcccttagacataaccgccatccggggtagcttcagcgtgaattatcgaggactgagacttagcctgagcgagatcacggcgacgtgcacaggagaggtcacaaacgtctccggatgctactcctgcatgaccggcgcaaaagtcagtatcaaactgcactcaagcaaaaacagcacagcacacgtacgctgcaaaggtgacgaaacagccttcagcgttttggaaggagtccactcatacaccgtctcactcagtttcgaccacgcagtagtagacgagcaatgccagctaaactgcggcggacacgaatcgcaagtgaccctcaaaggaaatctcatcttcctcgacgttccaaaattcgtagacggatcgtacatgcaaacgtaccacagctcagtaccaaccggagccaacatccccagcccaaccgattggttaaacgcactcttcggcaatggtctatcacgatggatcctcggcgtcatcggagtactgctgggcggactcgccctcttctttctcatcatgtccctgttcaaactcgggaccaaacaagtatttaggtcgagaacaaaactagcctag

SEQ ID NO: 16458 - RNA, 3222 nt, synthetic construct
  misc_feature 1..3222: note = derived and/or modified CDS sequence (opt11) from SFTSV(ZJZHSH-LU/China/10/2011)__KR017850.1__GP
  source 1..3222: mol_type = other RNA
atgatgaaagtgatatggttcagcagcctaatctgcttagtgatccaatgcagcggagacacgggacccataatctgcgccggaccaatccactccaacaaatcagctaacatcccgcatctcctcggctactcagaaaagatatgccaaatagaccgcctcatacacgtaagctcgtggctaagaaaccacagccaattccaaggatacgttggccaacgcggcggccgctcccaagtatcatactacccagcggaaaactcttacagtcgatggtccgggctgctttcaccctgcgatgcagactggttagggatgctagtcgtgaagaaagccaaagggagcgacatgatagtacccgggccctcgtacaaaggaaaagtattcttcgaacgaccaacattcgacgggtatgtcggctggggctgcggctccggcaaaagtagaaccgagagcggggaactctgcagcagcgactccggcacctcaagcggcctcctaccaagcgaccgcgttctatggataggagacgtagcctgccaacccatgacaccaatcccagaagaaaccttccttgaactcaagagcttctcacaaagcgaatttcccgacatgtgcaaaatagacggaatagtcttcaaccaatgcgagagcgagagcttaccacagcccttcgacgtagcctggatggacgtcggccacagccataaaataatcatgagggaacacaaaacaaaatgggtacaagaatcgtccagcaaagacttcgtatgctacaaagaaggtacaggaccttgcagcgaaagcgaagagaaaacatgcaaaacctccggctcctgccgaggcgatatgcagttctgtaaagtcgccggatgcgaacacggggaagaggcttcggaagcgaaatgcagatgctcgctagtgcacaaacccggggaagtcgtcgtctcatacggcggaatgcgcgttcgacccaagtgctacggattcagtagaatgatggccacactcgaagtaaacccaccggaacaaagaataggacaatgcaccgggtgccacctagaatgtataaacggaggcgtacgactcgtaacgctcacaagcgaactaaaatcggcaacagtctgcgctagccacttctgcagctccgccacatcgggaaagaaaagcacagaaatacaatttcatagcggatcgctcgtcggcaaagccgcaatacacgtcaaaggcgctttggtagacggcacagagttcacatttgaaggaagctgcatgttcccagacggctgcgacgccgtcgattgcaccttctgccgggagttcctcaaaaacccccagtgttacccagccaagaaatggctgttcatcattatcgtaatactcctcggatacgccggcctaatgcttctcaccaatgtgcttaaagcaatcggcgtctggggcagctgggtcatcgccccagtcaaactgatgttcgcaatcattaagaaactgatgcgatccgtctcgtgcctcatgggtaaactgatggaccgaggccgccaagtaatacacgaagagatcggagaaaaccgagaaggaaatcaggacgatgtccgaatagagatggtgcgtccccgccgagtacgacattggatgtattcacccgtgatacttaccatactggcgataggactcaccgagggctgcgatgaaatggtacacgcagacagcaaactggtctcctgcaggcaaggcagcgggaacatgaaagaatgcgtcacaaccggcagagccctactaccagcagtgaacccgggacaagaagcatgcctgcacttcacggcacccggatcacccgatagcaaatgcctcaaaataaaagtgaaaaggataaacctcaaatgcaagaaatccagttcctacttcgtaccggacgcacgatcccggtgcacgagtgtaagacgctgtcgatgggccggcgactgccaatctggttgcccgtcacacttcacaagcaacagcttctcagacgactgggccgggaaaatggaccgcgcagggctaggattcagcggctgcagcgacggatgtggaggggccgcctgcggctgcttcaatgcagcaccaagctgcatattctggcgaaaatgggtagaaaacccacacggcattatctggaaagtctcgccatgtgcagcctgggtacccagtgccgtaatagaactaacgatgccgagcggcgaggtccgcactttccaccccatgagcgggataccgacacaagtattcaaaggggtatccgtcacatacctaggatcggacatggaagtaagcggcctaactgacctctgcgagatcgaagaactgaaatcaaagaaactcgccctcgccccctgcaaccaagcaggaatgggggtggtcggcaaagtcggcgaaatccaatgcagcagcgaggaatccgcccgtacgatcaagaaagacggatgcatctggaatgcggaccttgtcgggatcgagctacgagtcgatgatgcggtctgctactcaaaaatcacgtccgtagaggccgtagcaaactactcagcaattcccacaacaataggcggactccgattcgagcgctcgcacgacagccaagggaaaatctcgggatccccactagacataaccgcgatacgaggatccttctcggtcaactaccgcgggctaagactgtcattgagtgaaatcaccgctacatgcactggagaagtaaccaacgtgagtggttgctacagctgcatgacgggcgcgaaagtaagtataaagctccactcatccaagaactccaccgcacacgtaagatgcaaaggcgacgaaacagcgttttccgtactagagggggtccactcctacacggtatccttatccttcgaccacgcagtcgtagacgagcaatgtcagctcaactgcgggggccacgaaagccaggtaactctgaagggcaacctcattttcttagacgttccaaaattcgtagacggatcatacatgcaaacataccacagctcagtccccacgggagcgaacataccgagcccgacggactggctgaacgcactattcggaaacgggctgagccgatggatactaggagtcatcggcgtgctcctcgggggactagcattattcttcctaataatgagcctattcaaactcggaaccaaacaagtcttcagaagccgcaccaaactcgcataa

SEQ ID NO: 16459 - RNA, 3222 nt, synthetic construct
  misc_feature 1..3222: note = derived and/or modified CDS sequence (opt11) from SFTSV(ZJZHSH-SHZ/China/05/2012)__KR017848.1__GP
  source 1..3222: mol_type = other RNA
atgatgaaagtcatatggttctccagtctaatctgcctagtaatacaatgcagcggggacacaggccccataatatgtgcaggacctatacacagcaacaagagcgccaacatcccgcacctactcggatacagcgaaaagatatgtcagatagaccggctaatccacgtgtccagctggctacgcaaccactcccaattccaaggatatgtagggcagcgcgggggcaggtcacaggtatcatactacccggcagaaaactcatactcaagatggtcgggtctactatcaccatgcgacgccgactggctggggatgctggtcgtaaagaaggcaaaaggctcagacatgatcgtaccgggcccatcctacaaggggaaagtatttttcgaaaggcccacgttcgacggctacgtcggctgggggtgcggctccggcaaaagtagaacagaatccggagaactatgctccagcgattcgggaacgtcgtccgggctactcccctccgaccgagtactctggataggcgatgtcgcctgtcagcccatgacaccgatacccgaggaaacgttcctagaactcaagagcttctcccaaagcgagttcccggacatatgcaagatagacggcatcgtcttcaaccaatgcgaaagcgaatcactcccgcaaccattcgacgtagcatggatggacgtcggacactcccacaaaatcataatgagggaacacaaaacaaaatgggtccaagaaagcagctccaaagacttcgtatgctataaagagggcacaggaccttgctcagagagcgaagaaaagacatgcaaaacatcaggcagctgtaggggcgacatgcaattctgcaaagtagctggctgtgaacacggcgaagaggcaagcgaagcaaaatgccgctgtagcctcgtacacaaacccggggaggtcgtggtatcctatgggggcatgcgggttagaccgaaatgctacggattttcaagaatgatggcaacgctcgaagtcaatccgccagaacagcgaatagggcagtgtaccggctgtcatctagagtgcatcaacggaggcgtgcgcctggtcacactcaccagcgaactcaaaagcgcaacagtatgcgcgtcacacttttgcagtagcgccaccagcggcaagaaatccacagaaatacagttccacagcggctcgctcgtaggcaaagccgcgatccacgtcaaaggcgcacttgtcgacggaacagagttcaccttcgaaggcagctgcatgttcccagacggatgcgacgccgtcgattgcactttttgccgagagttcctcaaaaacccccaatgttaccctgcaaagaaatggctgttcataataatcgttattctcctcggatacgcaggcctaatgctactcacgaacgtactaaaagccataggcgtatggggtagttgggtcatagcacccgttaaactcatgttcgcgatcataaagaaactcatgagatcagtctcctgcttaatgggaaagctaatggaccgaggccgccaagtaatacacgaagaaatcggagaaaatagggaaggtaaccaagacgatgtacggatcgagatggtccgcccaagaagagtcagacactggatgtacagccccgtaatcctaaccatacttgcaatcggactcacagagggctgtgacgagatggtacatgcagactcgaaactggtaagctgcagacaaggcagcggcaatatgaaagaatgcgtaacaaccggcagagccctgctaccggcagtcaatccaggacaggaagcatgcctacacttcacagcacccggaagccctgacagtaaatgcctcaaaatcaaagtaaaacgcataaacctgaagtgcaaaaagtcatcgtcgtactttgtacccgacgcccggagccgatgtacctccgtgcgtcgctgtaggtgggccggcgactgccaaagtggatgcccctcacacttcactagcaacagcttcagcgacgactgggcagggaagatggaccgcgccgggctagggttctcgggatgctccgacggatgcggaggagccgcatgcggatgcttcaacgcagcgccttcatgcatcttctggagaaagtgggtggaaaacccccacgggatcatatggaaagtctcaccctgcgccgcctgggtcccgtccgcagtaatagagctcacaatgccatccggagaagtccgcacgttccatcccatgagcggaatccccacacaagtcttcaaaggggtatcagtcacctacctgggcagtgacatggaagtctcgggtctcacagacctctgcgaaatagaagaactaaaaagcaagaaactcgcactggcaccatgtaaccaagccggtatgggtgtagtgggaaaagtaggcgaaatacaatgcagctcagaggaatcggcaagaacaatcaaaaaggacggctgtatctggaacgcggacctagtcggcatcgaactaagggtcgacgacgccgtctgttacagcaagattaccagcgtagaagctgtagccaactactcagcaataccgaccaccatcggaggccttcgcttcgaacgatcccacgactcccagggaaaaataagcggctcacctctcgacatcaccgctataaggggctcattcagcgtcaactaccgcggactccgactctcactaagcgagatcacagcaacctgcacaggcgaagtcacaaacgtgagtggatgctactcctgcatgaccggagccaaagtcagtataaaactccacagcagcaaaaactcaacagcccacgtcagatgcaaaggcgacgaaacagccttctcagtactggagggagtccacggttacaccgtatcactcagtttcgaccacgcagttgtggacgagcaatgccaactcaactgcggcggccacgaatctcaagtgaccctaaaaggtaatctcatcttccttgacgtaccaaaatttgttgacggctcttacatgcaaacctaccacagctcggtacccacaggagcaaatataccctcaccgacagattggctaaacgcactattcggaaacggactcagccgctggatattaggcgtgatcggcgtcttactcgggggactagcattattctttctgatcatgtcactattcaaactgggaaccaaacaagtcttcaggtcgagaacaaaactagcataa

SEQ ID NO: 16460 - RNA, 3222 nt, synthetic construct
  misc_feature 1..3222: note = derived and/or modified CDS sequence (opt11) from SFTSV(ZJZHSH-WSH/China/08/2012)__KR017854.1__GP
  source 1..3222: mol_type = other RNA
atgatgaaggtcatttggttcagctccctaatatgcctcgtcatacaatgcggtggcgatacagggcccataatctgcgcaggccccatacacagcaacaaaagcgccggcataccccacctactcggctacagcgagaaaatatgtcaaatagacaggctaatacacgtatcctcctggctccgcaaccactcgcagttccagggatacgtagggcagcgaggaggtcgcagccaggtgagctactacccagcagaaaacagctattctaggtggagcggcttactctcgccatgcgacgcggactggctgggaatgctagtcgtcaagaaagcaaaggggtcagacatgatcgtgccagggccaagctacaaaggaaaggtcttcttcgaacgaccaacatttgacgggtacgtaggctgggggtgcggctcaggtaaaagcagaaccgaatccggtgaactatgctcaagcgacagcgggacctccagcggcctcctgccatcagacagggtattatggattggagacgtagcatgccaaccaatgacaccgataccggaagaaacattcctcgaactcaaatcattctcccaaagcgagttcccggacgtctgcaaaatcgacggaatagtgttcaatcaatgcgaaggagaatccttaccccaaccctttgacgtagcctggatggacgtcggccactcacacaagataataatgcgggaacacaaaaccaaatgggtccaagaatcctcctctaaagacttcgtgtgctacaaagagggaactggcccatgctcggaaagtgaagagaaaacatgcaagacttccggatcatgtaggggcgacatgcaattttgcaaagtggcagggtgcgaacacggagaagaggcatcagaagcgaaatgcagatgctccctagtccagaaacccggcgaagtagtggtctcgtacggaggcatgcgcgtccgcccaaaatgctacggattctcgagaatgatggcgaccctggaagtgaacccacccgaacaacgcataggccaatgtacaggctgccaccttgaatgcatcaacgggggagtccgcctaataacactgacaagcgagctcaagagcgcaaccgtatgcgcaagccacttctgcagcagcgcaacctcagggaagaagagtacggaaatacaattccactcaggcagcctagtgggaaagacagccatccacgtcaagggagccctagtggatggcacagagttcacattcgaaggatcatgcatgttccccgacggatgcgacgcagtagattgcacattttgcagagagttcctgaaaaacccgcaatgctacccggcaaagaaatggctattcataattatcgtaatactactaggctacgcaggactgatgctactaaccaacgtcctcaaagccataggtgtgtgggggtcatgggtaatcgccccagtaaaactaatgttcgcgattatgaagaaactcatgaggtcagtaagctgcctaatgggcaagctaatggaccgcggccggcaggtaatacacgaagaaataggcgaaaatcgagaggggaaccaagacgacgtacgaatcgaaatggttcgaccaagacgagtgcggcactggatgtacagcccagtcatactcacgatactagcgatcggcctaacagaaggatgcgatgaaatggtacacgcggacagcaagctagtgtcgtgccggcaaggcagcggaaacatgaaggaatgtgtaactaccgggcgtgccctactccccgctgtaaacccaggacaagaagcgtgcctgcacttcacagcgcccggatcaccagacagcaaatgcctgaaaatcaaagtcaagcgcatcaacctcaaatgcaagaaaagcagcagctatttcgtacctgacgcaaggtcaagatgcacaagcgttaggcgctgccgatgggcgggcgactgccaaagcggctgtccgccacacttcacatcgaacagcttttcagatgactgggcaggaaaaatggaccgagccggactgggattctcagggtgctctgacgggtgcggaggggccgcgtgcggatgcttcaacgcagcgccgagctgtatcttctggagaaaatgggttgagaacccgcacggaataatatggaaagtctccccatgcgccgcctgggtgccctcggccgtaatagagctcaccatgccctctggcgaagtacggacgttccatcccatgagcggcataccaacacaggtattcaaaggagtctcagtgacatacctaggcagtgatatggaagtcagcggcctcacggacctctgcgagattgaggaactgaaatcgaagaaactcgcactagcaccgtgtaaccaagctggaatgggcgtcgtcggaaaagtcggcgagatacaatgctccagtgaagaatcggccagaacgatcaagaaagacgggtgcatatggaacgcggacctggtcggcattgaattaagagtagatgacgcggtctgctactcaaaaataacatcagtcgaagcagtcgccaactactcggcaattcccacgacaataggcgggctcaggttcgagcgcagccacgacagccagggaaaaatctccggatcgccccttgacatcacagcaatcagaggatcgtttagcgtcaattaccggggactacgtctgagcctatccgaaatcacagccacatgcaccggcgaggtaaccaacgtcagcggctgctatagctgcatgacaggagccaaagtaagcataaaactccactctagcaaaaacagtaccgcgcacgtgcggtgcaaaggggacgaaacagcgttctcagtattggagggcgtacactcgtacagcgtaagcctgagctttgatcacgcggtagtagacgaacaatgccagctaaactgcggcggacacgaatctcaagtgaccctaagaggcaacctaatcttcctagacgtccccaaatttgtggacggtagctacatgcaaacctaccactcaacagtccccaccggcgccaacataccatccccaacagattggctaaacgcgttatttgggaacggcctaagccggtggatcctaggggtcataggcgtactgctaggcgggctagcgctgttcttcctgatcatgagtctgttcaaactaggcacaaagcaagtcttccggtcacgtactaaactagcataa

SEQ ID NO: 16461 - RNA, 3222 nt, synthetic construct
  misc_feature 1..3222: note = derived and/or modified CDS sequence (opt11) from SFTSV(ZJZHSH-XAM/China/06/2012)__KR017853.1__GP
  source 1..3222: mol_type = other RNA
atgatgaaggtaatatggttctcatcactcatatgtcttgtcattcaatgcagcggagacacgggcccgataatctgcgccggtccgatacacagcaacaagagcgcaaacatcccgcacctcctaggatattccgagaaaatctgccagatcgaccgcctcatacacgtatccagctggttacgcaaccactcacaattccaaggctacgtcgggcaacgtggcggccgaagccaagtctcctactacccagcagaaaatagctactcacgctggtctggtctcctgagcccttgcgacgccgattggctcggcatgttggttgtgaagaaagcaaaaggatcggacatgatagtaccagggcccagctacaagggtaaagtcttcttcgaacgcccgaccttcgacggctacgtgggctggggctgcggctccggcaagtcccgaaccgaatcgggggaactgtgctcatccgactccggaacatccagcggactgctaccctcagacagggttctgtggattggcgacgtcgcctgccaacccatgaccccgataccagaagagacctttcttgaactaaaatccttttcccaaagcgaatttcccgacatatgcaaaatcgacgggatagtcttcaaccagtgcgaaagcgaaagcctaccccaaccgttcgacgtagcctggatggacgttggccacagccacaaaattataatgcgcgaacacaaaaccaaatgggtacaagaatcatcatccaaagacttcgtctgctacaaggaaggtacaggcccctgctcggagtccgaagagaaaacgtgcaagacgtcaggttcatgcagaggcgacatgcagttctgcaaagtagcaggatgcgaacacggagaagaagcctcagaagcgaaatgccgctgctccttggttcataaacccggagaagtggtagtatcctacgggggtatgagagtgcgaccaaaatgttacgggttctcccgcatgatggccaccctagaagtaaatcccccagaacaacgcatcggacagtgtacaggatgccacctcgaatgcatcaatggcggagtacgactcgtaacgctcacatctgaactaaaatcggccacagtatgcgcgagccacttctgcagctcggcaacatccggaaagaaatccacagaaatccagtttcacagcggctcattagtcggcaaagccgcaatccacgtaaaaggggcactcgtagacggaactgagttcacgttcgaaggatcctgtatgttccctgacggatgcgacgcagtggactgcaccttttgccgggagttcctcaaaaacccccagtgttatccggccaaaaagtggctattcatcatcattgtgatcctcctcggatacgcgggactaatgctactaacaaacgtactcaaagccataggagtatggggtagctgggtaatagcacccgtcaagctcgtgttcgccataatcaaaaagctcatgcgcgcagtctcttgcctgatgggaaaactaatggacagagggcgccaagtcatacacgaggagataggcgaaaacagggaaggcaaccaagacgacgtccggatcgagatggcaagaccacgacgtgtaagacactggatgtacagcccagtgatcctaaccatattggccatcggactcgcagagggttgcgacgaaatggtccacgcggactcaaaactcgtttcgtgcagacaaggcagcggcaacatgaaagaatgtgtcaccacaggccgcgcactactcccggctgtaaatcccggccaagaggcctgcctacacttcacggcaccaggatcgcccgactcaaaatgcctcaagatcaaggtcaagcgaatcaacctaaaatgtaagaaaagctcgagttactttgtcccagacgcacggtcacgatgtacatccgtgcgacggtgcagatgggcaggcgattgccaatccggatgccccagccacttcacatctaacagcttcagcgacgactgggcagggaaaatggaccgcgccggactagggttcagcggctgcagcgacggctgcggcggagcagcctgcggatgcttcaatgcagccccaagctgcatcttctggagaaaatgggtcgaaaacccgcacggtatcatatggaaagtctcaccctgcgccgcatgggtgccctcagccgtcatcgagctcaccatgcccagcggcgaagtacgcacattccacccaatgtccggcataccaacccaagtcttcaagggggtgagcgtcacgtacctgggctccgacatggaagtgagcggactcacagatctgtgcgaaatcgaagaactaaaatccaagaaactcgcgctcgccccgtgcaatcaagcaggaatgggcgtcgttggaaaagttggagaaatccaatgcagcagcgaggaaagcgcaagaacgatcaaaaaggacggctgcatctggaacgcggacctcgtcgggatcgagctcagggtagacgacgcggtatgttactcaaagatcacatccgtagaggctgtagccaattacagtgcaatccccacgacaatcggcggcctaagattcgaacgctcgcacgacagccaaggcaaaatttcgggatcacccctcgacataacagcgatcagaggttccttttcagtcaactacagaggcctacgtctgagcctgagcgaaataaccgcgacctgcaccggcgaagtaacaaacgtctctggctgttactcctgcatgaccggggccaaagtatccatcaaactccattcaagcaaaaactcaaccgcccatgtacgatgcaagggagacgaaaccgcattctcggttcttgagggagtgcatagctacaccgtcagcctgagcttcgaccacgcagtggtagacgaacaatgccaactaaattgcgggggccacgaatcacaagttacactcaaaggaaacctgatcttcctcgacgtcccgaaattcgtggacggatcatacatgcaaacatatcacagcagcgtcccgaccggcgccaacattccgagccccaccgactggctcaacgcactattcggcaacggactttcgagatggatacttggagtaataggggtactcttgggcgggctcgcactcttctttctcataatgagtctcttcaagctcggaaccaaacaagtatttcggagccgtacgaagctcgcttaa

SEQ ID NO: 16462 - RNA, 3222 nt, synthetic construct
  misc_feature 1..3222: note = derived and/or modified CDS sequence (opt11) from SFTSV(ZJZHSH-YJX/China/06/2012)__KR017860.1__GP
  source 1..3222: mol_type = other RNA
atgatgaaggtcatttggttcagcagcctaatatgcctcgtcatacagtgcagtggagacacgggaccaatcatctgcgcaggaccaatccactccaacaaatcagcaaacatcccgcacctattagggtattccgaaaagatctgccagatagacagactaatacatgtgtccagctggctgcgcaaccactcacagttccaaggctacgtaggccaacgcggcggacggagccaagtctcatactaccccgcggaaaacagctacagcagatggtccggactcctctcaccatgcgacgcagactggctaggtatgctggtagtgaaaaaggccaaaggctcagacatgatcgtaccagggccgtcatacaagggaaaagtgttctttgaacgtccaacattcgacgggtacgtcggatggggctgtggttctggaaaatcacggacagagtcaggtgaactatgctcatcagacagcggaacatcaagcggactccttccctcagatcgagtactatggattggggacgtagcttgccaaccaatgacgccaatccccgaagaaaccttccttgaactaaagagcttcagccagagcgaatttccggacatatgtaaaattgacggcatcgtcttcaaccaatgcgaaagcgagagcttgccgcaacccttcgacgtcgcctggatggacgtcgggcactcgcacaagatcataatgcgcgaacacaagacaaaatgggtccaggaatcatcctcaaaagactttgtctgctacaaagaaggaacaggcccttgctccgaatccgaggagaaaacgtgtaaaacctcgggaagctgtcgaggggacatgcaattctgcaaagtagcggggtgcgaacacggagaagaagcctcagacgccaagtgccgctgctccttagtacacaaaccgggtgaggttgtggtctcatatgggggcatgcgagtccgccccaaatgctacggattctcacgtatgatggccaccctcgaagtcaacccgcctgagcagaggatcggccagtgcacaggatgccacctcgaatgcatcaacgggggcgtgagactcatcaccctcacgagtgaattaaggtcagccacagtatgtgcaagccacttctgctcctcagccacaagcgggaagaaaagtacggaaatacaattccactcaggctcactcgttggcaagaccacaatacacgtgaagggcgcgctggtcgacggcaccgagttcacgtttgaaggatcctgcatgttcccagacggttgcgatgccgtagactgcactttttgccgagaatttcttaagaacccgcagtgctaccctgcgaagaaatggctctttataataatcgtaatcctactcggatacgcaggcctgatgctactcaccaacgtacttaaggctatcggagtatggggcagctgggtcatagcacccgtcaagctcatgttcgcgatcataaagaaactcatgcgatcggtatcttgcctaatgggaaaactcatggacagaggccgacaagtaatacacgaggagatcggggaaaaccgagaaggaaaccaggacgatgtcaggatcgaaatggcacgcccccgcagagtacgccactggatgtactccccggtcatcctcaccatactagcaataggcctagcagaaggctgcgacgagatggtacacgcagactcgaagctagtatcatgcaaacaagccagcgggaacatgaaagaatgcgtgaccacaggacgagcactgctaccagccgtaaacccggggcaagaagcatgcctgcactttaccgcgcccggatccccggactccaaatgtctcaagattaaagtcaagcgcataaatctgaaatgcaagaaaagcagtagctacttcgtcctcgacgcaaggagccggtgtacgtcggtgagacgatgccgatgggcgggtgactgccagagcggctgcccaagccactttacatctaactcgttcagcgacgactgggccggaaagatggacagagccggcctcggattctccggatgcagcgatggctgcggcggcgccgcctgcggatgcttcaacgcggccccgagctgcatcttctggcgcaaatgggtcgagaacccgcacggcatcatctggaaagtatcaccctgcgccgcgtgggtaccctccgccgtaatagagctaacgatgccctctggagaggtacggaccttccaccccatgagtggaatacccacccaggtattcaaaggggtctcggtcacgtacctcggatcagacatggaggtaagcggcctaaccgacctgtgtgagatcgaagaattgaagtcaaagaaactagccctagcgccctgcaaccaagccggaatgggggtcgtaggtaaagtcggggaaatccaatgtagcagcgaggaaagcgcgcgtacaataaagaaagatggctgcatatggaacgccgacctagtaggcattgaacttagagtagacgacgcagtttgctattccaaaataacctccgtcgaagcagtcgccaactacagcgccataccaacgacaataggcgggctaaggttcgaaagaagtcacgacagccagggcaagataagcggcagcccactcgacatcacagccatcagaggctcattcagtgtaaattaccgaggcttacgcttaagcctgagcgaagtcacggcaacatgcaccggcgaagtcacaaacgtatcagggtgctattcatgcatgacgggagcaaaagtcagcatcaaactgcactcgagcaaaaattccacagcacacgtaagatgcaaaggggatgaaaccgccttcagcgttctagaaggggtccacagttacaccgtgagcctgtcattcgaccatgcggtcgtcgacgaacagtgccaactcaactgcgggggtcatgagtcccaagtcaccctaaagggaaacctcatattcctcgacgtaccaaagttcgttgacggatcgtacatgcaaacctaccactcatcagtcttaaccggggcaaacatacccagccctacggattggctcaacgcactgttcggcaacggcttaagcaaatggatcctaggcgtcattggagtcctcctcggagggctcgcgcttttcttcttaatcatgagcctgttcaaattaggcacaaaacagatattccgatcgagaactaagctagcatag

SEQ ID NO: 16463 - RNA, 3222 nt, synthetic construct
  misc_feature 1..3222: note = derived and/or modified CDS sequence (opt11) from SFTSV(SPL003A)__AB817988.1__GP
  source 1..3222: mol_type = other RNA
atgatgaaggtgatctggttctcctccctcatatgtttagtcatacaatgcagcggcgacactggacccataatatgtgccggaccaatccacagtaacaaatccgcaaacataccccacctcctcgggtatagtgagaaaatctgccaaatagatcgactaatccacgtatcctcgtggctacgaaaccactcgcaattccagggatacgtgggtcaacgaggcggccgaagccaagtatcgtacttccccgcagaaaacagctacagcagatggtcgggcctactaagcccatgcgacgccgactggctaggcatgctggtggtcaagaaagccaaaggttcggacatgatcgtacccggccccagctacaaaggaaaagtcttcttcgaaaggccaacgttcgacggatacgtgggatggggctgcggcagcgggaaatcccgcaccgaatccggtgaactctgcagcagcgacagtggcaccagtagtggactattaccttcagacagagtactgtggatcggcgacgtcgcgtgccaacccatgacccccatccccgaagaaaccttcctcgaactaaagagcttcagccagtcagagttcccagacatctgcaaaatagacggaatcgtattcaaccaatgcgaatccgaatcactaccccaacccttcgacgtggcatggatggacgtgggacacagccataaaatcatcatgagggaacataaaacgaaatgggtccaagaaagcagttcaaaggacttcgtatgctacaaagaaggaaccggcccctgttccgaaagcgaagagaaaacgtgcaaaacatccggaagctgcagaggggacatgcaattctgcaaggtggcaggatgcgaacacggagaggaagcctcagaagcgaaatgtaggtgctcattagtacataaaccgggagaagtcgtcgtaagctacggcggaatgagggtgcggcccaaatgctacggcttctcgagaatgatggcaactctcgaagtcaactctcccgagcaaaggatcggccaatgcaccggttgccacctagaatgcataaatggaggggtgcgactgataacgttaacctcagaactcaaaagcgcgaccgtctgcgccagccacttctgttcaagtgccacaagcggaaagaaatcaacagaaatacaatttcactccggatccctcgtaggaaaaacagcgatccatgtcaaaggcgcactcgtcgacggtaccgagttcaccttcgaaggcagctgtatgttcccagacggctgcgacgcagtggactgcacattctgtcgcgagttcctcaaaaacccgcaatgctaccctgccaagaaatggcttttcataatcatagtcatcctcctcggatacgccggactcatgttactcacaaacgtactaaaagcaataggggtatggggaagctgggtcatcgcgccggtcaaactaatgttcgcaatcatcaagaaactcatgagatccgtctcgtgcctaatggggaaactaatggatcgggggcggcaggttatccatgaagaaataggcgagaaccgcgaagggaaccaagacgacgtaagaatagaaatggcacggccacgacgagtcaggcactggatgtactccccagtgattctaacgatcctcgccataggactagccgaaggatgcgacgagatggtccacgcggacagcaaactggtttcatgcaaacagggaagcggcaatatgaaggaatgcgtaacaacgggccgggccctgctacccgcggtcaacccaggacaagaagcatgcctgcactttacagcaccaggatcccccgacagcaaatgcctaaaaatcaaagtgaagcgaatcaacctaaaatgcaaaaagagcagctcctacttcgtaccagacgcccgtagccgatgcacgtcagtgagaagatgtcgctgggcaggagactgccaatccggttgcccaagccattttacgagcaactcattcagcgacgactgggctgggaaaatggaccgcgcaggactaggcttcagcggctgcagcgacggctgcggaggagcagcctgcggctgcttcaacgcagccccatcttgcatcttctggcgaaaatgggtagaaaacccacacggaatcatttggaaagtttccccctgcgccgcctgggtcccctcagccgtcattgaactcaccatgccgtccggagaagtgcgcacgttccacccgatgagcggaatcccaacgcaagtcttcaagggagtcagcgtaacctacctaggaagcgacatggaagtgagcggactaacggacctatgcgagatcgaagaactgaaatcaaagaaactagcgctggctccatgcaatcaagcgggaatgggcgtcgtcggcaaagtcggcgagatacaatgctcctcagaagaatcagcacgaacaatcaagaaagatggctgcatatggaacgccgacctagtcggaatcgaattaagggtcgacgacgcggtctgctacagcaaaatcacctccgtagaggcagtcgcgaactactcagcaatcccgactaccatcggaggactaaggttcgaaagatcgcacgactcacaaggcaaaatttcgggatccccgctagacatcacagccataagaggcagcttctcggtgaactaccgcggattaagactcagccttagcgaaatcacagcaacctgcaccggcgaagttaccaacgtcagcggatgctactcctgcatgacaggagcacgggtaagcataaaactacactcgagcaagaactcgactgcacacgtaagatgcaagggggacgaaaccgcattcagcgttttagaaggagtacactcctacacagttagtctctccttcgaccacgcagtcgtagacgagcagtgccaacttaattgcggaggccatgaatcacaagtgactctaaaaggaaacctaattttcctagatgtaccaaagtttgtagacggctcatacatgcaaacataccacagcagcgtcccaactggcgcgaacatccccagcccgacagactggctaaacgccctcttcggaaacggcctgtcacgctggatactgggcgtaatcggagttctcctcggagggctagcgcttttcttcttgatcatgtccctttttaaacttggcaccaagcaagtatttcgatcaaggacaaagttagcctaa

SEQ ID NO: 16464 - RNA, 3222 nt, synthetic construct
  misc_feature 1..3222: note = derived and/or modified CDS sequence (opt11) from SFTSV(SPL004A)__AB817989.1__GP
  source 1..3222: mol_type = other RNA
atgatgaaagtgatctggttctcctccttaatatgtttggtcatacaatgcagcggcgacaccggcccgatcatctgcgcaggtccgatccacagcaacaaaagcgcaaatataccacacctcctaggctacagcgagaaaatctgccaaatagaccgactgatccacgtatcctcatggctccgaaatcacagccaatttcaagggtacgtgggacaacgaggcggaaggtcgcaagtaagttactatccagcagagaacagttacagccgctggtctgggttactcagcccgtgcgacgcggactggctagggatgctagttgtgaagaaagcgaaaggatcggacatgatagttcccggcccatcatacaaagggaaggtcttcttcgagcgtcccacctttgacggatacgtcggctggggatgcggctcaggcaaatccaggacggaaagcggcgaactatgtagctccgatagcggcaccagttcggggctcctaccgagcgaccgcgtactctggataggggacgtcgcatgccaacccatgacaccaatcccggaagaaaccttcctcgaactaaagagcttcagccagagcgagttcccggacatatgcaaaatcgacgggatagtcttcaatcagtgcgaaagcgaaagcctgccacaaccattcgatgtggcctggatggacgtcggacactcccataaaatcatcatgagggaacacaaaaccaagtgggtccaagagagcagcagcaaagacttcgtatgctacaaagaaggaacaggtccatgcagtgagtccgaagagaaaacatgcaaaacatcaggatcctgcaggggtgacatgcagttctgcaaagtcgcagggtgtgaacacggagaggaagcctccgaggcgaaatgtcgctgtagcctagtacacaaacccggagaggtagtagtatcatacggaggaatgagggtgcgccccaaatgctatggcttcagcagaatgatggcgaccctcgaagtaaacccgccagagcaaaggataggccaatgcacaggatgccacctcgagtgcatctcagggggtgtacgcttaataactttaacgtcagaactaaaaagcgccaccgtatgcgcatcccatttctgcagctcagcgacaagtgggaagaaaagcacagaaatccaattccacagtggcagcctagtgggcaaagctgccatccacgtcaaaggcgccctcgtggacggcaccgagttcacgttcgaaggatcctgcatgttcccagacgggtgtgacgccgtagattgcaccttctgccgggaatttctcaaaaacccacaatgctaccctgccaaaaagtggctattcatcatcatcgtcatcctgctaggctatgctggtctcatgctactcacaaacgtcctcaaagccataggcgtatgggggagctgggtcattgccccagtgaaactgatgtttgcaatcatgaagaaactcatgcgaagcgtaagctgcctgatggggaaactaatggacagaggacgccaggtgatacacgaggaaataggcgaaaaccgggaaggcaaccaagacgacgtccggatcgaaatggcccgaccacggcgagtgcggcactggatgtacagcccagtcatcctcaccatcctcgcaataggactagcggaaggatgcgacgagatggtgcacgccgactcgaagctcgtatcatgcagacagggaagcggaaatatgaaagaatgcgtcacaactggcagggctctgctcccggcagtaaacccgggccaagaagcctgcctccacttcacggcgcccgggagcccagactcgaaatgcctcaagataaaggtcaaacgcatcaacttaaaatgcaaaaagagctcgagctacttcgtaccagatgcaaggagcagatgtacaagcgtgcgccgatgccgatgggcaggggactgccaaagcgggtgccccagccacttcacctctaacagttttagcgatgactgggcaggaaaaatggaccgggcaggactggggttcagcggatgctccgacggctgtggcggagcagcatgtggatgtttcaacgccgccccgagctgcatcttctggcggaagtgggtcgaaaacccgcacggcataatatggaaagtgagcccctgcgccgcgtgggtcccctcggcggttatagagctaacaatgccctcgggagaagtacgcacattccacccaatgtccggtatacccacccaggtcttcaaaggcgtctcggtgacctaccttggcagtgacatggaggtgagcggcctcaccgatctatgcgaaatcgaggaactcaaaagcaagaaactagctctagccccatgtaaccaggcgggaatgggggtcgtaggaaaagtaggggaaattcaatgctcatccgaagagtctgcacggaccataaagaaagacggttgcatatggaacgcagacctagttggaatagaactcagagtcgacgacgccgtctgttatagcaaaatcacatcggtagaagctgtcgccaactactcagccatacccacaaccataggcgggctaagattcgaacggtcgcacgattcacaaggcaaaattagcggctctcccttggacataacagccatcagaggctcattctccgtcaattacagaggcctccgcctgagcctctccgaaatcacagcaacctgcacgggggaagtcaccaacgtaagcggctgctacagctgcatgacgggagccaaagtcagtatcaaactccactcaagtaaaaactccacagcacacgtgcgatgcaaagaagacgaaacggcattttcagtcctcgaaggcgtccacagctacacggtaagcctcagcttcgaccacgcagtcgtcgacgaacaatgccagctaaactgcggaggccacgaaagccacgtgacactaaaaggaaacctcatctttttagatgtccccaaattcgtagacgggtcctatatgcaaacctaccactcctcagtaccgacaggagccaacataccgagcccaacagactggttaaacgccctgttcggaaacggactaagccgatggatcctcggagtcatgggagtgctactaggagggctagcgttatttttccttatcatgtccctattcaaactagggactaaacaagtgtttaggtctcggaccaaactcgcctaa

SEQ ID NO: 16465 - RNA, 3222 nt, synthetic construct
  misc_feature 1..3222: note = derived and/or modified CDS sequence (opt11) from SFTSV(SPL005A)__AB817990.1__GP
  source 1..3222: mol_type = other RNA
atgatgaaagtgatctggtttagtagtctaatatgcttagtaatacaatgcagcggagacgcaagcccaataatctgcgcgggtccgattcacagcaacaaatccgcaaacattccacacctactcggatacagcgagaaaatatgtcaaatcgacaggctaatacacgtaagctcatggctgcgcaaccactctcaatttcaaggctacgtggggcagcgcggcggcagaagccaggtttcgtacttccccgcagaaaacagctactcaaggtggagcggtctactgtcaccctgcgacgcagactggctagggatgctggtagttaaaaaggctaagggcagtgacatgatcgtccccggacccagctacaaaggaaaagtattcttcgaacgccccacattcgacgggtacgtgggctggggatgcggctccggaaaaagccgaacagaatctggggaactatgctcgagcgacagcggaacatcaagcggactcctcccatctgatcgagtcctatggatcggagacgtcgcatgccaaccgatgacaccaatcccagaggagaccttcttagaattaaagagctttagccagtcagagttccccgacatctgtaaaatcgacggaatagttttcaaccagtgcgaaagcgaaagcctcccacagcccttggacgtggcatggatggatgtcggccactcgcacaagatcataatgagagaacacaaaacaaaatgggtacaagaatccagctccaaagatttcgtatgctacaaagagggtacgggcccatgcagtgaatccgaagagaaaacatgcaagactagcgggagttgcagaggagacatgcagttctgtaaagtagcgggctgcgagcacggagaagaggcctcagaagctaaatgccgctgctccttggtccacaaaccaggagaggtcgtcgtctcatacgggggaatgcgcgtacgaccaaagtgctacggcttttcccgcatgatggcgaccctggaagtaaacccattggaacaaagaatcgggcaatgcacaggatgtcacctcgagtgtataaacggaggtgtccgcttaatcacactcaccagtgaactgaaatcagcgaccgtctgcgcgtcccacttctgttcgtcggcaacgagcggcaagaaaagcacagaaattcaatttcactccggctcacttgtaggaaaaacagccatccatgttaaaggagcgctcgtcgacgggaccgaatttacattcgaaggctcatgcatgttcccagacgggtgcgacgccgtggactgcaccttctgccgggagttcctcaaaaacccacaatgttacccagcaaagaaatggctattcataataatcgtcatcctactaggatacgccggcttgatgctactaaccaatgtcctcaaagccataggagtctggggaagctgggtaatagcccccgtcaaactcatgttcgccataataaagaaactcatgcgaagcgtctcatgcctaatgggaaaattaatggaccgcggcagacaagtaatacacgaagaaataggggaaaacagggaagggaaccaagatgacgtgaggatcgaaatggcgcgcccgcgcagggttcgacactggatgtacagcccggtcattctcacgatcctggcaatcggacttgcagaggggtgcgacgaaatggtacacgcagacagcaaattggtcagctgcaaacaagggggaggcaacatgaaagagtgcgtcacgacaggcagggccctactcccggccgtgaacccaggccaagaagcgtgtctgcacttcaccgcacccggatccccagattcgaaatgcctcaaaataaaagttaaacgtatcaacctcaaatgcaagaaaagctcaagctactttgtcccggacgcacgtagccgatgcacaagcgtcagaaggtgccgatgggccggcgactgccaatccgggtgcccgtcccacttcacaagcaactcatttagcgacgactgggcagggaaaatggaccgagccggtctcggattctctggatgctcagatggatgcggcggcgccgcatgcggctgcttcaacgcggccccgagttgtatattctggagaaagtgggtagaaaacccacacggaatcatctggaaggtctccccctgcgcagcatgggtaccaagcgccgtgatagaactaacaatgccctcaggagaagttaggaccttccacccaatgagcggaatacccacacaggtcttcaagggcgtatccgtaacgtacttaggctcggacatggaagtcagcgggctcacagacctgtgcgaaatcgaggaactcaaatctaagaaactcgccctagccccctgcaaccaggcaggcatgggagtggtgggaaaagtgggggagatccaatgctcctccgaagaaagcgcaaggacaatcaagaaagacggctgcatatggaacgctgacctcgtcggtatagaactgagagtggacgacgcagtctgctactcgaaaataacctccgtagaagccgtggcaaactactcagccatacccacgacaataggcgggcttcgcttcgaacgatcccacgacagccaaggcaaaatctcaggcagtcccctagacatcaccgcaataagaggctccttctcagtcaactacaggggcttacgcctttcattgagcgaaataacggctacctgcacgggcgaggtcacaaacgtaagcggctgctactcatgcatgacaggagcaaaagtatcgatcaaactacactcatccaaaaactccaccgcacacgtgcgctgtaagggggacgagaccgcgttctcggtcctagaaggagtccatagctacaccgtaagcctcagctttgaccacgccgtggtagacgagcaatgccagctaaactgcgggggccacgaatcacaagttaccctcaagggaaacctcatatttttagatgtccccaaattcgtcgacggaagttacatgcaaacgtaccacagctctgtaccaaccggggccaacatcccaagcccgaccgactggctcaatgcgctgttcggtaacggactaagccgatggatcctcggagtaatcggagttctcttgggcggactcgcactctttttcctcataatgtccctcttcaaactcggaactaaacaagtctttaggagcaggacgaaacttgcctga

SEQ ID NO: 16466 - RNA, 3222 nt, synthetic construct
  misc_feature 1..3222: note = derived and/or modified CDS sequence (opt11) from SFTSV(SPL010A)__AB817991.1__GP
  source 1..3222: mol_type = other RNA
atgatgaaagtcatctggttcagcagcctcatctgcttagtaatacagtgctcgggagacactggacccatcatatgcgcaggtccaatccattcaaacaaaagcgccaacattccccacttactcgggtactcagagaaaatttgccagatcgaccggctcatacacgtatccagctggctacgaaaccacagtcaattccaaggctacgtcggacagcgaggaggccgaagccaagtaagttacttcccagcagaaaacagctacagcagatggtcaggactcctgagcccctgcgatgcagactggctcggaatgctagtagtaaagaaagccaaagggtcagacatgatagtacccgggccaagctacaagggcaaggtattcttcgaacgacccaccttcgacggatacgtcggctggggatgcgggagcggcaaaagcaggactgagagcggagagctatgctccagcgacagcgggaccagcagcggcctcctaccgtcggacagggtcctatggatcggcgacgtcgcatgtcaacctatgaccccaatacccgaagaaactttcctggagctcaagagtttttcacagtccgagttcccagatatctgtaaaatcgacggcatcgtgttcaaccaatgcgaatccgaatcactaccacagcccttcgacgtggcatggatggacgtcggacacagccacaaaatcataatgagggaacacaaaaccaaatgggtgcaagaatcaagctccaaagacttcgtctgctacaaagagggcacaggtccgtgcagcgagagtgaagagaaaacgtgcaagacctcaggtagttgccgcggggatatgcagttctgcaaagtggcaggatgcgaacacggtgaagaggcctcagaagcaaaatgccgctgctcccttgtacacaaaccgggcgaagtagtggtctcctacggcggcatgcgcgtacgccccaaatgctacggattctccaggatgatggcaaccctggaagtgaacagcccagaacagcgaatcgggcaatgcacgggctgccatctcgaatgcatcaacggaggtgtccgcctcatcacgctcacgagcgaactaaagagtgcaacagtctgcgcctcacatttctgcagcagcgccaccagcggaaagaaatccacagaaatccagttccactcgggcagcctagtgggaaaaacggcgatccacgtaaaaggagcgttagtagacgggaccgagttcactttcgagggctcatgcatgttcccagacggctgcgacgccgtagactgtactttctgccgcgagttcctcaaaaatccgcaatgttacccggctaagaagtggctattcatcataatagtaatcctactaggctacgcgggactaatgctactcacaaacgtcctaaaagccatcggcgtatggggaagctgggtaatagcgccggtaaaactaatgttcgccataattaagaaactaatgcgctcggtctcatgcttgatggggaaactgatggacaggggccgccaagtcatacacgaggaaatcggtgagaaccgcgaaggcaaccaagacgacgtcaggatcgagatggcacgaccccgaagggtcagacactggatgtacagccccgtcatcctcacaatcctagctattggactggcagaaggttgtgacgaaatggtacacgcggattctaagctggtaagctgcaaacaagggagtgggaacatgaaagaatgcgttaccacaggccgagcgctactacccgcagtaaaccctggccaggaagcatgcctccacttcactgcgcccggatcaccggacagtaaatgcttgaaaatcaaagtcaaacgcataaatctaaaatgcaaaaagagttccagctatttcgtgccagatgcccgaagccggtgcacctccgtccgaagatgtaggtgggcgggagactgccaaagcggttgcccaagccacttcaccagcaacagcttctccgacgactgggcgggaaaaatggacagagcggggctagggttctccggctgctccgatggttgcggcggagccgcatgcggatgcttcaacgcagcgccaagctgcatcttctggagaaagtgggtcgagaacccgcacggaatcatctggaaagtctcaccatgcgccgcatgggtaccatctgccgtcattgaactcacgatgcctagtggagaggtacgcaccttccatccaatgagcggtatccctacccaagtcttcaaaggcgtatccgtgacgtacctgggcagcgacatggaagtatcgggtctaactgacctgtgcgaaatagaagaactgaaaagcaagaaactagccctggcaccgtgcaaccaagccggaatgggggtcgtaggcaaagtaggcgaaatacaatgctccagcgaagagagcgctcgaaccatcaagaaagacggctgcatatggaacgcggacctcgtcggcattgagctaagggtagacgacgcagtctgctactccaaaataacttcagtcgaagcagtggcgaattacagcgcaatacccacaacaataggagggctgagattcgagcgctcacacgacagccaagggaaaatatcgggatcgccactagacatcaccaccattcgaggatccttctctgttaactatagagggttgcgcttgagcctcagcgaaataacagcaacctgcacgggcgaagtaacaaacgtgagcggatgctactcttgcatgacgggcgccagagttagcataaaactacactcaagtaaaaacagcaccgcccacgtacgatgcaaaggcgacgagacagccttcagcgtcctcgaaggagtccactcatacaccgtctcattatcattcgaccatgccgtagtagacgagcagtgccaactcaactgcgggggccacgaatcacaagtaaccctcaagggcaacttgatattcctcgacgttccaaagttcgtagacggtagctacatgcaaacataccatagcagcgtgccaaccggggccaacatcccatcacccaccgactggttaaacgccctcttcgggaacggcctcagtagatggatactcggcgtcataggagtcctactcggagggctcgcgttattcttcctaatcatgtccctgttcaagctaggaacgaagcaagtattccgaagcaggaccaaactcgcctga

SEQ ID NO: 16467 - RNA, 3222 nt, synthetic construct
  misc_feature 1..3222: note = derived and/or modified CDS sequence (opt11) from SFTSV(SPL030A)__AB817992.1__GP
  source 1..3222: mol_type = other RNA
atgatgaaggtaatatggttcagctccctcatctgcctagtaatccaatgcagcggggatacgagccccatcatatgcgcaggacccatacacagcaataagagcgcaagcattccacatctgctcgggtactccgagaaaatctgccaaatcgacaggctcatacacgtcagcagctggctacggaaccattcacagttccaaggatacgtaggccaacgcggagggaggagccaggtctcctacttcccagccgaaaacagctacagcagatggtcgggactactctcaccgtgcgacgccgactggctaggaatgttagtagtcaagaaagccaaaggcagcgacatgatagttcccggcccctcctacaaaggcaaagtcttcttcgaacgcccgaccttcgacggatacgttggatggggctgcggaagcggaaagtccagaacggagtcaggggaactctgcagctcagatagtggcaccagcagcgggctactacccagcgaccgcgtcctctggataggagacgtagcgtgccaacccatgactccaatccccgaagagacgtttctcgagctgaaatcatttagccagtcagagttccccgacatatgcaaaattgacggcatcgtgtttaaccaatgcgaaagcgaatccctacctcaaccattggacgtagcatggatggacgtaggacactcacacaaaataattatgcgagaacacaagaccaagtgggtccaggaaagctcatcaaaagacttcgtatgctacaaggagggaaccggcccgtgttcggagagcgaagagaaaacgtgcaaaacttcaggctcgtgccgcggcgacatgcagttctgcaaagtggcaggctgcgaacacggggaagaggcctcagaagcaaaatgccgatgctccctggtccacaaacccggcgaagtagtagtaagctacggaggcatgagagtccgcccaaaatgctacggattctcgagaatgatggcaacactagaggtaaatcccccggaactaagaatcggacaatgcacaggctgtcacctagaatgcatcaacggtggagtacgactcatcacactcacatccgaacttaaaagcgcgacagtgtgcgcgtcacacttctgtagctccgcaaccagcgggaaaaagagtaccgaaatccaattccacagcgggtcactcgtcgggaagacagcaatacatgtgaaaggcgctctagttgacggaaccgagtttacgttcgaaggaagttgcatgttccccgatggatgcgacgcggtggactgcactttctgcagggagttccttaaaaacccgcagtgctatccggccaagaaatggctgttcattataatcgtgatattactaggatacgcaggcctgatgctcctcacaaacgtactcaaagcaataggggtatggggaagctgggtcatagcgccagtgaaactaatgttcgcgatcatcaaaaagctaatgagaagcgtctcctgcttgatgggaaaactgatggaccgagggagacaagtaatccacgaagaaataggtgaaaaccgcgaaggcaaccaagacgatgtccgcatagaaatggcacgcccaaggagagtccgccactggatgtacagcccggtcatcctaaccatactagccatcgggctcgccgaaggctgtgatgaaatggtccacgcagactccaaactcgtaagctgcaagcaaggaggaggaaacatgaaagaatgcgtcaccacaggacgggccctattaccggccgtcaacccaggtcaggaagcctgcctacatttcactgcaccagggagcccagactcaaaatgcctaaaaatacgcgtcaaacgaataaatctaaaatgcaagaaatctagcagctatttcgtacccgacgcgcgcagccgatgcacgagcgtcagaaggtgcagatgggcgggcgactgccaatcaggctgccccagccacttcacaagcaacagcttctcagacgactgggctgggaaaatggacagagcagggctagggttcagcgggtgcagcgatggatgcggaggagccgcctgcggttgcttcaacgccgcacccagctgcatcttttggcgaaaatgggtagaaaacccacacggaatcatctggaaagtatcgccatgcgcagcatgggtgcccagcgcagtgatcgaactaacaatgccgtccggagaggtgagaacattccaccccatgagcggaataccaacccaggtattcaagggcgtctccgtgacctacctcggatccgacatggaggtatcggggctaacggacctctgcgagatagaagaactaaagagtaaaaagttagcgcttgctccgtgcaaccaagcgggcatgggtgtagtgggcaaagtcggagagatacaatgcaacagtgaagagtccgcccgaacgatcaagaaagacggctgcatctggaacgcggaccttgtcgggatagaactcagagtggatgacgcggtgtgctacagcaaaatcacctcggtcgaagcagtcgccaactacagcgcaatcccaacaacaataggcggccttcggtttgaacggtcccatgactcccaggggaaaatcagtggatcacccctggacataacagccatcaggggctcattctcggtcaactacagaggccttcgtctgtccctaagtgaaatcacagcgacctgcaccggcgaagtaacgaacgtaagcgggtgctacagctgcatgaccggagcaaaagtcagcataaaactccactcaagcaaaaacagcacagcccacgtcagatgcaaaggagacgaaaccgccttctcggtactggaaggcgtccacagctacaccgtatccctctccttcgaccacgcagtagtagatgaacagtgccaactgaactgcggcggccacgagtcccaagtaactctcaaaggcaacctgatcttcctcgacgtaccaaaattcgtagacggctcgtatatgcaaacataccacagcagcgtaccgactggagcaaacatccccagccccaccgactggctcaacgcgctctttggcaacggactgagtcgatggatactcggcgtaattggagtactcctaggaggactcgcactattcttcctaatcatgtccctatttaaattaggcacgaagcaagtgttccgctcgcgcaccaagttagcgtga

SEQ ID NO: 16468 - RNA, 3222 nt, synthetic construct
  misc_feature 1..3222: note = derived and/or modified CDS sequence (opt11) from SFTSV(SPL053A)__AB985292.1__GP
  source 1..3222: mol_type = other RNA
atgatgaaggttatatggttcagctcactaatatgcctggtaatccaatgcagcggagatacagggccgatcatatgcgcaggaccgatccactccaacaaaggggctaacataccacatctgctaggatactccgaaaagatctgccaaatagacagacttatccacgtctcgtcgtggctaagaaaccacagtcaattccagggatacgtgggccaacgcggcggccgaagtcaagtcagctacttccccgcggagaatagttactcaagatggagcggactactatcaccatgcgacgctgactggctgggaatgctagtcgtcaaaaaggccaaaggctcagacatgatcgttccaggcccctcttacaaagggaaagtcttcttcgagcgcccaacattcgacggctacgtcggttggggatgtggctcaggcaagagccgcactgagagcggggaactatgcatcagcgactccgggacctccagcggcctactcccctccgacagagtcctctggataggggacgtcgcctgccaacccatgacaccaatacccgaggaaacgttcctagagctaaagagctttagccaaagcgagttcccagacatatgcaaaatagacgggatcgtattcaaccagtgcgaaagcgagagcttgccccagccatttgatgtagcatggatggacgtcgggcacagccacaaaataatcatgcgagaacacaaaaccaaatgggtacaggaaagctcatcgaaagacttcgtatgctataaagagggaacaggaccgtgctccgaatcagaagagaaaacctgcaaaacgagcggcagctgccgcggggacatgcaattctgcaaggtagcaggctgcgaacacggggaagaagcgagcgaagccaagtgccggtgtagtctcgttcacaaacctggggaagtcgtggtcagctacggaggtatgagagttcgcccaaaatgctatggtttctcgcgaatgatggcaaccctcgaagtcaactcgccagaacaaagaataggacaatgcaccgggtgccacctcgagtgcataaacgggggagtgcgcctcatcacgctcacatccgagctcaagtcagcaaccgtgtgcgcaagccacttttgctccagtgcaacaagcggaaagaaaagcactgagatacaattccactcaggaagcctagtcggaaaaacggccatccacgtcaagggcgcgcttgtcgacggaactgagttcacgtttgaaggctcgtgcatgttcccggatggatgtgacgccgtggactgcacattctgccgagagttcctcaagaacccccaatgctaccccgccaagaaatggctgttcataataatagtcatactcctagggtacgcgggactcatgttgttaacaaacgttctcaaggctatcggcgtctggggcagctgggttatcgccccggtgaagctcatgttcgcgataataaagaaactcatgcgctcagtctcgtgccttatgggaaaattgatggaccgtggacgccaagtcatacacgaagaaataggcgaaaaccgcgaaggcaaccaagacgacgtacggatagaaatggccagaccccgacgggtgcgccactggatgtacagcccggtcatactcacaatcctagcaataggcctcgccgaaggttgcgatgagatggtgcacgcagacagcaaactggtaagctgcaaacaagggtccgggaacatgaaagaatgcgtgacaacaggcagagctctactgccggccgtgaacccaggtcaggaagcatgcctacacttcaccgcccccggctcacccgactccaaatgcctaaaaatcaaagttaagcgaatcaacctgaaatgcaagaaatcgtcaagctactttgtacccgacgcaagatccaggtgcacatcagtgcgccggtgccggtgggccggcgattgccaatcaggttgccccagccacttcacctccaacagcttctccgatgactgggccggaaaaatggaccgggccggactaggattctcgggatgctcggacggttgcggaggggcagcatgcggatgctttaacgcggccccgagttgcatcttctggaggaaatgggtagaaaacccgcacggaatcatatggaaagtatccccatgtgccgcatgggtaccatctgccgtgatcgagctaaccatgccctccggagaagtacgaacattccacccgatgtccggcatcccgacccaggtctttaaaggggtctcagtcacctacctaggatcggacatggaagtgagtggcctcacagacctatgcgaaatcgaggaactaaaatcaaagaaactcgctctagcgccatgcaaccaggctggcatgggagtagtcgggaaagtaggagagatccaatgcagcagcgaggagagcgcgcgcactataaagaaagacggatgcatctggaacgcagacctggtcggaatcgagctacgagtcgacgacgcggtctgctactcgaaaataacctctgtagaagccgtcgcaaactactcggcaataccgaccacaatcggcggcctgcgattcgaacgatcgcatgactcccaaggaaaaatctctggatcgcccttagatatcacagcgatcagaggatcattcagcgtcaactacagaggcctacgcctcagcctgtcagagattacggcaacttgcacgggagaagtaactaacgtaagcggatgctacagctgcatgacaggcgcacgcgtgtccatcaaactgcactcgtccaaaaactccacagcacacgttcgctgcaaaggggatgagaccgcgttctcagtactggaaggggtccactcctacaccgtgagtttgtccttcgaccacgcagtggtagacgaacagtgtcaactaaactgcggaggccacgaatcacaagttaccctaaagggaaacctgatcttccttgatgtacccaaattcgtagacggctcctacatgcaaacgtaccatagctccgtaccgacaggggccaacataccaagcccgaccgactggctaaacgcgctattcggtaacggtttgagtaggtggatactcggagtcataggagtactactcggaggcctggccctcttcttcctaataatgagcctattcaagttaggcacaaagcaagtcttccgaagcagaacaaagctagcataa

SEQ ID NO: 16469 - RNA, 3222 nt, synthetic construct
  misc_feature 1..3222: note = derived and/or modified CDS sequence (opt11) from SFTSV(SPL054A)__AB985293.1__GP
  source 1..3222: mol_type = other RNA
atgatgaaagtcatctggttcagctccctaatctgcctagtaatacagtgcagcggtgacacaggccccatcatctgcgcaggccctatacactccaacaaaagtgcaaacatacctcacctactcggatactccgaaaagatctgccaaatagatagactcatccatgtgtccagctggttgaggaaccatagccaattccagggatatgtcggtcaacgcggtggaagaagccaagtgtcctacttcccggctgaaaacagctattccagatggtccgggctgctgtccccatgcgacgcagactggctcggaatgctcgttgtcaaaaaggcaaagggcagtgacatgatagtacccggaccatcatacaaaggaaaagtcttcttcgaacgacccacattcgacggatacgtaggctgggggtgcggctcaggcaaaagcagaaccgagagtggagaactatgctcgtccgacagcgggaccagctccggattattaccatcagacagagtcctatggataggagacgtcgcctgccaaccaatgacacctataccggaagagacattcatggaactaaaatcattcagccaatccgagttcccagacatatgtaaaatcgacggcatcgtattcaaccaatgcgaatccgaatcattaccacaaccattcgacgtcgcatggatggacgtcggccactcacacaaaatcataatgcgggaacacaaaactaaatgggtccaagaatcatcatccaaagacttcgtatgctacaaagaaggaacgggcccctgcagcgaaagcgaagaaaagacctgcaaaacctcgggcagctgcagaggcgacatgcaattttgcaaagtcgcggggtgtgagcacggagaagaagcctccgaagcgaaatgcagatgttcactcgtacacaagcccggcgaagtagtagtatcgtacggcggaatgcgggtccgcccgaaatgctacggcttctcccgcatgatggccaccctcgaagtgaacccacccgaacaacgaatcggacaatgcaccggatgccacctagaatgcataaacggcggcgtacgcctaataactctcacaagtgaacttaagtccgccacggtgtgcgccagccacttctgctccagcgctacaagcggaaagaaaagcaccgaaatccaattccactcgggcagcctggtcggaaaaaccgcaatccacgtaaaaggagccctcgtggatgggaccgagttcacattcgaagggtcctgcatgttcccggacgggtgcgacgccgtcgattgcaccttttgtagagaatttctcaaaaacccacagtgctaccccgcaaagaaatggctattcatcataatagtgatactcctagggtacgctggcctaatgctattaacaaatgtcctcaaagccatcggcgtatggggaagctgggtaattgcgccagtaaaactaatgttcgccatcatcaagaaactcatgcggtccgtgtcctgcctaatgggaaaactcatggaccgtgggcgacaagtcatccacgaagaaataggcgaaaacggagaaggcaaccaagacgacgtccgtatcgaaatagcccgaccacgccgggtgcgccattggatgtactccccagtgatcctaacgatactggcaatcggcctagctgagggctgcgacgaaatggtccatgcagacagcaaacttgtcagttgcaaacagggttcagggaacatgaaagagtgcgtaaccacagggagagctctactaccagccgttaacccaggacaagaagcatgcctacacttcactgcgcccggatccccagattcaaaatgcctcaaaatcaaagtcaaacggatcaacctcaaatgcaaaaagagctcgtcatatttcgtaccggacgcaaggagcagatgcacgtccgtaaggcgatgccggtgggccggagactgccaaagcggatgccccagccacttcacctccaactcattctcagacgactgggcgggcaagatggatcgcgcaggactcgggttttccgggtgcagcgacggctgcggaggcgcagcatgcggctgcttcaacgcagcccccagctgcatcttctggagaaaatgggtagaaaacccccacggcataatctggaaggtctccccctgcgccgcgtgggttcctagcgccgtgatagagctcaccatgccatccggcgaggtgcgcacgttccaccccatgtccgggatccccacccaagtatttaaaggagtaagtgtcacatacctaggctcagacatggaggtctctggtctaacagacctctgcgagatagaggaactaaaatcgaagaaactcgcactcgcgccctgcaaccaggccgggatgggcgtagtcggcaaagtcggagagatccaatgcagttcagaagaaagcgcgcgcaccatcaagaaagacggatgcatttggaacgcggacctagtgggcatcgaactcagagtggacgacgccgtgtgctacagcaaaatcacatctgtagaagccgtcgcaaattactccgcaatccccaccaccatcggagggctccgattcgagcgatcacatgactcacaaggcaagatatcaggctccccactagacatcacagcaatcagaggatccttctccgtgaactacagaggactacgcctaagcctctcagaaatcacagcgacgtgcacaggcgaagtaaccaatgtcagcggctgctacagctgcatgaccggagcgaaagtatccatcaaattacactcatcaaagaactccacagcacacgtacggtgcaaaggagacgaaacggccttcagcgtgctagaaggggttcactcctacaccgtcagcctcagcttcgaccacgcagtggtagacgaacaatgccaactaaactgcggcgggcacgagtcccaagtaaccctaaagggaaaccttatcttcctagacgtaccacgcttcgtagatggctcatacatgcaaacctaccactcgtccgtgccgaccggagccaacataccttcaccgacagattggctcaacgcgttatttggaaacgggctgtcccgctggatactcggcgtaataggagtgctactgggcggactcgcactcttcttcttaataatgagcctcttcaaactcggcacaaaacaagtattcagaagcagaaccaaactggcataa

SEQ ID NO: 16470 - RNA, 3222 nt, synthetic construct
  misc_feature 1..3222: note = derived and/or modified CDS sequence (opt11) from SFTSV(SPL055A)__AB985294.1__GP
  source 1..3222: mol_type = other RNA
atgatgaaggtcatctggttctccagcctaatctgcctcgtgatacaatgcagtggcgacaccggaccaataatttgcgcaggaccgatccacagcaacaaatccgccaacatacctcatctgcttggatactcggagaaaatttgccaaatcgacagactaatccatgtgagctcctggctccggaaccacagccaattccaagggtacgtcggccaacgaggcggccgctcccaagtcagctactttcccgcagaaaacagctactcaaggtggtcaggtctactctctccgtgcgacgccgactggcttggaatgttagtagtaaagaaagcaaaaggctcagacatgatcgtgccaggcccgtcatacaaaggaaaagtgttcttcgaaagacccacattcgatggctacgtggggtggggatgcggctcaggcaagtctagaacagaaagcggagaactctgctcatccgattccgggacctcgagcggactcctaccctccgaccgagtcctatggataggcgacgtcgcgtgccagccaatgacaccgataccagaagaaacattcctagaactcaagagcttctctcaaagcgagttcccagacatttgcaaaatcgacggaatagtgtttaaccaatgcgaaagcgaaagcctgccacaacctttcgacgtcgcctggatggatgttggacactcccataaaatcataatgagagaacacaaaacaaaatgggtacaagaatcatcgagcaaagacttcgtctgctacaaagaaggaacaggcccatgttcagaaagcgaagagaaaacctgcaagacgagcggatcctgccgcggcgacatgcagttttgtaaagtcgcaggttgcgaacacggcgaagaagcgtccgaagcaaagtgtcgctgctccctggtacacaaacccggcgaagtcgtggtctcgtacggcggaatgagagttagacccaaatgctacggcttcagccgcatgatggccaccctggaagttaacagcccagaacaaagaataggacaatgcaccggctgccacctagaatgcataaacggtggcgtcaggttaatcacccttacatcagagctcaagagcgcgaccgtatgcgcctcccatttctgcagcagcgccacatccgggaagaaatccaccgaaattcaattccactcagggagtcttgtgggcaaaacggcaatacacgtaaaaggggccctagtagacggtacagaatttaccttcgaaggctcgtgcatgttcccggacggctgcgacgcagtggactgcacattctgccgcgagttcctcaaaaatccgcaatgctaccccgcaaagaagtggctattcatcatcatcgtaatcctcctcggatacgctggactcatgctactcacaaacgtactaaaggcaataggagtctggggcagctgggtcatagcaccagtcaagctcatgttcgcaataatcaagaaactaatgcgatccgtaagttgcctgatgggaaaactcatggaccgcggccgccaagtcatacacgaagaaatcggcgaaaacagagaagggaaccaggacgacgtacgcatcgaagtcgcccgaccaagaagagtcaggcattggatgtattcgccggtcatcctaacaatattagcaatcggactagccgaaggttgcgacgagatggtacacgcagactcaaagctagtaagctgcaaacaaggatccggaaatatgaaagaatgcgtcacaaccggccgagcattactcccagcagtgaacccaggacaggaggcgtgccttcacttcaccgcccccggatcacccgacagcaagtgcctcaaaataaaagtaaagcgtatcaacctaaagtgcaagaaatcatcaagttacttcgtgccagacgcaagatcccgctgtacgtcggtgagacgctgcagatgggccggggactgtcaatcaggatgcccaagccactttacaagcaacagcttctctgacgactgggccggcaaaatggacagagcaggattaggattctcgggatgctcagacggctgtggcggcgccgcctgcggatgcttcaacgcagccccatcgtgtatattctggcgaaagtgggtcgaaaacccacacggcatcatatggaaagttagcccatgcgctgcatgggtaccatcagccgtaatcgagctaacaatgcccagcggggaagtacgaaccttccacccgatgtcaggaatccccacacaagttttcaaaggagtctcagtcacgtatctaggctcagacatggaggtctcaggcctaacagacctctgcgaaatcgaggaactgaaatcaaagaaactagcacttgcaccctgcaatcaagcaggaatgggcgtcgtcggcaaagtcggagagatccaatgctccagtgaagaatccgctcgcacgatcaaaaaggacggatgcatatggaacgccgacctggtcggcatcgaactgagagtagatgacgccgtctgttattcaaagatcacaagcgtagaggcagtagccaactacagcgccattccaacgaccataggagggctccgattcgagcgatcacacgacagccaaggtaaaatatccggctctcccctggacatcacagcgatccggggttccttcagcgtaaactaccgaggactgcgactcagcttatcagagataacagccacatgcacgggagaggtcacgaacgtgtcggggtgttacagctgcatgacaggagcccgcgtctcaatcaagctacacagttccaaaaactcgaccgcccacgtaagatgcaagggagacgaaacggccttcagcgttctcgaaggcgtccactcatacaccgtgtcactatcttttgaccatgcagtggtcgatgaacaatgtcagcttaactgcggcggccacgagagccaggtaacgctaaaagggaacctcatatttttagacgttccaaagttcgtagacggctcatacatgcaaacctaccactcgtcggtaccaacaggcgccaacatccccagcccaacagactggctcaacgccctattcggaaacggactcagccgatggatcctcggcgttataggagtactcctcggcgggctcgccctattcttcctaatcatgagcctattcaaactaggtaccaaacaagtattccgctcccgcacaaaactggcctaa

SEQ ID NO: 16471 - RNA, 3222 nt, synthetic construct
  misc_feature 1..3222: note = derived and/or modified CDS sequence (opt11) from SFTSV(SPL057A)__AB985295.1__GP
  source 1..3222: mol_type = other RNA
atgatgaaagtcatttggttcagctcactgatatgcttagttatacaatgttccggagacacgggaccgatcatatgcgcaggcccaatacacagcaacaaaagcgccgacataccacatctactcgggtacagcgagaaaatctgccaaatagacaggctcatccacgtgagcagctggctccgcaatcacagccaattccaaggctacgtaggtcaaaggggaggcagaagccaggtgtcttactaccccgcagaaaactcctatagcagatggagcggcctcctatcaccctgcgacgcggactggctgggaatgcttgtcgtgaagaaagccaaagggtcagacatgatcgtaccagggccttcctacaaaggaaaagtattcttcgaacgaccgacattcgacggctacgtcggatggggctgcggaagcggcaagagccggacagaaagcggcgaactatgctcaagcgacagcggaacctcaagtggcctcctcccatccgatagggtcttatggataggagacgtagcgtgccagcctatgacccctatccctgaagaaacattcctcgagttaaagagctttagccagtccgagttcccagacatatgccgaatagacggcatagtgtttaaccaatgcgaaagtgaaagcctaccacagccattcgacgtcgcctggatggacgtcggccacagccataaaataataatgagggaacacaaaacaaaatgggtccaagaatccagctcgaaagacttcgtctgctacaaagagggcaccgggccgtgctcagaatctgaagaaaagacatgcaagaccagcggtagctgcaggggagacatgcagttctgcaaagtcgccgggtgcgaacacggggaagaggccagtgaagcaaaatgcagatgctcgctggtccataaaccaggagaggtcgtagtctcgtatggcggcatgagggtccgaccaaaatgctacggattctccagaatgatggcgaccctagaagtcaacccacccgagcaaaggattggccaatgcaccggttgccacctggaatgcgtcaacggaggcgtgcgcttaataacactgacgagcgagctcaaatcggctacagtatgcgcttcccacttctgcagctccgcaatatcagggaagaaatcaaccgaaatacaattccactccggaagcctcgtaggcaaaaccgccatccacgtcaagggagccttagtagacgggaccgaatttacatttgaaggatcatgcatgttcccagacgggtgcgacgcagtcgattgcacattctgtcgcgagttcctgaaaaatccacaatgctacccagccaagaaatggctatttatcatcatcgtgatcctccttggatacgcggggcttatgctcctcacgaacgtgctcaaggccattggcgtctggggatcatgggtcatagcaccggtaaagctaatgttcgccatcatgaagaaacttatgagaagcgtcagctgcctaatggggaagctgatggaccggggcagacaagtgatacatgaggagatcggcgagaacagagaaggaaaccaagacgatgttcggatcgagatggcacgaccgcggcgcgtcagacactggatgtacagcccggtcatactaaccatcctagcagtgggcctggccgagggatgcgacgaaatggtacacgcagactcaaaactggtctcctgcaaacaaggatcaggaaacatgaaagagtgcgtcacaacgggccgagccctgctgccggcagtaaacccaggacaggaggcttgccttcactttaccgcacccggatcaccagactccaaatgccttaaaatcaaagtcaagaagataaacttgaaatgcaagaagtcctcaagctacttcgtaccagacgcaagaagccgatgtacaagcgtacgaaggtgcagatgggccggcgactgccaaagcgggtgccccagccatttcacaagtaacagcttttcagacgactgggccggaaaaatggacagagccggcctcgggttctcgggatgcagcgacgggtgcggcggagctgcgtgcgggtgcttcaatgctgccccaagttgcattttctggcgtaaatgggtagaaaacccgcacgggataatatggaaggttagtccttgtgccgcatgggtaccctcggcagtgatagagctaacgatgccaagcggggaggttcgcacattccacccaatgtcaggtataccaacgcaagtattcaagggagtctccgtaacatacctaggctccgacatggaagtcagcggacttacggacttatgcgagattgaagaactaaaatcaaagaaactcgcgctagcaccctgcaaccaggccggaatgggcgtcgtgggcaaagttggagaaattcaatgctccagcgaagaaagcgcccgaacgattaaaaaggacgggtgcatctggaacgcggacttagtgggcatcgaactcagagtggacgacgccgtctgctactcaaaaatcacgagcgtggaagcagtagccaactattcagcaatacccacaaccataggaggcttacgatttgaacgatcacatgacagccagggcaagatatcaggctcaccgctagacatcaccgcgataagagggagcttctcggtcaattacagaggattacgcctaagcctaagcgagatcacagcgacatgcacaggagaagtcacgaacgtttcgggatgctattcctgcatgacaggcgctaaagtaagtataaagctccactcgaacaagaacagtaccgcgcacgtccgctgcaaaggcgacgagaccgcgttctcagtactggagggcgtgcacagttacaccgttagcctcagtttcgaccatgcagtggtagacgaacaatgccagctgaactgtggaggccacgaatcacaagtgaccctgaaggggaacttaatattcctagacgtaccaaaattcgtagacggctcctacatgcaaacgtaccacagctcggtacccaccggagccaacataccaagcccaaccgattggcttaacgctctctttggcaacggtctatcgcggtggatcctaggcgttataggcgtattattaggaggactagcactattcttcctaataatgtcactattcaaactagggaccaaacaagtgttcagaagcagaacaaagctggcatga

SEQ ID NO: 16472 - RNA, 3222 nt, synthetic construct
  misc_feature 1..3222: note = derived and/or modified CDS sequence (opt11) from SFTSV(SPL062A)__AB985297.1__GP
  source 1..3222: mol_type = other RNA
atgatgaaagtgatatggttcagctcactaatatgcttagttatacgatgcagcggcggaaccggacccatcatatgcgccggcccgatacactcgaacaagtcagcaaacatcccccaccttctcggctacagcgaaaagatctgccaaattgaccgactcatacacgtaagctcatggctacgcaatcactcgcagttccaaggatacgtgggccaaaggggaggaaggagccaagtcagctacttccccgccgaaaactcttatagtagatggtccgggctactatctccctgtgacgccgactggctcggtatgttagtagtcaaaaaggccagaggatcagacatgatagtacccggcccctcctacaaaggaaaagtatttttcgagagaccaacattcgacggctacgtaggctggggatgcggatccggaaagtctcgaaccgaaagcggagaactatgctctagtgacagcggaacctccagcgggctactcccctccgacagagtactatggatcggcgacgtagcgtgccaaccgatgacgccgatcccggaagaaaccttcctagagctaaaatccttttcacaaagcgagttccccgacatttgcaagatagacggcatagtcttcaaccaatgcgaaagcgaatcactaccccaaccatttgacgtcgcctggatggatgtcggacactcacacaaaatcataatgagagaacataagacaaaatgggtccaggaatcaagctccaaagactttgtttgctacaaagaaggaaccggcccgtgcagcgaatccgaagagaaaacatgcaagacgtcaggctcatgcagaggagacatgcaattctgcaaagtggcaggatgcgaacacggagaagaggcttcggaagcgaaatgccgatgtagcctggtacacaagccgggagaagtcgtcgtcagttacggcggaatgagggtacgcccaaagtgctacggattcagccgcatgatggcaacgctggaagtaaaccctcccgaacaacgcatagggcaatgcaccggatgccatctggaatgcataaacggaggcgtacgactaataaccctaacgagcgagcttaagagcgcaaccgtatgcgcgtcacatttctgttcatcagccacctcaggcaagaaaagcacggaaatccaattccactcaggttccctagtaggtaaaaccgccatacatgtaaaaggagcgctagtcgacggaacagagttcacattcgaaggctcatgcatgttcccagacggatgcgacgcagtagactgcactttctgccgagagttcctcaagaacccccaatgttacccagcaaagaagtggctgttcatcataatcgcaatcttgctcgggtacgcaggtctaatgctgctgacgaacgtgctaaaggccataggcgtatgggggagctgggtaatcgcccccgtaaaacttatgttcgcaatcatcaaaaagctcatgcgcagcgtaagctgcctgatgggtaaattaatggacagaggcagacaagtcatacatgaagaaataggcgaaaacagggaaggaaaccaggacgacgttagaatagaaatggcccgcccacgccgcgtacgacactggatgtattccccagttatcctcacgatactcgcaatcggcctcgcagagggatgcgacgagatggtgcacgcagactccaagctagtctcatgcaaacaagggagcggaaacatgaaagagtgcgtgacaacaggcagggctctactccccgcagtgaaccccggacaagaagcatgcctgcacttcaccgctccaggaagtccagactctaaatgcctaaaaattaaagtaaagagaatcaaccttaaatgtaaaaagagctcaagctacttcgtacccgacgcccgtagccgatgcacgtccgtacgtcggtgccgatgggccggcgactgccaatccggatgcccgagccacttcaccagcaattccttcagcgacgattgggcgggaaaaatggatcgggccggactaggattctccggctgttcagacggctgcggaggggcagcctgcggctgcttcaacgcggccccgtcatgcatattctggaggaagtgggtcgaaaacccgcacggaatcatctggaaggtcagtccatgtgcggcatgggtcccatcagcagtgatcgagctaacaatgccaagcggggaagtgcgaaccttccacccaatgtccggcataccaacacaggtatttaaaggcgtcagcgtcacatacctcggtagcgacatggaagtgtcaggccttaccgacctgtgcgagatcgaggaactcaaatctaagaaattagcacttgccccatgcaaccaggccgggatgggagtcgtaggcaaagtcggcgaaatacaatgctcctcggaggaaagcgcacgcacgatcaagaaagacggctgcatatggaacgccgacctggtcgggattgagctaagggtagacgacgcagtctgttactccaaaattacctcagtagaagcggtagcaaactactccgcaatacctaccacgatcggcggtctcaggttcgagcgatcccacgacagccagggcaaaataagcggctcgcctctcgacataacagcgatccgcggttccttctccgtcaactacaggggccttaggttgagcctctccgaaatcacggccacgtgcacgggcgaagtcacgaacgtctccggatgctacagttgcatgaccggagcaaaagtctccataaaactccactcatccaaaaattcgaccgctcacgtaaggtgcaaaggagacgagacagccttctcagtgctcgaaggagtccacagctacaccgtatccctctccttcgaccacgcagtggtcgacgaacagtgccagctcaactgcggaggacacgaaagccaggtcaccttgaaaggtaatctgatttttctggacgtgcccaaatttgtcgacggctcatacatgcagacgtaccactcctcagtgcctacaggagccaatatccctagcccaacagattggctcaacgccctcttcggaaacggcctcagcagatggatactcggggtcataggcgttctattaggaggactagccctcttcttcctgataatgagcctattcaagctcggcaccaaacaagtcttcagaagcaggacgaagctcgcctaa

SEQ ID NO: 16473 - RNA, 3222 nt, synthetic construct
  misc_feature 1..3222: note = derived and/or modified CDS sequence (opt11) from SFTSV(SPL066A)__AB985298.1__GP
  source 1..3222: mol_type = other RNA
atgatgaaagtcatctggttctccagcctaatttgtctcgtaatccaatgcagcggggacgcgtcccctatcatatgcgcaggaccgatccacagcaataagtcagccaacatccctcatctgctgggctacagcgaaaagatctgccaaatagacagactgatccacgtcagctcgtggctgaggaaccacagccagttccaaggctacgtgggacaacggggaggcaggagccaagtctcttacttccccgcagagaactcctacagccgctggtccggcctcctatcaccctgcgacgccgactggctcgggatgctagtcgtcaagaaagccaaaggcagcgacatgatagtccccggaccatcgtacaaaggaaaagtattcttcgaaaggccgacattcgatggctacgtcggatggggctgcggcagtggaaaatcacgaaccgaatcaggagaactgtgctcaagcgacagcggcacatcgtccggactattgccatcagatcgagtactatggataggcgacgtagcttgccagcccatgactccaatccccgaggagacattcttagaactaaagagcttcagccagtcagaatttcccgacatctgcaaaattgacgggatcgtattcaaccaatgtgaatccgaatcactgccccaacccttcgacgtcgcctggatggacgtcggccacagtcacaaaataataatgcgagaacacaaaacaaaatgggtacaagaatcctcgagcaaggacttcgtatgttacaaagagggaacaggcccatgctcagaaagcgaagagaaaacttgtaaaaccagcgggagctgcagaggagacatgcaattctgcaaagtagctggatgcgaacatggggaagaggcaagcgaagccaagtgccgatgctccctagtacacaaaccaggtgaggtagtcgtatcctacggaggcatgcgcgtacgcccgaaatgctacggcttctcacgcatgatggcaaccctggaggtgaacccacccgaacagcgaattgggcagtgcacagggtgccacctcgaatgcatcaacggcggggtacggctaataacactaacatcagaattaaaaagcgcaacagtctgcgctagccacttctgctcaagtgccacaagcgggaagaaatcaacagaaatccaattccactccggcagcctcgtaggaaaagccgcgatccacgtcaaaggagcattagtcgacggcaccgaatttaccttcgaaggttcctgcatgttccccgatggctgtgacgccgtggactgcacattctgccgcgagttcctcaaaaatccccagtgttatccggcaaagaaatggttattcatcattatcgtcatactcctaggctacgcaggtctcatgctcttaacaaacgttctaaaagccatcggtgtatggggaagttgggtcatagctccggtcaaacttatgttcgcgataataaagaaactaatccgctccgtatcatgcctgatgggtaaacttatggaccgcggtcgacaagtaatacacgaagaaataggcgaaaacggcgaaggaaaccaggacgacgtacggatagagatggcaagacccagacgggtccgacactggatgtactcgccagtgatactcacgatcctcgccatcgggctagcagaaggctgcgacgaaatggtgcacgccgactcaaaactcgtaagttgtaaacaaggatcaggtaacatgaaagagtgcgtcaccacaggacgcgccctactacctgccgtcaacccgggacaagaggcatgtctacacttcacagcgccaggttcacccgacagcaaatgcctgaaaatcaaagtaaaaagaatcaacctaaaatgcaagaaatccagcagttactttgtcccggacgcccgaagccgttgcacgtcagtacgaaggtgccgctgggcaggagactgtcagagcggttgcccctcccacttcaccagcaattcattctcagacgactgggcaggcaaaatggacagggccggcctaggcttctcaggctgcagtgatggctgcggaggggcggcctgcgggtgcttcaacgccgctccatcctgcatcttctggcgcaaatgggtcgaaaacccacacgggataatatggaaagtatccccttgcgcagcatgggtaccctcagcagtcatcgagctcacaatgcctagcggcgaagtccgaacattccacccgatgagcgggatacctacccaaatatttaagggggtctccgtcacatacctaggcagcgacatggaagtaagcggactgacagacctgtgcgaaatagaagaactccgaagcaagaaacttgccctagccccatgcaaccaagctggcatgggagtagtaggaaaagtcggggaaatacaatgcagctcagaagagtcggcacgcacaataaagaaagacggctgcatctggaatgcagacctagtaggaatcgaactacgcgtcgacgacgccgtatgctacagcaaaataacaagcgtagaagcagtggcaaactactctgcgatcccaactaccataggcggcctacggtttgaacgctcccacgacagccagggaaaaatctccggaagccccctcgacatcaccgccatacgaggtagctttagcgtgaactacagagggctaagactgagcctcagcgaaatcaccgccacatgcacaggagaagtcaccaacgtcagcggttgctactcctgtatgacgggcgcgaaagtcagcatcaagctgcacagctcgaaaaattcaaccgcacacgtccggtgcaagggcgacgaaacagcattttcagtcctcgagggagtccacagctacacggtatcactatccttcgaccacgcggtagtcgacgaacaatgccaattgaactgcggcggacacgaaagccaagtgacgctaaaaggaaacctaattttcctagacgtaccaaagttcgtggacggcagctacatgcagacgtaccacagctcggtcccgacaggcgcaaacatcccttccccaacagactggctgaacgccctcttcggcaacggactctcaagatggatcctcggggtcatcggggtactcctcggaggactcgcgctctttttcctgatcatgtccctatttaaactaggaacaaagcaagtcttccggagccgcaccaagctcgcctaa

SEQ ID NO: 16474 - RNA, 3222 nt, synthetic construct
  misc_feature 1..3222: note = derived and/or modified CDS sequence (opt11) from SFTSV(SPL070A)__AB985301.1__GP
  source 1..3222: mol_type = other RNA
atgatgaaagtcatctggttcagttcactcatttgcttagtcatacaatgcagcggcgacaccgggcccataatatgcgcaggaccgatccactcaaacaaatcagccaacattccgcacttgctcggctactcggagaaaatctgccaaatcgaccgactcatacacgtatcaagttggctccgcaaccacagtcaattccaaggctacgtcggccagcgaggcggccgatcccaagtgagttatttccccgcagaaaacagctacagtcgatggtcgggcctcctatcgccatgcgacgcggactggctagggatgctcgtcgtcaaaaaggcgaaaggcagcgacatgatcgtaccaggaccaagctacaaaggcaaggtcttctttgaacgccccaccttcgacggatacgtaggctggggatgcggctcaggcaaaagcagaacggaaagtggggaactctgctcaagcgattcaggcacaagcagcggactactgcccagcgaccgcgtactgtggataggagatgtagcctgccaacccatgaccccaatcccagaagaaacctttatggaactgaaatcattcagccagtccgagttcccggatatatgcaaaatcgacgggatagtattcaaccagtgcgagtcagagagcttaccccagccctttgacgtggcctggatggatgtcgggcacagccacaagataataatgagagaacacaaaacgaaatgggtacaggaatcaagttcaaaagacttcgtgtgctacaaggaaggcacagggccatgcagcgaatcagaagagaaaacgtgtaagacatcaggcagctgtagaggagacatgcaattctgcaaagtcgccgggtgcgaacacggggaagaagcaagcgaagcaaagtgtaggtgcagcctggtacacaaaccgggcgaagtagttgtgtcgtacggcggcatgcgagtccgaccgaaatgctacgggttctcccggatgatggccacattggaagtaagcccacccgaacaaagaattggccagtgcaccggatgccatcttgaatgcatcaacggcggcgttcgactaatcacactcaccagtgagctgaaaagcgcaacagtgtgcgcaagccatttctgcagctcggcaaccagtggaaagaaaagcactgaaatacaattccacagcggcagccttgttggaaagaccgccatccacgtaaaaggcgcactcatggatgggaccgaatttaccttcgaaggcagctgcatgttcccggacggatgcgacgcagtggactgcaccttctgccgagagttcctaaagaatccacaatgctaccccgcaaagaaatggttattcattattatcgtaatactcctcggctacgcaggactcatgctcctaacaaacgtactcaaagcaataggcgtatggggtagctgggtgatagcacccgtaaaacttatgttcgcaataatcaagaaactcatgcgttcggtatcatgcctaatgggaaaactcatggacagagggcgccaggtcatccacgaagaaataggagaaaacggcgagggaaaccaggatgacgtcagaatagagatggcgaggccccgacgagtccggcactggatgtatagcccggtcatactaacaatcctggcaataggactagccgaggggtgcgacgagatggtacacgccgactcaaaattagtctcatgcaaacaaggcagcggaaacatgaaagagtgtgtaacgactggcagagcgctcctaccggccgtaaacccgggacaagaagcatgtctccattttaccgctcccgggagtccggacagtaagtgcctcaagatcaaagtcaaacgaataaacctcaaatgcaagaaaagcagcagttactttgtccccgatgcacgtagcagatgcacatccgtccggagatgccgctgggccggagattgccagtcgggatgccccagtcacttcacaagcaacagcttctcagacgactgggccggtaaaatggaccgtgccgggctagggttcagcgggtgctcagacggctgtggcggcgccgcatgcgggtgcttcaacgcagcgcccagctgcatcttctggagaaaatgggtcgagaacccccacggaataatctggaaagtctcaccctgtgccgcatgggtcccctctgccgtgatagaattaaccatgccaagcggggaagtacggacgttccaccccatgagcggaatacccacgcaggtctttaaaggtgtatcggtcacatacctaggaagcgacatggaagtaaccgggctcacagacctatgcgaaatagaagaattaaagtccaaaaagctagcactagctccctgcaaccaagccggcatgggagtcgtgggcaaggtcggggagattcagtgcagctccgaagaatcagcacgcacgatcaaaaaggacgggtgcatatggaacgcggatctagtaggcatagaactcagagtcgacgacgcggtatgctacagtaagatcacgagcgtagaagctgtagccaactactcggcaatacccaccacgataggcggcctacggttcgagcgcagccatgatagccagggcaaaatcagcggcagccccctagacataacagcaatccgcggctcattctccgtcaactacagaggcctgagactttcactaagcgagatcacggccacatgcacaggcgaagtaacgaacgtctcaggctgctacagctgtatgacgggggccaaagtgagcataaaattacacagcagtaaaaactctaccgctcacgtccgctgcaaaggagacgagaccgcattctcggtcctcgaaggggtacactcgtacaccgtgtcactctcctttgatcacgccgtcgtagacgaacaatgccaactcaattgcggcgggcacgaatctcaggtcacgctgaaagggaacctaatttttcttgatgtacccaaattcgtagacgggtcctacatgcagacctaccattcctcagtacccaccggcgcgaacatcccaagcccaacagattggctaaatgcactcttcggcaacggcttgtccagatggatactcggcgtcataggcgtgctactgggcggcttagccctattcttcctaatcatgagcctgttcaaactcggaaccaaacaagtattcagacctagaacaaaactagcgtaa

SEQ ID NO: 16475 - RNA, 3222 nt, synthetic construct
  misc_feature 1..3222: note = derived and/or modified CDS sequence (opt11) from SFTSV(SPL071A)__AB985302.1__GP
  source 1..3222: mol_type = other RNA
atgatgaaagttatctggttcagctccctcatctgcctaataatacaatgcagcggggacacaggaccgatcatatgcgctggtccaatccactcaaacaaatccgccaacatcccccatctactaggctactcagagaaaatctgccaaatcgacagacttatccacgtgagctcttggctgagaaaccactcccaattccaaggatacgtaggacaacgaggaggaagaagccaggtaagctacttccccgcggaaaacagctactccagatggtccggcctactgtcaccgtgcgacgcggactggctagggatgctcgtcgtaaagaaagcaaaaggtagcgacatgatcgtacccggaccctcatacaaaggcaaagtcttcttcgaacgcccaaccttcgatggatacgtcgggtggggatgcgggtcgggaaaaagccgcacggaaagcggcgaactatgttcttcagactcaggcacatcgagcggcctattaccatcagaccgcgtcctctggattggagacgtcgcctgccaacctatgacccccataccggaggaaacatttctcgaattaaagagctttagccaaagcgagttcccagacatatgcaaaatcgacgggatcgtgttcaaccaatgtgaaagcgaatcacttccccagcccttcgacgtagcatggatggacgtagggcactcacacaaaatcataatgagggagcacaaaactaaatgggtacaagagtcatcatcgaaagatttcgtatgttacaaagagggcacaggaccctgctcagaaagcgaagagaaaacatgtaaaacctcaggctcctgtcgcggcgacatgcagttctgcaaagtagctggatgcgaacacggagaagaaacatcggaggctaaatgccgctgtagcctggtccacaaaccaggagaagtagtagtctcctacggaggcatgcgcgtaaggccgaaatgctacggcttcagcagaatgatggcaacactggaagtcaacccacccgaacaacggataggacaatgcaccggctgccacctagaatgcatcaacgggggagtgcgcttaataacactcacatccgaactaaaaagcgcaacagtgtgcgccagtcatttctgcagcagcgcaacgagtggaaagaaaagcaccgaaatacagttccactcagggtcgctagtcggaaaaaccgcgatccacgtaaaaggtgcgctcgttgacgggaccgagttcacattcgaaggttcatgcatgttcccggacgggtgcgacgccgtagactgcaccttctgccgagagttcttgaaaaacccgcagtgttacccagctaagaaatggctattcatcatcatcgtcatcctcctcggatacgcgggcctcatgctgctaactaacgtcctaaaagcaatcggcgtttgggggagctgggtaatagcccccgtcaagctcatgttcgccataataaagaaactaatgcggtcagtctcatgcctaatggggaaactgatggaccggggtcgacaggtcatacacgaggaaataggcgaaaacagggaagggaaccaagacgacgttcggatcgaaatggcgcgaccccgccgcgtgcgacactggatgtatagccccgtgattctggcaatccttgcgatcggactagcagaaggatgcgacgaaatggtacatgcggacagcaaactcgtcagctgcaaacaagggagtggtaacatgaaagagtgcgtaacaacaggccgggcactactacccgcagtcaaccccggacaggaggcctgcctccacttcaccgcacccggttcaccagacagcaaatgcctgaaaatcaaagtgaaacgcataaacttaaaatgcaagaaaagctcgagctacttcgtccctgacgccagaagtagatgtacgagtgtaagacgatgccgctgggcgggagactgccaaagcgggtgcccaagccacttcactagcaactcattcagcgatgactgggcaggcaaaatggacagagcaggactagggttctcaggatgctcggacggctgcggcggggccgcctgcggctgtttcaacgccgcaccgagctgtatcttctggagaaaatgggtagaaaacccccacgggataatctggaaagtatcgccatgtgcagcctgggtaccctcagccgtcatagagcttacaatgccaagcggggaggtgcgcaccttccacccaatgtccggaatcccgacacaagttttcaaaggcgtctcagtaacgtacctgggctccgacatggaagtttccgggctcaccgacctctgcgaaatcgaggaactaaaatcgaagaaattagccctagcaccatgcaaccaagccgggatgggggtagtgggaaaagtcggggaaatccaatgctcatcagaagaatctgcccggacgatcaagaaagatggctgtatctggaacgcggacttggtcggcatagaactaagagtggacgacgcagtatgctactccaaaataacctcagtagaagccgtagccaactactcagctataccaaccactataggcgggctaagattcgagcgctcgcacgactcacagggaaaaatctcaggctcgcccttagacataacggcaataaggggctcgttctcggtcaactaccggggtctgaggctaagcctgtccgaaataaccgccacttgcacgggcgaagtcactaacgtaagcggctgctacagctgcatgactggggcaaaagtcagcataaaactacactcgagcaagaactctaccgcgcacgtccgctgcaaaggagacgagaccgcattctccgtactggaaggagtacattcatacaccgtatccctgagctttgaccatgcagtagtcgacgaacaatgccaattaaattgcggaggccacgagagccaggtgaccctcaaaggtaacctaatctttcttgacgtacctaaattcgttgacggttcgtatatgcagacctaccacagctcagtaccaacaggcgccaacatcccaagccccactgactggctcaacgccctattcggaaacggcttgagccgctggatattgggagtcataggcgtactactagggggactcgccctcttcttcctgataatgtcactattcaaactaggaaccaaacaagtgttcaggtcccggacgaaactagcgtaa

SEQ ID NO: 16476 - RNA, 3222 nt, synthetic construct
  misc_feature 1..3222: note = derived and/or modified CDS sequence (opt11) from SFTSV(SPL077A)__AB985304.1__GP
  source 1..3222: mol_type = other RNA
atgatgaaggtaatatggttcagctcgctcatctgcttggtaacgcagtgcagcggcgacacgggacccataatatgcgcaggccctatacacagtaacaaatccgccaacatcccgcatctgcttggctactcggaaaagatatgccaaatagacagactgatccacgtgagctcatggctacgaaaccacagtcagttccaagggtacgttggccaacgagggggccgaagccaagtatcttactttccagcagaaaacagctattcacgctggtcgggtctgctaagcccctgtgacgcagattggctcggaatgctagtagtaaagaaggcaaagggttcagacatgatcgtgccaggtccctcgtacaaaggcaaagtatttttcgaacggccaacgttcgacggctacgtcggatgggggtgcggatcaggaaagagcagaaccgaaagcggggaattatgctcaagtgacagcggtaccagcagcggcctcctaccgtcggaccgggtactatggatcggagacgttgcatgccaacccatgactccaatacctgaggagaccttcctcgaactcaaatcattcagccaaagtgagttcccagacatatgcaaaatcgacggcatagtattcaaccaatgtgagagcgagagcctgccacagcctttcgacgtcgcatggatggacgtcggacacagccacaaaataattatgagagaacacaaaaccaaatgggtccaagaatcaagctcgaaagatttcgtatgctacaaagagggcaccggcccatgctcagaatcagaggaaaagacctgcaagacctcaggaagctgccggggcgacatgcagttttgtaaagtcgctggatgcgaacacggagaagaagccagcgaagcaaaatgccgctgcagcctcgtccacaaacccggcgaagtagtggtctcatacggtggcatgcgagtacgacctaaatgctacggcttttcaagaatgatggctacactggaagtcaaccctcccgaacaaaggatcgggcaatgcaccggctgtcacctggaatgcataaatggcggcgtccgactgatcacgctcacaagcgaacttaagagcgcgacggtgtgcgcctcccacttctgcagctcggctacatcaggcaaaaagagcacggaaatacaattccactcaggaagcctagttggaaaaaccgcaatccatgtcaagggagccctcgtggacggcacggagttcacattcgaaggttcgtgcatgttccccgacggatgcgatgccgtagattgcaccttttgcagagagttcctgaaaaacccacaatgctaccccgccaagaaatggctattcataataatcgtcatcctcctcggctacgcaggcctgatgctgctgacaaatgtgcttaaagcgataggagtatggggaagctgggtcatcgcaccggtcaaactaatgttcgcaatcctaaagaaactgatgcgcagcgtcagctgcctgatgggaaaactgatggatcgcggccgccaagtcatacacgaagaaataggagaaaacagagaagggaaccaagacgacgtacggatcgagatggctcgcccaagacgcgtgaggcattggatgtacagcccggtcatactcactatactagccataggcctagctgagggctgcgacgagatggtacacgccgactccaaactggtcagctgcaagcaaggatcaggtaacatgaaagaatgcgtaacaacaggcagagccctactgcccgctgtcaacccaggccaggaagcctgcctgcacttcacggccccaggctcaccagactcgaaatgtctcaaaatcaaggtaaagcggatcaacctaaaatgcaaaaagagcagcagctatttcgtcccagatgcccgaagccgatgcacgagcgtaagacgatgtaggtgggcaggagactgccagtcagggtgcccctcccacttcaccagcaacagcttttccgatgactgggcaggcaagatggaccgcgccgggctcggattctcaggctgcagcgacggatgcggtggcgcggcctgcggctgcttcaacgctgcaccctcatgcattttctggcgaaaatgggtcgagaacccccacggcatcatatggaaagtctcaccatgcgccgcatgggtcccaagcgcagtaatcgagctcaccatgcccagcggagaggtccgcacattccacccaatgagtagcatccccacgcaagtatttaaaggcgtatccgtaacatacctcggcagcgacatggaagtatccggattaactgatttatgcgaaatcgaggaactcaagtccaagaagctagccttagcgccctgcaaccaagcaggcatgggcgtcgtcggtaaagtaggggaaatacaatgtagctcagaggagagcgcgcgcacaatcaagaaagacggatgtatctggaacgccgacctagtgggcatagaactaagggtagacgacgcggtctgctactcaaaaatcacctcggtagaggccgtcgccaactacagtgccatacccaccaccatagggggcctgaggtttgaacgatcccacgactcacaaggaaaaatatcgggctcaccactagacataacagcgatcagaggctcattctcagtcaattaccgagggctgcgtcttagcctcagtgagatcacagcaacgtgcaccggagaagtcacaaacgtgtccggctgctacagctgcatgacaggcgcaaaggtatctatcaagctccacagtagtaaaaactcaacagctcacgtgcgatgcaaaggggacgagactgccttctcagtcctcgagggagtccactcctacacggtgagtctcagctttgaccacgcagtagtagacgaacaatgccaattaaactgcgggggacacgaatcacaagtcaccctcaaagggaacctgatattcctcgacgtaccaaaattcgtcgacggatcatatatgcagacctaccacagctcagtaccgaccggagccaacatacccagcccaactgactggctgaacgcactattcggcaacggcctatccaggtggatactcggcgtcataggcgtgctgctgggaggactagccctcttcttcctgatcatgagccttttcaaacagggcaccaagcaagtcttccgaagccgaaccaaactcgcctaa

SEQ ID NO: 16477 - RNA, 3222 nt, synthetic construct
  misc_feature 1..3222: note = derived and/or modified CDS sequence (opt11) from SFTSV(SPL084A)__AB985307.1__GP
  source 1..3222: mol_type = other RNA
atgatgaaagtcatatggttcagctccctaatctgcctagtcatccaatgcagtggggacaccggcccgataatatgcgcgggtccaatccactcgaataaatcagctaatataccccatctgcttggatattcagagaagatctgccaaatagaccgactaatacacgtaagcagctggctccgaaaccactcgcagttccagggatacgtgggtcaacgcgggggacggtcccaagtatcctacttcccagccgaaaactcatattcacgatggtccggactactctccccctgcgatgccgactggctaggaatgttggtcgtcaagaaagccaaagggagcgacatgatagtcccaggcccctcgtacaaaggtaaagtattcttcgaacgacctacctttgacggctacgtaggctggggctgcggctccggcaagagcagaaccgaaagcggagaactatgctcgagtgactccgggacctcgagtggactactgccttcagacagggtactatggataggcgacgtcgcctgccaacccatgacaccgatccccgaagaaacattcctcgagctaaagagcttcagccagtccgagttcccagacatatgcaaaatcgacggcattgtattcaaccagtgcgaaagtgagtcactgccccaaccattcgacgtcgcctggatggacgtcgggcactcacacaaaatcataatgagggaacacaaaacaaaatgggtacaggagtcatcatctaaagacttcgtttgctacaaagaggggacgggcccatgctcagaaagcgaagagaagacgtgtaagacatcaggaagttgcaggggcgacatgcaattctgcaaagtggccggttgtgaacacggggaagaggcctccgaagcaaaatgccgatgcagcctagtacacaaacccggagaagtggtagtctcctacggcggaatgcgcgtccgcccaaagtgctacgggttctccagaatgatggccaccctggaagtaaatcccccagaacaacgaatagggcaatgtacagggtgccaccttgagtgtataaacggcggcgtacgcctcattactctgacgtcagaacttaagagcgcaaccgtgtgcgctagccacttctgcagcagcgcaacctcaggtaagaaatccacagaaatacagtttcacagtggctccctagttggcaaaaccgcgatacacgtaaaaggcgccctagtagacggaaccgagttcacattcgaaggtagctgcatgttccccgacggatgtgacgcagttgactgcaccttctgcagagagttcctaaagaacccacaatgctacccagcaaagaaatggctattcatcatcatcgtaatactactcggttacaccggactaatgctactaacaaacgtgctcaaagcaataggagtctgggggagttgggtaatcgcaccggtaaagctaatgttcgcaatcctaaagaagctaatgcgctcggtctcatgcctcatgggaaaactaatggaccgcggacgccaagtgatccacgaagaaatcggcgaaaaccgagaaggaaaccaagacgacgtgcgaatcgaaatggcacgacccagacgagtccggcactggatgtatagcccggtcatcctcaccatcctagcaatcggcctcgccgaaggttgtgacgagatggttcacgccgactccaagttagtcagttgcaagcaaggcagcggaaacatgaaggaatgcgtaacaacgggcagagccttgctacccgcagtcaaccccggccaagaagcatgcctgcacttcacagccccaggaagccctgattcaaagtgcctaaaaataaaagtgaagcgtataaacttaaaatgcaaaaagtcatcgagctacttcgtgccggacgcccggtccaggtgcacgagcgtgaggcgctgccgatgggccggtgactgtcagtccggctgcccgagccatttcacgagtaacagtttcagcgacgactgggcagggaaaatggaccgggccggtctcggcttcagcggatgtagcgacggctgcggaggggccgcatgcggctgcttcaacgccgctccctcctgcatcttttggagaaaatgggtggagaatccacacggaatcatatggaaagtaagcccatgcgccgcatgggtaccaagcgcagtcatagagctaacaatgccaagcggagaagttcgtacgttccacccaatgtcgggtataccaacgcaagtcttcaaaggagtctcggtcacgtacctcgggtccgatatggaagtatccggactaacagacctatgcgaaatagaagaactaaaaagcaagaaactcgcactagcgccctgcaaccaagcaggtatgggcgtagtgggtaaagtcggagaaatccaatgtagcagcgaagaaagcgcgcgcaccatcaagaaagacgggtgcatctggaacgccgacctagtcggtatagagctaagagtagacgatgcagtatgctactcaaaaattacatccgtcgaggccgtagccaattattcagccatcccaacgaccatcggcggactccgctttgagcgcagccacgactcccaaggcaaaatctcgggcagccccctggacataacagcaatacgcggatccttcagcgtaaattacagaggactaagactaagcctgagcgaaatcacggcaacctgcaccggcgaagtcacaaacgtcagcggctgttacagctgcatgacaggcgccaaggtgagcatcaaactacactccagcaagaactcaaccgcccacgtacgatgcaagggggacgaaaccgcgttctcagtccaggaaggcgtccattcatacaccgtaagtctatccttcgaccacgccgtcgtcgacgagcagtgccagcttaactgcggaggccacgaatctcaagtcacgttaaaaggaaatctcatattcctcgatgtgccaaaattcgtagacggcagttacatgcaaacgtaccacagctcggtcccaaccggagccaacatcccaagcccaaccgactggctcaacgctctatttggcaacggcctttccaggtggatcttaggcgtcataggcgtcctcctgggcgggctagcactattctttctaataatgagtttattcaaactggggaccaaacaagtcttccgatccaggaccaaattggcatag

SEQ ID NO: 16478 - RNA, 3222 nt, synthetic construct
  misc_feature 1..3222: note = derived and/or modified CDS sequence (opt11) from SFTSV(SPL086A)__AB985308.1__GP
  source 1..3222: mol_type = other RNA
atgatgaaagtcatttggttcagctcgcttatatgccttgtcatacaatgctcaggcgacacaggcccgatcatatgcgccggacccatccacagcaacaagagcgccaacatcccacatctgctaggctacagcgagaaaatatgccaaatagacagactcatacacgtaagttcatggctccgaaaccacagccaattccaggggtacgtgggccaacgcgggggacgtagccaggtctcatacttcccagccgaaaacagctactccaggtggtcaggattactttcaccgtgtgacgccgactggctaggaatgttagtagtgaagaaagcaaaagggagtgacatgatcgtccccggcccctcctacaaaggaaaagtcttcttcgaacgcccgacctttgacggatacgtcggatggggctgcggcagcggaaaatcccgcaccgaaagcggcgaactatgttcctcagactccggaactagcagcggcctactcccctccgacagggtcctatggataggtgacgtagcttgtcagcctatgacacccattccagaggaaaccttcctcgaactaaagagcttcagccaaagcgagttccccgacatatgcaaaatcgacggcatagtgttcaaccaatgcgaatcagaatccctaccccaacccttcgacgtcgcctggatggacgtcggacacagccacaaaatcatcatgcgcgagcacaagacgaaatgggttcaggaaagcagctccaaagattttgtatgctacaaagaaggcacaggcccatgctccgagagcgaggagaagacctgcaaaacatcaggctcatgccggggcgatatgcaattctgcaaagttgcgggctgcgaacacggagaagaagcaagcgaagcaaaatgccgatgcagtctcgtgcacaaaccaggcgaggtagtcgtatcatacggaggcatgcgagtgcgcccaaaatgctacggattctcgcgcatgatggccaccctagaagtcaacccaccagaacagcgaataggacaatgcaccgggtgccacctcgagtgcatcaacggaggagtgaggctcataacgctcacatccgagctaaaaagcgcaacagtatgcgccagccacttctgctcatcggccaccagcggcaagaaaagcacagaaattcaattccacagcggatccctagtgggcaaaaccgcgatacatgtcaaaggagcattagtcgacggcacagaatttacgttcgaaggatcatgcatgttcccagacggatgcgacgcagtagactgcaccttctgccgtgagttcctcaagaatccacaatgctacccggccaagaaatggttattcatcatcatagtgatactcctgggatacgcaggcctaatgctactcacgaacgtattaaaagcaatcggagtatggggctcgtgggtcatagccccagtaaaattaatgttcgccataatcaaaaagctcatgcggagcgtctcgtgcctcatgggcaaactcatggaccgcggacgccaagtcatacacgaggaaatcggtgaaaaccgcgaaggaaaccaggatgatgtacgcatcgaaatggcacgtcccagaagagtccgacactggatgtatagcccagttatattaacaatactggctatcggcctcgccgaaggctgcgacgaaatggtgcacgcagactccaaattagtatcctgtaagcaaggcagcggcaacatgaaagaatgcgtcaccacaggccgcgccctgctccccgcggtcaacccaggccaagaggcttgtctgcatttcaccgcccccggaagcccggacagcaaatgcctcaaaatcaaagtaaaaagaatcaacctgaagtgcaagaaaagctcgagctacttcgtacccgacgctcgaagccgttgcacatcagtacgaagatgccgctgggcgggagactgccaaagcgggtgcccgagccacttcacctccaactcgttctccgatgactgggccggaaaaatggaccgcgcagggctcggcttctccggctgcagcgacggatgcggcggcgcagcctgcgggtgcttcaacgctgcccccagctgcatattctggcggaaatgggtggagaacccccacggaatcatctggaaagtttcaccctgcgccgcatgggtgccttcagccgtaatagagctcacgatgccatccggcgaagtccgtacgttccacccaatgagtggaatccccacccaagtattcaaaggagtgagcgtgacatatcttggctcggacatggaagttagcggactcacggatctatgcgaaatcgaagaactgaaatctaagaaactagccctagcaccctgcaatcaagcgggcatgggcgtcgtaggtaaagtaggcgagatacaatgctcgagcgaagaaagcgcccgaacgatcaagaaagacggctgcatctggaacgcagacctagtaggaatagagctccgagtcgacgacgccgtctgctactcaaaaataacctccgtagaagccgtagcgaattattctgccatccccaccacaatcggaggcctccgcttcgaacgctcccacgactcccaaggcaaaatctcgggtagccccctggacatcacagccatacgaggatcgttcagcgtcaactacagaggactacgtcttagtctgtcagagattacagccacatgcaccggcgaagtcacaaatgtatcagggtgctattcctgcatgacgggcgctcgagtctccatcaaattacacagctccaaaaactcaaccgcgcacgtccgctgcaaaggagacgaaaccgcattctcggtacttgagggcgtccactcatacacagtctctcttagcttcgaccacgccgtcgtcgacgaacaatgccaactaaactgcggaggccacgaatcacaagtaaccctgaaaggcaacctaatcttcttagacgttcccaaattcgtagacggaagctacatgcaaacataccacagtagcgtcccaacaggagccaatatcccgtcccccaccgactggctcaacgcactattcggcaatggactatccaggtggatcctcggggtaatcggagtactgctaggtgggctagcgctattcttcctaatcatgtctctattcaaactcggaacaaaacaggtcttccgcagccgaacaaaactagcctga

SEQ ID NO: 16479 - RNA, 3222 nt, synthetic construct
  misc_feature 1..3222: note = derived and/or modified CDS sequence (opt11) from SFTSV(SPL087A)__AB985309.1__GP
  source 1..3222: mol_type = other RNA
atgatgaaggtaatatggttcagcagtctcatatgcctagtaatccaatgtagtggcgacagtggaccaatcatatgcgcagggccaatacactcaaacaaaagcgctgacataccacacctactcgggtactcagagaaaatctgccaaatagacagactcatccacgtttcaagttggctacgaaatcacagccaatttcaaggatacgtcggtcagcgcggaggacgcagccaggtcagttactacccagccgaaaactcctacagccgatggagcggattactgtcaccctgcgacgcggactggctaggaatgctagtcgtaaagaaggctaaaggttccgacatgatcgtcccaggcccaagctacaaaggcaaggtcttcttcgaaagaccaacattcgacggatacgtggggtggggatgtggtagcggaaaaagccgatccgaatcaggagagctgtgctcgtcagacagcggaacctcgtcagggctgctaccgagtgaccgagtactctggatcggggacgtcgcctgccagcccatgacccccataccagaagaaaccttcctagaactaaagagcttctcacagtcagagttccccgacatctgcaaaatcgacggcattgtcttcaatcagtgcgaaggagaaagcctgccgcagccattcgacgtcgcctggatggacgtaggccactcacacaaaataataatgcgtgaacacaaaactaaatgggtccaagaatcgagcagcaaagactttgtatgctacaaagaaggaaccggcccttgttccgaatcggaagagaaaacatgcaagacctcaggctcgtgcagaggtgatacccaattctgcaaagtagcggggtgcgaacacggagaagaagcctcagaagcgaagtgcagatgcagcctcgtccataaacccggcgaagtcgtcgtcagctacggcggaatgcgcgtccgacccaagtgctacggattctcccgcatgatggcaaccctcgaagtcagcccacccgaacaacgaataggacaatgtactggctgccacctagaatgcattaacggaggagtacgcttgatcacattaaccagcgaactaaagtcagcgacagtatgcgccagtcatttctgctcatccgccacctccggaaagaaatccaccgaaatccaattccactcaggctccctcgtcgggaaaaccgccatccacgtaaaaggagcgctcgtagacggcaccgaatttacgttcgaaggatcctgcatgttcccagatgggtgtgacgcagtagactgcaccttctgccgcgagttccttaaaaacccccagtgctacccagcaaagaaatggttattcatcataatcgtgatactgctaggctacgcggggctaatgctgctcacgaacgtgctgaaagccataggggtgtggggcagctgggtgatagccccggtaaaactcatgttcgccatcatcaagaaactcatgcgaacagtatcctgcttgatgggaaaactgatggaccgcggacgacaggtaatacacgaagaaataggagaaaatcgggaaggaaacagggacgacatccgaatcgagatggcacgaccacgcagagtccggcactggatgtactctcccgtgattctgaccatactagccatcgggctagccgaaggctgtgacgaaatggtccacgccgacagtaaattagtctcgtgtagacaggggagcggaaatatgaaagagtgcgtgacaacaggccgggccctgctcccagccgtaaacccaggccaagaggcatgcctccacttcacagccccaggcagccccgactccaaatgcctcaaaatcaaagtgaaaaggataaacctaaaatgcaagaaatcctcctcctacttcgtgcccgacgccagatcgagatgcaccagcgtaagacgatgccgatgggcaggagactgccaatccggctgcccaccccacttcacgagcaacagctttagcgacgactgggctggaaaaatggacagggctggactcggctttagcggctgcagcgacggctgcggcggagcagcatgcggatgcttcaacgcagcaccctcatgcatcttctggcgaaaatgggtcgagaacccccacggaatcatatggaaagtctcgccctgcgcagcctgggtaccctcggccgtaatcgaactgacaatgccatccggtgaagtacgaaccttccaccccatgagcgggattccaacacaggtcttcaaaggagtctccgtaacataccttggatccgacatggaagtcagtggactcacagacctctgcgagatagaggaactgaaaagcaagaaactagcccttgcaccttgcaaccaggccggaatgggagtcgtgggaaaagtaggtgaaattcagtgcagcagtgaagaatccgcacgaacgatcaagaaagacggatgcatctggaatgcggacctcgtcggaatcgagctgcgagtcgacgacgctgtgtgctacagcaaaatcacatccgtcgaggccgtagccaattactccgccattcctaccaccataggcggattgagattcgaacgctcgcatgactcgcaagggaaaatatcaggttcgcccctcgatattactgccataagaggcagcttctcagtaaactacaggggactccgcctaagcctgagcgaaatcacagccacatgcaccggagaggtaacgaacgtcagcggatgctacagctgcatgacaggagcgaaagtatcaatcaaactacattcaagcaaaaactcaacagcacacgtaagatgcaaaggagacgaaacagccttctccgtactcgagggagtccactcctacacagtgtcactgtccttcgaccacgcagtagtagacgaacggtgccaactgaactgcggcggccacgaatcgcaagtaaccctaaaaggcaacctaatattcctggacgtcccaaaattcgtcgacggttcctacatgcagacctatcacagcacagtacccaccggagccaacataccaagcccaacagactggctcaacgcactctttgggaacggcctcagtagatggatcctaggagtaataggcgtactcctaggcggcctggccctcttcttcctgatcatgagcctattcaaactcggtacaaagcaggtcttcagaagccgtacgaaactagcctaa

SEQ ID NO: 16480 - RNA, 3222 nt, synthetic construct
  misc_feature 1..3222: note = derived and/or modified CDS sequence (opt11) from SFTSV(SPL090A)__AB985311.1__GP
  source 1..3222: mol_type = other RNA
atgatgaaggtcatatggttcccatctctgatatgtttagtaatacgttgcagcggcggcacaggcccaataatatgcgcgggcccaatccacagcaacaaaagtgccaacatcccacatctgctaggttattccgaaaagatctgccaaatcgaccgtcttatccacgtcagctcatggctacgtaaccactcacaattccaaggatacgtcggccagcgcggagggaggtcacaagtttcatacttcccagcagaaaacagctacagccgatggtcaggcttgctttcaccatgtgacgcagactggctgggaatgctagtagttaagaaagcccggggatccgatatgatagtccccggcccatcatacaaaggtaaagtattcttcgaacgccccactttcgacgggtacgtaggatggggatgtggaagtggaaaaagccgaaccgagtcaggggaactctgctccagcgactccgggacatcaagcgggctactgccctccgaccgggtactgtggatcggcgacgtagcctgccaacccatgacccccatcccagaagagacctttctagaactcaagagtttcagccaatcagagttccccgacatatgtaagatcgacggcatagtattcaaccaatgcgaaagcgaaagcctaccccaaccgttcgacgtagcctggatggatgtcggacactctcacaagatcataatgagagaacacaaaaccaaatgggtccaggaatcaagctccaaagacttcgtatgctacaaagagggcacaggcccctgctcagaaagtgaagagaaaacatgcaaaacatcaggaagctgccgcggcgacatgcaattctgcaaagtcgccggatgcgagcacggggaagaggcctcggaagcaaagtgtcggtgtagcctcgttcacaagccaggcgaggtagtagtatcgtacggaggtatgagagtgcgcccgaagtgctacggattctcccgcatgatggccaccttagaagtgaacccaccagagcaaagaataggacagtgcacgggatgtcacctggagtgcataaacggaggagtaaggctgataacacttaccagtgagctcaaaagcgcaacagtctgcgcgagccacttctgctcctcggcaaccagtggcaaaaagagcaccgaaatccaattccactcaggatcgctagtaggaaagacagcaatccacgtcaagggcgccctagtagacgggacggagttcaccttcgaaggttcatgcatgttccccgacggctgcgacgcagtagactgcaccttctgccgagagttcctcaaaaacccacaatgctacccagcaaagaaatggttattcatcatcatcgcaatccttctcggatacgcgggactaatgctgctaaccaacgtactcaaagccattggcgtatggggctcctgggtgatagcgccagtaaagctaatgtttgcaatcataaagaaactcatgagatcggtctcatgcctcatgggaaaactaatggacagggggaggcaagtgatacatgaagagatcggtgaaaaccgagaaggcaatcaagacgacgtccgcatagagatggcccgccctagaagagtccgccactggatgtactccccagtcatcctaaccatcctggccataggcctcgcagagggctgcgacgaaatggtacacgcagacagcaagctagtgtcctgtaaacaagggagcggcaacatgaaagaatgcgtgaccacaggccgcgccttgctaccggcagtaaaccccggacaagaggcgtgcttgcacttcaccgctccaggaagcccagacagcaaatgcctcaaaataaaggtaaaacgcatcaacctcaaatgcaagaaaagcagctcatacttcgtaccagatgcgcggagcagatgtacctccgtaagacgatgcagatgggccggagactgccagtccgggtgcccgagccacttcacatcaaactccttcagcgacgactgggcaggaaaaatggaccgcgctggactgggtttcagcggatgcagtgacggctgcggcggtgcggcctgcgggtgcttcaacgcagccccctcatgcatattctggagaaaatgggtcgagaacccccacggaataatatggaaagtatcgccctgcgccgcatgggtaccctcagcagttatagagctaaccatgccgtccggagaagtacgcacgttccacccaatgtccggaataccaacccaagtattcaaaggggtttccgtaacatacctagggtcagatatggaagtctccggactcaccgacctctgtgaaatcgaggaactaaaatcaaagaagctcgccctagcgccatgcaaccaagcgggaatgggagtggtgggaaaagtcggtgaaatacaatgcagctcagaggaaagcgcacgcacaatcaagaaagacggatgcatatggaacgccgacctcgtcgggatcgagctccgggtagacgatgcagtctgttactcaaaaatcaccagcgtcgaagccgtagccaactactccgccatacctacaacaatcggcggactacgattcgagcgtagtcacgactcccaaggcaaaatctctggctcgccgctagacataaccgcgatacggggttcattctcggtcaactatcgtgggctacggctaagtctcagcgagataacagccacctgtaccggcgaagtaacgaacgtatccggatgctatagctgcatgaccggggccaaagtatccattaaactccactccagcaaaaacagcacagcacatgtccgatgcaaaggggacgagacagctttcagcgtactagaaggagtccactcttacaccgtatcattgtcatttgaccacgccgttgtcgatgaacaatgccaactcaactgcggcggacacgaatcacaagtaaccctgaaaggcaacctcatcttcctcgacgtacctaaattcgtcgacgggtcctacatgcagacctaccacagctccgtcccgacgggagcaaatatacccagcccaacggactggctgaacgccctcttcggaaacggactatccagatggatcctaggagttataggagtgctcctaggcggcctcgcactcttcttcctgatcatgtccctattcaaacttggtaccaaacaagtattccgaagccgcaccaaactcgcataa

SEQ ID NO: 16481 - RNA, 3222 nt, synthetic construct
  misc_feature 1..3222: note = derived and/or modified CDS sequence (opt11) from SFTSV(SPL097A)__AB985312.1__GP
  source 1..3222: mol_type = other RNA
atgatgaaagtgatatggttcagctcgctcatatgcctcgtcatccaatgctccggagacaccggcccgatcatatgcgccggaccaatccactcaaacaaatcagccgacataccccacctcttaggatactcagagaaaatatgccagatagacaggctcatacatgtcagcagctggctacgcaaccacagtcaattccaaggatatgtagggcagcgaggcggccggtcccaagtctcatactacccagcagaaaactcctacagccggtggtcaggcctcctatcaccgtgcgacgcagactggctcggtatgctggtcgtgaagaaagcaaagggcagcgacatgatagtacccggtcccagttacaaaggcaaagtattcttcgaacgacccaccttcgacgggtacgtcggttggggttgcggctcgggtaaatcgcgaaccgaaagcggagaactatgtagtagcgactcgggcacatcgtctggactcctaccctcagacagagtcctatggatcggcgacgtcgcctgccaaccaatgacacccataccggaagaaacatttctggagctcaagagcttcagccaatctgagttcccagacatatgcaaaatagacggaatcgtattcaaccaatgcgagagcgaatcactgccccaacccttcgacgtagcctggatggacgtcgggcacagccacaaaataattatgcgtgagcacaagacaaaatgggtgcaagaatcatctagcaaagactttgtatgctacaaacaaggaacaggcccctgcccggaatcggaagagaaaacctgcaagacaagcggatcatgtaggggcgatatgcaattttgcaaagtcgctggatgtgaacacggagaagaagcatccgaagctaagtgccgatgcagcctcgtccataaacccggcgaagtagtagtaagttatggaggaatgcgcgtacgaccaaagtgctacggcttctcccggatgatggcgacgctggaagtgaatcccccagaacagcgcataggacaatgcacaggctgccatctcgagtgcgtaaacggaggcgtcagactaataactctaacatcagagctaaaaagcgccaccgtatgcgcatcccacttttgcagctcagcaacctcaggcaagaaaaacaccgaaatccagttccacagcggatcattagtcggaaaaacggctatccacgtaaaaggagccctattagacggcaccgagttcacattcgaaggctcctgtatgttcccggacggctgcgacgcagtcgactgtacattctgccgagagttcctgaaaaacccccagtgctaccccgcgaaaaagtggttattcatcataatcgtaattcttctcggatacgcgggcctcatgctcctcacaaacgtcctcaaagccatcggcgtctggggatcgtgggtcatagcaccagtgaaactgatgttcgccataatcaaaaagctaatgcgcagcgtgtcctgcctcatgggaaaattgatggacagaggccgacaagtaatccacgaagaaatcggagaaaacagagaaggaaaccaggacgacgtacgcatcgaaatggcccgaccccgccgggtgcgacactggatgtatagcccggtaatcctgacaatattggcagtaggcctcgccgaaggatgtgatgagatggtacacgcggactcaaagttagtgagctgcaagcaaggctcaggcaacatgaaggaatgcgtaacgacaggccgcgcactgcttccggccgttaacccagggcaggaagcatgcctccacttcacagcaccggggtcgcccgatagcaaatgcctcaaaataaaagtcaaaaagatcaatctgaaatgtaaaaagagctcgagctacttcgtaccggacgcacgctcacgatgcacctcagttaggaggtgtagatgggccggagactgccaaagtggatgcccaagtcacttcacctccaactcattcagtgatgactgggccggaaaaatggacagagcaggcctcggcttctccggctgttcagacggctgcgggggagctgcgtgcggatgcttcaacgccgccccatcatgtatattctggagaaaatgggtagagaacccccacgggatcatatggaaagtctccccctgtgctgcctgggtgccaagtgcagttatagaattgacgatgccgagtggcgaagtccgaacctttcaccccatgagcggcataccgacccaggtgttcaagggagtcagcgtcacgtacctaggctcggacatggaggtgagcggcctaaccgatctgtgcgaaatcgaggagctcaagagcaagaaactggcactggccccctgcaaccaagccggcatgggagtagtaggaaaagtcggcgaaatccaatgcagcagcgaagagagcgcgcgaacaataaagaaagacgggtgcatctggaacgccgacctcgtaggaatcgaactgagagtagacgacgcagtgtgctactccaaaatcacaagcgtggaggccgtggcgaactacagcgcaatccccacaacgatcggcggcctaaggttcgaacgaagccatgactcccagggaaaaatctccgggagcccactagacatcaccgcaataagaggatctttcagcgtcaactatcgaggcctccggctaagcctgagcgaaatcaccgcaacatgcacaggagaggtaactaacgtctccggatgttacagctgcatgaccggcgccaaagtaagcataaaactgcacagcaacaaaaacagcacagcacacgtgcgctgcaaaggcgacgaaacagcattcagtgtgctagagggagtccacagctacaccgtcagcctctcattcgaccatgctgtcgtcgacgaacagtgccagctcaactgcggaggacacgaaagccaggtcactctaaaaggcaacctaatcttcctcgacgtcccaaaattcgtcgacggttcttacatgcaaacgtaccacagctcagtaccgaccggcgctaacataccgagtcccaccgactggctaaacgccctgttcggcaacggactgtccaggtggatactaggcgtcataggagttcttctcggcggactcgcactcttctttctaatcatgtccctgtttaaactcggcacaaaacaagtcttcagatccagaaccaaactagcctga

SEQ ID NO: 16482 - RNA, 3222 nt, synthetic construct
  misc_feature 1..3222: note = derived and/or modified CDS sequence (opt11) from SFTSV(SPL100A)__AB985313.1__GP
  source 1..3222: mol_type = other RNA
atgatgaaagtcatctggttctcaagcctaatatgcctggtcatccaatgcagcggcgacacaggaccaatcatctgtgcaggcccaatccattcaaacaaatccgccgacatcccccacctactcggatactccgagaaaatatgccaaatagacagattaatccacgtatcctcctggctacgaaaccacagccagttccaaggatacgtcggacagcgcggcggcaggtcacaagtatcctactacccggcagaaaacagctatagccgctggagcggtctactaagcccttgtgacgccgactggctaggcatgctcgtcgtgaagaaagctaaaggatcagacatgatcgtaccgggaccaagctataaaggcaaagtattcttcgaacgacctaccttcgacggctatgtaggatggggatgcgggtcgggaaagagcagaacagaatcgggagagctctgctcctcagactcaggcacatcatccggtctactccccagcgaccgagtactatggataggcgacgtggcttgccagcccatgaccccgatacccgaggaaaccttcctagaattaaagtccttctcccaatcagaatttcccgacatctgcaaaatagacggaatcgtattcaaccaatgtgaaagcgaatcactccctcagcccttcgacgtcgcctggatggacgttggccacagccacaaaataatcatgcgagaacacaaaactaaatgggtacaggaatcctcgagcaaagactttgtatgctacaagcaaggaacagggccttgcagcgaaagcgaagagaaaacatgcaaaacatccgggtcgtgccgaggagacatgcaattctgcaaagtagcaggctgtgaacacggagaggaggcatcagaggcgaaatgccgatgcagcctcgtacacaagcccggcgaagtggtcgtaagctacggaggcatgcgcgtcagaccaaagtgctacgggttcagccgcatgatggctacactagaggtcaatcccccagaacaacgcatagggcaatgcacgggctgccacctcgaatgcgtaaacggcggagtcaggctcatcaccctcacctcagaactaaaatcggccacagtatgcgcttcacacttctgcagctccgccacctccggcaagaaaagcacagaaatacaattccactcaggcagcctggtgggaaaaaccgccatccacgtgaaaggcgcactcctcgacgggacagagttcacctttgaaggatcgtgtatgttcccagacggttgcgacgctgtcgactgtacattctgccgggagttcctcaaaaacccacaatgctacccagcaaagaaatggctattcatcataatagtcatcctcctcggatacgcagggctcatgctcttgaccaacgtgctcaaagcaatagccgtctgggggtcctgggtaatcgcccccgtcaaactaatgttcgcaataattaagaaactcatgcgctcagtttcctgccttatgggcaaactaatggacaggggccggcaagtaatacacgaggaaataggggaaaacagagagggaaaccaggacgacgtccgaatcgaaatggcgcgacctcgccgagtaagacactggatgtacagcccagttatacttacagttctcgcggtcggcttagcagaagggtgcgacgaaatggttcacgcagactccaaacttgtgagctgcaagcagggcagcggcaacatgaaagagtgcgtcaccacggggcgcgccctgttacccgcagtgaatcccggccaagaggcgtgcctccacttcacagcgcccggaagcccagactccaaatgtctaaaaataaaagttaagaaaatcaaccttaaatgcaagaaatcgtcttcctacttcgtccccgacgccagatcccgctgcacctcagtcagaagatgtcgatgggccggggactgccagagcggatgccccagccacttcaccagcaacagcttctcggacgactgggccggaaaaatggacagagcgggcctcggattcagtgggtgctccgacgggtgcggcggagccgcatgcggatgcttcaacgcagcaccaagctgcatcttctggaggaagtgggtcgagaatccccacggcatcatatggaaagtcagtccatgcgcggcatgggtaccgtcagcagtcatcgaactcacaatgccaagcggtgaagtaagaacattccaccccatgagcggaatacccacacaagttttcaaaggggtctccgtgacgtatctcggcagcgacatggaagtctccggactgaccgacctttgcgagatcgaggaactaaagtcaaagaaactggccctggccccatgtaaccaggcaggaatgggggtcgtaggcaaagtcggagagatccaatgttcgtccgaggagagcgcacgcaccatcaagaaagacggatgtatatggaatgccgacctcgtcggaatagaactccgtgtagacgacgcagtctgttactcaaaaattacctccgtagaagcagtggcaaactacagcgcaataccaaccaccataggaggcctcagattcgaaagaagccatgactcacaaggcaaaatcagcggatcgccactagacatcaccgcaataagagggagcttctcagtcaactacaggggcctcaggctaagcctatccgaaataaccgcgacatgcaccggcgaagtcacaaacgtaagtggctgctactcgtgcatgactggcgccaaagtatcaattaaactccactcaaataaaaacagcaccgcccacgtacgatgcaaaggagacgaaactgcatttagcgtgctagaaggcgtacacagctacactgtctcactcagcttcgatcacgcagtagtcgacgagcagtgccaactcaattgtggcggacatgaatctcaagtgaccctaaaaggaaacctcatatttttggacgtacccaaattcgtggacggatcctacatgcaaacataccactcttccgttcctaccggcgctaacatcccctccccaacggactggctcaacgcactcttcggcaatggcctatcgcgatggatcctgggcgtcataggagtattattgggaggcctcgcactattcttcctaatcatgtccctctttaagctaggtacgaaacaagtcttccgctcacgaacaaagctcgcgtaa

SEQ ID NO: 16483 - RNA, 3222 nt, synthetic construct
  misc_feature 1..3222: note = derived and/or modified CDS sequence (opt11) from SFTSV(SPL106A)__AB985316.1__GP
  source 1..3222: mol_type = other RNA
atgatgaaggtaatatggttcagctcactaatttgtctggtgatccaatgctcaggagacacaggcccgatcatctgcgcgggacccatccacagcaacaaatccgccaacataccacacctactaggctatagcgagaaaatatgccaaattgatcgactaatccacgtaagtagttggctgagaaaccactctcaatttcaaggatatgtaggccaaagaggaggcagatcgcaagtctcctacttcccagccgaaaactcctactcacgatggagcggcctactcagcccatgtgatgcagactggcttggaatgctcgtggtcaaaaaggccaaaggctcggacatgatcgtccccggcccttcctacaaaggaaaggtcttcttcgaacgccccaccttcgacggctacgtcggctggggctgcggcagcggcaaaagccgaaccgaaagcggcgaactttgctcctcggacagcgggacctcgagcgggctactgccaagcgatcgcgtcctatggataggagatgtcgcatgccaaccgatgacccccatcccagaagaaaccttcctggaactcaaatcattcagccaaagcgagttcccagacatttgcaagatagacggcatcgtattcaaccagtgcgaaagcgaatccctaccccaacctttcgacgtagcctggatggacgtagggcacagccacaaaatcatcatgcgcgaacacaagaccaagtgggtgcaggaaagcagctccaaagacttcgtctgctacaaagaaggcacaggcccatgctctgaatccgaggaaaagacatgcaaaacctccggatcgtgtcgcggagatatgcagttctgcaaagtcgcggggtgtgaacacggagaagaagccagtgaggccaaatgtaggtgctccctggtgcacaaacccggcgaagtcgtagtatcatacggcggaatgcgagtccgcccaaagtgctacggattcagccgcatgatggcgacgctagaagtaaacccacccgaacaacggatcggccagtgcaccggctgccacttagaatgcatcaacggcggcgtacgactgatcacacttacatcagaactaaagtccgccaccgtgtgcgccagccacttctgctcctcagccacatcaggcaaaaagagcaccgaaatacaattccactcgggctccctcgtcggaaaaacagcgatccacgtaaaaggcgcccttgtagacggaacagagttcacattcgagggaagctgcatgttcccggacggctgcgatgcagtcgactgcaccttctgcagagagttcctcaaaaacccacaatgctaccccgcaaagaaatggctgttcataataatcgtcatactcctcggatacgcaggactaatgctactgaccaacgtactaaaagccatcggcgtgtgggggagctgggtaatcgccccagtcaaacttatgttcgccattctcaaaaagctaatgcgctcggtatcatgcctcatgggaaaactaatggaccgcggccgccaggtaattcacgaagaaataggagaaaaccgggaaggaaaccaagacgacgtccggatcgaaatggcgcgcccacgaagagtgcgccactggatgtacagcccagtaattctcacaatcctcgcaatcggcctagccgaagggtgtgacgaggtcgtacacgcggactcaaagctagtctcgtgcaaacaaggcagcggtaacatgaaggagtgcgtcactacaggccgagcactactcccagctgtcaacccgggacaagaggcttgcctacacttcaccgccccaggctcaccagactccaaatgtctaaaaataaaagtcaagcgcattaatttaaaatgtaagaaaagctcatcctacttcgtcccagacgccaggtctagatgcacatccgtaagaaggtgcagatgggctggcgactgccagtcaggatgcccctcccacttcacaagcaactccttcagcgacgactgggccgggaaaatggaccgggcaggcctagggttctcaggctgcagcgacggatgcggcggagccgcatgtggctgcttcaacgccgcacccagctgcatcttctggcgaaaatgggtcgaaaacccgcacggaataatatggaaagtatcgccatgtgcagcgtgggtaccgtcggcagtaattgaactcacgatgccatccggcgaagtaagaactttccaccccatgagcggcataccaacacaggtattcaaaggcgtaagcgtaacatacttaggctcggacatggaagtgtccgggctaaccgacctatgcgaaatagaggaactcaaatcgaagaaattagccctcgccccatgcaatcaagccggaatgggagtagtaggtaaagtcggggaaatacaatgtagttcggaagaatcagcccgtaccatcaagaaagacggttgcatctggaacgcagacttagtagggatcgaacttcgagtcgatgacgcagtatgctactcgaaaattaccagtgtcgaggccgtggccaactacagtgcgatacccaccacaattggcggattaagattcgaacggtcacacgacagtcaaggaaaaatatccgggtctcccctggacataaccgccattcgcgggagcttctcggtaaactacagagggctcagactaagcctcagtgagattaccgccacatgcaccggagaggtcacaaacgtctccgggtgctactcctgcatgatcggagcaaaagtaagcataaaactgcacagcagcaaaaactcgaccgcgcacgttcgatgcaaaggagacgaaaccgcattcagcgtcctagaaggagtacatagctacacggtctccctttcctttgaccacgcggtagtggacgaacaatgccaattaaactgcggagggcacgaaagccaagtcaccctaaaaggaaacctcattttccttgacgtgcccaagttcgtcgatggctcctacatgcaaacataccacagctcggtcccaaccggggccaatataccctccccgaccgactggctcaatgccctcttcggtaatgggctcagccgctggatcctcggagtaattggcgtgctccttggcggactagcgctattcagcctaataatgtcactattcaaactaggcacgaaacaagtcctgaggtctagaaccaaacttgcctag

SEQ ID NO: 16484 - RNA, 3222 nt, synthetic construct
  misc_feature 1..3222: note = derived and/or modified CDS sequence (opt11) from SFTSV(SPL117A)__AB985321.1__GP
  source 1..3222: mol_type = other RNA
atgatgaaagtaatatggttcagctccctcatatgcctcgtaatccaatgctccggggataccggccccattatctgtgccggacccatccactccaacaaaagcgcaaacatcccacatctactaggctacagcgagaaaatttgccagatcgacagactgatacacgtgagtagctggctacgaaaccactcacaatttcagggctacgtcggccaacgagggggacgctcccaggtatcatacttccccgcggaaaactcatacagcagatggagcgggctactcagcccatgcgacgcggactggctgggaatgctggtcgtaaagaaagcaaaaggcagcgacatgatcgtccccgggccatcataccgtggcaaagttttcttcgaacggccaacgttcgacggctacgtcggatggggctgcggaagcggaaaaagtaggacagaatctggagaactgtgttcctcagattccggaacctcaagcgggctcctccccagcgacagagtcctgtggataggagacgtggcatgccaacccatgacccccatacctgaagaaacgttcctagaactgaaatcattcagccaaagtgaatttcccgacatctgcaaaatcgacggaatcgtattcaaccagtgcgaaagcgagtcgctacctcaaccgttcgacgtggcatggatggacgttggccactctcacaaaataatcatgcgtgaacacaagaccaaatgggtacaggagagctccagtaaagactttgtctgctacaaggaaggtacgggcccatgcagcgaatccgaagagaaaacatgcaaaacctcaggctcctgccgcggcgacatgcagttctgcaaagtagcggggtgcgaacacggcgaagaagcctccgaagcaaaatgcagatgctcattagtacacaagcccggagaggtagtcgtatcatacggaggcatgagagtgcgacctaaatgctacggcttcagccggatgatggcaacactcgaagtaaacccacccgagcaaagaataggccagtgcacaggctgccaccttgaatgcatcaacgggggagtacgactcataacactaacaagtgaactaaagtcggccacagtctgtgcaagccacttttgctccagcgcgacctcgggaaagaaatcaacggaaatccaattccactcaggtagtctagtcggaaaaacagccatacacgtcaaaggtgccctcgtggatggcacagaatttacgttcgaagggtcctgtatgtttcccgacgggtgcgacgccgtagactgcaccttctgcagagaattcctaaaaaacccccaatgctaccccgcaaagaaatggctattcataataatagtcatcttactcggatacgcaggtctcatgctgttaacaaacgtgcttaaagcgatcggagtctgggggtcgtgggtaatcgcccccgtaaaactgatgttcgcaattataaagaaactgatgcgtagcgtctcctgcctcatgggaaagctaatggaccgcggacggcaagtaatccacgaagagataggagaaaaccgggaaggaaaccaagacgacgtccgtatcgaaatggctaggccccgcagagttcgccactggatgtactcccccgttatcctaacaatactggccatcgggctcgcagagggctgcgacgaaatggtacacgccgatagcaagctggtgtcctgcaaacagggcagcggcaacatgaaggaatgtgtcacgactgggcgagcactcctcccagcagtcaacccgggccaagaggcctgcctacacttcacagcgcccgggtcaccggatagcaaatgcctgaaaataaaagtcaaacggataaacctaaaatgcaagaaatcaagcagctacttcgtaccagacgctcgaagccgatgtaccagcgtacgaagatgcagatgggccggagactgccaatccggctgcccctcacacttcacatccaactcattcagcgacgactgggccggcaaaatggaccgcgcaggcctgggcttcagcgggtgctccgacggctgcggaggcgcggcatgcggctgcttcaacgccgcgcccagctgtattttctggcgcaagtgggtcgaaaacccacatggaataatctggaaagtcagcccgtgcgccgcttgggtacccagcgccgtaatcgaactaacgatgccatccggggaagtccgaaccttccatccaatgagcggcatacccacgcaggtgttcaaaggggtatcggtcacatacctcggcagcgacatggaggtctcaggcctcaccgacctttgcgaaatagaagaactcaaatcgaaaaaactagcactagctccctgcaaccaagccggtatgggcgtcgttggcaaggtgggagaaatccaatgcagcagcgaggaaagcgcccgaaccataaaaaaagatggctgcatttggaacgcagacctcgtcggcatcgaactccgcgtagacgacgcggtgtgctatagtaaaatcacaagcgtcgaagcagtcgctaactattcagccatacccacaaccatagggggactccgcttcgagcgaagccacgacagccaaggaaagatctcaggctcacctctcgacataaccgcaatacgcgggagcttcagcgtaaactaccgcggactccggctctcactctccgaaatcaccgcaacctgcacgggagaggtgaccaacgtctccggttgctactcgtgtatgactggcgccaaggtaagcatcaagctccactccagcaaaaacagcaccgcgcacgtaaggtgcaagggcgacgagactgcttttagtgtcctggaaggagtccactcctacacagtcagcctcagcttcgaccatgcagtggtggacgaacagtgccagctcaactgcggcggacacgagtctcaagtcaccctaaagggaaacttaatattcctcgatgtacccaagtttgtggacgggtcctatatgcagacctaccacagcagtgtgcccacaggcgccaacatcccaagccccaccgactggctcaacgccctgttcgggaacggactttcgcgctggatactaggcgttataggagtcctcctagggggtcttgcactattcttcctgataatgagcctgttcaaactaggaaccaaacaggtctttcgctcacgcacaaaactagcctaa

SEQ ID NO: 16485 - RNA, 3222 nt, synthetic construct
  misc_feature 1..3222: note = derived and/or modified CDS sequence (opt11) from SFTSV(SPL120A)__AB985322.1__GP
  source 1..3222: mol_type = other RNA
atgatgaaagtcatctggttctcttcgctaatatgcctagtgatccaatgctccggggacacaggccccatcatctgcgccggcccgatccactccaacaaaagcgccaacatcccccatctcctaggctacagcgaaaagatctgccaaatcgacagactcatccacgtaagctcatggctgcgcaatcactcccagttccaaggatacgtaggacaacgcggaggcagatcccaggtctcctacttccccgcagaaaacagttactccaggtggagcggactccttagcccatgcgacgcagactggctagggatgctcgtcgtcaaaaaggccaaaggatctgatatgatagtacccggaccatcatacaaagggaaggtcttctttgaacgcccgacgtttgacggctacgtcggatggggatgcggaagtggcaaaagccgcaccgaatcaggagagctctgttccagcgactccggcacaagctcaggcctgctccccagcgaccgagttttatggataggagacgtcgcatgccaaccaatgaccccaatacccgaggagaccttcctcgaactaaaaagtttcagccaaagtgagttcccagacatctgcaagatcgacggcatcgtattcaaccaatgcgaatctgagtccctgccccaacctttcgatgtcgcctggatggacgtcggccactcccacaaaatcatcatgcgggagcacaaaacgaaatgggtccaagagtcatccagcaaagactttgtgtgctacaaagagggcacaggtccctgcagcgagtcggaggagaaaacctgcaaaaccagcggaagttgccgaggagacatgcaattctgcaaagtggccgggtgcgaacacggcgaagaagcctccgaagcaaagtgtcgatgcagcctggtccacaaaccgggcgaagtagtagtctcatacggaggaatgagagtacgcccgaagtgctacggattttcacgcatgatggcaaccctagaagtgaacccgcccgagcaaagaattggccaatgcaccggatgccacctcgaatgcataaacggaggagtccgattaatcaccttgacgtcagaacttaaaagcgcaaccgtttgcgcgtcccatttctgcagcagcgcaaccagcggcaagaaaagcaccgagatccagtttcacagcggctccctcgtagggaaaacagccatacacgtaaaaggagccctagttgacggcaccgagttcacctttgaaggctcctgcatgtttcccgacgggtgcgacgcagtagactgcacattctgccgcgaatttcttaaaaacccccagtgctatcccgcaaagaaatggctattcataataatagtaattctactaggctacgcaggcctaatgctcctcaccaacgtcctcaaagctatcggcgtatggggcagctgggtaatagccccagtcaaactaatgttcgcaatcctaaagaaactcatgcgatcagtctcttgcctcatgggaaaactgatggaccgcggacgccaggtcatacacgaagaaatcggagaaaacagagaaggcaaccaagacgacgtgcgaatcgagatggcacgcccacgcagagtcagacactggatgtacagcccagtaatcctcaccattctggccatcggactcgcagaaggttgcgatgaagtagtacacgcagattccaaactggtctcatgcaaacagggatccggaaacatgaaagaatgcgttacaactggcagagccctgctcccagcggtcaacccaggacaagaagcgtgcctgcacttcaccgcccctgggtcaccggacagtaaatgtctaaaaatcaaagtaaaaagaatcaacctcaaatgcaagaaaagttcgtcctactttgtcccagatgcacggtcacgctgcacgagcgtccggcgctgcagatgggcaggcgattgccagtcaggatgcccatcccacttcacatctaactcattcagcgacgactgggccggcaaaatggaccgagcaggcctcgggttctcaggctgttccgatggatgcggaggcgcagcgtgcggatgcttcaacgcagctccctcctgcatattttggagaaaatgggtggaaaacccccacggcattatctggaaggtatccccatgtgccgcatgggtaccctcagccgtcatcgagttgacaatgccatcaggcgaagtccgaacattccaccccatgagcggaatccccacccaagtcttcaagggcgtatccgtaacctacctaggatccgacatggaagtgagcggtctcaccgacctgtgcgaaatcgaagaactaaaaagtaaaaagctcgccctcgccccatgcaaccaggcgggaatgggtgttgtaggcaaagtaggagaaatccaatgctccagtgaagagagcgcaagaaccataaagaaagatggctgcatctggaacgcggacctcgtgggcatagaactcagagtcgacgacgcggtctgctacagcaaaatcacatcagtcgaagcagtagcaaactactccgccatcccgacaaccatagggggcctaaggttcgaacgctcacacgactctcagggaaagatctcaggcagccctctcgacataaccgcaatacggggatccttcagcgtcaactaccgaggtctccggctgagcctctcagaaataacagcgacgtgcaccggcgaagtaaccaatgtctccggatgctactcgtgcatgacgggtgcaaaagtaagcataaaacttcattcctccaaaaactcaaccgcgcacgtacggtgcaaaggcgacgaaaccgcattctcagtactggaaggagtacacagctacacagtctcactgtccttcgaccacgccgtagtggatgaacaatgccaattgaattgtggaggccacgagagccaagtgacgctcaaaggcaatctcatcttcctggacgtcccaaaattcgtagacggctcttacatgcaaacgtaccactcgtcagttccgaccggcgctaacatccccagcccaaccgactggctcaacgccctattcggaaacggactctcgagatggatcctaggtgtcataggggtcctactgggtggcctcgcactcttctcactaataatgagtcttttcaaactcggaacaaaacaggtattccgaagtaggacaaagctcgcctga

SEQ ID NO: 16486 - RNA, 3222 nt, synthetic construct
  misc_feature 1..3222: note = derived and/or modified CDS sequence (opt11) from SFTSV(SPL121A)__AB985323.1__GP
  source 1..3222: mol_type = other RNA
atgatgaaagtgatatggttctcctccctcatctgcctcgttatccagtgctcaggcgacaccggcccaataatatgcgcaggcccaatccacagcaacaagagcgctaacatacctcacctactcggatatagcgagaaaatatgccaaatagaccgcctgatccacgtcagctcctggctacgcaaccactcgcaattccaaggctacgttggacaacgcggcggacggagccaagtatcctacttcccggcagagaactcatactccaggtggagcggtctgctgagcccatgcgacgccgactggttaggtatgctagtcgttaagaaagccaaaggatctgacatgatagttccaggaccctcatacaaaggtaaagtattctttgaaaggcctacattcgacggctacgtcggctggggatgcggctccggaaaaagcaggaccgaaagcggagaactctgcagctccgacagcggaacaagctcaggactcctgccaagcgaccgcgtactttggatcggcgacgtcgcttgtcaacccatgacccccatcccggaggaaaccttcctagagctaaaatccttctcccaatcagaatttcccgacatctgcaaaatagacggcattgtattcaaccagtgcgaaagcgaatcactaccgcagcccttcgatgtagcctggatggacgtaggccactcccacaagataatcatgagggaacacaaaacgaagtgggtccaggaatccagcccaaaagacttcgtatgctacaaggagggaacaggtccctgtagcgagagcgaagaaaagacctgcaaaacatcaggctcctgcaggggcgacatgcaattctgtaaagtcgccgggtgcgaacacggggaagaggcaagcgaagcgaaatgccgatgcagcctcgtccacaaaccaggcgaagtagtagtaagttacggcggcatgcgcgtgcggccaaagtgctacggattctccaggatgatggcaacccttgaggtcaacagccccgaacagcgtataggacaatgcaccgggtgtcacttagaatgcataaacgggggcgtacgtcttataacactaacaagcgaactaaaatcagccaccgtatgcgccagtcacttctgctccagcgcaaccagcgggaaaaagagtacagaaatacaattccattccggctcactcgtaggcaaaacagccatccacgtcaaaggagcgctagtagacggaacagagttcacattcgaaggcagctgcatgttccccgacggctgcgacgcagtagactgcacattctgtcgcgagttcctcaaaaacccacaatgctacccagccaagaaatggctattcatcatcatcgtaatcctactaggatacgccggcctgatgctactcactaatgtactcaaagcaataggcgtctggggatcttgggtaatcgcacccgtaaaactcatgttcgctatcataaagaagctcatgagaagcgtaagctgcctgatgggcaaattaatggaccgcggccgccaggtcatacacgaagaaatcggcgaaaacagggaaggcaaccaagatgatgtacggatcgaaatggcccgcccacgacgagtccgacactggatgtatagcccggtaatcctcacaatcctagcaatcggcctagccgaaggatgcgacgaaatggtacacgccgactcaaaactggtctcatgcaagcaaggatcaggaaacatgaaagaatgtgtaactacgggaagggccttactaccggcagtaaatccgggacaggaagcatgcctacacttcactgcaccgggcagcccagactcaaaatgtctcaaggtcaaagttaaacgaatcaacctaaaatgcaagaaatcatcatcatacttcgtacctgacgcacggtcgcgctgcacaagcgtccgtcgctgcagatgggccggcgactgccagagtggctgcccaagccatttcaccagcaactccttcagtgacgactgggcagggaaaatggaccgagcaggactgggcttctctggctgtagcgacggctgtgggggcgccgcatgcgggtgcttcaacgcggcacccagctgcattttctggcgcaaatgggtggaaaacccacatggaatcatatggaaagtatccccatgcgccgcctgggtaccatcggccgtaatagagctgacaatgccctcaggagaagtccggacgttccacccaatgagcggcatccccacccaggttttcaaaggcgtaagcgtgacctacctcggatccgacatggaagtatctggattgaccgacctgtgtgaaatggaagaacttaaaagcaagaaactagcactcgctccctgtaaccaagccggcatgggagtcgtcggaaaagtaggagagatacaatgcagctcagaagaaagtgcacgcacaatcaagaaagacggctgcatctggaacgccgacctggtcggcatagaactacgagtagacgacgccgtgtgctattctaaaataaccagcgttgaagccgtcgccaactacagtgccatccccacaacaatcggcggactacgcttcgaacgcagccacgacagccaaggcaaaatctcaggctcaccgctcgacatcacagcaatccggggatcattctctgtcaactacagaggactacggcttagcctcagtgaaataaccgccacatgcacgggcgaggtcaccaatgtgtccggctgctattcctgtatgacgggggctagggtcagcatcaaactacacagtagtaaaaactccacagcacacgtccgatgcaaaggcgacgaaacggccttctcagtcctggaaggcgtccactcctatacagtgagcctgagcttcgaccacgcagtagtcgacgaacaatgccaactgaactgcggcggacacgaatcacaggtcactctaaaaggtaatttgatctttcttgacgtccccaaatttgtcgacggcagctacatgcaaacctaccactccagcgtcccaaccggagccaacataccgagccccaccgactggctcaacgcactcttcggcaacggtctgtcgcggtggatcctcggcgttataggagtactcttagggggactcgcactatttttcctaataatgtcactcttcaagctaggaacaaagcaagtcttcaggtcgcgtaccaaactcgcctaa

SEQ ID NO: 16487 - RNA, 3222 nt, synthetic construct
  misc_feature 1..3222: note = derived and/or modified CDS sequence (opt11) from SFTSV(SPL124A)__AB985324.1__GP
  source 1..3222: mol_type = other RNA
atgatgaaggtcatatggttcagttcgcttatatgtttagtgatccaatgctccggcgacaccgggcccataatatgcgcgggcccaatacacagcaacaagagcgccaatatcccgcatctgctaggatactcagagaaaatctgccaaatagaccgtctcatacacgtaagctcgtggctacgcaaccactcgcaatttcaagggtatgtgggccagagagggggaaggagccaagtatcctatttccccgcagaaaattcatactcacggtggtcaggactgctgagcccctgcgacgcagactggctaggaatgttagtcgtaaagaaagccaaaggatcggacatgatcgtgcccggaccctcatacaagggcaaagtcttcttcgaaaggcccacatttgacgggtacgtaggatggggctgtggctcgggaaaaagcagaacagaatccggagaactatgctccagcgatagcggaacatcgagcggcctattgcccagcgacagagtgctctggattggggacgtagcctgccagcctatgactcccatacctgaagagaccttcctggagctcaagagcttcagccagtcagagttccccgatatctgcaaaatcgacggaatcgtattcaaccaatgcgaatcagaaagcctaccccagccgttcgacgtagcatggatggacgtggggcactcacacaagatcattatgagagagcacaaaacaaaatgggtccaagagtcgagctccaaggacttcgtctgctacaaagagggaactggaccatgctccgaatcggaagagaaaacttgcaaaacgagcggatcgtgccggggcgatatgcagttctgcaaagtagccggatgcgagcacggcgaagaagcgagcgaagctaaatgccgctgcagcctggtccataaaccaggcgaagtcgtggtatcatacggcggaatgcgagtgcgaccgaaatgctacggcttctcacgcatgatggcgacgctcgaagtgaactcccccgagcaacgcatcggacaatgcacgggatgccacttagagtgcataaacggaggggtccggcttatcacgctcaccagcgaactcaaatccgcaaccgtatgcgcgagccacttctgcagctcagccacatcagggaaaaagagcaccgaaatacaattccacagcggctccctcgtgggaaaaacggccatacatgtaaaaggcgccctcgtggacggcacagagttcacgttcgaaggctcatgcatgttccccgatggatgcgacgccgtggattgcaccttctgcagagagtttctgaaaaatccacaatgctacccggcaaagaaatggctattcataataatcgtaatactactagggtatgcgggcctaatgctccttacgaacgtgctcaaagccataggagtgtgggggagctgggtcatagctccagtaaaactaatgttcgccattatcaaaaagctcatgagatcagtcagctgtctaatgggaaagctgatggaccgcggcagacaagtcattcacgaggaaattggcgaaaacagagaagggaaccaggacgacgtcaggatcgagatggcgcgccccagaagggtaagacactggatgtacagcccagtcatactgactatcttggccataggtctagcagagggatgtgacgaaatggtgcacgcggactccaagctagtatcttgtaaacaagggagcggaaacatgaaagaatgcgtaaccacaggtagggcactgctacccgcagtgaacccgggacaggaggcatgcctacacttcacggcgccaggcagcccagactcaaaatgccttaaaattagagtcaaaagaatcaacctaaagtgcaagaaatcatcatcctacttcgtgcccgatgccagaagccgctgcacatccgtgagaagatgtaggtgggcgggggactgccagagcggctgcccaagccacttcacaagcaactccttcagcgacgactgggcaggaaaaatggacagagccgggctgggattctcaggctgcagtgatggctgcggtggggcagcatgcgggtgctttaacgcagcaccgagctgcatcttctggagaaaatgggtcgaaaacccgcacgggatcatatggaaagtctcgccatgcgcagcctgggtacccagtgcagtaatagaactcacaatgccatcaggagaagtccgaactttccaccccatgagcggaataccaacccaggtattcaaaggagtatcagtaacatacctcggctccgacatggaagtgtcgggtcttacagacctatgcgaaatagaggaactgaaatcaaagaaattggcactagcaccctgcaaccaggcgggaatgggagtcgtgggcaaagtcggggaaatacaatgcagcagcgaagagagcgcgcgcacaataaagaaagatgggtgcatatggaacgcagatctggtcgggatcgagctccgagtcgacgacgcagtatgctattcgaagataacctcagtagaagccgtagccaattactccgccatacccactacgatcggtggactccgcttcgaacgctcgcatgacagccaaggaaaaatatccggcagtcccctcgacataaccgctataaggggcagcttcagcgtaaattacagaggcctccgcctgtcattgagcgaaataacagccacgtgcactggagaagtcaccaacgtgtccggatgctactcgtgcatgacgggggctcgtgtaagcataaaactgcactccagcaaaaactcaaccgcgcacgtgagatgcaaaggagacgagaccgccttcagcgtacttgaaggggtgcacagctacaccgtaagcctgagcttcgatcacgccgtggtagacgaacagtgtcagctaaactgtggcggacatgaatctcaagtgaccttgaagggcaacttaatattcctagacgttccaaaattcgtcgatggctcatacatgcaaacataccatagtagcgtaccaacaggcgcaaatatcccctccccaaccgactggctaaatgccctattcggaaacggcctgtcaaggtggatcttaggagtgataggagtactattaggcggactcgccctcttcttcctgataataagtctattcaaactaggaaccaaacaagtattccgaagccggaccaaactagcgtga

SEQ ID NO: 16488 - RNA, 3222 nt, synthetic construct
  misc_feature 1..3222: note = derived and/or modified CDS sequence (opt11) from SFTSV(SPL128A)__AB985325.1__GP
  source 1..3222: mol_type = other RNA
atgatgaaggtaatatggttctcctccctaatatgtctagtaatccaatgcagcggcgacacaggtcccatcatatgcgccggcccaatccactccaacaagtcggccaacataccccacctactcggatacagtgagaaaatatgccaaatagataggctaatccacgtcagctcgtggctgcgaaaccactcgcaattccaaggttacgtcgggcagaggggcggcagatcgcaagtcagttacttccccgcagaaaacagctactcgagatggtccgggctattatcaccatgcgacgcggactggcttgggatgctcgtcgtaaagaaagctaaaggctccgacatgattgtcccaggaccctcatacaaaggaaaagtgtttttcgaacgtccaactttcgatggatacgtgggctggggatgtggctccgggaaaagccgcacagaatcaggagaactttgctccagcgacagcggcacatcctcgggactcttaccttcagaccgggtgctatggatcggcgacgtagcctgccaaccaatgacccccatccccgaagaaaccttcctcgaactgaaatcattcagtcaaagcgagttcccggacatatgcaagatcgacgggattgtattcaaccaatgcgaatccgaatccctaccacaacccttcgacgtagcctggatggacgtcggccactcgcacaaaatcataatgcgtgaacacaaaaccaaatgggtccaagaatccagctcgaaggacttcgtctgctacaaagaaggcacagggccatgcagcgaatcagaagagaaaacatgcaaaacatcaggctcatgtcggggagatatgcaattctgcaaagttgcaggatgcgaacatggtgaagaagcatccgaagccaagtgccgctgttcccttgtccacaaaccaggagaagtggttgtatcatacggcgggatgcgcgtccgacccaaatgctacgggttcagccgaatgatggcaacgctcgaggtgaactcccccgagcaacgcatcggccaatgcaccggctgccacctcgagtgcataaacggcggagtccgactcatcaccctgacaagcgaactcaaaagtgcaacagtgtgcgctagccacttctgcagctccgccacctccggaaagaaaagcacagaaattcaattccactcgggcagcctcgtcgggaaaaccgcaatacacgtcaaaggcgcactcgtcgacggaacagagttcacattcgaaggatcatgcatgtttccggacgggtgcgatgcagtcgactgcaccttctgcagggagttcctcaaaaacccccaatgctaccccgcaaagaaatggctattcatcataatcgtcatactgctcgggtacgccgggcttatgctcctaacaaacgtcctcaaagcaatcggcgtctggggcagctgggtaattgcccccgtgaaactaatgttcgcaataatcaagaaactcatgcgatcagtcagctgtctcatgggcaaactcatggaccgtggacgacaagtgatacacgaagagataggagagaacagggaagggaaccaagacgacgttagaatagaaatggcacgcccgcgaagggtcagacattggatgtactcccccgtcattctaacgatcctagcaataggactagcggagggatgcgacgaaatggtacatgcagactcgaaattagtctcatgcaaacaggggagcggaaacatgaaagagtgcgtaacgaccggcagagccctactccctgccgtcaaccccggccaggaagcctgcttgcacttcaccgcacccggaagtccagactcaaaatgcctcaaaatccgagttaaacgcataaacctaaaatgcaagaaatcctcaagctactttgtaccagatgccaggagccgctgcacctccgttcgacgttgccgctgggccggcgactgccagtccggctgccccagccacttcacaagcaacagcttcagcgacgactgggccgggaaaatggacagagcaggcctcggattcagcggctgctcagacggctgcggaggggcagcctgcggatgcttcaacgcagctccaagctgcatcttctggagaaaatgggtagaaaacccacacggaataatctggaaagtcagcccctgcgcagcgtgggtgcccagcgccgtaatagaactcacgatgccttccggggaagtacgaaccttccacccaatgtccggcatccccacgcaagtattcaaaggagtctcagttacatacctcggcagcgacatggaagtaagcgggctaacggatctatgcgaaatagaagaactaaaatcaaagaaactcgccctagctccatgcaaccaggccgggatgggagtcgtaggcaaagtaggagaaatccaatgcagcagcgaggaaagcgcacgaacaattaagaaagacggctgcatctggaatgcggacctggtggggatagaactgcgagtcgacgacgcagtctgctacagcaaaataacaagcgtcgaggccgtagccaattactcggcaatccccaccaccataggcggcttacggttcgaaagatcacacgactcgcagggcaaaatctcaggttcacccttagatatcacagccatccgcggctcattcagtgtcaactaccgaggcctgagactaagcctaagcgaaataacagctacctgcacaggagaagtcaccaacgtatccgggtgctattcctgtatgactggcgcccgcgtatccattaaactccactccagcaaaaactcgacggcacacgtccgatgcaaaggagatgaaaccgccttctcggtcctcgaaggggtccactcctacaccgtctcactatccttcgaccacgcggtcgtcgacgaacagtgccaactcaattgcggaggccacgagtcgcaagtcacccttaaaggaaacttaatcttcctggacgtacctaaatttgtagatggatcctacatgcagacttaccactcttccgtaccaaccggcgccaacatacccagtcccaccgactggctgaacgcactcttcggcaacgggctctcaaggtggatactcggagcaataggcgtgttattaggcggactagccctcttctttctgatcatcagcctattcaaattaggaactaaacaagtattccggagtcgcacaaaactcgcatga

SEQ ID NO: 16489 - RNA, 3222 nt, synthetic construct
  misc_feature 1..3222: note = derived and/or modified CDS sequence (opt11) from SFTSV(SPL129A)__AB985326.1__GP
  source 1..3222: mol_type = other RNA
atgatgaaagtgatctggtttagcagcctgatatgcctcgtaatacaatgctccggcgacaccgggcccataatatgcgcaggacccattcacagcaacaaatccgcaaacatcccacatctcctgggatactcagagaaaatctgccaaattgaccgactaatccacgtatcgagctggctaagaaatcactcacaattccaaggatacgtcggccagcgcgggggaaggagccaggtcagctactacccagcagaaaacagctacagcagatggagtggactcctgagcccatgtgacgcggactggctaggaatgcttgtggtcaagaaggcaaaaggcagtgacatgattgtcccaggccccagctacaaaggcaaagtattcttcgaacgccccactttcgacggatacgtagggtggggctgcggcagcggcaaatcacgaaccgaaagcggagaactgtgctcaagtgactcaggcacatcctcgggcctactgccaagcgaccgagtcctatggatcggggacgtcgcatgccagcccatgacaccaatcccagaagaaacgttcctagaactaaaatcattcagccaatcagagttcccagacatatgcaagatcgacggaatagtcttcaaccaatgcgaaagtgaatccttgccccagcccttcgacgtcgcctggatggacgtcgggcacagccacaaaatcataatgcgagaacacaaaacaaagtgggtccaagaatcaagctccaaagactttgtctgctacaaagaaggcacaggaccatgcagcgagagcgaggaaaagacctgtaaaacctcaggctcatgcagaggcgacatgcagttctgtaaagtcgcaggctgcgaacacggagaggaagccagcgaagccaaatgccgctgcagcctagtacacaaaccaggcgaagtcgtggtatcatacggagggatgcgcgtccgaccaaaatgctacggattctcgcgcatgatggctacgctagaagtaaacccgcccgaacaacgcatcggacaatgcaccggctgtcatctcgaatgcattagcgggggcgtacgcctcataaccctcaccagcgagctaaaatccgccaccgtctgtgcctcacacttctgcagttcagccacatccggaaagaaatccaccgagatacagtttcactcagggagcctcgtcggtaaagcagcgatccacgtcaaaggggcactcgtagacgggacagagttcacattcgaaggaagctgcatgttccctgacgggtgcgacgccgtggactgcacgttttgccgggagttccttaaaaacccgcaatgctaccccgccaagaaatggctattcatcataatcgtaatcctcctaggatacgccggtctcatgcttctgaccaacgtcctcaaagcaatcggcgtatggggcagttgggtaattgccccagtcaaactgatgttcgccataatgaagaaactcatgcgaagcgtaagctgcctcatgggaaaactaatggatcgcggacgccaagtcatacacgaagaaataggcgaaaacagggaaggcaacagagacgacgtacgcatagaaatggcgcgcccccgaagagtacgccactggatgtacagccctgtcatactaacaatcctcgcaataggccttgccgaaggctgtgacgaaatggtccatgccgatagcaagctagtcagctgccgacagggctcaggaaacatgaaagagtgcgtcaccaccggacgcgcactactacccgccgtaaaccccggccaagaagcatgcttgcacttcacagcccccggatcaccagacagtaaatgtctaaaaatcaaagttaaaaggataaatctaaaatgcaagaaaagctcgtcatacttcgtcccagacgcacgatcacgatgcaccagcgtgagacgatgccgctgggccggagactgccagtccggctgtccttcacattttacgtccaacagcttctcagacgactgggcagggaaaatggacagagccggactcggattctcaggctgctcagacggctgcggaggcgcagcatgcgggtgctttaacgccgcacccagctgcatattctggcgcaaatgggtagaaaacccacacggtatcatatggaaagtatcaccctgcgcggcatgggtgccaagcgctgttatcgaactgacgatgccatcaggcgaggtccgcacctttcatcccatgagcggcatccccacgcaagtattcaaaggtgtgagcgtgacatacctcggatcagacatggaggtcagcggcctaacagacctctgcgaaatcgaagaactgaaaagcaagaaactagccctcgcgccgtgcaaccaagccggaatgggggtcgtcggcaaagtgggcgagatacaatgtagcagcgaagaaagcgcccgaacaattaagaaagatggctgcatttggaacgcagacctcgtgggcatagaactaagggtcgacgacgcggtctgctacagcaaaataacatcggtggaaaccgtggccaattacagtgccatacccaccacaataggcggactgcgcttcgaaagatcccacgatagccaaggaaaaataagcgggtcaccactagacatcaccgccatcagaggcagcttcagtgtaaactacagaggcctaaggctatccttatccgagataaccgcaacgtgcacaggagaagtcacgaacgtaagcggatgctactcatgcatgacaggggcaaaagtatcgatcaaactgcacagctccaaaaactcaacagcacacgtccgctgcaaagaggacgagaccgccttcagcgtactagaaggcgtacacagctacactgtctcgctcagctttgaccacgcagtggtagacgaacaatgccaactaaactgcggcggccacgaatcacacgtaacactgaaaggaaacctgatctttctagacgtgccaaaattcgtagacgggtcgtatatgcaaacataccactcctccgtgccgacaggagcaaacataccgtcccctacagactggctcaatgcgctatttggcaacggcctttcccgatggatactgggagtcatgggggtgctcttgggaggcctagcactgttctttctgataatgagcctattcaaactagggacaaaacaggtcttcaggagccgaaccaaactcgcctag
